United States Patent 7,709,616 (MICRORNAS AND USES THEREOF) - sequence listing, part 2

SEQ ID NO: 27754 - RNA, 64 nt, hsa
uacuccaucucaaaaaaaaaaaaaaaaaaaaaaaaaaaaaaaaaaaaaaaaaccuuuggugccu

SEQ ID NO: 27755 - RNA, 64 nt, hsa
auacuccaucucaaaaaaaaaaaaaaaaaaaaaaaaaaaaaaaaaaaaaaaaaccuuuggugcc

SEQ ID NO: 27756 - RNA, 64 nt, hsa
gauacuccaucucaaaaaaaaaaaaaaaaaaaaaaaaaaaaaaaaaaaaaaaaaccuuuggugc

SEQ ID NO: 27757 - RNA, 64 nt, hsa
ugauacuccaucucaaaaaaaaaaaaaaaaaaaaaaaaaaaaaaaaaaaaaaaaaccuuuggug

SEQ ID NO: 27758 - RNA, 64 nt, hsa
gugauacuccaucucaaaaaaaaaaaaaaaaaaaaaaaaaaaaaaaaaaaaaaaaaccuuuggu

SEQ ID NO: 27759 - RNA, 64 nt, hsa
agugauacuccaucucaaaaaaaaaaaaaaaaaaaaaaaaaaaaaaaaaaaaaaaaaccuuugg

SEQ ID NO: 27760 - RNA, 64 nt, hsa
gagugauacuccaucucaaaaaaaaaaaaaaaaaaaaaaaaaaaaaaaaaaaaaaaaaccuuug

SEQ ID NO: 27761 - RNA, 64 nt, hsa
agagugauacuccaucucaaaaaaaaaaaaaaaaaaaaaaaaaaaaaaaaaaaaaaaaaccuuu

SEQ ID NO: 27762 - RNA, 64 nt, hsa
cagagugauacuccaucucaaaaaaaaaaaaaaaaaaaaaaaaaaaaaaaaaaaaaaaaaccuu

SEQ ID NO: 27763 - RNA, 64 nt, hsa
acagagugauacuccaucucaaaaaaaaaaaaaaaaaaaaaaaaaaaaaaaaaaaaaaaaaccu

SEQ ID NO: 27764 - RNA, 64 nt, hsa
gacagagugauacuccaucucaaaaaaaaaaaaaaaaaaaaaaaaaaaaaaaaaaaaaaaaacc

SEQ ID NO: 27765 - RNA, 64 nt, hsa
ugacagagugauacuccaucucaaaaaaaaaaaaaaaaaaaaaaaaaaaaaaaaaaaaaaaaac

SEQ ID NO: 27766 - RNA, 64 nt, hsa
gugacagagugauacuccaucucaaaaaaaaaaaaaaaaaaaaaaaaaaaaaaaaaaaaaaaaa

SEQ ID NO: 27767 - RNA, 64 nt, hsa
ggugacagagugauacuccaucucaaaaaaaaaaaaaaaaaaaaaaaaaaaaaaaaaaaaaaaa

SEQ ID NO: 27768 - RNA, 64 nt, hsa
gggugacagagugauacuccaucucaaaaaaaaaaaaaaaaaaaaaaaaaaaaaaaaaaaaaaa

SEQ ID NO: 27769 - RNA, 64 nt, hsa
ugggugacagagugauacuccaucucaaaaaaaaaaaaaaaaaaaaaaaaaaaaaaaaaaaaaa

SEQ ID NO: 27770 - RNA, 64 nt, hsa
cugggugacagagugauacuccaucucaaaaaaaaaaaaaaaaaaaaaaaaaaaaaaaaaaaaa

SEQ ID NO: 27771 - RNA, 64 nt, hsa
ccugggugacagagugauacuccaucucaaaaaaaaaaaaaaaaaaaaaaaaaaaaaaaaaaaa

SEQ ID NO: 27772 - RNA, 64 nt, hsa
gccugggugacagagugauacuccaucucaaaaaaaaaaaaaaaaaaaaaaaaaaaaaaaaaaa

SEQ ID NO: 27773 - RNA, 64 nt, hsa
agccugggugacagagugauacuccaucucaaaaaaaaaaaaaaaaaaaaaaaaaaaaaaaaaa

SEQ ID NO: 27774 - RNA, 64 nt, hsa
cagccugggugacagagugauacuccaucucaaaaaaaaaaaaaaaaaaaaaaaaaaaaaaaaa

SEQ ID NO: 27775 - RNA, 64 nt, hsa
ccagccugggugacagagugauacuccaucucaaaaaaaaaaaaaaaaaaaaaaaaaaaaaaaa

SEQ ID NO: 27776 - RNA, 64 nt, hsa
uccagccugggugacagagugauacuccaucucaaaaaaaaaaaaaaaaaaaaaaaaaaaaaaa

SEQ ID NO: 27777 - RNA, 64 nt, hsa
cuccagccugggugacagagugauacuccaucucaaaaaaaaaaaaaaaaaaaaaaaaaaaaaa

SEQ ID NO: 27778 - RNA, 64 nt, hsa
ggcuaucuuaaacaaguucauacauuugaaaagaaaaaaaaauguuguuuaaaaaauguuuucu

SEQ ID NO: 27779 - RNA, 64 nt, hsa
uggcuaucuuaaacaaguucauacauuugaaaagaaaaaaaaauguuguuuaaaaaauguuuuc

SEQ ID NO: 27780 - RNA, 64 nt, hsa
uuauauuaacgauacuaaaaaaaaauagcuuuggaaaaaaaacuacuguauguaacggaauugc

SEQ ID NO: 27781 - RNA, 64 nt, hsa
cuuuuugugcaacugcuuuauauuaacgauacuaaaaaaaaauagcuuuggaaaaaaaacuacu

SEQ ID NO: 27782 - RNA, 64 nt, hsa
gcuuuuugugcaacugcuuuauauuaacgauacuaaaaaaaaauagcuuuggaaaaaaaacuac

SEQ ID NO: 27783 - RNA, 64 nt, hsa
gcagguaucacagccuugcagaagaaccaacugaaaaaaaaauucucaggcuuuacagcaagca

SEQ ID NO: 27784 - RNA, 64 nt, hsa
ugcagguaucacagccuugcagaagaaccaacugaaaaaaaaauucucaggcuuuacagcaagc

SEQ ID NO: 27785 - RNA, 64 nt, hsa
ugcaugcuuagucuaaagacuguagcaaaaaaaaaaaaaaaagaaaaauuagauuuuacauauc

SEQ ID NO: 27786 - RNA, 64 nt, hsa
uugcaugcuuagucuaaagacuguagcaaaaaaaaaaaaaaaagaaaaauuagauuuuacauau

SEQ ID NO: 27787 - RNA, 64 nt, hsa
cuugcaugcuuagucuaaagacuguagcaaaaaaaaaaaaaaaagaaaaauuagauuuuacaua

SEQ ID NO: 27788 - RNA, 64 nt, hsa
ucuugcaugcuuagucuaaagacuguagcaaaaaaaaaaaaaaaagaaaaauuagauuuuacau

SEQ ID NO: 27789 - RNA, 64 nt, hsa
gucuugcaugcuuagucuaaagacuguagcaaaaaaaaaaaaaaaagaaaaauuagauuuuaca

SEQ ID NO: 27790 - RNA, 64 nt, hsa
ugucuugcaugcuuagucuaaagacuguagcaaaaaaaaaaaaaaaagaaaaauuagauuuuac

SEQ ID NO: 27791 - RNA, 64 nt, hsa
augucuugcaugcuuagucuaaagacuguagcaaaaaaaaaaaaaaaagaaaaauuagauuuua

SEQ ID NO: 27792 - RNA, 64 nt, hsa
uaugucuugcaugcuuagucuaaagacuguagcaaaaaaaaaaaaaaaagaaaaauuagauuuu

SEQ ID NO: 27793 - RNA, 64 nt, hsa
guaugucuugcaugcuuagucuaaagacuguagcaaaaaaaaaaaaaaaagaaaaauuagauuu

SEQ ID NO: 27794 - RNA, 64 nt, hsa
caguucaaaccuuuagggaaugauuaaaauuuaaaaaaaaaacauuucacucaguugcacuuag

SEQ ID NO: 27795 - RNA, 64 nt, hsa
ucaguucaaaccuuuagggaaugauuaaaauuuaaaaaaaaaacauuucacucaguugcacuua

SEQ ID NO: 27796 - RNA, 64 nt, hsa
cucaguucaaaccuuuagggaaugauuaaaauuuaaaaaaaaaacauuucacucaguugcacuu

SEQ ID NO: 27797 - RNA, 64 nt, hsa
uaaaaaaaaaaaaaaaaaaaaaaaaaaaaaaaaaaaaaaaaacuuuuccaggcagcuucaugau

SEQ ID NO: 27798 - RNA, 64 nt, hsa
uuaaaaaaaaaaaaaaaaaaaaaaaaaaaaaaaaaaaaaaaaacuuuuccaggcagcuucauga

SEQ ID NO: 27799 - RNA, 64 nt, hsa
uuuaaaaaaaaaaaaaaaaaaaaaaaaaaaaaaaaaaaaaaaaacuuuuccaggcagcuucaug

SEQ ID NO: 27800 - RNA, 64 nt, hsa
cuuuaaaaaaaaaaaaaaaaaaaaaaaaaaaaaaaaaaaaaaaaacuuuuccaggcagcuucau

SEQ ID NO: 27801 - RNA, 64 nt, hsa
acuuuaaaaaaaaaaaaaaaaaaaaaaaaaaaaaaaaaaaaaaaaacuuuuccaggcagcuuca

SEQ ID NO: 27802 - RNA, 64 nt, hsa
gacuuuaaaaaaaaaaaaaaaaaaaaaaaaaaaaaaaaaaaaaaaaacuuuuccaggcagcuuc

SEQ ID NO: 27803 - RNA, 64 nt, hsa
agacuuuaaaaaaaaaaaaaaaaaaaaaaaaaaaaaaaaaaaaaaaaacuuuuccaggcagcuu

SEQ ID NO: 27804 - RNA, 64 nt, hsa
aagacuuuaaaaaaaaaaaaaaaaaaaaaaaaaaaaaaaaaaaaaaaaacuuuuccaggcagcu

SEQ ID NO: 27805 - RNA, 64 nt, hsa
caagacuuuaaaaaaaaaaaaaaaaaaaaaaaaaaaaaaaaaaaaaaaaacuuuuccaggcagc

SEQ ID NO: 27806 - RNA, 64 nt, hsa
gcaagacuuuaaaaaaaaaaaaaaaaaaaaaaaaaaaaaaaaaaaaaaaaacuuuuccaggcag

SEQ ID NO: 27807 - RNA, 64 nt, hsa
cgcaagacuuuaaaaaaaaaaaaaaaaaaaaaaaaaaaaaaaaaaaaaaaaacuuuuccaggca

SEQ ID NO: 27808 - RNA, 64 nt, hsa
acgcaagacuuuaaaaaaaaaaaaaaaaaaaaaaaaaaaaaaaaaaaaaaaaacuuuuccaggc

SEQ ID NO: 27809 - RNA, 64 nt, hsa
cacgcaagacuuuaaaaaaaaaaaaaaaaaaaaaaaaaaaaaaaaaaaaaaaaacuuuuccagg

SEQ ID NO: 27810 - RNA, 64 nt, hsa
ucacgcaagacuuuaaaaaaaaaaaaaaaaaaaaaaaaaaaaaaaaaaaaaaaaacuuuuccag

SEQ ID NO: 27811 - RNA, 64 nt, hsa
gucacgcaagacuuuaaaaaaaaaaaaaaaaaaaaaaaaaaaaaaaaaaaaaaaaacuuuucca

SEQ ID NO: 27812 - RNA, 64 nt, hsa
ggucacgcaagacuuuaaaaaaaaaaaaaaaaaaaaaaaaaaaaaaaaaaaaaaaaacuuuucc

SEQ ID NO: 27813 - RNA, 64 nt, hsa
uggucacgcaagacuuuaaaaaaaaaaaaaaaaaaaaaaaaaaaaaaaaaaaaaaaaacuuuuc

SEQ ID NO: 27814 - RNA, 64 nt, hsa
guggucacgcaagacuuuaaaaaaaaaaaaaaaaaaaaaaaaaaaaaaaaaaaaaaaaacuuuu

SEQ ID NO: 27815 - RNA, 64 nt, hsa
uguggucacgcaagacuuuaaaaaaaaaaaaaaaaaaaaaaaaaaaaaaaaaaaaaaaaacuuu

SEQ ID NO: 27816 - RNA, 64 nt, hsa
cuguggucacgcaagacuuuaaaaaaaaaaaaaaaaaaaaaaaaaaaaaaaaaaaaaaaaacuu

SEQ ID NO: 27817 - RNA, 64 nt, hsa
ucuguggucacgcaagacuuuaaaaaaaaaaaaaaaaaaaaaaaaaaaaaaaaaaaaaaaaacu

SEQ ID NO: 27818 - RNA, 64 nt, hsa
gucuguggucacgcaagacuuuaaaaaaaaaaaaaaaaaaaaaaaaaaaaaaaaaaaaaaaaac

SEQ ID NO: 27819 - RNA, 64 nt, hsa
agucuguggucacgcaagacuuuaaaaaaaaaaaaaaaaaaaaaaaaaaaaaaaaaaaaaaaaa

SEQ ID NO: 27820 - RNA, 64 nt, hsa
cagucuguggucacgcaagacuuuaaaaaaaaaaaaaaaaaaaaaaaaaaaaaaaaaaaaaaaa

SEQ ID NO: 27821 - RNA, 64 nt, hsa
gcagucuguggucacgcaagacuuuaaaaaaaaaaaaaaaaaaaaaaaaaaaaaaaaaaaaaaa

SEQ ID NO: 27822 - RNA, 64 nt, hsa
ggcagucuguggucacgcaagacuuuaaaaaaaaaaaaaaaaaaaaaaaaaaaaaaaaaaaaaa

SEQ ID NO: 27823 - RNA, 64 nt, hsa
gggcagucuguggucacgcaagacuuuaaaaaaaaaaaaaaaaaaaaaaaaaaaaaaaaaaaaa

SEQ ID NO: 27824 - RNA, 64 nt, hsa
agggcagucuguggucacgcaagacuuuaaaaaaaaaaaaaaaaaaaaaaaaaaaaaaaaaaaa

SEQ ID NO: 27825 - RNA, 64 nt, hsa
aagggcagucuguggucacgcaagacuuuaaaaaaaaaaaaaaaaaaaaaaaaaaaaaaaaaaa

SEQ ID NO: 27826 - RNA, 64 nt, hsa
aaagggcagucuguggucacgcaagacuuuaaaaaaaaaaaaaaaaaaaaaaaaaaaaaaaaaa

SEQ ID NO: 27827 - RNA, 64 nt, hsa
uaaagggcagucuguggucacgcaagacuuuaaaaaaaaaaaaaaaaaaaaaaaaaaaaaaaaa

SEQ ID NO: 27828 - RNA, 64 nt, hsa
auaaagggcagucuguggucacgcaagacuuuaaaaaaaaaaaaaaaaaaaaaaaaaaaaaaaa

SEQ ID NO: 27829 - RNA, 64 nt, hsa
uauaaagggcagucuguggucacgcaagacuuuaaaaaaaaaaaaaaaaaaaaaaaaaaaaaaa

SEQ ID NO: 27830 - RNA, 64 nt, hsa
guauaaagggcagucuguggucacgcaagacuuuaaaaaaaaaaaaaaaaaaaaaaaaaaaaaa

SEQ ID NO: 27831 - RNA, 64 nt, hsa
aaggagcuacagaaggaagggagucccaucucaaaaaaaaaaugaauguaugccacugcaauua

SEQ ID NO: 27832 - RNA, 64 nt, hsa
aaaggagcuacagaaggaagggagucccaucucaaaaaaaaaaugaauguaugccacugcaauu

SEQ ID NO: 27833 - RNA, 64 nt, hsa
uaaaggagcuacagaaggaagggagucccaucucaaaaaaaaaaugaauguaugccacugcaau

SEQ ID NO: 27834 - RNA, 64 nt, hsa
gguguggguugguuuuguuugcaaaauggccaaaaaaaaaaaccggcuuccccgagcagcugcc

SEQ ID NO: 27835 - RNA, 64 nt, hsa
ggguguggguugguuuuguuugcaaaauggccaaaaaaaaaaaccggcuuccccgagcagcugc

SEQ ID NO: 27836 - RNA, 64 nt, hsa
cggguguggguugguuuuguuugcaaaauggccaaaaaaaaaaaccggcuuccccgagcagcug

SEQ ID NO: 27837 - RNA, 64 nt, hsa
acggguguggguugguuuuguuugcaaaauggccaaaaaaaaaaaccggcuuccccgagcagcu

SEQ ID NO: 27838 - RNA, 64 nt, hsa
ccagcacaaggaaacauaggcagcacugaaaaaaaaaaaaaagcucauauuaauuagacugaca

SEQ ID NO: 27839 - RNA, 64 nt, hsa
accagcacaaggaaacauaggcagcacugaaaaaaaaaaaaaagcucauauuaauuagacugac

SEQ ID NO: 27840 - RNA, 64 nt, hsa
uaccagcacaaggaaacauaggcagcacugaaaaaaaaaaaaaagcucauauuaauuagacuga

SEQ ID NO: 27841 - RNA, 64 nt, hsa
cuaccagcacaaggaaacauaggcagcacugaaaaaaaaaaaaaagcucauauuaauuagacug

SEQ ID NO: 27842 - RNA, 64 nt, hsa
ucuaccagcacaaggaaacauaggcagcacugaaaaaaaaaaaaaagcucauauuaauuagacu

SEQ ID NO: 27843 - RNA, 64 nt, hsa
uucuaccagcacaaggaaacauaggcagcacugaaaaaaaaaaaaaagcucauauuaauuagac

SEQ ID NO: 27844 - RNA, 64 nt, hsa
auucuaccagcacaaggaaacauaggcagcacugaaaaaaaaaaaaaagcucauauuaauuaga

SEQ ID NO: 27845 - RNA, 64 nt, hsa
ugacguccugccagaaagagaaugaaugacagaaaaaaaaaagagagacaaacucuaggaacaa

SEQ ID NO: 27846 - RNA, 64 nt, hsa
gugacguccugccagaaagagaaugaaugacagaaaaaaaaaagagagacaaacucuaggaaca

SEQ ID NO: 27847 - RNA, 64 nt, hsa
cgugacguccugccagaaagagaaugaaugacagaaaaaaaaaagagagacaaacucuaggaac

SEQ ID NO: 27848 - RNA, 64 nt, hsa
caaccccgagaaugaagauuggaaaaaggaaaaaaaaaaaaacacgucaaaaguuagcagugaa

SEQ ID NO: 27849 - RNA, 64 nt, hsa
ccaaccccgagaaugaagauuggaaaaaggaaaaaaaaaaaaacacgucaaaaguuagcaguga

SEQ ID NO: 27850 - RNA, 64 nt, hsa
gccaaccccgagaaugaagauuggaaaaaggaaaaaaaaaaaaacacgucaaaaguuagcagug

SEQ ID NO: 27851 - RNA, 64 nt, hsa
ggccaaccccgagaaugaagauuggaaaaaggaaaaaaaaaaaaacacgucaaaaguuagcagu

SEQ ID NO: 27852 - RNA, 64 nt, hsa
gggccaaccccgagaaugaagauuggaaaaaggaaaaaaaaaaaaacacgucaaaaguuagcag

SEQ ID NO: 27853 - RNA, 64 nt, hsa
cgggccaaccccgagaaugaagauuggaaaaaggaaaaaaaaaaaaacacgucaaaaguuagca

SEQ ID NO: 27854 - RNA, 64 nt, hsa
uuggaugugcuccugaaucuacuuuuuauaaaaaaaaaaaaaucugcugugcacaauuuuccau

SEQ ID NO: 27855 - RNA, 64 nt, hsa
auuggaugugcuccugaaucuacuuuuuauaaaaaaaaaaaaaucugcugugcacaauuuucca

SEQ ID NO: 27856 - RNA, 64 nt, hsa
aauuggaugugcuccugaaucuacuuuuuauaaaaaaaaaaaaaucugcugugcacaauuuucc

SEQ ID NO: 27857 - RNA, 64 nt, hsa
uaauuggaugugcuccugaaucuacuuuuuauaaaaaaaaaaaaaucugcugugcacaauuuuc

SEQ ID NO: 27858 - RNA, 64 nt, hsa
auaauuggaugugcuccugaaucuacuuuuuauaaaaaaaaaaaaaucugcugugcacaauuuu

SEQ ID NO: 27859 - RNA, 64 nt, hsa
uauaauuggaugugcuccugaaucuacuuuuuauaaaaaaaaaaaaaucugcugugcacaauuu

SEQ ID NO: 27860 - RNA, 64 nt, hsa
aguggaaaacaaagccaaacaaaacugaaccacaaaaaaaaaggcugguguucaccaaaaccaa

SEQ ID NO: 27861 - RNA, 64 nt, hsa
caguggaaaacaaagccaaacaaaacugaaccacaaaaaaaaaggcugguguucaccaaaacca

SEQ ID NO: 27862 - RNA, 64 nt, hsa
cauuguaacuauuaaccuuuuuugucuuauugaaaaaaaaaauguugagaagcguuuuuaaccu

SEQ ID NO: 27863 - RNA, 64 nt, hsa
ccauuguaacuauuaaccuuuuuugucuuauugaaaaaaaaaauguugagaagcguuuuuaacc

SEQ ID NO: 27864 - RNA, 64 nt, hsa
accauuguaacuauuaaccuuuuuugucuuauugaaaaaaaaaauguugagaagcguuuuuaac

SEQ ID NO: 27865 - RNA, 64 nt, hsa
agggauuuauuucuuuaacuuuauaagacuuuaaaaaaaaaacccaaauucuaagcacugacau

SEQ ID NO: 27866 - RNA, 64 nt, hsa
gagggauuuauuucuuuaacuuuauaagacuuuaaaaaaaaaacccaaauucuaagcacugaca

SEQ ID NO: 27867 - RNA, 64 nt, hsa
ugagggauuuauuucuuuaacuuuauaagacuuuaaaaaaaaaacccaaauucuaagcacugac

SEQ ID NO: 27868 - RNA, 64 nt, hsa
aauaguuuugcaauguguauauaguugcaggcaaaaaaaaaaccaccucacugcaaaacuuauu

SEQ ID NO: 27869 - RNA, 64 nt, hsa
gaauaguuuugcaauguguauauaguugcaggcaaaaaaaaaaccaccucacugcaaaacuuau

SEQ ID NO: 27870 - RNA, 64 nt, hsa
agaauaguuuugcaauguguauauaguugcaggcaaaaaaaaaaccaccucacugcaaaacuua

SEQ ID NO: 27871 - RNA, 64 nt, hsa
aaauucuccuugauaacauaggacaauuaauggaaaaaaaaauucucauuauuugcaaagaaug

SEQ ID NO: 27872 - RNA, 64 nt, hsa
aaaauucuccuugauaacauaggacaauuaauggaaaaaaaaauucucauuauuugcaaagaau

SEQ ID NO: 27873 - RNA, 64 nt, hsa
guucugauuuucaacugaucaaacuaaugcaaaaaaaaaaaaguauguauucuucacuacugag

SEQ ID NO: 27874 - RNA, 64 nt, hsa
gguucugauuuucaacugaucaaacuaaugcaaaaaaaaaaaaguauguauucuucacuacuga

SEQ ID NO: 27875 - RNA, 64 nt, hsa
agguucugauuuucaacugaucaaacuaaugcaaaaaaaaaaaaguauguauucuucacuacug

SEQ ID NO: 27876 - RNA, 64 nt, hsa
aagguucugauuuucaacugaucaaacuaaugcaaaaaaaaaaaaguauguauucuucacuacu

SEQ ID NO: 27877 - RNA, 64 nt, hsa
gaagguucugauuuucaacugaucaaacuaaugcaaaaaaaaaaaaguauguauucuucacuac

SEQ ID NO: 27878 - RNA, 64 nt, hsa
aucugcaaucuuugccaagguacuuuuuuauuuaaaaaaaaacauaacuuuguaaauauuaccc

SEQ ID NO: 27879 - RNA, 64 nt, hsa
uaucugcaaucuuugccaagguacuuuuuuauuuaaaaaaaaacauaacuuuguaaauauuacc

SEQ ID NO: 27880 - RNA, 64 nt, hsa
aacugagcauacuagcaagacagcucuucuugaaaaaaaaaauauguauacacaaauauauacg

SEQ ID NO: 27881 - RNA, 64 nt, hsa
aaacugagcauacuagcaagacagcucuucuugaaaaaaaaaauauguauacacaaauauauac

SEQ ID NO: 27882 - RNA, 64 nt, hsa
aaaacugagcauacuagcaagacagcucuucuugaaaaaaaaaauauguauacacaaauauaua

SEQ ID NO: 27883 - RNA, 64 nt, hsa
ugacaaauaugccaguuuauuuaauuuguuuaaaaaaaaaaaggcagaaaacccaccaugggaa

SEQ ID NO: 27884 - RNA, 64 nt, hsa
augacaaauaugccaguuuauuuaauuuguuuaaaaaaaaaaaggcagaaaacccaccauggga

SEQ ID NO: 27885 - RNA, 64 nt, hsa
aaugacaaauaugccaguuuauuuaauuuguuuaaaaaaaaaaaggcagaaaacccaccauggg

SEQ ID NO: 27886 - RNA, 64 nt, hsa
caaugacaaauaugccaguuuauuuaauuuguuuaaaaaaaaaaaggcagaaaacccaccaugg

SEQ ID NO: 27887 - RNA, 64 nt, hsa
uaugguuaccuaaaauugccacuuuuuuuagguuaaaaaaaacuucaguauccucauuaacauu

SEQ ID NO: 27888 - RNA, 64 nt, hsa
cagcuucagacauuugguuaagaacccaugggaaaaaaaaaauccuugcuaaugugguuuccuu

SEQ ID NO: 27889 - RNA, 64 nt, hsa
gcagcuucagacauuugguuaagaacccaugggaaaaaaaaaauccuugcuaaugugguuuccu

SEQ ID NO: 27890 - RNA, 64 nt, hsa
agcagcuucagacauuugguuaagaacccaugggaaaaaaaaaauccuugcuaaugugguuucc

SEQ ID NO: 27891 - RNA, 64 nt, hsa
uuaaaaggacuauuucucuaaaacucaaaaaaaaaaaaaaaacucaagauaguaaaagcaccua

SEQ ID NO: 27892 - RNA, 64 nt, hsa
auuaaaaggacuauuucucuaaaacucaaaaaaaaaaaaaaaacucaagauaguaaaagcaccu

SEQ ID NO: 27893 - RNA, 64 nt, hsa
uauuaaaaggacuauuucucuaaaacucaaaaaaaaaaaaaaaacucaagauaguaaaagcacc

SEQ ID NO: 27894 - RNA, 64 nt, hsa
auauuaaaaggacuauuucucuaaaacucaaaaaaaaaaaaaaaacucaagauaguaaaagcac

SEQ ID NO: 27895 - RNA, 64 nt, hsa
cauauuaaaaggacuauuucucuaaaacucaaaaaaaaaaaaaaaacucaagauaguaaaagca

SEQ ID NO: 27896 - RNA, 64 nt, hsa
ucauauuaaaaggacuauuucucuaaaacucaaaaaaaaaaaaaaaacucaagauaguaaaagc

SEQ ID NO: 27897 - RNA, 64 nt, hsa
gucauauuaaaaggacuauuucucuaaaacucaaaaaaaaaaaaaaaacucaagauaguaaaag

SEQ ID NO: 27898 - RNA, 64 nt, hsa
agucauauuaaaaggacuauuucucuaaaacucaaaaaaaaaaaaaaaacucaagauaguaaaa

SEQ ID NO: 27899 - RNA, 64 nt, hsa
aagucauauuaaaaggacuauuucucuaaaacucaaaaaaaaaaaaaaaacucaagauaguaaa

SEQ ID NO: 27900 - RNA, 55 nt, hsa
cuggccagacuuuuggcuaaaaaaaaaaaaaaaguguaaauaauacuggcacuuu

SEQ ID NO: 27901 - RNA, 54 nt, hsa
cuggccagacuuuuggcuaaaaaaaaaaaaaaaguguaaauaauacuggcacuu

SEQ ID NO: 27902 - RNA, 53 nt, hsa
cuggccagacuuuuggcuaaaaaaaaaaaaaaaguguaaauaauacuggcacu

SEQ ID NO: 27903 - RNA, 52 nt, hsa
cuggccagacuuuuggcuaaaaaaaaaaaaaaaguguaaauaauacuggcac

SEQ ID NO: 27904 - RNA, 51 nt, hsa
cuggccagacuuuuggcuaaaaaaaaaaaaaaaguguaaauaauacuggca

SEQ ID NO: 27905 - RNA, 50 nt, hsa
cuggccagacuuuuggcuaaaaaaaaaaaaaaaguguaaauaauacuggc

SEQ ID NO: 27906 - RNA, 64 nt, hsa
cuuaaaauguguacucguuauuucuaaugauguaaaaaaaaaucccuaguccuguuuagcauuu

SEQ ID NO: 27907 - RNA, 64 nt, hsa
ucuuaaaauguguacucguuauuucuaaugauguaaaaaaaaaucccuaguccuguuuagcauu

SEQ ID NO: 27908 - RNA, 64 nt, hsa
gauucagccauugugccugaaaucaguguuuaaaaaaaaaaaucaaccagguugugguaacaag

SEQ ID NO: 27909 - RNA, 64 nt, hsa
ggauucagccauugugccugaaaucaguguuuaaaaaaaaaaaucaaccagguugugguaacaa

SEQ ID NO: 27910 - RNA, 64 nt, hsa
uggauucagccauugugccugaaaucaguguuuaaaaaaaaaaaucaaccagguugugguaaca

SEQ ID NO: 27911 - RNA, 64 nt, hsa
guggauucagccauugugccugaaaucaguguuuaaaaaaaaaaaucaaccagguugugguaac

SEQ ID NO: 27912 - RNA, 64 nt, hsa
gcuucucagauauggcuugccaaaaaaaaaaaaaaaaaaaaaucagaaauuggagaaauccuua

SEQ ID NO: 27913 - RNA, 64 nt, hsa
ggcuucucagauauggcuugccaaaaaaaaaaaaaaaaaaaaaucagaaauuggagaaauccuu

SEQ ID NO: 27914 - RNA, 64 nt, hsa
uggcuucucagauauggcuugccaaaaaaaaaaaaaaaaaaaaaucagaaauuggagaaauccu

SEQ ID NO: 27915 - RNA, 64 nt, hsa
auggcuucucagauauggcuugccaaaaaaaaaaaaaaaaaaaaaucagaaauuggagaaaucc

SEQ ID NO: 27916 - RNA, 64 nt, hsa
gauggcuucucagauauggcuugccaaaaaaaaaaaaaaaaaaaaaucagaaauuggagaaauc

SEQ ID NO: 27917 - RNA, 64 nt, hsa
agauggcuucucagauauggcuugccaaaaaaaaaaaaaaaaaaaaaucagaaauuggagaaau

SEQ ID NO: 27918 - RNA, 64 nt, hsa
gagauggcuucucagauauggcuugccaaaaaaaaaaaaaaaaaaaaaucagaaauuggagaaa

SEQ ID NO: 27919 - RNA, 64 nt, hsa
agagauggcuucucagauauggcuugccaaaaaaaaaaaaaaaaaaaaaucagaaauuggagaa

SEQ ID NO: 27920 - RNA, 64 nt, hsa
cagagauggcuucucagauauggcuugccaaaaaaaaaaaaaaaaaaaaaucagaaauuggaga

SEQ ID NO: 27921 - RNA, 64 nt, hsa
gcagagauggcuucucagauauggcuugccaaaaaaaaaaaaaaaaaaaaaucagaaauuggag

SEQ ID NO: 27922 - RNA, 64 nt, hsa
ggcagagauggcuucucagauauggcuugccaaaaaaaaaaaaaaaaaaaaaucagaaauugga

SEQ ID NO: 27923 - RNA, 64 nt, hsa
gggcagagauggcuucucagauauggcuugccaaaaaaaaaaaaaaaaaaaaaucagaaauugg

SEQ ID NO: 27924 - RNA, 64 nt, hsa
agggcagagauggcuucucagauauggcuugccaaaaaaaaaaaaaaaaaaaaaucagaaauug

SEQ ID NO: 27925 - RNA, 64 nt, hsa
aagggcagagauggcuucucagauauggcuugccaaaaaaaaaaaaaaaaaaaaaucagaaauu

SEQ ID NO: 27926 - RNA, 64 nt, hsa
uucauuugaaugaaggguucugcugcuaaaaaaaaaaaaaaagucggaaaaaccaccugaucac

SEQ ID NO: 27927 - RNA, 64 nt, hsa
cuucauuugaaugaaggguucugcugcuaaaaaaaaaaaaaaagucggaaaaaccaccugauca

SEQ ID NO: 27928 - RNA, 64 nt, hsa
gcuucauuugaaugaaggguucugcugcuaaaaaaaaaaaaaaagucggaaaaaccaccugauc

SEQ ID NO: 27929 - RNA, 64 nt, hsa
ggcuucauuugaaugaaggguucugcugcuaaaaaaaaaaaaaaagucggaaaaaccaccugau

SEQ ID NO: 27930 - RNA, 64 nt, hsa
aggcuucauuugaaugaaggguucugcugcuaaaaaaaaaaaaaaagucggaaaaaccaccuga

SEQ ID NO: 27931 - RNA, 64 nt, hsa
aaggcuucauuugaaugaaggguucugcugcuaaaaaaaaaaaaaaagucggaaaaaccaccug

SEQ ID NO: 27932 - RNA, 64 nt, hsa
uaaggcuucauuugaaugaaggguucugcugcuaaaaaaaaaaaaaaagucggaaaaaccaccu

SEQ ID NO: 27933 - RNA, 64 nt, hsa
guaaggcuucauuugaaugaaggguucugcugcuaaaaaaaaaaaaaaagucggaaaaaccacc

SEQ ID NO: 27934 - RNA, 64 nt, hsa
gcagggccacaagggugcuuuuuuucuuuaaaaaaaaaaaaauuagaaccaauucauguucaug

SEQ ID NO: 27935 - RNA, 64 nt, hsa
agcagggccacaagggugcuuuuuuucuuuaaaaaaaaaaaaauuagaaccaauucauguucau

SEQ ID NO: 27936 - RNA, 64 nt, hsa
gagcagggccacaagggugcuuuuuuucuuuaaaaaaaaaaaaauuagaaccaauucauguuca

SEQ ID NO: 27937 - RNA, 64 nt, hsa
agagcagggccacaagggugcuuuuuuucuuuaaaaaaaaaaaaauuagaaccaauucauguuc

SEQ ID NO: 27938 - RNA, 64 nt, hsa
cagagcagggccacaagggugcuuuuuuucuuuaaaaaaaaaaaaauuagaaccaauucauguu

SEQ ID NO: 27939 - RNA, 64 nt, hsa
ccagagcagggccacaagggugcuuuuuuucuuuaaaaaaaaaaaaauuagaaccaauucaugu

SEQ ID NO: 27940 - RNA, 64 nt, hsa
cagggugagacucugucucaaaaaaaaaaaaaaaaaaaaaaagaauuccaugauucuuuugagc

SEQ ID NO: 27941 - RNA, 64 nt, hsa
acagggugagacucugucucaaaaaaaaaaaaaaaaaaaaaaagaauuccaugauucuuuugag

SEQ ID NO: 27942 - RNA, 64 nt, hsa
aacagggugagacucugucucaaaaaaaaaaaaaaaaaaaaaaagaauuccaugauucuuuuga

SEQ ID NO: 27943 - RNA, 64 nt, hsa
caacagggugagacucugucucaaaaaaaaaaaaaaaaaaaaaaagaauuccaugauucuuuug

SEQ ID NO: 27944 - RNA, 64 nt, hsa
gcaacagggugagacucugucucaaaaaaaaaaaaaaaaaaaaaaagaauuccaugauucuuuu

SEQ ID NO: 27945 - RNA, 64 nt, hsa
ggcaacagggugagacucugucucaaaaaaaaaaaaaaaaaaaaaaagaauuccaugauucuuu

SEQ ID NO: 27946 - RNA, 64 nt, hsa
gggcaacagggugagacucugucucaaaaaaaaaaaaaaaaaaaaaaagaauuccaugauucuu

SEQ ID NO: 27947 - RNA, 64 nt, hsa
ugggcaacagggugagacucugucucaaaaaaaaaaaaaaaaaaaaaaagaauuccaugauucu

SEQ ID NO: 27948 - RNA, 64 nt, hsa
cugggcaacagggugagacucugucucaaaaaaaaaaaaaaaaaaaaaaagaauuccaugauuc

SEQ ID NO: 27949 - RNA, 64 nt, hsa
ccugggcaacagggugagacucugucucaaaaaaaaaaaaaaaaaaaaaaagaauuccaugauu

SEQ ID NO: 27950 - RNA, 64 nt, hsa
cccugggcaacagggugagacucugucucaaaaaaaaaaaaaaaaaaaaaaagaauuccaugau

SEQ ID NO: 27951 - RNA, 64 nt, hsa
acccugggcaacagggugagacucugucucaaaaaaaaaaaaaaaaaaaaaaagaauuccauga

SEQ ID NO: 27952 - RNA, 64 nt, hsa
cacccugggcaacagggugagacucugucucaaaaaaaaaaaaaaaaaaaaaaagaauuccaug

SEQ ID NO: 27953 - RNA, 64 nt, hsa
ccacccugggcaacagggugagacucugucucaaaaaaaaaaaaaaaaaaaaaaagaauuccau

SEQ ID NO: 27954 - RNA, 64 nt, hsa
uccacccugggcaacagggugagacucugucucaaaaaaaaaaaaaaaaaaaaaaagaauucca

SEQ ID NO: 27955 - RNA, 64 nt, hsa
uuccacccugggcaacagggugagacucugucucaaaaaaaaaaaaaaaaaaaaaaagaauucc

SEQ ID NO: 27956 - RNA, 64 nt, hsa
aacauggugaaacccugucucuacuaaaaauacaaaaaaaaauuagcuggaccugguggcgcau

SEQ ID NO: 27957 - RNA, 64 nt, hsa
caacauggugaaacccugucucuacuaaaaauacaaaaaaaaauuagcuggaccugguggcgca

SEQ ID NO: 27958 - RNA, 64 nt, hsa
uuagaggaagaaaauuuaaagaaaagcuagaggaaaaaaaaauuuuuuuaaaaauacuuauuag

SEQ ID NO: 27959 - RNA, 64 nt, hsa
auuagaggaagaaaauuuaaagaaaagcuagaggaaaaaaaaauuuuuuuaaaaauacuuauua

SEQ ID NO: 27960 - RNA, 64 nt, hsa
ccgcauuccacuggguauaacaguauuuuaauuaaaaaaaaauaauuaaaagugaugucuuugc

SEQ ID NO: 27961 - RNA, 64 nt, hsa
gccgcauuccacuggguauaacaguauuuuaauuaaaaaaaaauaauuaaaagugaugucuuug

SEQ ID NO: 27962 - RNA, 64 nt, hsa
aaagaggaaaaaaaggcaaaaaauauugugaaagaaaaaaaacaacuuaauauauuuuggauua

SEQ ID NO: 27963 - RNA, 64 nt, hsa
auacaccuguuuuaugaaaacucaacauugaguaaaaaaaaacauauuuuuaacuuuauuuucc

SEQ ID NO: 27964 - RNA, 64 nt, hsa
uauacaccuguuuuaugaaaacucaacauugaguaaaaaaaaacauauuuuuaacuuuauuuuc

SEQ ID NO: 27965 - RNA, 64 nt, hsa
acuuuuuaagagaguauuuaaaaaaaaaaaaaggaaaaaaaauucaccgggcaaccggggaagu

SEQ ID NO: 27966 - RNA, 64 nt, hsa
gaucgguggaacuuuuuaagagaguauuuaaaaaaaaaaaaaggaaaaaaaauucaccgggcaa

SEQ ID NO: 27967 - RNA, 64 nt, hsa
agaucgguggaacuuuuuaagagaguauuuaaaaaaaaaaaaaggaaaaaaaauucaccgggca

SEQ ID NO: 27968 - RNA, 64 nt, hsa
aagaucgguggaacuuuuuaagagaguauuuaaaaaaaaaaaaaggaaaaaaaauucaccgggc

SEQ ID NO: 27969 - RNA, 64 nt, hsa
aaagaucgguggaacuuuuuaagagaguauuuaaaaaaaaaaaaaggaaaaaaaauucaccggg

SEQ ID NO: 27970 - RNA, 64 nt, hsa
gaaagaucgguggaacuuuuuaagagaguauuuaaaaaaaaaaaaaggaaaaaaaauucaccgg

SEQ ID NO: 27971 - RNA, 64 nt, hsa
ugaaagaucgguggaacuuuuuaagagaguauuuaaaaaaaaaaaaaggaaaaaaaauucaccg

SEQ ID NO: 27972 - RNA, 64 nt, hsa
auugccuuugaaagaucuauguucucucaguagaaaaaaaaauacuuauaaaauuacauauucu

SEQ ID NO: 27973 - RNA, 64 nt, hsa
cauugccuuugaaagaucuauguucucucaguagaaaaaaaaauacuuauaaaauuacauauuc

SEQ ID NO: 27974 - RNA, 64 nt, hsa
ccccagugaauaggggaaaaauaaacacagugaaaaaaaaaaucaaacaguggagucuucuuua

SEQ ID NO: 27975 - RNA, 64 nt, hsa
accccagugaauaggggaaaaauaaacacagugaaaaaaaaaaucaaacaguggagucuucuuu

SEQ ID NO: 27976 - RNA, 64 nt, hsa
uaccccagugaauaggggaaaaauaaacacagugaaaaaaaaaaucaaacaguggagucuucuu

SEQ ID NO: 27977 - RNA, 64 nt, hsa
auuggcuauuuguauacuuagccauaacuuggugaaaaaaaaccugagcagugucuauguauua

SEQ ID NO: 27978 - RNA, 64 nt, hsa
gcaugagugaguauaguaacccaagaugccauaaaaaaaaaacuugaucguuuucugacuuaau

SEQ ID NO: 27979 - RNA, 64 nt, hsa
ugcaugagugaguauaguaacccaagaugccauaaaaaaaaaacuugaucguuuucugacuuaa

SEQ ID NO: 27980 - RNA, 64 nt, hsa
uugcaugagugaguauaguaacccaagaugccauaaaaaaaaaacuugaucguuuucugacuua

SEQ ID NO: 27981 - RNA, 64 nt, hsa
auuauagcuuugaaagauaaaaaaaaaaaaaacaaaaaaaaacucaguaugaaaaaauacaguu

SEQ ID NO: 27982 - RNA, 64 nt, hsa
aauuauagcuuugaaagauaaaaaaaaaaaaaacaaaaaaaaacucaguaugaaaaaauacagu

SEQ ID NO: 27983 - RNA, 64 nt, hsa
cauaaaguuaauuauagcuuugaaagauaaaaaaaaaaaaaacaaaaaaaaacucaguaugaaa

SEQ ID NO: 27984 - RNA, 64 nt, hsa
ccauaaaguuaauuauagcuuugaaagauaaaaaaaaaaaaaacaaaaaaaaacucaguaugaa

SEQ ID NO: 27985 - RNA, 64 nt, hsa
accauaaaguuaauuauagcuuugaaagauaaaaaaaaaaaaaacaaaaaaaaacucaguauga

SEQ ID NO: 27986 - RNA, 64 nt, hsa
gaccauaaaguuaauuauagcuuugaaagauaaaaaaaaaaaaaacaaaaaaaaacucaguaug

SEQ ID NO: 27987 - RNA, 64 nt, hsa
ggaccauaaaguuaauuauagcuuugaaagauaaaaaaaaaaaaaacaaaaaaaaacucaguau

SEQ ID NO: 27988 - RNA, 64 nt, hsa
uggaccauaaaguuaauuauagcuuugaaagauaaaaaaaaaaaaaacaaaaaaaaacucagua

SEQ ID NO: 27989 - RNA, 64 nt, hsa
cuggaccauaaaguuaauuauagcuuugaaagauaaaaaaaaaaaaaacaaaaaaaaacucagu

SEQ ID NO: 27990 - RNA, 64 nt, hsa
ugugccccuuaaauguagauaugugcugaaagaaaaaaaaaacgcccaacucuugaaguccauu

SEQ ID NO: 27991 - RNA, 64 nt, hsa
uugugccccuuaaauguagauaugugcugaaagaaaaaaaaaacgcccaacucuugaaguccau

SEQ ID NO: 27992 - RNA, 64 nt, hsa
uuugugccccuuaaauguagauaugugcugaaagaaaaaaaaaacgcccaacucuugaagucca

SEQ ID NO: 27993 - RNA, 64 nt, hsa
aaaaacccaaaaaguuuucuuuacuguugguuaaaaaaaaaagccagaccauaguuugacuggu

SEQ ID NO: 27994 - RNA, 64 nt, hsa
aaaaaacccaaaaaguuuucuuuacuguugguuaaaaaaaaaagccagaccauaguuugacugg

SEQ ID NO: 27995 - RNA, 64 nt, hsa
aaaaaaacccaaaaaguuuucuuuacuguugguuaaaaaaaaaagccagaccauaguuugacug

SEQ ID NO: 27996 - RNA, 64 nt, hsa
accgcaaagcugcaacgauggacucuugcauagaaaaaaaaaucuuguuaacaaugaaaaaaug

SEQ ID NO: 27997 - RNA, 64 nt, hsa
caccgcaaagcugcaacgauggacucuugcauagaaaaaaaaaucuuguuaacaaugaaaaaau

SEQ ID NO: 27998 - RNA, 64 nt, hsa
cgacagagcgagacuugguuucaaaaaaaaaaaaaaaaaaaacuucaguaaguacguguuauuu

SEQ ID NO: 27999 - RNA, 64 nt, hsa
gcgacagagcgagacuugguuucaaaaaaaaaaaaaaaaaaaacuucaguaaguacguguuauu

SEQ ID NO: 28000 - RNA, 64 nt, hsa
ggcgacagagcgagacuugguuucaaaaaaaaaaaaaaaaaaaacuucaguaaguacguguuau

SEQ ID NO: 28001 - RNA, 64 nt, hsa
uggcgacagagcgagacuugguuucaaaaaaaaaaaaaaaaaaaacuucaguaaguacguguua

SEQ ID NO: 28002 - RNA, 64 nt, hsa
cuggcgacagagcgagacuugguuucaaaaaaaaaaaaaaaaaaaacuucaguaaguacguguu

SEQ ID NO: 28003 - RNA, 64 nt, hsa
ccuggcgacagagcgagacuugguuucaaaaaaaaaaaaaaaaaaaacuucaguaaguacgugu

SEQ ID NO: 28004 - RNA, 64 nt, hsa
gccuggcgacagagcgagacuugguuucaaaaaaaaaaaaaaaaaaaacuucaguaaguacgug

SEQ ID NO: 28005 - RNA, 64 nt, hsa
agccuggcgacagagcgagacuugguuucaaaaaaaaaaaaaaaaaaaacuucaguaaguacgu

SEQ ID NO: 28006 - RNA, 64 nt, hsa
cagccuggcgacagagcgagacuugguuucaaaaaaaaaaaaaaaaaaaacuucaguaaguacg

SEQ ID NO: 28007 - RNA, 64 nt, hsa
ccagccuggcgacagagcgagacuugguuucaaaaaaaaaaaaaaaaaaaacuucaguaaguac

SEQ ID NO: 28008 - RNA, 64 nt, hsa
uccagccuggcgacagagcgagacuugguuucaaaaaaaaaaaaaaaaaaaacuucaguaagua

SEQ ID NO: 28009 - RNA, 64 nt, hsa
cuccagccuggcgacagagcgagacuugguuucaaaaaaaaaaaaaaaaaaaacuucaguaagu

SEQ ID NO: 28010 - RNA, 64 nt, hsa
acuccagccuggcgacagagcgagacuugguuucaaaaaaaaaaaaaaaaaaaacuucaguaag

SEQ ID NO: 28011 - RNA, 64 nt, hsa
gguccacaucugugguugaccucuguuauuguuuaaaaaaaauaaauaaaaauuaaaaaaaucu

SEQ ID NO: 28012 - RNA, 64 nt, hsa
acuuuuuuuuuaauuaccauagagaagauacauuaaaaaaaaucuucugauguuuuguagccau

SEQ ID NO: 28013 - RNA, 64 nt, hsa
uuaucuacaaaaacaagcuuucaguaaacuaccaaaaaaaaaguggggguggaggaaaaaaggc

SEQ ID NO: 28014 - RNA, 64 nt, hsa
auuaucuacaaaaacaagcuuucaguaaacuaccaaaaaaaaaguggggguggaggaaaaaagg

SEQ ID NO: 28015 - RNA, 64 nt, hsa
aaggaaauuuagaaaaugcguagauacaaaauuaaaaaaaaauacuguccacgauccuauuaga

SEQ ID NO: 28016 - RNA, 64 nt, hsa
gaaggaaauuuagaaaaugcguagauacaaaauuaaaaaaaaauacuguccacgauccuauuag

SEQ ID NO: 28017 - RNA, 64 nt, hsa
guguucugugacaaaaaaaaaaaaaaaaaaaagaaaaaaaaagaaaaaacagaaauauauccag

SEQ ID NO: 28018 - RNA, 64 nt, hsa
aguguucugugacaaaaaaaaaaaaaaaaaaaagaaaaaaaaagaaaaaacagaaauauaucca

SEQ ID NO: 28019 - RNA, 64 nt, hsa
acugcaaacaguguucugugacaaaaaaaaaaaaaaaaaaaagaaaaaaaaagaaaaaacagaa

SEQ ID NO: 28020 - RNA, 64 nt, hsa
uacugcaaacaguguucugugacaaaaaaaaaaaaaaaaaaaagaaaaaaaaagaaaaaacaga

SEQ ID NO: 28021 - RNA, 64 nt, hsa
cuacugcaaacaguguucugugacaaaaaaaaaaaaaaaaaaaagaaaaaaaaagaaaaaacag

SEQ ID NO: 28022 - RNA, 64 nt, hsa
ucuacugcaaacaguguucugugacaaaaaaaaaaaaaaaaaaaagaaaaaaaaagaaaaaaca

SEQ ID NO: 28023 - RNA, 64 nt, hsa
cucuacugcaaacaguguucugugacaaaaaaaaaaaaaaaaaaaagaaaaaaaaagaaaaaac

SEQ ID NO: 28024 - RNA, 64 nt, hsa
ccucuacugcaaacaguguucugugacaaaaaaaaaaaaaaaaaaaagaaaaaaaaagaaaaaa

SEQ ID NO: 28025 - RNA, 64 nt, hsa
uccucuacugcaaacaguguucugugacaaaaaaaaaaaaaaaaaaaagaaaaaaaaagaaaaa

SEQ ID NO: 28026 - RNA, 64 nt, hsa
uuccucuacugcaaacaguguucugugacaaaaaaaaaaaaaaaaaaaagaaaaaaaaagaaaa

SEQ ID NO: 28027 - RNA, 64 nt, hsa
uuuccucuacugcaaacaguguucugugacaaaaaaaaaaaaaaaaaaaagaaaaaaaaagaaa

SEQ ID NO: 28028 - RNA, 64 nt, hsa
guuuccucuacugcaaacaguguucugugacaaaaaaaaaaaaaaaaaaaagaaaaaaaaagaa

SEQ ID NO: 28029 - RNA, 64 nt, hsa
aguuuccucuacugcaaacaguguucugugacaaaaaaaaaaaaaaaaaaaagaaaaaaaaaga

SEQ ID NO: 28030 - RNA, 64 nt, hsa
caguuuccucuacugcaaacaguguucugugacaaaaaaaaaaaaaaaaaaaagaaaaaaaaag

SEQ ID NO: 28031 - RNA, 64 nt, hsa
ccaguuuccucuacugcaaacaguguucugugacaaaaaaaaaaaaaaaaaaaagaaaaaaaaa

SEQ ID NO: 28032 - RNA, 64 nt, hsa
cuuuuggacaaaccuugaaaauguuuauuuaaaaaaaaaaaagaugacaaagaaaaacagagag

SEQ ID NO: 28033 - RNA, 64 nt, hsa
ucuuuuggacaaaccuugaaaauguuuauuuaaaaaaaaaaaagaugacaaagaaaaacagaga

SEQ ID NO: 28034 - RNA, 64 nt, hsa
uucuuuuggacaaaccuugaaaauguuuauuuaaaaaaaaaaaagaugacaaagaaaaacagag

SEQ ID NO: 28035 - RNA, 64 nt, hsa
cuucuuuuggacaaaccuugaaaauguuuauuuaaaaaaaaaaaagaugacaaagaaaaacaga

SEQ ID NO: 28036 - RNA, 64 nt, hsa
ccuucuuuuggacaaaccuugaaaauguuuauuuaaaaaaaaaaaagaugacaaagaaaaacag

SEQ ID NO: 28037 - RNA, 64 nt, hsa
gcauuuuuuuauuuuuuuaauaaaaaugaguuggaaaaaaaauaagauaucaacugccagccug

SEQ ID NO: 28038 - RNA, 64 nt, hsa
ucaauauucagcaaaaugauuccuuucuuuaaaaaaaaaaaauguggaggaaaguagaaauuua

SEQ ID NO: 28039 - RNA, 64 nt, hsa
aucaauauucagcaaaaugauuccuuucuuuaaaaaaaaaaaauguggaggaaaguagaaauuu

SEQ ID NO: 28040 - RNA, 64 nt, hsa
caucaauauucagcaaaaugauuccuuucuuuaaaaaaaaaaaauguggaggaaaguagaaauu

SEQ ID NO: 28041 - RNA, 64 nt, hsa
ccaucaauauucagcaaaaugauuccuuucuuuaaaaaaaaaaaauguggaggaaaguagaaau

SEQ ID NO: 28042 - RNA, 64 nt, hsa
gccaucaauauucagcaaaaugauuccuuucuuuaaaaaaaaaaaauguggaggaaaguagaaa

SEQ ID NO: 28043 - RNA, 64 nt, hsa
uuggugucauaauauuguguaaaaagggaaggaaaaaaaaaaccacccccagcuucuuucuuuu

SEQ ID NO: 28044 - RNA, 64 nt, hsa
auuggugucauaauauuguguaaaaagggaaggaaaaaaaaaaccacccccagcuucuuucuuu

SEQ ID NO: 28045 - RNA, 64 nt, hsa
aauuggugucauaauauuguguaaaaagggaaggaaaaaaaaaaccacccccagcuucuuucuu

SEQ ID NO: 28046 - RNA, 64 nt, hsa
ucaggagugguguagagacauccaaauuuaaagaaaaaaaaacacaaaacagaauguuaaaaaa

SEQ ID NO: 28047 - RNA, 64 nt, hsa
aucaggagugguguagagacauccaaauuuaaagaaaaaaaaacacaaaacagaauguuaaaaa

SEQ ID NO: 28048 - RNA, 64 nt, hsa
guugugcacauguacccuagaacuuaaaguauauaaaaaaaagaaaccuugcacugauuuuguu

SEQ ID NO: 28049 - RNA, 64 nt, hsa
ggcgacagagcgagacuccaucucaaaaaaaaaaaaaaaaaauugcaguaaauuuaaaacuaau

SEQ ID NO: 28050 - RNA, 64 nt, hsa
gggcgacagagcgagacuccaucucaaaaaaaaaaaaaaaaaauugcaguaaauuuaaaacuaa

SEQ ID NO: 28051 - RNA, 64 nt, hsa
ugggcgacagagcgagacuccaucucaaaaaaaaaaaaaaaaaauugcaguaaauuuaaaacua

SEQ ID NO: 28052 - RNA, 64 nt, hsa
cugggcgacagagcgagacuccaucucaaaaaaaaaaaaaaaaaauugcaguaaauuuaaaacu

SEQ ID NO: 28053 - RNA, 64 nt, hsa
ccugggcgacagagcgagacuccaucucaaaaaaaaaaaaaaaaaauugcaguaaauuuaaaac

SEQ ID NO: 28054 - RNA, 64 nt, hsa
gccugggcgacagagcgagacuccaucucaaaaaaaaaaaaaaaaaauugcaguaaauuuaaaa

SEQ ID NO: 28055 - RNA, 64 nt, hsa
agccugggcgacagagcgagacuccaucucaaaaaaaaaaaaaaaaaauugcaguaaauuuaaa

SEQ ID NO: 28056 - RNA, 64 nt, hsa
uagccugggcgacagagcgagacuccaucucaaaaaaaaaaaaaaaaaauugcaguaaauuuaa

SEQ ID NO: 28057 - RNA, 64 nt, hsa
cuagccugggcgacagagcgagacuccaucucaaaaaaaaaaaaaaaaaauugcaguaaauuua

SEQ ID NO: 28058 - RNA, 64 nt, hsa
ucuagccugggcgacagagcgagacuccaucucaaaaaaaaaaaaaaaaaauugcaguaaauuu

SEQ ID NO: 28059 - RNA, 64 nt, hsa
cucuagccugggcgacagagcgagacuccaucucaaaaaaaaaaaaaaaaaauugcaguaaauu

SEQ ID NO: 28060 - RNA, 64 nt, hsa
agcaaaaagaagcucuuuuuuuuuuuuaaucacaaaaaaaaaccccaguucaaaauguguaguu

SEQ ID NO: 28061 - RNA, 64 nt, hsa
cagcaaaaagaagcucuuuuuuuuuuuuaaucacaaaaaaaaaccccaguucaaaauguguagu

SEQ ID NO: 28062 - RNA, 64 nt, hsa
gaaaccacuggucuugucagucauguacacacagaaaaaaaaaccagucauuuuuauuuuuauu

SEQ ID NO: 28063 - RNA, 64 nt, hsa
aaaccacuggucuugucagucauguacacacagaaaaaaaaaccagucauuuuuauuuuuauuu

SEQ ID NO: 28064 - RNA, 64 nt, hsa
caugaaaaagcucaagaguaaaauuaaaauucucaaaaaaaaaccccacgaaauuuaaagaugg

SEQ ID NO: 28065 - RNA, 64 nt, hsa
augaaaaagcucaagaguaaaauuaaaauucucaaaaaaaaaccccacgaaauuuaaagauggg

SEQ ID NO: 28066 - RNA, 64 nt, hsa
uuuaaaaucaauagauucaucaccuuaguuuuuuaaaaaaaaucuauaaauaggguaauugcug

SEQ ID NO: 28067 - RNA, 64 nt, hsa
ggugucugacgauuuuggaaaugagaacaaucucaaaaaaaaaaaaaaaaaaaaaaaaaaaaga

SEQ ID NO: 28068 - RNA, 64 nt, hsa
gugucugacgauuuuggaaaugagaacaaucucaaaaaaaaaaaaaaaaaaaaaaaaaaaagaa

SEQ ID NO: 28069 - RNA, 64 nt, hsa
ugucugacgauuuuggaaaugagaacaaucucaaaaaaaaaaaaaaaaaaaaaaaaaaaagaaa

SEQ ID NO: 28070 - RNA, 64 nt, hsa
gucugacgauuuuggaaaugagaacaaucucaaaaaaaaaaaaaaaaaaaaaaaaaaaagaaaa

SEQ ID NO: 28071 - RNA, 64 nt, hsa
ucugacgauuuuggaaaugagaacaaucucaaaaaaaaaaaaaaaaaaaaaaaaaaaagaaaag

SEQ ID NO: 28072 - RNA, 64 nt, hsa
cugacgauuuuggaaaugagaacaaucucaaaaaaaaaaaaaaaaaaaaaaaaaaaagaaaaga

SEQ ID NO: 28073 - RNA, 64 nt, hsa
ugacgauuuuggaaaugagaacaaucucaaaaaaaaaaaaaaaaaaaaaaaaaaaagaaaagag

SEQ ID NO: 28074 - RNA, 64 nt, hsa
gacgauuuuggaaaugagaacaaucucaaaaaaaaaaaaaaaaaaaaaaaaaaaagaaaagaga

SEQ ID NO: 28075 - RNA, 64 nt, hsa
acgauuuuggaaaugagaacaaucucaaaaaaaaaaaaaaaaaaaaaaaaaaaagaaaagagaa

SEQ ID NO: 28076 - RNA, 64 nt, hsa
cgauuuuggaaaugagaacaaucucaaaaaaaaaaaaaaaaaaaaaaaaaaaagaaaagagaaa

SEQ ID NO: 28077 - RNA, 64 nt, hsa
gauuuuggaaaugagaacaaucucaaaaaaaaaaaaaaaaaaaaaaaaaaaagaaaagagaaaa

SEQ ID NO: 28078 - RNA, 64 nt, hsa
auuuuggaaaugagaacaaucucaaaaaaaaaaaaaaaaaaaaaaaaaaaagaaaagagaaaaa

SEQ ID NO: 28079 - RNA, 64 nt, hsa
uuuuggaaaugagaacaaucucaaaaaaaaaaaaaaaaaaaaaaaaaaaagaaaagagaaaaaa

SEQ ID NO: 28080 - RNA, 64 nt, hsa
uuuggaaaugagaacaaucucaaaaaaaaaaaaaaaaaaaaaaaaaaaagaaaagagaaaaaaa

SEQ ID NO: 28081 - RNA, 64 nt, hsa
gagaacaaucucaaaaaaaaaaaaaaaaaaaaaaaaaaaaaaaaaaaagaaaagagaaaaaaaa

SEQ ID NO: 28082 - RNA, 64 nt, hsa
agaacaaucucaaaaaaaaaaaaaaaaaaaaaaaaaaaaaaaaaaaagaaaagagaaaaaaaag

SEQ ID NO: 28083 - RNA, 64 nt, hsa
gaacaaucucaaaaaaaaaaaaaaaaaaaaaaaaaaaaaaaaaaaagaaaagagaaaaaaaaga

SEQ ID NO: 28084 - RNA, 64 nt, hsa
aacaaucucaaaaaaaaaaaaaaaaaaaaaaaaaaaaaaaaaaaagaaaagagaaaaaaaagac

SEQ ID NO: 28085 - RNA, 64 nt, hsa
acaaucucaaaaaaaaaaaaaaaaaaaaaaaaaaaaaaaaaaaagaaaagagaaaaaaaagacu

SEQ ID NO: 28086 - RNA, 64 nt, hsa
caaucucaaaaaaaaaaaaaaaaaaaaaaaaaaaaaaaaaaaagaaaagagaaaaaaaagacua

SEQ ID NO: 28087 - RNA, 64 nt, hsa
aaucucaaaaaaaaaaaaaaaaaaaaaaaaaaaaaaaaaaaagaaaagagaaaaaaaagacuag

SEQ ID NO: 28088 - RNA, 64 nt, hsa
aaaaaaaaaaaaaaaaaaaaaaaaaagaaaagagaaaaaaaagacuagccagccaggaagauga

SEQ ID NO: 28089 - RNA, 64 nt, hsa
ccuaugagagaagagaguauggugcuggguccuuaaaaaaaaaaaugauacuugguccuuaaaa

SEQ ID NO: 28090 - RNA, 64 nt, hsa
cuaugagagaagagaguauggugcuggguccuuaaaaaaaaaaaugauacuugguccuuaaaaa

SEQ ID NO: 28091 - RNA, 64 nt, hsa
uaugagagaagagaguauggugcuggguccuuaaaaaaaaaaaugauacuugguccuuaaaaaa

SEQ ID NO: 28092 - RNA, 64 nt, hsa
augagagaagagaguauggugcuggguccuuaaaaaaaaaaaugauacuugguccuuaaaaaau

SEQ ID NO: 28093 - RNA, 64 nt, hsa
uucauauugcugcccaaaaguaugacuguggaggaaaaaaaaauacuuuaaaaauccacacuuu

SEQ ID NO: 28094 - RNA, 64 nt, hsa
ucauauugcugcccaaaaguaugacuguggaggaaaaaaaaauacuuuaaaaauccacacuuuu

SEQ ID NO: 28095 - RNA, 64 nt, hsa
uugugaugugcaauacuguuucuaauguuuguauaaaaaaaaacaguguaaaccuuuuuaaugc

SEQ ID NO: 28096 - RNA, 64 nt, hsa
ugugaugugcaauacuguuucuaauguuuguauaaaaaaaaacaguguaaaccuuuuuaaugca

SEQ ID NO: 28097 - RNA, 64 nt, hsa
ugcaagugcugauuugaaaugcagaagccacaguaaaaaaaaaaaaaaaaaaaaaaaaaaagaa

SEQ ID NO: 28098 - RNA, 64 nt, hsa
gcaagugcugauuugaaaugcagaagccacaguaaaaaaaaaaaaaaaaaaaaaaaaaaagaaa

SEQ ID NO: 28099 - RNA, 64 nt, hsa
caagugcugauuugaaaugcagaagccacaguaaaaaaaaaaaaaaaaaaaaaaaaaaagaaaa

SEQ ID NO: 28100 - RNA, 64 nt, hsa
aagugcugauuugaaaugcagaagccacaguaaaaaaaaaaaaaaaaaaaaaaaaaaagaaaaa

SEQ ID NO: 28101 - RNA, 64 nt, hsa
agugcugauuugaaaugcagaagccacaguaaaaaaaaaaaaaaaaaaaaaaaaaaagaaaaaa

SEQ ID NO: 28102 - RNA, 64 nt, hsa
gugcugauuugaaaugcagaagccacaguaaaaaaaaaaaaaaaaaaaaaaaaaaagaaaaaaa

SEQ ID NO: 28103 - RNA, 64 nt, hsa
ugcugauuugaaaugcagaagccacaguaaaaaaaaaaaaaaaaaaaaaaaaaaagaaaaaaaa

SEQ ID NO: 28104 - RNA, 64 nt, hsa
gcugauuugaaaugcagaagccacaguaaaaaaaaaaaaaaaaaaaaaaaaaaagaaaaaaaaa

SEQ ID NO: 28105 - RNA, 64 nt, hsa
cugauuugaaaugcagaagccacaguaaaaaaaaaaaaaaaaaaaaaaaaaaagaaaaaaaaau

SEQ ID NO: 28106 - RNA, 64 nt, hsa
ugauuugaaaugcagaagccacaguaaaaaaaaaaaaaaaaaaaaaaaaaaagaaaaaaaaauc

SEQ ID NO: 28107 - RNA, 64 nt, hsa
gauuugaaaugcagaagccacaguaaaaaaaaaaaaaaaaaaaaaaaaaaagaaaaaaaaauca

SEQ ID NO: 28108 - RNA, 64 nt, hsa
auuugaaaugcagaagccacaguaaaaaaaaaaaaaaaaaaaaaaaaaaagaaaaaaaaaucaa

SEQ ID NO: 28109 - RNA, 64 nt, hsa
uuugaaaugcagaagccacaguaaaaaaaaaaaaaaaaaaaaaaaaaaagaaaaaaaaaucaaa

SEQ ID NO: 28110 - RNA, 64 nt, hsa
uugaaaugcagaagccacaguaaaaaaaaaaaaaaaaaaaaaaaaaaagaaaaaaaaaucaaaa

SEQ ID NO: 28111 - RNA, 64 nt, hsa
ugaaaugcagaagccacaguaaaaaaaaaaaaaaaaaaaaaaaaaaagaaaaaaaaaucaaaau

SEQ ID NO: 28112 - RNA, 64 nt, hsa
gaaaugcagaagccacaguaaaaaaaaaaaaaaaaaaaaaaaaaaagaaaaaaaaaucaaaaug

SEQ ID NO: 28113 - RNA, 64 nt, hsa
aaaugcagaagccacaguaaaaaaaaaaaaaaaaaaaaaaaaaaagaaaaaaaaaucaaaaugu

SEQ ID NO: 28114 - RNA, 64 nt, hsa
aaugcagaagccacaguaaaaaaaaaaaaaaaaaaaaaaaaaaagaaaaaaaaaucaaaaugua

SEQ ID NO: 28115 - RNA, 64 nt, hsa
augcagaagccacaguaaaaaaaaaaaaaaaaaaaaaaaaaaagaaaaaaaaaucaaaauguau

SEQ ID NO: 28116 - RNA, 64 nt, hsa
ugcagaagccacaguaaaaaaaaaaaaaaaaaaaaaaaaaaagaaaaaaaaaucaaaauguaua

SEQ ID NO: 28117 - RNA, 64 nt, hsa
cacaguaaaaaaaaaaaaaaaaaaaaaaaaaaagaaaaaaaaaucaaaauguauaaauauugga

SEQ ID NO: 28118 - RNA, 64 nt, hsa
acaguaaaaaaaaaaaaaaaaaaaaaaaaaaagaaaaaaaaaucaaaauguauaaauauuggaa

SEQ ID NO: 28119 - RNA, 64 nt, hsa
uaaaacguaauugcacuacuguuuuccagacuggaaaaaaaaaaaaucucugcaagugaaacug

SEQ ID NO: 28120 - RNA, 64 nt, hsa
aaaacguaauugcacuacuguuuuccagacuggaaaaaaaaaaaaucucugcaagugaaacugu

SEQ ID NO: 28121 - RNA, 64 nt, hsa
aaacguaauugcacuacuguuuuccagacuggaaaaaaaaaaaaucucugcaagugaaacugua

SEQ ID NO: 28122 - RNA, 64 nt, hsa
aacguaauugcacuacuguuuuccagacuggaaaaaaaaaaaaucucugcaagugaaacuguau

SEQ ID NO: 28123 - RNA, 64 nt, hsa
acguaauugcacuacuguuuuccagacuggaaaaaaaaaaaaucucugcaagugaaacuguaua

SEQ ID NO: 28124 - RNA, 64 nt, hsa
ucucucucuuugguauuuaaggaaguuugucuuuaaaaaaaaaauagaguguuuucauacauuu

SEQ ID NO: 28125 - RNA, 64 nt, hsa
cucucucuuugguauuuaaggaaguuugucuuuaaaaaaaaaauagaguguuuucauacauuuu

SEQ ID NO: 28126 - RNA, 64 nt, hsa
ucucucuuugguauuuaaggaaguuugucuuuaaaaaaaaaauagaguguuuucauacauuuuu

SEQ ID NO: 28127 - RNA, 64 nt, hsa
auauucaggggugccccaagagucugggacuuucaaaaaaaaaagaucaggcugaaacugcagu

SEQ ID NO: 28128 - RNA, 64 nt, hsa
uauucaggggugccccaagagucugggacuuucaaaaaaaaaagaucaggcugaaacugcaguc

SEQ ID NO: 28129 - RNA, 64 nt, hsa
auucaggggugccccaagagucugggacuuucaaaaaaaaaagaucaggcugaaacugcaguca

SEQ ID NO: 28130 - RNA, 64 nt, hsa
uggacugcaguggaugugccccaccucuuugcuuaaaaaaaaaaaugucaauagccaggcauag

SEQ ID NO: 28131 - RNA, 64 nt, hsa
ggacugcaguggaugugccccaccucuuugcuuaaaaaaaaaaaugucaauagccaggcauagu

SEQ ID NO: 28132 - RNA, 64 nt, hsa
gacugcaguggaugugccccaccucuuugcuuaaaaaaaaaaaugucaauagccaggcauagug

SEQ ID NO: 28133 - RNA, 64 nt, hsa
acugcaguggaugugccccaccucuuugcuuaaaaaaaaaaaugucaauagccaggcauagugg

SEQ ID NO: 28134 - RNA, 64 nt, hsa
aagagcaaaacuccaucucaaauaaauaaaaaggaaaaaaaagucaauaaacuguacaaauuua

SEQ ID NO: 28135 - RNA, 64 nt, hsa
ccuaaugauguuaucuaggcaccauuggagacugaaaaaaaaaaaucccugcucuguaaauaaa

SEQ ID NO: 28136 - RNA, 64 nt, hsa
cuaaugauguuaucuaggcaccauuggagacugaaaaaaaaaaaucccugcucuguaaauaaag

SEQ ID NO: 28137 - RNA, 64 nt, hsa
uaaugauguuaucuaggcaccauuggagacugaaaaaaaaaaaucccugcucuguaaauaaagc

SEQ ID NO: 28138 - RNA, 64 nt, hsa
aaugauguuaucuaggcaccauuggagacugaaaaaaaaaaaucccugcucuguaaauaaagcu

SEQ ID NO: 28139 - RNA, 64 nt, hsa
uuacugcaccauguuuacuucaaaaagacaaaacaaaaaaaaaauuauuuuuccagucuaccgu

SEQ ID NO: 28140 - RNA, 64 nt, hsa
uacugcaccauguuuacuucaaaaagacaaaacaaaaaaaaaauuauuuuuccagucuaccgug

SEQ ID NO: 28141 - RNA, 64 nt, hsa
acugcaccauguuuacuucaaaaagacaaaacaaaaaaaaaauuauuuuuccagucuaccgugg

SEQ ID NO: 28142 - RNA, 64 nt, hsa
ccagccugggugacagaguaacacucugucucagaaaaaaaaaaaaagaaaaauauauggggua

SEQ ID NO: 28143 - RNA, 64 nt, hsa
cagccugggugacagaguaacacucugucucagaaaaaaaaaaaaagaaaaauauaugggguaa

SEQ ID NO: 28144 - RNA, 64 nt, hsa
agccugggugacagaguaacacucugucucagaaaaaaaaaaaaagaaaaauauaugggguaaa

SEQ ID NO: 28145 - RNA, 64 nt, hsa
gccugggugacagaguaacacucugucucagaaaaaaaaaaaaagaaaaauauaugggguaaau

SEQ ID NO: 28146 - RNA, 64 nt, hsa
ccugggugacagaguaacacucugucucagaaaaaaaaaaaaagaaaaauauaugggguaaaua

SEQ ID NO: 28147 - RNA, 64 nt, hsa
cugggugacagaguaacacucugucucagaaaaaaaaaaaaagaaaaauauaugggguaaauac

SEQ ID NO: 28148 - RNA, 64 nt, hsa
ugggcagcagagcaagacucugucucaaaaggggaaaaaaaaaauugcugaugugacccaugaa

SEQ ID NO: 28149 - RNA, 64 nt, hsa
gggcagcagagcaagacucugucucaaaaggggaaaaaaaaaauugcugaugugacccaugaag

SEQ ID NO: 28150 - RNA, 64 nt, hsa
ggcagcagagcaagacucugucucaaaaggggaaaaaaaaaauugcugaugugacccaugaagg

SEQ ID NO: 28151 - RNA, 64 nt, hsa
uuccuccagaauuugaguccuguuaauguaguagaaaaaaaaaaaagaaauuuucuuuuucuuu

SEQ ID NO: 28152 - RNA, 64 nt, hsa
uccuccagaauuugaguccuguuaauguaguagaaaaaaaaaaaagaaauuuucuuuuucuuuu

SEQ ID NO: 28153 - RNA, 64 nt, hsa
ccuccagaauuugaguccuguuaauguaguagaaaaaaaaaaaagaaauuuucuuuuucuuuug

SEQ ID NO: 28154 - RNA, 64 nt, hsa
cuccagaauuugaguccuguuaauguaguagaaaaaaaaaaaagaaauuuucuuuuucuuuugu

SEQ ID NO: 28155 - RNA, 64 nt, hsa
uccagaauuugaguccuguuaauguaguagaaaaaaaaaaaagaaauuuucuuuuucuuuugug

SEQ ID NO: 28156 - RNA, 64 nt, hsa
uuggaaggucaaauuauuuugaagugauuuuuuuaaaaaaaagucuucuguuuauuaacaggaa

SEQ ID NO: 28157 - RNA, 64 nt, hsa
agauugugaugcaagauuucuuucuuccugagacaaaaaaaaaaaaagaaaaaaaaaucuuuuc

SEQ ID NO: 28158 - RNA, 64 nt, hsa
gauugugaugcaagauuucuuucuuccugagacaaaaaaaaaaaaagaaaaaaaaaucuuuuca

SEQ ID NO: 28159 - RNA, 64 nt, hsa
auugugaugcaagauuucuuucuuccugagacaaaaaaaaaaaaagaaaaaaaaaucuuuucaa

SEQ ID NO: 28160 - RNA, 64 nt, hsa
uugugaugcaagauuucuuucuuccugagacaaaaaaaaaaaaagaaaaaaaaaucuuuucaaa

SEQ ID NO: 28161 - RNA, 64 nt, hsa
ugugaugcaagauuucuuucuuccugagacaaaaaaaaaaaaagaaaaaaaaaucuuuucaaaa

SEQ ID NO: 28162 - RNA, 64 nt, hsa
gugaugcaagauuucuuucuuccugagacaaaaaaaaaaaaagaaaaaaaaaucuuuucaaaau

SEQ ID NO: 28163 - RNA, 64 nt, hsa
gauuucuuucuuccugagacaaaaaaaaaaaaagaaaaaaaaaucuuuucaaaauuuacuuugu

SEQ ID NO: 28164 - RNA, 64 nt, hsa
auuucuuucuuccugagacaaaaaaaaaaaaagaaaaaaaaaucuuuucaaaauuuacuuuguc

SEQ ID NO: 28165 - RNA, 64 nt, hsa
agauuguuaugcaagauuucuuucuuccugugacaaaaaaaaaaacuuuucaaaaucuaccuug

SEQ ID NO: 28166 - RNA, 64 nt, hsa
gauuguuaugcaagauuucuuucuuccugugacaaaaaaaaaaacuuuucaaaaucuaccuugu

SEQ ID NO: 28167 - RNA, 64 nt, hsa
auuguuaugcaagauuucuuucuuccugugacaaaaaaaaaaacuuuucaaaaucuaccuuguc

SEQ ID NO: 28168 - RNA, 64 nt, hsa
uuguuaugcaagauuucuuucuuccugugacaaaaaaaaaaacuuuucaaaaucuaccuuguca

SEQ ID NO: 28169 - RNA, 64 nt, hsa
uugcuugcaacuuuuuuugccuuggugacuuuugaaaaaaaaagaaaagaaaaagcagcauccu

SEQ ID NO: 28170 - RNA, 64 nt, hsa
ugcuugcaacuuuuuuugccuuggugacuuuugaaaaaaaaagaaaagaaaaagcagcauccuu

SEQ ID NO: 28171 - RNA, 64 nt, hsa
aucaucuaauggcuguaaacuguaguacuagaauaaaaaaaauggaaaaucagcuuuuccucug

SEQ ID NO: 28172 - RNA, 64 nt, hsa
ggcaggaagguaaugguuugaguagccuuuguuuaaaaaaaagacuaaauauauuuaaaaggcc

SEQ ID NO: 28173 - RNA, 64 nt, hsa
gcauuccaaccugggugaugaagugagacucuccaaaaaaaaaaaagaaauuauuaaucccugc

SEQ ID NO: 28174 - RNA, 64 nt, hsa
cauuccaaccugggugaugaagugagacucuccaaaaaaaaaaaagaaauuauuaaucccugcc

SEQ ID NO: 28175 - RNA, 64 nt, hsa
auuccaaccugggugaugaagugagacucuccaaaaaaaaaaaagaaauuauuaaucccugccu

SEQ ID NO: 28176 - RNA, 64 nt, hsa
uuccaaccugggugaugaagugagacucuccaaaaaaaaaaaagaaauuauuaaucccugccug

SEQ ID NO: 28177 - RNA, 64 nt, hsa
uccaaccugggugaugaagugagacucuccaaaaaaaaaaaagaaauuauuaaucccugccugu

SEQ ID NO: 28178 - RNA, 64 nt, hsa
uagacaacauagugagacuuggucucuaaaaaagaaaaaaaaaaauaaaacugauguaaugaau

SEQ ID NO: 28179 - RNA, 64 nt, hsa
agacaacauagugagacuuggucucuaaaaaagaaaaaaaaaaauaaaacugauguaaugaaua

SEQ ID NO: 28180 - RNA, 64 nt, hsa
gacaacauagugagacuuggucucuaaaaaagaaaaaaaaaaauaaaacugauguaaugaauau

SEQ ID NO: 28181 - RNA, 64 nt, hsa
acaacauagugagacuuggucucuaaaaaagaaaaaaaaaaauaaaacugauguaaugaauaua

SEQ ID NO: 28182 - RNA, 64 nt, hsa
uaaaauucuauuaaaggcuauaauguuuuuaagcaaaaaaaaaucauuacagaucuaugaaaua

SEQ ID NO: 28183 - RNA, 64 nt, hsa
aaaauucuauuaaaggcuauaauguuuuuaagcaaaaaaaaaucauuacagaucuaugaaauag

SEQ ID NO: 28184 - RNA, 64 nt, hsa
auauaagaaaucuagguguaaauauugaguacagaaaaaaaaucuucaugauguguauugagcg

SEQ ID NO: 28185 - RNA, 64 nt, hsa
cucacccaaauuuauggggagaaaucuauuucucaaaaaaaaaaaucuucuuuuacagaaaugu

SEQ ID NO: 28186 - RNA, 64 nt, hsa
ucacccaaauuuauggggagaaaucuauuucucaaaaaaaaaaaucuucuuuuacagaaauguu

SEQ ID NO: 28187 - RNA, 64 nt, hsa
cacccaaauuuauggggagaaaucuauuucucaaaaaaaaaaaucuucuuuuacagaaauguug

SEQ ID NO: 28188 - RNA, 64 nt, hsa
acccaaauuuauggggagaaaucuauuucucaaaaaaaaaaaucuucuuuuacagaaauguuga

SEQ ID NO: 28189 - RNA, 64 nt, hsa
cuuaaauuuuaucaauaacagaauuauuguauuuaaaaaaaaacuaauacuuaucuuuaaaaua

SEQ ID NO: 28190 - RNA, 64 nt, hsa
uuaaauuuuaucaauaacagaauuauuguauuuaaaaaaaaacuaauacuuaucuuuaaaauag

SEQ ID NO: 28191 - RNA, 64 nt, hsa
uccagccugggugacagagugagacucugucuccaaaaaaaaacuuugcuuguauauuauuuuu

SEQ ID NO: 28192 - RNA, 64 nt, hsa
ccagccugggugacagagugagacucugucuccaaaaaaaaacuuugcuuguauauuauuuuug

SEQ ID NO: 28193 - RNA, 64 nt, hsa
uccagccuggugacagagcaagacuccggcucuuaaaaaaaaaaaaaaaaaaaaaaaaagagag

SEQ ID NO: 28194 - RNA, 64 nt, hsa
ccagccuggugacagagcaagacuccggcucuuaaaaaaaaaaaaaaaaaaaaaaaaagagaga

SEQ ID NO: 28195 - RNA, 64 nt, hsa
cagccuggugacagagcaagacuccggcucuuaaaaaaaaaaaaaaaaaaaaaaaaagagagag

SEQ ID NO: 28196 - RNA, 64 nt, hsa
agccuggugacagagcaagacuccggcucuuaaaaaaaaaaaaaaaaaaaaaaaaagagagaga

SEQ ID NO: 28197 - RNA, 64 nt, hsa
gccuggugacagagcaagacuccggcucuuaaaaaaaaaaaaaaaaaaaaaaaaagagagagag

SEQ ID NO: 28198 - RNA, 64 nt, hsa
ccuggugacagagcaagacuccggcucuuaaaaaaaaaaaaaaaaaaaaaaaaagagagagaga

SEQ ID NO: 28199 - RNA, 64 nt, hsa
cuggugacagagcaagacuccggcucuuaaaaaaaaaaaaaaaaaaaaaaaaagagagagagag

SEQ ID NO: 28200 - RNA, 64 nt, hsa
uggugacagagcaagacuccggcucuuaaaaaaaaaaaaaaaaaaaaaaaaagagagagagaga

SEQ ID NO: 28201 - RNA, 64 nt, hsa
ggugacagagcaagacuccggcucuuaaaaaaaaaaaaaaaaaaaaaaaaagagagagagagaa

SEQ ID NO: 28202 - RNA, 64 nt, hsa
gugacagagcaagacuccggcucuuaaaaaaaaaaaaaaaaaaaaaaaaagagagagagagaau

SEQ ID NO: 28203 - RNA, 64 nt, hsa
ugacagagcaagacuccggcucuuaaaaaaaaaaaaaaaaaaaaaaaaagagagagagagaaua

SEQ ID NO: 28204 - RNA, 64 nt, hsa
gacagagcaagacuccggcucuuaaaaaaaaaaaaaaaaaaaaaaaaagagagagagagaauaa

SEQ ID NO: 28205 - RNA, 64 nt, hsa
acagagcaagacuccggcucuuaaaaaaaaaaaaaaaaaaaaaaaaagagagagagagaauaaa

SEQ ID NO: 28206 - RNA, 64 nt, hsa
cagagcaagacuccggcucuuaaaaaaaaaaaaaaaaaaaaaaaaagagagagagagaauaaau

SEQ ID NO: 28207 - RNA, 64 nt, hsa
agagcaagacuccggcucuuaaaaaaaaaaaaaaaaaaaaaaaaagagagagagagaauaaaua

SEQ ID NO: 28208 - RNA, 64 nt, hsa
gagcaagacuccggcucuuaaaaaaaaaaaaaaaaaaaaaaaaagagagagagagaauaaauag

SEQ ID NO: 28209 - RNA, 64 nt, hsa
agcaagacuccggcucuuaaaaaaaaaaaaaaaaaaaaaaaaagagagagagagaauaaauaga

SEQ ID NO: 28210 - RNA, 64 nt, hsa
gcaagacuccggcucuuaaaaaaaaaaaaaaaaaaaaaaaaagagagagagagaauaaauagaa

SEQ ID NO: 28211 - RNA, 64 nt, hsa
augacgggaaaaccaaacacguucccuaaucaggaaaaaaaaaaaaaaaaaaaguaagacacaa

SEQ ID NO: 28212 - RNA, 64 nt, hsa
ugacgggaaaaccaaacacguucccuaaucaggaaaaaaaaaaaaaaaaaaaguaagacacaaa

SEQ ID NO: 28213 - RNA, 64 nt, hsa
gacgggaaaaccaaacacguucccuaaucaggaaaaaaaaaaaaaaaaaaaguaagacacaaac

SEQ ID NO: 28214 - RNA, 64 nt, hsa
acgggaaaaccaaacacguucccuaaucaggaaaaaaaaaaaaaaaaaaaguaagacacaaaca

SEQ ID NO: 28215 - RNA, 64 nt, hsa
cgggaaaaccaaacacguucccuaaucaggaaaaaaaaaaaaaaaaaaaguaagacacaaacaa

SEQ ID NO: 28216 - RNA, 64 nt, hsa
gggaaaaccaaacacguucccuaaucaggaaaaaaaaaaaaaaaaaaaguaagacacaaacaaa

SEQ ID NO: 28217 - RNA, 64 nt, hsa
ggaaaaccaaacacguucccuaaucaggaaaaaaaaaaaaaaaaaaaguaagacacaaacaaac

SEQ ID NO: 28218 - RNA, 64 nt, hsa
gaaaaccaaacacguucccuaaucaggaaaaaaaaaaaaaaaaaaaguaagacacaaacaaacc

SEQ ID NO: 28219 - RNA, 64 nt, hsa
aaaaccaaacacguucccuaaucaggaaaaaaaaaaaaaaaaaaaguaagacacaaacaaacca

SEQ ID NO: 28220 - RNA, 64 nt, hsa
aaaccaaacacguucccuaaucaggaaaaaaaaaaaaaaaaaaaguaagacacaaacaaaccau

SEQ ID NO: 28221 - RNA, 64 nt, hsa
aaccaaacacguucccuaaucaggaaaaaaaaaaaaaaaaaaaguaagacacaaacaaaccauu

SEQ ID NO: 28222 - RNA, 64 nt, hsa
accaaacacguucccuaaucaggaaaaaaaaaaaaaaaaaaaguaagacacaaacaaaccauuu

SEQ ID NO: 28223 - RNA, 64 nt, hsa
gagguuuuuuuuuuuaauuuuucccccuuuauacaaaaaaaaaagaacauuuccaaaacuaaaa

SEQ ID NO: 28224 - RNA, 64 nt, hsa
agguuuuuuuuuuuaauuuuucccccuuuauacaaaaaaaaaagaacauuuccaaaacuaaaau

SEQ ID NO: 28225 - RNA, 64 nt, hsa
gguuuuuuuuuuuaauuuuucccccuuuauacaaaaaaaaaagaacauuuccaaaacuaaaaua

SEQ ID NO: 28226 - RNA, 64 nt, hsa
uccgucccaaaaaaacaaacaaacaaaacaaaacaaaaaaaaacagaaguuacaaaugaauacu

SEQ ID NO: 28227 - RNA, 64 nt, hsa
ccgucccaaaaaaacaaacaaacaaaacaaaacaaaaaaaaacagaaguuacaaaugaauacuc

SEQ ID NO: 28228 - RNA, 64 nt, hsa
auuuuaaaaugagagucacuugaugugccauuuuaaaaaaaaaggcauauugcuuuuucuaaug

SEQ ID NO: 28229 - RNA, 64 nt, hsa
uuuuaaaaugagagucacuugaugugccauuuuaaaaaaaaaggcauauugcuuuuucuaaugu

SEQ ID NO: 28230 - RNA, 64 nt, hsa
ugcuuuuucuaaugugguuauuucucugauuugcaaaaaaaaaaaaaaaaaaaaaauacuuguc

SEQ ID NO: 28231 - RNA, 64 nt, hsa
gcuuuuucuaaugugguuauuucucugauuugcaaaaaaaaaaaaaaaaaaaaaauacuuguca

SEQ ID NO: 28232 - RNA, 64 nt, hsa
cuuuuucuaaugugguuauuucucugauuugcaaaaaaaaaaaaaaaaaaaaaauacuugucaa

SEQ ID NO: 28233 - RNA, 64 nt, hsa
uuuuucuaaugugguuauuucucugauuugcaaaaaaaaaaaaaaaaaaaaaauacuugucaau

SEQ ID NO: 28234 - RNA, 64 nt, hsa
uuuucuaaugugguuauuucucugauuugcaaaaaaaaaaaaaaaaaaaaaauacuugucaaua

SEQ ID NO: 28235 - RNA, 64 nt, hsa
uuucuaaugugguuauuucucugauuugcaaaaaaaaaaaaaaaaaaaaaauacuugucaauau

SEQ ID NO: 28236 - RNA, 64 nt, hsa
uucuaaugugguuauuucucugauuugcaaaaaaaaaaaaaaaaaaaaaauacuugucaauauu

SEQ ID NO: 28237 - RNA, 64 nt, hsa
ucuaaugugguuauuucucugauuugcaaaaaaaaaaaaaaaaaaaaaauacuugucaauauuu

SEQ ID NO: 28238 - RNA, 64 nt, hsa
cuaaugugguuauuucucugauuugcaaaaaaaaaaaaaaaaaaaaaauacuugucaauauuua

SEQ ID NO: 28239 - RNA, 64 nt, hsa
uaaugugguuauuucucugauuugcaaaaaaaaaaaaaaaaaaaaaauacuugucaauauuuaa

SEQ ID NO: 28240 - RNA, 64 nt, hsa
aaugugguuauuucucugauuugcaaaaaaaaaaaaaaaaaaaaaauacuugucaauauuuaaa

SEQ ID NO: 28241 - RNA, 64 nt, hsa
augugguuauuucucugauuugcaaaaaaaaaaaaaaaaaaaaaauacuugucaauauuuaaac

SEQ ID NO: 28242 - RNA, 64 nt, hsa
ugugguuauuucucugauuugcaaaaaaaaaaaaaaaaaaaaaauacuugucaauauuuaaaca

SEQ ID NO: 28243 - RNA, 64 nt, hsa
gugguuauuucucugauuugcaaaaaaaaaaaaaaaaaaaaaauacuugucaauauuuaaacau

SEQ ID NO: 28244 - RNA, 64 nt, hsa
ugguuauuucucugauuugcaaaaaaaaaaaaaaaaaaaaaauacuugucaauauuuaaacaug

SEQ ID NO: 28245 - RNA, 64 nt, hsa
gaauauaucuaugagggcauguauuaguuaauggaaaaaaaaauacaacacuaacaauacauag

SEQ ID NO: 28246 - RNA, 64 nt, hsa
aauauaucuaugagggcauguauuaguuaauggaaaaaaaaauacaacacuaacaauacauagc

SEQ ID NO: 28247 - RNA, 64 nt, hsa
agaagaacggaucaugugccaacuguaguuuuuuaaaaaaaacgcuccuuuguaggguuuuaaa

SEQ ID NO: 28248 - RNA, 64 nt, hsa
gggugcaagugaccaaggccuuaucuugaaaguuaaaaaaaaaaaguaaagaaaucacaguaag

SEQ ID NO: 28249 - RNA, 64 nt, hsa
ggugcaagugaccaaggccuuaucuugaaaguuaaaaaaaaaaaguaaagaaaucacaguaagu

SEQ ID NO: 28250 - RNA, 64 nt, hsa
gugcaagugaccaaggccuuaucuugaaaguuaaaaaaaaaaaguaaagaaaucacaguaaguu

SEQ ID NO: 28251 - RNA, 64 nt, hsa
ugcaagugaccaaggccuuaucuugaaaguuaaaaaaaaaaaguaaagaaaucacaguaaguuc

SEQ ID NO: 28252 - RNA, 64 nt, hsa
gggccaaccuauuagggcucaaguauguauaugcaaaaaaaaaaaguuauaucaaacaggcaca

SEQ ID NO: 28253 - RNA, 64 nt, hsa
ggccaaccuauuagggcucaaguauguauaugcaaaaaaaaaaaguuauaucaaacaggcacag

SEQ ID NO: 28254 - RNA, 64 nt, hsa
gccaaccuauuagggcucaaguauguauaugcaaaaaaaaaaaguuauaucaaacaggcacagu

SEQ ID NO: 28255 - RNA, 64 nt, hsa
ccaaccuauuagggcucaaguauguauaugcaaaaaaaaaaaguuauaucaaacaggcacaguu

SEQ ID NO: 28256 - RNA, 64 nt, hsa
augaaaauaccaaguugcaacauuacauguuuacaaaaaaaaaucuguguuuguaguguggaag

SEQ ID NO: 28257 - RNA, 64 nt, hsa
ugaaaauaccaaguugcaacauuacauguuuacaaaaaaaaaucuguguuuguaguguggaagu

SEQ ID NO: 28258 - RNA, 64 nt, hsa
uucuugacacauuuauuaacaaaaugcaucauggaaaaaaaaaucuaccucuuaaaauuccauu

SEQ ID NO: 28259 - RNA, 64 nt, hsa
ucuugacacauuuauuaacaaaaugcaucauggaaaaaaaaaucuaccucuuaaaauuccauuu

SEQ ID NO: 28260 - RNA, 64 nt, hsa
uagcauucuuuauaaaagaauugaugcuagagguaaaaaaaaauacuuguuuuuaaaaaauccu

SEQ ID NO: 28261 - RNA, 64 nt, hsa
agcauucuuuauaaaagaauugaugcuagagguaaaaaaaaauacuuguuuuuaaaaaauccuu

SEQ ID NO: 28262 - RNA, 64 nt, hsa
auuccaaugggcauuuauuuuuuauccugucauuaaaaaaaaaagacuguuauccugcuacaca

SEQ ID NO: 28263 - RNA, 64 nt, hsa
uuccaaugggcauuuauuuuuuauccugucauuaaaaaaaaaagacuguuauccugcuacacac

SEQ ID NO: 28264 - RNA, 64 nt, hsa
uccaaugggcauuuauuuuuuauccugucauuaaaaaaaaaagacuguuauccugcuacacacu

SEQ ID NO: 28265 - RNA, 64 nt, hsa
ugaaacaguacugugcaauccgauggaucuaauuaaaaaaaaggcaauauuuuuauauuaaagu

SEQ ID NO: 28266 - RNA, 64 nt, hsa
ucugugaccaacuguuggauucagaaauuuaaacaaaaaaaaaaaaaaacacacacaccuuggu

SEQ ID NO: 28267 - RNA, 64 nt, hsa
cugugaccaacuguuggauucagaaauuuaaacaaaaaaaaaaaaaaacacacacaccuuggua

SEQ ID NO: 28268 - RNA, 64 nt, hsa
ugugaccaacuguuggauucagaaauuuaaacaaaaaaaaaaaaaaacacacacaccuugguaa

SEQ ID NO: 28269 - RNA, 64 nt, hsa
gugaccaacuguuggauucagaaauuuaaacaaaaaaaaaaaaaaacacacacaccuugguaac

SEQ ID NO: 28270 - RNA, 64 nt, hsa
ugaccaacuguuggauucagaaauuuaaacaaaaaaaaaaaaaaacacacacaccuugguaaca

SEQ ID NO: 28271 - RNA, 64 nt, hsa
gaccaacuguuggauucagaaauuuaaacaaaaaaaaaaaaaaacacacacaccuugguaacau

SEQ ID NO: 28272 - RNA, 64 nt, hsa
accaacuguuggauucagaaauuuaaacaaaaaaaaaaaaaaacacacacaccuugguaacaua

SEQ ID NO: 28273 - RNA, 64 nt, hsa
ccaacuguuggauucagaaauuuaaacaaaaaaaaaaaaaaacacacacaccuugguaacauac

SEQ ID NO: 28274 - RNA, 64 nt, hsa
acaugauuauuugaacuuauuuacacauaguuugaaaaaaaaaagacaaaaauaguauucaggu

SEQ ID NO: 28275 - RNA, 64 nt, hsa
caugauuauuugaacuuauuuacacauaguuugaaaaaaaaaagacaaaaauaguauucaggug

SEQ ID NO: 28276 - RNA, 64 nt, hsa
augauuauuugaacuuauuuacacauaguuugaaaaaaaaaagacaaaaauaguauucagguga

SEQ ID NO: 28277 - RNA, 64 nt, hsa
auuucuugauuagaggcacagugaaaaagaagucaaaaaaaaaaguucuacuuuucaucagugc

SEQ ID NO: 28278 - RNA, 64 nt, hsa
uuucuugauuagaggcacagugaaaaagaagucaaaaaaaaaaguucuacuuuucaucagugcu

SEQ ID NO: 28279 - RNA, 64 nt, hsa
uucuugauuagaggcacagugaaaaagaagucaaaaaaaaaaguucuacuuuucaucagugcua

SEQ ID NO: 28280 - RNA, 64 nt, hsa
acuuauccaauuucuguauuucaccuuuaggguuaaaaaaaacucuucuacugaaucuauaaaa

SEQ ID NO: 28281 - RNA, 64 nt, hsa
ggcuuuuagucagaaaauggccuucugugcuuucaaaaaaaaaaacaaaaaaaaaaccacacac

SEQ ID NO: 28282 - RNA, 64 nt, hsa
gcuuuuagucagaaaauggccuucugugcuuucaaaaaaaaaaacaaaaaaaaaaccacacaca

SEQ ID NO: 28283 - RNA, 64 nt, hsa
cuuuuagucagaaaauggccuucugugcuuucaaaaaaaaaaacaaaaaaaaaaccacacacac

SEQ ID NO: 28284 - RNA, 64 nt, hsa
uuuuagucagaaaauggccuucugugcuuucaaaaaaaaaaacaaaaaaaaaaccacacacaca

SEQ ID NO: 28285 - RNA, 64 nt, hsa
gaaaauggccuucugugcuuucaaaaaaaaaaacaaaaaaaaaaccacacacacacauaaaaaa

SEQ ID NO: 28286 - RNA, 64 nt, hsa
aaaauggccuucugugcuuucaaaaaaaaaaacaaaaaaaaaaccacacacacacauaaaaaac

SEQ ID NO: 28287 - RNA, 64 nt, hsa
aaauggccuucugugcuuucaaaaaaaaaaacaaaaaaaaaaccacacacacacauaaaaaacc

SEQ ID NO: 28288 - RNA, 64 nt, hsa
cuccagccugggcaacaaagugagacuccaucucaaaaaaaaaaaaaaaaaaaaaaaaaaaaaa

SEQ ID NO: 28289 - RNA, 64 nt, hsa
uccagccugggcaacaaagugagacuccaucucaaaaaaaaaaaaaaaaaaaaaaaaaaaaaaa

SEQ ID NO: 28290 - RNA, 64 nt, hsa
ccagccugggcaacaaagugagacuccaucucaaaaaaaaaaaaaaaaaaaaaaaaaaaaaaag

SEQ ID NO: 28291 - RNA, 64 nt, hsa
cagccugggcaacaaagugagacuccaucucaaaaaaaaaaaaaaaaaaaaaaaaaaaaaaaga

SEQ ID NO: 28292 - RNA, 64 nt, hsa
agccugggcaacaaagugagacuccaucucaaaaaaaaaaaaaaaaaaaaaaaaaaaaaaagaa

SEQ ID NO: 28293 - RNA, 64 nt, hsa
gccugggcaacaaagugagacuccaucucaaaaaaaaaaaaaaaaaaaaaaaaaaaaaaagaag

SEQ ID NO: 28294 - RNA, 64 nt, hsa
ccugggcaacaaagugagacuccaucucaaaaaaaaaaaaaaaaaaaaaaaaaaaaaaagaaga

SEQ ID NO: 28295 - RNA, 64 nt, hsa
cugggcaacaaagugagacuccaucucaaaaaaaaaaaaaaaaaaaaaaaaaaaaaaagaagaa

SEQ ID NO: 28296 - RNA, 64 nt, hsa
ugggcaacaaagugagacuccaucucaaaaaaaaaaaaaaaaaaaaaaaaaaaaaaagaagaag

SEQ ID NO: 28297 - RNA, 64 nt, hsa
gggcaacaaagugagacuccaucucaaaaaaaaaaaaaaaaaaaaaaaaaaaaaaagaagaaga

SEQ ID NO: 28298 - RNA, 64 nt, hsa
ggcaacaaagugagacuccaucucaaaaaaaaaaaaaaaaaaaaaaaaaaaaaaagaagaagaa

SEQ ID NO: 28299 - RNA, 64 nt, hsa
gcaacaaagugagacuccaucucaaaaaaaaaaaaaaaaaaaaaaaaaaaaaaagaagaagaaa

SEQ ID NO: 28300 - RNA, 64 nt, hsa
caacaaagugagacuccaucucaaaaaaaaaaaaaaaaaaaaaaaaaaaaaaagaagaagaaac

SEQ ID NO: 28301 - RNA, 64 nt, hsa
aacaaagugagacuccaucucaaaaaaaaaaaaaaaaaaaaaaaaaaaaaaagaagaagaaacc

SEQ ID NO: 28302 - RNA, 64 nt, hsa
acaaagugagacuccaucucaaaaaaaaaaaaaaaaaaaaaaaaaaaaaaagaagaagaaaccc

SEQ ID NO: 28303 - RNA, 64 nt, hsa
caaagugagacuccaucucaaaaaaaaaaaaaaaaaaaaaaaaaaaaaaagaagaagaaacccu

SEQ ID NO: 28304 - RNA, 64 nt, hsa
aaagugagacuccaucucaaaaaaaaaaaaaaaaaaaaaaaaaaaaaaagaagaagaaacccug

SEQ ID NO: 28305 - RNA, 64 nt, hsa
aagugagacuccaucucaaaaaaaaaaaaaaaaaaaaaaaaaaaaaaagaagaagaaacccuga

SEQ ID NO: 28306 - RNA, 64 nt, hsa
agugagacuccaucucaaaaaaaaaaaaaaaaaaaaaaaaaaaaaaagaagaagaaacccugag

SEQ ID NO: 28307 - RNA, 64 nt, hsa
gugagacuccaucucaaaaaaaaaaaaaaaaaaaaaaaaaaaaaaagaagaagaaacccugagc

SEQ ID NO: 28308 - RNA, 64 nt, hsa
ugagacuccaucucaaaaaaaaaaaaaaaaaaaaaaaaaaaaaaagaagaagaaacccugagcc

SEQ ID NO: 28309 - RNA, 64 nt, hsa
gagacuccaucucaaaaaaaaaaaaaaaaaaaaaaaaaaaaaaagaagaagaaacccugagcca

SEQ ID NO: 28310 - RNA, 64 nt, hsa
agacuccaucucaaaaaaaaaaaaaaaaaaaaaaaaaaaaaaagaagaagaaacccugagccau

SEQ ID NO: 28311 - RNA, 64 nt, hsa
gacuccaucucaaaaaaaaaaaaaaaaaaaaaaaaaaaaaaagaagaagaaacccugagccauu

SEQ ID NO: 28312 - RNA, 64 nt, hsa
cauuuuaaaggacuagcuaagaugcucaaucucuaaaaaaaaaaggaucuguauucgugagagu

SEQ ID NO: 28313 - RNA, 64 nt, hsa
auuuuaaaggacuagcuaagaugcucaaucucuaaaaaaaaaaggaucuguauucgugagagua

SEQ ID NO: 28314 - RNA, 64 nt, hsa
uuuuaaaggacuagcuaagaugcucaaucucuaaaaaaaaaaggaucuguauucgugagaguag

SEQ ID NO: 28315 - RNA, 64 nt, hsa
guauguacucacuucaguacuucagcucuucaagaaaaaaaaaaaaaaccuuaaaaagcuacuu

SEQ ID NO: 28316 - RNA, 64 nt, hsa
uauguacucacuucaguacuucagcucuucaagaaaaaaaaaaaaaaccuuaaaaagcuacuuu

SEQ ID NO: 28317 - RNA, 64 nt, hsa
auguacucacuucaguacuucagcucuucaagaaaaaaaaaaaaaaccuuaaaaagcuacuuuu

SEQ ID NO: 28318 - RNA, 64 nt, hsa
uguacucacuucaguacuucagcucuucaagaaaaaaaaaaaaaaccuuaaaaagcuacuuuug

SEQ ID NO: 28319 - RNA, 64 nt, hsa
guacucacuucaguacuucagcucuucaagaaaaaaaaaaaaaaccuuaaaaagcuacuuuugu

SEQ ID NO: 28320 - RNA, 64 nt, hsa
uacucacuucaguacuucagcucuucaagaaaaaaaaaaaaaaccuuaaaaagcuacuuuugug

SEQ ID NO: 28321 - RNA, 64 nt, hsa
acucacuucaguacuucagcucuucaagaaaaaaaaaaaaaaccuuaaaaagcuacuuuugugg

SEQ ID NO: 28322 - RNA, 64 nt, hsa
uggcccagaauugcauucugaaugaauaaagguuaaaaaaaaauccccagugcauguauuucag

SEQ ID NO: 28323 - RNA, 64 nt, hsa
ggcccagaauugcauucugaaugaauaaagguuaaaaaaaaauccccagugcauguauuucagu

SEQ ID NO: 28324 - RNA, 64 nt, hsa
aaaggcagaaacauaccuuugacuauaagaaauuaaaaaaaaaacaccaaaauaauauuuuucu

SEQ ID NO: 28325 - RNA, 64 nt, hsa
aaggcagaaacauaccuuugacuauaagaaauuaaaaaaaaaacaccaaaauaauauuuuucuu

SEQ ID NO: 28326 - RNA, 64 nt, hsa
aggcagaaacauaccuuugacuauaagaaauuaaaaaaaaaacaccaaaauaauauuuuucuua

SEQ ID NO: 28327 - RNA, 64 nt, hsa
uagcauuauuuugccaccuuuauauuguauuuauaaaaaaaaaaguacuaucaaucaaucauac

SEQ ID NO: 28328 - RNA, 64 nt, hsa
agcauuauuuugccaccuuuauauuguauuuauaaaaaaaaaaguacuaucaaucaaucauacu

SEQ ID NO: 28329 - RNA, 64 nt, hsa
gcauuauuuugccaccuuuauauuguauuuauaaaaaaaaaaguacuaucaaucaaucauacua

SEQ ID NO: 28330 - RNA, 64 nt, hsa
auccagaagauuaaaaugccuacauugagugcuuaaaaaaaaaaaaacaacugugaugauguga

SEQ ID NO: 28331 - RNA, 64 nt, hsa
uccagaagauuaaaaugccuacauugagugcuuaaaaaaaaaaaaacaacugugaugaugugag

SEQ ID NO: 28332 - RNA, 64 nt, hsa
ccagaagauuaaaaugccuacauugagugcuuaaaaaaaaaaaaacaacugugaugaugugagc

SEQ ID NO: 28333 - RNA, 64 nt, hsa
cagaagauuaaaaugccuacauugagugcuuaaaaaaaaaaaaacaacugugaugaugugagca

SEQ ID NO: 28334 - RNA, 64 nt, hsa
agaagauuaaaaugccuacauugagugcuuaaaaaaaaaaaaacaacugugaugaugugagcag

SEQ ID NO: 28335 - RNA, 64 nt, hsa
gaagauuaaaaugccuacauugagugcuuaaaaaaaaaaaaacaacugugaugaugugagcaga

SEQ ID NO: 28336 - RNA, 64 nt, hsa
uauuaauaaauggauacacauucaaaauacuuuuaaaaaaaagaaaauguuaccaguuuuuuua

SEQ ID NO: 28337 - RNA, 64 nt, hsa
aaaaagacauuacaggcuuaaauuccauuuuauuaaaaaaaaaaaauugccuguaaucccagca

SEQ ID NO: 28338 - RNA, 64 nt, hsa
aaaagacauuacaggcuuaaauuccauuuuauuaaaaaaaaaaaauugccuguaaucccagcac

SEQ ID NO: 28339 - RNA, 64 nt, hsa
aaagacauuacaggcuuaaauuccauuuuauuaaaaaaaaaaaauugccuguaaucccagcacu

SEQ ID NO: 28340 - RNA, 64 nt, hsa
aagacauuacaggcuuaaauuccauuuuauuaaaaaaaaaaaauugccuguaaucccagcacuu

SEQ ID NO: 28341 - RNA, 64 nt, hsa
agacauuacaggcuuaaauuccauuuuauuaaaaaaaaaaaauugccuguaaucccagcacuuc

SEQ ID NO: 28342 - RNA, 64 nt, hsa
gcuucagcuggcagagaggcuuucccagaaaaaaaaaaaaaaccauuuuuaaaaagaagaaagc

SEQ ID NO: 28343 - RNA, 64 nt, hsa
agcuucagcuggcagagaggcuuucccagaaaaaaaaaaaaaaccauuuuuaaaaagaagaaag

SEQ ID NO: 28344 - RNA, 64 nt, hsa
cagcuucagcuggcagagaggcuuucccagaaaaaaaaaaaaaaccauuuuuaaaaagaagaaa

SEQ ID NO: 28345 - RNA, 64 nt, hsa
gcagcuucagcuggcagagaggcuuucccagaaaaaaaaaaaaaaccauuuuuaaaaagaagaa

SEQ ID NO: 28346 - RNA, 64 nt, hsa
ggcagcuucagcuggcagagaggcuuucccagaaaaaaaaaaaaaaccauuuuuaaaaagaaga

SEQ ID NO: 28347 - RNA, 64 nt, hsa
cggcagcuucagcuggcagagaggcuuucccagaaaaaaaaaaaaaaccauuuuuaaaaagaag

SEQ ID NO: 28348 - RNA, 64 nt, hsa
gcggcagcuucagcuggcagagaggcuuucccagaaaaaaaaaaaaaaccauuuuuaaaaagaa

SEQ ID NO: 28349 - RNA, 64 nt, hsa
uuuaggauauaggcaaauacaguaaaaguuaaaaaaaaaaaaccugacccaaaguauacucuga

SEQ ID NO: 28350 - RNA, 64 nt, hsa
auuuaggauauaggcaaauacaguaaaaguuaaaaaaaaaaaaccugacccaaaguauacucug

SEQ ID NO: 28351 - RNA, 64 nt, hsa
uauuuaggauauaggcaaauacaguaaaaguuaaaaaaaaaaaaccugacccaaaguauacucu

SEQ ID NO: 28352 - RNA, 64 nt, hsa
auauuuaggauauaggcaaauacaguaaaaguuaaaaaaaaaaaaccugacccaaaguauacuc

SEQ ID NO: 28353 - RNA, 64 nt, hsa
uauauuuaggauauaggcaaauacaguaaaaguuaaaaaaaaaaaaccugacccaaaguauacu

SEQ ID NO: 28354 - RNA, 64 nt, hsa
cuauaugaaggaacuaaacuauuucacugaaaaaaaaaaaaagauuuuuucuggagacgcuaug

SEQ ID NO: 28355 - RNA, 64 nt, hsa
ucuauaugaaggaacuaaacuauuucacugaaaaaaaaaaaaagauuuuuucuggagacgcuau

SEQ ID NO: 28356 - RNA, 64 nt, hsa
cucuauaugaaggaacuaaacuauuucacugaaaaaaaaaaaaagauuuuuucuggagacgcua

SEQ ID NO: 28357 - RNA, 64 nt, hsa
ucucuauaugaaggaacuaaacuauuucacugaaaaaaaaaaaaagauuuuuucuggagacgcu

SEQ ID NO: 28358 - RNA, 64 nt, hsa
gucucuauaugaaggaacuaaacuauuucacugaaaaaaaaaaaaagauuuuuucuggagacgc

SEQ ID NO: 28359 - RNA, 64 nt, hsa
ugucucuauaugaaggaacuaaacuauuucacugaaaaaaaaaaaaagauuuuuucuggagacg

SEQ ID NO: 28360 - RNA, 64 nt, hsa
uuggauaagaugggacagcacuuauaaugaaauaaaaaaaaacuuugagccccucucauuccac

SEQ ID NO: 28361 - RNA, 64 nt, hsa
auuggauaagaugggacagcacuuauaaugaaauaaaaaaaaacuuugagccccucucauucca

SEQ ID NO: 28362 - RNA, 64 nt, hsa
ggcuaacugcaugacaugcccauucuaccauuuaaaaaaaaaucuuaaagccuguaauuucuga

SEQ ID NO: 28363 - RNA, 64 nt, hsa
uggcuaacugcaugacaugcccauucuaccauuuaaaaaaaaaucuuaaagccuguaauuucug

SEQ ID NO: 28364 - RNA, 64 nt, hsa
gccaacaacccagaaagguuuaaaaaacauaaggaaaaaaaagacaaauuaaaggaggggcuag

SEQ ID NO: 28365 - RNA, 64 nt, hsa
uggggggccucaaccaacuuagugacuuguuuagaaaaaaaagacaaaaaaguaaaaauaaaaa

SEQ ID NO: 28366 - RNA, 64 nt, hsa
cuuaaauuaauuuuuguaaacccaaguaaguucuaaaaaaaaguaaaaaauacauagaauacuu

SEQ ID NO: 28367 - RNA, 64 nt, hsa
agcuuuuccuucugaaccacguucuauguaaaagaaaaaaaauagcuuugauuuucucacuggu

SEQ ID NO: 28368 - RNA, 64 nt, hsa
cuuugcuuggauugcugugauucuuaaaaaaaaaaaaaaaaaguuuuuuuauuuuccugaaggc

SEQ ID NO: 28369 - RNA, 64 nt, hsa
acuuugcuuggauugcugugauucuuaaaaaaaaaaaaaaaaaguuuuuuuauuuuccugaagg

SEQ ID NO: 28370 - RNA, 64 nt, hsa
uacuuugcuuggauugcugugauucuuaaaaaaaaaaaaaaaaaguuuuuuuauuuuccugaag

SEQ ID NO: 28371 - RNA, 64 nt, hsa
guacuuugcuuggauugcugugauucuuaaaaaaaaaaaaaaaaaguuuuuuuauuuuccugaa

SEQ ID NO: 28372 - RNA, 64 nt, hsa
gguacuuugcuuggauugcugugauucuuaaaaaaaaaaaaaaaaaguuuuuuuauuuuccuga

SEQ ID NO: 28373 - RNA, 64 nt, hsa
agguacuuugcuuggauugcugugauucuuaaaaaaaaaaaaaaaaaguuuuuuuauuuuccug

SEQ ID NO: 28374 - RNA, 64 nt, hsa
gagguacuuugcuuggauugcugugauucuuaaaaaaaaaaaaaaaaaguuuuuuuauuuuccu

SEQ ID NO: 28375 - RNA, 64 nt, hsa
ugagguacuuugcuuggauugcugugauucuuaaaaaaaaaaaaaaaaaguuuuuuuauuuucc

SEQ ID NO: 28376 - RNA, 64 nt, hsa
gugagguacuuugcuuggauugcugugauucuuaaaaaaaaaaaaaaaaaguuuuuuuauuuuc

SEQ ID NO: 28377 - RNA, 64 nt, hsa
agugagguacuuugcuuggauugcugugauucuuaaaaaaaaaaaaaaaaaguuuuuuuauuuu

SEQ ID NO: 28378 - RNA, 64 nt, hsa
uuggcuucccugucuaacuguagacaaaucuuuaaaaaaaaauaauaauaaucuggugccucag

SEQ ID NO: 28379 - RNA, 64 nt, hsa
cuuggcuucccugucuaacuguagacaaaucuuuaaaaaaaaauaauaauaaucuggugccuca

SEQ ID NO: 28380 - RNA, 64 nt, hsa
aaauaaaaauaacauauuggugaagaugcgggaaaaaaaaaagaacucuuagacacugcuggug

SEQ ID NO: 28381 - RNA, 64 nt, hsa
aaaauaaaaauaacauauuggugaagaugcgggaaaaaaaaaagaacucuuagacacugcuggu

SEQ ID NO: 28382 - RNA, 64 nt, hsa
uaaaauaaaaauaacauauuggugaagaugcgggaaaaaaaaaagaacucuuagacacugcugg

SEQ ID NO: 28383 - RNA, 64 nt, hsa
auacuauuugcauaagacaaaauaccacagcaaaaaaaaaaaucugauuaacaaaugaaaaagc

SEQ ID NO: 28384 - RNA, 64 nt, hsa
aauacuauuugcauaagacaaaauaccacagcaaaaaaaaaaaucugauuaacaaaugaaaaag

SEQ ID NO: 28385 - RNA, 64 nt, hsa
caauacuauuugcauaagacaaaauaccacagcaaaaaaaaaaaucugauuaacaaaugaaaaa

SEQ ID NO: 28386 - RNA, 64 nt, hsa
acaauacuauuugcauaagacaaaauaccacagcaaaaaaaaaaaucugauuaacaaaugaaaa

SEQ ID NO: 28387 - RNA, 64 nt, hsa
gcaacagagugagacccugucucaaaaaaaaaaaaaaaaaaaggagagaagaaaauaaagaagg

SEQ ID NO: 28388 - RNA, 64 nt, hsa
ggcaacagagugagacccugucucaaaaaaaaaaaaaaaaaaaggagagaagaaaauaaagaag

SEQ ID NO: 28389 - RNA, 64 nt, hsa
gggcaacagagugagacccugucucaaaaaaaaaaaaaaaaaaaggagagaagaaaauaaagaa

SEQ ID NO: 28390 - RNA, 64 nt, hsa
ugggcaacagagugagacccugucucaaaaaaaaaaaaaaaaaaaggagagaagaaaauaaaga

SEQ ID NO: 28391 - RNA, 64 nt, hsa
cugggcaacagagugagacccugucucaaaaaaaaaaaaaaaaaaaggagagaagaaaauaaag

SEQ ID NO: 28392 - RNA, 64 nt, hsa
ccugggcaacagagugagacccugucucaaaaaaaaaaaaaaaaaaaggagagaagaaaauaaa

SEQ ID NO: 28393 - RNA, 64 nt, hsa
gccugggcaacagagugagacccugucucaaaaaaaaaaaaaaaaaaaggagagaagaaaauaa

SEQ ID NO: 28394 - RNA, 64 nt, hsa
agccugggcaacagagugagacccugucucaaaaaaaaaaaaaaaaaaaggagagaagaaaaua

SEQ ID NO: 28395 - RNA, 64 nt, hsa
cagccugggcaacagagugagacccugucucaaaaaaaaaaaaaaaaaaaggagagaagaaaau

SEQ ID NO: 28396 - RNA, 64 nt, hsa
ccagccugggcaacagagugagacccugucucaaaaaaaaaaaaaaaaaaaggagagaagaaaa

SEQ ID NO: 28397 - RNA, 64 nt, hsa
uccagccugggcaacagagugagacccugucucaaaaaaaaaaaaaaaaaaaggagagaagaaa

SEQ ID NO: 28398 - RNA, 64 nt, hsa
cuccagccugggcaacagagugagacccugucucaaaaaaaaaaaaaaaaaaaggagagaagaa

SEQ ID NO: 28399 - RNA, 64 nt, hsa
cuaaaacuuaaaguauaauuuaaaaaaagcaaaaaaaaaaaauacaacucuuuuuuuuaaacca

SEQ ID NO: 28400 - RNA, 64 nt, hsa
ccuaaaacuuaaaguauaauuuaaaaaaagcaaaaaaaaaaaauacaacucuuuuuuuuaaacc

SEQ ID NO: 28401 - RNA, 64 nt, hsa
cccuaaaacuuaaaguauaauuuaaaaaaagcaaaaaaaaaaaauacaacucuuuuuuuuaaac

SEQ ID NO: 28402 - RNA, 64 nt, hsa
acccuaaaacuuaaaguauaauuuaaaaaaagcaaaaaaaaaaaauacaacucuuuuuuuuaaa

SEQ ID NO: 28403 - RNA, 64 nt, hsa
uacccuaaaacuuaaaguauaauuuaaaaaaagcaaaaaaaaaaaauacaacucuuuuuuuuaa

SEQ ID NO: 28404 - RNA, 64 nt, hsa
ccuuuucauuuggaggaaaucacaaguggccgaaaaaaaaaauuaugcucccaaaucauucuac

SEQ ID NO: 28405 - RNA, 64 nt, hsa
uccuuuucauuuggaggaaaucacaaguggccgaaaaaaaaaauuaugcucccaaaucauucua

SEQ ID NO: 28406 - RNA, 64 nt, hsa
uuccuuuucauuuggaggaaaucacaaguggccgaaaaaaaaaauuaugcucccaaaucauucu

SEQ ID NO: 28407 - RNA, 64 nt, hsa
gaaauguauaagagaagaaccaagucuuacauagaaaaaaaagguagauaugaaaagaaaaauc

SEQ ID NO: 28408 - RNA, 64 nt, hsa
ucaagguacucacagaucuguuuaacccacuugaaaaaaaaacacuaaaaaugaagaaaugcua

SEQ ID NO: 28409 - RNA, 64 nt, hsa
cucaagguacucacagaucuguuuaacccacuugaaaaaaaaacacuaaaaaugaagaaaugcu

SEQ ID NO: 28410 - RNA, 64 nt, hsa
agagagcuuggaauguuaaaaacaaaacaaaacaaaaaaaaacaaggagaaguuguccaaggga

SEQ ID NO: 28411 - RNA, 64 nt, hsa
gagagagcuuggaauguuaaaaacaaaacaaaacaaaaaaaaacaaggagaaguuguccaaggg

SEQ ID NO: 28412 - RNA, 64 nt, hsa
ucagcuucuuuuaucauuaaagauguauguauaaaaaaaaaaugaguguauaucaaguuguuca

SEQ ID NO: 28413 - RNA, 64 nt, hsa
cucagcuucuuuuaucauuaaagauguauguauaaaaaaaaaaugaguguauaucaaguuguuc

SEQ ID NO: 28414 - RNA, 64 nt, hsa
ucucagcuucuuuuaucauuaaagauguauguauaaaaaaaaaaugaguguauaucaaguuguu

SEQ ID NO: 28415 - RNA, 64 nt, hsa
ggacaugcccacugaauucagguccuuugaguaaaaaaaaaaucuucugcugcacauuuuguuu

SEQ ID NO: 28416 - RNA, 64 nt, hsa
aggacaugcccacugaauucagguccuuugaguaaaaaaaaaaucuucugcugcacauuuuguu

SEQ ID NO: 28417 - RNA, 64 nt, hsa
aaggacaugcccacugaauucagguccuuugaguaaaaaaaaaaucuucugcugcacauuuugu

SEQ ID NO: 28418 - RNA, 64 nt, hsa
auaccuuaacaggcugauuuggagugagccagaaaaaaaaaauaaaacucucauuauuugugug

SEQ ID NO: 28419 - RNA, 64 nt, hsa
uauaccuuaacaggcugauuuggagugagccagaaaaaaaaaauaaaacucucauuauuugugu

SEQ ID NO: 28420 - RNA, 64 nt, hsa
auauaccuuaacaggcugauuuggagugagccagaaaaaaaaaauaaaacucucauuauuugug

SEQ ID NO: 28421 - RNA, 64 nt, hsa
caauauugccauuuuuccaaagaaacauguuaaaaaaaaaaauuauaagacauggacuaguccu

SEQ ID NO: 28422 - RNA, 64 nt, hsa
ucaauauugccauuuuuccaaagaaacauguuaaaaaaaaaaauuauaagacauggacuagucc

SEQ ID NO: 28423 - RNA, 64 nt, hsa
cucaauauugccauuuuuccaaagaaacauguuaaaaaaaaaaauuauaagacauggacuaguc

SEQ ID NO: 28424 - RNA, 64 nt, hsa
acucaauauugccauuuuuccaaagaaacauguuaaaaaaaaaaauuauaagacauggacuagu

SEQ ID NO: 28425 - RNA, 64 nt, hsa
cagugccuauugaguauaucaaaccaaaaaagaaaaaaaaaaguuuuaagaggggucaggcugg

SEQ ID NO: 28426 - RNA, 64 nt, hsa
ccagugccuauugaguauaucaaaccaaaaaagaaaaaaaaaaguuuuaagaggggucaggcug

SEQ ID NO: 28427 - RNA, 64 nt, hsa
gccagugccuauugaguauaucaaaccaaaaaagaaaaaaaaaaguuuuaagaggggucaggcu

SEQ ID NO: 28428 - RNA, 64 nt, hsa
guggaaagccacaucacaaaaaaagccacaucacaaaaaaaagccagugccuauugaguauauc

SEQ ID NO: 28429 - RNA, 64 nt, hsa
aaacugggaaaugcugcucacugacagaauuaaaaaaaaaaauaaccaguaugaaagucguugc

SEQ ID NO: 28430 - RNA, 64 nt, hsa
aaaacugggaaaugcugcucacugacagaauuaaaaaaaaaaauaaccaguaugaaagucguug

SEQ ID NO: 28431 - RNA, 64 nt, hsa
uaaaacugggaaaugcugcucacugacagaauuaaaaaaaaaaauaaccaguaugaaagucguu

SEQ ID NO: 28432 - RNA, 64 nt, hsa
guaaaacugggaaaugcugcucacugacagaauuaaaaaaaaaaauaaccaguaugaaagucgu

SEQ ID NO: 28433 - RNA, 64 nt, hsa
uuaaaaacuuuuuuuuggaccuaaauaauaauaaaaaaaaaagcccuuuaaacuuuguaaggaa

SEQ ID NO: 28434 - RNA, 64 nt, hsa
uuuaaaaacuuuuuuuuggaccuaaauaauaauaaaaaaaaaagcccuuuaaacuuuguaagga

SEQ ID NO: 28435 - RNA, 64 nt, hsa
uuuuaaaaacuuuuuuuuggaccuaaauaauaauaaaaaaaaaagcccuuuaaacuuuguaagg

SEQ ID NO: 28436 - RNA, 64 nt, hsa
ucuuucuuauaacugcagagaaaauauccugacuaaaaaaaauucauuuuuuuggauuccuuuc

SEQ ID NO: 28437 - RNA, 64 nt, hsa
cuaaaaugcuuaaugccuuugaaauuuuguaaucaaaaaaaagcuuugaaaaaaucuaaagggg

SEQ ID NO: 28438 - RNA, 64 nt, hsa
aaaaaaaaaucugccuaugcauguuuuuuaagaaaaaaaaaauggcuguaucggccuguauggg

SEQ ID NO: 28439 - RNA, 64 nt, hsa
aaaaaaaaaaucugccuaugcauguuuuuuaagaaaaaaaaaauggcuguaucggccuguaugg

SEQ ID NO: 28440 - RNA, 64 nt, hsa
aaaaaaaaaaaucugccuaugcauguuuuuuaagaaaaaaaaaauggcuguaucggccuguaug

SEQ ID NO: 28441 - RNA, 64 nt, hsa
guacagugauaaagcaucuauauucuguaaaaaaaaaaaaaaucugccuaugcauguuuuuuaa

SEQ ID NO: 28442 - RNA, 64 nt, hsa
aguacagugauaaagcaucuauauucuguaaaaaaaaaaaaaaucugccuaugcauguuuuuua

SEQ ID NO: 28443 - RNA, 64 nt, hsa
aaguacagugauaaagcaucuauauucuguaaaaaaaaaaaaaaucugccuaugcauguuuuuu

SEQ ID NO: 28444 - RNA, 64 nt, hsa
uaaguacagugauaaagcaucuauauucuguaaaaaaaaaaaaaaucugccuaugcauguuuuu

SEQ ID NO: 28445 - RNA, 64 nt, hsa
uuaaguacagugauaaagcaucuauauucuguaaaaaaaaaaaaaaucugccuaugcauguuuu

SEQ ID NO: 28446 - RNA, 64 nt, hsa
auuaaguacagugauaaagcaucuauauucuguaaaaaaaaaaaaaaucugccuaugcauguuu

SEQ ID NO: 28447 - RNA, 64 nt, hsa
uauuaaguacagugauaaagcaucuauauucuguaaaaaaaaaaaaaaucugccuaugcauguu

SEQ ID NO: 28448 - RNA, 64 nt, hsa
aggcagucuuaaaaaaaaaaaaaaacagaaaaagaaaaaaaagaacguugcaaauuuguuaaaa

SEQ ID NO: 28449 - RNA, 64 nt, hsa
uggcuauaaacugaauuaggcagucuuaaaaaaaaaaaaaaacagaaaaagaaaaaaaagaacg

SEQ ID NO: 28450 - RNA, 64 nt, hsa
auggcuauaaacugaauuaggcagucuuaaaaaaaaaaaaaaacagaaaaagaaaaaaaagaac

SEQ ID NO: 28451 - RNA, 64 nt, hsa
aauggcuauaaacugaauuaggcagucuuaaaaaaaaaaaaaaacagaaaaagaaaaaaaagaa

SEQ ID NO: 28452 - RNA, 64 nt, hsa
caauggcuauaaacugaauuaggcagucuuaaaaaaaaaaaaaaacagaaaaagaaaaaaaaga

SEQ ID NO: 28453 - RNA, 64 nt, hsa
acaauggcuauaaacugaauuaggcagucuuaaaaaaaaaaaaaaacagaaaaagaaaaaaaag

SEQ ID NO: 28454 - RNA, 64 nt, hsa
gacaauggcuauaaacugaauuaggcagucuuaaaaaaaaaaaaaaacagaaaaagaaaaaaaa

SEQ ID NO: 28455 - RNA, 64 nt, hsa
agacaauggcuauaaacugaauuaggcagucuuaaaaaaaaaaaaaaacagaaaaagaaaaaaa

SEQ ID NO: 28456 - RNA, 64 nt, hsa
cagacaauggcuauaaacugaauuaggcagucuuaaaaaaaaaaaaaaacagaaaaagaaaaaa

SEQ ID NO: 28457 - RNA, 64 nt, hsa
cuuuuggguaugccuuuuaaaaaugcuuauagagaaaaaaaauuuuaaaaagaaagcuaaugcu

SEQ ID NO: 28458 - RNA, 64 nt, hsa
gaaauuucucuucaccuuguacacuugacagcugaaaaaaaacaacaugggaguaauaaugggu

SEQ ID NO: 28459 - RNA, 64 nt, hsa
agagaacaguugcccaagacucagaauuuuuaaaaaaaaaaauggagcauguguauuauguggc

SEQ ID NO: 28460 - RNA, 64 nt, hsa
aagagaacaguugcccaagacucagaauuuuuaaaaaaaaaaauggagcauguguauuaugugg

SEQ ID NO: 28461 - RNA, 64 nt, hsa
caagagaacaguugcccaagacucagaauuuuuaaaaaaaaaaauggagcauguguauuaugug

SEQ ID NO: 28462 - RNA, 64 nt, hsa
acaagagaacaguugcccaagacucagaauuuuuaaaaaaaaaaauggagcauguguauuaugu

SEQ ID NO: 28463 - RNA, 64 nt, hsa
uuaaugccuagcagagaacugccuuaaaaaaaaaaaaaaaaaguucauguuggccauggugaaa

SEQ ID NO: 28464 - RNA, 64 nt, hsa
uuuaaugccuagcagagaacugccuuaaaaaaaaaaaaaaaaaguucauguuggccauggugaa

SEQ ID NO: 28465 - RNA, 64 nt, hsa
guuuaaugccuagcagagaacugccuuaaaaaaaaaaaaaaaaaguucauguuggccaugguga

SEQ ID NO: 28466 - RNA, 64 nt, hsa
aguuuaaugccuagcagagaacugccuuaaaaaaaaaaaaaaaaaguucauguuggccauggug

SEQ ID NO: 28467 - RNA, 64 nt, hsa
aaguuuaaugccuagcagagaacugccuuaaaaaaaaaaaaaaaaaguucauguuggccauggu

SEQ ID NO: 28468 - RNA, 64 nt, hsa
aaaguuuaaugccuagcagagaacugccuuaaaaaaaaaaaaaaaaaguucauguuggccaugg

SEQ ID NO: 28469 - RNA, 64 nt, hsa
uaaaguuuaaugccuagcagagaacugccuuaaaaaaaaaaaaaaaaaguucauguuggccaug

SEQ ID NO: 28470 - RNA, 64 nt, hsa
uuaaaguuuaaugccuagcagagaacugccuuaaaaaaaaaaaaaaaaaguucauguuggccau

SEQ ID NO: 28471 - RNA, 64 nt, hsa
uuuaaaguuuaaugccuagcagagaacugccuuaaaaaaaaaaaaaaaaaguucauguuggcca

SEQ ID NO: 28472 - RNA, 64 nt, hsa
uuuuaaaguuuaaugccuagcagagaacugccuuaaaaaaaaaaaaaaaaaguucauguuggcc

SEQ ID NO: 28473 - RNA, 64 nt, hsa
acuccagccugggcaacgagugaaacuccgucucaaaaaaaagaaaaugucuuucucuuccuuu

SEQ ID NO: 28474 - RNA, 64 nt, hsa
aacauggagaagccccgucucuacuaaaaaugcaaaaaaaaauuuagcuaggcauggcggcgca

SEQ ID NO: 28475 - RNA, 64 nt, hsa
caacauggagaagccccgucucuacuaaaaaugcaaaaaaaaauuuagcuaggcauggcggcgc

SEQ ID NO: 28476 - RNA, 64 nt, hsa
caaaaucaauuuauuaagagccauauucuuuaaaaaaaaaaagcuggauaauauucucuguaau

SEQ ID NO: 28477 - RNA, 64 nt, hsa
ucaaaaucaauuuauuaagagccauauucuuuaaaaaaaaaaagcuggauaauauucucuguaa

SEQ ID NO: 28478 - RNA, 64 nt, hsa
cucaaaaucaauuuauuaagagccauauucuuuaaaaaaaaaaagcuggauaauauucucugua

SEQ ID NO: 28479 - RNA, 64 nt, hsa
acucaaaaucaauuuauuaagagccauauucuuuaaaaaaaaaaagcuggauaauauucucugu

SEQ ID NO: 28480 - RNA, 64 nt, hsa
aagcagcuauacguggcauacauguauuuaaagaaaaaaaaauagauguagaguguuuuuuuua

SEQ ID NO: 28481 - RNA, 64 nt, hsa
gaagcagcuauacguggcauacauguauuuaaagaaaaaaaaauagauguagaguguuuuuuuu

SEQ ID NO: 28482 - RNA, 64 nt, hsa
guuuguuugguuuuuuuuuuuuuuuuuaagguaaaaaaaaaauacaccuucaguuuccuggugu

SEQ ID NO: 28483 - RNA, 64 nt, hsa
gguuuguuugguuuuuuuuuuuuuuuuuaagguaaaaaaaaaauacaccuucaguuuccuggug

SEQ ID NO: 28484 - RNA, 64 nt, hsa
ugguuuguuugguuuuuuuuuuuuuuuuuaagguaaaaaaaaaauacaccuucaguuuccuggu

SEQ ID NO: 28485 - RNA, 64 nt, hsa
cuguuggcaaaacaauagggggagauuagacaaaaaaaaaaauccacaauauuccaaguacaac

SEQ ID NO: 28486 - RNA, 64 nt, hsa
acuguuggcaaaacaauagggggagauuagacaaaaaaaaaaauccacaauauuccaaguacaa

SEQ ID NO: 28487 - RNA, 64 nt, hsa
uacuguuggcaaaacaauagggggagauuagacaaaaaaaaaaauccacaauauuccaaguaca

SEQ ID NO: 28488 - RNA, 64 nt, hsa
uuacuguuggcaaaacaauagggggagauuagacaaaaaaaaaaauccacaauauuccaaguac

SEQ ID NO: 28489 - RNA, 64 nt, hsa
aagucuuacuuuuaacaagaaaugguauaaauggaaaaaaaauacaacuccauagccuugcaaa

SEQ ID NO: 28490 - RNA, 64 nt, hsa
ccuacauuuagagucuguagaugcauaugcaaccaaaaaaaagucuuacuuuuaacaagaaaug

SEQ ID NO: 28491 - RNA, 51 nt, hsa
uuuuaguacacuuaguuuaaaaaaaaaaagacuuauuuucuagaaaacguu

SEQ ID NO: 28492 - RNA, 50 nt, hsa
uuuuaguacacuuaguuuaaaaaaaaaaagacuuauuuucuagaaaacgu

SEQ ID NO: 28493 - RNA, 64 nt, hsa
augugaagaugugaucauuugugauguuacuuguaaaaaaaaguauauauacauaucuuuugaa

SEQ ID NO: 28494 - RNA, 64 nt, hsa
agaaacucuuagguggaauguuucugaaggcuuuaaaaaaaauacaauaaaguaaaaaccgcag

SEQ ID NO: 28495 - RNA, 64 nt, hsa
cccauuuuagaaaaucagauuuucuccugugggaaaaaaaaauuccaugcacucucucucuguu

SEQ ID NO: 28496 - RNA, 64 nt, hsa
ucccauuuuagaaaaucagauuuucuccugugggaaaaaaaaauuccaugcacucucucucugu

SEQ ID NO: 28497 - RNA, 64 nt, hsa
agguauaaggaucuuuuguaaaugagacacauacaaaaaaaaucuuuaaugguuaauaggauga

SEQ ID NO: 28498 - RNA, 64 nt, hsa
aaaugaaacaugaaaugcaguagcaaccacuaaaaaaaaaaauucaaggacaucuaacuuuuuc

SEQ ID NO: 28499 - RNA, 64 nt, hsa
aaaaugaaacaugaaaugcaguagcaaccacuaaaaaaaaaaauucaaggacaucuaacuuuuu

SEQ ID NO: 28500 - RNA, 64 nt, hsa
aaaaaugaaacaugaaaugcaguagcaaccacuaaaaaaaaaaauucaaggacaucuaacuuuu

SEQ ID NO: 28501 - RNA, 64 nt, hsa
caaaaaugaaacaugaaaugcaguagcaaccacuaaaaaaaaaaauucaaggacaucuaacuuu

SEQ ID NO: 28502 - RNA, 64 nt, hsa
caauguauauuauguuccuguguguugaauuuaaaaaaaaaauacuuuacuuggauauucaugu

SEQ ID NO: 28503 - RNA, 64 nt, hsa
acaauguauauuauguuccuguguguugaauuuaaaaaaaaaauacuuuacuuggauauucaug

SEQ ID NO: 28504 - RNA, 64 nt, hsa
aacaauguauauuauguuccuguguguugaauuuaaaaaaaaaauacuuuacuuggauauucau

SEQ ID NO: 28505 - RNA, 64 nt, hsa
agaugaaaucauuccuaaauuaaccuuuuuuuuaaaaaaaaacaauguauauuauguuccugug

SEQ ID NO: 28506 - RNA, 64 nt, hsa
aagaugaaaucauuccuaaauuaaccuuuuuuuuaaaaaaaaacaauguauauuauguuccugu

SEQ ID NO: 28507 - RNA, 64 nt, hsa
ccuuugaggcaucugcuccccgucucccccuccaaaaaaaaaguggauauuugaagaaaagcau

SEQ ID NO: 28508 - RNA, 64 nt, hsa
cccuuugaggcaucugcuccccgucucccccuccaaaaaaaaaguggauauuugaagaaaagca

SEQ ID NO: 28509 - RNA, 64 nt, hsa
ggugcaauuucuaaauuuguaagaguagguuuaaaaaaaaaagugcuucuuaucuuuguuaaca

SEQ ID NO: 28510 - RNA, 64 nt, hsa
aggugcaauuucuaaauuuguaagaguagguuuaaaaaaaaaagugcuucuuaucuuuguuaac

SEQ ID NO: 28511 - RNA, 64 nt, hsa
aaggugcaauuucuaaauuuguaagaguagguuuaaaaaaaaaagugcuucuuaucuuuguuaa

SEQ ID NO: 28512 - RNA, 64 nt, hsa
ccccauccuccaccccccccaaaaaauagaaagaaaaaaaaaguuugcacuaauugagguacau

SEQ ID NO: 28513 - RNA, 64 nt, hsa
accccauccuccaccccccccaaaaaauagaaagaaaaaaaaaguuugcacuaauugagguaca

SEQ ID NO: 28514 - RNA, 64 nt, hsa
ccagccucggugacaagagcgagacuccaucucaaaaaaaaauaaaaagaaucuuaaaauagga

SEQ ID NO: 28515 - RNA, 64 nt, hsa
uccagccucggugacaagagcgagacuccaucucaaaaaaaaauaaaaagaaucuuaaaauagg

SEQ ID NO: 28516 - RNA, 64 nt, hsa
uuaaaaauggucaaauauuugaggcaaaaaaaaaaaaaaaaagugucuccaggaggcuguccag

SEQ ID NO: 28517 - RNA, 64 nt, hsa
uuuaaaaauggucaaauauuugaggcaaaaaaaaaaaaaaaaagugucuccaggaggcugucca

SEQ ID NO: 28518 - RNA, 64 nt, hsa
auuuaaaaauggucaaauauuugaggcaaaaaaaaaaaaaaaaagugucuccaggaggcugucc

SEQ ID NO: 28519 - RNA, 64 nt, hsa
uauuuaaaaauggucaaauauuugaggcaaaaaaaaaaaaaaaaagugucuccaggaggcuguc

SEQ ID NO: 28520 - RNA, 64 nt, hsa
auauuuaaaaauggucaaauauuugaggcaaaaaaaaaaaaaaaaagugucuccaggaggcugu

SEQ ID NO: 28521 - RNA, 64 nt, hsa
gauauuuaaaaauggucaaauauuugaggcaaaaaaaaaaaaaaaaagugucuccaggaggcug

SEQ ID NO: 28522 - RNA, 64 nt, hsa
ugauauuuaaaaauggucaaauauuugaggcaaaaaaaaaaaaaaaaagugucuccaggaggcu

SEQ ID NO: 28523 - RNA, 64 nt, hsa
augauauuuaaaaauggucaaauauuugaggcaaaaaaaaaaaaaaaaagugucuccaggaggc

SEQ ID NO: 28524 - RNA, 64 nt, hsa
caugauauuuaaaaauggucaaauauuugaggcaaaaaaaaaaaaaaaaagugucuccaggagg

SEQ ID NO: 28525 - RNA, 64 nt, hsa
ucaugauauuuaaaaauggucaaauauuugaggcaaaaaaaaaaaaaaaaagugucuccaggag

SEQ ID NO: 28526 - RNA, 64 nt, hsa
caucagcccaggucccagugccauuggcuucaagaaaaaaaaaaaaucucuccccaaugcucuc

SEQ ID NO: 28527 - RNA, 64 nt, hsa
aucagcccaggucccagugccauuggcuucaagaaaaaaaaaaaaucucuccccaaugcucucc

SEQ ID NO: 28528 - RNA, 64 nt, hsa
ucagcccaggucccagugccauuggcuucaagaaaaaaaaaaaaucucuccccaaugcucuccu

SEQ ID NO: 28529 - RNA, 64 nt, hsa
cagcccaggucccagugccauuggcuucaagaaaaaaaaaaaaucucuccccaaugcucuccuu

SEQ ID NO: 28530 - RNA, 64 nt, hsa
agcccaggucccagugccauuggcuucaagaaaaaaaaaaaaucucuccccaaugcucuccuua

SEQ ID NO: 28531 - RNA, 64 nt, hsa
caccuguaguucuguuuauuggucaguggaaaugaaaaaaaaaaaaaaaaaaagucugcguuca

SEQ ID NO: 28532 - RNA, 64 nt, hsa
accuguaguucuguuuauuggucaguggaaaugaaaaaaaaaaaaaaaaaaagucugcguucau

SEQ ID NO: 28533 - RNA, 64 nt, hsa
ccuguaguucuguuuauuggucaguggaaaugaaaaaaaaaaaaaaaaaaagucugcguucauu

SEQ ID NO: 28534 - RNA, 64 nt, hsa
cuguaguucuguuuauuggucaguggaaaugaaaaaaaaaaaaaaaaaaagucugcguucauug

SEQ ID NO: 28535 - RNA, 64 nt, hsa
uguaguucuguuuauuggucaguggaaaugaaaaaaaaaaaaaaaaaaagucugcguucauugc

SEQ ID NO: 28536 - RNA, 64 nt, hsa
guaguucuguuuauuggucaguggaaaugaaaaaaaaaaaaaaaaaaagucugcguucauugca

SEQ ID NO: 28537 - RNA, 64 nt, hsa
uaguucuguuuauuggucaguggaaaugaaaaaaaaaaaaaaaaaaagucugcguucauugcag

SEQ ID NO: 28538 - RNA, 64 nt, hsa
aguucuguuuauuggucaguggaaaugaaaaaaaaaaaaaaaaaaagucugcguucauugcagu

SEQ ID NO: 28539 - RNA, 64 nt, hsa
guucuguuuauuggucaguggaaaugaaaaaaaaaaaaaaaaaaagucugcguucauugcaguu

SEQ ID NO: 28540 - RNA, 64 nt, hsa
uucuguuuauuggucaguggaaaugaaaaaaaaaaaaaaaaaaagucugcguucauugcaguuc

SEQ ID NO: 28541 - RNA, 64 nt, hsa
ucuguuuauuggucaguggaaaugaaaaaaaaaaaaaaaaaaagucugcguucauugcaguucc

SEQ ID NO: 28542 - RNA, 64 nt, hsa
cuguuuauuggucaguggaaaugaaaaaaaaaaaaaaaaaaagucugcguucauugcaguucca

SEQ ID NO: 28543 - RNA, 64 nt, hsa
cacagacaccaacacaccacucauuggaaaauggaaaaaaaaaacaaaaaaaaaacaaaaaaau

SEQ ID NO: 28544 - RNA, 64 nt, hsa
acagacaccaacacaccacucauuggaaaauggaaaaaaaaaacaaaaaaaaaacaaaaaaaug

SEQ ID NO: 28545 - RNA, 64 nt, hsa
cagacaccaacacaccacucauuggaaaauggaaaaaaaaaacaaaaaaaaaacaaaaaaaugu

SEQ ID NO: 28546 - RNA, 64 nt, hsa
acacaccacucauuggaaaauggaaaaaaaaaacaaaaaaaaaacaaaaaaauguacaauggau

SEQ ID NO: 28547 - RNA, 64 nt, hsa
cacaccacucauuggaaaauggaaaaaaaaaacaaaaaaaaaacaaaaaaauguacaauggaug

SEQ ID NO: 28548 - RNA, 64 nt, hsa
acaccacucauuggaaaauggaaaaaaaaaacaaaaaaaaaacaaaaaaauguacaauggaugc

SEQ ID NO: 28549 - RNA, 64 nt, hsa
uaaaaauaacuuagauucaaauuuauaguagaagaaaaaaaaucuuucagauaagagguguucu

SEQ ID NO: 28550 - RNA, 64 nt, hsa
ucauugaaauaaaugacaagucauacugccacuuaaaaaaaaaaagaccuuugucaaggagagu

SEQ ID NO: 28551 - RNA, 64 nt, hsa
cauugaaauaaaugacaagucauacugccacuuaaaaaaaaaaagaccuuugucaaggagagug

SEQ ID NO: 28552 - RNA, 64 nt, hsa
auugaaauaaaugacaagucauacugccacuuaaaaaaaaaaagaccuuugucaaggagagugc

SEQ ID NO: 28553 - RNA, 64 nt, hsa
uugaaauaaaugacaagucauacugccacuuaaaaaaaaaaagaccuuugucaaggagagugca

SEQ ID NO: 28554 - RNA, 64 nt, hsa
gaaaagcaagucaaaaauauuuccuuuuugauguaaaaaaaaaaagcccuauuucgcacuaaca

SEQ ID NO: 28555 - RNA, 64 nt, hsa
aaaagcaagucaaaaauauuuccuuuuugauguaaaaaaaaaaagcccuauuucgcacuaacau

SEQ ID NO: 28556 - RNA, 64 nt, hsa
aaagcaagucaaaaauauuuccuuuuugauguaaaaaaaaaaagcccuauuucgcacuaacauu

SEQ ID NO: 28557 - RNA, 64 nt, hsa
aagcaagucaaaaauauuuccuuuuugauguaaaaaaaaaaagcccuauuucgcacuaacauuu

SEQ ID NO: 28558 - RNA, 64 nt, hsa
uaagauaacuagaauuggauuaugguguaaaaauaaaaaaaaaauuuauucacauaaguuucaa

SEQ ID NO: 28559 - RNA, 64 nt, hsa
aagauaacuagaauuggauuaugguguaaaaauaaaaaaaaaauuuauucacauaaguuucaag

SEQ ID NO: 28560 - RNA, 64 nt, hsa
agauaacuagaauuggauuaugguguaaaaauaaaaaaaaaauuuauucacauaaguuucaaga

SEQ ID NO: 28561 - RNA, 64 nt, hsa
cuccagccugggcgacagagcgagacuccgucucaaaaaaaaaaaaaaaaaaaaaaagaaagua

SEQ ID NO: 28562 - RNA, 64 nt, hsa
uccagccugggcgacagagcgagacuccgucucaaaaaaaaaaaaaaaaaaaaaaagaaaguaa

SEQ ID NO: 28563 - RNA, 64 nt, hsa
ccagccugggcgacagagcgagacuccgucucaaaaaaaaaaaaaaaaaaaaaaagaaaguaau

SEQ ID NO: 28564 - RNA, 64 nt, hsa
cagccugggcgacagagcgagacuccgucucaaaaaaaaaaaaaaaaaaaaaaagaaaguaauu

SEQ ID NO: 28565 - RNA, 64 nt, hsa
agccugggcgacagagcgagacuccgucucaaaaaaaaaaaaaaaaaaaaaaagaaaguaauuu

SEQ ID NO: 28566 - RNA, 64 nt, hsa
gccugggcgacagagcgagacuccgucucaaaaaaaaaaaaaaaaaaaaaaagaaaguaauuuu

SEQ ID NO: 28567 - RNA, 64 nt, hsa
ccugggcgacagagcgagacuccgucucaaaaaaaaaaaaaaaaaaaaaaagaaaguaauuuua

SEQ ID NO: 28568 - RNA, 64 nt, hsa
cugggcgacagagcgagacuccgucucaaaaaaaaaaaaaaaaaaaaaaagaaaguaauuuuaa

SEQ ID NO: 28569 - RNA, 64 nt, hsa
ugggcgacagagcgagacuccgucucaaaaaaaaaaaaaaaaaaaaaaagaaaguaauuuuaaa

SEQ ID NO: 28570 - RNA, 64 nt, hsa
gggcgacagagcgagacuccgucucaaaaaaaaaaaaaaaaaaaaaaagaaaguaauuuuaaac

SEQ ID NO: 28571 - RNA, 64 nt, hsa
ggcgacagagcgagacuccgucucaaaaaaaaaaaaaaaaaaaaaaagaaaguaauuuuaaacu

SEQ ID NO: 28572 - RNA, 64 nt, hsa
gcgacagagcgagacuccgucucaaaaaaaaaaaaaaaaaaaaaaagaaaguaauuuuaaacuc

SEQ ID NO: 28573 - RNA, 64 nt, hsa
cgacagagcgagacuccgucucaaaaaaaaaaaaaaaaaaaaaaagaaaguaauuuuaaacuca

SEQ ID NO: 28574 - RNA, 64 nt, hsa
gacagagcgagacuccgucucaaaaaaaaaaaaaaaaaaaaaaagaaaguaauuuuaaacucac

SEQ ID NO: 28575 - RNA, 64 nt, hsa
acagagcgagacuccgucucaaaaaaaaaaaaaaaaaaaaaaagaaaguaauuuuaaacucacu

SEQ ID NO: 28576 - RNA, 64 nt, hsa
cagagcgagacuccgucucaaaaaaaaaaaaaaaaaaaaaaagaaaguaauuuuaaacucacug

SEQ ID NO: 28577 - RNA, 64 nt, hsa
caagguuuaaggugacccaaugauucagcuauuuaaaaaaaaaagaggaaagaaugaaagagua

SEQ ID NO: 28578 - RNA, 64 nt, hsa
aagguuuaaggugacccaaugauucagcuauuuaaaaaaaaaagaggaaagaaugaaagaguaa

SEQ ID NO: 28579 - RNA, 64 nt, hsa
agguuuaaggugacccaaugauucagcuauuuaaaaaaaaaagaggaaagaaugaaagaguaaa

SEQ ID NO: 28580 - RNA, 64 nt, hsa
aaggcagaaaaacuugaaauaccaacauucuggcaaaaaaaaaucaguuuuaugaagaguaagu

SEQ ID NO: 28581 - RNA, 64 nt, hsa
aggcagaaaaacuugaaauaccaacauucuggcaaaaaaaaaucaguuuuaugaagaguaagug

SEQ ID NO: 28582 - RNA, 64 nt, hsa
uauuauaguuuaacaaaaauuguuuauaucuuggaaaaaaaacuuucuguuuaaaaaaaauaaa

SEQ ID NO: 28583 - RNA, 64 nt, hsa
auuguuuauaucuuggaaaaaaaacuuucuguuuaaaaaaaauaaacaagugaauguuggaaau

SEQ ID NO: 28584 - RNA, 64 nt, hsa
gcagaaucuccuggauauauaauuuauucuguugaaaaaaaaaaaagcaugcaguaucuaugac

SEQ ID NO: 28585 - RNA, 64 nt, hsa
cagaaucuccuggauauauaauuuauucuguugaaaaaaaaaaaagcaugcaguaucuaugacc

SEQ ID NO: 28586 - RNA, 64 nt, hsa
agaaucuccuggauauauaauuuauucuguugaaaaaaaaaaaagcaugcaguaucuaugaccu

SEQ ID NO: 28587 - RNA, 64 nt, hsa
gaaucuccuggauauauaauuuauucuguugaaaaaaaaaaaagcaugcaguaucuaugaccua

SEQ ID NO: 28588 - RNA, 64 nt, hsa
aaucuccuggauauauaauuuauucuguugaaaaaaaaaaaagcaugcaguaucuaugaccuau

SEQ ID NO: 28589 - RNA, 64 nt, hsa
gaaaaccuuucuucaccaaaucuugguugaugccaaaaaaaaauacaugcuaagagaaguagaa

SEQ ID NO: 28590 - RNA, 64 nt, hsa
aaaaccuuucuucaccaaaucuugguugaugccaaaaaaaaauacaugcuaagagaaguagaaa

SEQ ID NO: 28591 - RNA, 64 nt, hsa
caguauaugcuauucaaugaucuuagaaguacugaaaaaaaaagacguuuuuaaaacguagagg

SEQ ID NO: 28592 - RNA, 64 nt, hsa
aguauaugcuauucaaugaucuuagaaguacugaaaaaaaaagacguuuuuaaaacguagagga

SEQ ID NO: 28593 - RNA, 64 nt, hsa
augacuguuuucucucucuauggaaauaaaaaggaaaaaaaaaaaggaaacuuuuuuuguuugc

SEQ ID NO: 28594 - RNA, 64 nt, hsa
ugacuguuuucucucucuauggaaauaaaaaggaaaaaaaaaaaggaaacuuuuuuuguuugcu

SEQ ID NO: 28595 - RNA, 64 nt, hsa
gacuguuuucucucucuauggaaauaaaaaggaaaaaaaaaaaggaaacuuuuuuuguuugcuc

SEQ ID NO: 28596 - RNA, 64 nt, hsa
acuguuuucucucucuauggaaauaaaaaggaaaaaaaaaaaggaaacuuuuuuuguuugcucu

SEQ ID NO: 28597 - RNA, 64 nt, hsa
ucaugucauuugacauuuuuuguuugcugaagugaaaaaaaaagauaaagguuguacggugguc

SEQ ID NO: 28598 - RNA, 64 nt, hsa
caugucauuugacauuuuuuguuugcugaagugaaaaaaaaagauaaagguuguacgguggucu

SEQ ID NO: 28599 - RNA, 64 nt, hsa
uagcuccuguccuuguauucucacuccuacacuuaaaaaaaaaauccuuacugacuaguuaugu

SEQ ID NO: 28600 - RNA, 64 nt, hsa
agcuccuguccuuguauucucacuccuacacuuaaaaaaaaaauccuuacugacuaguuaugug

SEQ ID NO: 28601 - RNA, 64 nt, hsa
gcuccuguccuuguauucucacuccuacacuuaaaaaaaaaauccuuacugacuaguuauguga

SEQ ID NO: 28602 - RNA, 64 nt, hsa
gucagcaagaaggccugccucaucuuaacaaagcaaaaaaaaaugcuuuaauucaaauuaaaaa

SEQ ID NO: 28603 - RNA, 64 nt, hsa
ucagcaagaaggccugccucaucuuaacaaagcaaaaaaaaaugcuuuaauucaaauuaaaaau

SEQ ID NO: 28604 - RNA, 64 nt, hsa
ucgaacaugcaguacauaaaaaggggaaaaggagaaaaaaaaagccuuacuuuguuuuacuugc

SEQ ID NO: 28605 - RNA, 64 nt, hsa
cgaacaugcaguacauaaaaaggggaaaaggagaaaaaaaaagccuuacuuuguuuuacuugcc

SEQ ID NO: 28606 - RNA, 64 nt, hsa
auaaaauucacuuauuguauguguguuguaaucuaaaaaaaaaaagaaugacaaacagcuucuu

SEQ ID NO: 28607 - RNA, 64 nt, hsa
uaaaauucacuuauuguauguguguuguaaucuaaaaaaaaaaagaaugacaaacagcuucuuu

SEQ ID NO: 28608 - RNA, 64 nt, hsa
aaaauucacuuauuguauguguguuguaaucuaaaaaaaaaaagaaugacaaacagcuucuuua

SEQ ID NO: 28609 - RNA, 64 nt, hsa
aaauucacuuauuguauguguguuguaaucuaaaaaaaaaaagaaugacaaacagcuucuuuaa

SEQ ID NO: 28610 - RNA, 64 nt, hsa
uccuuuuuuaaaaguaaauguacaggaugccaguaaaaaaaaaaaauggcuucagaauuaaaac

SEQ ID NO: 28611 - RNA, 64 nt, hsa
ccuuuuuuaaaaguaaauguacaggaugccaguaaaaaaaaaaaauggcuucagaauuaaaacu

SEQ ID NO: 28612 - RNA, 64 nt, hsa
cuuuuuuaaaaguaaauguacaggaugccaguaaaaaaaaaaaauggcuucagaauuaaaacua

SEQ ID NO: 28613 - RNA, 64 nt, hsa
uuuuuuaaaaguaaauguacaggaugccaguaaaaaaaaaaaauggcuucagaauuaaaacuau

SEQ ID NO: 28614 - RNA, 64 nt, hsa
uuuuuaaaaguaaauguacaggaugccaguaaaaaaaaaaaauggcuucagaauuaaaacuaug

SEQ ID NO: 28615 - RNA, 64 nt, hsa
gugccugauaagcuucaaagcugcuuuauucaauaaaaaaaagaaaugaaaaagauauaugaau

SEQ ID NO: 28616 - RNA, 64 nt, hsa
cuauccaucaugaccagcaaauacucauuuuaggaaaaaaaaaagcaugaucugaaaaauacuu

SEQ ID NO: 28617 - RNA, 64 nt, hsa
uauccaucaugaccagcaaauacucauuuuaggaaaaaaaaaagcaugaucugaaaaauacuuu

SEQ ID NO: 28618 - RNA, 64 nt, hsa
auccaucaugaccagcaaauacucauuuuaggaaaaaaaaaagcaugaucugaaaaauacuuuu

SEQ ID NO: 28619 - RNA, 64 nt, hsa
gcacauauauauauguauuuaaaaaaaucaaaacaaaaaaaaacucauuuauaccuguguauuu

SEQ ID NO: 28620 - RNA, 64 nt, hsa
cacauauauauauguauuuaaaaaaaucaaaacaaaaaaaaacucauuuauaccuguguauuuu

SEQ ID NO: 28621 - RNA, 64 nt, hsa; identical to SEQ ID NO: 28549

SEQ ID NO: 28622 - RNA, 64 nt, hsa
ucauugaaauaaaugacaagucauacugucacuuaaaaaaaaaaaaaagaccuuugucaaggag

SEQ ID NO: 28623 - RNA, 64 nt, hsa
cauugaaauaaaugacaagucauacugucacuuaaaaaaaaaaaaaagaccuuugucaaggaga

SEQ ID NO: 28624 - RNA, 64 nt, hsa
auugaaauaaaugacaagucauacugucacuuaaaaaaaaaaaaaagaccuuugucaaggagag

SEQ ID NO: 28625 - RNA, 64 nt, hsa
uugaaauaaaugacaagucauacugucacuuaaaaaaaaaaaaaagaccuuugucaaggagagu

SEQ ID NO: 28626 - RNA, 64 nt, hsa
ugaaauaaaugacaagucauacugucacuuaaaaaaaaaaaaaagaccuuugucaaggagagug

SEQ ID NO: 28627 - RNA, 64 nt, hsa
gaaauaaaugacaagucauacugucacuuaaaaaaaaaaaaaagaccuuugucaaggagagugc

SEQ ID NO: 28628 - RNA, 64 nt, hsa
aaauaaaugacaagucauacugucacuuaaaaaaaaaaaaaagaccuuugucaaggagagugca

SEQ ID NO: 28629 - RNA, 64 nt, hsa
auaauaagggauagcaagguguuuuccuccauuuaaaaaaaaaaagguauaauuuacauacaau

SEQ ID NO: 28630 - RNA, 64 nt, hsa
uaauaagggauagcaagguguuuuccuccauuuaaaaaaaaaaagguauaauuuacauacaaua

SEQ ID NO: 28631 - RNA, 64 nt, hsa
aauaagggauagcaagguguuuuccuccauuuaaaaaaaaaaagguauaauuuacauacaauaa

SEQ ID NO: 28632 - RNA, 64 nt, hsa
auaagggauagcaagguguuuuccuccauuuaaaaaaaaaaagguauaauuuacauacaauaaa

SEQ ID NO: 28633 - RNA, 64 nt, hsa
caacauggugagacccugucucuacuaaaacgauaaaaaaaaaaaaaaaauuagccaggcuugg

SEQ ID NO: 28634 - RNA, 64 nt, hsa
aacauggugagacccugucucuacuaaaacgauaaaaaaaaaaaaaaaauuagccaggcuuggu

SEQ ID NO: 28635 - RNA, 64 nt, hsa
acauggugagacccugucucuacuaaaacgauaaaaaaaaaaaaaaaauuagccaggcuuggug

SEQ ID NO: 28636 - RNA, 64 nt, hsa
cauggugagacccugucucuacuaaaacgauaaaaaaaaaaaaaaaauuagccaggcuuggugg

SEQ ID NO: 28637 - RNA, 64 nt, hsa
auggugagacccugucucuacuaaaacgauaaaaaaaaaaaaaaaauuagccaggcuugguggc

SEQ ID NO: 28638 - RNA, 64 nt, hsa
uggugagacccugucucuacuaaaacgauaaaaaaaaaaaaaaaauuagccaggcuugguggca

SEQ ID NO: 28639 - RNA, 64 nt, hsa
ggugagacccugucucuacuaaaacgauaaaaaaaaaaaaaaaauuagccaggcuugguggcac

SEQ ID NO: 28640 - RNA, 64 nt, hsa
gugagacccugucucuacuaaaacgauaaaaaaaaaaaaaaaauuagccaggcuugguggcaca

SEQ ID NO: 28641 - RNA, 64 nt, hsa
ugagacccugucucuacuaaaacgauaaaaaaaaaaaaaaaauuagccaggcuugguggcacac

SEQ ID NO: 28642 - RNA, 64 nt, hsa
ucauaaggagcuuaucugaacagauuuaucuaagaaaaaaaaaaaacgacauaaaauaagugaa

SEQ ID NO: 28643 - RNA, 64 nt, hsa
cauaaggagcuuaucugaacagauuuaucuaagaaaaaaaaaaaacgacauaaaauaagugaaa

SEQ ID NO: 28644 - RNA, 64 nt, hsa
auaaggagcuuaucugaacagauuuaucuaagaaaaaaaaaaaacgacauaaaauaagugaaac

SEQ ID NO: 28645 - RNA, 64 nt, hsa
uaaggagcuuaucugaacagauuuaucuaagaaaaaaaaaaaacgacauaaaauaagugaaaca

SEQ ID NO: 28646 - RNA, 64 nt, hsa
aaggagcuuaucugaacagauuuaucuaagaaaaaaaaaaaacgacauaaaauaagugaaacaa

SEQ ID NO: 28647 - RNA, 64 nt, hsa
agacagacugaauauaucuaaaauuuccagcaauaaaaaaaaaagcauuuaacuugcaccaagc

SEQ ID NO: 28648 - RNA, 64 nt, hsa
gacagacugaauauaucuaaaauuuccagcaauaaaaaaaaaagcauuuaacuugcaccaagca

SEQ ID NO: 28649 - RNA, 64 nt, hsa
acagacugaauauaucuaaaauuuccagcaauaaaaaaaaaagcauuuaacuugcaccaagcaa

SEQ ID NO: 28650 - RNA, 64 nt, hsa
agccugggugacagagccagacacugucucggggaaaaaaaaaaaaaaaaaaagacacaucacu

SEQ ID NO: 28651 - RNA, 64 nt, hsa
gccugggugacagagccagacacugucucggggaaaaaaaaaaaaaaaaaaagacacaucacua

SEQ ID NO: 28652 - RNA, 64 nt, hsa
ccugggugacagagccagacacugucucggggaaaaaaaaaaaaaaaaaaagacacaucacuau

SEQ ID NO: 28653 - RNA, 64 nt, hsa
cugggugacagagccagacacugucucggggaaaaaaaaaaaaaaaaaaagacacaucacuaua

SEQ ID NO: 28654 - RNA, 64 nt, hsa
ugggugacagagccagacacugucucggggaaaaaaaaaaaaaaaaaaagacacaucacuauaa

SEQ ID NO: 28655 - RNA, 64 nt, hsa
gggugacagagccagacacugucucggggaaaaaaaaaaaaaaaaaaagacacaucacuauaaa

SEQ ID NO: 28656 - RNA, 64 nt, hsa
ggugacagagccagacacugucucggggaaaaaaaaaaaaaaaaaaagacacaucacuauaaau

SEQ ID NO: 28657 - RNA, 64 nt, hsa
gugacagagccagacacugucucggggaaaaaaaaaaaaaaaaaaagacacaucacuauaaaua

SEQ ID NO: 28658 - RNA, 64 nt, hsa
ugacagagccagacacugucucggggaaaaaaaaaaaaaaaaaaagacacaucacuauaaauag

SEQ ID NO: 28659 - RNA, 64 nt, hsa
gacagagccagacacugucucggggaaaaaaaaaaaaaaaaaaagacacaucacuauaaauagc

SEQ ID NO: 28660 - RNA, 64 nt, hsa
acagagccagacacugucucggggaaaaaaaaaaaaaaaaaaagacacaucacuauaaauagca

SEQ ID NO: 28661 - RNA, 64 nt, hsa
cagagccagacacugucucggggaaaaaaaaaaaaaaaaaaagacacaucacuauaaauagcaa

SEQ ID NO: 28662 - RNA, 64 nt, hsa
uuuagaccccucucaguuaagaaaugcuuagauuaaaaaaaaaaaauuacguaggauuaauaca

SEQ ID NO: 28663 - RNA, 64 nt, hsa
uuagaccccucucaguuaagaaaugcuuagauuaaaaaaaaaaaauuacguaggauuaauacag

SEQ ID NO: 28664 - RNA, 64 nt, hsa
uagaccccucucaguuaagaaaugcuuagauuaaaaaaaaaaaauuacguaggauuaauacaga

SEQ ID NO: 28665 - RNA, 64 nt, hsa
agaccccucucaguuaagaaaugcuuagauuaaaaaaaaaaaauuacguaggauuaauacagaa

SEQ ID NO: 28666 - RNA, 64 nt, hsa
gaccccucucaguuaagaaaugcuuagauuaaaaaaaaaaaauuacguaggauuaauacagaaa

SEQ ID NO: 28667 - RNA, 64 nt, hsa
aguucucaauugaugacaguguuugaaucaucauaaaaaaaauaccugcuuuucaucuggacaa

SEQ ID NO: 28668 - RNA, 64 nt, hsa
uuccagccugggugacugagcgagacucugucucaaaaaaaaaaaaaaaaaaaaaaagaaaaag

SEQ ID NO: 28669 - RNA, 64 nt, hsa
uccagccugggugacugagcgagacucugucucaaaaaaaaaaaaaaaaaaaaaaagaaaaaga

SEQ ID NO: 28670 - RNA, 64 nt, hsa
ccagccugggugacugagcgagacucugucucaaaaaaaaaaaaaaaaaaaaaaagaaaaagaa

SEQ ID NO: 28671 - RNA, 64 nt, hsa
cagccugggugacugagcgagacucugucucaaaaaaaaaaaaaaaaaaaaaaagaaaaagaaa

SEQ ID NO: 28672 - RNA, 64 nt, hsa
agccugggugacugagcgagacucugucucaaaaaaaaaaaaaaaaaaaaaaagaaaaagaaaa

SEQ ID NO: 28673 - RNA, 64 nt, hsa
gccugggugacugagcgagacucugucucaaaaaaaaaaaaaaaaaaaaaaagaaaaagaaaaa

SEQ ID NO: 28674 - RNA, 64 nt, hsa
ccugggugacugagcgagacucugucucaaaaaaaaaaaaaaaaaaaaaaagaaaaagaaaaag

SEQ ID NO: 28675 - RNA, 64 nt, hsa
cugggugacugagcgagacucugucucaaaaaaaaaaaaaaaaaaaaaaagaaaaagaaaaaga

SEQ ID NO: 28676 - RNA, 64 nt, hsa
ugggugacugagcgagacucugucucaaaaaaaaaaaaaaaaaaaaaaagaaaaagaaaaagaa

SEQ ID NO: 28677 - RNA, 64 nt, hsa
gggugacugagcgagacucugucucaaaaaaaaaaaaaaaaaaaaaaagaaaaagaaaaagaaa

SEQ ID NO: 28678 - RNA, 64 nt, hsa
ggugacugagcgagacucugucucaaaaaaaaaaaaaaaaaaaaaaagaaaaagaaaaagaaaa

SEQ ID NO: 28679 - RNA, 64 nt, hsa
gugacugagcgagacucugucucaaaaaaaaaaaaaaaaaaaaaaagaaaaagaaaaagaaaag

SEQ ID NO: 28680 - RNA, 64 nt, hsa
ugacugagcgagacucugucucaaaaaaaaaaaaaaaaaaaaaaagaaaaagaaaaagaaaaga

SEQ ID NO: 28681 - RNA, 64 nt, hsa
gacugagcgagacucugucucaaaaaaaaaaaaaaaaaaaaaaagaaaaagaaaaagaaaagaa

SEQ ID NO: 28682 - RNA, 64 nt, hsa
acugagcgagacucugucucaaaaaaaaaaaaaaaaaaaaaaagaaaaagaaaaagaaaagaaa

SEQ ID NO: 28683 - RNA, 64 nt, hsa
cugagcgagacucugucucaaaaaaaaaaaaaaaaaaaaaaagaaaaagaaaaagaaaagaaaa

SEQ ID NO: 28684 - RNA, 64 nt, hsa
gguuuuuucuuuuuucuuuuaccaguacaguaagaaaaaaaaaaaaaaaaaaaaagccaugcua

SEQ ID NO: 28685 - RNA, 64 nt, hsa
guuuuuucuuuuuucuuuuaccaguacaguaagaaaaaaaaaaaaaaaaaaaaagccaugcuau

SEQ ID NO: 28686 - RNA, 64 nt, hsa
uuuuuucuuuuuucuuuuaccaguacaguaagaaaaaaaaaaaaaaaaaaaaagccaugcuauc

SEQ ID NO: 28687 - RNA, 64 nt, hsa
uuuuucuuuuuucuuuuaccaguacaguaagaaaaaaaaaaaaaaaaaaaaagccaugcuauca

SEQ ID NO: 28688 - RNA, 64 nt, hsa
uuuucuuuuuucuuuuaccaguacaguaagaaaaaaaaaaaaaaaaaaaaagccaugcuaucaa

SEQ ID NO: 28689 - RNA, 64 nt, hsa
uuucuuuuuucuuuuaccaguacaguaagaaaaaaaaaaaaaaaaaaaaagccaugcuaucaau

SEQ ID NO: 28690 - RNA, 64 nt, hsa
uucuuuuuucuuuuaccaguacaguaagaaaaaaaaaaaaaaaaaaaaagccaugcuaucaauc

SEQ ID NO: 28691 - RNA, 64 nt, hsa
ucuuuuuucuuuuaccaguacaguaagaaaaaaaaaaaaaaaaaaaaagccaugcuaucaauca

SEQ ID NO: 28692 - RNA, 64 nt, hsa
cuuuuuucuuuuaccaguacaguaagaaaaaaaaaaaaaaaaaaaaagccaugcuaucaaucaa

SEQ ID NO: 28693 - RNA, 64 nt, hsa
uuuuuucuuuuaccaguacaguaagaaaaaaaaaaaaaaaaaaaaagccaugcuaucaaucaag

SEQ ID NO: 28694 - RNA, 64 nt, hsa
uuuuucuuuuaccaguacaguaagaaaaaaaaaaaaaaaaaaaaagccaugcuaucaaucaaga

SEQ ID NO: 28695 - RNA, 64 nt, hsa
uuuucuuuuaccaguacaguaagaaaaaaaaaaaaaaaaaaaaagccaugcuaucaaucaagau

SEQ ID NO: 28696 - RNA, 64 nt, hsa
uuucuuuuaccaguacaguaagaaaaaaaaaaaaaaaaaaaaagccaugcuaucaaucaagauu

SEQ ID NO: 28697 - RNA, 64 nt, hsa
uucuuuuaccaguacaguaagaaaaaaaaaaaaaaaaaaaaagccaugcuaucaaucaagauuc

SEQ ID NO: 28698 - RNA, 64 nt, hsa
gagaugcuuauagaugauaguuguacauaugugcaaaaaaaaauccacuugcaaugguaagaaa

SEQ ID NO: 28699 - RNA, 64 nt, hsa
agaugcuuauagaugauaguuguacauaugugcaaaaaaaaauccacuugcaaugguaagaaau

SEQ ID NO: 28700 - RNA, 64 nt, hsa
uaaacuuacaucagggaaaaauugguauuuaugcaaaaaaaaauguuuuuguccuugugagucc

SEQ ID NO: 28701 - RNA, 64 nt, hsa
aaacuuacaucagggaaaaauugguauuuaugcaaaaaaaaauguuuuuguccuugugagucca

SEQ ID NO: 28702 - RNA, 64 nt, hsa
aauaguucacaauguucuaaauuuggaaggacuuaaaaaaaaaacuuguuuaaauuuccaucug

SEQ ID NO: 28703 - RNA, 64 nt, hsa
auaguucacaauguucuaaauuuggaaggacuuaaaaaaaaaacuuguuuaaauuuccaucugu

SEQ ID NO: 28704 - RNA, 64 nt, hsa
uaguucacaauguucuaaauuuggaaggacuuaaaaaaaaaacuuguuuaaauuuccaucuguu

SEQ ID NO: 28705 - RNA, 64 nt, hsa
ucaggauuuaagucugagguagucaacccucaggaaaaaaaaaauggcuuaucugaaaucagua

SEQ ID NO: 28706 - RNA, 64 nt, hsa
caggauuuaagucugagguagucaacccucaggaaaaaaaaaauggcuuaucugaaaucaguac

SEQ ID NO: 28707 - RNA, 64 nt, hsa
aggauuuaagucugagguagucaacccucaggaaaaaaaaaauggcuuaucugaaaucaguacu

SEQ ID NO: 28708 - RNA, 64 nt, hsa
ugauuagugccucuuucugcaaacuuuuccaucuaaaaaaaaaaauguuuuuuuuaagacagga

SEQ ID NO: 28709 - RNA, 64 nt, hsa
gauuagugccucuuucugcaaacuuuuccaucuaaaaaaaaaaauguuuuuuuuaagacaggau

SEQ ID NO: 28710 - RNA, 64 nt, hsa
auuagugccucuuucugcaaacuuuuccaucuaaaaaaaaaaauguuuuuuuuaagacaggauc

SEQ ID NO: 28711 - RNA, 64 nt, hsa
uuagugccucuuucugcaaacuuuuccaucuaaaaaaaaaaauguuuuuuuuaagacaggaucu

SEQ ID NO: 28712 - RNA, 64 nt, hsa
aaguuguugguguuuguuuaggggccauuuuguuaaaaaaaaaaagcacauaacuuuuaacacu

SEQ ID NO: 28713 - RNA, 64 nt, hsa
aguuguugguguuuguuuaggggccauuuuguuaaaaaaaaaaagcacauaacuuuuaacacua

SEQ ID NO: 28714 - RNA, 64 nt, hsa
guuguugguguuuguuuaggggccauuuuguuaaaaaaaaaaagcacauaacuuuuaacacuag

SEQ ID NO: 28715 - RNA, 64 nt, hsa
uuguugguguuuguuuaggggccauuuuguuaaaaaaaaaaagcacauaacuuuuaacacuaga

SEQ ID NO: 28716 - RNA, 64 nt, hsa
cagaauauuaagaaaaugaaguaacugauuuucuaaaaaaaaaaaaaaaaaaaauuucuacauu

SEQ ID NO: 28717 - RNA, 64 nt, hsa
agaauauuaagaaaaugaaguaacugauuuucuaaaaaaaaaaaaaaaaaaaauuucuacauua

SEQ ID NO: 28718 - RNA, 64 nt, hsa
gaauauuaagaaaaugaaguaacugauuuucuaaaaaaaaaaaaaaaaaaaauuucuacauuau

SEQ ID NO: 28719 - RNA, 64 nt, hsa
aauauuaagaaaaugaaguaacugauuuucuaaaaaaaaaaaaaaaaaaaauuucuacauuaua

SEQ ID NO: 28720 - RNA, 64 nt, hsa
auauuaagaaaaugaaguaacugauuuucuaaaaaaaaaaaaaaaaaaaauuucuacauuauaa

SEQ ID NO: 28721 - RNA, 64 nt, hsa
uauuaagaaaaugaaguaacugauuuucuaaaaaaaaaaaaaaaaaaaauuucuacauuauaac

SEQ ID NO: 28722 - RNA, 64 nt, hsa
auuaagaaaaugaaguaacugauuuucuaaaaaaaaaaaaaaaaaaaauuucuacauuauaacu

SEQ ID NO: 28723 - RNA, 64 nt, hsa
uuaagaaaaugaaguaacugauuuucuaaaaaaaaaaaaaaaaaaaauuucuacauuauaacuc

SEQ ID NO: 28724 - RNA, 64 nt, hsa
uaagaaaaugaaguaacugauuuucuaaaaaaaaaaaaaaaaaaaauuucuacauuauaacuca

SEQ ID NO: 28725 - RNA, 64 nt, hsa
aagaaaaugaaguaacugauuuucuaaaaaaaaaaaaaaaaaaaauuucuacauuauaacucac

SEQ ID NO: 28726 - RNA, 64 nt, hsa
agaaaaugaaguaacugauuuucuaaaaaaaaaaaaaaaaaaaauuucuacauuauaacucaca

SEQ ID NO: 28727 - RNA, 64 nt, hsa
gaaaaugaaguaacugauuuucuaaaaaaaaaaaaaaaaaaaauuucuacauuauaacucacag

SEQ ID NO: 28728 - RNA, 64 nt, hsa
aaaaugaaguaacugauuuucuaaaaaaaaaaaaaaaaaaaauuucuacauuauaacucacagc

SEQ ID NO: 28729 - RNA, 64 nt, hsa
cugucugugaaauaauguaagaagcuuuucacuuaaaaaaaaugcauuacuuucacuuaacacu

SEQ ID NO: 28730 - RNA, 64 nt, hsa
cacuccagucuggguaacagggagacugcaucucaaaaaaaaaaaaaaaaaaaaaaaagggcug

SEQ ID NO: 28731 - RNA, 64 nt, hsa
acuccagucuggguaacagggagacugcaucucaaaaaaaaaaaaaaaaaaaaaaaagggcugu

SEQ ID NO: 28732 - RNA, 64 nt, hsa
cuccagucuggguaacagggagacugcaucucaaaaaaaaaaaaaaaaaaaaaaaagggcuguc

SEQ ID NO: 28733 - RNA, 64 nt, hsa
uccagucuggguaacagggagacugcaucucaaaaaaaaaaaaaaaaaaaaaaaagggcugucc

SEQ ID NO: 28734 - RNA, 64 nt, hsa
ccagucuggguaacagggagacugcaucucaaaaaaaaaaaaaaaaaaaaaaaagggcugucca

SEQ ID NO: 28735 - RNA, 64 nt, hsa
cagucuggguaacagggagacugcaucucaaaaaaaaaaaaaaaaaaaaaaaagggcuguccau

SEQ ID NO: 28736 - RNA, 64 nt, hsa
agucuggguaacagggagacugcaucucaaaaaaaaaaaaaaaaaaaaaaaagggcuguccaug

SEQ ID NO: 28737 - RNA, 64 nt, hsa
gucuggguaacagggagacugcaucucaaaaaaaaaaaaaaaaaaaaaaaagggcuguccaugu

SEQ ID NO: 28738 - RNA, 64 nt, hsa
ucuggguaacagggagacugcaucucaaaaaaaaaaaaaaaaaaaaaaaagggcuguccaugua

SEQ ID NO: 28739 - RNA, 64 nt, hsa
cuggguaacagggagacugcaucucaaaaaaaaaaaaaaaaaaaaaaaagggcuguccauguau

SEQ ID NO: 28740 - RNA, 64 nt, hsa
uggguaacagggagacugcaucucaaaaaaaaaaaaaaaaaaaaaaaagggcuguccauguauu

SEQ ID NO: 28741 - RNA, 64 nt, hsa
ggguaacagggagacugcaucucaaaaaaaaaaaaaaaaaaaaaaaagggcuguccauguauuc

SEQ ID NO: 28742 - RNA, 64 nt, hsa
gguaacagggagacugcaucucaaaaaaaaaaaaaaaaaaaaaaaagggcuguccauguauuca

SEQ ID NO: 28743 - RNA, 64 nt, hsa
guaacagggagacugcaucucaaaaaaaaaaaaaaaaaaaaaaaagggcuguccauguauucac

SEQ ID NO: 28744 - RNA, 64 nt, hsa
uaacagggagacugcaucucaaaaaaaaaaaaaaaaaaaaaaaagggcuguccauguauucaca

SEQ ID NO: 28745 - RNA, 64 nt, hsa
aacagggagacugcaucucaaaaaaaaaaaaaaaaaaaaaaaagggcuguccauguauucacac

SEQ ID NO: 28746 - RNA, 64 nt, hsa
acagggagacugcaucucaaaaaaaaaaaaaaaaaaaaaaaagggcuguccauguauucacaca

SEQ ID NO: 28747 - RNA, 64 nt, hsa
augaagccuguagaacugagaaggagaagcuuacaaaaaaaaaaaaauccucuucuauauugca

SEQ ID NO: 28748 - RNA, 64 nt, hsa
ugaagccuguagaacugagaaggagaagcuuacaaaaaaaaaaaaauccucuucuauauugcag

SEQ ID NO: 28749 - RNA, 64 nt, hsa
gaagccuguagaacugagaaggagaagcuuacaaaaaaaaaaaaauccucuucuauauugcagu

SEQ ID NO: 28750 - RNA, 64 nt, hsa
aagccuguagaacugagaaggagaagcuuacaaaaaaaaaaaaauccucuucuauauugcagug

SEQ ID NO: 28751 - RNA, 64 nt, hsa
agccuguagaacugagaaggagaagcuuacaaaaaaaaaaaaauccucuucuauauugcagugu

SEQ ID NO: 28752 - RNA, 64 nt, hsa
gccuguagaacugagaaggagaagcuuacaaaaaaaaaaaaauccucuucuauauugcaguguc

SEQ ID NO: 28753 - RNA, 64 nt, hsa
cccacagauuaaaccaaccacagaucaaaaauagaaaaaaaaaaaaaaagaaaaaaagaaugua

SEQ ID NO: 28754 - RNA, 64 nt, hsa
ccacagauuaaaccaaccacagaucaaaaauagaaaaaaaaaaaaaaagaaaaaaagaauguaa

SEQ ID NO: 28755 - RNA, 64 nt, hsa
cacagauuaaaccaaccacagaucaaaaauagaaaaaaaaaaaaaaagaaaaaaagaauguaaa

SEQ ID NO: 28756 - RNA, 64 nt, hsa
acagauuaaaccaaccacagaucaaaaauagaaaaaaaaaaaaaaagaaaaaaagaauguaaaa

SEQ ID NO: 28757 - RNA, 64 nt, hsa
cagauuaaaccaaccacagaucaaaaauagaaaaaaaaaaaaaaagaaaaaaagaauguaaaau

SEQ ID NO: 28758 - RNA, 64 nt, hsa
agauuaaaccaaccacagaucaaaaauagaaaaaaaaaaaaaaagaaaaaaagaauguaaaauu

SEQ ID NO: 28759 - RNA, 64 nt, hsa
gauuaaaccaaccacagaucaaaaauagaaaaaaaaaaaaaaagaaaaaaagaauguaaaauuu

SEQ ID NO: 28760 - RNA, 64 nt, hsa
auuaaaccaaccacagaucaaaaauagaaaaaaaaaaaaaaagaaaaaaagaauguaaaauuuu

SEQ ID NO: 28761 - RNA, 64 nt, hsa
aaccaacccaguuacuuauauuaauaauauucagaaaaaaaaaaaaagaaaaggaaaaagaaaa

SEQ ID NO: 28762 - RNA, 64 nt, hsa
accaacccaguuacuuauauuaauaauauucagaaaaaaaaaaaaagaaaaggaaaaagaaaaa

SEQ ID NO: 28763 - RNA, 64 nt, hsa
ccaacccaguuacuuauauuaauaauauucagaaaaaaaaaaaaagaaaaggaaaaagaaaaau

SEQ ID NO: 28764 - RNA, 64 nt, hsa
caacccaguuacuuauauuaauaauauucagaaaaaaaaaaaaagaaaaggaaaaagaaaaaua

SEQ ID NO: 28765 - RNA, 64 nt, hsa
aacccaguuacuuauauuaauaauauucagaaaaaaaaaaaaagaaaaggaaaaagaaaaauau

SEQ ID NO: 28766 - RNA, 64 nt, hsa
acccaguuacuuauauuaauaauauucagaaaaaaaaaaaaagaaaaggaaaaagaaaaauaua

SEQ ID NO: 28767 - RNA, 64 nt, hsa
uguacuuuuaccaguuucuuugucccaccaacuuaaaaaaaaaaaguacaauucauuguuuugc

SEQ ID NO: 28768 - RNA, 64 nt, hsa
guacuuuuaccaguuucuuugucccaccaacuuaaaaaaaaaaaguacaauucauuguuuugca

SEQ ID NO: 28769 - RNA, 64 nt, hsa
uacuuuuaccaguuucuuugucccaccaacuuaaaaaaaaaaaguacaauucauuguuuugcaa

SEQ ID NO: 28770 - RNA, 64 nt, hsa
acuuuuaccaguuucuuugucccaccaacuuaaaaaaaaaaaguacaauucauuguuuugcaaa

SEQ ID NO: 28771 - RNA, 64 nt, hsa
uaauuaugacaugagaaugaagaaauuauuuuggaaaaaaaaaaugaccuaauuuaccuaucag

SEQ ID NO: 28772 - RNA, 64 nt, hsa
aauuaugacaugagaaugaagaaauuauuuuggaaaaaaaaaaugaccuaauuuaccuaucagu

SEQ ID NO: 28773 - RNA, 64 nt, hsa
auuaugacaugagaaugaagaaauuauuuuggaaaaaaaaaaugaccuaauuuaccuaucagug

SEQ ID NO: 28774 - RNA, 64 nt, hsa
gacuuuccacuuuguccuuucugcucuugugaagaaaaaaaaaagcauuuucgaggaaagaauu

SEQ ID NO: 28775 - RNA, 64 nt, hsa
acuuuccacuuuguccuuucugcucuugugaagaaaaaaaaaagcauuuucgaggaaagaauua

SEQ ID NO: 28776 - RNA, 64 nt, hsa
cuuuccacuuuguccuuucugcucuugugaagaaaaaaaaaagcauuuucgaggaaagaauuau

SEQ ID NO: 28777 - RNA, 64 nt, hsa
auaaauaauuuuucacauuguauuguugcuauauaaaaaaaauaauagaauugguuggguuucu

SEQ ID NO: 28778 - RNA, 64 nt, hsa
uuguauuauuuggaguuagguccucacuugggggaaaaaaaaaaaagaaaagccaagcaaacca

SEQ ID NO: 28779 - RNA, 64 nt, hsa
uguauuauuuggaguuagguccucacuugggggaaaaaaaaaaaagaaaagccaagcaaaccaa

SEQ ID NO: 28780 - RNA, 64 nt, hsa
guauuauuuggaguuagguccucacuugggggaaaaaaaaaaaagaaaagccaagcaaaccaau

SEQ ID NO: 28781 - RNA, 64 nt, hsa
uauuauuuggaguuagguccucacuugggggaaaaaaaaaaaagaaaagccaagcaaaccaaug

SEQ ID NO: 28782 - RNA, 64 nt, hsa
auuauuuggaguuagguccucacuugggggaaaaaaaaaaaagaaaagccaagcaaaccaaugg

SEQ ID NO: 28783 - RNA, 64 nt, hsa
agacugggaucccccaccccaacagugauuuuggaaaaaaaaaugaaaguucuguucguuuauc

SEQ ID NO: 28784 - RNA, 64 nt, hsa
gacugggaucccccaccccaacagugauuuuggaaaaaaaaaugaaaguucuguucguuuaucc

SEQ ID NO: 28785 - RNA, 64 nt, hsa
guuugagaccaauguagugagacucaucucugccaaaaaaaaaaaauuagccgggcaugguggc

SEQ ID NO: 28786 - RNA, 64 nt, hsa
uuugagaccaauguagugagacucaucucugccaaaaaaaaaaaauuagccgggcaugguggca

SEQ ID NO: 28787 - RNA, 64 nt, hsa
uugagaccaauguagugagacucaucucugccaaaaaaaaaaaauuagccgggcaugguggcac

SEQ ID NO: 28788 - RNA, 64 nt, hsa
ugagaccaauguagugagacucaucucugccaaaaaaaaaaaauuagccgggcaugguggcaca

SEQ ID NO: 28789 - RNA, 64 nt, hsa
gagaccaauguagugagacucaucucugccaaaaaaaaaaaauuagccgggcaugguggcacac

SEQ ID NO: 28790 - RNA, 64 nt, hsa
uaggagucuguuauuuaaaaaaagcauuaaauuuaaaaaaaaacugucuugucuacuuuuagcu

SEQ ID NO: 28791 - RNA, 64 nt, hsa
aggagucuguuauuuaaaaaaagcauuaaauuuaaaaaaaaacugucuugucuacuuuuagcuu

SEQ ID NO: 28792 - RNA, 64 nt, hsa
auaaaacuguuaaaucauggccugauaucaucuuaaaaaaaaaucucagaaucugaaauaagcc

SEQ ID NO: 28793 - RNA, 64 nt, hsa
uaaaacuguuaaaucauggccugauaucaucuuaaaaaaaaaucucagaaucugaaauaagccc

SEQ ID NO: 28794 - RNA, 64 nt, hsa
uuuugaaauuaaauuaucuauucuucccccccccaaaaaaaaguauuguaaauccuuaaguaaa

SEQ ID NO: 28795 - RNA, 64 nt, hsa
ugagccucauguaagaacaugauggucuuuuuuuaaaaaaaaagucgugccaauuauaagugcu

SEQ ID NO: 28796 - RNA, 64 nt, hsa
gagccucauguaagaacaugauggucuuuuuuuaaaaaaaaagucgugccaauuauaagugcuu

SEQ ID NO: 28797 - RNA, 64 nt, hsa
uuuuuuugagauggagucucguaaaguuaccuuuaaaaaaaaaguucuauuuucccuguauugg

SEQ ID NO: 28798 - RNA, 64 nt, hsa
uuuuuugagauggagucucguaaaguuaccuuuaaaaaaaaaguucuauuuucccuguauuggu

SEQ ID NO: 28799 - RNA, 64 nt, hsa
uuuaauggcuaacaacucaaucucauuaaguuggaaaaaaaacuuaucaaagagacauuuacau

SEQ ID NO: 28800 - RNA, 64 nt, hsa
uaagcguguguaaaugggcuuuagucuggaaaccaaaaaaaaaaaaaaaauuuagucauucuau

SEQ ID NO: 28801 - RNA, 64 nt, hsa
aagcguguguaaaugggcuuuagucuggaaaccaaaaaaaaaaaaaaaauuuagucauucuaua

SEQ ID NO: 28802 - RNA, 64 nt, hsa
agcguguguaaaugggcuuuagucuggaaaccaaaaaaaaaaaaaaaauuuagucauucuauag

SEQ ID NO: 28803 - RNA, 64 nt, hsa
gcguguguaaaugggcuuuagucuggaaaccaaaaaaaaaaaaaaaauuuagucauucuauagg

SEQ ID NO: 28804 - RNA, 64 nt, hsa
cguguguaaaugggcuuuagucuggaaaccaaaaaaaaaaaaaaaauuuagucauucuauagga

SEQ ID NO: 28805 - RNA, 64 nt, hsa
guguguaaaugggcuuuagucuggaaaccaaaaaaaaaaaaaaaauuuagucauucuauaggau

SEQ ID NO: 28806 - RNA, 64 nt, hsa
uguguaaaugggcuuuagucuggaaaccaaaaaaaaaaaaaaaauuuagucauucuauaggauc

SEQ ID NO: 28807 - RNA, 64 nt, hsa
guguaaaugggcuuuagucuggaaaccaaaaaaaaaaaaaaaauuuagucauucuauaggauca

SEQ ID NO: 28808 - RNA, 64 nt, hsa
uguaaaugggcuuuagucuggaaaccaaaaaaaaaaaaaaaauuuagucauucuauaggaucau

SEQ ID NO: 28809 - RNA, 64 nt, hsa
aucaucuauaagggagggcugggggcgggaaaagaaaaaaaaaagucauuuugaaauuaaccuc

SEQ ID NO: 28810 - RNA, 64 nt, hsa
ucaucuauaagggagggcugggggcgggaaaagaaaaaaaaaagucauuuugaaauuaaccucc

SEQ ID NO: 28811 - RNA, 64 nt, hsa
caucuauaagggagggcugggggcgggaaaagaaaaaaaaaagucauuuugaaauuaaccuccu

SEQ ID NO: 28812 - RNA, 64 nt, hsa
ggaauagggaacuaauuuaugaaacagccaucuuaaaaaaaaaaaaaguaaacugcaaaaguac

SEQ ID NO: 28813 - RNA, 64 nt, hsa
gaauagggaacuaauuuaugaaacagccaucuuaaaaaaaaaaaaaguaaacugcaaaaguaca

SEQ ID NO: 28814 - RNA, 64 nt, hsa
aauagggaacuaauuuaugaaacagccaucuuaaaaaaaaaaaaaguaaacugcaaaaguacaa

SEQ ID NO: 28815 - RNA, 64 nt, hsa
auagggaacuaauuuaugaaacagccaucuuaaaaaaaaaaaaaguaaacugcaaaaguacaaa

SEQ ID NO: 28816 - RNA, 64 nt, hsa
uagggaacuaauuuaugaaacagccaucuuaaaaaaaaaaaaaguaaacugcaaaaguacaaaa

SEQ ID NO: 28817 - RNA, 64 nt, hsa
agggaacuaauuuaugaaacagccaucuuaaaaaaaaaaaaaguaaacugcaaaaguacaaaau

SEQ ID NO: 28818 - RNA, 64 nt, hsa
ugagaaugugacuuuuucugguguuguaaaaaagaaaaaaaaaagaaugcucauuguaaaaaua

SEQ ID NO: 28819 - RNA, 64 nt, hsa
gagaaugugacuuuuucugguguuguaaaaaagaaaaaaaaaagaaugcucauuguaaaaauaa

SEQ ID NO: 28820 - RNA, 64 nt, hsa
agaaugugacuuuuucugguguuguaaaaaagaaaaaaaaaagaaugcucauuguaaaaauaaa

SEQ ID NO: 28821 - RNA, 64 nt, hsa
acuccagccuggugacagagugagacucugucucaaaaaaaaaguuucaauguuuacuccuaga

SEQ ID NO: 28822 - RNA, 64 nt, hsa
cuccagccuggugacagagugagacucugucucaaaaaaaaaguuucaauguuuacuccuagag

SEQ ID NO: 28823 - RNA, 64 nt, hsa
ugauauuuuaggaauaacggacuuuuaaagaagcaaaaaaaaagacugaauuuccuugcuuacu

SEQ ID NO: 28824 - RNA, 64 nt, hsa
gauauuuuaggaauaacggacuuuuaaagaagcaaaaaaaaagacugaauuuccuugcuuacuu

SEQ ID NO: 28825 - RNA, 64 nt, hsa
uauuuaucuuugauuucagucuuggcaauuguuuaaaaaaaaaaucuagauuuguuuuauuagg

SEQ ID NO: 28826 - RNA, 64 nt, hsa
auuuaucuuugauuucagucuuggcaauuguuuaaaaaaaaaaucuagauuuguuuuauuaggu

SEQ ID NO: 28827 - RNA, 64 nt, hsa
uuuaucuuugauuucagucuuggcaauuguuuaaaaaaaaaaucuagauuuguuuuauuagguu

SEQ ID NO: 28828 - RNA, 64 nt, hsa
agaagaaaaaagacaaaaucgaccauaaaagaccaaaaaaaaaaaaaaaaucagaaaaccccca

SEQ ID NO: 28829 - RNA, 64 nt, hsa
gaagaaaaaagacaaaaucgaccauaaaagaccaaaaaaaaaaaaaaaaucagaaaacccccac

SEQ ID NO: 28830 - RNA, 64 nt, hsa
aagaaaaaagacaaaaucgaccauaaaagaccaaaaaaaaaaaaaaaaucagaaaacccccacc

SEQ ID NO: 28831 - RNA, 64 nt, hsa
agaaaaaagacaaaaucgaccauaaaagaccaaaaaaaaaaaaaaaaucagaaaacccccaccu

SEQ ID NO: 28832 - RNA, 64 nt, hsa
gaaaaaagacaaaaucgaccauaaaagaccaaaaaaaaaaaaaaaaucagaaaacccccaccua

SEQ ID NO: 28833 - RNA, 64 nt, hsa
aaaaaagacaaaaucgaccauaaaagaccaaaaaaaaaaaaaaaaucagaaaacccccaccuaa

SEQ ID NO: 28834 - RNA, 64 nt, hsa
aaaaagacaaaaucgaccauaaaagaccaaaaaaaaaaaaaaaaucagaaaacccccaccuaau

SEQ ID NO: 28835 - RNA, 64 nt, hsa
aaaagacaaaaucgaccauaaaagaccaaaaaaaaaaaaaaaaucagaaaacccccaccuaauc

SEQ ID NO: 28836 - RNA, 64 nt, hsa
aaagacaaaaucgaccauaaaagaccaaaaaaaaaaaaaaaaucagaaaacccccaccuaaucc

SEQ ID NO: 28837 - RNA, 64 nt, hsa
uugaaacuaguacuuuucccuuuaaaaacaaaccaaaaaaaaaaacaaaaaaaaacuuuuuaau

SEQ ID NO: 28838 - RNA, 64 nt, hsa
ugaaacuaguacuuuucccuuuaaaaacaaaccaaaaaaaaaaacaaaaaaaaacuuuuuaauu

SEQ ID NO: 28839 - RNA, 64 nt, hsa
gaaacuaguacuuuucccuuuaaaaacaaaccaaaaaaaaaaacaaaaaaaaacuuuuuaauua

SEQ ID NO: 28840 - RNA, 64 nt, hsa
aaacuaguacuuuucccuuuaaaaacaaaccaaaaaaaaaaacaaaaaaaaacuuuuuaauuaa

SEQ ID NO: 28841 - RNA, 64 nt, hsa
cuuuucccuuuaaaaacaaaccaaaaaaaaaaacaaaaaaaaacuuuuuaauuaaagaaccuag

SEQ ID NO: 28842 - RNA, 64 nt, hsa
uuuucccuuuaaaaacaaaccaaaaaaaaaaacaaaaaaaaacuuuuuaauuaaagaaccuagu

SEQ ID NO: 28843 - RNA, 64 nt, hsa
ggggaagaugguucaaagauacaagaaaaaguagaaaaaaaaauaacacuuaacuaaaaccccu

SEQ ID NO: 28844 - RNA, 64 nt, hsa
gggaagaugguucaaagauacaagaaaaaguagaaaaaaaaauaacacuuaacuaaaaccccua

SEQ ID NO: 28845 - RNA, 64 nt, hsa
uuccaaagcugaagauccccauucuuucucuuugaaaaaaaaaaaggccuaaugcauuauuuug

SEQ ID NO: 28846 - RNA, 64 nt, hsa
uccaaagcugaagauccccauucuuucucuuugaaaaaaaaaaaggccuaaugcauuauuuugu

SEQ ID NO: 28847 - RNA, 64 nt, hsa
ccaaagcugaagauccccauucuuucucuuugaaaaaaaaaaaggccuaaugcauuauuuuguc

SEQ ID NO: 28848 - RNA, 64 nt, hsa
caaagcugaagauccccauucuuucucuuugaaaaaaaaaaaggccuaaugcauuauuuuguca

SEQ ID NO: 28849 - RNA, 64 nt, hsa
cgaaaaaguauugaagauuagcuuuuaaaaacugaaaaaaaaaaaugaaugacucacauagagg

SEQ ID NO: 28850 - RNA, 64 nt, hsa
gaaaaaguauugaagauuagcuuuuaaaaacugaaaaaaaaaaaugaaugacucacauagaggu

SEQ ID NO: 28851 - RNA, 64 nt, hsa
aaaaaguauugaagauuagcuuuuaaaaacugaaaaaaaaaaaugaaugacucacauagagguu

SEQ ID NO: 28852 - RNA, 64 nt, hsa
aaaaguauugaagauuagcuuuuaaaaacugaaaaaaaaaaaugaaugacucacauagagguug

SEQ ID NO: 28853 - RNA, 64 nt, hsa
aaccaaaguccuuuuucccaaagguucugaaaggaaaaaaaaaaaaaacaaaaaaaaagaaaaa

SEQ ID NO: 28854 - RNA, 64 nt, hsa
accaaaguccuuuuucccaaagguucugaaaggaaaaaaaaaaaaaacaaaaaaaaagaaaaac

SEQ ID NO: 28855 - RNA, 64 nt, hsa
ccaaaguccuuuuucccaaagguucugaaaggaaaaaaaaaaaaaacaaaaaaaaagaaaaaca

SEQ ID NO: 28856 - RNA, 64 nt, hsa
caaaguccuuuuucccaaagguucugaaaggaaaaaaaaaaaaaacaaaaaaaaagaaaaacaa

SEQ ID NO: 28857 - RNA, 64 nt, hsa
aaaguccuuuuucccaaagguucugaaaggaaaaaaaaaaaaaacaaaaaaaaagaaaaacaaa

SEQ ID NO: 28858 - RNA, 63 nt, hsa
aaguccuuuuucccaaagguucugaaaggaaaaaaaaaaaaaacaaaaaaaaagaaaaacaaa

SEQ ID NO: 28859 - RNA, 62 nt, hsa
aguccuuuuucccaaagguucugaaaggaaaaaaaaaaaaaacaaaaaaaaagaaaaacaaa

SEQ ID NO: 28860 - RNA, 64 nt, hsa
uaacauggugaaacccugccucuacuaaaaauacaaaaaaaaacaaaauuagccgggcgugguu

SEQ ID NO: 28861 - RNA, 64 nt, hsa
aacauggugaaacccugccucuacuaaaaauacaaaaaaaaacaaaauuagccgggcgugguug

SEQ ID NO: 28862 - RNA, 64 nt, hsa
ucccucaaaaaguuaccaccacaucagaaaaaauaaaaaaaaaauaguaaaguaggcagagcua

SEQ ID NO: 28863 - RNA, 64 nt, hsa
cccucaaaaaguuaccaccacaucagaaaaaauaaaaaaaaaauaguaaaguaggcagagcuag

SEQ ID NO: 28864 - RNA, 64 nt, hsa
ccucaaaaaguuaccaccacaucagaaaaaauaaaaaaaaaauaguaaaguaggcagagcuagg

SEQ ID NO: 28865 - RNA, 64 nt, hsa
ucgcaugaaaaugacagauaacacuguaguuccuaaaaaaaaaauuaaaugcauaagcauaagg

SEQ ID NO: 28866 - RNA, 64 nt, hsa
cgcaugaaaaugacagauaacacuguaguuccuaaaaaaaaaauuaaaugcauaagcauaaggu

SEQ ID NO: 28867 - RNA, 64 nt, hsa
gcaugaaaaugacagauaacacuguaguuccuaaaaaaaaaauuaaaugcauaagcauaaggua

SEQ ID NO: 28868 - RNA, 64 nt, hsa
cagagaugucugcucuuuuaaauuauauauaaggaaaaaaaauagccugccuugggacaggugu

SEQ ID NO: 28869 - RNA, 64 nt, hsa
uaaauauucuugaacaauuaguagauccagaaagaaaaaaaaauaugcuuucucugugugugua

SEQ ID NO: 28870 - RNA, 64 nt, hsa
aaauauucuugaacaauuaguagauccagaaagaaaaaaaaauaugcuuucucuguguguguac

SEQ ID NO: 28871 - RNA, 64 nt, hsa
gaaauggggaaaaaagaaaacaacagcaagucagaaaaaaaaaacaagagagagaaauucauau

SEQ ID NO: 28872 - RNA, 64 nt, hsa
aaauggggaaaaaagaaaacaacagcaagucagaaaaaaaaaacaagagagagaaauucauauu

SEQ ID NO: 28873 - RNA, 64 nt, hsa
aauggggaaaaaagaaaacaacagcaagucagaaaaaaaaaacaagagagagaaauucauauua

SEQ ID NO: 28874 - RNA, 64 nt, hsa
uggggaggggaaaucuuuucuuucuuucccccuuaaaaaaaaacacaucugccccgaacacuuu

SEQ ID NO: 28875 - RNA, 64 nt, hsa
ggggaggggaaaucuuuucuuucuuucccccuuaaaaaaaaacacaucugccccgaacacuuuc

SEQ ID NO: 28876 - RNA, 64 nt, hsa
uuuuuugaaugaaaugccacugugcauuuucagaaaaaaaaaucucugauaaacagacuuugaa

SEQ ID NO: 28877 - RNA, 64 nt, hsa
guuuuuugaaugaaaugccacugugcauuuucagaaaaaaaaaucucugauaaacagacuuuga

SEQ ID NO: 28878 - RNA, 64 nt, hsa
acaaguucuaucacuccuuuaccuagggaaggaaaaaaaaaauauauauauauaugugugugug

SEQ ID NO: 28879 - RNA, 64 nt, hsa
cacaaguucuaucacuccuuuaccuagggaaggaaaaaaaaaauauauauauauaugugugugu

SEQ ID NO: 28880 - RNA, 64 nt, hsa
gcacaaguucuaucacuccuuuaccuagggaaggaaaaaaaaaauauauauauauaugugugug

SEQ ID NO: 28881 - RNA, 64 nt, hsa
ucuuuacuuucucccaguauguuuuaacaaaaaaaaaaaaaagcaggaaaaaaggaauauuuag

SEQ ID NO: 28882 - RNA, 64 nt, hsa
uucuuuacuuucucccaguauguuuuaacaaaaaaaaaaaaaagcaggaaaaaaggaauauuua

SEQ ID NO: 28883 - RNA, 64 nt, hsa
uuucuuuacuuucucccaguauguuuuaacaaaaaaaaaaaaaagcaggaaaaaaggaauauuu

SEQ ID NO: 28884 - RNA, 64 nt, hsa
uuuucuuuacuuucucccaguauguuuuaacaaaaaaaaaaaaaagcaggaaaaaaggaauauu

SEQ ID NO: 28885 - RNA, 64 nt, hsa
uuuuucuuuacuuucucccaguauguuuuaacaaaaaaaaaaaaaagcaggaaaaaaggaauau

SEQ ID NO: 28886 - RNA, 64 nt, hsa
guuuuucuuuacuuucucccaguauguuuuaacaaaaaaaaaaaaaagcaggaaaaaaggaaua

SEQ ID NO: 28887 - RNA, 64 nt, hsa
aguuuuucuuuacuuucucccaguauguuuuaacaaaaaaaaaaaaaagcaggaaaaaaggaau

SEQ ID NO: 28888 - RNA, 64 nt, hsa
ugcagugguuucagaggcagaucugagaagauuaaaaaaaaaucucaauguaucagcuuuuuuu

SEQ ID NO: 28889 - RNA, 64 nt, hsa
uugcagugguuucagaggcagaucugagaagauuaaaaaaaaaucucaauguaucagcuuuuuu

SEQ ID NO: 28890 - RNA, 64 nt, hsa
uuuagucagaauuccuagacugaaagaaccuaaaaaaaaaaauauuuuaaagauauaaauauau

SEQ ID NO: 28891 - RNA, 64 nt, hsa
auuuagucagaauuccuagacugaaagaaccuaaaaaaaaaaauauuuuaaagauauaaauaua

SEQ ID NO: 28892 - RNA, 64 nt, hsa
gauuuagucagaauuccuagacugaaagaaccuaaaaaaaaaaauauuuuaaagauauaaauau

SEQ ID NO: 28893 - RNA, 64 nt, hsa
ugauuuagucagaauuccuagacugaaagaaccuaaaaaaaaaaauauuuuaaagauauaaaua

SEQ ID NO: 28894 - RNA, 64 nt, hsa
uguuagguauuauuugaauggaaagacacccaaaaaaaaaaaugugcuccgacuagggggaaaa

SEQ ID NO: 28895 - RNA, 64 nt, hsa
guguuagguauuauuugaauggaaagacacccaaaaaaaaaaaugugcuccgacuagggggaaa

SEQ ID NO: 28896 - RNA, 64 nt, hsa
aguguuagguauuauuugaauggaaagacacccaaaaaaaaaaaugugcuccgacuagggggaa

SEQ ID NO: 28897 - RNA, 64 nt, hsa
caguguuagguauuauuugaauggaaagacacccaaaaaaaaaaaugugcuccgacuaggggga

SEQ ID NO: 28898 - RNA, 64 nt, hsa
uaauuuauuauacaccuuagucuuuccuuaguuaaaaaaaaauucccuaaagacuaacuugaaa

SEQ ID NO: 28899 - RNA, 64 nt, hsa
auaauuuauuauacaccuuagucuuuccuuaguuaaaaaaaaauucccuaaagacuaacuugaa

SEQ ID NO: 28900 - RNA, 64 nt, hsa
ugcuuuaucccacggaaaaugccaaucucuucuaaaaaaaaacaaaauuaaauuaaaaacagaa

SEQ ID NO: 28901 - RNA, 64 nt, hsa
cugcuuuaucccacggaaaaugccaaucucuucuaaaaaaaaacaaaauuaaauuaaaaacaga

SEQ ID NO: 28902 - RNA, 64 nt, hsa
ccugguggcacagugagacuccaccucaaaaaaaaaaaaaaauccuugaacuaaugacucaaau

SEQ ID NO: 28903 - RNA, 64 nt, hsa
gccugguggcacagugagacuccaccucaaaaaaaaaaaaaaauccuugaacuaaugacucaaa

SEQ ID NO: 28904 - RNA, 64 nt, hsa
agccugguggcacagugagacuccaccucaaaaaaaaaaaaaaauccuugaacuaaugacucaa

SEQ ID NO: 28905 - RNA, 64 nt, hsa
cagccugguggcacagugagacuccaccucaaaaaaaaaaaaaaauccuugaacuaaugacuca

SEQ ID NO: 28906 - RNA, 64 nt, hsa
ccagccugguggcacagugagacuccaccucaaaaaaaaaaaaaaauccuugaacuaaugacuc

SEQ ID NO: 28907 - RNA, 64 nt, hsa
uccagccugguggcacagugagacuccaccucaaaaaaaaaaaaaaauccuugaacuaaugacu

SEQ ID NO: 28908 - RNA, 64 nt, hsa
cuccagccugguggcacagugagacuccaccucaaaaaaaaaaaaaaauccuugaacuaaugac

SEQ ID NO: 28909 - RNA, 64 nt, hsa
gcuccagccugguggcacagugagacuccaccucaaaaaaaaaaaaaaauccuugaacuaauga

SEQ ID NO: 28910 - RNA, 64 nt, hsa
ucauugugauauuugacaacucuaaaaaauaaaaaaaaaaaacuuagagcacaauaauccuugc

SEQ ID NO: 28911 - RNA, 64 nt, hsa
gucauugugauauuugacaacucuaaaaaauaaaaaaaaaaaacuuagagcacaauaauccuug

SEQ ID NO: 28912 - RNA, 64 nt, hsa
ugucauugugauauuugacaacucuaaaaaauaaaaaaaaaaaacuuagagcacaauaauccuu

SEQ ID NO: 28913 - RNA, 64 nt, hsa
gugucauugugauauuugacaacucuaaaaaauaaaaaaaaaaaacuuagagcacaauaauccu

SEQ ID NO: 28914 - RNA, 64 nt, hsa
cgugucauugugauauuugacaacucuaaaaaauaaaaaaaaaaaacuuagagcacaauaaucc

SEQ ID NO: 28915 - RNA, 64 nt, hsa
gaugagcaaaaucuacuucuaguguuaggaauaaaaaaaaaagaccaguaacuuuguuuuucaa

SEQ ID NO: 28916 - RNA, 64 nt, hsa
ugaugagcaaaaucuacuucuaguguuaggaauaaaaaaaaaagaccaguaacuuuguuuuuca

SEQ ID NO: 28917 - RNA, 64 nt, hsa
uugaugagcaaaaucuacuucuaguguuaggaauaaaaaaaaaagaccaguaacuuuguuuuuc

SEQ ID NO: 28918 - RNA, 64 nt, hsa
gccuuugccauuugucuuagaaaguuauuuuuuaaaaaaaaaucauacuuacuauuaguaucua

SEQ ID NO: 28919 - RNA, 64 nt, hsa
agccuuugccauuugucuuagaaaguuauuuuuuaaaaaaaaaucauacuuacuauuaguaucu

SEQ ID NO: 28920 - RNA, 64 nt, hsa
aaaaacaauacaaguuuuagaaaacaaagcauuaaaaaaaaagccuaucaguauuaugggcaau

SEQ ID NO: 28921 - RNA, 64 nt, hsa
uaaaaacaauacaaguuuuagaaaacaaagcauuaaaaaaaaagccuaucaguauuaugggcaa

SEQ ID NO: 28922 - RNA, 64 nt, hsa
gaaaaguuacucuagaggaaaaaugucuaaagaaaaaaaaaauucaaaaaguuuacauuaauua

SEQ ID NO: 28923 - RNA, 64 nt, hsa
ugaaaaguuacucuagaggaaaaaugucuaaagaaaaaaaaaauucaaaaaguuuacauuaauu

SEQ ID NO: 28924 - RNA, 64 nt, hsa
uugaaaaguuacucuagaggaaaaaugucuaaagaaaaaaaaaauucaaaaaguuuacauuaau

SEQ ID NO: 28925 - RNA, 64 nt, hsa
uaggcucugcaucaagauugcacaaaaaaaaaaaaaaaaaaauugaauaucacuccuccaggag

SEQ ID NO: 28926 - RNA, 64 nt, hsa
uuaggcucugcaucaagauugcacaaaaaaaaaaaaaaaaaaauugaauaucacuccuccagga

SEQ ID NO: 28927 - RNA, 64 nt, hsa
uuuaggcucugcaucaagauugcacaaaaaaaaaaaaaaaaaaauugaauaucacuccuccagg

SEQ ID NO: 28928 - RNA, 64 nt, hsa
guuuaggcucugcaucaagauugcacaaaaaaaaaaaaaaaaaaauugaauaucacuccuccag

SEQ ID NO: 28929 - RNA, 64 nt, hsa
uguuuaggcucugcaucaagauugcacaaaaaaaaaaaaaaaaaaauugaauaucacuccucca

SEQ ID NO: 28930 - RNA, 64 nt, hsa
cuguuuaggcucugcaucaagauugcacaaaaaaaaaaaaaaaaaaauugaauaucacuccucc

SEQ ID NO: 28931 - RNA, 64 nt, hsa
acuguuuaggcucugcaucaagauugcacaaaaaaaaaaaaaaaaaaauugaauaucacuccuc

SEQ ID NO: 28932 - RNA, 64 nt, hsa
gacuguuuaggcucugcaucaagauugcacaaaaaaaaaaaaaaaaaaauugaauaucacuccu

SEQ ID NO: 28933 - RNA, 64 nt, hsa
ggacuguuuaggcucugcaucaagauugcacaaaaaaaaaaaaaaaaaaauugaauaucacucc

SEQ ID NO: 28934 - RNA, 64 nt, hsa
aggacuguuuaggcucugcaucaagauugcacaaaaaaaaaaaaaaaaaaauugaauaucacuc

SEQ ID NO: 28935 - RNA, 64 nt, hsa
uaggacuguuuaggcucugcaucaagauugcacaaaaaaaaaaaaaaaaaaauugaauaucacu

SEQ ID NO: 28936 - RNA, 64 nt, hsa
auaggacuguuuaggcucugcaucaagauugcacaaaaaaaaaaaaaaaaaaauugaauaucac

SEQ ID NO: 28937 - RNA, 64 nt, hsa
aucuaaagaucuauuuugccuuaccagaaaagaaaaaaaaaacccuaaaaccaaaaacuccuuu

SEQ ID NO: 28938 - RNA, 64 nt, hsa
uaucuaaagaucuauuuugccuuaccagaaaagaaaaaaaaaacccuaaaaccaaaaacuccuu

SEQ ID NO: 28939 - RNA, 64 nt, hsa
auaucuaaagaucuauuuugccuuaccagaaaagaaaaaaaaaacccuaaaaccaaaaacuccu

SEQ ID NO: 28940 - RNA, 64 nt, hsa
ucaaauuauucuugucuuucaaaaagaaccaaaaaaaaaaaauucaucauggauaaaaacuaag

SEQ ID NO: 28941 - RNA, 64 nt, hsa
aucaaauuauucuugucuuucaaaaagaaccaaaaaaaaaaaauucaucauggauaaaaacuaa

SEQ ID NO: 28942 - RNA, 64 nt, hsa
uaucaaauuauucuugucuuucaaaaagaaccaaaaaaaaaaaauucaucauggauaaaaacua

SEQ ID NO: 28943 - RNA, 64 nt, hsa
auaucaaauuauucuugucuuucaaaaagaaccaaaaaaaaaaaauucaucauggauaaaaacu

SEQ ID NO: 28944 - RNA, 64 nt, hsa
uauaucaaauuauucuugucuuucaaaaagaaccaaaaaaaaaaaauucaucauggauaaaaac

SEQ ID NO: 28945 - RNA, 64 nt, hsa
uuaacaaucuccauguaguccaaauuugucauuaaaaaaaaaucaaagaaagaaggccacguau

SEQ ID NO: 28946 - RNA, 64 nt, hsa
uuuaacaaucuccauguaguccaaauuugucauuaaaaaaaaaucaaagaaagaaggccacgua

SEQ ID NO: 28947 - RNA, 64 nt, hsa
uauguauuaauauaugcauucacuugaaaaacuaaaaaaaaacaauaauuuggaaaaacccaug

SEQ ID NO: 28948 - RNA, 64 nt, hsa
uuauguauuaauauaugcauucacuugaaaaacuaaaaaaaaacaauaauuuggaaaaacccau

SEQ ID NO: 28949 - RNA, 64 nt, hsa
ucauugaagauaaagcaaaaguaaaaaaaaaaaaaaaaaaaacaaggggaaaggguugguuagg

SEQ ID NO: 28950 - RNA, 64 nt, hsa
uucauugaagauaaagcaaaaguaaaaaaaaaaaaaaaaaaaacaaggggaaaggguugguuag

SEQ ID NO: 28951 - RNA, 64 nt, hsa
guucauugaagauaaagcaaaaguaaaaaaaaaaaaaaaaaaaacaaggggaaaggguugguua

SEQ ID NO: 28952 - RNA, 64 nt, hsa
aguucauugaagauaaagcaaaaguaaaaaaaaaaaaaaaaaaaacaaggggaaaggguugguu

SEQ ID NO: 28953 - RNA, 64 nt, hsa
aaguucauugaagauaaagcaaaaguaaaaaaaaaaaaaaaaaaaacaaggggaaaggguuggu

SEQ ID NO: 28954 - RNA, 64 nt, hsa
gaaguucauugaagauaaagcaaaaguaaaaaaaaaaaaaaaaaaaacaaggggaaaggguugg

SEQ ID NO: 28955 - RNA, 64 nt, hsa
agaaguucauugaagauaaagcaaaaguaaaaaaaaaaaaaaaaaaaacaaggggaaaggguug

SEQ ID NO: 28956 - RNA, 64 nt, hsa
aagaaguucauugaagauaaagcaaaaguaaaaaaaaaaaaaaaaaaaacaaggggaaaggguu

SEQ ID NO: 28957 - RNA, 64 nt, hsa
aaagaaguucauugaagauaaagcaaaaguaaaaaaaaaaaaaaaaaaaacaaggggaaagggu

SEQ ID NO: 28958 - RNA, 64 nt, hsa
gaaagaaguucauugaagauaaagcaaaaguaaaaaaaaaaaaaaaaaaaacaaggggaaaggg

SEQ ID NO: 28959 - RNA, 64 nt, hsa
ggaaagaaguucauugaagauaaagcaaaaguaaaaaaaaaaaaaaaaaaaacaaggggaaagg

SEQ ID NO: 28960 - RNA, 64 nt, hsa
uggaaagaaguucauugaagauaaagcaaaaguaaaaaaaaaaaaaaaaaaaacaaggggaaag

SEQ ID NO: 28961 - RNA, 64 nt, hsa
uuggaaagaaguucauugaagauaaagcaaaaguaaaaaaaaaaaaaaaaaaaacaaggggaaa

SEQ ID NO: 28962 - RNA, 64 nt, hsa
auaaagaaccucucuaugucccuuuuuuuaauuuaaaaaaaaugacucuugucuaauauucguc

SEQ ID NO: 28963 - RNA, 64 nt, hsa
aucagagaccauuaaaagaggaccauaccuauuaaaaaaaaauguggaguuggagggcuaacau

SEQ ID NO: 28964 - RNA, 64 nt, hsa
gaucagagaccauuaaaagaggaccauaccuauuaaaaaaaaauguggaguuggagggcuaaca

SEQ ID NO: 28965 - RNA, 64 nt, hsa
ggucgauaugcauuauaugugccguguguggaaaaaaaaaaagucagguacucuguuuuguaaa

SEQ ID NO: 28966 - RNA, 64 nt, hsa
gggucgauaugcauuauaugugccguguguggaaaaaaaaaaagucagguacucuguuuuguaa

SEQ ID NO: 28967 - RNA, 64 nt, hsa
ggggucgauaugcauuauaugugccguguguggaaaaaaaaaaagucagguacucuguuuugua

SEQ ID NO: 28968 - RNA, 64 nt, hsa
gggggucgauaugcauuauaugugccguguguggaaaaaaaaaaagucagguacucuguuuugu

SEQ ID NO: 28969 - RNA, 64 nt, hsa
uugggagaaaugauauauaccacuuucccagaaaaaaaaaaacuuacacuugggacuuggcaaa

SEQ ID NO: 28970 - RNA, 64 nt, hsa
guugggagaaaugauauauaccacuuucccagaaaaaaaaaaacuuacacuugggacuuggcaa

SEQ ID NO: 28971 - RNA, 64 nt, hsa
uguugggagaaaugauauauaccacuuucccagaaaaaaaaaaacuuacacuugggacuuggca

SEQ ID NO: 28972 - RNA, 64 nt, hsa
auguugggagaaaugauauauaccacuuucccagaaaaaaaaaaacuuacacuugggacuuggc

SEQ ID NO: 28973 - RNA, 64 nt, hsa
uccaugucaucagagaugguaaaauaggccgggaaaaaaaaaucuuugguaccaaagauuacac

SEQ ID NO: 28974 - RNA, 64 nt, hsa
uuccaugucaucagagaugguaaaauaggccgggaaaaaaaaaucuuugguaccaaagauuaca

SEQ ID NO: 28975 - RNA, 64 nt, hsa
uauauuagucuagggccacuuaauuuagaggaagaaaaaaaaucaacccauccauagaaauagu

SEQ ID NO: 28976 - RNA, 64 nt, hsa
gaaaaaaggcccacaauuagaaaaauuuacauuuaaaaaaaauguuguuucuauccccauuaca

SEQ ID NO: 28977 - RNA, 64 nt, hsa
uuaguuuuuaacuucaaaggcuucuuucucuuuaaaaaaaaauuauuuuuaauauagagucaaa

SEQ ID NO: 28978 - RNA, 64 nt, hsa
uuuaguuuuuaacuucaaaggcuucuuucucuuuaaaaaaaaauuauuuuuaauauagagucaa

SEQ ID NO: 28979 - RNA, 64 nt, hsa
aacaggauugcaccuaucaauuucuuguagaauaaaaaaaaaucuuucaacaaacugacuuuac

SEQ ID NO: 28980 - RNA, 64 nt, hsa
uaacaggauugcaccuaucaauuucuuguagaauaaaaaaaaaucuuucaacaaacugacuuua

SEQ ID NO: 28981 - RNA, 64 nt, hsa
ugagcaacagagugagaccccaucucaaaaaagaaaaaaaaaggcauucuaguaaaucgaaugu

SEQ ID NO: 28982 - RNA, 64 nt, hsa
cugagcaacagagugagaccccaucucaaaaaagaaaaaaaaaggcauucuaguaaaucgaaug

SEQ ID NO: 28983 - RNA, 64 nt, hsa
caagauccccaacucuacaaaaaaauaaaaauuaaaaaaaaauuauuaggcugcagaggcaaga

SEQ ID NO: 28984 - RNA, 64 nt, hsa
gcaagauccccaacucuacaaaaaaauaaaaauuaaaaaaaaauuauuaggcugcagaggcaag

SEQ ID NO: 28985 - RNA, 64 nt, hsa
cauuuuuuaaaaucaagaaaauuuaaaaagacaaaaaaaaaagaauucauugauaauucuaacu

SEQ ID NO: 28986 - RNA, 64 nt, hsa
acauuuuuuaaaaucaagaaaauuuaaaaagacaaaaaaaaaagaauucauugauaauucuaac

SEQ ID NO: 28987 - RNA, 64 nt, hsa
uacauuuuuuaaaaucaagaaaauuuaaaaagacaaaaaaaaaagaauucauugauaauucuaa

SEQ ID NO: 28988 - RNA, 64 nt, hsa
cagugagcuguuuauuuaaauaucauuaaggagaaaaaaaaauauggugagaagcucgcuccuu

SEQ ID NO: 28989 - RNA, 64 nt, hsa
acagugagcuguuuauuuaaauaucauuaaggagaaaaaaaaauauggugagaagcucgcuccu

SEQ ID NO: 28990 - RNA, 64 nt, hsa
guauauuuagguaacuagaauuucaaaauagaaaaaaaaaaacuguguccuguuuugcacauag

SEQ ID NO: 28991 - RNA, 64 nt, hsa
uguauauuuagguaacuagaauuucaaaauagaaaaaaaaaaacuguguccuguuuugcacaua

SEQ ID NO: 28992 - RNA, 64 nt, hsa
cuguauauuuagguaacuagaauuucaaaauagaaaaaaaaaaacuguguccuguuuugcacau

SEQ ID NO: 28993 - RNA, 64 nt, hsa
acuguauauuuagguaacuagaauuucaaaauagaaaaaaaaaaacuguguccuguuuugcaca

SEQ ID NO: 28994 - RNA, 64 nt, hsa
agacuccgucucaaaaaaaaaaaaaaaaaaaaaaaaaaaaaagauacuucuccaaaguguucuc

SEQ ID NO: 28995 - RNA, 64 nt, hsa
aagacuccgucucaaaaaaaaaaaaaaaaaaaaaaaaaaaaaagauacuucuccaaaguguucu

SEQ ID NO: 28996 - RNA, 64 nt, hsa
caagacuccgucucaaaaaaaaaaaaaaaaaaaaaaaaaaaaaagauacuucuccaaaguguuc

SEQ ID NO: 28997 - RNA, 64 nt, hsa
gcaagacuccgucucaaaaaaaaaaaaaaaaaaaaaaaaaaaaaagauacuucuccaaaguguu

SEQ ID NO: 28998 - RNA, 64 nt, hsa
agcaagacuccgucucaaaaaaaaaaaaaaaaaaaaaaaaaaaaaagauacuucuccaaagugu

SEQ ID NO: 28999 - RNA, 64 nt, hsa
gagcaagacuccgucucaaaaaaaaaaaaaaaaaaaaaaaaaaaaaagauacuucuccaaagug

SEQ ID NO: 29000 - RNA, 64 nt, hsa
agagcaagacuccgucucaaaaaaaaaaaaaaaaaaaaaaaaaaaaaagauacuucuccaaagu

SEQ ID NO: 29001 - RNA, 64 nt, hsa
cagagcaagacuccgucucaaaaaaaaaaaaaaaaaaaaaaaaaaaaaagauacuucuccaaag

SEQ ID NO: 29002 - RNA, 64 nt, hsa
acagagcaagacuccgucucaaaaaaaaaaaaaaaaaaaaaaaaaaaaaagauacuucuccaaa

SEQ ID NO: 29003 - RNA, 64 nt, hsa
gacagagcaagacuccgucucaaaaaaaaaaaaaaaaaaaaaaaaaaaaaagauacuucuccaa

SEQ ID NO: 29004 - RNA, 64 nt, hsa
cgacagagcaagacuccgucucaaaaaaaaaaaaaaaaaaaaaaaaaaaaaagauacuucucca

SEQ ID NO: 29005 - RNA, 64 nt, hsa
gcgacagagcaagacuccgucucaaaaaaaaaaaaaaaaaaaaaaaaaaaaaagauacuucucc

SEQ ID NO: 29006 - RNA, 64 nt, hsa
ggcgacagagcaagacuccgucucaaaaaaaaaaaaaaaaaaaaaaaaaaaaaagauacuucuc

SEQ ID NO: 29007 - RNA, 64 nt, hsa
gggcgacagagcaagacuccgucucaaaaaaaaaaaaaaaaaaaaaaaaaaaaaagauacuucu

SEQ ID NO: 29008 - RNA, 64 nt, hsa
ugggcgacagagcaagacuccgucucaaaaaaaaaaaaaaaaaaaaaaaaaaaaaagauacuuc

SEQ ID NO: 29009 - RNA, 64 nt, hsa
cugggcgacagagcaagacuccgucucaaaaaaaaaaaaaaaaaaaaaaaaaaaaaagauacuu

SEQ ID NO: 29010 - RNA, 64 nt, hsa
ccugggcgacagagcaagacuccgucucaaaaaaaaaaaaaaaaaaaaaaaaaaaaaagauacu

SEQ ID NO: 29011 - RNA, 64 nt, hsa
gccugggcgacagagcaagacuccgucucaaaaaaaaaaaaaaaaaaaaaaaaaaaaaagauac

SEQ ID NO: 29012 - RNA, 64 nt, hsa
agccugggcgacagagcaagacuccgucucaaaaaaaaaaaaaaaaaaaaaaaaaaaaaagaua

SEQ ID NO: 29013 - RNA, 64 nt, hsa
cagccugggcgacagagcaagacuccgucucaaaaaaaaaaaaaaaaaaaaaaaaaaaaaagau

SEQ ID NO: 29014 - RNA, 64 nt, hsa
ccagccugggcgacagagcaagacuccgucucaaaaaaaaaaaaaaaaaaaaaaaaaaaaaaga

SEQ ID NO: 29015 - RNA, 64 nt, hsa
uccagccugggcgacagagcaagacuccgucucaaaaaaaaaaaaaaaaaaaaaaaaaaaaaag

SEQ ID NO: 29016 - RNA, 64 nt, hsa
cuccagccugggcgacagagcaagacuccgucucaaaaaaaaaaaaaaaaaaaaaaaaaaaaaa

SEQ ID NO: 29017 - RNA, 64 nt, hsa
aaaucacucacuuuauuuuggaaauuuuugauuaaaaaaaaauuuuauaaucucaaaugcuagu

SEQ ID NO: 29018 - RNA, 64 nt, hsa
gaaaucacucacuuuauuuuggaaauuuuugauuaaaaaaaaauuuuauaaucucaaaugcuag

SEQ ID NO: 29019 - RNA, 64 nt, hsa
ucugcccuccaaaaagacaaaaaaaaaaaaaaaaaaaaaaaagcaaaaagacgucggagaaaag

SEQ ID NO: 29020 - RNA, 64 nt, hsa
cucugcccuccaaaaagacaaaaaaaaaaaaaaaaaaaaaaaagcaaaaagacgucggagaaaa

SEQ ID NO: 29021 - RNA, 64 nt, hsa
acucugcccuccaaaaagacaaaaaaaaaaaaaaaaaaaaaaaagcaaaaagacgucggagaaa

SEQ ID NO: 29022 - RNA, 64 nt, hsa
cacucugcccuccaaaaagacaaaaaaaaaaaaaaaaaaaaaaaagcaaaaagacgucggagaa

SEQ ID NO: 29023 - RNA, 64 nt, hsa
ccacucugcccuccaaaaagacaaaaaaaaaaaaaaaaaaaaaaaagcaaaaagacgucggaga

SEQ ID NO: 29024 - RNA, 64 nt, hsa
cccacucugcccuccaaaaagacaaaaaaaaaaaaaaaaaaaaaaaagcaaaaagacgucggag

SEQ ID NO: 29025 - RNA, 64 nt, hsa
ccccacucugcccuccaaaaagacaaaaaaaaaaaaaaaaaaaaaaaagcaaaaagacgucgga

SEQ ID NO: 29026 - RNA, 64 nt, hsa
accccacucugcccuccaaaaagacaaaaaaaaaaaaaaaaaaaaaaaagcaaaaagacgucgg

SEQ ID NO: 29027 - RNA, 64 nt, hsa
gaccccacucugcccuccaaaaagacaaaaaaaaaaaaaaaaaaaaaaaagcaaaaagacgucg

SEQ ID NO: 29028 - RNA, 64 nt, hsa
ggaccccacucugcccuccaaaaagacaaaaaaaaaaaaaaaaaaaaaaaagcaaaaagacguc

SEQ ID NO: 29029 - RNA, 64 nt, hsa
cggaccccacucugcccuccaaaaagacaaaaaaaaaaaaaaaaaaaaaaaagcaaaaagacgu

SEQ ID NO: 29030 - RNA, 64 nt, hsa
ccggaccccacucugcccuccaaaaagacaaaaaaaaaaaaaaaaaaaaaaaagcaaaaagacg

SEQ ID NO: 29031 - RNA, 64 nt, hsa
uccggaccccacucugcccuccaaaaagacaaaaaaaaaaaaaaaaaaaaaaaagcaaaaagac

SEQ ID NO: 29032 - RNA, 64 nt, hsa
uuccggaccccacucugcccuccaaaaagacaaaaaaaaaaaaaaaaaaaaaaaagcaaaaaga

SEQ ID NO: 29033 - RNA, 64 nt, hsa
uuuccggaccccacucugcccuccaaaaagacaaaaaaaaaaaaaaaaaaaaaaaagcaaaaag

SEQ ID NO: 29034 - RNA, 64 nt, hsa
uuuuccggaccccacucugcccuccaaaaagacaaaaaaaaaaaaaaaaaaaaaaaagcaaaaa

SEQ ID NO: 29035 - RNA, 64 nt, hsa
cuuuuccggaccccacucugcccuccaaaaagacaaaaaaaaaaaaaaaaaaaaaaaagcaaaa

SEQ ID NO: 29036 - RNA, 64 nt, hsa
cugcaccauguaccccaccuucaguuuaaaagaaaaaaaaaauccccuucacuccuacugggag

SEQ ID NO: 29037 - RNA, 64 nt, hsa
gcugcaccauguaccccaccuucaguuuaaaagaaaaaaaaaauccccuucacuccuacuggga

SEQ ID NO: 29038 - RNA, 64 nt, hsa
agcugcaccauguaccccaccuucaguuuaaaagaaaaaaaaaauccccuucacuccuacuggg

SEQ ID NO: 29039 - RNA, 64 nt, hsa
aaaaaaaaaaaaaaaaaaaaaaaaaaaaaaaaaaaaaaaaaagccuuucuuucucacaggcaua

SEQ ID NO: 29040 - RNA, 64 nt, hsa
aaaaaaaaaaaaaaaaaaaaaaaaaaaaaaaaaaaaaaaaaaagccuuucuuucucacaggcau

SEQ ID NO: 29041 - RNA, 64 nt, hsa
uaaaaaaaaaaaaaaaaaaaaaaaaaaaaaaaaaaaaaaaaaaagccuuucuuucucacaggca

SEQ ID NO: 29042 - RNA, 64 nt, hsa
uuaaaaaaaaaaaaaaaaaaaaaaaaaaaaaaaaaaaaaaaaaaagccuuucuuucucacaggc

SEQ ID NO: 29043 - RNA, 64 nt, hsa
auuaaaaaaaaaaaaaaaaaaaaaaaaaaaaaaaaaaaaaaaaaaagccuuucuuucucacagg

SEQ ID NO: 29044 - RNA, 64 nt, hsa
gauuaaaaaaaaaaaaaaaaaaaaaaaaaaaaaaaaaaaaaaaaaaagccuuucuuucucacag

SEQ ID NO: 29045 - RNA, 64 nt, hsa
agauuaaaaaaaaaaaaaaaaaaaaaaaaaaaaaaaaaaaaaaaaaaagccuuucuuucucaca

SEQ ID NO: 29046 - RNA, 64 nt, hsa
cagauuaaaaaaaaaaaaaaaaaaaaaaaaaaaaaaaaaaaaaaaaaaagccuuucuuucucac

SEQ ID NO: 29047 - RNA, 64 nt, hsa
gcagauuaaaaaaaaaaaaaaaaaaaaaaaaaaaaaaaaaaaaaaaaaaagccuuucuuucuca

SEQ ID NO: 29048 - RNA, 64 nt, hsa
ugcagauuaaaaaaaaaaaaaaaaaaaaaaaaaaaaaaaaaaaaaaaaaaagccuuucuuucuc

SEQ ID NO: 29049 - RNA, 64 nt, hsa
uugcagauuaaaaaaaaaaaaaaaaaaaaaaaaaaaaaaaaaaaaaaaaaaagccuuucuuucu

SEQ ID NO: 29050 - RNA, 64 nt, hsa
uuugcagauuaaaaaaaaaaaaaaaaaaaaaaaaaaaaaaaaaaaaaaaaaaagccuuucuuuc

SEQ ID NO: 29051 - RNA, 64 nt, hsa
cuuugcagauuaaaaaaaaaaaaaaaaaaaaaaaaaaaaaaaaaaaaaaaaaaagccuuucuuu

SEQ ID NO: 29052 - RNA, 64 nt, hsa
acuuugcagauuaaaaaaaaaaaaaaaaaaaaaaaaaaaaaaaaaaaaaaaaaaagccuuucuu

SEQ ID NO: 29053 - RNA, 64 nt, hsa
gacuuugcagauuaaaaaaaaaaaaaaaaaaaaaaaaaaaaaaaaaaaaaaaaaaagccuuucu

SEQ ID NO: 29054 - RNA, 64 nt, hsa
ggacuuugcagauuaaaaaaaaaaaaaaaaaaaaaaaaaaaaaaaaaaaaaaaaaaagccuuuc

SEQ ID NO: 29055 - RNA, 64 nt, hsa
aggacuuugcagauuaaaaaaaaaaaaaaaaaaaaaaaaaaaaaaaaaaaaaaaaaaagccuuu

SEQ ID NO: 29056 - RNA, 64 nt, hsa
aaggacuuugcagauuaaaaaaaaaaaaaaaaaaaaaaaaaaaaaaaaaaaaaaaaaaagccuu

SEQ ID NO: 29057 - RNA, 64 nt, hsa
aaaggacuuugcagauuaaaaaaaaaaaaaaaaaaaaaaaaaaaaaaaaaaaaaaaaaaagccu

SEQ ID NO: 29058 - RNA, 64 nt, hsa
caaaggacuuugcagauuaaaaaaaaaaaaaaaaaaaaaaaaaaaaaaaaaaaaaaaaaaagcc

SEQ ID NO: 29059 - RNA, 64 nt, hsa
gcaaaggacuuugcagauuaaaaaaaaaaaaaaaaaaaaaaaaaaaaaaaaaaaaaaaaaaagc

SEQ ID NO: 29060 - RNA, 64 nt, hsa
ugcaaaggacuuugcagauuaaaaaaaaaaaaaaaaaaaaaaaaaaaaaaaaaaaaaaaaaaag

SEQ ID NO: 29061 - RNA, 64 nt, hsa
gugcaaaggacuuugcagauuaaaaaaaaaaaaaaaaaaaaaaaaaaaaaaaaaaaaaaaaaaa

SEQ ID NO: 29062 - RNA, 64 nt, hsa
ugugcaaaggacuuugcagauuaaaaaaaaaaaaaaaaaaaaaaaaaaaaaaaaaaaaaaaaaa

SEQ ID NO: 29063 - RNA, 64 nt, hsa
uugugcaaaggacuuugcagauuaaaaaaaaaaaaaaaaaaaaaaaaaaaaaaaaaaaaaaaaa

SEQ ID NO: 29064 - RNA, 64 nt, hsa
cuugugcaaaggacuuugcagauuaaaaaaaaaaaaaaaaaaaaaaaaaaaaaaaaaaaaaaaa

SEQ ID NO: 29065 - RNA, 64 nt, hsa
acuugugcaaaggacuuugcagauuaaaaaaaaaaaaaaaaaaaaaaaaaaaaaaaaaaaaaaa

SEQ ID NO: 29066 - RNA, 64 nt, hsa
gacuugugcaaaggacuuugcagauuaaaaaaaaaaaaaaaaaaaaaaaaaaaaaaaaaaaaaa

SEQ ID NO: 29067 - RNA, 64 nt, hsa
agacuugugcaaaggacuuugcagauuaaaaaaaaaaaaaaaaaaaaaaaaaaaaaaaaaaaaa

SEQ ID NO: 29068 - RNA, 64 nt, hsa
gagacuugugcaaaggacuuugcagauuaaaaaaaaaaaaaaaaaaaaaaaaaaaaaaaaaaaa

SEQ ID NO: 29069 - RNA, 64 nt, hsa
ggagacuugugcaaaggacuuugcagauuaaaaaaaaaaaaaaaaaaaaaaaaaaaaaaaaaaa

SEQ ID NO: 29070 - RNA, 64 nt, hsa
gggagacuugugcaaaggacuuugcagauuaaaaaaaaaaaaaaaaaaaaaaaaaaaaaaaaaa

SEQ ID NO: 29071 - RNA, 64 nt, hsa
ugggagacuugugcaaaggacuuugcagauuaaaaaaaaaaaaaaaaaaaaaaaaaaaaaaaaa

SEQ ID NO: 29072 - RNA, 64 nt, hsa
uugggagacuugugcaaaggacuuugcagauuaaaaaaaaaaaaaaaaaaaaaaaaaaaaaaaa

SEQ ID NO: 29073 - RNA, 64 nt, hsa
guugggagacuugugcaaaggacuuugcagauuaaaaaaaaaaaaaaaaaaaaaaaaaaaaaaa

SEQ ID NO: 29074 - RNA, 64 nt, hsa
aguugggagacuugugcaaaggacuuugcagauuaaaaaaaaaaaaaaaaaaaaaaaaaaaaaa

SEQ ID NO: 29075 - RNA, 64 nt, hsa
accagugaaauguguguguauacaauaaacugaaaaaaaaaacuagccuuuggcuuguucugug

SEQ ID NO: 29076 - RNA, 64 nt, hsa
caccagugaaauguguguguauacaauaaacugaaaaaaaaaacuagccuuuggcuuguucugu

SEQ ID NO: 29077 - RNA, 64 nt, hsa
ccaccagugaaauguguguguauacaauaaacugaaaaaaaaaacuagccuuuggcuuguucug

SEQ ID NO: 29078 - RNA, 64 nt, hsa
guuuguauugucuugucaauuguacagacuuuuuaaaaaaaacaaccaccagugaaaugugugu

SEQ ID NO: 29079 - RNA, 64 nt, hsa
ccuuucucugggauucaaauuuuugcaucaguuaaaaaaaaaggggugggggggaaugggccaa

SEQ ID NO: 29080 - RNA, 64 nt, hsa
accuuucucugggauucaaauuuuugcaucaguuaaaaaaaaaggggugggggggaaugggcca

SEQ ID NO: 29081 - RNA, 64 nt, hsa
uaaauuccauaugcuccaggaucuuugacugaaaaaaaaaaagaagaagaagaaggagagcaag

SEQ ID NO: 29082 - RNA, 64 nt, hsa
uuaaauuccauaugcuccaggaucuuugacugaaaaaaaaaaagaagaagaagaaggagagcaa

SEQ ID NO: 29083 - RNA, 64 nt, hsa
guuaaauuccauaugcuccaggaucuuugacugaaaaaaaaaaagaagaagaagaaggagagca

SEQ ID NO: 29084 - RNA, 64 nt, hsa
gguuaaauuccauaugcuccaggaucuuugacugaaaaaaaaaaagaagaagaagaaggagagc

SEQ ID NO: 29085 - RNA, 64 nt, hsa
uuuuuaaucuacuuuugcuaagaugcauuuaauaaaaaaaaagagagagagagagaggugugag

SEQ ID NO: 29086 - RNA, 64 nt, hsa
uuuuuuaaucuacuuuugcuaagaugcauuuaauaaaaaaaaagagagagagagagagguguga

SEQ ID NO: 29087 - RNA, 64 nt, hsa
aauuguuuugcaaauggaucuauuuuuguaugaaaaaaaaaauuuuuuuaaagaaaacuguucc

SEQ ID NO: 29088 - RNA, 64 nt, hsa
aaauuguuuugcaaauggaucuauuuuuguaugaaaaaaaaaauuuuuuuaaagaaaacuguuc

SEQ ID NO: 29089 - RNA, 64 nt, hsa
gaaauuguuuugcaaauggaucuauuuuuguaugaaaaaaaaaauuuuuuuaaagaaaacuguu

SEQ ID NO: 29090 - RNA, 64 nt, hsa
acucaaaucuccaguauucuugucaaaaaaaaaaaaaaaaaagcucauauuuuguauauaucug

SEQ ID NO: 29091 - RNA, 64 nt, hsa
gacucaaaucuccaguauucuugucaaaaaaaaaaaaaaaaaagcucauauuuuguauauaucu

SEQ ID NO: 29092 - RNA, 64 nt, hsa
ugacucaaaucuccaguauucuugucaaaaaaaaaaaaaaaaaagcucauauuuuguauauauc

SEQ ID NO: 29093 - RNA, 64 nt, hsa
uugacucaaaucuccaguauucuugucaaaaaaaaaaaaaaaaaagcucauauuuuguauauau

SEQ ID NO: 29094 - RNA, 64 nt, hsa
auugacucaaaucuccaguauucuugucaaaaaaaaaaaaaaaaaagcucauauuuuguauaua

SEQ ID NO: 29095 - RNA, 64 nt, hsa
aauugacucaaaucuccaguauucuugucaaaaaaaaaaaaaaaaaagcucauauuuuguauau

SEQ ID NO: 29096 - RNA, 64 nt, hsa
aaauugacucaaaucuccaguauucuugucaaaaaaaaaaaaaaaaaagcucauauuuuguaua

SEQ ID NO: 29097 - RNA, 64 nt, hsa
aaaauugacucaaaucuccaguauucuugucaaaaaaaaaaaaaaaaaagcucauauuuuguau

SEQ ID NO: 29098 - RNA, 64 nt, hsa
aaaaauugacucaaaucuccaguauucuugucaaaaaaaaaaaaaaaaaagcucauauuuugua

SEQ ID NO: 29099 - RNA, 64 nt, hsa
caaaaauugacucaaaucuccaguauucuugucaaaaaaaaaaaaaaaaaagcucauauuuugu

SEQ ID NO: 29100 - RNA, 64 nt, hsa
acaaaaauugacucaaaucuccaguauucuugucaaaaaaaaaaaaaaaaaagcucauauuuug

SEQ ID NO: 29101 - RNA, 64 nt, hsa
guaauauguaaacugugauuugguccucuggaaaaaaaaaaaugaaaugaagagugggaaggca

SEQ ID NO: 29102 - RNA, 64 nt, hsa
uguaauauguaaacugugauuugguccucuggaaaaaaaaaaaugaaaugaagagugggaaggc

SEQ ID NO: 29103 - RNA, 64 nt, hsa
auguaauauguaaacugugauuugguccucuggaaaaaaaaaaaugaaaugaagagugggaagg

SEQ ID NO: 29104 - RNA, 64 nt, hsa
aauguaauauguaaacugugauuugguccucuggaaaaaaaaaaaugaaaugaagagugggaag

SEQ ID NO: 29105 - RNA, 62 nt, hsa
gaccaaaccauccaaaugccaaaaagaaaaagaaaaaaaaaagccucucuguccuaugaaga

SEQ ID NO: 29106 - RNA, 63 nt, hsa
ugaccaaaccauccaaaugccaaaaagaaaaagaaaaaaaaaagccucucuguccuaugaaga

SEQ ID NO: 29107 - RNA, 64 nt, hsa
uugaccaaaccauccaaaugccaaaaagaaaaagaaaaaaaaaagccucucuguccuaugaaga

SEQ ID NO: 29108 - RNA, 64 nt, hsa
acucugcauuaacucuauaauguucuugguauuaaaaaaaaagcauauuugucacagaaauuua

SEQ ID NO: 29109 - RNA, 64 nt, hsa
gacucugcauuaacucuauaauguucuugguauuaaaaaaaaagcauauuugucacagaaauuu

SEQ ID NO: 29110 - RNA, 64 nt, hsa
cuggccaacacagcgagacccccaucucuaaaaaaaaaaaaauuaauaagacauggauacaacc

SEQ ID NO: 29111 - RNA, 64 nt, hsa
acuggccaacacagcgagacccccaucucuaaaaaaaaaaaaauuaauaagacauggauacaac

SEQ ID NO: 29112 - RNA, 64 nt, hsa
gacuggccaacacagcgagacccccaucucuaaaaaaaaaaaaauuaauaagacauggauacaa

SEQ ID NO: 29113 - RNA, 64 nt, hsa
agacuggccaacacagcgagacccccaucucuaaaaaaaaaaaaauuaauaagacauggauaca

SEQ ID NO: 29114 - RNA, 64 nt, hsa
cagacuggccaacacagcgagacccccaucucuaaaaaaaaaaaaauuaauaagacauggauac

SEQ ID NO: 29115 - RNA, 64 nt, hsa
ccagacuggccaacacagcgagacccccaucucuaaaaaaaaaaaaauuaauaagacauggaua

SEQ ID NO: 29116 - RNA, 64 nt, hsa
cucaacaaaaccaaucuacauguuuuggacuaaaaaaaaaaauagagguuguauucucaguguc

SEQ ID NO: 29117 - RNA, 64 nt, hsa
acucaacaaaaccaaucuacauguuuuggacuaaaaaaaaaaauagagguuguauucucagugu

SEQ ID NO: 29118 - RNA, 64 nt, hsa
cacucaacaaaaccaaucuacauguuuuggacuaaaaaaaaaaauagagguuguauucucagug

SEQ ID NO: 29119 - RNA, 64 nt, hsa
acacucaacaaaaccaaucuacauguuuuggacuaaaaaaaaaaauagagguuguauucucagu

SEQ ID NO: 29120 - RNA, 64 nt, hsa
cuuaaaauauauucugggucaguugguaugagaaaaaaaaaagccuagaauucuuuguugaaag

SEQ ID NO: 29121 - RNA, 64 nt, hsa
ucuuaaaauauauucugggucaguugguaugagaaaaaaaaaagccuagaauucuuuguugaaa

SEQ ID NO: 29122 - RNA, 64 nt, hsa
uucuuaaaauauauucugggucaguugguaugagaaaaaaaaaagccuagaauucuuuguugaa

SEQ ID NO: 29123 - RNA, 64 nt, hsa
guuuuuuauaaaaauauauauuuuuguccaagaaaaaaaaaagcauacauaugugauuauggcu

SEQ ID NO: 29124 - RNA, 64 nt, hsa
aguuuuuuauaaaaauauauauuuuuguccaagaaaaaaaaaagcauacauaugugauuauggc

SEQ ID NO: 29125 - RNA, 64 nt, hsa
caguuuuuuauaaaaauauauauuuuuguccaagaaaaaaaaaagcauacauaugugauuaugg

SEQ ID NO: 29126 - RNA, 64 nt, hsa
aguaaaaaaaaaaaaaaagaaaaaaaggaaaaaaaaaaaaaauaggaaugccaguuagauuuuu

SEQ ID NO: 29127 - RNA, 64 nt, hsa
aaguaaaaaaaaaaaaaaagaaaaaaaggaaaaaaaaaaaaaauaggaaugccaguuagauuuu

SEQ ID NO: 29128 - RNA, 64 nt, hsa
aaaguaaaaaaaaaaaaaaagaaaaaaaggaaaaaaaaaaaaaauaggaaugccaguuagauuu

SEQ ID NO: 29129 - RNA, 64 nt, hsa
aaaaguaaaaaaaaaaaaaaagaaaaaaaggaaaaaaaaaaaaaauaggaaugccaguuagauu

SEQ ID NO: 29130 - RNA, 64 nt, hsa
aaaaaguaaaaaaaaaaaaaaagaaaaaaaggaaaaaaaaaaaagcuuguaugggacagaauag

SEQ ID NO: 29131 - RNA, 64 nt, hsa
aaaaaaguaaaaaaaaaaaaaaagaaaaaaaggaaaaaaaaaaaagcuuguaugggacagaaua

SEQ ID NO: 29132 - RNA, 64 nt, hsa
caaaaaaguaaaaaaaaaaaaaaagaaaaaaaggaaaaaaaaaaaagcuuguaugggacagaau

SEQ ID NO: 29133 - RNA, 64 nt, hsa
augaaguggugauauuuacaaaaaaguaaaaaaaaaaaaaaagaaaaaaaggaaaaaaaaaaaa

SEQ ID NO: 29134 - RNA, 64 nt, hsa
aaugaaguggugauauuuacaaaaaaguaaaaaaaaaaaaaaagaaaaaaaggaaaaaaaaaaa

SEQ ID NO: 29135 - RNA, 64 nt, hsa
gaaugaaguggugauauuuacaaaaaaguaaaaaaaaaaaaaaagaaaaaaaggaaaaaaaaaa

SEQ ID NO: 29136 - RNA, 64 nt, hsa
agaaugaaguggugauauuuacaaaaaaguaaaaaaaaaaaaaaagaaaaaaaggaaaaaaaaa

SEQ ID NO: 29137 - RNA, 64 nt, hsa
aagaaugaaguggugauauuuacaaaaaaguaaaaaaaaaaaaaaagaaaaaaaggaaaaaaaa

SEQ ID NO: 29138 - RNA, 64 nt, hsa
gaagaaugaaguggugauauuuacaaaaaaguaaaaaaaaaaaaaaagaaaaaaaggaaaaaaa

SEQ ID NO: 29139 - RNA, 64 nt, hsa
ggaagaaugaaguggugauauuuacaaaaaaguaaaaaaaaaaaaaaagaaaaaaaggaaaaaa

SEQ ID NO: 29140 - RNA, 64 nt, hsa
aggaagaaugaaguggugauauuuacaaaaaaguaaaaaaaaaaaaaaagaaaaaaaggaaaaa

SEQ ID NO: 29141 - RNA, 64 nt, hsa
cagccuaggugacagaaugagacccugucucaaaaaaaaaaaugauugaaauuaaaauucagcu

SEQ ID NO: 29142 - RNA, 64 nt, hsa
ccagccuaggugacagaaugagacccugucucaaaaaaaaaaaugauugaaauuaaaauucagc

SEQ ID NO: 29143 - RNA, 64 nt, hsa
accagccuaggugacagaaugagacccugucucaaaaaaaaaaaugauugaaauuaaaauucag

SEQ ID NO: 29144 - RNA, 64 nt, hsa
uaccagccuaggugacagaaugagacccugucucaaaaaaaaaaaugauugaaauuaaaauuca

SEQ ID NO: 29145 - RNA, 64 nt, hsa
cagccugggaaacauaacaagaccccgucucuacaaaaaaaauuuaaaauuagccaggcguggu

SEQ ID NO: 29146 - RNA, 64 nt, hsa
gggucauuaaaaccagcucaaaggggguuuaaaaaaaaaaaaccagcccauccuuugaggcuga

SEQ ID NO: 29147 - RNA, 64 nt, hsa
ugggucauuaaaaccagcucaaaggggguuuaaaaaaaaaaaaccagcccauccuuugaggcug

SEQ ID NO: 29148 - RNA, 64 nt, hsa
cugggucauuaaaaccagcucaaaggggguuuaaaaaaaaaaaaccagcccauccuuugaggcu

SEQ ID NO: 29149 - RNA, 64 nt, hsa
acugggucauuaaaaccagcucaaaggggguuuaaaaaaaaaaaaccagcccauccuuugaggc

SEQ ID NO: 29150 - RNA, 64 nt, hsa
aacugggucauuaaaaccagcucaaaggggguuuaaaaaaaaaaaaccagcccauccuuugagg

SEQ ID NO: 29151 - RNA, 64 nt, hsa
cuccaaccugggcaacagaguaagaccuugucuuaaaaaaaaauaaaaacauaaaaaaaaauaa

SEQ ID NO: 29152 - RNA, 64 nt, hsa
uccaaccugggcaacagaguaagaccuugucuuaaaaaaaaauaaaaacauaaaaaaaaauaaa

SEQ ID NO: 29153 - RNA, 64 nt, hsa
uauauuaaaaaaccacuuuuagaugguuuuuuuuaaaaaaaaaaaaaaaacugguaaaauuacu

SEQ ID NO: 29154 - RNA, 64 nt, hsa
auauuaaaaaaccacuuuuagaugguuuuuuuuaaaaaaaaaaaaaaaacugguaaaauuacuu

SEQ ID NO: 29155 - RNA, 64 nt, hsa
uauuaaaaaaccacuuuuagaugguuuuuuuuaaaaaaaaaaaaaaaacugguaaaauuacuuu

SEQ ID NO: 29156 - RNA, 64 nt, hsa
auuaaaaaaccacuuuuagaugguuuuuuuuaaaaaaaaaaaaaaaacugguaaaauuacuuuu

SEQ ID NO: 29157 - RNA, 64 nt, hsa
uuaaaaaaccacuuuuagaugguuuuuuuuaaaaaaaaaaaaaaaacugguaaaauuacuuuug

SEQ ID NO: 29158 - RNA, 64 nt, hsa
uaaaaaaccacuuuuagaugguuuuuuuuaaaaaaaaaaaaaaaacugguaaaauuacuuuugg

SEQ ID NO: 29159 - RNA, 64 nt, hsa
aaaaaaccacuuuuagaugguuuuuuuuaaaaaaaaaaaaaaaacugguaaaauuacuuuuggc

SEQ ID NO: 29160 - RNA, 64 nt, hsa
aaaaaccacuuuuagaugguuuuuuuuaaaaaaaaaaaaaaaacugguaaaauuacuuuuggca

SEQ ID NO: 29161 - RNA, 64 nt, hsa
aaaaccacuuuuagaugguuuuuuuuaaaaaaaaaaaaaaaacugguaaaauuacuuuuggcag

SEQ ID NO: 29162 - RNA, 64 nt, hsa
uaagugcagcauuuuugcaucugacauuuuaccuaaaaaaaaagacaccaaacuuggcagagag

SEQ ID NO: 29163 - RNA, 64 nt, hsa
aagugcagcauuuuugcaucugacauuuuaccuaaaaaaaaagacaccaaacuuggcagagagg

SEQ ID NO: 29164 - RNA, 64 nt, hsa
aaaaguuuucuaaccccugcucuagguuacggagaaaaaaaaaauggaauaauguucucugcua

SEQ ID NO: 29165 - RNA, 64 nt, hsa
aaaguuuucuaaccccugcucuagguuacggagaaaaaaaaaauggaauaauguucucugcuac

SEQ ID NO: 29166 - RNA, 64 nt, hsa
aaguuuucuaaccccugcucuagguuacggagaaaaaaaaaauggaauaauguucucugcuacu

SEQ ID NO: 29167 - RNA, 64 nt, hsa
aucaaaaaacccuucaauagcauccuuaagauuuaaaaaaaaaaaaaaaaaaaaggaaaaaaaa

SEQ ID NO: 29168 - RNA, 64 nt, hsa
ucaaaaaacccuucaauagcauccuuaagauuuaaaaaaaaaaaaaaaaaaaaggaaaaaaaag

SEQ ID NO: 29169 - RNA, 64 nt, hsa
caaaaaacccuucaauagcauccuuaagauuuaaaaaaaaaaaaaaaaaaaaggaaaaaaaagu

SEQ ID NO: 29170 - RNA, 64 nt, hsa
aaaaaacccuucaauagcauccuuaagauuuaaaaaaaaaaaaaaaaaaaaggaaaaaaaagug

SEQ ID NO: 29171 - RNA, 64 nt, hsa
aaaaacccuucaauagcauccuuaagauuuaaaaaaaaaaaaaaaaaaaaggaaaaaaaaguga

SEQ ID NO: 29172 - RNA, 64 nt, hsa
aaaacccuucaauagcauccuuaagauuuaaaaaaaaaaaaaaaaaaaaggaaaaaaaagugau

SEQ ID NO: 29173 - RNA, 64 nt, hsa
aaacccuucaauagcauccuuaagauuuaaaaaaaaaaaaaaaaaaaaggaaaaaaaagugaug

SEQ ID NO: 29174 - RNA, 64 nt, hsa
aacccuucaauagcauccuuaagauuuaaaaaaaaaaaaaaaaaaaaggaaaaaaaagugaugg

SEQ ID NO: 29175 - RNA, 64 nt, hsa
acccuucaauagcauccuuaagauuuaaaaaaaaaaaaaaaaaaaaggaaaaaaaagugaugga

SEQ ID NO: 29176 - RNA, 64 nt, hsa
cccuucaauagcauccuuaagauuuaaaaaaaaaaaaaaaaaaaaggaaaaaaaagugauggaa

SEQ ID NO: 29177 - RNA, 64 nt, hsa
ccuucaauagcauccuuaagauuuaaaaaaaaaaaaaaaaaaaaggaaaaaaaagugauggaag

SEQ ID NO: 29178 - RNA, 64 nt, hsa
cuucaauagcauccuuaagauuuaaaaaaaaaaaaaaaaaaaaggaaaaaaaagugauggaagc

SEQ ID NO: 29179 - RNA, 64 nt, hsa
uucaauagcauccuuaagauuuaaaaaaaaaaaaaaaaaaaaggaaaaaaaagugauggaagcc

SEQ ID NO: 29180 - RNA, 64 nt, hsa
uccuuaagauuuaaaaaaaaaaaaaaaaaaaaggaaaaaaaagugauggaagccguaagugcuu

SEQ ID NO: 29181 - RNA, 64 nt, hsa
uuuucucuucauguuguaacaaaaaggaaaaaagaaaaaaaaaucccaucccuuuuguacauau

SEQ ID NO: 29182 - RNA, 64 nt, hsa
uuucucuucauguuguaacaaaaaggaaaaaagaaaaaaaaaucccaucccuuuuguacauaug

SEQ ID NO: 29183 - RNA, 64 nt, hsa
uaauuauuccaacacccaucugccaugcgauguuaaaaaaaaaaaaaaggaagaaaaauaacac

SEQ ID NO: 29184 - RNA, 64 nt, hsa
aauuauuccaacacccaucugccaugcgauguuaaaaaaaaaaaaaaggaagaaaaauaacaca

SEQ ID NO: 29185 - RNA, 64 nt, hsa
auuauuccaacacccaucugccaugcgauguuaaaaaaaaaaaaaaggaagaaaaauaacacag

SEQ ID NO: 29186 - RNA, 64 nt, hsa
uuauuccaacacccaucugccaugcgauguuaaaaaaaaaaaaaaggaagaaaaauaacacagc

SEQ ID NO: 29187 - RNA, 64 nt, hsa
uauuccaacacccaucugccaugcgauguuaaaaaaaaaaaaaaggaagaaaaauaacacagcu

SEQ ID NO: 29188 - RNA, 64 nt, hsa
auuccaacacccaucugccaugcgauguuaaaaaaaaaaaaaaggaagaaaaauaacacagcua

SEQ ID NO: 29189 - RNA, 64 nt, hsa
uuccaacacccaucugccaugcgauguuaaaaaaaaaaaaaaggaagaaaaauaacacagcuac

SEQ ID NO: 29190 - RNA, 64 nt, hsa
acaugaugacuugugaacauuagggauuuaaaggaaaaaaaaaaagaauucuguuccccucaua

SEQ ID NO: 29191 - RNA, 64 nt, hsa
caugaugacuugugaacauuagggauuuaaaggaaaaaaaaaaagaauucuguuccccucauau

SEQ ID NO: 29192 - RNA, 64 nt, hsa
augaugacuugugaacauuagggauuuaaaggaaaaaaaaaaagaauucuguuccccucauauc

SEQ ID NO: 29193 - RNA, 64 nt, hsa
ugaugacuugugaacauuagggauuuaaaggaaaaaaaaaaagaauucuguuccccucauauca

SEQ ID NO: 29194 - RNA, 64 nt, hsa
aggaguuuacgaaaucugcuguuuuaucaaagugaaaaaaaauugcuuauuacucuucauuuua

SEQ ID NO: 29195 - RNA, 64 nt, hsa
cuuccuccaaagaauuaauaggcaacagugggagaaaaaaaaggcauaauggcaaauccuucaa

SEQ ID NO: 29196 - RNA, 64 nt, hsa
cauauguuuaauugaauugaaaauaucccuuaggaaaaaaaaaaaacacacaaaaaaccacaag

SEQ ID NO: 29197 - RNA, 64 nt, hsa
auauguuuaauugaauugaaaauaucccuuaggaaaaaaaaaaaacacacaaaaaaccacaaga

SEQ ID NO: 29198 - RNA, 64 nt, hsa
uauguuuaauugaauugaaaauaucccuuaggaaaaaaaaaaaacacacaaaaaaccacaagag

SEQ ID NO: 29199 - RNA, 64 nt, hsa
auguuuaauugaauugaaaauaucccuuaggaaaaaaaaaaaacacacaaaaaaccacaagagc

SEQ ID NO: 29200 - RNA, 64 nt, hsa
uguuuaauugaauugaaaauaucccuuaggaaaaaaaaaaaacacacaaaaaaccacaagagcc

SEQ ID NO: 29201 - RNA, 64 nt, hsa
gcuaguuuaaaaaagaaaauauguaauauaauguaaaaaaaaacaaaaaaaagcuuuuaugaug

SEQ ID NO: 29202 - RNA, 64 nt, hsa
cuaguuuaaaaaagaaaauauguaauauaauguaaaaaaaaacaaaaaaaagcuuuuaugaugg

SEQ ID NO: 29203 - RNA, 64 nt, hsa
aaaagaaaauauguaauauaauguaaaaaaaaacaaaaaaaagcuuuuaugauggauuuuguaa

SEQ ID NO: 29204 - RNA, 64 nt, hsa
gcagggagaagggccgggggggguaggagaggagaaaaaaaaagugaaaaaaagaaacgaaaag

SEQ ID NO: 29205 - RNA, 64 nt, hsa
cagggagaagggccgggggggguaggagaggagaaaaaaaaagugaaaaaaagaaacgaaaagg

SEQ ID NO: 29206 - RNA, 64 nt, hsa
ugugauuguuguuauugauguuguuguugauggcaaaaaaaaaaaagcgacuucgaguuugcuc

SEQ ID NO: 29207 - RNA, 64 nt, hsa
gugauuguuguuauugauguuguuguugauggcaaaaaaaaaaaagcgacuucgaguuugcucc

SEQ ID NO: 29208 - RNA, 64 nt, hsa
ugauuguuguuauugauguuguuguugauggcaaaaaaaaaaaagcgacuucgaguuugcuccc

SEQ ID NO: 29209 - RNA, 64 nt, hsa
gauuguuguuauugauguuguuguugauggcaaaaaaaaaaaagcgacuucgaguuugcucccc

SEQ ID NO: 29210 - RNA, 64 nt, hsa
auuguuguuauugauguuguuguugauggcaaaaaaaaaaaagcgacuucgaguuugcuccccu

SEQ ID NO: 29211 - RNA, 64 nt, hsa
acaggggcagucaguggagggcgagugguuucggaaaaaaaaaaagaaaaaaagaaaaaaaaag

SEQ ID NO: 29212 - RNA, 64 nt, hsa
caggggcagucaguggagggcgagugguuucggaaaaaaaaaaagaaaaaaagaaaaaaaaaga

SEQ ID NO: 29213 - RNA, 64 nt, hsa
aggggcagucaguggagggcgagugguuucggaaaaaaaaaaagaaaaaaagaaaaaaaaagaa

SEQ ID NO: 29214 - RNA, 64 nt, hsa
ggggcagucaguggagggcgagugguuucggaaaaaaaaaaagaaaaaaagaaaaaaaaagaaa

SEQ ID NO: 29215 - RNA, 64 nt, hsa
gcgagugguuucggaaaaaaaaaaagaaaaaaagaaaaaaaaagaaaaaaaaaagauuuuuuuc

SEQ ID NO: 29216 - RNA, 64 nt, hsa
cgagugguuucggaaaaaaaaaaagaaaaaaagaaaaaaaaagaaaaaaaaaagauuuuuuucu

SEQ ID NO: 29217 - RNA, 64 nt, hsa
ucggaaaaaaaaaaagaaaaaaagaaaaaaaaagaaaaaaaaaagauuuuuuucuucucuuaau

SEQ ID NO: 29218 - RNA, 64 nt, hsa
cggaaaaaaaaaaagaaaaaaagaaaaaaaaagaaaaaaaaaagauuuuuuucuucucuuaauc

SEQ ID NO: 29219 - RNA, 64 nt, hsa
ggaaaaaaaaaaagaaaaaaagaaaaaaaaagaaaaaaaaaagauuuuuuucuucucuuaaucg

SEQ ID NO: 29220 - RNA, 64 nt, hsa
uaaaauucaaggccacaaaaacaauguuugggggaaaaaaaagaaaaaaucaugccagcuaauc

SEQ ID NO: 29221 - RNA, 64 nt, hsa
cugcaguaagccaagaucaugcugugccucaaggaaaaaaaaaauuaauguuuacugauauuug

SEQ ID NO: 29222 - RNA, 64 nt, hsa
ugcaguaagccaagaucaugcugugccucaaggaaaaaaaaaauuaauguuuacugauauuugu

SEQ ID NO: 29223 - RNA, 64 nt, hsa
gcaguaagccaagaucaugcugugccucaaggaaaaaaaaaauuaauguuuacugauauuuguu

SEQ ID NO: 29224 - RNA, 64 nt, hsa
gaaaagucugaaugagaagauggcaggacgucugaaaaaaaaaguuauaauuaauaaaaucugc

SEQ ID NO: 29225 - RNA, 64 nt, hsa
aaaagucugaaugagaagauggcaggacgucugaaaaaaaaaguuauaauuaauaaaaucugcg

SEQ ID NO: 29226 - RNA, 64 nt, hsa
cacuccagccugggugacagcuagacccugucucaaaaaaaaaaaaaaagacugggaagagagc

SEQ ID NO: 29227 - RNA, 64 nt, hsa
acuccagccugggugacagcuagacccugucucaaaaaaaaaaaaaaagacugggaagagagcu

SEQ ID NO: 29228 - RNA, 64 nt, hsa
cuccagccugggugacagcuagacccugucucaaaaaaaaaaaaaaagacugggaagagagcua

SEQ ID NO: 29229 - RNA, 64 nt, hsa
uccagccugggugacagcuagacccugucucaaaaaaaaaaaaaaagacugggaagagagcuag

SEQ ID NO: 29230 - RNA, 64 nt, hsa
ccagccugggugacagcuagacccugucucaaaaaaaaaaaaaaagacugggaagagagcuaga

SEQ ID NO: 29231 - RNA, 64 nt, hsa
cagccugggugacagcuagacccugucucaaaaaaaaaaaaaaagacugggaagagagcuagag

SEQ ID NO: 29232 - RNA, 64 nt, hsa
agccugggugacagcuagacccugucucaaaaaaaaaaaaaaagacugggaagagagcuagagg

SEQ ID NO: 29233 - RNA, 64 nt, hsa
gccugggugacagcuagacccugucucaaaaaaaaaaaaaaagacugggaagagagcuagaggg

SEQ ID NO: 29234 - RNA, 64 nt, hsa
caggacccuugcccccacccccauuuuuuuaaugaaaaaaaaaaacaaaaaaaacggauccaag

SEQ ID NO: 29235 - RNA, 64 nt, hsa
aggacccuugcccccacccccauuuuuuuaaugaaaaaaaaaaacaaaaaaaacggauccaaga

SEQ ID NO: 29236 - RNA, 64 nt, hsa
ggacccuugcccccacccccauuuuuuuaaugaaaaaaaaaaacaaaaaaaacggauccaagaa

SEQ ID NO: 29237 - RNA, 64 nt, hsa
gacccuugcccccacccccauuuuuuuaaugaaaaaaaaaaacaaaaaaaacggauccaagaag

SEQ ID NO: 29238 - RNA, 64 nt, hsa
ccccacccccauuuuuuuaaugaaaaaaaaaaacaaaaaaaacggauccaagaagaaaagagaa

SEQ ID NO: 29239 - RNA, 64 nt, hsa
uuauuuccuucuccacucucuccaugcccuggagaaaaaaaaguccagaagaaaucauaaauau

SEQ ID NO: 29240 - RNA, 64 nt, hsa
aggggauagccagaaucucugaggaaaauggaccaaaaaaaaaaaggccugaaccccaaggaag

SEQ ID NO: 29241 - RNA, 64 nt, hsa
ggggauagccagaaucucugaggaaaauggaccaaaaaaaaaaaggccugaaccccaaggaaga

SEQ ID NO: 29242 - RNA, 64 nt, hsa
gggauagccagaaucucugaggaaaauggaccaaaaaaaaaaaggccugaaccccaaggaagac

SEQ ID NO: 29243 - RNA, 64 nt, hsa
ggauagccagaaucucugaggaaaauggaccaaaaaaaaaaaggccugaaccccaaggaagacu

SEQ ID NO: 29244 - RNA, 64 nt, hsa
ugcccuuggcucagaaugguuauagcagaaauacaaaaaaaaaaaaaaagucuguacuaauuuc

SEQ ID NO: 29245 - RNA, 64 nt, hsa
gcccuuggcucagaaugguuauagcagaaauacaaaaaaaaaaaaaaagucuguacuaauuuca

SEQ ID NO: 29246 - RNA, 64 nt, hsa
cccuuggcucagaaugguuauagcagaaauacaaaaaaaaaaaaaaagucuguacuaauuucaa

SEQ ID NO: 29247 - RNA, 64 nt, hsa
ccuuggcucagaaugguuauagcagaaauacaaaaaaaaaaaaaaagucuguacuaauuucaau

SEQ ID NO: 29248 - RNA, 64 nt, hsa
cuuggcucagaaugguuauagcagaaauacaaaaaaaaaaaaaaagucuguacuaauuucaaua

SEQ ID NO: 29249 - RNA, 64 nt, hsa
uuggcucagaaugguuauagcagaaauacaaaaaaaaaaaaaaagucuguacuaauuucaauau

SEQ ID NO: 29250 - RNA, 64 nt, hsa
uggcucagaaugguuauagcagaaauacaaaaaaaaaaaaaaagucuguacuaauuucaauaug

SEQ ID NO: 29251 - RNA, 64 nt, hsa
ggcucagaaugguuauagcagaaauacaaaaaaaaaaaaaaagucuguacuaauuucaauaugg

SEQ ID NO: 29252 - RNA, 64 nt, hsa
cagacaaggaacucucuccucucuuuuuggagggaaaaaaaaaauaucacuacacaaaccaggc

SEQ ID NO: 29253 - RNA, 64 nt, hsa
agacaaggaacucucuccucucuuuuuggagggaaaaaaaaaauaucacuacacaaaccaggca

SEQ ID NO: 29254 - RNA, 64 nt, hsa
gacaaggaacucucuccucucuuuuuggagggaaaaaaaaaauaucacuacacaaaccaggcac

SEQ ID NO: 29255 - RNA, 64 nt, hsa
cugcaggacagaaacaagguuuuaaagcauugccaaaaaaaagaaaacagaaagaaaaaaugua

SEQ ID NO: 29256 - RNA, 64 nt, hsa
cccuccccaccuucaccuucucaaaaauggaaggaaaaaaaaacugugaauggggaaugcugac

SEQ ID NO: 29257 - RNA, 64 nt, hsa
ccuccccaccuucaccuucucaaaaauggaaggaaaaaaaaacugugaauggggaaugcugacu

SEQ ID NO: 29258 - RNA, 64 nt, hsa
gaaucuuguaacuuuauucuuuuuucuccugcugaaaaaaaaaauuaaaccaaucguaugaaag

SEQ ID NO: 29259 - RNA, 64 nt, hsa
aaucuuguaacuuuauucuuuuuucuccugcugaaaaaaaaaauuaaaccaaucguaugaaagu

SEQ ID NO: 29260 - RNA, 64 nt, hsa
aucuuguaacuuuauucuuuuuucuccugcugaaaaaaaaaauuaaaccaaucguaugaaaguu

SEQ ID NO: 29261 - RNA, 64 nt, hsa
uacauuuuguaaaaauauuuauaaaauguuuuguaaaaaaaaaaaaacuauaacaaauugcagu

SEQ ID NO: 29262 - RNA, 64 nt, hsa
acauuuuguaaaaauauuuauaaaauguuuuguaaaaaaaaaaaaacuauaacaaauugcaguu

SEQ ID NO: 29263 - RNA, 64 nt, hsa
cauuuuguaaaaauauuuauaaaauguuuuguaaaaaaaaaaaaacuauaacaaauugcaguuu

SEQ ID NO: 29264 - RNA, 64 nt, hsa
auuuuguaaaaauauuuauaaaauguuuuguaaaaaaaaaaaaacuauaacaaauugcaguuua

SEQ ID NO: 29265 - RNA, 64 nt, hsa
uuuuguaaaaauauuuauaaaauguuuuguaaaaaaaaaaaaacuauaacaaauugcaguuuau

SEQ ID NO: 29266 - RNA, 64 nt, hsa
uuuguaaaaauauuuauaaaauguuuuguaaaaaaaaaaaaacuauaacaaauugcaguuuauu

SEQ ID NO: 29267 - RNA, 64 nt, hsa
ucacaguccuauguacagagcuuucuuuuguauuaaaaaaaaauacucuuucaauaaauguauc

SEQ ID NO: 29268 - RNA, 64 nt, hsa
cacaguccuauguacagagcuuucuuuuguauuaaaaaaaaauacucuuucaauaaauguauca

SEQ ID NO: 29269 - RNA, 64 nt, hsa
gcaaaugaagaaauauuuuaaggaaaccuauuugaaaaaaaaagcaaagaccauuugauaaaag

SEQ ID NO: 29270 - RNA, 64 nt, hsa
caaaugaagaaauauuuuaaggaaaccuauuugaaaaaaaaagcaaagaccauuugauaaaagc

SEQ ID NO: 29271 - RNA, 64 nt, hsa
auauuagguagaauacacauacaaucaaaauuuuaaaaaaaaaagcuaaauaacuuaaaaaaaa

SEQ ID NO: 29272 - RNA, 64 nt, hsa
uauuagguagaauacacauacaaucaaaauuuuaaaaaaaaaagcuaaauaacuuaaaaaaaaa

SEQ ID NO: 29273 - RNA, 64 nt, hsa
auuagguagaauacacauacaaucaaaauuuuaaaaaaaaaagcuaaauaacuuaaaaaaaaac

SEQ ID NO: 29274 - RNA, 64 nt, hsa
aaucaaaauuuuaaaaaaaaaagcuaaauaacuuaaaaaaaaacugaggcguacaacggagcaa

SEQ ID NO: 29275 - RNA, 64 nt, hsa
aucaaaauuuuaaaaaaaaaagcuaaauaacuuaaaaaaaaacugaggcguacaacggagcaac

SEQ ID NO: 29276 - RNA, 64 nt, hsa
ggcaacauaacaagaccccaucccuuauuaaaagaaaaaaaaauaauuccucauuucaucauug

SEQ ID NO: 29277 - RNA, 64 nt, hsa
gcaacauaacaagaccccaucccuuauuaaaagaaaaaaaaauaauuccucauuucaucauugg

SEQ ID NO: 29278 - RNA, 64 nt, hsa
cagccugggcaacauggcaaaacaccgucucuacaaaaaaaaaaaaaaaaaaaauuagccaagu

SEQ ID NO: 29279 - RNA, 64 nt, hsa
agccugggcaacauggcaaaacaccgucucuacaaaaaaaaaaaaaaaaaaaauuagccaagua

SEQ ID NO: 29280 - RNA, 64 nt, hsa
gccugggcaacauggcaaaacaccgucucuacaaaaaaaaaaaaaaaaaaaauuagccaaguac

SEQ ID NO: 29281 - RNA, 64 nt, hsa
ccugggcaacauggcaaaacaccgucucuacaaaaaaaaaaaaaaaaaaaauuagccaaguaca

SEQ ID NO: 29282 - RNA, 64 nt, hsa
cugggcaacauggcaaaacaccgucucuacaaaaaaaaaaaaaaaaaaaauuagccaaguacag

SEQ ID NO: 29283 - RNA, 64 nt, hsa
ugggcaacauggcaaaacaccgucucuacaaaaaaaaaaaaaaaaaaaauuagccaaguacagu

SEQ ID NO: 29284 - RNA, 64 nt, hsa
gggcaacauggcaaaacaccgucucuacaaaaaaaaaaaaaaaaaaaauuagccaaguacagug

SEQ ID NO: 29285 - RNA, 64 nt, hsa
ggcaacauggcaaaacaccgucucuacaaaaaaaaaaaaaaaaaaaauuagccaaguacagugg

SEQ ID NO: 29286 - RNA, 64 nt, hsa
gcaacauggcaaaacaccgucucuacaaaaaaaaaaaaaaaaaaaauuagccaaguacaguggg

SEQ ID NO: 29287 - RNA, 64 nt, hsa
caacauggcaaaacaccgucucuacaaaaaaaaaaaaaaaaaaaauuagccaaguacagugggg

SEQ ID NO: 29288 - RNA, 64 nt, hsa
aacauggcaaaacaccgucucuacaaaaaaaaaaaaaaaaaaaauuagccaaguacaguggggc

SEQ ID NO: 29289 - RNA, 64 nt, hsa
acauggcaaaacaccgucucuacaaaaaaaaaaaaaaaaaaaauuagccaaguacaguggggca

SEQ ID NO: 29290 - RNA, 64 nt, hsa
cauggcaaaacaccgucucuacaaaaaaaaaaaaaaaaaaaauuagccaaguacaguggggcac

SEQ ID NO: 29291 - RNA, 64 nt, hsa
acaacauagcaagaccucaucucuucuaaaaauuaaaaaaaaaaaaaauaggcauggugguaca

SEQ ID NO: 29292 - RNA, 64 nt, hsa
caacauagcaagaccucaucucuucuaaaaauuaaaaaaaaaaaaaauaggcauggugguacac

SEQ ID NO: 29293 - RNA, 64 nt, hsa
aacauagcaagaccucaucucuucuaaaaauuaaaaaaaaaaaaaauaggcauggugguacaca

SEQ ID NO: 29294 - RNA, 64 nt, hsa
acauagcaagaccucaucucuucuaaaaauuaaaaaaaaaaaaaauaggcauggugguacacac

SEQ ID NO: 29295 - RNA, 64 nt, hsa
cauagcaagaccucaucucuucuaaaaauuaaaaaaaaaaaaaauaggcauggugguacacacc

SEQ ID NO: 29296 - RNA, 64 nt, hsa
auagcaagaccucaucucuucuaaaaauuaaaaaaaaaaaaaauaggcauggugguacacaccu

SEQ ID NO: 29297 - RNA, 64 nt, hsa
uagcaagaccucaucucuucuaaaaauuaaaaaaaaaaaaaauaggcauggugguacacaccug

SEQ ID NO: 29298 - RNA, 64 nt, hsa
cuuuuuuuuuuuuaaucuauugcucuuuggaaauaaaaaaaaagucaguuuaaaaugauuucuc

SEQ ID NO: 29299 - RNA, 64 nt, hsa
uuuuuuuuuuuuaaucuauugcucuuuggaaauaaaaaaaaagucaguuuaaaaugauuucuca

SEQ ID NO: 29300 - RNA, 64 nt, hsa
ggcaauaagaacuucauuuuacaauuuaguuuucaaaaaaaaaaugcaggaaacuguuuuauca

SEQ ID NO: 29301 - RNA, 64 nt, hsa
gcaauaagaacuucauuuuacaauuuaguuuucaaaaaaaaaaugcaggaaacuguuuuaucag

SEQ ID NO: 29302 - RNA, 64 nt, hsa
caauaagaacuucauuuuacaauuuaguuuucaaaaaaaaaaugcaggaaacuguuuuaucagg

SEQ ID NO: 29303 - RNA, 64 nt, hsa
cuugaagacuuacagcaaauccuuugugaaaaauaaaaaaaaaaaagagacuuuaaaauccugg

SEQ ID NO: 29304 - RNA, 64 nt, hsa
uugaagacuuacagcaaauccuuugugaaaaauaaaaaaaaaaaagagacuuuaaaauccuggu

SEQ ID NO: 29305 - RNA, 64 nt, hsa
ugaagacuuacagcaaauccuuugugaaaaauaaaaaaaaaaaagagacuuuaaaauccuggug

SEQ ID NO: 29306 - RNA, 64 nt, hsa
gaagacuuacagcaaauccuuugugaaaaauaaaaaaaaaaaagagacuuuaaaauccuggugu

SEQ ID NO: 29307 - RNA, 64 nt, hsa
aagacuuacagcaaauccuuugugaaaaauaaaaaaaaaaaagagacuuuaaaauccuggugua

SEQ ID NO: 29308 - RNA, 64 nt, hsa
aagagcaauucaaaaaaaguaaccuuauacuacuaaaaaaaaaauucuugcauauauuaucauc

SEQ ID NO: 29309 - RNA, 64 nt, hsa
agagcaauucaaaaaaaguaaccuuauacuacuaaaaaaaaaauucuugcauauauuaucauca

SEQ ID NO: 29310 - RNA, 64 nt, hsa
gagcaauucaaaaaaaguaaccuuauacuacuaaaaaaaaaauucuugcauauauuaucaucaa

SEQ ID NO: 29311 - RNA, 64 nt, hsa
uuuuaauuauuauuuccccgucccuuaaaaagacaaaaaaaauaaggcaaaaggaaagcaacua

SEQ ID NO: 29312 - RNA, 64 nt, hsa
auaccuggcaaaacuaaauaaauuaccaaaaaggaaaaaaaauccaccaaaccaugauaaacac

SEQ ID NO: 29313 - RNA, 64 nt, hsa
gcccccucuuucacuaaggaaggcaaaugaagugaaaaaaaaaaaugccauuuucaauccuucc

SEQ ID NO: 29314 - RNA, 64 nt, hsa
cccccucuuucacuaaggaaggcaaaugaagugaaaaaaaaaaaugccauuuucaauccuuccu

SEQ ID NO: 29315 - RNA, 64 nt, hsa
ccccucuuucacuaaggaaggcaaaugaagugaaaaaaaaaaaugccauuuucaauccuuccuu

SEQ ID NO: 29316 - RNA, 64 nt, hsa
cccucuuucacuaaggaaggcaaaugaagugaaaaaaaaaaaugccauuuucaauccuuccuuu

SEQ ID NO: 29317 - RNA, 64 nt, hsa
caagccauguaaaagaucuacuuuuucuaagggcaaaaaaaaaaaaaaaaaaaaaagaacacuc

SEQ ID NO: 29318 - RNA, 64 nt, hsa
aagccauguaaaagaucuacuuuuucuaagggcaaaaaaaaaaaaaaaaaaaaaagaacacucc

SEQ ID NO: 29319 - RNA, 64 nt, hsa
agccauguaaaagaucuacuuuuucuaagggcaaaaaaaaaaaaaaaaaaaaaagaacacuccu

SEQ ID NO: 29320 - RNA, 64 nt, hsa
gccauguaaaagaucuacuuuuucuaagggcaaaaaaaaaaaaaaaaaaaaaagaacacuccuu

SEQ ID NO: 29321 - RNA, 64 nt, hsa
ccauguaaaagaucuacuuuuucuaagggcaaaaaaaaaaaaaaaaaaaaaagaacacuccuuu

SEQ ID NO: 29322 - RNA, 64 nt, hsa
cauguaaaagaucuacuuuuucuaagggcaaaaaaaaaaaaaaaaaaaaaagaacacuccuuuc

SEQ ID NO: 29323 - RNA, 64 nt, hsa
auguaaaagaucuacuuuuucuaagggcaaaaaaaaaaaaaaaaaaaaaagaacacuccuuucu

SEQ ID NO: 29324 - RNA, 64 nt, hsa
uguaaaagaucuacuuuuucuaagggcaaaaaaaaaaaaaaaaaaaaaagaacacuccuuucug

SEQ ID NO: 29325 - RNA, 64 nt, hsa
guaaaagaucuacuuuuucuaagggcaaaaaaaaaaaaaaaaaaaaaagaacacuccuuucuga

SEQ ID NO: 29326 - RNA, 64 nt, hsa
uaaaagaucuacuuuuucuaagggcaaaaaaaaaaaaaaaaaaaaaagaacacuccuuucugag

SEQ ID NO: 29327 - RNA, 64 nt, hsa
aaaagaucuacuuuuucuaagggcaaaaaaaaaaaaaaaaaaaaaagaacacuccuuucugaga

SEQ ID NO: 29328 - RNA, 64 nt, hsa
aaagaucuacuuuuucuaagggcaaaaaaaaaaaaaaaaaaaaaagaacacuccuuucugagac

SEQ ID NO: 29329 - RNA, 64 nt, hsa
aagaucuacuuuuucuaagggcaaaaaaaaaaaaaaaaaaaaaagaacacuccuuucugagacu

SEQ ID NO: 29330 - RNA, 64 nt, hsa
agaucuacuuuuucuaagggcaaaaaaaaaaaaaaaaaaaaaagaacacuccuuucugagacuu

SEQ ID NO: 29331 - RNA, 64 nt, hsa
gaucuacuuuuucuaagggcaaaaaaaaaaaaaaaaaaaaaagaacacuccuuucugagacuuu

SEQ ID NO: 29332 - RNA, 64 nt, hsa
ccagaggaacuuagggauuucaccccuggcuuuuaaaaaaaacgaaauaccgacaagccacaag

SEQ ID NO: 29333 - RNA, 64 nt, hsa
acaguuguggaguaucccauucugaugaguacagaaaaaaaaagaaaaagaaaagaagagaaaa

SEQ ID NO: 29334 - RNA, 64 nt, hsa
caguuguggaguaucccauucugaugaguacagaaaaaaaaagaaaaagaaaagaagagaaaaa

SEQ ID NO: 29335 - RNA, 64 nt, hsa
aaauuaagaaaaaaaucaaaaaaggaagaaaacuaaaaaaaaaaaaaaucaaaucaccuuguga

SEQ ID NO: 29336 - RNA, 64 nt, hsa
aauuaagaaaaaaaucaaaaaaggaagaaaacuaaaaaaaaaaaaaaucaaaucaccuugugau

SEQ ID NO: 29337 - RNA, 64 nt, hsa
auuaagaaaaaaaucaaaaaaggaagaaaacuaaaaaaaaaaaaaaucaaaucaccuugugauu

SEQ ID NO: 29338 - RNA, 64 nt, hsa
uuaagaaaaaaaucaaaaaaggaagaaaacuaaaaaaaaaaaaaaucaaaucaccuugugauuc

SEQ ID NO: 29339 - RNA, 64 nt, hsa
uaagaaaaaaaucaaaaaaggaagaaaacuaaaaaaaaaaaaaaucaaaucaccuugugauuca

SEQ ID NO: 29340 - RNA, 64 nt, hsa
aagaaaaaaaucaaaaaaggaagaaaacuaaaaaaaaaaaaaaucaaaucaccuugugauucag

SEQ ID NO: 29341 - RNA, 64 nt, hsa
agaaaaaaaucaaaaaaggaagaaaacuaaaaaaaaaaaaaaucaaaucaccuugugauucagu

SEQ ID NO: 29342 - RNA, 64 nt, hsa
gucagauucaucaaacaaaaaauaaaucucgaagaaaaaaaaugcacuuacaugugcuuauuug

SEQ ID NO: 29343 - RNA, 64 nt, hsa
uuaagauuaaaaaauuuuuaaaccucuaugucugaaaaaaaaaaugacacuccuggaagauggc

SEQ ID NO: 29344 - RNA, 64 nt, hsa
uaagauuaaaaaauuuuuaaaccucuaugucugaaaaaaaaaaugacacuccuggaagauggcu

SEQ ID NO: 29345 - RNA, 64 nt, hsa
aagauuaaaaaauuuuuaaaccucuaugucugaaaaaaaaaaugacacuccuggaagauggcua

SEQ ID NO: 29346 - RNA, 64 nt, hsa
gaggaaaaaagaaaaaacaccaauacccagauuuaaaaaaaaaaaaacgaucauagucuuagga

SEQ ID NO: 29347 - RNA, 64 nt, hsa
aggaaaaaagaaaaaacaccaauacccagauuuaaaaaaaaaaaaacgaucauagucuuaggag

SEQ ID NO: 29348 - RNA, 64 nt, hsa
ggaaaaaagaaaaaacaccaauacccagauuuaaaaaaaaaaaaacgaucauagucuuaggagu

SEQ ID NO: 29349 - RNA, 64 nt, hsa
gaaaaaagaaaaaacaccaauacccagauuuaaaaaaaaaaaaacgaucauagucuuaggaguu

SEQ ID NO: 29350 - RNA, 64 nt, hsa
aaaaaagaaaaaacaccaauacccagauuuaaaaaaaaaaaaacgaucauagucuuaggaguuc

SEQ ID NO: 29351 - RNA, 64 nt, hsa
aaaaagaaaaaacaccaauacccagauuuaaaaaaaaaaaaacgaucauagucuuaggaguuca

SEQ ID NO: 29352 - RNA, 64 nt, hsa
ugcuuucuuuuccagucgucuuugagaauaaaggaaaaaaaaaucuucagaugcaaugguuuug

SEQ ID NO: 29353 - RNA, 64 nt, hsa
gcuuucuuuuccagucgucuuugagaauaaaggaaaaaaaaaucuucagaugcaaugguuuugu

SEQ ID NO: 29354 - RNA, 64 nt, hsa
cugaaaaaugaagugaagacccauauaugcaguuaaaaaaaaguuaauuuucaaaaaauacugu

SEQ ID NO: 29355 - RNA, 64 nt, hsa
cagaauuuggcauaucgaugcaugcaauggaaagaaaaaaaauuuguuaaaauuuguaaauguu

SEQ ID NO: 29356 - RNA, 64 nt, hsa
ugaguaucucaggguaaguaacaaaaaaacaaacaaaaaaaaucacugaaauuuuucccucaca

SEQ ID NO: 29357 - RNA, 64 nt, hsa
uaccuggucauuuugugaucacaagagucuaugcaaaaaaaaaaauuucuuuaccccagauuau

SEQ ID NO: 29358 - RNA, 64 nt, hsa
accuggucauuuugugaucacaagagucuaugcaaaaaaaaaaauuucuuuaccccagauuauc

SEQ ID NO: 29359 - RNA, 64 nt, hsa
ccuggucauuuugugaucacaagagucuaugcaaaaaaaaaaauuucuuuaccccagauuauca

SEQ ID NO: 29360 - RNA, 64 nt, hsa
cuggucauuuugugaucacaagagucuaugcaaaaaaaaaaauuucuuuaccccagauuaucag

SEQ ID NO: 29361 - RNA, 64 nt, hsa
acuuaaagggaauauaugagguuuuuuuuuuuuuaaaaaaaaacuuuuauuuauuauuuguagu

SEQ ID NO: 29362 - RNA, 64 nt, hsa
cuuaaagggaauauaugagguuuuuuuuuuuuuaaaaaaaaacuuuuauuuauuauuuguagua

SEQ ID NO: 29363 - RNA, 64 nt, hsa
ugugaaccuagacuuagaacaaauccugcuuuugaaaaaaaauguuuugcuucuuacaaaauca

SEQ ID NO: 29364 - RNA, 64 nt, hsa
uuaacuuggaguuucauuucuuuucauuguaaucaaaaaaaaaauuaacagaagccaaaauacu

SEQ ID NO: 29365 - RNA, 64 nt, hsa
uaacuuggaguuucauuucuuuucauuguaaucaaaaaaaaaauuaacagaagccaaaauacuu

SEQ ID NO: 29366 - RNA, 64 nt, hsa
aacuuggaguuucauuucuuuucauuguaaucaaaaaaaaaauuaacagaagccaaaauacuuc

SEQ ID NO: 29367 - RNA, 64 nt, hsa
aacugugucauuuuguauacacaugugagguuugaaaaaaaaaaaaaaaaaaaaaagaacuacc

SEQ ID NO: 29368 - RNA, 64 nt, hsa
acugugucauuuuguauacacaugugagguuugaaaaaaaaaaaaaaaaaaaaaagaacuaccu

SEQ ID NO: 29369 - RNA, 64 nt, hsa
cugugucauuuuguauacacaugugagguuugaaaaaaaaaaaaaaaaaaaaaagaacuaccuu

SEQ ID NO: 29370 - RNA, 64 nt, hsa
ugugucauuuuguauacacaugugagguuugaaaaaaaaaaaaaaaaaaaaaagaacuaccuug

SEQ ID NO: 29371 - RNA, 64 nt, hsa
gugucauuuuguauacacaugugagguuugaaaaaaaaaaaaaaaaaaaaaagaacuaccuugu

SEQ ID NO: 29372 - RNA, 64 nt, hsa
ugucauuuuguauacacaugugagguuugaaaaaaaaaaaaaaaaaaaaaagaacuaccuugug

SEQ ID NO: 29373 - RNA, 64 nt, hsa
gucauuuuguauacacaugugagguuugaaaaaaaaaaaaaaaaaaaaaagaacuaccuuguga

SEQ ID NO: 29374 - RNA, 64 nt, hsa
ucauuuuguauacacaugugagguuugaaaaaaaaaaaaaaaaaaaaaagaacuaccuugugag

SEQ ID NO: 29375 - RNA, 64 nt, hsa
cauuuuguauacacaugugagguuugaaaaaaaaaaaaaaaaaaaaaagaacuaccuugugagu

SEQ ID NO: 29376 - RNA, 64 nt, hsa
auuuuguauacacaugugagguuugaaaaaaaaaaaaaaaaaaaaaagaacuaccuugugaguu

SEQ ID NO: 29377 - RNA, 64 nt, hsa
uuuuguauacacaugugagguuugaaaaaaaaaaaaaaaaaaaaaagaacuaccuugugaguuu

SEQ ID NO: 29378 - RNA, 64 nt, hsa
uuuguauacacaugugagguuugaaaaaaaaaaaaaaaaaaaaaagaacuaccuugugaguuuu

SEQ ID NO: 29379 - RNA, 64 nt, hsa
uuguauacacaugugagguuugaaaaaaaaaaaaaaaaaaaaaagaacuaccuugugaguuuug

SEQ ID NO: 29380 - RNA, 64 nt, hsa
uguauacacaugugagguuugaaaaaaaaaaaaaaaaaaaaaagaacuaccuugugaguuuugc

SEQ ID NO: 29381 - RNA, 64 nt, hsa
guauacacaugugagguuugaaaaaaaaaaaaaaaaaaaaaagaacuaccuugugaguuuugcu

SEQ ID NO: 29382 - RNA, 64 nt, hsa
ugcuuugugguugcugucauauuugcucuagaagaaaaaaaaaaaaggaggggaaaugcauuuu

SEQ ID NO: 29383 - RNA, 64 nt, hsa
gcuuugugguugcugucauauuugcucuagaagaaaaaaaaaaaaggaggggaaaugcauuuuc

SEQ ID NO: 29384 - RNA, 64 nt, hsa
cuuugugguugcugucauauuugcucuagaagaaaaaaaaaaaaggaggggaaaugcauuuucc

SEQ ID NO: 29385 - RNA, 64 nt, hsa
uuugugguugcugucauauuugcucuagaagaaaaaaaaaaaaggaggggaaaugcauuuuccc

SEQ ID NO: 29386 - RNA, 64 nt, hsa
uugugguugcugucauauuugcucuagaagaaaaaaaaaaaaggaggggaaaugcauuuucccc

SEQ ID NO: 29387 - RNA, 64 nt, hsa
gcugcauuuuuuuaaaguuggauugcugcuauuuaaaaaaaaaaaaaggacacagaucaaaaaa

SEQ ID NO: 29388 - RNA, 64 nt, hsa
cugcauuuuuuuaaaguuggauugcugcuauuuaaaaaaaaaaaaaggacacagaucaaaaaaa

SEQ ID NO: 29389 - RNA, 64 nt, hsa
ugcauuuuuuuaaaguuggauugcugcuauuuaaaaaaaaaaaaaggacacagaucaaaaaaac

SEQ ID NO: 29390 - RNA, 64 nt, hsa
gcauuuuuuuaaaguuggauugcugcuauuuaaaaaaaaaaaaaggacacagaucaaaaaaaca

SEQ ID NO: 29391 - RNA, 64 nt, hsa
cauuuuuuuaaaguuggauugcugcuauuuaaaaaaaaaaaaaggacacagaucaaaaaaacac

SEQ ID NO: 29392 - RNA, 64 nt, hsa
auuuuuuuaaaguuggauugcugcuauuuaaaaaaaaaaaaaggacacagaucaaaaaaacacc

SEQ ID NO: 29393 - RNA, 64 nt, hsa
uagaaauagaacaauccaucagcaugagacuuugaaaaaaaaacacaugaucagcuucucaugu

SEQ ID NO: 29394 - RNA, 64 nt, hsa
agaaauagaacaauccaucagcaugagacuuugaaaaaaaaacacaugaucagcuucucauguu

SEQ ID NO: 29395 - RNA, 64 nt, hsa
aauguaccuuugcauucuuuaauuaaaauugcuuaaaaaaaaacuuucauuauuucaguaaaau

SEQ ID NO: 29396 - RNA, 64 nt, hsa
auguaccuuugcauucuuuaauuaaaauugcuuaaaaaaaaacuuucauuauuucaguaaaaug

SEQ ID NO: 29397 - RNA, 64 nt, hsa
uuguucaaaaguuagaacaucuggcugcaccaggaaaaaaaaaaaaaaaaaguccuguucuucu

SEQ ID NO: 29398 - RNA, 64 nt, hsa
uguucaaaaguuagaacaucuggcugcaccaggaaaaaaaaaaaaaaaaaguccuguucuucuu

SEQ ID NO: 29399 - RNA, 64 nt, hsa
guucaaaaguuagaacaucuggcugcaccaggaaaaaaaaaaaaaaaaaguccuguucuucuuu

SEQ ID NO: 29400 - RNA, 64 nt, hsa
uucaaaaguuagaacaucuggcugcaccaggaaaaaaaaaaaaaaaaaguccuguucuucuuua

SEQ ID NO: 29401 - RNA, 64 nt, hsa
ucaaaaguuagaacaucuggcugcaccaggaaaaaaaaaaaaaaaaaguccuguucuucuuuag

SEQ ID NO: 29402 - RNA, 64 nt, hsa
caaaaguuagaacaucuggcugcaccaggaaaaaaaaaaaaaaaaaguccuguucuucuuuaga

SEQ ID NO: 29403 - RNA, 64 nt, hsa
aaaaguuagaacaucuggcugcaccaggaaaaaaaaaaaaaaaaaguccuguucuucuuuagau

SEQ ID NO: 29404 - RNA, 64 nt, hsa
aaaguuagaacaucuggcugcaccaggaaaaaaaaaaaaaaaaaguccuguucuucuuuagaua

SEQ ID NO: 29405 - RNA, 64 nt, hsa
aaguuagaacaucuggcugcaccaggaaaaaaaaaaaaaaaaaguccuguucuucuuuagauaa

SEQ ID NO: 29406 - RNA, 64 nt, hsa
aguuagaacaucuggcugcaccaggaaaaaaaaaaaaaaaaaguccuguucuucuuuagauaaa

SEQ ID NO: 29407 - RNA, 64 nt, hsa
cuagccauauuuaggacaacugaagaaaagcuggaaaaaaaaacaagcaaacuugaacacugaa

SEQ ID NO: 29408 - RNA, 64 nt, hsa
uagccauauuuaggacaacugaagaaaagcuggaaaaaaaaacaagcaaacuugaacacugaag

SEQ ID NO: 29409 - RNA, 64 nt, hsa
ccagccugggcgacagagugaaacuacaucucagaaaaaaaaaaaaaaaaaaaaaaaaaaaguu

SEQ ID NO: 29410 - RNA, 64 nt, hsa
cagccugggcgacagagugaaacuacaucucagaaaaaaaaaaaaaaaaaaaaaaaaaaaguua

SEQ ID NO: 29411 - RNA, 64 nt, hsa
agccugggcgacagagugaaacuacaucucagaaaaaaaaaaaaaaaaaaaaaaaaaaaguuaa

SEQ ID NO: 29412 - RNA, 64 nt, hsa
gccugggcgacagagugaaacuacaucucagaaaaaaaaaaaaaaaaaaaaaaaaaaaguuaau

SEQ ID NO: 29413 - RNA, 64 nt, hsa
ccugggcgacagagugaaacuacaucucagaaaaaaaaaaaaaaaaaaaaaaaaaaaguuaaug

SEQ ID NO: 29414 - RNA, 64 nt, hsa
cugggcgacagagugaaacuacaucucagaaaaaaaaaaaaaaaaaaaaaaaaaaaguuaaugu

SEQ ID NO: 29415 - RNA, 64 nt, hsa
ugggcgacagagugaaacuacaucucagaaaaaaaaaaaaaaaaaaaaaaaaaaaguuaauguc

SEQ ID NO: 29416 - RNA, 64 nt, hsa
gggcgacagagugaaacuacaucucagaaaaaaaaaaaaaaaaaaaaaaaaaaaguuaaugucc

SEQ ID NO: 29417 - RNA, 64 nt, hsa
ggcgacagagugaaacuacaucucagaaaaaaaaaaaaaaaaaaaaaaaaaaaguuaaugucca

SEQ ID NO: 29418 - RNA, 64 nt, hsa
gcgacagagugaaacuacaucucagaaaaaaaaaaaaaaaaaaaaaaaaaaaguuaauguccaa

SEQ ID NO: 29419 - RNA, 64 nt, hsa
cgacagagugaaacuacaucucagaaaaaaaaaaaaaaaaaaaaaaaaaaaguuaauguccaaa

SEQ ID NO: 29420 - RNA, 64 nt, hsa
gacagagugaaacuacaucucagaaaaaaaaaaaaaaaaaaaaaaaaaaaguuaauguccaaaa

SEQ ID NO: 29421 - RNA, 64 nt, hsa
acagagugaaacuacaucucagaaaaaaaaaaaaaaaaaaaaaaaaaaaguuaauguccaaaaa

SEQ ID NO: 29422 - RNA, 64 nt, hsa
cagagugaaacuacaucucagaaaaaaaaaaaaaaaaaaaaaaaaaaaguuaauguccaaaaau

SEQ ID NO: 29423 - RNA, 64 nt, hsa
agagugaaacuacaucucagaaaaaaaaaaaaaaaaaaaaaaaaaaaguuaauguccaaaaaug

SEQ ID NO: 29424 - RNA, 64 nt, hsa
gagugaaacuacaucucagaaaaaaaaaaaaaaaaaaaaaaaaaaaguuaauguccaaaaauga

SEQ ID NO: 29425 - RNA, 64 nt, hsa
agugaaacuacaucucagaaaaaaaaaaaaaaaaaaaaaaaaaaaguuaauguccaaaaaugac

SEQ ID NO: 29426 - RNA, 64 nt, hsa
gugaaacuacaucucagaaaaaaaaaaaaaaaaaaaaaaaaaaaguuaauguccaaaaaugaca

SEQ ID NO: 29427 - RNA, 64 nt, hsa
ugaaacuacaucucagaaaaaaaaaaaaaaaaaaaaaaaaaaaguuaauguccaaaaaugacag

SEQ ID NO: 29428 - RNA, 64 nt, hsa
gaaacuacaucucagaaaaaaaaaaaaaaaaaaaaaaaaaaaguuaauguccaaaaaugacaga

SEQ ID NO: 29429 - RNA, 64 nt, hsa
gaaaacuaccaauaaauguagaauggaugauuccaaaaaaaaaaaaaaaaagaagaaagagaga

SEQ ID NO: 29430 - RNA, 64 nt, hsa
aaaacuaccaauaaauguagaauggaugauuccaaaaaaaaaaaaaaaaagaagaaagagagaa

SEQ ID NO: 29431 - RNA, 64 nt, hsa
aaacuaccaauaaauguagaauggaugauuccaaaaaaaaaaaaaaaaagaagaaagagagaaa

SEQ ID NO: 29432 - RNA, 64 nt, hsa
aacuaccaauaaauguagaauggaugauuccaaaaaaaaaaaaaaaaagaagaaagagagaaag

SEQ ID NO: 29433 - RNA, 64 nt, hsa
acuaccaauaaauguagaauggaugauuccaaaaaaaaaaaaaaaaagaagaaagagagaaaga

SEQ ID NO: 29434 - RNA, 64 nt, hsa
cuaccaauaaauguagaauggaugauuccaaaaaaaaaaaaaaaaagaagaaagagagaaagaa

SEQ ID NO: 29435 - RNA, 64 nt, hsa
uaccaauaaauguagaauggaugauuccaaaaaaaaaaaaaaaaagaagaaagagagaaagaaa

SEQ ID NO: 29436 - RNA, 64 nt, hsa
accaauaaauguagaauggaugauuccaaaaaaaaaaaaaaaaagaagaaagagagaaagaaag

SEQ ID NO: 29437 - RNA, 64 nt, hsa
ccaauaaauguagaauggaugauuccaaaaaaaaaaaaaaaaagaagaaagagagaaagaaaga

SEQ ID NO: 29438 - RNA, 64 nt, hsa
caauaaauguagaauggaugauuccaaaaaaaaaaaaaaaaagaagaaagagagaaagaaagaa

SEQ ID NO: 29439 - RNA, 64 nt, hsa
agugaucaccaaaggacugagaaucugggagggcaaaaaaaaaaaaaaaguuuuuaugugcacu

SEQ ID NO: 29440 - RNA, 64 nt, hsa
gugaucaccaaaggacugagaaucugggagggcaaaaaaaaaaaaaaaguuuuuaugugcacuu

SEQ ID NO: 29441 - RNA, 64 nt, hsa
ugaucaccaaaggacugagaaucugggagggcaaaaaaaaaaaaaaaguuuuuaugugcacuua

SEQ ID NO: 29442 - RNA, 64 nt, hsa
gaucaccaaaggacugagaaucugggagggcaaaaaaaaaaaaaaaguuuuuaugugcacuuaa

SEQ ID NO: 29443 - RNA, 64 nt, hsa
aucaccaaaggacugagaaucugggagggcaaaaaaaaaaaaaaaguuuuuaugugcacuuaaa

SEQ ID NO: 29444 - RNA, 64 nt, hsa
ucaccaaaggacugagaaucugggagggcaaaaaaaaaaaaaaaguuuuuaugugcacuuaaau

SEQ ID NO: 29445 - RNA, 64 nt, hsa
caccaaaggacugagaaucugggagggcaaaaaaaaaaaaaaaguuuuuaugugcacuuaaauu

SEQ ID NO: 29446 - RNA, 64 nt, hsa
accaaaggacugagaaucugggagggcaaaaaaaaaaaaaaaguuuuuaugugcacuuaaauuu

SEQ ID NO: 29447 - RNA, 64 nt, hsa
cuuagauuuucuuuuaaaaaaauuaaaauaaaacaaaaaaaaauuucuaggacuagacgaugua

SEQ ID NO: 29448 - RNA, 64 nt, hsa
uuagauuuucuuuuaaaaaaauuaaaauaaaacaaaaaaaaauuucuaggacuagacgauguaa

SEQ ID NO: 29449 - RNA, 64 nt, hsa
gcugauguugguauuggguguaggaacaugauuuaaaaaaaaacucuugccucugcuuuccccc

SEQ ID NO: 29450 - RNA, 64 nt, hsa
cugauguugguauuggguguaggaacaugauuuaaaaaaaaacucuugccucugcuuuccccca

SEQ ID NO: 29451 - RNA, 64 nt, hsa
ggaacuuuugggugccaaaugggacuuuuagauuaaaaaaaaaucagaauuaugcuuaacuuuc

SEQ ID NO: 29452 - RNA, 64 nt, hsa
gaacuuuugggugccaaaugggacuuuuagauuaaaaaaaaaucagaauuaugcuuaacuuucc

SEQ ID NO: 29453 - RNA, 64 nt, hsa
aaaaaaagaaagaaaaaauacaaaaaacaaaaacaaaaaaaaaagaggguaauguacaaguuuc

SEQ ID NO: 29454 - RNA, 64 nt, hsa
aaaaaagaaagaaaaaauacaaaaaacaaaaacaaaaaaaaaagaggguaauguacaaguuucu

SEQ ID NO: 29455 - RNA, 64 nt, hsa
aaaaagaaagaaaaaauacaaaaaacaaaaacaaaaaaaaaagaggguaauguacaaguuucug

SEQ ID NO: 29456 - RNA, 64 nt, hsa
gaauccacauuuguauuucaagauaauguaguuuaaaaaaaaaaaaaagaaaaaaacuugaugu

SEQ ID NO: 29457 - RNA, 64 nt, hsa
aauccacauuuguauuucaagauaauguaguuuaaaaaaaaaaaaaagaaaaaaacuugaugua

SEQ ID NO: 29458 - RNA, 64 nt, hsa
auccacauuuguauuucaagauaauguaguuuaaaaaaaaaaaaaagaaaaaaacuugauguaa

SEQ ID NO: 29459 - RNA, 64 nt, hsa
uccacauuuguauuucaagauaauguaguuuaaaaaaaaaaaaaagaaaaaaacuugauguaaa

SEQ ID NO: 29460 - RNA, 64 nt, hsa
ccacauuuguauuucaagauaauguaguuuaaaaaaaaaaaaaagaaaaaaacuugauguaaau

SEQ ID NO: 29461 - RNA, 64 nt, hsa
cacauuuguauuucaagauaauguaguuuaaaaaaaaaaaaaagaaaaaaacuugauguaaauu

SEQ ID NO: 29462 - RNA, 64 nt, hsa
acauuuguauuucaagauaauguaguuuaaaaaaaaaaaaaagaaaaaaacuugauguaaauuc

SEQ ID NO: 29463 - RNA, 64 nt, hsa
auuugaaacagaccugccauuccauuuguuaauuaaaaaaaaaaaaaauccuaaagggaaaaaa

SEQ ID NO: 29464 - RNA, 64 nt, hsa
uuugaaacagaccugccauuccauuuguuaauuaaaaaaaaaaaaaauccuaaagggaaaaaac

SEQ ID NO: 29465 - RNA, 64 nt, hsa
uugaaacagaccugccauuccauuuguuaauuaaaaaaaaaaaaaauccuaaagggaaaaaacc

SEQ ID NO: 29466 - RNA, 64 nt, hsa
ugaaacagaccugccauuccauuuguuaauuaaaaaaaaaaaaaauccuaaagggaaaaaaccg

SEQ ID NO: 29467 - RNA, 64 nt, hsa
gaaacagaccugccauuccauuuguuaauuaaaaaaaaaaaaaauccuaaagggaaaaaaccga

SEQ ID NO: 29468 - RNA, 64 nt, hsa
aaacagaccugccauuccauuuguuaauuaaaaaaaaaaaaaauccuaaagggaaaaaaccgac

SEQ ID NO: 29469 - RNA, 64 nt, hsa
aacagaccugccauuccauuuguuaauuaaaaaaaaaaaaaauccuaaagggaaaaaaccgacc

SEQ ID NO: 29470 - RNA, 64 nt, hsa
cuuuucaucugaaaacuaauaccuggaaaaggauaaaaaaaaaaaggaauccgugacccacaga

SEQ ID NO: 29471 - RNA, 64 nt, hsa
uuuucaucugaaaacuaauaccuggaaaaggauaaaaaaaaaaaggaauccgugacccacagag

SEQ ID NO: 29472 - RNA, 64 nt, hsa
uuucaucugaaaacuaauaccuggaaaaggauaaaaaaaaaaaggaauccgugacccacagagc

SEQ ID NO: 29473 - RNA, 64 nt, hsa
uucaucugaaaacuaauaccuggaaaaggauaaaaaaaaaaaggaauccgugacccacagagcu

SEQ ID NO: 29474 - RNA, 64 nt, hsa
agguaguugguugaucacaguuuguuaauuguauaaaaaaaaauuaccuagaauaucucuuccc

SEQ ID NO: 29475 - RNA, 64 nt, hsa
gguaguugguugaucacaguuuguuaauuguauaaaaaaaaauuaccuagaauaucucuuccca

SEQ ID NO: 29476 - RNA, 64 nt, hsa
ugacuuugacaauuacucagguuugagaaaaaggaaaaaaaaacagccaccguuucuuccugcc

SEQ ID NO: 29477 - RNA, 64 nt, hsa
gacuuugacaauuacucagguuugagaaaaaggaaaaaaaaacagccaccguuucuuccugcca

SEQ ID NO: 29478 - RNA, 64 nt, hsa
aggcaugugugaaacauacucauagauguuaugcaaaaaaaagucuauggccagguaugcaugg

SEQ ID NO: 29479 - RNA, 64 nt, hsa
aaaaugauggcagugguuugaaaaacuaaaacagaaaaaaaaauggaagccaacacaucacuca

SEQ ID NO: 29480 - RNA, 64 nt, hsa
aaaugauggcagugguuugaaaaacuaaaacagaaaaaaaaauggaagccaacacaucacucau

SEQ ID NO: 29481 - RNA, 64 nt, hsa
cuccagccugggugacaaagcgagacuccaucucaaaaaaaaaaaaaaaaaaaaaggaaagaac

SEQ ID NO: 29482 - RNA, 64 nt, hsa
uccagccugggugacaaagcgagacuccaucucaaaaaaaaaaaaaaaaaaaaaggaaagaacu

SEQ ID NO: 29483 - RNA, 64 nt, hsa
ccagccugggugacaaagcgagacuccaucucaaaaaaaaaaaaaaaaaaaaaggaaagaacug

SEQ ID NO: 29484 - RNA, 64 nt, hsa
cagccugggugacaaagcgagacuccaucucaaaaaaaaaaaaaaaaaaaaaggaaagaacugu

SEQ ID NO: 29485 - RNA, 64 nt, hsa
agccugggugacaaagcgagacuccaucucaaaaaaaaaaaaaaaaaaaaaggaaagaacuguc

SEQ ID NO: 29486 - RNA, 64 nt, hsa
gccugggugacaaagcgagacuccaucucaaaaaaaaaaaaaaaaaaaaaggaaagaacuguca

SEQ ID NO: 29487 - RNA, 64 nt, hsa
ccugggugacaaagcgagacuccaucucaaaaaaaaaaaaaaaaaaaaaggaaagaacugucau

SEQ ID NO: 29488 - RNA, 64 nt, hsa
cugggugacaaagcgagacuccaucucaaaaaaaaaaaaaaaaaaaaaggaaagaacugucaug

SEQ ID NO: 29489 - RNA, 64 nt, hsa
ugggugacaaagcgagacuccaucucaaaaaaaaaaaaaaaaaaaaaggaaagaacugucaugu

SEQ ID NO: 29490 - RNA, 64 nt, hsa
gggugacaaagcgagacuccaucucaaaaaaaaaaaaaaaaaaaaaggaaagaacugucaugua

SEQ ID NO: 29491 - RNA, 64 nt, hsa
ggugacaaagcgagacuccaucucaaaaaaaaaaaaaaaaaaaaaggaaagaacugucauguaa

SEQ ID NO: 29492 - RNA, 64 nt, hsa
gugacaaagcgagacuccaucucaaaaaaaaaaaaaaaaaaaaaggaaagaacugucauguaaa

SEQ ID NO: 29493 - RNA, 64 nt, hsa
ugacaaagcgagacuccaucucaaaaaaaaaaaaaaaaaaaaaggaaagaacugucauguaaac

SEQ ID NO: 29494 - RNA, 64 nt, hsa
gacaaagcgagacuccaucucaaaaaaaaaaaaaaaaaaaaaggaaagaacugucauguaaaca

SEQ ID NO: 29495 - RNA, 64 nt, hsa
caccaacacuuauuauuuuccuuuuccuuuuuuuaaaaaaaauaaguuauggccaucuuagugg

SEQ ID NO: 29496 - RNA, 64 nt, hsa
auguugcauaaccaccaccuuuauuuaaaguuccaaaaaaaauguucuccucuaaaaggaaacc

SEQ ID NO: 29497 - RNA, 64 nt, hsa
aaaagauuuugacauaaaagagccuugauuuuaaaaaaaaaagagagagagauguaauuuaaaa

SEQ ID NO: 29498 - RNA, 64 nt, hsa
aaaaagauuuugacauaaaagagccuugauuuuaaaaaaaaaagagagagagauguaauuuaaa

SEQ ID NO: 29499 - RNA, 64 nt, hsa
aaaaaagauuuugacauaaaagagccuugauuuuaaaaaaaaaagagagagagauguaauuuaa

SEQ ID NO: 29500 - RNA, 64 nt, hsa
gcuugggugacagagugagacuccaucucaacaaaaaaaaaaucuaacugaagaacuaaguuga

SEQ ID NO: 29501 - RNA, 64 nt, hsa
agcuugggugacagagugagacuccaucucaacaaaaaaaaaaucuaacugaagaacuaaguug

SEQ ID NO: 29502 - RNA, 64 nt, hsa
cagcuugggugacagagugagacuccaucucaacaaaaaaaaaaucuaacugaagaacuaaguu

SEQ ID NO: 29503 - RNA, 64 nt, hsa
guauaaaguguuacugcaugaguaauguagacaaaaaaaaaagccagcuguccuuggagcagag

SEQ ID NO: 29504 - RNA, 64 nt, hsa
uguauaaaguguuacugcaugaguaauguagacaaaaaaaaaagccagcuguccuuggagcaga

SEQ ID NO: 29505 - RNA, 64 nt, hsa
auguauaaaguguuacugcaugaguaauguagacaaaaaaaaaagccagcuguccuuggagcag

SEQ ID NO: 29506 - RNA, 64 nt, hsa
uuacugggacacuuuuaaacucugaauaggcauuaaaaaaaauauggcuaacuaguguguuuuc

SEQ ID NO: 29507 - RNA, 64 nt, hsa
auuuaauaaauaguaaauccaauaagaacccuuaaaaaaaaacaacuuccagaaaauguuuaga

SEQ ID NO: 29508 - RNA, 64 nt, hsa
aauuuaauaaauaguaaauccaauaagaacccuuaaaaaaaaacaacuuccagaaaauguuuag

SEQ ID NO: 29509 - RNA, 64 nt, hsa
uaaaaaacaagaaugcaugaucucagagugauuaaaaaaaaaucaguggaaauaaaugaucaua

SEQ ID NO: 29510 - RNA, 64 nt, hsa
uuaaaaaacaagaaugcaugaucucagagugauuaaaaaaaaaucaguggaaauaaaugaucau

SEQ ID NO: 29511 - RNA, 64 nt, hsa
uguuuguagauguuugucugaugcauuucauuaaaaaaaaaaccaugaauuacgaagcaccuua

SEQ ID NO: 29512 - RNA, 64 nt, hsa
uuguuuguagauguuugucugaugcauuucauuaaaaaaaaaaccaugaauuacgaagcaccuu

SEQ ID NO: 29513 - RNA, 64 nt, hsa
uuuguuuguagauguuugucugaugcauuucauuaaaaaaaaaaccaugaauuacgaagcaccu

SEQ ID NO: 29514 - RNA, 54 nt, hsa
uggagauggcaacguucugagaagaaaaaaaagaggaaggggacugcguuaacg

SEQ ID NO: 29515 - RNA, 64 nt, hsa
guggugucucugaauuacugcaaaggguaaaaaaaaaaaaaagaaaucuagauuaucaagguua

SEQ ID NO: 29516 - RNA, 64 nt, hsa
aguggugucucugaauuacugcaaaggguaaaaaaaaaaaaaagaaaucuagauuaucaagguu

SEQ ID NO: 29517 - RNA, 64 nt, hsa
caguggugucucugaauuacugcaaaggguaaaaaaaaaaaaaagaaaucuagauuaucaaggu

SEQ ID NO: 29518 - RNA, 64 nt, hsa
gcaguggugucucugaauuacugcaaaggguaaaaaaaaaaaaaagaaaucuagauuaucaagg

SEQ ID NO: 29519 - RNA, 64 nt, hsa
agcaguggugucucugaauuacugcaaaggguaaaaaaaaaaaaaagaaaucuagauuaucaag

SEQ ID NO: 29520 - RNA, 64 nt, hsa
cagcaguggugucucugaauuacugcaaaggguaaaaaaaaaaaaaagaaaucuagauuaucaa

SEQ ID NO: 29521 - RNA, 64 nt, hsa
ucagcaguggugucucugaauuacugcaaaggguaaaaaaaaaaaaaagaaaucuagauuauca

SEQ ID NO: 29522 - RNA, 64 nt, hsa
uugaaaauaguacuuucuucguuucacaaauuaaaaaaaaaaucugguaucaacccacauuuug

SEQ ID NO: 29523 - RNA, 64 nt, hsa
auugaaaauaguacuuucuucguuucacaaauuaaaaaaaaaaucugguaucaacccacauuuu

SEQ ID NO: 29524 - RNA, 64 nt, hsa
cauugaaaauaguacuuucuucguuucacaaauuaaaaaaaaaaucugguaucaacccacauuu

SEQ ID NO: 29525 - RNA, 64 nt, hsa
uuuguggguuuugaaugcaucuuuaaagugcuuuaaaaaaaaguuuuauaaguagggagaaauu

SEQ ID NO: 29526 - RNA, 64 nt, hsa
cucacuuuaaacucuuuggggaaaaaacaaaaacaaaaaaaacuaaguugcuuucuuuuuuuca

SEQ ID NO: 29527 - RNA, 64 nt, hsa
ucaaaguugccuaaauccauuuggaaaucuuuaaaaaaaaaauuggggauucuuaaaguugaau

SEQ ID NO: 29528 - RNA, 64 nt, hsa
uucaaaguugccuaaauccauuuggaaaucuuuaaaaaaaaaauuggggauucuuaaaguugaa

SEQ ID NO: 29529 - RNA, 64 nt, hsa
auucaaaguugccuaaauccauuuggaaaucuuuaaaaaaaaaauuggggauucuuaaaguuga

SEQ ID NO: 29530 - RNA, 64 nt, hsa
ucguuggagagccuuacuuggguuugcacccaaaaaaaaaaacccaaucugaggaaagacugca

SEQ ID NO: 29531 - RNA, 64 nt, hsa
uucguuggagagccuuacuuggguuugcacccaaaaaaaaaaacccaaucugaggaaagacugc

SEQ ID NO: 29532 - RNA, 64 nt, hsa
auucguuggagagccuuacuuggguuugcacccaaaaaaaaaaacccaaucugaggaaagacug

SEQ ID NO: 29533 - RNA, 64 nt, hsa
cauucguuggagagccuuacuuggguuugcacccaaaaaaaaaaacccaaucugaggaaagacu

SEQ ID NO: 29534 - RNA, 64 nt, hsa
gugguggccacuggugacuugaaaauauagagaaaaaaaaaaccugcucuauaucugaaagagc

SEQ ID NO: 29535 - RNA, 64 nt, hsa
ugugguggccacuggugacuugaaaauauagagaaaaaaaaaaccugcucuauaucugaaagag

SEQ ID NO: 29536 - RNA, 64 nt, hsa
gugugguggccacuggugacuugaaaauauagagaaaaaaaaaaccugcucuauaucugaaaga

SEQ ID NO: 29537 - RNA, 64 nt, hsa
uuuuuuuccaccuccacuuuuuaaaagcaaaaaaaaaaaaaaguaugaugguggugaauaaaga

SEQ ID NO: 29538 - RNA, 64 nt, hsa
uuuuuuuuccaccuccacuuuuuaaaagcaaaaaaaaaaaaaaguaugaugguggugaauaaag

SEQ ID NO: 29539 - RNA, 64 nt, hsa
uuuuuuuuuccaccuccacuuuuuaaaagcaaaaaaaaaaaaaaguaugaugguggugaauaaa

SEQ ID NO: 29540 - RNA, 64 nt, hsa
uuuuuuuuuuccaccuccacuuuuuaaaagcaaaaaaaaaaaaaaguaugaugguggugaauaa

SEQ ID NO: 29541 - RNA, 64 nt, hsa
uuuuuuuuuuuccaccuccacuuuuuaaaagcaaaaaaaaaaaaaaguaugaugguggugaaua

SEQ ID NO: 29542 - RNA, 64 nt, hsa
uuuuuuuuuuuuccaccuccacuuuuuaaaagcaaaaaaaaaaaaaaguaugaugguggugaau

SEQ ID NO: 29543 - RNA, 64 nt, hsa
uuuuuuuuuuuuuccaccuccacuuuuuaaaagcaaaaaaaaaaaaaaguaugaugguggugaa

SEQ ID NO: 29544 - RNA, 64 nt, hsa
ucaaaggcccagcuccugcucaaaaaaaaaaaaaaaaaaaaauuaaaguuauuuguuugugggu

SEQ ID NO: 29545 - RNA, 64 nt, hsa
cucaaaggcccagcuccugcucaaaaaaaaaaaaaaaaaaaaauuaaaguuauuuguuuguggg

SEQ ID NO: 29546 - RNA, 64 nt, hsa
ccucaaaggcccagcuccugcucaaaaaaaaaaaaaaaaaaaaauuaaaguuauuuguuugugg

SEQ ID NO: 29547 - RNA, 64 nt, hsa
cccucaaaggcccagcuccugcucaaaaaaaaaaaaaaaaaaaaauuaaaguuauuuguuugug

SEQ ID NO: 29548 - RNA, 64 nt, hsa
gcccucaaaggcccagcuccugcucaaaaaaaaaaaaaaaaaaaaauuaaaguuauuuguuugu

SEQ ID NO: 29549 - RNA, 64 nt, hsa
ggcccucaaaggcccagcuccugcucaaaaaaaaaaaaaaaaaaaaauuaaaguuauuuguuug

SEQ ID NO: 29550 - RNA, 64 nt, hsa
gggcccucaaaggcccagcuccugcucaaaaaaaaaaaaaaaaaaaaauuaaaguuauuuguuu

SEQ ID NO: 29551 - RNA, 64 nt, hsa
ggggcccucaaaggcccagcuccugcucaaaaaaaaaaaaaaaaaaaaauuaaaguuauuuguu

SEQ ID NO: 29552 - RNA, 64 nt, hsa
aggggcccucaaaggcccagcuccugcucaaaaaaaaaaaaaaaaaaaaauuaaaguuauuugu

SEQ ID NO: 29553 - RNA, 64 nt, hsa
caggggcccucaaaggcccagcuccugcucaaaaaaaaaaaaaaaaaaaaauuaaaguuauuug

SEQ ID NO: 29554 - RNA, 64 nt, hsa
gcaggggcccucaaaggcccagcuccugcucaaaaaaaaaaaaaaaaaaaaauuaaaguuauuu

SEQ ID NO: 29555 - RNA, 64 nt, hsa
agcaggggcccucaaaggcccagcuccugcucaaaaaaaaaaaaaaaaaaaaauuaaaguuauu

SEQ ID NO: 29556 - RNA, 64 nt, hsa
gagcaggggcccucaaaggcccagcuccugcucaaaaaaaaaaaaaaaaaaaaauuaaaguuau

SEQ ID NO: 29557 - RNA, 64 nt, hsa
ggagcaggggcccucaaaggcccagcuccugcucaaaaaaaaaaaaaaaaaaaaauuaaaguua

SEQ ID NO: 29558 - RNA, 64 nt, hsa
gaugcacuuuuuuguguguucuuuaaauaaauccaaaaaaaaugugacuucccauuguuuuugg

SEQ ID NO: 29559 - RNA, 64 nt, hsa
agcauaugaggaauuaaagacauuguuuuuaaaaaaaaaaaaucauuuagaugcacuuuuuugu

SEQ ID NO: 29560 - RNA, 64 nt, hsa
cagcauaugaggaauuaaagacauuguuuuuaaaaaaaaaaaaucauuuagaugcacuuuuuug

SEQ ID NO: 29561 - RNA, 64 nt, hsa
ucagcauaugaggaauuaaagacauuguuuuuaaaaaaaaaaaaucauuuagaugcacuuuuuu

SEQ ID NO: 29562 - RNA, 64 nt, hsa
gucagcauaugaggaauuaaagacauuguuuuuaaaaaaaaaaaaucauuuagaugcacuuuuu

SEQ ID NO: 29563 - RNA, 64 nt, hsa
agucagcauaugaggaauuaaagacauuguuuuuaaaaaaaaaaaaucauuuagaugcacuuuu

SEQ ID NO: 29564 - RNA, 64 nt, hsa
cuuugaacuuucauagcacugcagaaaccuuuaaaaaaaaaaugcuucaugaauuucuccuuuc

SEQ ID NO: 29565 - RNA, 64 nt, hsa
ccuuugaacuuucauagcacugcagaaaccuuuaaaaaaaaaaugcuucaugaauuucuccuuu

SEQ ID NO: 29566 - RNA, 64 nt, hsa
accuuugaacuuucauagcacugcagaaaccuuuaaaaaaaaaaugcuucaugaauuucuccuu

SEQ ID NO: 29567 - RNA, 64 nt, hsa
ucccuucaaaucugccuuugaaucaucauuuuuaaaaaaaaauuaacauguuuuuguuguaguu

SEQ ID NO: 29568 - RNA, 64 nt, hsa
uucccuucaaaucugccuuugaaucaucauuuuuaaaaaaaaauuaacauguuuuuguuguagu

SEQ ID NO: 29569 - RNA, 64 nt, hsa
agccuggcgacagagcgagacgccgucucaaaaaaaaaaaaagaaaauugugcaaagcauaggu

SEQ ID NO: 29570 - RNA, 64 nt, hsa
cagccuggcgacagagcgagacgccgucucaaaaaaaaaaaaagaaaauugugcaaagcauagg

SEQ ID NO: 29571 - RNA, 64 nt, hsa
ccagccuggcgacagagcgagacgccgucucaaaaaaaaaaaaagaaaauugugcaaagcauag

SEQ ID NO: 29572 - RNA, 64 nt, hsa
uccagccuggcgacagagcgagacgccgucucaaaaaaaaaaaaagaaaauugugcaaagcaua

SEQ ID NO: 29573 - RNA, 64 nt, hsa
cuccagccuggcgacagagcgagacgccgucucaaaaaaaaaaaaagaaaauugugcaaagcau

SEQ ID NO: 29574 - RNA, 64 nt, hsa
acuccagccuggcgacagagcgagacgccgucucaaaaaaaaaaaaagaaaauugugcaaagca

SEQ ID NO: 29575 - RNA, 64 nt, hsa
uguuuuaaaaguggucauuuuauucagguuuagaaaaaaaaauccuauuucuuuuccuuuuauu

SEQ ID NO: 29576 - RNA, 64 nt, hsa
cuguuuuaaaaguggucauuuuauucagguuuagaaaaaaaaauccuauuucuuuuccuuuuau

SEQ ID NO: 29577 - RNA, 64 nt, hsa
cucgauccuugaaaagaacuguguggagccuggaaaaaaaaauuaggaccacaugugagauguu

SEQ ID NO: 29578 - RNA, 64 nt, hsa
acucgauccuugaaaagaacuguguggagccuggaaaaaaaaauuaggaccacaugugagaugu

SEQ ID NO: 29579 - RNA, 64 nt, hsa
uaaguauguacauacaguuucacuucaaaaauaaaaaaaaaaucccuaaaaacucucuauacuc

SEQ ID NO: 29580 - RNA, 64 nt, hsa
auaaguauguacauacaguuucacuucaaaaauaaaaaaaaaaucccuaaaaacucucuauacu

SEQ ID NO: 29581 - RNA, 64 nt, hsa
uauaaguauguacauacaguuucacuucaaaaauaaaaaaaaaaucccuaaaaacucucuauac

SEQ ID NO: 29582 - RNA, 64 nt, hsa
cauaguuaagcuacuccucuuucuccuaaaaaaaaaaaaaaaugagagaauuagggaaacacca

SEQ ID NO: 29583 - RNA, 64 nt, hsa
ccauaguuaagcuacuccucuuucuccuaaaaaaaaaaaaaaaugagagaauuagggaaacacc

SEQ ID NO: 29584 - RNA, 64 nt, hsa
cccauaguuaagcuacuccucuuucuccuaaaaaaaaaaaaaaaugagagaauuagggaaacac

SEQ ID NO: 29585 - RNA, 64 nt, hsa
acccauaguuaagcuacuccucuuucuccuaaaaaaaaaaaaaaaugagagaauuagggaaaca

SEQ ID NO: 29586 - RNA, 64 nt, hsa
aacccauaguuaagcuacuccucuuucuccuaaaaaaaaaaaaaaaugagagaauuagggaaac

SEQ ID NO: 29587 - RNA, 64 nt, hsa
caacccauaguuaagcuacuccucuuucuccuaaaaaaaaaaaaaaaugagagaauuagggaaa

SEQ ID NO: 29588 - RNA, 64 nt, hsa
ucaacccauaguuaagcuacuccucuuucuccuaaaaaaaaaaaaaaaugagagaauuagggaa

SEQ ID NO: 29589 - RNA, 64 nt, hsa
cucaacccauaguuaagcuacuccucuuucuccuaaaaaaaaaaaaaaaugagagaauuaggga

SEQ ID NO: 29590 - RNA, 64 nt, hsa
gcuugggcaccaacagaauuaaaaacgaaaaacaaaaaaaaacucgaaugacuuaggcagaaca

SEQ ID NO: 29591 - RNA, 64 nt, hsa
ugcuugggcaccaacagaauuaaaaacgaaaaacaaaaaaaaacucgaaugacuuaggcagaac

SEQ ID NO: 29592 - RNA, 64 nt, hsa
ggguuuauuuuauguaaaaaaaaaaaaaaaaacaaaaaaaaacccugagaccaugaguggggcu

SEQ ID NO: 29593 - RNA, 64 nt, hsa
aggguuuauuuuauguaaaaaaaaaaaaaaaaacaaaaaaaaacccugagaccaugaguggggc

SEQ ID NO: 29594 - RNA, 64 nt, hsa
ggugugcuaaggguuuauuuuauguaaaaaaaaaaaaaaaaacaaaaaaaaacccugagaccau

SEQ ID NO: 29595 - RNA, 64 nt, hsa
gggugugcuaaggguuuauuuuauguaaaaaaaaaaaaaaaaacaaaaaaaaacccugagacca

SEQ ID NO: 29596 - RNA, 64 nt, hsa
cgggugugcuaaggguuuauuuuauguaaaaaaaaaaaaaaaaacaaaaaaaaacccugagacc

SEQ ID NO: 29597 - RNA, 64 nt, hsa
acgggugugcuaaggguuuauuuuauguaaaaaaaaaaaaaaaaacaaaaaaaaacccugagac

SEQ ID NO: 29598 - RNA, 64 nt, hsa
gacgggugugcuaaggguuuauuuuauguaaaaaaaaaaaaaaaaacaaaaaaaaacccugaga

SEQ ID NO: 29599 - RNA, 64 nt, hsa
ggacgggugugcuaaggguuuauuuuauguaaaaaaaaaaaaaaaaacaaaaaaaaacccugag

SEQ ID NO: 29600 - RNA, 64 nt, hsa
uggacgggugugcuaaggguuuauuuuauguaaaaaaaaaaaaaaaaacaaaaaaaaacccuga

SEQ ID NO: 29601 - RNA, 64 nt, hsa
guggacgggugugcuaaggguuuauuuuauguaaaaaaaaaaaaaaaaacaaaaaaaaacccug

SEQ ID NO: 29602 - RNA, 64 nt, hsa
aguggacgggugugcuaaggguuuauuuuauguaaaaaaaaaaaaaaaaacaaaaaaaaacccu

SEQ ID NO: 29603 - RNA, 64 nt, hsa
caguggacgggugugcuaaggguuuauuuuauguaaaaaaaaaaaaaaaaacaaaaaaaaaccc

SEQ ID NO: 29604 - RNA, 64 nt, hsa
guucaguguuuuaaccuguauuuguuaaaaaagaaaaaaaaacacacauaaaguuccaugugua

SEQ ID NO: 29605 - RNA, 64 nt, hsa
uguucaguguuuuaaccuguauuuguuaaaaaagaaaaaaaaacacacauaaaguuccaugugu

SEQ ID NO: 29606 - RNA, 64 nt, hsa
uuggagggaagacagcagagucaucaguuaaaaaaaaaaaaagaaaaccaaacaccucccuuga

SEQ ID NO: 29607 - RNA, 64 nt, hsa
cuuggagggaagacagcagagucaucaguuaaaaaaaaaaaaagaaaaccaaacaccucccuug

SEQ ID NO: 29608 - RNA, 64 nt, hsa
ccuuggagggaagacagcagagucaucaguuaaaaaaaaaaaaagaaaaccaaacaccucccuu

SEQ ID NO: 29609 - RNA, 64 nt, hsa
cccuuggagggaagacagcagagucaucaguuaaaaaaaaaaaaagaaaaccaaacaccucccu

SEQ ID NO: 29610 - RNA, 64 nt, hsa
ucccuuggagggaagacagcagagucaucaguuaaaaaaaaaaaaagaaaaccaaacaccuccc

SEQ ID NO: 29611 - RNA, 64 nt, hsa
uucccuuggagggaagacagcagagucaucaguuaaaaaaaaaaaaagaaaaccaaacaccucc

SEQ ID NO: 29612 - RNA, 64 nt, hsa
gccugggcgauggagcgagacuccaacucaaaaaaaaaaaaagaauaaagaaagaaaagugcga

SEQ ID NO: 29613 - RNA, 64 nt, hsa
agccugggcgauggagcgagacuccaacucaaaaaaaaaaaaagaauaaagaaagaaaagugcg

SEQ ID NO: 29614 - RNA, 64 nt, hsa
cagccugggcgauggagcgagacuccaacucaaaaaaaaaaaaagaauaaagaaagaaaagugc

SEQ ID NO: 29615 - RNA, 64 nt, hsa
ccagccugggcgauggagcgagacuccaacucaaaaaaaaaaaaagaauaaagaaagaaaagug

SEQ ID NO: 29616 - RNA, 64 nt, hsa
uccagccugggcgauggagcgagacuccaacucaaaaaaaaaaaaagaauaaagaaagaaaagu

SEQ ID NO: 29617 - RNA, 64 nt, hsa
cuccagccugggcgauggagcgagacuccaacucaaaaaaaaaaaaagaauaaagaaagaaaag

SEQ ID NO: 29618 - RNA, 64 nt, hsa
aagguuccauaguaucuuuuacaaaauggauuaaaaaaaaaaugccuaugcaacuucaaauagu

SEQ ID NO: 29619 - RNA, 64 nt, hsa
caagguuccauaguaucuuuuacaaaauggauuaaaaaaaaaaugccuaugcaacuucaaauag

SEQ ID NO: 29620 - RNA, 64 nt, hsa
ucaagguuccauaguaucuuuuacaaaauggauuaaaaaaaaaaugccuaugcaacuucaaaua

SEQ ID NO: 29621 - RNA, 64 nt, hsa
cuguauaaugaaaaaguauuuaaggauaugguuaaaaaaaaaucccaggacccacccauguuuu

SEQ ID NO: 29622 - RNA, 64 nt, hsa
acuguauaaugaaaaaguauuuaaggauaugguuaaaaaaaaaucccaggacccacccauguuu

SEQ ID NO: 29623 - RNA, 64 nt, hsa
ugagauaucaagguaauuaaaauagcaugcuugaaaaaaaaauacguaaucuguuucaccugua

SEQ ID NO: 29624 - RNA, 64 nt, hsa
augagauaucaagguaauuaaaauagcaugcuugaaaaaaaaauacguaaucuguuucaccugu

SEQ ID NO: 29625 - RNA, 64 nt, hsa
gauugggacacauaccauugauuuguuguuaaaaaaaaaaaauuccugcaacccucuugaucuu

SEQ ID NO: 29626 - RNA, 64 nt, hsa
agauugggacacauaccauugauuuguuguuaaaaaaaaaaaauuccugcaacccucuugaucu

SEQ ID NO: 29627 - RNA, 64 nt, hsa
gagauugggacacauaccauugauuuguuguuaaaaaaaaaaaauuccugcaacccucuugauc

SEQ ID NO: 29628 - RNA, 64 nt, hsa
ggagauugggacacauaccauugauuuguuguuaaaaaaaaaaaauuccugcaacccucuugau

SEQ ID NO: 29629 - RNA, 64 nt, hsa
aggagauugggacacauaccauugauuuguuguuaaaaaaaaaaaauuccugcaacccucuuga

SEQ ID NO: 29630 - RNA, 64 nt, hsa
uucuggaacaaaacaguuagaaaaacuuuaaaaaaaaaaaaaccgacaaaguuacgaggccauc

SEQ ID NO: 29631 - RNA, 64 nt, hsa
auucuggaacaaaacaguuagaaaaacuuuaaaaaaaaaaaaaccgacaaaguuacgaggccau

SEQ ID NO: 29632 - RNA, 64 nt, hsa
gauucuggaacaaaacaguuagaaaaacuuuaaaaaaaaaaaaaccgacaaaguuacgaggcca

SEQ ID NO: 29633 - RNA, 64 nt, hsa
ugauucuggaacaaaacaguuagaaaaacuuuaaaaaaaaaaaaaccgacaaaguuacgaggcc

SEQ ID NO: 29634 - RNA, 64 nt, hsa
cugauucuggaacaaaacaguuagaaaaacuuuaaaaaaaaaaaaaccgacaaaguuacgaggc

SEQ ID NO: 29635 - RNA, 64 nt, hsa
acugauucuggaacaaaacaguuagaaaaacuuuaaaaaaaaaaaaaccgacaaaguuacgagg

SEQ ID NO: 29636 - RNA, 64 nt, hsa
guucaugcaguaggauaaaaaaaaaaaaaaaaaaaaaaaaaaggcuuuucuuuuuaaacaguuc

SEQ ID NO: 29637 - RNA, 64 nt, hsa
aguucaugcaguaggauaaaaaaaaaaaaaaaaaaaaaaaaaaggcuuuucuuuuuaaacaguu

SEQ ID NO: 29638 - RNA, 64 nt, hsa
caguucaugcaguaggauaaaaaaaaaaaaaaaaaaaaaaaaaaggcuuuucuuuuuaaacagu

SEQ ID NO: 29639 - RNA, 64 nt, hsa
ucaguucaugcaguaggauaaaaaaaaaaaaaaaaaaaaaaaaaaggcuuuucuuuuuaaacag

SEQ ID NO: 29640 - RNA, 64 nt, hsa
gucaguucaugcaguaggauaaaaaaaaaaaaaaaaaaaaaaaaaaggcuuuucuuuuuaaaca

SEQ ID NO: 29641 - RNA, 64 nt, hsa
ugucaguucaugcaguaggauaaaaaaaaaaaaaaaaaaaaaaaaaaggcuuuucuuuuuaaac

SEQ ID NO: 29642 - RNA, 64 nt, hsa
uugucaguucaugcaguaggauaaaaaaaaaaaaaaaaaaaaaaaaaaggcuuuucuuuuuaaa

SEQ ID NO: 29643 - RNA, 64 nt, hsa
uuugucaguucaugcaguaggauaaaaaaaaaaaaaaaaaaaaaaaaaaggcuuuucuuuuuaa

SEQ ID NO: 29644 - RNA, 64 nt, hsa
auuugucaguucaugcaguaggauaaaaaaaaaaaaaaaaaaaaaaaaaaggcuuuucuuuuua

SEQ ID NO: 29645 - RNA, 64 nt, hsa
aauuugucaguucaugcaguaggauaaaaaaaaaaaaaaaaaaaaaaaaaaggcuuuucuuuuu

SEQ ID NO: 29646 - RNA, 64 nt, hsa
aaauuugucaguucaugcaguaggauaaaaaaaaaaaaaaaaaaaaaaaaaaggcuuuucuuuu

SEQ ID NO: 29647 - RNA, 64 nt, hsa
gaaauuugucaguucaugcaguaggauaaaaaaaaaaaaaaaaaaaaaaaaaaggcuuuucuuu

SEQ ID NO: 29648 - RNA, 64 nt, hsa
agaaauuugucaguucaugcaguaggauaaaaaaaaaaaaaaaaaaaaaaaaaaggcuuuucuu

SEQ ID NO: 29649 - RNA, 64 nt, hsa
cagaaauuugucaguucaugcaguaggauaaaaaaaaaaaaaaaaaaaaaaaaaaggcuuuucu

SEQ ID NO: 29650 - RNA, 64 nt, hsa
ccagaaauuugucaguucaugcaguaggauaaaaaaaaaaaaaaaaaaaaaaaaaaggcuuuuc

SEQ ID NO: 29651 - RNA, 64 nt, hsa
gccagaaauuugucaguucaugcaguaggauaaaaaaaaaaaaaaaaaaaaaaaaaaggcuuuu

SEQ ID NO: 29652 - RNA, 64 nt, hsa
ugccagaaauuugucaguucaugcaguaggauaaaaaaaaaaaaaaaaaaaaaaaaaaggcuuu

SEQ ID NO: 29653 - RNA, 64 nt, hsa
augccagaaauuugucaguucaugcaguaggauaaaaaaaaaaaaaaaaaaaaaaaaaaggcuu

SEQ ID NO: 29654 - RNA, 64 nt, hsa
aaugccagaaauuugucaguucaugcaguaggauaaaaaaaaaaaaaaaaaaaaaaaaaaggcu

SEQ ID NO: 29655 - RNA, 64 nt, hsa
cacugagcaauaaaguaucguggcauuuaugcaaaaaaaaaaguuaauuuuuuacaccuucaug

SEQ ID NO: 29656 - RNA, 64 nt, hsa
acacugagcaauaaaguaucguggcauuuaugcaaaaaaaaaaguuaauuuuuuacaccuucau

SEQ ID NO: 29657 - RNA, 64 nt, hsa
aacacugagcaauaaaguaucguggcauuuaugcaaaaaaaaaaguuaauuuuuuacaccuuca

SEQ ID NO: 29658 - RNA, 64 nt, hsa
gauucaaaaguugaccugaaagucaagugugaaaaaaaaaaagagauuaaacaagauaauuaug

SEQ ID NO: 29659 - RNA, 64 nt, hsa
agauucaaaaguugaccugaaagucaagugugaaaaaaaaaaagagauuaaacaagauaauuau

SEQ ID NO: 29660 - RNA, 64 nt, hsa
gagauucaaaaguugaccugaaagucaagugugaaaaaaaaaaagagauuaaacaagauaauua

SEQ ID NO: 29661 - RNA, 64 nt, hsa
ugagauucaaaaguugaccugaaagucaagugugaaaaaaaaaaagagauuaaacaagauaauu

SEQ ID NO: 29662 - RNA, 64 nt, hsa
gcgacagagccagaccuugucucaaaaaaaaaaaaaaaaaaagaaaaaagaaaguacugucugu

SEQ ID NO: 29663 - RNA, 64 nt, hsa
ggcgacagagccagaccuugucucaaaaaaaaaaaaaaaaaaagaaaaaagaaaguacugucug

SEQ ID NO: 29664 - RNA, 64 nt, hsa
gggcgacagagccagaccuugucucaaaaaaaaaaaaaaaaaaagaaaaaagaaaguacugucu

SEQ ID NO: 29665 - RNA, 64 nt, hsa
ugggcgacagagccagaccuugucucaaaaaaaaaaaaaaaaaaagaaaaaagaaaguacuguc

SEQ ID NO: 29666 - RNA, 64 nt, hsa
cugggcgacagagccagaccuugucucaaaaaaaaaaaaaaaaaaagaaaaaagaaaguacugu

SEQ ID NO: 29667 - RNA, 64 nt, hsa
ccugggcgacagagccagaccuugucucaaaaaaaaaaaaaaaaaaagaaaaaagaaaguacug

SEQ ID NO: 29668 - RNA, 64 nt, hsa
accugggcgacagagccagaccuugucucaaaaaaaaaaaaaaaaaaagaaaaaagaaaguacu

SEQ ID NO: 29669 - RNA, 64 nt, hsa
aaccugggcgacagagccagaccuugucucaaaaaaaaaaaaaaaaaaagaaaaaagaaaguac

SEQ ID NO: 29670 - RNA, 64 nt, hsa
caaccugggcgacagagccagaccuugucucaaaaaaaaaaaaaaaaaaagaaaaaagaaagua

SEQ ID NO: 29671 - RNA, 64 nt, hsa
ccaaccugggcgacagagccagaccuugucucaaaaaaaaaaaaaaaaaaagaaaaaagaaagu

SEQ ID NO: 29672 - RNA, 64 nt, hsa
uccaaccugggcgacagagccagaccuugucucaaaaaaaaaaaaaaaaaaagaaaaaagaaag

SEQ ID NO: 29673 - RNA, 64 nt, hsa
uuccaaccugggcgacagagccagaccuugucucaaaaaaaaaaaaaaaaaaagaaaaaagaaa

SEQ ID NO: 29674 - RNA, 64 nt, hsa
ucaagccuggcgacagagcgagacuccgucucaaaaaaaaaaguuaaaugacuugaguacccaa

SEQ ID NO: 29675 - RNA, 64 nt, hsa
cucaagccuggcgacagagcgagacuccgucucaaaaaaaaaaguuaaaugacuugaguaccca

SEQ ID NO: 29676 - RNA, 64 nt, hsa
acucaagccuggcgacagagcgagacuccgucucaaaaaaaaaaguuaaaugacuugaguaccc

SEQ ID NO: 29677 - RNA, 64 nt, hsa
auuuuaacucugucuucaccugauucaacuaaaaaaaaaaaaguauuauuuuccaaaaguggcc

SEQ ID NO: 29678 - RNA, 64 nt, hsa
gauuuuaacucugucuucaccugauucaacuaaaaaaaaaaaaguauuauuuuccaaaaguggc

SEQ ID NO: 29679 - RNA, 64 nt, hsa
ugauuuuaacucugucuucaccugauucaacuaaaaaaaaaaaaguauuauuuuccaaaagugg

SEQ ID NO: 29680 - RNA, 64 nt, hsa
gugauuuuaacucugucuucaccugauucaacuaaaaaaaaaaaaguauuauuuuccaaaagug

SEQ ID NO: 29681 - RNA, 64 nt, hsa
ugugauuuuaacucugucuucaccugauucaacuaaaaaaaaaaaaguauuauuuuccaaaagu

SEQ ID NO: 29682 - RNA, 64 nt, hsa
acaacaaaaaacaaacaacaaaaaaaaaauuaaaaaaaaaaacagaaauagagcucuaaguuau

SEQ ID NO: 29683 - RNA, 64 nt, hsa
aacaacaaaaaacaaacaacaaaaaaaaaauuaaaaaaaaaaacagaaauagagcucuaaguua

SEQ ID NO: 29684 - RNA, 64 nt, hsa
aaacaacaaaaaacaaacaacaaaaaaaaaauuaaaaaaaaaaacagaaauagagcucuaaguu

SEQ ID NO: 29685 - RNA, 64 nt, hsa
caaacaacaaaaaacaaacaacaaaaaaaaaauuaaaaaaaaaaacagaaauagagcucuaagu

SEQ ID NO: 29686 - RNA, 64 nt, hsa
auguuaaaaacaaacaacaaaaaacaaacaacaaaaaaaaaauuaaaaaaaaaaacagaaauag

SEQ ID NO: 29687 - RNA, 64 nt, hsa
uauguuaaaaacaaacaacaaaaaacaaacaacaaaaaaaaaauuaaaaaaaaaaacagaaaua

SEQ ID NO: 29688 - RNA, 64 nt, hsa
cuauguuaaaaacaaacaacaaaaaacaaacaacaaaaaaaaaauuaaaaaaaaaaacagaaau

SEQ ID NO: 29689 - RNA, 64 nt, hsa
uuauguugacuaaaauuauaguuagagcugagaaaaaaaaaauagcaucuaguccaacuccuug

SEQ ID NO: 29690 - RNA, 64 nt, hsa
cuuauguugacuaaaauuauaguuagagcugagaaaaaaaaaauagcaucuaguccaacuccuu

SEQ ID NO: 29691 - RNA, 64 nt, hsa
ucuuauguugacuaaaauuauaguuagagcugagaaaaaaaaaauagcaucuaguccaacuccu

SEQ ID NO: 29692 - RNA, 64 nt, hsa
ugaucucuuuuucugagcaggauaucagguuaaaaaaaaaaaguuacuggcugguuuaauacuu

SEQ ID NO: 29693 - RNA, 64 nt, hsa
gugaucucuuuuucugagcaggauaucagguuaaaaaaaaaaaguuacuggcugguuuaauacu

SEQ ID NO: 29694 - RNA, 64 nt, hsa
agugaucucuuuuucugagcaggauaucagguuaaaaaaaaaaaguuacuggcugguuuaauac

SEQ ID NO: 29695 - RNA, 64 nt, hsa
aagugaucucuuuuucugagcaggauaucagguuaaaaaaaaaaaguuacuggcugguuuaaua

SEQ ID NO: 29696 - RNA, 64 nt, hsa
cagccugggggauacagugagaccuugucuuuaaaaaaaaaaugcugcaaaaccaaaaauaaau

SEQ ID NO: 29697 - RNA, 64 nt, hsa
ucagccugggggauacagugagaccuugucuuuaaaaaaaaaaugcugcaaaaccaaaaauaaa

SEQ ID NO: 29698 - RNA, 64 nt, hsa
uucagccugggggauacagugagaccuugucuuuaaaaaaaaaaugcugcaaaaccaaaaauaa

SEQ ID NO: 29699 - RNA, 64 nt, hsa
uaacacuugagcaaaugcuuaagaaggaauuaaaaaaaaaaagcuuugccaauagcuaaaaagu

SEQ ID NO: 29700 - RNA, 64 nt, hsa
uuaacacuugagcaaaugcuuaagaaggaauuaaaaaaaaaaagcuuugccaauagcuaaaaag

SEQ ID NO: 29701 - RNA, 64 nt, hsa
uuuaacacuugagcaaaugcuuaagaaggaauuaaaaaaaaaaagcuuugccaauagcuaaaaa

SEQ ID NO: 29702 - RNA, 64 nt, hsa
guuuaacacuugagcaaaugcuuaagaaggaauuaaaaaaaaaaagcuuugccaauagcuaaaa

SEQ ID NO: 29703 - RNA, 64 nt, hsa
uuaaauccaguauuuguuuacucauguuaaaaaaaaaaaaaacagacaaaacacacugaaauuu

SEQ ID NO: 29704 - RNA, 64 nt, hsa
uuuaaauccaguauuuguuuacucauguuaaaaaaaaaaaaaacagacaaaacacacugaaauu

SEQ ID NO: 29705 - RNA, 64 nt, hsa
cuuuaaauccaguauuuguuuacucauguuaaaaaaaaaaaaaacagacaaaacacacugaaau

SEQ ID NO: 29706 - RNA, 64 nt, hsa
acuuuaaauccaguauuuguuuacucauguuaaaaaaaaaaaaaacagacaaaacacacugaaa

SEQ ID NO: 29707 - RNA, 64 nt, hsa
cacuuuaaauccaguauuuguuuacucauguuaaaaaaaaaaaaaacagacaaaacacacugaa

SEQ ID NO: 29708 - RNA, 64 nt, hsa
gcacuuuaaauccaguauuuguuuacucauguuaaaaaaaaaaaaaacagacaaaacacacuga

SEQ ID NO: 29709 - RNA, 64 nt, hsa
ugcacuuuaaauccaguauuuguuuacucauguuaaaaaaaaaaaaaacagacaaaacacacug

SEQ ID NO: 29710 - RNA, 64 nt, hsa
aaaacauugauuugagcauagacgcagagacugaaaaaaaaauuuacuuugaucucuguuuuug

SEQ ID NO: 29711 - RNA, 64 nt, hsa
gaaaacauugauuugagcauagacgcagagacugaaaaaaaaauuuacuuugaucucuguuuuu

SEQ ID NO: 29712 - RNA, 64 nt, hsa
guuguuaaugaccaaacauucuaaaagaaaugcaaaaaaaaaguuuauuuucaagccuucgaac

SEQ ID NO: 29713 - RNA, 64 nt, hsa
aguuguuaaugaccaaacauucuaaaagaaaugcaaaaaaaaaguuuauuuucaagccuucgaa

SEQ ID NO: 29714 - RNA, 64 nt, hsa
uaaacugguugucaguuacaucugacagaaaaaaaaaaaaaaucacuguguaaccagguuaagu

SEQ ID NO: 29715 - RNA, 64 nt, hsa
cuaaacugguugucaguuacaucugacagaaaaaaaaaaaaaaucacuguguaaccagguuaag

SEQ ID NO: 29716 - RNA, 64 nt, hsa
acuaaacugguugucaguuacaucugacagaaaaaaaaaaaaaaucacuguguaaccagguuaa

SEQ ID NO: 29717 - RNA, 64 nt, hsa
gacuaaacugguugucaguuacaucugacagaaaaaaaaaaaaaaucacuguguaaccagguua

SEQ ID NO: 29718 - RNA, 64 nt, hsa
agacuaaacugguugucaguuacaucugacagaaaaaaaaaaaaaaucacuguguaaccagguu

SEQ ID NO: 29719 - RNA, 64 nt, hsa
aagacuaaacugguugucaguuacaucugacagaaaaaaaaaaaaaaucacuguguaaccaggu

SEQ ID NO: 29720 - RNA, 64 nt, hsa
aaagacuaaacugguugucaguuacaucugacagaaaaaaaaaaaaaaucacuguguaaccagg

SEQ ID NO: 29721 - RNA, 64 nt, hsa
acauggcgaaaccccgucuccacuaaaaaugcaaaaaaaaaauuaaccgggcgugguggcaggc

SEQ ID NO: 29722 - RNA, 64 nt, hsa
aacauggcgaaaccccgucuccacuaaaaaugcaaaaaaaaaauuaaccgggcgugguggcagg

SEQ ID NO: 29723 - RNA, 64 nt, hsa
caacauggcgaaaccccgucuccacuaaaaaugcaaaaaaaaaauuaaccgggcgugguggcag

SEQ ID NO: 29724 - RNA, 64 nt, hsa
gcuuuaugugaaaaaaguugaauguuauaguaaaaaaaaaaagauauuuauguauguacaguuu

SEQ ID NO: 29725 - RNA, 64 nt, hsa
ggcuuuaugugaaaaaaguugaauguuauaguaaaaaaaaaaagauauuuauguauguacaguu

SEQ ID NO: 29726 - RNA, 64 nt, hsa
aggcuuuaugugaaaaaaguugaauguuauaguaaaaaaaaaaagauauuuauguauguacagu

SEQ ID NO: 29727 - RNA, 64 nt, hsa
aaggcuuuaugugaaaaaaguugaauguuauaguaaaaaaaaaaagauauuuauguauguacag

SEQ ID NO: 29728 - RNA, 64 nt, hsa
aaaaaaggaaaaguagauagugauacugaggguaaaaaaaaauugauucaauuuuaugguaaag

SEQ ID NO: 29729 - RNA, 64 nt, hsa
gaaaaaaggaaaaguagauagugauacugaggguaaaaaaaaauugauucaauuuuaugguaaa

SEQ ID NO: 29730 - RNA, 64 nt, hsa
ugaauguuaguuagaaaauguuagguuuuaacuuaaaaaaaauuguauugugauuuucaauuuu

SEQ ID NO: 29731 - RNA, 64 nt, hsa
cuuuaggugagaugacuaaauuaugccuccaagaaaaaaaaauuaaagugcuuuucugggucau

SEQ ID NO: 29732 - RNA, 64 nt, hsa
gcuuuaggugagaugacuaaauuaugccuccaagaaaaaaaaauuaaagugcuuuucuggguca

SEQ ID NO: 29733 - RNA, 64 nt, hsa
ccccuccaucucgauucucguacccaacuaaaaaaaaaaaaauaaagaaaaaaugugcugcguu

SEQ ID NO: 29734 - RNA, 64 nt, hsa
cccccuccaucucgauucucguacccaacuaaaaaaaaaaaaauaaagaaaaaaugugcugcgu

SEQ ID NO: 29735 - RNA, 64 nt, hsa
ucccccuccaucucgauucucguacccaacuaaaaaaaaaaaaauaaagaaaaaaugugcugcg

SEQ ID NO: 29736 - RNA, 64 nt, hsa
uucccccuccaucucgauucucguacccaacuaaaaaaaaaaaaauaaagaaaaaaugugcugc

SEQ ID NO: 29737 - RNA, 64 nt, hsa
guucccccuccaucucgauucucguacccaacuaaaaaaaaaaaaauaaagaaaaaaugugcug

SEQ ID NO: 29738 - RNA, 64 nt, hsa
uguucccccuccaucucgauucucguacccaacuaaaaaaaaaaaaauaaagaaaaaaugugcu

SEQ ID NO: 29739 - RNA, 64 nt, hsa
cugagucgggggagaggauggcagagacuuuauuaaaaaaaaaaaaagauuguagugguagucu

SEQ ID NO: 29740 - RNA, 64 nt, hsa
ugagucgggggagaggauggcagagacuuuauuaaaaaaaaaaaaagauuguagugguagucua

SEQ ID NO: 29741 - RNA, 64 nt, hsa
gagucgggggagaggauggcagagacuuuauuaaaaaaaaaaaaagauuguagugguagucuaa

SEQ ID NO: 29742 - RNA, 64 nt, hsa
agucgggggagaggauggcagagacuuuauuaaaaaaaaaaaaagauuguagugguagucuaac

SEQ ID NO: 29743 - RNA, 64 nt, hsa
gucgggggagaggauggcagagacuuuauuaaaaaaaaaaaaagauuguagugguagucuaacu

SEQ ID NO: 29744 - RNA, 64 nt, hsa
ucgggggagaggauggcagagacuuuauuaaaaaaaaaaaaagauuguagugguagucuaacuc

SEQ ID NO: 29745 - RNA, 64 nt, hsa
guccugucccuuggaaccuuuguacgcuuugcucaaaaaaaaacaaaaaaaaaaaacaaaaaaa

SEQ ID NO: 29746 - RNA, 64 nt, hsa
uccugucccuuggaaccuuuguacgcuuugcucaaaaaaaaacaaaaaaaaaaaacaaaaaaaa

SEQ ID NO: 29747 - RNA, 64 nt, hsa
uuggaaccuuuguacgcuuugcucaaaaaaaaacaaaaaaaaaaaacaaaaaaaaaaaacaacg

SEQ ID NO: 29748 - RNA, 64 nt, hsa
uggaaccuuuguacgcuuugcucaaaaaaaaacaaaaaaaaaaaacaaaaaaaaaaaacaacgg

SEQ ID NO: 29749 - RNA, 64 nt, hsa
ggaaccuuuguacgcuuugcucaaaaaaaaacaaaaaaaaaaaacaaaaaaaaaaaacaacggu

SEQ ID NO: 29750 - RNA, 64 nt, hsa
gaaccuuuguacgcuuugcucaaaaaaaaacaaaaaaaaaaaacaaaaaaaaaaaacaacggug

SEQ ID NO: 29751 - RNA, 64 nt, hsa
aaccuuuguacgcuuugcucaaaaaaaaacaaaaaaaaaaaacaaaaaaaaaaaacaacggugg

SEQ ID NO: 29752 - RNA, 64 nt, hsa
acgcuuugcucaaaaaaaaacaaaaaaaaaaaacaaaaaaaaaaaacaacgguggagccuucgc

SEQ ID NO: 29753 - RNA, 64 nt, hsa
cgcuuugcucaaaaaaaaacaaaaaaaaaaaacaaaaaaaaaaaacaacgguggagccuucgca

SEQ ID NO: 29754 - RNA, 64 nt, hsa
gcuuugcucaaaaaaaaacaaaaaaaaaaaacaaaaaaaaaaaacaacgguggagccuucgcac

SEQ ID NO: 29755 - RNA, 64 nt, hsa
cuuugcucaaaaaaaaacaaaaaaaaaaaacaaaaaaaaaaaacaacgguggagccuucgcacu

SEQ ID NO: 29756 - RNA, 64 nt, hsa
uuugcucaaaaaaaaacaaaaaaaaaaaacaaaaaaaaaaaacaacgguggagccuucgcacuc

SEQ ID NO: 29757 - RNA, 64 nt, hsa
uguuuguuucuaacuucuguaauacauacaaugcaaaaaaaaaaaaaaaaaaauggccacaaca

SEQ ID NO: 29758 - RNA, 64 nt, hsa
guuuguuucuaacuucuguaauacauacaaugcaaaaaaaaaaaaaaaaaaauggccacaacag

SEQ ID NO: 29759 - RNA, 64 nt, hsa
uuuguuucuaacuucuguaauacauacaaugcaaaaaaaaaaaaaaaaaaauggccacaacagu

SEQ ID NO: 29760 - RNA, 64 nt, hsa
uuguuucuaacuucuguaauacauacaaugcaaaaaaaaaaaaaaaaaaauggccacaacaguu

SEQ ID NO: 29761 - RNA, 64 nt, hsa
uguuucuaacuucuguaauacauacaaugcaaaaaaaaaaaaaaaaaaauggccacaacaguug

SEQ ID NO: 29762 - RNA, 64 nt, hsa
guuucuaacuucuguaauacauacaaugcaaaaaaaaaaaaaaaaaaauggccacaacaguugc

SEQ ID NO: 29763 - RNA, 64 nt, hsa
uuucuaacuucuguaauacauacaaugcaaaaaaaaaaaaaaaaaaauggccacaacaguugca

SEQ ID NO: 29764 - RNA, 64 nt, hsa
uucuaacuucuguaauacauacaaugcaaaaaaaaaaaaaaaaaaauggccacaacaguugcac

SEQ ID NO: 29765 - RNA, 64 nt, hsa
ucuaacuucuguaauacauacaaugcaaaaaaaaaaaaaaaaaaauggccacaacaguugcaca

SEQ ID NO: 29766 - RNA, 64 nt, hsa
cuaacuucuguaauacauacaaugcaaaaaaaaaaaaaaaaaaauggccacaacaguugcacag

SEQ ID NO: 29767 - RNA, 64 nt, hsa
uaacuucuguaauacauacaaugcaaaaaaaaaaaaaaaaaaauggccacaacaguugcacagu

SEQ ID NO: 29768 - RNA, 64 nt, hsa
aacuucuguaauacauacaaugcaaaaaaaaaaaaaaaaaaauggccacaacaguugcacagug

SEQ ID NO: 29769 - RNA, 64 nt, hsa
cacacuccagccugggcaacagagacucugucucaaaaaaaaaaaaaaaaaaaauuaaccucaa

SEQ ID NO: 29770 - RNA, 64 nt, hsa
acacuccagccugggcaacagagacucugucucaaaaaaaaaaaaaaaaaaaauuaaccucaac

SEQ ID NO: 29771 - RNA, 64 nt, hsa
cacuccagccugggcaacagagacucugucucaaaaaaaaaaaaaaaaaaaauuaaccucaacc

SEQ ID NO: 29772 - RNA, 64 nt, hsa
acuccagccugggcaacagagacucugucucaaaaaaaaaaaaaaaaaaaauuaaccucaacca

SEQ ID NO: 29773 - RNA, 64 nt, hsa
cuccagccugggcaacagagacucugucucaaaaaaaaaaaaaaaaaaaauuaaccucaaccaa

SEQ ID NO: 29774 - RNA, 64 nt, hsa
uccagccugggcaacagagacucugucucaaaaaaaaaaaaaaaaaaaauuaaccucaaccaaa

SEQ ID NO: 29775 - RNA, 64 nt, hsa
ccagccugggcaacagagacucugucucaaaaaaaaaaaaaaaaaaaauuaaccucaaccaaac

SEQ ID NO: 29776 - RNA, 64 nt, hsa
cagccugggcaacagagacucugucucaaaaaaaaaaaaaaaaaaaauuaaccucaaccaaacg

SEQ ID NO: 29777 - RNA, 64 nt, hsa
agccugggcaacagagacucugucucaaaaaaaaaaaaaaaaaaaauuaaccucaaccaaacgc

SEQ ID NO: 29778 - RNA, 64 nt, hsa
gccugggcaacagagacucugucucaaaaaaaaaaaaaaaaaaaauuaaccucaaccaaacgcc

SEQ ID NO: 29779 - RNA, 64 nt, hsa
ccugggcaacagagacucugucucaaaaaaaaaaaaaaaaaaaauuaaccucaaccaaacgccu

SEQ ID NO: 29780 - RNA, 64 nt, hsa
cugggcaacagagacucugucucaaaaaaaaaaaaaaaaaaaauuaaccucaaccaaacgccua

SEQ ID NO: 29781 - RNA, 64 nt, hsa
ugggcaacagagacucugucucaaaaaaaaaaaaaaaaaaaauuaaccucaaccaaacgccuau

SEQ ID NO: 29782 - RNA, 64 nt, hsa
gaguagauccaugauggauuaauaaagcuugcugaaaaaaaaaaucuguguaucaauuagauuu

SEQ ID NO: 29783 - RNA, 64 nt, hsa
aguagauccaugauggauuaauaaagcuugcugaaaaaaaaaaucuguguaucaauuagauuua

SEQ ID NO: 29784 - RNA, 64 nt, hsa
guagauccaugauggauuaauaaagcuugcugaaaaaaaaaaucuguguaucaauuagauuuac

SEQ ID NO: 29785 - RNA, 64 nt, hsa
gagaagagaaacuuggcuucuguuuucgcaaaggaaaaaaaaaauaggauaggcuucccuugug

SEQ ID NO: 29786 - RNA, 64 nt, hsa
agaagagaaacuuggcuucuguuuucgcaaaggaaaaaaaaaauaggauaggcuucccuugugc

SEQ ID NO: 29787 - RNA, 64 nt, hsa
gaagagaaacuuggcuucuguuuucgcaaaggaaaaaaaaaauaggauaggcuucccuugugca

SEQ ID NO: 29788 - RNA, 64 nt, hsa
cuccagccuggcaauagaccgagacuccgucuccaaaaaaaaaaaaaauacaauuuuuauuucu

SEQ ID NO: 29789 - RNA, 64 nt, hsa
uccagccuggcaauagaccgagacuccgucuccaaaaaaaaaaaaaauacaauuuuuauuucuu

SEQ ID NO: 29790 - RNA, 64 nt, hsa
ccagccuggcaauagaccgagacuccgucuccaaaaaaaaaaaaaauacaauuuuuauuucuuu

SEQ ID NO: 29791 - RNA, 64 nt, hsa
cagccuggcaauagaccgagacuccgucuccaaaaaaaaaaaaaauacaauuuuuauuucuuuu

SEQ ID NO: 29792 - RNA, 64 nt, hsa
agccuggcaauagaccgagacuccgucuccaaaaaaaaaaaaaauacaauuuuuauuucuuuua

SEQ ID NO: 29793 - RNA, 64 nt, hsa
gccuggcaauagaccgagacuccgucuccaaaaaaaaaaaaaauacaauuuuuauuucuuuuac

SEQ ID NO: 29794 - RNA, 64 nt, hsa
ccuggcaauagaccgagacuccgucuccaaaaaaaaaaaaaauacaauuuuuauuucuuuuacu

SEQ ID NO: 29795 - RNA, 64 nt, hsa
aaguccaagugauucauguacugaggaauguaggaaaaaaaaucugaggauagugcuuuacucu

SEQ ID NO: 29796 - RNA, 64 nt, hsa
uauaauauuacuucaaagauauguaaucacaaacaaaaaaaacuauuuuuuauaaugucauuug

SEQ ID NO: 29797 - RNA, 64 nt, hsa
cucccuccugggcaacagaacaagacuccaucucaaaaaaaaaaaaguacaucauaaaaguaca

SEQ ID NO: 29798 - RNA, 64 nt, hsa
ucccuccugggcaacagaacaagacuccaucucaaaaaaaaaaaaguacaucauaaaaguacau

SEQ ID NO: 29799 - RNA, 64 nt, hsa
cccuccugggcaacagaacaagacuccaucucaaaaaaaaaaaaguacaucauaaaaguacauc

SEQ ID NO: 29800 - RNA, 64 nt, hsa
ccuccugggcaacagaacaagacuccaucucaaaaaaaaaaaaguacaucauaaaaguacauca

SEQ ID NO: 29801 - RNA, 64 nt, hsa
cuccugggcaacagaacaagacuccaucucaaaaaaaaaaaaguacaucauaaaaguacaucau

SEQ ID NO: 29802 - RNA, 64 nt, hsa
agucuuuacaaugcuuguuucaaagaaccaacagaaaaaaaagcuaagaaaacugagaacuaac

SEQ ID NO: 29803 - RNA, 64 nt, hsa
uaaaugucacgagaucauuuuuacauuaaacgugaaaaaaaaucaacuuugccggaucacuuau

SEQ ID NO: 29804 - RNA, 64 nt, hsa
uacuuuuuauuaugaguuaauauaguuuagcaguaaaaaaaaaaaaaaaaaccacaccuaaaau

SEQ ID NO: 29805 - RNA, 64 nt, hsa
acuuuuuauuaugaguuaauauaguuuagcaguaaaaaaaaaaaaaaaaaccacaccuaaaaua

SEQ ID NO: 29806 - RNA, 64 nt, hsa
cuuuuuauuaugaguuaauauaguuuagcaguaaaaaaaaaaaaaaaaaccacaccuaaaauag

SEQ ID NO: 29807 - RNA, 64 nt, hsa
uuuuuauuaugaguuaauauaguuuagcaguaaaaaaaaaaaaaaaaaccacaccuaaaauaga

SEQ ID NO: 29808 - RNA, 64 nt, hsa
uuuuauuaugaguuaauauaguuuagcaguaaaaaaaaaaaaaaaaaccacaccuaaaauagac

SEQ ID NO: 29809 - RNA, 64 nt, hsa
uuuauuaugaguuaauauaguuuagcaguaaaaaaaaaaaaaaaaaccacaccuaaaauagacc

SEQ ID NO: 29810 - RNA, 64 nt, hsa
uuauuaugaguuaauauaguuuagcaguaaaaaaaaaaaaaaaaaccacaccuaaaauagacca

SEQ ID NO: 29811 - RNA, 64 nt, hsa
uauuaugaguuaauauaguuuagcaguaaaaaaaaaaaaaaaaaccacaccuaaaauagaccac

SEQ ID NO: 29812 - RNA, 64 nt, hsa
auuaugaguuaauauaguuuagcaguaaaaaaaaaaaaaaaaaccacaccuaaaauagaccacu

SEQ ID NO: 29813 - RNA, 64 nt, hsa
uuaugaguuaauauaguuuagcaguaaaaaaaaaaaaaaaaaccacaccuaaaauagaccacug

SEQ ID NO: 29814 - RNA, 64 nt, hsa
auaaauuuuaaucucuguuaaucuuaccugcuuuaaaaaaaaguucuuguguguucguaucuuu

SEQ ID NO: 29815 - RNA, 64 nt, hsa
gcauugcaugugaauaagaaaauaauguuuaaagaaaaaaaaaaaaaagcaaaccuccaaaacg

SEQ ID NO: 29816 - RNA, 64 nt, hsa
cauugcaugugaauaagaaaauaauguuuaaagaaaaaaaaaaaaaagcaaaccuccaaaacgu

SEQ ID NO: 29817 - RNA, 64 nt, hsa
auugcaugugaauaagaaaauaauguuuaaagaaaaaaaaaaaaaagcaaaccuccaaaacgug

SEQ ID NO: 29818 - RNA, 64 nt, hsa
uugcaugugaauaagaaaauaauguuuaaagaaaaaaaaaaaaaagcaaaccuccaaaacgugg

SEQ ID NO: 29819 - RNA, 64 nt, hsa
ugcaugugaauaagaaaauaauguuuaaagaaaaaaaaaaaaaagcaaaccuccaaaacgugga

SEQ ID NO: 29820 - RNA, 64 nt, hsa
gcaugugaauaagaaaauaauguuuaaagaaaaaaaaaaaaaagcaaaccuccaaaacguggac

SEQ ID NO: 29821 - RNA, 64 nt, hsa
caugugaauaagaaaauaauguuuaaagaaaaaaaaaaaaaagcaaaccuccaaaacguggacc

SEQ ID NO: 29822 - RNA, 64 nt, hsa
cuuggauauaugguugaagaaucaaaacaaaagcaaaaaaaaaaagcaaaaaaagaaaagagaa

SEQ ID NO: 29823 - RNA, 64 nt, hsa
uuggauauaugguugaagaaucaaaacaaaagcaaaaaaaaaaagcaaaaaaagaaaagagaaa

SEQ ID NO: 29824 - RNA, 64 nt, hsa
uggauauaugguugaagaaucaaaacaaaagcaaaaaaaaaaagcaaaaaaagaaaagagaaaa

SEQ ID NO: 29825 - RNA, 64 nt, hsa
ggauauaugguugaagaaucaaaacaaaagcaaaaaaaaaaagcaaaaaaagaaaagagaaaaa

SEQ ID NO: 29826 - RNA, 64 nt, hsa
acaauuuugacaacuuuugaccacuugcgcuaauaaaaaaaaaaaaaaacuacucuuaugucca

SEQ ID NO: 29827 - RNA, 64 nt, hsa
caauuuugacaacuuuugaccacuugcgcuaauaaaaaaaaaaaaaaacuacucuuauguccac

SEQ ID NO: 29828 - RNA, 64 nt, hsa
aauuuugacaacuuuugaccacuugcgcuaauaaaaaaaaaaaaaaacuacucuuauguccacu

SEQ ID NO: 29829 - RNA, 64 nt, hsa
auuuugacaacuuuugaccacuugcgcuaauaaaaaaaaaaaaaaacuacucuuauguccacuu

SEQ ID NO: 29830 - RNA, 64 nt, hsa
uuuugacaacuuuugaccacuugcgcuaauaaaaaaaaaaaaaaacuacucuuauguccacuuu

SEQ ID NO: 29831 - RNA, 64 nt, hsa
uuugacaacuuuugaccacuugcgcuaauaaaaaaaaaaaaaaacuacucuuauguccacuuua

SEQ ID NO: 29832 - RNA, 64 nt, hsa
uugacaacuuuugaccacuugcgcuaauaaaaaaaaaaaaaaacuacucuuauguccacuuuac

SEQ ID NO: 29833 - RNA, 64 nt, hsa
ugacaacuuuugaccacuugcgcuaauaaaaaaaaaaaaaaacuacucuuauguccacuuuaca

SEQ ID NO: 29834 - RNA, 64 nt, hsa
uuuugacacuuccauuguuuaaaaauacacauggaaaaaaaaaaaacccuauaugcuuacugug

SEQ ID NO: 29835 - RNA, 64 nt, hsa
uuugacacuuccauuguuuaaaaauacacauggaaaaaaaaaaaacccuauaugcuuacugugc

SEQ ID NO: 29836 - RNA, 64 nt, hsa
uugacacuuccauuguuuaaaaauacacauggaaaaaaaaaaaacccuauaugcuuacugugca

SEQ ID NO: 29837 - RNA, 64 nt, hsa
ugacacuuccauuguuuaaaaauacacauggaaaaaaaaaaaacccuauaugcuuacugugcac

SEQ ID NO: 29838 - RNA, 64 nt, hsa
gacacuuccauuguuuaaaaauacacauggaaaaaaaaaaaacccuauaugcuuacugugcacc

SEQ ID NO: 29839 - RNA, 64 nt, hsa
uuuuguuuagucuagccacaguucuucacaaaggaaaaaaaaauguguagaugauaccaugacu

SEQ ID NO: 29840 - RNA, 64 nt, hsa
uuuguuuagucuagccacaguucuucacaaaggaaaaaaaaauguguagaugauaccaugacuu

SEQ ID NO: 29841 - RNA, 64 nt, hsa
ucacagggacagaucugauuuauuuauuuugguuaaaaaaaaaaaaaaggaacagaaacaacuu

SEQ ID NO: 29842 - RNA, 64 nt, hsa
cacagggacagaucugauuuauuuauuuugguuaaaaaaaaaaaaaaggaacagaaacaacuuu

SEQ ID NO: 29843 - RNA, 64 nt, hsa
acagggacagaucugauuuauuuauuuugguuaaaaaaaaaaaaaaggaacagaaacaacuuug

SEQ ID NO: 29844 - RNA, 64 nt, hsa
cagggacagaucugauuuauuuauuuugguuaaaaaaaaaaaaaaggaacagaaacaacuuugc

SEQ ID NO: 29845 - RNA, 64 nt, hsa
agggacagaucugauuuauuuauuuugguuaaaaaaaaaaaaaaggaacagaaacaacuuugca

SEQ ID NO: 29846 - RNA, 64 nt, hsa
gggacagaucugauuuauuuauuuugguuaaaaaaaaaaaaaaggaacagaaacaacuuugcau

SEQ ID NO: 29847 - RNA, 64 nt, hsa
ggacagaucugauuuauuuauuuugguuaaaaaaaaaaaaaaggaacagaaacaacuuugcauu

SEQ ID NO: 29848 - RNA, 64 nt, hsa
gagcagaaauuuaucuuucaaagagguauauuugaaaaaaaaaaaaaguauaugugaggauuuu

SEQ ID NO: 29849 - RNA, 64 nt, hsa
agcagaaauuuaucuuucaaagagguauauuugaaaaaaaaaaaaaguauaugugaggauuuuu

SEQ ID NO: 29850 - RNA, 64 nt, hsa
gcagaaauuuaucuuucaaagagguauauuugaaaaaaaaaaaaaguauaugugaggauuuuua

SEQ ID NO: 29851 - RNA, 64 nt, hsa
cagaaauuuaucuuucaaagagguauauuugaaaaaaaaaaaaaguauaugugaggauuuuuau

SEQ ID NO: 29852 - RNA, 64 nt, hsa
agaaauuuaucuuucaaagagguauauuugaaaaaaaaaaaaaguauaugugaggauuuuuauu

SEQ ID NO: 29853 - RNA, 64 nt, hsa
gaaauuuaucuuucaaagagguauauuugaaaaaaaaaaaaaguauaugugaggauuuuuauug

SEQ ID NO: 29854 - RNA, 64 nt, hsa
uucugaaucaucuugaaaauaagauuccaaccacaaaaaaaauuuagccauuucuuuacuaaaa

SEQ ID NO: 29855 - RNA, 64 nt, hsa
ccaaccacaaaaaaaauuuagccauuucuuuacuaaaaaaaaccaaaaaacaaaucuguuuuau

SEQ ID NO: 29856 - RNA, 64 nt, hsa
aaaguucuaaaguuauaaaaauguuuucugcaguaaaaaaaaaguucucugggccgggcguggu

SEQ ID NO: 29857 - RNA, 64 nt, hsa
aaguucuaaaguuauaaaaauguuuucugcaguaaaaaaaaaguucucugggccgggcguggug

SEQ ID NO: 29858 - RNA, 64 nt, hsa
ugggcaacauaaugaaacuuccuuuccagggaggaaaaaaaaaaaaaaaaaaagcucugagagc

SEQ ID NO: 29859 - RNA, 64 nt, hsa
gggcaacauaaugaaacuuccuuuccagggaggaaaaaaaaaaaaaaaaaaagcucugagagca

SEQ ID NO: 29860 - RNA, 64 nt, hsa
ggcaacauaaugaaacuuccuuuccagggaggaaaaaaaaaaaaaaaaaaagcucugagagcau

SEQ ID NO: 29861 - RNA, 64 nt, hsa
gcaacauaaugaaacuuccuuuccagggaggaaaaaaaaaaaaaaaaaaagcucugagagcauc

SEQ ID NO: 29862 - RNA, 64 nt, hsa
caacauaaugaaacuuccuuuccagggaggaaaaaaaaaaaaaaaaaaagcucugagagcaucu

SEQ ID NO: 29863 - RNA, 64 nt, hsa
aacauaaugaaacuuccuuuccagggaggaaaaaaaaaaaaaaaaaaagcucugagagcaucuu

SEQ ID NO: 29864 - RNA, 64 nt, hsa
acauaaugaaacuuccuuuccagggaggaaaaaaaaaaaaaaaaaaagcucugagagcaucuua

SEQ ID NO: 29865 - RNA, 64 nt, hsa
cauaaugaaacuuccuuuccagggaggaaaaaaaaaaaaaaaaaaagcucugagagcaucuuau

SEQ ID NO: 29866 - RNA, 64 nt, hsa
auaaugaaacuuccuuuccagggaggaaaaaaaaaaaaaaaaaaagcucugagagcaucuuauu

SEQ ID NO: 29867 - RNA, 64 nt, hsa
uaaugaaacuuccuuuccagggaggaaaaaaaaaaaaaaaaaaagcucugagagcaucuuauuu

SEQ ID NO: 29868 - RNA, 64 nt, hsa
aaugaaacuuccuuuccagggaggaaaaaaaaaaaaaaaaaaagcucugagagcaucuuauuuu

SEQ ID NO: 29869 - RNA, 64 nt, hsa
augaaacuuccuuuccagggaggaaaaaaaaaaaaaaaaaaagcucugagagcaucuuauuuug

SEQ ID NO: 29870 - RNA, 64 nt, hsa
cuccagccugggugauagagcaagaccccaacucaaaaaaaaaaaaaaggaucccacgguucac

SEQ ID NO: 29871 - RNA, 64 nt, hsa
uccagccugggugauagagcaagaccccaacucaaaaaaaaaaaaaaggaucccacgguucacc

SEQ ID NO: 29872 - RNA, 64 nt, hsa
ccagccugggugauagagcaagaccccaacucaaaaaaaaaaaaaaggaucccacgguucaccu

SEQ ID NO: 29873 - RNA, 64 nt, hsa
cagccugggugauagagcaagaccccaacucaaaaaaaaaaaaaaggaucccacgguucaccuu

SEQ ID NO: 29874 - RNA, 64 nt, hsa
agccugggugauagagcaagaccccaacucaaaaaaaaaaaaaaggaucccacgguucaccuug

SEQ ID NO: 29875 - RNA, 64 nt, hsa
gccugggugauagagcaagaccccaacucaaaaaaaaaaaaaaggaucccacgguucaccuugu

SEQ ID NO: 29876 - RNA, 64 nt, hsa
ccugggugauagagcaagaccccaacucaaaaaaaaaaaaaaggaucccacgguucaccuugug

SEQ ID NO: 29877 - RNA, 64 nt, hsa
cuccagccugggcgacagagcaagacuccaucucaaaaaaaaaguuaauuaauuaauuagauua

SEQ ID NO: 29878 - RNA, 64 nt, hsa
uccagccugggcgacagagcaagacuccaucucaaaaaaaaaguuaauuaauuaauuagauuaa

SEQ ID NO: 29879 - RNA, 64 nt, hsa
cugugauaguucaguucuuuaguuuuucuauuugaaaaaaaaaaaucauuuaaaugauccuuug

SEQ ID NO: 29880 - RNA, 64 nt, hsa
ugugauaguucaguucuuuaguuuuucuauuugaaaaaaaaaaaucauuuaaaugauccuuugu

SEQ ID NO: 29881 - RNA, 64 nt, hsa
gugauaguucaguucuuuaguuuuucuauuugaaaaaaaaaaaucauuuaaaugauccuuuguu

SEQ ID NO: 29882 - RNA, 64 nt, hsa
ugauaguucaguucuuuaguuuuucuauuugaaaaaaaaaaaucauuuaaaugauccuuuguuc

SEQ ID NO: 29883 - RNA, 64 nt, hsa
uaaacauugcagguuuaaacauaaaggagucuuuaaaaaaaaaucauuuacguuggaauuuuag

SEQ ID NO: 29884 - RNA, 64 nt, hsa
aaacauugcagguuuaaacauaaaggagucuuuaaaaaaaaaucauuuacguuggaauuuuagg

SEQ ID NO: 29885 - RNA, 64 nt, hsa
aguuuggagggauccuaagagcauuuuuguggguaaaaaaaaaaccuguggacauaaugaauuu

SEQ ID NO: 29886 - RNA, 64 nt, hsa
guuuggagggauccuaagagcauuuuuguggguaaaaaaaaaaccuguggacauaaugaauuuu

SEQ ID NO: 29887 - RNA, 64 nt, hsa
uuuggagggauccuaagagcauuuuuguggguaaaaaaaaaaccuguggacauaaugaauuuug

SEQ ID NO: 29888 - RNA, 64 nt, hsa
gacagggucugacauggucagucuacuaaaaaacaaaaaaaaaaaacaaaaaaaaaaaaacaaa

SEQ ID NO: 29889 - RNA, 64 nt, hsa
acagggucugacauggucagucuacuaaaaaacaaaaaaaaaaaacaaaaaaaaaaaaacaaaa

SEQ ID NO: 29890 - RNA, 64 nt, hsa
cagggucugacauggucagucuacuaaaaaacaaaaaaaaaaaacaaaaaaaaaaaaacaaaag

SEQ ID NO: 29891 - RNA, 64 nt, hsa
agggucugacauggucagucuacuaaaaaacaaaaaaaaaaaacaaaaaaaaaaaaacaaaaga

SEQ ID NO: 29892 - RNA, 64 nt, hsa
gggucugacauggucagucuacuaaaaaacaaaaaaaaaaaacaaaaaaaaaaaaacaaaagaa

SEQ ID NO: 29893 - RNA, 64 nt, hsa
auggucagucuacuaaaaaacaaaaaaaaaaaacaaaaaaaaaaaaacaaaagaaaaaaauaaa

SEQ ID NO: 29894 - RNA, 64 nt, hsa
uggucagucuacuaaaaaacaaaaaaaaaaaacaaaaaaaaaaaaacaaaagaaaaaaauaaaa

SEQ ID NO: 29895 - RNA, 64 nt, hsa
ggucagucuacuaaaaaacaaaaaaaaaaaacaaaaaaaaaaaaacaaaagaaaaaaauaaaaa

SEQ ID NO: 29896 - RNA, 64 nt, hsa
gucagucuacuaaaaaacaaaaaaaaaaaacaaaaaaaaaaaaacaaaagaaaaaaauaaaaau

SEQ ID NO: 29897 - RNA, 64 nt, hsa
ucagucuacuaaaaaacaaaaaaaaaaaacaaaaaaaaaaaaacaaaagaaaaaaauaaaaaua

SEQ ID NO: 29898 - RNA, 64 nt, hsa
cagucuacuaaaaaacaaaaaaaaaaaacaaaaaaaaaaaaacaaaagaaaaaaauaaaaauac

SEQ ID NO: 29899 - RNA, 64 nt, hsa
uuuuaaugaauaugaccccuauagaaaagucaagaaaaaaaaacccuuguauaaauuauuuuau

SEQ ID NO: 29900 - RNA, 64 nt, hsa
uuuaaugaauaugaccccuauagaaaagucaagaaaaaaaaacccuuguauaaauuauuuuauu

SEQ ID NO: 29901 - RNA, 64 nt, hsa
ugucauugagaaaguucaaaauggaauaggcuuuaaaaaaaaaaaaacuuucaaagauccgcca

SEQ ID NO: 29902 - RNA, 64 nt, hsa
gucauugagaaaguucaaaauggaauaggcuuuaaaaaaaaaaaaacuuucaaagauccgccaa

SEQ ID NO: 29903 - RNA, 64 nt, hsa
ucauugagaaaguucaaaauggaauaggcuuuaaaaaaaaaaaaacuuucaaagauccgccaaa

SEQ ID NO: 29904 - RNA, 64 nt, hsa
cauugagaaaguucaaaauggaauaggcuuuaaaaaaaaaaaaacuuucaaagauccgccaaau

SEQ ID NO: 29905 - RNA, 64 nt, hsa
auugagaaaguucaaaauggaauaggcuuuaaaaaaaaaaaaacuuucaaagauccgccaaauc

SEQ ID NO: 29906 - RNA, 64 nt, hsa
uugagaaaguucaaaauggaauaggcuuuaaaaaaaaaaaaacuuucaaagauccgccaaauca

SEQ ID NO: 29907 - RNA, 64 nt, hsa
uuccagacugggugacagagugagacuccaucucaaaaaaaaaaaaguugacucuacccccuaa

SEQ ID NO: 29908 - RNA, 64 nt, hsa
uccagacugggugacagagugagacuccaucucaaaaaaaaaaaaguugacucuacccccuaau

SEQ ID NO: 29909 - RNA, 64 nt, hsa
ccagacugggugacagagugagacuccaucucaaaaaaaaaaaaguugacucuacccccuaauu

SEQ ID NO: 29910 - RNA, 64 nt, hsa
cagacugggugacagagugagacuccaucucaaaaaaaaaaaaguugacucuacccccuaauuu

SEQ ID NO: 29911 - RNA, 64 nt, hsa
agacugggugacagagugagacuccaucucaaaaaaaaaaaaguugacucuacccccuaauuug

SEQ ID NO: 29912 - RNA, 64 nt, hsa
aauguagaaaagauacucagucuuaauccuaugcaaaaaaaaaaaucaaguaauuguuuuccua

SEQ ID NO: 29913 - RNA, 64 nt, hsa
auguagaaaagauacucagucuuaauccuaugcaaaaaaaaaaaucaaguaauuguuuuccuau

SEQ ID NO: 29914 - RNA, 64 nt, hsa
uguagaaaagauacucagucuuaauccuaugcaaaaaaaaaaaucaaguaauuguuuuccuaug

SEQ ID NO: 29915 - RNA, 64 nt, hsa
guagaaaagauacucagucuuaauccuaugcaaaaaaaaaaaucaaguaauuguuuuccuauga

SEQ ID NO: 29916 - RNA, 64 nt, hsa
ccuuccaggauuaaguugucaucauucugggaagaaaaaaaaaacauuaaugaagaggccaaua

SEQ ID NO: 29917 - RNA, 64 nt, hsa
cuuccaggauuaaguugucaucauucugggaagaaaaaaaaaacauuaaugaagaggccaauaa

SEQ ID NO: 29918 - RNA, 64 nt, hsa
uuccaggauuaaguugucaucauucugggaagaaaaaaaaaacauuaaugaagaggccaauaau

SEQ ID NO: 29919 - RNA, 64 nt, hsa
uucaaaguuugcuuaguuacaacaaagcaccuuuaaaaaaaauacauuuuaaaaaaacauucca

SEQ ID NO: 29920 - RNA, 64 nt, hsa
uguugacuuaaaaauaugagauacauaggaugugaaaaaaaauguuugcaguacucagcaaaaa

SEQ ID NO: 29921 - RNA, 64 nt, hsa
uacgugccuuuuucuuaaaugcuuucauuuauugaaaaaaaaaaaaaaugcccccaaagcacua

SEQ ID NO: 29922 - RNA, 64 nt, hsa
acgugccuuuuucuuaaaugcuuucauuuauugaaaaaaaaaaaaaaugcccccaaagcacuau

SEQ ID NO: 29923 - RNA, 64 nt, hsa
cgugccuuuuucuuaaaugcuuucauuuauugaaaaaaaaaaaaaaugcccccaaagcacuaug

SEQ ID NO: 29924 - RNA, 64 nt, hsa
gugccuuuuucuuaaaugcuuucauuuauugaaaaaaaaaaaaaaugcccccaaagcacuaugc

SEQ ID NO: 29925 - RNA, 64 nt, hsa
ugccuuuuucuuaaaugcuuucauuuauugaaaaaaaaaaaaaaugcccccaaagcacuaugcu

SEQ ID NO: 29926 - RNA, 64 nt, hsa
gccuuuuucuuaaaugcuuucauuuauugaaaaaaaaaaaaaaugcccccaaagcacuaugcug

SEQ ID NO: 29927 - RNA, 64 nt, hsa
ccuuuuucuuaaaugcuuucauuuauugaaaaaaaaaaaaaaugcccccaaagcacuaugcugg

SEQ ID NO: 29928 - RNA, 64 nt, hsa
acuccagccugggugacuagcaaaacuccaucucaaaaaaaaaaaaaagaaagaaagaaacuga

SEQ ID NO: 29929 - RNA, 64 nt, hsa
cuccagccugggugacuagcaaaacuccaucucaaaaaaaaaaaaaagaaagaaagaaacugaa

SEQ ID NO: 29930 - RNA, 64 nt, hsa
uccagccugggugacuagcaaaacuccaucucaaaaaaaaaaaaaagaaagaaagaaacugaaa

SEQ ID NO: 29931 - RNA, 64 nt, hsa
ccagccugggugacuagcaaaacuccaucucaaaaaaaaaaaaaagaaagaaagaaacugaaaa

SEQ ID NO: 29932 - RNA, 64 nt, hsa
cagccugggugacuagcaaaacuccaucucaaaaaaaaaaaaaagaaagaaagaaacugaaaag

SEQ ID NO: 29933 - RNA, 64 nt, hsa
agccugggugacuagcaaaacuccaucucaaaaaaaaaaaaaagaaagaaagaaacugaaaagu

SEQ ID NO: 29934 - RNA, 64 nt, hsa
gccugggugacuagcaaaacuccaucucaaaaaaaaaaaaaagaaagaaagaaacugaaaagug

SEQ ID NO: 29935 - RNA, 64 nt, hsa
ucgcuucucagccuuuuggcuaagauuaaguauuaaaaaaaaaccaggcucugccaggcgcagu

SEQ ID NO: 29936 - RNA, 64 nt, hsa
cgcuucucagccuuuuggcuaagauuaaguauuaaaaaaaaaccaggcucugccaggcgcagug

SEQ ID NO: 29937 - RNA, 64 nt, hsa
ucauuugaccaagacacagaagaugaugaaugggaaaaaaaacauagagaucacaccgcaaaga

SEQ ID NO: 29938 - RNA, 64 nt, hsa
guauaaauguuuuuacugcuuuuagaaaauaaagaaaaaaaacuugguucauguuuacaugccu

SEQ ID NO: 29939 - RNA, 64 nt, hsa
uccagccugggcaacaagagcaaaacucugucucaaaaaaaaaaaaaaaugauggagcuccgaa

SEQ ID NO: 29940 - RNA, 64 nt, hsa
ccagccugggcaacaagagcaaaacucugucucaaaaaaaaaaaaaaaugauggagcuccgaau

SEQ ID NO: 29941 - RNA, 64 nt, hsa
cagccugggcaacaagagcaaaacucugucucaaaaaaaaaaaaaaaugauggagcuccgaaug

SEQ ID NO: 29942 - RNA, 64 nt, hsa
agccugggcaacaagagcaaaacucugucucaaaaaaaaaaaaaaaugauggagcuccgaaugu

SEQ ID NO: 29943 - RNA, 64 nt, hsa
gccugggcaacaagagcaaaacucugucucaaaaaaaaaaaaaaaugauggagcuccgaaugug

SEQ ID NO: 29944 - RNA, 64 nt, hsa
ccugggcaacaagagcaaaacucugucucaaaaaaaaaaaaaaaugauggagcuccgaaugugc

SEQ ID NO: 29945 - RNA, 64 nt, hsa
cugggcaacaagagcaaaacucugucucaaaaaaaaaaaaaaaugauggagcuccgaaugugcu

SEQ ID NO: 29946 - RNA, 64 nt, hsa
ugggcaacaagagcaaaacucugucucaaaaaaaaaaaaaaaugauggagcuccgaaugugcuu

SEQ ID NO: 29947 - RNA, 64 nt, hsa
ucagccugggcaacacagugagacuccaucucuuaaaaaaaaaauuagcuggguauagugguau

SEQ ID NO: 29948 - RNA, 64 nt, hsa
cagccugggcaacacagugagacuccaucucuuaaaaaaaaaauuagcuggguauagugguaug

SEQ ID NO: 29949 - RNA, 64 nt, hsa
agccugggcaacacagugagacuccaucucuuaaaaaaaaaauuagcuggguauagugguaugu

SEQ ID NO: 29950 - RNA, 64 nt, hsa
aaguaaguaaucuuuaacugaacucugaccacuuaaaaaaaaaucuaaaaauugaacuaccuau

SEQ ID NO: 29951 - RNA, 64 nt, hsa
aguaaguaaucuuuaacugaacucugaccacuuaaaaaaaaaucuaaaaauugaacuaccuaua

SEQ ID NO: 29952 - RNA, 64 nt, hsa
cuccagccugggcgacagagcaagacuccgucucaaaaaaaaaaaaaaaaaaaaaaaaagagug

SEQ ID NO: 29953 - RNA, 64 nt, hsa
uccagccugggcgacagagcaagacuccgucucaaaaaaaaaaaaaaaaaaaaaaaaagaguga

SEQ ID NO: 29954 - RNA, 64 nt, hsa
ccagccugggcgacagagcaagacuccgucucaaaaaaaaaaaaaaaaaaaaaaaaagagugaa

SEQ ID NO: 29955 - RNA, 64 nt, hsa
cagccugggcgacagagcaagacuccgucucaaaaaaaaaaaaaaaaaaaaaaaaagagugaau

SEQ ID NO: 29956 - RNA, 64 nt, hsa
agccugggcgacagagcaagacuccgucucaaaaaaaaaaaaaaaaaaaaaaaaagagugaaug

SEQ ID NO: 29957 - RNA, 64 nt, hsa
gccugggcgacagagcaagacuccgucucaaaaaaaaaaaaaaaaaaaaaaaaagagugaaugu

SEQ ID NO: 29958 - RNA, 64 nt, hsa
ccugggcgacagagcaagacuccgucucaaaaaaaaaaaaaaaaaaaaaaaaagagugaaugua

SEQ ID NO: 29959 - RNA, 64 nt, hsa
cugggcgacagagcaagacuccgucucaaaaaaaaaaaaaaaaaaaaaaaaagagugaauguaa

SEQ ID NO: 29960 - RNA, 64 nt, hsa
ugggcgacagagcaagacuccgucucaaaaaaaaaaaaaaaaaaaaaaaaagagugaauguaau

SEQ ID NO: 29961 - RNA, 64 nt, hsa
gggcgacagagcaagacuccgucucaaaaaaaaaaaaaaaaaaaaaaaaagagugaauguaaua

SEQ ID NO: 29962 - RNA, 64 nt, hsa
ggcgacagagcaagacuccgucucaaaaaaaaaaaaaaaaaaaaaaaaagagugaauguaauag

SEQ ID NO: 29963 - RNA, 64 nt, hsa
gcgacagagcaagacuccgucucaaaaaaaaaaaaaaaaaaaaaaaaagagugaauguaauagu

SEQ ID NO: 29964 - RNA, 64 nt, hsa
cgacagagcaagacuccgucucaaaaaaaaaaaaaaaaaaaaaaaaagagugaauguaauaguc

SEQ ID NO: 29965 - RNA, 64 nt, hsa
gacagagcaagacuccgucucaaaaaaaaaaaaaaaaaaaaaaaaagagugaauguaauagucu

SEQ ID NO: 29966 - RNA, 64 nt, hsa
acagagcaagacuccgucucaaaaaaaaaaaaaaaaaaaaaaaaagagugaauguaauagucuu

SEQ ID NO: 29967 - RNA, 64 nt, hsa
cagagcaagacuccgucucaaaaaaaaaaaaaaaaaaaaaaaaagagugaauguaauagucuug

SEQ ID NO: 29968 - RNA, 64 nt, hsa
agagcaagacuccgucucaaaaaaaaaaaaaaaaaaaaaaaaagagugaauguaauagucuugc

SEQ ID NO: 29969 - RNA, 64 nt, hsa
gagcaagacuccgucucaaaaaaaaaaaaaaaaaaaaaaaaagagugaauguaauagucuugca

SEQ ID NO: 29970 - RNA, 64 nt, hsa
aaaaccaccaaggaaaccuacuccaaaaaugaacaaaaaaaaaaaaagcgaaagacugcaguug

SEQ ID NO: 29971 - RNA, 64 nt, hsa
aaaccaccaaggaaaccuacuccaaaaaugaacaaaaaaaaaaaaagcgaaagacugcaguugu

SEQ ID NO: 29972 - RNA, 64 nt, hsa
aaccaccaaggaaaccuacuccaaaaaugaacaaaaaaaaaaaaagcgaaagacugcaguugug

SEQ ID NO: 29973 - RNA, 64 nt, hsa
accaccaaggaaaccuacuccaaaaaugaacaaaaaaaaaaaaagcgaaagacugcaguugugc

SEQ ID NO: 29974 - RNA, 64 nt, hsa
ccaccaaggaaaccuacuccaaaaaugaacaaaaaaaaaaaaagcgaaagacugcaguugugcu

SEQ ID NO: 29975 - RNA, 64 nt, hsa
caccaaggaaaccuacuccaaaaaugaacaaaaaaaaaaaaagcgaaagacugcaguugugcua

SEQ ID NO: 29976 - RNA, 64 nt, hsa
acucccgccuggcaacagagcaagagucugucucaaaaaaaaaaagaaaaaaagaaaaaaagaa

SEQ ID NO: 29977 - RNA, 64 nt, hsa
cucccgccuggcaacagagcaagagucugucucaaaaaaaaaaagaaaaaaagaaaaaaagaaa

SEQ ID NO: 29978 - RNA, 64 nt, hsa
ucccgccuggcaacagagcaagagucugucucaaaaaaaaaaagaaaaaaagaaaaaaagaaaa

SEQ ID NO: 29979 - RNA, 64 nt, hsa
cccgccuggcaacagagcaagagucugucucaaaaaaaaaaagaaaaaaagaaaaaaagaaaaa

SEQ ID NO: 29980 - RNA, 64 nt, hsa
gguaauuugagagaaauaugaagaacugaggaggaaaaaaaaaaaaaagaaaagaaccaacaac

SEQ ID NO: 29981 - RNA, 64 nt, hsa
guaauuugagagaaauaugaagaacugaggaggaaaaaaaaaaaaaagaaaagaaccaacaacc

SEQ ID NO: 29982 - RNA, 64 nt, hsa
uaauuugagagaaauaugaagaacugaggaggaaaaaaaaaaaaaagaaaagaaccaacaaccu

SEQ ID NO: 29983 - RNA, 64 nt, hsa
aauuugagagaaauaugaagaacugaggaggaaaaaaaaaaaaaagaaaagaaccaacaaccuc

SEQ ID NO: 29984 - RNA, 64 nt, hsa
auuugagagaaauaugaagaacugaggaggaaaaaaaaaaaaaagaaaagaaccaacaaccuca

SEQ ID NO: 29985 - RNA, 64 nt, hsa
uuugagagaaauaugaagaacugaggaggaaaaaaaaaaaaaagaaaagaaccaacaaccucaa

SEQ ID NO: 29986 - RNA, 64 nt, hsa
uugagagaaauaugaagaacugaggaggaaaaaaaaaaaaaagaaaagaaccaacaaccucaac

SEQ ID NO: 29987 - RNA, 64 nt, hsa
aauauguaaauuaaaauauuucuacauuuuauugaaaaaaaaaccuuuuuuuuugccuaaauau

SEQ ID NO: 29988 - RNA, 64 nt, hsa
auauguaaauuaaaauauuucuacauuuuauugaaaaaaaaaccuuuuuuuuugccuaaauaua

SEQ ID NO: 29989 - RNA, 64 nt, hsa
ucguugaacauaauguuccaguugaaugcaaaacaaaaaaaauauggaaaacauuuugauaaaa

SEQ ID NO: 29990 - RNA, 64 nt, hsa
ugaacauuggcuaugaugaagauuauuacauaugaaaaaaaaacucacacaacauauuuguauu

SEQ ID NO: 29991 - RNA, 64 nt, hsa
gaacauuggcuaugaugaagauuauuacauaugaaaaaaaaacucacacaacauauuuguauug

SEQ ID NO: 29992 - RNA, 64 nt, hsa
guaguucaagugacuuuccuacuuuuguauuuccaaaaaaaauuaucuuguaaguagcuuguca

SEQ ID NO: 29993 - RNA, 64 nt, hsa
caaaauuauuaauuuuauuaggcuuuuggaaaagaaaaaaaacuuuuugauguuuuaggugauu

SEQ ID NO: 29994 - RNA, 64 nt, hsa
gagcuguuauguaacacuguauauaaaugguugcaaaaaaaaaaaaaagucagugcuucuaaaa

SEQ ID NO: 29995 - RNA, 64 nt, hsa
agcuguuauguaacacuguauauaaaugguugcaaaaaaaaaaaaaagucagugcuucuaaaaa

SEQ ID NO: 29996 - RNA, 64 nt, hsa
gcuguuauguaacacuguauauaaaugguugcaaaaaaaaaaaaaagucagugcuucuaaaaag

SEQ ID NO: 29997 - RNA, 64 nt, hsa
cuguuauguaacacuguauauaaaugguugcaaaaaaaaaaaaaagucagugcuucuaaaaaga

SEQ ID NO: 29998 - RNA, 64 nt, hsa
uguuauguaacacuguauauaaaugguugcaaaaaaaaaaaaaagucagugcuucuaaaaagaa

SEQ ID NO: 29999 - RNA, 64 nt, hsa
guuauguaacacuguauauaaaugguugcaaaaaaaaaaaaaagucagugcuucuaaaaagaau

SEQ ID NO: 30000 - RNA, 64 nt, hsa
uuauguaacacuguauauaaaugguugcaaaaaaaaaaaaaagucagugcuucuaaaaagaauu

SEQ ID NO: 30001 - RNA, 64 nt, hsa
guugguuuuauuuggagguuugugggcuuuuuuuaaaaaaaaaaaguccucaaaucaggaagaa

SEQ ID NO: 30002 - RNA, 64 nt, hsa
uugguuuuauuuggagguuugugggcuuuuuuuaaaaaaaaaaaguccucaaaucaggaagaaa

SEQ ID NO: 30003 - RNA, 64 nt, hsa
ugguuuuauuuggagguuugugggcuuuuuuuaaaaaaaaaaaguccucaaaucaggaagaaac

SEQ ID NO: 30004 - RNA, 64 nt, hsa
gguuuuauuuggagguuugugggcuuuuuuuaaaaaaaaaaaguccucaaaucaggaagaaaca

SEQ ID NO: 30005 - RNA, 64 nt, hsa
ccuaaguauaaaugguugucuguuuuuguaacuuaaaaaaaaaaaaaaaaguuuggccgggugc

SEQ ID NO: 30006 - RNA, 64 nt, hsa
cuaaguauaaaugguugucuguuuuuguaacuuaaaaaaaaaaaaaaaaguuuggccgggugcg

SEQ ID NO: 30007 - RNA, 64 nt, hsa
uaaguauaaaugguugucuguuuuuguaacuuaaaaaaaaaaaaaaaaguuuggccgggugcgg

SEQ ID NO: 30008 - RNA, 64 nt, hsa
aaguauaaaugguugucuguuuuuguaacuuaaaaaaaaaaaaaaaaguuuggccgggugcggu

SEQ ID NO: 30009 - RNA, 64 nt, hsa
aguauaaaugguugucuguuuuuguaacuuaaaaaaaaaaaaaaaaguuuggccgggugcggug

SEQ ID NO: 30010 - RNA, 64 nt, hsa
guauaaaugguugucuguuuuuguaacuuaaaaaaaaaaaaaaaaguuuggccgggugcggugg

SEQ ID NO: 30011 - RNA, 64 nt, hsa
uauaaaugguugucuguuuuuguaacuuaaaaaaaaaaaaaaaaguuuggccgggugcgguggc

SEQ ID NO: 30012 - RNA, 64 nt, hsa
auaaaugguugucuguuuuuguaacuuaaaaaaaaaaaaaaaaguuuggccgggugcgguggcu

SEQ ID NO: 30013 - RNA, 64 nt, hsa
uaaaugguugucuguuuuuguaacuuaaaaaaaaaaaaaaaaguuuggccgggugcgguggcuc

SEQ ID NO: 30014 - RNA, 64 nt, hsa
acuccggccugaugacagagcgagauuccgucuuaaaaaaaaaaaaaaaaaaguuuguuuuuaa

SEQ ID NO: 30015 - RNA, 64 nt, hsa
cuccggccugaugacagagcgagauuccgucuuaaaaaaaaaaaaaaaaaaguuuguuuuuaaa

SEQ ID NO: 30016 - RNA, 64 nt, hsa
uccggccugaugacagagcgagauuccgucuuaaaaaaaaaaaaaaaaaaguuuguuuuuaaaa

SEQ ID NO: 30017 - RNA, 64 nt, hsa
ccggccugaugacagagcgagauuccgucuuaaaaaaaaaaaaaaaaaaguuuguuuuuaaaaa

SEQ ID NO: 30018 - RNA, 64 nt, hsa
cggccugaugacagagcgagauuccgucuuaaaaaaaaaaaaaaaaaaguuuguuuuuaaaaaa

SEQ ID NO: 30019 - RNA, 64 nt, hsa
ggccugaugacagagcgagauuccgucuuaaaaaaaaaaaaaaaaaaguuuguuuuuaaaaaaa

SEQ ID NO: 30020 - RNA, 64 nt, hsa
gccugaugacagagcgagauuccgucuuaaaaaaaaaaaaaaaaaaguuuguuuuuaaaaaaau

SEQ ID NO: 30021 - RNA, 64 nt, hsa
ccugaugacagagcgagauuccgucuuaaaaaaaaaaaaaaaaaaguuuguuuuuaaaaaaauc

SEQ ID NO: 30022 - RNA, 64 nt, hsa
cugaugacagagcgagauuccgucuuaaaaaaaaaaaaaaaaaaguuuguuuuuaaaaaaaucu

SEQ ID NO: 30023 - RNA, 64 nt, hsa
ugaugacagagcgagauuccgucuuaaaaaaaaaaaaaaaaaaguuuguuuuuaaaaaaaucua

SEQ ID NO: 30024 - RNA, 64 nt, hsa
gaugacagagcgagauuccgucuuaaaaaaaaaaaaaaaaaaguuuguuuuuaaaaaaaucuaa

SEQ ID NO: 30025 - RNA, 64 nt, hsa
acccagccugggccacagugcaagacuccaucucaaaaaaaaaagaaaagaaaaagccuguuua

SEQ ID NO: 30026 - RNA, 64 nt, hsa
cccagccugggccacagugcaagacuccaucucaaaaaaaaaagaaaagaaaaagccuguuuaa

SEQ ID NO: 30027 - RNA, 64 nt, hsa
ccagccugggccacagugcaagacuccaucucaaaaaaaaaagaaaagaaaaagccuguuuaau

SEQ ID NO: 30028 - RNA, 64 nt, hsa
acgaugcaagcccguuguguuuccgagcuuuuuuaaaaaaaaauuuguagcaccgggcauggug

SEQ ID NO: 30029 - RNA, 64 nt, hsa
cgaugcaagcccguuguguuuccgagcuuuuuuaaaaaaaaauuuguagcaccgggcauggugc

SEQ ID NO: 30030 - RNA, 64 nt, hsa
gagaucaauaagaaauguucaggagagaggaaagaaaaaaaauauaugcuccacaauuuauauu

SEQ ID NO: 30031 - RNA, 64 nt, hsa
ccccauuuccuccucuuucccucuccccgcugccaaaaaaaaaaaaaaaggaaacguuuaucau

SEQ ID NO: 30032 - RNA, 64 nt, hsa
cccauuuccuccucuuucccucuccccgcugccaaaaaaaaaaaaaaaggaaacguuuaucaug

SEQ ID NO: 30033 - RNA, 64 nt, hsa
ccauuuccuccucuuucccucuccccgcugccaaaaaaaaaaaaaaaggaaacguuuaucauga

SEQ ID NO: 30034 - RNA, 64 nt, hsa
cauuuccuccucuuucccucuccccgcugccaaaaaaaaaaaaaaaggaaacguuuaucaugaa

SEQ ID NO: 30035 - RNA, 64 nt, hsa
auuuccuccucuuucccucuccccgcugccaaaaaaaaaaaaaaaggaaacguuuaucaugaau

SEQ ID NO: 30036 - RNA, 64 nt, hsa
uuuccuccucuuucccucuccccgcugccaaaaaaaaaaaaaaaggaaacguuuaucaugaauc

SEQ ID NO: 30037 - RNA, 64 nt, hsa
uuccuccucuuucccucuccccgcugccaaaaaaaaaaaaaaaggaaacguuuaucaugaauca

SEQ ID NO: 30038 - RNA, 64 nt, hsa
uccuccucuuucccucuccccgcugccaaaaaaaaaaaaaaaggaaacguuuaucaugaaucaa

SEQ ID NO: 30039 - RNA, 64 nt, hsa
caauguauauucuaaauaaagucaucuaacuauuaaaaaaaaaacacccuuccuaacccuucuu

SEQ ID NO: 30040 - RNA, 64 nt, hsa
aauguauauucuaaauaaagucaucuaacuauuaaaaaaaaaacacccuuccuaacccuucuuu

SEQ ID NO: 30041 - RNA, 64 nt, hsa
auguauauucuaaauaaagucaucuaacuauuaaaaaaaaaacacccuuccuaacccuucuuuu

SEQ ID NO: 30042 - RNA, 64 nt, hsa
ucagauuugaaauacugcaauaaugguugucuuuaaaaaaaaaaaagaaauguacuguuaaggu

SEQ ID NO: 30043 - RNA, 64 nt, hsa
cagauuugaaauacugcaauaaugguugucuuuaaaaaaaaaaaagaaauguacuguuaaggua

SEQ ID NO: 30044 - RNA, 64 nt, hsa
agauuugaaauacugcaauaaugguugucuuuaaaaaaaaaaaagaaauguacuguuaagguau

SEQ ID NO: 30045 - RNA, 64 nt, hsa
gauuugaaauacugcaauaaugguugucuuuaaaaaaaaaaaagaaauguacuguuaagguauu

SEQ ID NO: 30046 - RNA, 64 nt, hsa
auuugaaauacugcaauaaugguugucuuuaaaaaaaaaaaagaaauguacuguuaagguauua

SEQ ID NO: 30047 - RNA, 64 nt, hsa
ccugggugaaagagcgagacuccgucucaaaaacaaaaaaaaaagaaaagaaauauauuuuauu

SEQ ID NO: 30048 - RNA, 64 nt, hsa
cugggugaaagagcgagacuccgucucaaaaacaaaaaaaaaagaaaagaaauauauuuuauuc

SEQ ID NO: 30049 - RNA, 64 nt, hsa
ugggugaaagagcgagacuccgucucaaaaacaaaaaaaaaagaaaagaaauauauuuuauuca

SEQ ID NO: 30050 - RNA, 64 nt, hsa
cgugagccacugcgcccgggcaagaccuuuuuuuaaaaaaaaaaaaaaaaaaacuuccauucuu

SEQ ID NO: 30051 - RNA, 64 nt, hsa
gugagccacugcgcccgggcaagaccuuuuuuuaaaaaaaaaaaaaaaaaaacuuccauucuuu

SEQ ID NO: 30052 - RNA, 64 nt, hsa
ugagccacugcgcccgggcaagaccuuuuuuuaaaaaaaaaaaaaaaaaaacuuccauucuuuc

SEQ ID NO: 30053 - RNA, 64 nt, hsa
gagccacugcgcccgggcaagaccuuuuuuuaaaaaaaaaaaaaaaaaaacuuccauucuuucu

SEQ ID NO: 30054 - RNA, 64 nt, hsa
agccacugcgcccgggcaagaccuuuuuuuaaaaaaaaaaaaaaaaaaacuuccauucuuucuu

SEQ ID NO: 30055 - RNA, 64 nt, hsa
gccacugcgcccgggcaagaccuuuuuuuaaaaaaaaaaaaaaaaaaacuuccauucuuucuuc

SEQ ID NO: 30056 - RNA, 64 nt, hsa
ccacugcgcccgggcaagaccuuuuuuuaaaaaaaaaaaaaaaaaaacuuccauucuuucuucc

SEQ ID NO: 30057 - RNA, 64 nt, hsa
cacugcgcccgggcaagaccuuuuuuuaaaaaaaaaaaaaaaaaaacuuccauucuuucuuccu

SEQ ID NO: 30058 - RNA, 64 nt, hsa
acugcgcccgggcaagaccuuuuuuuaaaaaaaaaaaaaaaaaaacuuccauucuuucuuccuc

SEQ ID NO: 30059 - RNA, 64 nt, hsa
cugcgcccgggcaagaccuuuuuuuaaaaaaaaaaaaaaaaaaacuuccauucuuucuuccucc

SEQ ID NO: 30060 - RNA, 64 nt, hsa
ugcgcccgggcaagaccuuuuuuuaaaaaaaaaaaaaaaaaaacuuccauucuuucuuccucca

SEQ ID NO: 30061 - RNA, 64 nt, hsa
gcgcccgggcaagaccuuuuuuuaaaaaaaaaaaaaaaaaaacuuccauucuuucuuccuccag

SEQ ID NO: 30062 - RNA, 64 nt, hsa
cccaugcugccaaguuguagcuauagcuacaaauaaaaaaaaaccuuguuuuccagaauucuca

SEQ ID NO: 30063 - RNA, 64 nt, hsa
ccaugcugccaaguuguagcuauagcuacaaauaaaaaaaaaccuuguuuuccagaauucucag

SEQ ID NO: 30064 - RNA, 64 nt, hsa
uggaauauaauggaauauucuugagacugaucacaaaaaaaaaaaccuuuuuaauauuucuuua

SEQ ID NO: 30065 - RNA, 64 nt, hsa
ggaauauaauggaauauucuugagacugaucacaaaaaaaaaaaccuuuuuaauauuucuuuau

SEQ ID NO: 30066 - RNA, 64 nt, hsa
gaauauaauggaauauucuugagacugaucacaaaaaaaaaaaccuuuuuaauauuucuuuaua

SEQ ID NO: 30067 - RNA, 64 nt, hsa
aauauaauggaauauucuugagacugaucacaaaaaaaaaaaccuuuuuaauauuucuuuauag

SEQ ID NO: 30068 - RNA, 64 nt, hsa
uuccuuucuuagacuucauaggagauagugcuuuaaaaaaaaaaaaaacuucuauuauuuguuu

SEQ ID NO: 30069 - RNA, 64 nt, hsa
uccuuucuuagacuucauaggagauagugcuuuaaaaaaaaaaaaaacuucuauuauuuguuua

SEQ ID NO: 30070 - RNA, 64 nt, hsa
ccuuucuuagacuucauaggagauagugcuuuaaaaaaaaaaaaaacuucuauuauuuguuuag

SEQ ID NO: 30071 - RNA, 64 nt, hsa
cuuucuuagacuucauaggagauagugcuuuaaaaaaaaaaaaaacuucuauuauuuguuuagu

SEQ ID NO: 30072 - RNA, 64 nt, hsa
uuucuuagacuucauaggagauagugcuuuaaaaaaaaaaaaaacuucuauuauuuguuuagua

SEQ ID NO: 30073 - RNA, 64 nt, hsa
uucuuagacuucauaggagauagugcuuuaaaaaaaaaaaaaacuucuauuauuuguuuaguau

SEQ ID NO: 30074 - RNA, 64 nt, hsa
ucuuagacuucauaggagauagugcuuuaaaaaaaaaaaaaacuucuauuauuuguuuaguaug

SEQ ID NO: 30075 - RNA, 64 nt, hsa
uauccaaaagauuuuuaaaaauagggcuguguuuaaaaaaaaaaaacaaaacaagaaaagcagc

SEQ ID NO: 30076 - RNA, 64 nt, hsa
auccaaaagauuuuuaaaaauagggcuguguuuaaaaaaaaaaaacaaaacaagaaaagcagca

SEQ ID NO: 30077 - RNA, 64 nt, hsa
uccaaaagauuuuuaaaaauagggcuguguuuaaaaaaaaaaaacaaaacaagaaaagcagcag

SEQ ID NO: 30078 - RNA, 64 nt, hsa
ccaaaagauuuuuaaaaauagggcuguguuuaaaaaaaaaaaacaaaacaagaaaagcagcagu

SEQ ID NO: 30079 - RNA, 64 nt, hsa
caaaagauuuuuaaaaauagggcuguguuuaaaaaaaaaaaacaaaacaagaaaagcagcagug

SEQ ID NO: 30080 - RNA, 64 nt, hsa
gcuggacagugagacuuuugacagugagacugucaaaaaaaaaaaaaaaauuaauagauaaaac

SEQ ID NO: 30081 - RNA, 64 nt, hsa
cuggacagugagacuuuugacagugagacugucaaaaaaaaaaaaaaaauuaauagauaaaaca

SEQ ID NO: 30082 - RNA, 64 nt, hsa
uggacagugagacuuuugacagugagacugucaaaaaaaaaaaaaaaauuaauagauaaaacag

SEQ ID NO: 30083 - RNA, 64 nt, hsa
ggacagugagacuuuugacagugagacugucaaaaaaaaaaaaaaaauuaauagauaaaacagg

SEQ ID NO: 30084 - RNA, 64 nt, hsa
gacagugagacuuuugacagugagacugucaaaaaaaaaaaaaaaauuaauagauaaaacaggc

SEQ ID NO: 30085 - RNA, 64 nt, hsa
acagugagacuuuugacagugagacugucaaaaaaaaaaaaaaaauuaauagauaaaacaggcc

SEQ ID NO: 30086 - RNA, 64 nt, hsa
cagugagacuuuugacagugagacugucaaaaaaaaaaaaaaaauuaauagauaaaacaggcca

SEQ ID NO: 30087 - RNA, 64 nt, hsa
agugagacuuuugacagugagacugucaaaaaaaaaaaaaaaauuaauagauaaaacaggccac

SEQ ID NO: 30088 - RNA, 64 nt, hsa
gugagacuuuugacagugagacugucaaaaaaaaaaaaaaaauuaauagauaaaacaggccacu

SEQ ID NO: 30089 - RNA, 64 nt, hsa
aaaaauaagucagauuguuaacuccaagauugaaaaaaaaaacucuugaaagaagauuauuagu

SEQ ID NO: 30090 - RNA, 64 nt, hsa
gaaaaauaagucagauuguuaacuccaagauugaaaaaaaaaacucuugaaagaagauuauuag

SEQ ID NO: 30091 - RNA, 64 nt, hsa
agaaaaauaagucagauuguuaacuccaagauugaaaaaaaaaacucuugaaagaagauuauua

SEQ ID NO: 30092 - RNA, 64 nt, hsa
aacaaaagcaaaacucuaucuuuaaaaaaaaaaaaaaaaaaacuaagauacccauucuuucugc

SEQ ID NO: 30093 - RNA, 64 nt, hsa
caacaaaagcaaaacucuaucuuuaaaaaaaaaaaaaaaaaaacuaagauacccauucuuucug

SEQ ID NO: 30094 - RNA, 64 nt, hsa
gcaacaaaagcaaaacucuaucuuuaaaaaaaaaaaaaaaaaaacuaagauacccauucuuucu

SEQ ID NO: 30095 - RNA, 64 nt, hsa
agcaacaaaagcaaaacucuaucuuuaaaaaaaaaaaaaaaaaaacuaagauacccauucuuuc

SEQ ID NO: 30096 - RNA, 64 nt, hsa
gagcaacaaaagcaaaacucuaucuuuaaaaaaaaaaaaaaaaaaacuaagauacccauucuuu

SEQ ID NO: 30097 - RNA, 64 nt, hsa
ugagcaacaaaagcaaaacucuaucuuuaaaaaaaaaaaaaaaaaaacuaagauacccauucuu

SEQ ID NO: 30098 - RNA, 64 nt, hsa
cugagcaacaaaagcaaaacucuaucuuuaaaaaaaaaaaaaaaaaaacuaagauacccauucu

SEQ ID NO: 30099 - RNA, 64 nt, hsa
ccugagcaacaaaagcaaaacucuaucuuuaaaaaaaaaaaaaaaaaaacuaagauacccauuc

SEQ ID NO: 30100 - RNA, 64 nt, hsa
gccugagcaacaaaagcaaaacucuaucuuuaaaaaaaaaaaaaaaaaaacuaagauacccauu

SEQ ID NO: 30101 - RNA, 64 nt, hsa
agccugagcaacaaaagcaaaacucuaucuuuaaaaaaaaaaaaaaaaaaacuaagauacccau

SEQ ID NO: 30102 - RNA, 64 nt, hsa
cagccugagcaacaaaagcaaaacucuaucuuuaaaaaaaaaaaaaaaaaaacuaagauaccca

SEQ ID NO: 30103 - RNA, 64 nt, hsa
ccagccugagcaacaaaagcaaaacucuaucuuuaaaaaaaaaaaaaaaaaaacuaagauaccc

SEQ ID NO: 30104 - RNA, 64 nt, hsa
agauauguuucugauacaauagcaaacuugaaaaaaaaaaaagaaauagaagauuccugcugug

SEQ ID NO: 30105 - RNA, 64 nt, hsa
aagauauguuucugauacaauagcaaacuugaaaaaaaaaaaagaaauagaagauuccugcugu

SEQ ID NO: 30106 - RNA, 64 nt, hsa
aaagauauguuucugauacaauagcaaacuugaaaaaaaaaaaagaaauagaagauuccugcug

SEQ ID NO: 30107 - RNA, 64 nt, hsa
aaaagauauguuucugauacaauagcaaacuugaaaaaaaaaaaagaaauagaagauuccugcu

SEQ ID NO: 30108 - RNA, 64 nt, hsa
uaaaagauauguuucugauacaauagcaaacuugaaaaaaaaaaaagaaauagaagauuccugc

SEQ ID NO: 30109 - RNA, 64 nt, hsa
auuuucauagguacaaacacaagugcgccuugcaaaaaaaaacuuugacaaauugaagauggau

SEQ ID NO: 30110 - RNA, 64 nt, hsa
uauuuucauagguacaaacacaagugcgccuugcaaaaaaaaacuuugacaaauugaagaugga

SEQ ID NO: 30111 - RNA, 64 nt, hsa
uguauacuaccauagugagccaugauuuucuaaaaaaaaaaauaaauguuuuggggguguucug

SEQ ID NO: 30112 - RNA, 64 nt, hsa
uuguauacuaccauagugagccaugauuuucuaaaaaaaaaaauaaauguuuuggggguguucu

SEQ ID NO: 30113 - RNA, 64 nt, hsa
auuguauacuaccauagugagccaugauuuucuaaaaaaaaaaauaaauguuuuggggguguuc

SEQ ID NO: 30114 - RNA, 64 nt, hsa
uauuguauacuaccauagugagccaugauuuucuaaaaaaaaaaauaaauguuuuggggguguu

SEQ ID NO: 30115 - RNA, 52 nt, hsa
ugcugaagacugaauuguaaagaaaaaaaaucuccaagcccuucugucuguc

SEQ ID NO: 30116 - RNA, 64 nt, hsa
ucuuuuuuucauccuuccucugaggggaaaaacaaaaaaaaacuuaaaauacaaaaaacaacau

SEQ ID NO: 30117 - RNA, 64 nt, hsa
uucuuuuuuucauccuuccucugaggggaaaaacaaaaaaaaacuuaaaauacaaaaaacaaca

SEQ ID NO: 30118 - RNA, 64 nt, hsa
cacugaucuaaaggacauauauauaacccuuuaaaaaaaaaaucacugccucauucuuauuuca

SEQ ID NO: 30119 - RNA, 64 nt, hsa
acacugaucuaaaggacauauauauaacccuuuaaaaaaaaaaucacugccucauucuuauuuc

SEQ ID NO: 30120 - RNA, 64 nt, hsa
uacacugaucuaaaggacauauauauaacccuuuaaaaaaaaaaucacugccucauucuuauuu

SEQ ID NO: 30121 - RNA, 64 nt, hsa
caggauuucuguauacugugcaaucaguucuuugaaaaaaaagucaaaagauagagaauacaag

SEQ ID NO: 30122 - RNA, 64 nt, hsa
auuuugaagauuuuuaagcacugauaaauuaaaaaaaaaaaauuagacuccaccuuaaguagua

SEQ ID NO: 30123 - RNA, 64 nt, hsa
uauuuugaagauuuuuaagcacugauaaauuaaaaaaaaaaaauuagacuccaccuuaaguagu

SEQ ID NO: 30124 - RNA, 64 nt, hsa
cuauuuugaagauuuuuaagcacugauaaauuaaaaaaaaaaaauuagacuccaccuuaaguag

SEQ ID NO: 30125 - RNA, 64 nt, hsa
gcuauuuugaagauuuuuaagcacugauaaauuaaaaaaaaaaaauuagacuccaccuuaagua

SEQ ID NO: 30126 - RNA, 64 nt, hsa
agcuauuuugaagauuuuuaagcacugauaaauuaaaaaaaaaaaauuagacuccaccuuaagu

SEQ ID NO: 30127 - RNA, 64 nt, hsa
gccugggugacgagugaaacugucuccaaaaaaaaaaaaaaaucuagaauucuuggaaguacau

SEQ ID NO: 30128 - RNA, 64 nt, hsa
agccugggugacgagugaaacugucuccaaaaaaaaaaaaaaaucuagaauucuuggaaguaca

SEQ ID NO: 30129 - RNA, 64 nt, hsa
aagccugggugacgagugaaacugucuccaaaaaaaaaaaaaaaucuagaauucuuggaaguac

SEQ ID NO: 30130 - RNA, 64 nt, hsa
caagccugggugacgagugaaacugucuccaaaaaaaaaaaaaaaucuagaauucuuggaagua

SEQ ID NO: 30131 - RNA, 64 nt, hsa
ucaagccugggugacgagugaaacugucuccaaaaaaaaaaaaaaaucuagaauucuuggaagu

SEQ ID NO: 30132 - RNA, 64 nt, hsa
cucaagccugggugacgagugaaacugucuccaaaaaaaaaaaaaaaucuagaauucuuggaag

SEQ ID NO: 30133 - RNA, 64 nt, hsa
acucaagccugggugacgagugaaacugucuccaaaaaaaaaaaaaaaucuagaauucuuggaa

SEQ ID NO: 30134 - RNA, 64 nt, hsa
cacucaagccugggugacgagugaaacugucuccaaaaaaaaaaaaaaaucuagaauucuugga

SEQ ID NO: 30135 - RNA, 64 nt, hsa
cuauauaaaaaucauuggcacaguuacacuuaauaaaaaaaauuaaacagaagagcacccugaa

SEQ ID NO: 30136 - RNA, 64 nt, hsa
guuacguaaaguuaaaaugauuuuugucugaauaaaaaaaaagcauugcaaaugcuuuagaaau

SEQ ID NO: 30137 - RNA, 64 nt, hsa
uguuacguaaaguuaaaaugauuuuugucugaauaaaaaaaaagcauugcaaaugcuuuagaaa

SEQ ID NO: 30138 - RNA, 64 nt, hsa
aauaacauuaccuuacuguggaggaaggauuguaaaaaaaaaugccuuugagacaguuucuuag

SEQ ID NO: 30139 - RNA, 64 nt, hsa
uaauaacauuaccuuacuguggaggaaggauuguaaaaaaaaaugccuuugagacaguuucuua

SEQ ID NO: 30140 - RNA, 64 nt, hsa
ucaauaucaugaucauccaaucucaaaugugaaaaaaaaaaagaaauuugauuuuagggauugu

SEQ ID NO: 30141 - RNA, 64 nt, hsa
cucaauaucaugaucauccaaucucaaaugugaaaaaaaaaaagaaauuugauuuuagggauug

SEQ ID NO: 30142 - RNA, 64 nt, hsa
ccucaauaucaugaucauccaaucucaaaugugaaaaaaaaaaagaaauuugauuuuagggauu

SEQ ID NO: 30143 - RNA, 64 nt, hsa
cccucaauaucaugaucauccaaucucaaaugugaaaaaaaaaaagaaauuugauuuuagggau

SEQ ID NO: 30144 - RNA, 64 nt, hsa
gacagagugagacuccaucucagaaaaaaaaaaaaaaaaaaacagaaucucaguguauucucaa

SEQ ID NO: 30145 - RNA, 64 nt, hsa
cgacagagugagacuccaucucagaaaaaaaaaaaaaaaaaaacagaaucucaguguauucuca

SEQ ID NO: 30146 - RNA, 64 nt, hsa
gcgacagagugagacuccaucucagaaaaaaaaaaaaaaaaaaacagaaucucaguguauucuc

SEQ ID NO: 30147 - RNA, 64 nt, hsa
ggcgacagagugagacuccaucucagaaaaaaaaaaaaaaaaaaacagaaucucaguguauucu

SEQ ID NO: 30148 - RNA, 64 nt, hsa
gggcgacagagugagacuccaucucagaaaaaaaaaaaaaaaaaaacagaaucucaguguauuc

SEQ ID NO: 30149 - RNA, 64 nt, hsa
ugggcgacagagugagacuccaucucagaaaaaaaaaaaaaaaaaaacagaaucucaguguauu

SEQ ID NO: 30150 - RNA, 64 nt, hsa
cugggcgacagagugagacuccaucucagaaaaaaaaaaaaaaaaaaacagaaucucaguguau

SEQ ID NO: 30151 - RNA, 64 nt, hsa
ccugggcgacagagugagacuccaucucagaaaaaaaaaaaaaaaaaaacagaaucucagugua

SEQ ID NO: 30152 - RNA, 64 nt, hsa
gccugggcgacagagugagacuccaucucagaaaaaaaaaaaaaaaaaaacagaaucucagugu

SEQ ID NO: 30153 - RNA, 64 nt, hsa
agccugggcgacagagugagacuccaucucagaaaaaaaaaaaaaaaaaaacagaaucucagug

SEQ ID NO: 30154 - RNA, 64 nt, hsa
cagccugggcgacagagugagacuccaucucagaaaaaaaaaaaaaaaaaaacagaaucucagu

SEQ ID NO: 30155 - RNA, 64 nt, hsa
ccagccugggcgacagagugagacuccaucucagaaaaaaaaaaaaaaaaaaacagaaucucag

SEQ ID NO: 30156 - RNA, 64 nt, hsa
gugauuuagguuuguaacauccggcaaaacugaaaaaaaaaaucuguaaacgcgaaaaauacua

SEQ ID NO: 30157 - RNA, 64 nt, hsa
agugauuuagguuuguaacauccggcaaaacugaaaaaaaaaaucuguaaacgcgaaaaauacu

SEQ ID NO: 30158 - RNA, 64 nt, hsa
cagugauuuagguuuguaacauccggcaaaacugaaaaaaaaaaucuguaaacgcgaaaaauac

SEQ ID NO: 30159 - RNA, 64 nt, hsa
uuuuuuuuuaauugcacuucuuguaaagagugagaaaaaaaaucaaaggcgcuuugaaacaggg

SEQ ID NO: 30160 - RNA, 64 nt, hsa
acuugaaguaacuauaacaaaaaaagaaaagagaaaaaaaaacacacaaaaagucccccuucaa

SEQ ID NO: 30161 - RNA, 64 nt, hsa
uacuugaaguaacuauaacaaaaaaagaaaagagaaaaaaaaacacacaaaaagucccccuuca

SEQ ID NO: 30162 - RNA, 64 nt, hsa
uguucaucucuuuguccugaauggcuuugucuugaaaaaaaauagauguuuuaacuuauuuaua

SEQ ID NO: 30163 - RNA, 64 nt, hsa
uguaaaguagcuguaagaauuucccagugaaauaaaaaaaaauuuuaaguguucucggggaugc

SEQ ID NO: 30164 - RNA, 64 nt, hsa
uuguaaaguagcuguaagaauuucccagugaaauaaaaaaaaauuuuaaguguucucggggaug

SEQ ID NO: 30165 - RNA, 64 nt, hsa
ccuuccucuguaagauaucccagcuuuaaaaagaaaaaaaaagaauuaccaagagaaggggacu

SEQ ID NO: 30166 - RNA, 64 nt, hsa
uccuuccucuguaagauaucccagcuuuaaaaagaaaaaaaaagaauuaccaagagaaggggac

SEQ ID NO: 30167 - RNA, 64 nt, hsa
accugcuuuuuaaauauuucuacuaaaaaugaaaaaaaaaaacccuuagaccuguagauaguga

SEQ ID NO: 30168 - RNA, 64 nt, hsa
caccugcuuuuuaaauauuucuacuaaaaaugaaaaaaaaaaacccuuagaccuguagauagug

SEQ ID NO: 30169 - RNA, 64 nt, hsa
gcaccugcuuuuuaaauauuucuacuaaaaaugaaaaaaaaaaacccuuagaccuguagauagu

SEQ ID NO: 30170 - RNA, 64 nt, hsa
ugcaccugcuuuuuaaauauuucuacuaaaaaugaaaaaaaaaaacccuuagaccuguagauag

SEQ ID NO: 30171 - RNA, 64 nt, hsa
uuggaauugucucuaaaugcaucaagcauacaauaaaaaaaacugaaauuaacauccaguggag

SEQ ID NO: 30172 - RNA, 64 nt, hsa
gauggaaaaugcuauuggcagggaauaauaauaaaaaaaaaagaaaaucauucuguuuccugca

SEQ ID NO: 30173 - RNA, 64 nt, hsa
agauggaaaaugcuauuggcagggaauaauaauaaaaaaaaaagaaaaucauucuguuuccugc

SEQ ID NO: 30174 - RNA, 64 nt, hsa
uagauggaaaaugcuauuggcagggaauaauaauaaaaaaaaaagaaaaucauucuguuuccug

SEQ ID NO: 30175 - RNA, 64 nt, hsa
acuccucaccguaucuuuuaacccauuuaaaaaaaaaaaaaagcuaaaauuagaaaaauaacuc

SEQ ID NO: 30176 - RNA, 64 nt, hsa
cacuccucaccguaucuuuuaacccauuuaaaaaaaaaaaaaagcuaaaauuagaaaaauaacu

SEQ ID NO: 30177 - RNA, 64 nt, hsa
acacuccucaccguaucuuuuaacccauuuaaaaaaaaaaaaaagcuaaaauuagaaaaauaac

SEQ ID NO: 30178 - RNA, 64 nt, hsa
cacacuccucaccguaucuuuuaacccauuuaaaaaaaaaaaaaagcuaaaauuagaaaaauaa

SEQ ID NO: 30179 - RNA, 64 nt, hsa
acacacuccucaccguaucuuuuaacccauuuaaaaaaaaaaaaaagcuaaaauuagaaaaaua

SEQ ID NO: 30180 - RNA, 64 nt, hsa
aacacacuccucaccguaucuuuuaacccauuuaaaaaaaaaaaaaagcuaaaauuagaaaaau

SEQ ID NO: 30181 - RNA, 64 nt, hsa
caacacacuccucaccguaucuuuuaacccauuuaaaaaaaaaaaaaagcuaaaauuagaaaaa

SEQ ID NO: 30182 - RNA, 64 nt, hsa
aauagaaauuaaaaacaaaacaaaaaaaaaaacaaaaaaaaacaaaaguaaauuaaaaacaaaa

SEQ ID NO: 30183 - RNA, 64 nt, hsa
aaauagaaauuaaaaacaaaacaaaaaaaaaaacaaaaaaaaacaaaaguaaauuaaaaacaaa

SEQ ID NO: 30184 - RNA, 64 nt, hsa
uaaccagaaaaauagaaauuaaaaacaaaacaaaaaaaaaaacaaaaaaaaacaaaaguaaauu

SEQ ID NO: 30185 - RNA, 64 nt, hsa
uuaaccagaaaaauagaaauuaaaaacaaaacaaaaaaaaaaacaaaaaaaaacaaaaguaaau

SEQ ID NO: 30186 - RNA, 64 nt, hsa
guuaaccagaaaaauagaaauuaaaaacaaaacaaaaaaaaaaacaaaaaaaaacaaaaguaaa

SEQ ID NO: 30187 - RNA, 64 nt, hsa
aguuaaccagaaaaauagaaauuaaaaacaaaacaaaaaaaaaaacaaaaaaaaacaaaaguaa

SEQ ID NO: 30188 - RNA, 64 nt, hsa
aaaaaaaaaaaaacaagaugacgacgacaaccacaaaaaaaauugacaucagaugaaaugaaaa

SEQ ID NO: 30189 - RNA, 64 nt, hsa
augugauuuguuaaaaaaaaacaaaaaaaaaaaaaaaaaaaacaagaugacgacgacaaccaca

SEQ ID NO: 30190 - RNA, 64 nt, hsa
gaugugauuuguuaaaaaaaaacaaaaaaaaaaaaaaaaaaaacaagaugacgacgacaaccac

SEQ ID NO: 30191 - RNA, 64 nt, hsa
agaugugauuuguuaaaaaaaaacaaaaaaaaaaaaaaaaaaaacaagaugacgacgacaacca

SEQ ID NO: 30192 - RNA, 64 nt, hsa
cagaugugauuuguuaaaaaaaaacaaaaaaaaaaaaaaaaaaaacaagaugacgacgacaacc

SEQ ID NO: 30193 - RNA, 64 nt, hsa
ccagaugugauuuguuaaaaaaaaacaaaaaaaaaaaaaaaaaaaacaagaugacgacgacaac

SEQ ID NO: 30194 - RNA, 64 nt, hsa
accagaugugauuuguuaaaaaaaaacaaaaaaaaaaaaaaaaaaaacaagaugacgacgacaa

SEQ ID NO: 30195 - RNA, 64 nt, hsa
gaccagaugugauuuguuaaaaaaaaacaaaaaaaaaaaaaaaaaaaacaagaugacgacgaca

SEQ ID NO: 30196 - RNA, 64 nt, hsa
agaccagaugugauuuguuaaaaaaaaacaaaaaaaaaaaaaaaaaaaacaagaugacgacgac

SEQ ID NO: 30197 - RNA, 64 nt, hsa
aagaccagaugugauuuguuaaaaaaaaacaaaaaaaaaaaaaaaaaaaacaagaugacgacga

SEQ ID NO: 30198 - RNA, 64 nt, hsa
caagaccagaugugauuuguuaaaaaaaaacaaaaaaaaaaaaaaaaaaaacaagaugacgacg

SEQ ID NO: 30199 - RNA, 64 nt, hsa
acaagaccagaugugauuuguuaaaaaaaaacaaaaaaaaaaaaaaaaaaaacaagaugacgac

SEQ ID NO: 30200 - RNA, 64 nt, hsa
aacaagaccagaugugauuuguuaaaaaaaaacaaaaaaaaaaaaaaaaaaaacaagaugacga

SEQ ID NO: 30201 - RNA, 64 nt, hsa
aaacaagaccagaugugauuuguuaaaaaaaaacaaaaaaaaaaaaaaaaaaaacaagaugacg

SEQ ID NO: 30202 - RNA, 64 nt, hsa
ucugcagaaaaacaagaccagaugugauuuguuaaaaaaaaacaaaaaaaaaaaaaaaaaaaac

SEQ ID NO: 30203 - RNA, 64 nt, hsa
gucugcagaaaaacaagaccagaugugauuuguuaaaaaaaaacaaaaaaaaaaaaaaaaaaaa

SEQ ID NO: 30204 - RNA, 64 nt, hsa
augcuccaugaugcuguguguuuugguaguaagaaaaaaaaauugggaggcuuuucaaaggugg

SEQ ID NO: 30205 - RNA, 64 nt, hsa
uaugcuccaugaugcuguguguuuugguaguaagaaaaaaaaauugggaggcuuuucaaaggug

SEQ ID NO: 30206 - RNA, 64 nt, hsa
aaugugcuugggucccacgugacugaucugacaaaaaaaaaagagggauauuaccauggcaacc

SEQ ID NO: 30207 - RNA, 64 nt, hsa
gaaugugcuugggucccacgugacugaucugacaaaaaaaaaagagggauauuaccauggcaac

SEQ ID NO: 30208 - RNA, 64 nt, hsa
agaaugugcuugggucccacgugacugaucugacaaaaaaaaaagagggauauuaccauggcaa

SEQ ID NO: 30209 - RNA, 64 nt, hsa
agccugggucacagagugagacuccaucucaaaaaaaaaaaagagagagagagagaaagaaaua

SEQ ID NO: 30210 - RNA, 64 nt, hsa
cagccugggucacagagugagacuccaucucaaaaaaaaaaaagagagagagagagaaagaaau

SEQ ID NO: 30211 - RNA, 64 nt, hsa
ccagccugggucacagagugagacuccaucucaaaaaaaaaaaagagagagagagagaaagaaa

SEQ ID NO: 30212 - RNA, 64 nt, hsa
uccagccugggucacagagugagacuccaucucaaaaaaaaaaaagagagagagagagaaagaa

SEQ ID NO: 30213 - RNA, 64 nt, hsa
cuccagccugggucacagagugagacuccaucucaaaaaaaaaaaagagagagagagagaaaga

SEQ ID NO: 30214 - RNA, 64 nt, hsa
cggccugggugacagagugagacccugucucaaaaaaaaaaagauucugugucagagcccagcc

SEQ ID NO: 30215 - RNA, 64 nt, hsa
ccggccugggugacagagugagacccugucucaaaaaaaaaaagauucugugucagagcccagc

SEQ ID NO: 30216 - RNA, 64 nt, hsa
uccggccugggugacagagugagacccugucucaaaaaaaaaaagauucugugucagagcccag

SEQ ID NO: 30217 - RNA, 64 nt, hsa
cuccggccugggugacagagugagacccugucucaaaaaaaaaaagauucugugucagagccca

SEQ ID NO: 30218 - RNA, 64 nt, hsa
ugggcaacaagagcaaaacuccgucucaaaaaaaaaaaaaaauuacaaauggggcaaacagucu

SEQ ID NO: 30219 - RNA, 64 nt, hsa
cugggcaacaagagcaaaacuccgucucaaaaaaaaaaaaaaauuacaaauggggcaaacaguc

SEQ ID NO: 30220 - RNA, 64 nt, hsa
ccugggcaacaagagcaaaacuccgucucaaaaaaaaaaaaaaauuacaaauggggcaaacagu

SEQ ID NO: 30221 - RNA, 64 nt, hsa
gccugggcaacaagagcaaaacuccgucucaaaaaaaaaaaaaaauuacaaauggggcaaacag

SEQ ID NO: 30222 - RNA, 64 nt, hsa
agccugggcaacaagagcaaaacuccgucucaaaaaaaaaaaaaaauuacaaauggggcaaaca

SEQ ID NO: 30223 - RNA, 64 nt, hsa
cagccugggcaacaagagcaaaacuccgucucaaaaaaaaaaaaaaauuacaaauggggcaaac

SEQ ID NO: 30224 - RNA, 64 nt, hsa
ccagccugggcaacaagagcaaaacuccgucucaaaaaaaaaaaaaaauuacaaauggggcaaa

SEQ ID NO: 30225 - RNA, 64 nt, hsa
uccagccugggcaacaagagcaaaacuccgucucaaaaaaaaaaaaaaauuacaaauggggcaa

SEQ ID NO: 30226 - RNA, 64 nt, hsa
ccucugacuuuauuuuccauguauuacaaaaggaaaaaaaaauugagauuacacuggcauaaac

SEQ ID NO: 30227 - RNA, 64 nt, hsa
uccucugacuuuauuuuccauguauuacaaaaggaaaaaaaaauugagauuacacuggcauaaa

SEQ ID NO: 30228 - RNA, 64 nt, hsa
aucaaaucauauuucuguacauuuucagugguagaaaaaaaagguuuuaaaaauuguauccuag

SEQ ID NO: 30229 - RNA, 64 nt, hsa
cagagagacagugcaguguagcuuuaguuuaagaaaaaaaaauauuccuccccacugcaugaag

SEQ ID NO: 30230 - RNA, 64 nt, hsa
acagagagacagugcaguguagcuuuaguuuaagaaaaaaaaauauuccuccccacugcaugaa

SEQ ID NO: 30231 - RNA, 64 nt, hsa
auugggaauggauaauuuagaaacaaaccaaaaaaaaaaaaagauauuugaaguguuuuuauag

SEQ ID NO: 30232 - RNA, 64 nt, hsa
uauugggaauggauaauuuagaaacaaaccaaaaaaaaaaaaagauauuugaaguguuuuuaua

SEQ ID NO: 30233 - RNA, 64 nt, hsa
uuauugggaauggauaauuuagaaacaaaccaaaaaaaaaaaaagauauuugaaguguuuuuau

SEQ ID NO: 30234 - RNA, 64 nt, hsa
cuuauugggaauggauaauuuagaaacaaaccaaaaaaaaaaaaagauauuugaaguguuuuua

SEQ ID NO: 30235 - RNA, 64 nt, hsa
ccuuauugggaauggauaauuuagaaacaaaccaaaaaaaaaaaaagauauuugaaguguuuuu

SEQ ID NO: 30236 - RNA, 64 nt, hsa
accuuauugggaauggauaauuuagaaacaaaccaaaaaaaaaaaaagauauuugaaguguuuu

SEQ ID NO: 30237 - RNA, 64 nt, hsa
gcucaaagcaauuaagugggaacauuuuuaauuuaaaaaaaauuuccaaauauuuguggguccg

SEQ ID NO: 30238 - RNA, 64 nt, hsa
guauaaguagcugccaauuuguaauucaucuguuaaaaaaaaucuagauuauaacaaacugcua

SEQ ID NO: 30239 - RNA, 64 nt, hsa
cugggugacacagcaagacuccaucucaaaaaaaaaaaaaaauuacuuucaacaaggcauauag

SEQ ID NO: 30240 - RNA, 64 nt, hsa
ccugggugacacagcaagacuccaucucaaaaaaaaaaaaaaauuacuuucaacaaggcauaua

SEQ ID NO: 30241 - RNA, 64 nt, hsa
gccugggugacacagcaagacuccaucucaaaaaaaaaaaaaaauuacuuucaacaaggcauau

SEQ ID NO: 30242 - RNA, 64 nt, hsa
agccugggugacacagcaagacuccaucucaaaaaaaaaaaaaaauuacuuucaacaaggcaua

SEQ ID NO: 30243 - RNA, 64 nt, hsa
uagccugggugacacagcaagacuccaucucaaaaaaaaaaaaaaauuacuuucaacaaggcau

SEQ ID NO: 30244 - RNA, 64 nt, hsa
cuagccugggugacacagcaagacuccaucucaaaaaaaaaaaaaaauuacuuucaacaaggca

SEQ ID NO: 30245 - RNA, 64 nt, hsa
gcuagccugggugacacagcaagacuccaucucaaaaaaaaaaaaaaauuacuuucaacaaggc

SEQ ID NO: 30246 - RNA, 64 nt, hsa
cgcuagccugggugacacagcaagacuccaucucaaaaaaaaaaaaaaauuacuuucaacaagg

SEQ ID NO: 30247 - RNA, 64 nt, hsa
auuuucucuuguaaaacauuuagaaaacaaaaacaaaaaaaaugugauuuguuucugucuucaa

SEQ ID NO: 30248 - RNA, 64 nt, hsa
uagcuuaucaacuccccuccaaacaaacaauuaaaaaaaaaacauacagacacucaaauuccac

SEQ ID NO: 30249 - RNA, 64 nt, hsa
uuagcuuaucaacuccccuccaaacaaacaauuaaaaaaaaaacauacagacacucaaauucca

SEQ ID NO: 30250 - RNA, 64 nt, hsa
auuagcuuaucaacuccccuccaaacaaacaauuaaaaaaaaaacauacagacacucaaauucc

SEQ ID NO: 30251 - RNA, 64 nt, hsa
agccugggcaacagcgugagacuucaucucaaaaaaaaaaaauuguauuuguacuuuuaaaggg

SEQ ID NO: 30252 - RNA, 64 nt, hsa
cagccugggcaacagcgugagacuucaucucaaaaaaaaaaaauuguauuuguacuuuuaaagg

SEQ ID NO: 30253 - RNA, 64 nt, hsa
ccagccugggcaacagcgugagacuucaucucaaaaaaaaaaaauuguauuuguacuuuuaaag

SEQ ID NO: 30254 - RNA, 64 nt, hsa
uccagccugggcaacagcgugagacuucaucucaaaaaaaaaaaauuguauuuguacuuuuaaa

SEQ ID NO: 30255 - RNA, 64 nt, hsa
uuccagccugggcaacagcgugagacuucaucucaaaaaaaaaaaauuguauuuguacuuuuaa

SEQ ID NO: 30256 - RNA, 63 nt, hsa
aaugcagagaaagagcaaagcccaaaagggagaaaaaaaaaacaaaaaaacaaaaaaacgaag

SEQ ID NO: 30257 - RNA, 64 nt, hsa
uaaugcagagaaagagcaaagcccaaaagggagaaaaaaaaaacaaaaaaacaaaaaaacgaag

SEQ ID NO: 30258 - RNA, 64 nt, hsa
uuaaugcagagaaagagcaaagcccaaaagggagaaaaaaaaaacaaaaaaacaaaaaaacgaa

SEQ ID NO: 30259 - RNA, 64 nt, hsa
ccagcuugggcaacagagcaagacuccaucucaaaaaaaaaagaguucuagcccaggagcggug

SEQ ID NO: 30260 - RNA, 64 nt, hsa
uccagcuugggcaacagagcaagacuccaucucaaaaaaaaaagaguucuagcccaggagcggu

SEQ ID NO: 30261 - RNA, 64 nt, hsa
cuccagcuugggcaacagagcaagacuccaucucaaaaaaaaaagaguucuagcccaggagcgg

SEQ ID NO: 30262 - RNA, 64 nt, hsa
caaaaccuagucccuaaaauuaaaaaaaaaaaaaaaaaaaaaggaaaauaaaggagacuugaaa

SEQ ID NO: 30263 - RNA, 64 nt, hsa
gcaaaaccuagucccuaaaauuaaaaaaaaaaaaaaaaaaaaaggaaaauaaaggagacuugaa

SEQ ID NO: 30264 - RNA, 64 nt, hsa
agcaaaaccuagucccuaaaauuaaaaaaaaaaaaaaaaaaaaaggaaaauaaaggagacuuga

SEQ ID NO: 30265 - RNA, 64 nt, hsa
uagcaaaaccuagucccuaaaauuaaaaaaaaaaaaaaaaaaaaaggaaaauaaaggagacuug

SEQ ID NO: 30266 - RNA, 64 nt, hsa
auagcaaaaccuagucccuaaaauuaaaaaaaaaaaaaaaaaaaaaggaaaauaaaggagacuu

SEQ ID NO: 30267 - RNA, 64 nt, hsa
cauagcaaaaccuagucccuaaaauuaaaaaaaaaaaaaaaaaaaaaggaaaauaaaggagacu

SEQ ID NO: 30268 - RNA, 64 nt, hsa
acauagcaaaaccuagucccuaaaauuaaaaaaaaaaaaaaaaaaaaaggaaaauaaaggagac

SEQ ID NO: 30269 - RNA, 64 nt, hsa
aacauagcaaaaccuagucccuaaaauuaaaaaaaaaaaaaaaaaaaaaggaaaauaaaggaga

SEQ ID NO: 30270 - RNA, 64 nt, hsa
caacauagcaaaaccuagucccuaaaauuaaaaaaaaaaaaaaaaaaaaaggaaaauaaaggag

SEQ ID NO: 30271 - RNA, 64 nt, hsa
gcaacauagcaaaaccuagucccuaaaauuaaaaaaaaaaaaaaaaaaaaaggaaaauaaagga

SEQ ID NO: 30272 - RNA, 64 nt, hsa
ggcaacauagcaaaaccuagucccuaaaauuaaaaaaaaaaaaaaaaaaaaaggaaaauaaagg

SEQ ID NO: 30273 - RNA, 64 nt, hsa
gggcaacauagcaaaaccuagucccuaaaauuaaaaaaaaaaaaaaaaaaaaaggaaaauaaag

SEQ ID NO: 30274 - RNA, 64 nt, hsa
ugggcaacauagcaaaaccuagucccuaaaauuaaaaaaaaaaaaaaaaaaaaaggaaaauaaa

SEQ ID NO: 30275 - RNA, 64 nt, hsa
cugggcaacauagcaaaaccuagucccuaaaauuaaaaaaaaaaaaaaaaaaaaaggaaaauaa

SEQ ID NO: 30276 - RNA, 64 nt, hsa
gggcaacauggugaccucccgucucucucggaaaaaaaaaaagaaaaaagaaaaagccggguga

SEQ ID NO: 30277 - RNA, 64 nt, hsa
ugggcaacauggugaccucccgucucucucggaaaaaaaaaaagaaaaaagaaaaagccgggug

SEQ ID NO: 30278 - RNA, 64 nt, hsa
cugggcaacauggugaccucccgucucucucggaaaaaaaaaaagaaaaaagaaaaagccgggu

SEQ ID NO: 30279 - RNA, 64 nt, hsa
ccugggcaacauggugaccucccgucucucucggaaaaaaaaaaagaaaaaagaaaaagccggg

SEQ ID NO: 30280 - RNA, 64 nt, hsa
cugggcgacaaaucaagaccccgucuccaaaaaaaaaaaaaacaaaacuugauugggauccaaa

SEQ ID NO: 30281 - RNA, 64 nt, hsa
ccugggcgacaaaucaagaccccgucuccaaaaaaaaaaaaaacaaaacuugauugggauccaa

SEQ ID NO: 30282 - RNA, 64 nt, hsa
gccugggcgacaaaucaagaccccgucuccaaaaaaaaaaaaaacaaaacuugauugggaucca

SEQ ID NO: 30283 - RNA, 64 nt, hsa
agccugggcgacaaaucaagaccccgucuccaaaaaaaaaaaaaacaaaacuugauugggaucc

SEQ ID NO: 30284 - RNA, 64 nt, hsa
cagccugggcgacaaaucaagaccccgucuccaaaaaaaaaaaaaacaaaacuugauugggauc

SEQ ID NO: 30285 - RNA, 64 nt, hsa
ccagccugggcgacaaaucaagaccccgucuccaaaaaaaaaaaaaacaaaacuugauugggau

SEQ ID NO: 30286 - RNA, 64 nt, hsa
uccagccugggcgacaaaucaagaccccgucuccaaaaaaaaaaaaaacaaaacuugauuggga

SEQ ID NO: 30287 - RNA, 64 nt, hsa
gagugggagccugacagacaccacuauuaaaaaaaaaaaaaauccccaaaaugauuccaauaga

SEQ ID NO: 30288 - RNA, 64 nt, hsa
ggagugggagccugacagacaccacuauuaaaaaaaaaaaaaauccccaaaaugauuccaauag

SEQ ID NO: 30289 - RNA, 64 nt, hsa
aggagugggagccugacagacaccacuauuaaaaaaaaaaaaaauccccaaaaugauuccaaua

SEQ ID NO: 30290 - RNA, 64 nt, hsa
uaggagugggagccugacagacaccacuauuaaaaaaaaaaaaaauccccaaaaugauuccaau

SEQ ID NO: 30291 - RNA, 64 nt, hsa
cuaggagugggagccugacagacaccacuauuaaaaaaaaaaaaaauccccaaaaugauuccaa

SEQ ID NO: 30292 - RNA, 64 nt, hsa
ucuaggagugggagccugacagacaccacuauuaaaaaaaaaaaaaauccccaaaaugauucca

SEQ ID NO: 30293 - RNA, 64 nt, hsa
gucuaggagugggagccugacagacaccacuauuaaaaaaaaaaaaaauccccaaaaugauucc

SEQ ID NO: 30294 - RNA, 64 nt, hsa
cucuaucucuguacuccuauaugaagagaacaguaaaaaaaauuacugguauuuauuugguuaa

SEQ ID NO: 30295 - RNA, 64 nt, hsa
aguaaguguggguagcaaaaacaauuaucuuuaaaaaaaaaaucacaucaguauaggccaucaa

SEQ ID NO: 30296 - RNA, 64 nt, hsa
aaguaaguguggguagcaaaaacaauuaucuuuaaaaaaaaaaucacaucaguauaggccauca

SEQ ID NO: 30297 - RNA, 64 nt, hsa
caaguaaguguggguagcaaaaacaauuaucuuuaaaaaaaaaaucacaucaguauaggccauc

SEQ ID NO: 30298 - RNA, 64 nt, hsa
cauacccuacuuuuucuguaccuaaauuuucuuaaaaaaaaaucuaguauagcacuacauucuu

SEQ ID NO: 30299 - RNA, 64 nt, hsa
ucauacccuacuuuuucuguaccuaaauuuucuuaaaaaaaaaucuaguauagcacuacauucu

SEQ ID NO: 30300 - RNA, 64 nt, hsa
ucuuugcagaauuaucuuauuaaaaaaaaauacaaaaaaaaagcaccaugaauuuguacugugc

SEQ ID NO: 30301 - RNA, 64 nt, hsa
gucuuugcagaauuaucuuauuaaaaaaaaauacaaaaaaaaagcaccaugaauuuguacugug

SEQ ID NO: 30302 - RNA, 64 nt, hsa
agccgagagcugucuuugcagaauuaucuuauuaaaaaaaaauacaaaaaaaaagcaccaugaa

SEQ ID NO: 30303 - RNA, 64 nt, hsa
aagccgagagcugucuuugcagaauuaucuuauuaaaaaaaaauacaaaaaaaaagcaccauga

SEQ ID NO: 30304 - RNA, 64 nt, hsa
guauaugcuuauauauuaagucuaugggcugguuaaaaaaaacagauuauauuaaaauuuaaag

SEQ ID NO: 30305 - RNA, 64 nt, hsa
uauuuucucgccaccaaaaaaaaaaaaaaaaaaaaaaaaaaaugcaccacaguauuucuagcau

SEQ ID NO: 30306 - RNA, 64 nt, hsa
cuauuuucucgccaccaaaaaaaaaaaaaaaaaaaaaaaaaaaugcaccacaguauuucuagca

SEQ ID NO: 30307 - RNA, 64 nt, hsa
acuauuuucucgccaccaaaaaaaaaaaaaaaaaaaaaaaaaaaugcaccacaguauuucuagc

SEQ ID NO: 30308 - RNA, 64 nt, hsa
uacuauuuucucgccaccaaaaaaaaaaaaaaaaaaaaaaaaaaaugcaccacaguauuucuag

SEQ ID NO: 30309 - RNA, 64 nt, hsa
guacuauuuucucgccaccaaaaaaaaaaaaaaaaaaaaaaaaaaaugcaccacaguauuucua

SEQ ID NO: 30310 - RNA, 64 nt, hsa
aguacuauuuucucgccaccaaaaaaaaaaaaaaaaaaaaaaaaaaaugcaccacaguauuucu

SEQ ID NO: 30311 - RNA, 64 nt, hsa
caguacuauuuucucgccaccaaaaaaaaaaaaaaaaaaaaaaaaaaaugcaccacaguauuuc

SEQ ID NO: 30312 - RNA, 64 nt, hsa
acaguacuauuuucucgccaccaaaaaaaaaaaaaaaaaaaaaaaaaaaugcaccacaguauuu

SEQ ID NO: 30313 - RNA, 64 nt, hsa
aacaguacuauuuucucgccaccaaaaaaaaaaaaaaaaaaaaaaaaaaaugcaccacaguauu

SEQ ID NO: 30314 - RNA, 64 nt, hsa
uaacaguacuauuuucucgccaccaaaaaaaaaaaaaaaaaaaaaaaaaaaugcaccacaguau

SEQ ID NO: 30315 - RNA, 64 nt, hsa
uuaacaguacuauuuucucgccaccaaaaaaaaaaaaaaaaaaaaaaaaaaaugcaccacagua

SEQ ID NO: 30316 - RNA, 64 nt, hsa
cuuaacaguacuauuuucucgccaccaaaaaaaaaaaaaaaaaaaaaaaaaaaugcaccacagu

SEQ ID NO: 30317 - RNA, 64 nt, hsa
ccuuaacaguacuauuuucucgccaccaaaaaaaaaaaaaaaaaaaaaaaaaaaugcaccacag

SEQ ID NO: 30318 - RNA, 64 nt, hsa
gccuuaacaguacuauuuucucgccaccaaaaaaaaaaaaaaaaaaaaaaaaaaaugcaccaca

SEQ ID NO: 30319 - RNA, 64 nt, hsa
ugccuuaacaguacuauuuucucgccaccaaaaaaaaaaaaaaaaaaaaaaaaaaaugcaccac

SEQ ID NO: 30320 - RNA, 64 nt, hsa
uugccuuaacaguacuauuuucucgccaccaaaaaaaaaaaaaaaaaaaaaaaaaaaugcacca

SEQ ID NO: 30321 - RNA, 64 nt, hsa
uuugccuuaacaguacuauuuucucgccaccaaaaaaaaaaaaaaaaaaaaaaaaaaaugcacc

SEQ ID NO: 30322 - RNA, 64 nt, hsa
auuugccuuaacaguacuauuuucucgccaccaaaaaaaaaaaaaaaaaaaaaaaaaaaugcac

SEQ ID NO: 30323 - RNA, 64 nt, hsa
gauuugccuuaacaguacuauuuucucgccaccaaaaaaaaaaaaaaaaaaaaaaaaaaaugca

SEQ ID NO: 30324 - RNA, 64 nt, hsa
agauuugccuuaacaguacuauuuucucgccaccaaaaaaaaaaaaaaaaaaaaaaaaaaaugc

SEQ ID NO: 30325 - RNA, 64 nt, hsa
acaccaguuaauacuuuuuaaaacuacucuuuaaaaaaaaaauacguuccccuugguuaacuga

SEQ ID NO: 30326 - RNA, 64 nt, hsa
gacaccaguuaauacuuuuuaaaacuacucuuuaaaaaaaaaauacguuccccuugguuaacug

SEQ ID NO: 30327 - RNA, 64 nt, hsa
ggacaccaguuaauacuuuuuaaaacuacucuuuaaaaaaaaaauacguuccccuugguuaacu

SEQ ID NO: 30328 - RNA, 64 nt, hsa
ggugacagagugagacucuaucucaaaaaaaaaaaaaaaaaagaaagguuguuauggacuggac

SEQ ID NO: 30329 - RNA, 64 nt, hsa
gggugacagagugagacucuaucucaaaaaaaaaaaaaaaaaagaaagguuguuauggacugga

SEQ ID NO: 30330 - RNA, 64 nt, hsa
ugggugacagagugagacucuaucucaaaaaaaaaaaaaaaaaagaaagguuguuauggacugg

SEQ ID NO: 30331 - RNA, 64 nt, hsa
cugggugacagagugagacucuaucucaaaaaaaaaaaaaaaaaagaaagguuguuauggacug

SEQ ID NO: 30332 - RNA, 64 nt, hsa
ccugggugacagagugagacucuaucucaaaaaaaaaaaaaaaaaagaaagguuguuauggacu

SEQ ID NO: 30333 - RNA, 64 nt, hsa
gccugggugacagagugagacucuaucucaaaaaaaaaaaaaaaaaagaaagguuguuauggac

SEQ ID NO: 30334 - RNA, 64 nt, hsa
cgccugggugacagagugagacucuaucucaaaaaaaaaaaaaaaaaagaaagguuguuaugga

SEQ ID NO: 30335 - RNA, 64 nt, hsa
ccgccugggugacagagugagacucuaucucaaaaaaaaaaaaaaaaaagaaagguuguuaugg

SEQ ID NO: 30336 - RNA, 64 nt, hsa
cccgccugggugacagagugagacucuaucucaaaaaaaaaaaaaaaaaagaaagguuguuaug

SEQ ID NO: 30337 - RNA, 64 nt, hsa
ucccgccugggugacagagugagacucuaucucaaaaaaaaaaaaaaaaaagaaagguuguuau

SEQ ID NO: 30338 - RNA, 64 nt, hsa
cucccgccugggugacagagugagacucuaucucaaaaaaaaaaaaaaaaaagaaagguuguua

SEQ ID NO: 30339 - RNA, 64 nt, hsa
ugaauguuucuaaaaaugccuuuuuaaggagagaaaaaaaaaucaaagggcagucucaauacuu

SEQ ID NO: 30340 - RNA, 64 nt, hsa
uugaauguuucuaaaaaugccuuuuuaaggagagaaaaaaaaaucaaagggcagucucaauacu

SEQ ID NO: 30341 - RNA, 64 nt, hsa
acagaaaaagaaaaagaaaauaaaaauuaaauuaaaaaaaaagaagacaaagaaaaccuaaagu

SEQ ID NO: 30342 - RNA, 64 nt, hsa
cacagaaaaagaaaaagaaaauaaaaauuaaauuaaaaaaaaagaagacaaagaaaaccuaaag

SEQ ID NO: 30343 - RNA, 64 nt, hsa
agagagaaauucauaacaaauccgacuaccagaaaaaaaaaauuguuuuggaggaggggcaaaa

SEQ ID NO: 30344 - RNA, 64 nt, hsa
gagagagaaauucauaacaaauccgacuaccagaaaaaaaaaauuguuuuggaggaggggcaaa

SEQ ID NO: 30345 - RNA, 64 nt, hsa
ggagagagaaauucauaacaaauccgacuaccagaaaaaaaaaauuguuuuggaggaggggcaa

SEQ ID NO: 30346 - RNA, 64 nt, hsa
aaugauaauagaaagcacccuaauugacuuggaaaaaaaaaacagcaaaagcaaaaguagcaac

SEQ ID NO: 30347 - RNA, 64 nt, hsa
gaaugauaauagaaagcacccuaauugacuuggaaaaaaaaaacagcaaaagcaaaaguagcaa

SEQ ID NO: 30348 - RNA, 64 nt, hsa
ugaaugauaauagaaagcacccuaauugacuuggaaaaaaaaaacagcaaaagcaaaaguagca

SEQ ID NO: 30349 - RNA, 64 nt, hsa
agcuccaccgguaaaaaaaaaaaaaaaaaaaaaaaaaaaaaauaguuuuuuuagaguagaguua

SEQ ID NO: 30350 - RNA, 64 nt, hsa
cagcuccaccgguaaaaaaaaaaaaaaaaaaaaaaaaaaaaaauaguuuuuuuagaguagaguu

SEQ ID NO: 30351 - RNA, 64 nt, hsa
acagcuccaccgguaaaaaaaaaaaaaaaaaaaaaaaaaaaaaauaguuuuuuuagaguagagu

SEQ ID NO: 30352 - RNA, 64 nt, hsa
aacagcuccaccgguaaaaaaaaaaaaaaaaaaaaaaaaaaaaaauaguuuuuuuagaguagag

SEQ ID NO: 30353 - RNA, 64 nt, hsa
aaacagcuccaccgguaaaaaaaaaaaaaaaaaaaaaaaaaaaaaauaguuuuuuuagaguaga

SEQ ID NO: 30354 - RNA, 64 nt, hsa
uaaacagcuccaccgguaaaaaaaaaaaaaaaaaaaaaaaaaaaaaauaguuuuuuuagaguag

SEQ ID NO: 30355 - RNA, 64 nt, hsa
uuaaacagcuccaccgguaaaaaaaaaaaaaaaaaaaaaaaaaaaaaauaguuuuuuuagagua

SEQ ID NO: 30356 - RNA, 64 nt, hsa
cuuaaacagcuccaccgguaaaaaaaaaaaaaaaaaaaaaaaaaaaaaauaguuuuuuuagagu

SEQ ID NO: 30357 - RNA, 64 nt, hsa
gcuuaaacagcuccaccgguaaaaaaaaaaaaaaaaaaaaaaaaaaaaaauaguuuuuuuagag

SEQ ID NO: 30358 - RNA, 64 nt, hsa
ggcuuaaacagcuccaccgguaaaaaaaaaaaaaaaaaaaaaaaaaaaaaauaguuuuuuuaga

SEQ ID NO: 30359 - RNA, 64 nt, hsa
uggcuuaaacagcuccaccgguaaaaaaaaaaaaaaaaaaaaaaaaaaaaaauaguuuuuuuag

SEQ ID NO: 30360 - RNA, 64 nt, hsa
uuggcuuaaacagcuccaccgguaaaaaaaaaaaaaaaaaaaaaaaaaaaaaauaguuuuuuua

SEQ ID NO: 30361 - RNA, 64 nt, hsa
cuuggcuuaaacagcuccaccgguaaaaaaaaaaaaaaaaaaaaaaaaaaaaaauaguuuuuuu

SEQ ID NO: 30362 - RNA, 64 nt, hsa
ccuuggcuuaaacagcuccaccgguaaaaaaaaaaaaaaaaaaaaaaaaaaaaaauaguuuuuu

SEQ ID NO: 30363 - RNA, 64 nt, hsa
uccuuggcuuaaacagcuccaccgguaaaaaaaaaaaaaaaaaaaaaaaaaaaaaauaguuuuu

SEQ ID NO: 30364 - RNA, 64 nt, hsa
cuccuuggcuuaaacagcuccaccgguaaaaaaaaaaaaaaaaaaaaaaaaaaaaaauaguuuu

SEQ ID NO: 30365 - RNA, 64 nt, hsa
acuccuuggcuuaaacagcuccaccgguaaaaaaaaaaaaaaaaaaaaaaaaaaaaaauaguuu

SEQ ID NO: 30366 - RNA, 64 nt, hsa
aacuccuuggcuuaaacagcuccaccgguaaaaaaaaaaaaaaaaaaaaaaaaaaaaaauaguu

SEQ ID NO: 30367 - RNA, 64 nt, hsa
caacuccuuggcuuaaacagcuccaccgguaaaaaaaaaaaaaaaaaaaaaaaaaaaaaauagu

SEQ ID NO: 30368 - RNA, 64 nt, hsa
acaacuccuuggcuuaaacagcuccaccgguaaaaaaaaaaaaaaaaaaaaaaaaaaaaaauag

SEQ ID NO: 30369 - RNA, 64 nt, hsa
cacaacuccuuggcuuaaacagcuccaccgguaaaaaaaaaaaaaaaaaaaaaaaaaaaaaaua

SEQ ID NO: 30370 - RNA, 64 nt, hsa
ccacaacuccuuggcuuaaacagcuccaccgguaaaaaaaaaaaaaaaaaaaaaaaaaaaaaau

SEQ ID NO: 30371 - RNA, 64 nt, hsa
uccacaacuccuuggcuuaaacagcuccaccgguaaaaaaaaaaaaaaaaaaaaaaaaaaaaaa

SEQ ID NO: 30372 - RNA, 64 nt, hsa
gcuggggagaaaaugcuuaaggacaugcuaggggaaaaaaaaguaaaauugaagugcuauugca

SEQ ID NO: 30373 - RNA, 64 nt, hsa
gaucuuuauuagauagcaguggcaugcuuuaaaaaaaaaaaaggcaaugaaaauuuagcaagcc

SEQ ID NO: 30374 - RNA, 64 nt, hsa
ugaucuuuauuagauagcaguggcaugcuuuaaaaaaaaaaaaggcaaugaaaauuuagcaagc

SEQ ID NO: 30375 - RNA, 64 nt, hsa
gugaucuuuauuagauagcaguggcaugcuuuaaaaaaaaaaaaggcaaugaaaauuuagcaag

SEQ ID NO: 30376 - RNA, 64 nt, hsa
ugugaucuuuauuagauagcaguggcaugcuuuaaaaaaaaaaaaggcaaugaaaauuuagcaa

SEQ ID NO: 30377 - RNA, 64 nt, hsa
augugaucuuuauuagauagcaguggcaugcuuuaaaaaaaaaaaaggcaaugaaaauuuagca

SEQ ID NO: 30378 - RNA, 64 nt, hsa
gacccaaguucuucccaucucaaaaaaaaauuaaaaaaaaaacaaaaaacaaaaaacaacucua

SEQ ID NO: 30379 - RNA, 64 nt, hsa
ggacccaaguucuucccaucucaaaaaaaaauuaaaaaaaaaacaaaaaacaaaaaacaacucu

SEQ ID NO: 30380 - RNA, 64 nt, hsa
aggacccaaguucuucccaucucaaaaaaaaauuaaaaaaaaaacaaaaaacaaaaaacaacuc

SEQ ID NO: 30381 - RNA, 64 nt, hsa
uggagcaaggaggacccaaguucuucccaucucaaaaaaaaauuaaaaaaaaaacaaaaaacaa

SEQ ID NO: 30382 - RNA, 64 nt, hsa
guggagcaaggaggacccaaguucuucccaucucaaaaaaaaauuaaaaaaaaaacaaaaaaca

SEQ ID NO: 30383 - RNA, 64 nt, hsa
auugcucuaucagcugacuuuucaggguauccuuaaaaaaaaacacacacgaaaaacaaaaguu

SEQ ID NO: 30384 - RNA, 64 nt, hsa
uugcucuaucagcugacuuuucaggguauccuuaaaaaaaaacacacacgaaaaacaaaaguuu

SEQ ID NO: 30385 - RNA, 64 nt, hsa
aggucacauauugugauuuccagcuguagcauucaaaaaaaaaauugguguucaugacucugug

SEQ ID NO: 30386 - RNA, 64 nt, hsa
ggucacauauugugauuuccagcuguagcauucaaaaaaaaaauugguguucaugacucugugg

SEQ ID NO: 30387 - RNA, 64 nt, hsa
gucacauauugugauuuccagcuguagcauucaaaaaaaaaauugguguucaugacucuguggu

SEQ ID NO: 30388 - RNA, 64 nt, hsa
aaaaucaguacgaauguaucuccuugaaaaaugcaaaaaaaaaaaaaucccugaaauauucuuc

SEQ ID NO: 30389 - RNA, 64 nt, hsa
aaaucaguacgaauguaucuccuugaaaaaugcaaaaaaaaaaaaaucccugaaauauucuucu

SEQ ID NO: 30390 - RNA, 64 nt, hsa
aaucaguacgaauguaucuccuugaaaaaugcaaaaaaaaaaaaaucccugaaauauucuucua

SEQ ID NO: 30391 - RNA, 64 nt, hsa
aucaguacgaauguaucuccuugaaaaaugcaaaaaaaaaaaaaucccugaaauauucuucuau

SEQ ID NO: 30392 - RNA, 64 nt, hsa
ucaguacgaauguaucuccuugaaaaaugcaaaaaaaaaaaaaucccugaaauauucuucuaua

SEQ ID NO: 30393 - RNA, 64 nt, hsa
caguacgaauguaucuccuugaaaaaugcaaaaaaaaaaaaaucccugaaauauucuucuauaa

SEQ ID NO: 30394 - RNA, 64 nt, hsa
uauaauuaccuguaagguuaucugguuuuaaaagaaaaaaaaaaagccuacaaacucagugacc

SEQ ID NO: 30395 - RNA, 64 nt, hsa
auaauuaccuguaagguuaucugguuuuaaaagaaaaaaaaaaagccuacaaacucagugaccu

SEQ ID NO: 30396 - RNA, 64 nt, hsa
uaauuaccuguaagguuaucugguuuuaaaagaaaaaaaaaaagccuacaaacucagugaccua

SEQ ID NO: 30397 - RNA, 64 nt, hsa
aauuaccuguaagguuaucugguuuuaaaagaaaaaaaaaaagccuacaaacucagugaccuac

SEQ ID NO: 30398 - RNA, 64 nt, hsa
cuccagccugggugacagagcaagacucucucucaaaaaaaaaaaaaaaaaaaaauucuagacc

SEQ ID NO: 30399 - RNA, 64 nt, hsa
uccagccugggugacagagcaagacucucucucaaaaaaaaaaaaaaaaaaaaauucuagaccg

SEQ ID NO: 30400 - RNA, 64 nt, hsa
ccagccugggugacagagcaagacucucucucaaaaaaaaaaaaaaaaaaaaauucuagaccga

SEQ ID NO: 30401 - RNA, 64 nt, hsa
cagccugggugacagagcaagacucucucucaaaaaaaaaaaaaaaaaaaaauucuagaccgaa

SEQ ID NO: 30402 - RNA, 64 nt, hsa
agccugggugacagagcaagacucucucucaaaaaaaaaaaaaaaaaaaaauucuagaccgaag

SEQ ID NO: 30403 - RNA, 64 nt, hsa
gccugggugacagagcaagacucucucucaaaaaaaaaaaaaaaaaaaaauucuagaccgaagu

SEQ ID NO: 30404 - RNA, 64 nt, hsa
ccugggugacagagcaagacucucucucaaaaaaaaaaaaaaaaaaaaauucuagaccgaagug

SEQ ID NO: 30405 - RNA, 64 nt, hsa
cugggugacagagcaagacucucucucaaaaaaaaaaaaaaaaaaaaauucuagaccgaagugu

SEQ ID NO: 30406 - RNA, 64 nt, hsa
ugggugacagagcaagacucucucucaaaaaaaaaaaaaaaaaaaaauucuagaccgaagugua

SEQ ID NO: 30407 - RNA, 64 nt, hsa
gggugacagagcaagacucucucucaaaaaaaaaaaaaaaaaaaaauucuagaccgaaguguac

SEQ ID NO: 30408 - RNA, 64 nt, hsa
ggugacagagcaagacucucucucaaaaaaaaaaaaaaaaaaaaauucuagaccgaaguguacg

SEQ ID NO: 30409 - RNA, 64 nt, hsa
gugacagagcaagacucucucucaaaaaaaaaaaaaaaaaaaaauucuagaccgaaguguacgg

SEQ ID NO: 30410 - RNA, 64 nt, hsa
ugacagagcaagacucucucucaaaaaaaaaaaaaaaaaaaaauucuagaccgaaguguacggc

SEQ ID NO: 30411 - RNA, 64 nt, hsa
gacagagcaagacucucucucaaaaaaaaaaaaaaaaaaaaauucuagaccgaaguguacggca

SEQ ID NO: 30412 - RNA, 64 nt, hsa
uguuuuucagaaaaggguguguuuggaugaaaguaaaaaaaaaaauaaaaucuuucacugucuc

SEQ ID NO: 30413 - RNA, 64 nt, hsa
guuuuucagaaaaggguguguuuggaugaaaguaaaaaaaaaaauaaaaucuuucacugucucu

SEQ ID NO: 30414 - RNA, 64 nt, hsa
uuuuucagaaaaggguguguuuggaugaaaguaaaaaaaaaaauaaaaucuuucacugucucua

SEQ ID NO: 30415 - RNA, 64 nt, hsa
uuuucagaaaaggguguguuuggaugaaaguaaaaaaaaaaauaaaaucuuucacugucucuaa

SEQ ID NO: 30416 - RNA, 64 nt, hsa
cugcguugugugaaauguccaucuuaguuuuguuaaaaaaaaaaaaaaaaaaaggaaacagccu

SEQ ID NO: 30417 - RNA, 64 nt, hsa
ugcguugugugaaauguccaucuuaguuuuguuaaaaaaaaaaaaaaaaaaaggaaacagccuc

SEQ ID NO: 30418 - RNA, 64 nt, hsa
gcguugugugaaauguccaucuuaguuuuguuaaaaaaaaaaaaaaaaaaaggaaacagccuca

SEQ ID NO: 30419 - RNA, 64 nt, hsa
cguugugugaaauguccaucuuaguuuuguuaaaaaaaaaaaaaaaaaaaggaaacagccucac

SEQ ID NO: 30420 - RNA, 64 nt, hsa
guugugugaaauguccaucuuaguuuuguuaaaaaaaaaaaaaaaaaaaggaaacagccucacu

SEQ ID NO: 30421 - RNA, 64 nt, hsa
uugugugaaauguccaucuuaguuuuguuaaaaaaaaaaaaaaaaaaaggaaacagccucacuu

SEQ ID NO: 30422 - RNA, 64 nt, hsa
ugugugaaauguccaucuuaguuuuguuaaaaaaaaaaaaaaaaaaaggaaacagccucacuuu

SEQ ID NO: 30423 - RNA, 64 nt, hsa
gugugaaauguccaucuuaguuuuguuaaaaaaaaaaaaaaaaaaaggaaacagccucacuuuu

SEQ ID NO: 30424 - RNA, 64 nt, hsa
ugugaaauguccaucuuaguuuuguuaaaaaaaaaaaaaaaaaaaggaaacagccucacuuuuu

SEQ ID NO: 30425 - RNA, 64 nt, hsa
gugaaauguccaucuuaguuuuguuaaaaaaaaaaaaaaaaaaaggaaacagccucacuuuuuu

SEQ ID NO: 30426 - RNA, 64 nt, hsa
ugaaauguccaucuuaguuuuguuaaaaaaaaaaaaaaaaaaaggaaacagccucacuuuuuug

SEQ ID NO: 30427 - RNA, 64 nt, hsa
gaaauguccaucuuaguuuuguuaaaaaaaaaaaaaaaaaaaggaaacagccucacuuuuuugu

SEQ ID NO: 30428 - RNA, 64 nt, hsa
uuucuuguaauggcaccucaaauuuuauacucuuaaaaaaaaacaauaauuugugaauuaccac

SEQ ID NO: 30429 - RNA, 64 nt, hsa
uucuuguaauggcaccucaaauuuuauacucuuaaaaaaaaacaauaauuugugaauuaccacc

SEQ ID NO: 30430 - RNA, 64 nt, hsa
cggccugaguagcauagcaagacccugucucuacaaaaaaaacaaaaauuagcugggcauggug

SEQ ID NO: 30431 - RNA, 64 nt, hsa
cacucuagccugggcaacggugagacccugccucaaaaaaaauaaaaauaaaaauaaaacacuu

SEQ ID NO: 30432 - RNA, 64 nt, hsa
aauccucagcugacacauaauuugaauggugcagaaaaaaaaaaagaaaccguaauuuuauuau

SEQ ID NO: 30433 - RNA, 64 nt, hsa
auccucagcugacacauaauuugaauggugcagaaaaaaaaaaagaaaccguaauuuuauuauu

SEQ ID NO: 30434 - RNA, 64 nt, hsa
uccucagcugacacauaauuugaauggugcagaaaaaaaaaaagaaaccguaauuuuauuauua

SEQ ID NO: 30435 - RNA, 64 nt, hsa
ccucagcugacacauaauuugaauggugcagaaaaaaaaaaagaaaccguaauuuuauuauuag

SEQ ID NO: 30436 - RNA, 64 nt, hsa
cugaauagaaacaaaacuuuugaaugcuggauucaaaaaaaaaaaaaaguuaucuggacagcuu

SEQ ID NO: 30437 - RNA, 64 nt, hsa
ugaauagaaacaaaacuuuugaaugcuggauucaaaaaaaaaaaaaaguuaucuggacagcuuc

SEQ ID NO: 30438 - RNA, 64 nt, hsa
gaauagaaacaaaacuuuugaaugcuggauucaaaaaaaaaaaaaaguuaucuggacagcuucu

SEQ ID NO: 30439 - RNA, 64 nt, hsa
aauagaaacaaaacuuuugaaugcuggauucaaaaaaaaaaaaaaguuaucuggacagcuucuu

SEQ ID NO: 30440 - RNA, 64 nt, hsa
auagaaacaaaacuuuugaaugcuggauucaaaaaaaaaaaaaaguuaucuggacagcuucuuu

SEQ ID NO: 30441 - RNA, 64 nt, hsa
uagaaacaaaacuuuugaaugcuggauucaaaaaaaaaaaaaaguuaucuggacagcuucuuug

SEQ ID NO: 30442 - RNA, 64 nt, hsa
agaaacaaaacuuuugaaugcuggauucaaaaaaaaaaaaaaguuaucuggacagcuucuuuga

SEQ ID NO: 30443 - RNA, 64 nt, hsa
uuugaguugauaguuauuaaaaagaaaacaaaacaaaaaaaaaaggcaaggcacaacaaaaaaa

SEQ ID NO: 30444 - RNA, 64 nt, hsa
uugaguugauaguuauuaaaaagaaaacaaaacaaaaaaaaaaggcaaggcacaacaaaaaaau

SEQ ID NO: 30445 - RNA, 64 nt, hsa
ugaguugauaguuauuaaaaagaaaacaaaacaaaaaaaaaaggcaaggcacaacaaaaaaaua

SEQ ID NO: 30446 - RNA, 64 nt, hsa
aggcaaggcacaacaaaaaaauauccugggcaauaaaaaaaauauuuuaaaccagcuuuggagc

SEQ ID NO: 30447 - RNA, 64 nt, hsa
gugagcuaugauugcaccacuguacuccugccuuaaaaaaaaaaaaaaaaucccaauaguccau

SEQ ID NO: 30448 - RNA, 64 nt, hsa
ugagcuaugauugcaccacuguacuccugccuuaaaaaaaaaaaaaaaaucccaauaguccaug

SEQ ID NO: 30449 - RNA, 64 nt, hsa
gagcuaugauugcaccacuguacuccugccuuaaaaaaaaaaaaaaaaucccaauaguccauga

SEQ ID NO: 30450 - RNA, 64 nt, hsa
agcuaugauugcaccacuguacuccugccuuaaaaaaaaaaaaaaaaucccaauaguccaugaa

SEQ ID NO: 30451 - RNA, 64 nt, hsa
gcuaugauugcaccacuguacuccugccuuaaaaaaaaaaaaaaaaucccaauaguccaugaag

SEQ ID NO: 30452 - RNA, 64 nt, hsa
cuaugauugcaccacuguacuccugccuuaaaaaaaaaaaaaaaaucccaauaguccaugaagg

SEQ ID NO: 30453 - RNA, 64 nt, hsa
uaugauugcaccacuguacuccugccuuaaaaaaaaaaaaaaaaucccaauaguccaugaaggc

SEQ ID NO: 30454 - RNA, 64 nt, hsa
augauugcaccacuguacuccugccuuaaaaaaaaaaaaaaaaucccaauaguccaugaaggcu

SEQ ID NO: 30455 - RNA, 64 nt, hsa
ugauugcaccacuguacuccugccuuaaaaaaaaaaaaaaaaucccaauaguccaugaaggcuu

SEQ ID NO: 30456 - RNA, 64 nt, hsa
accccccaacuuuuuuagagacagccugucucuuaaaaaaaaaauuaauuugguagugagagcu

SEQ ID NO: 30457 - RNA, 64 nt, hsa
ccccccaacuuuuuuagagacagccugucucuuaaaaaaaaaauuaauuugguagugagagcuu

SEQ ID NO: 30458 - RNA, 64 nt, hsa
cccccaacuuuuuuagagacagccugucucuuaaaaaaaaaauuaauuugguagugagagcuug

SEQ ID NO: 30459 - RNA, 64 nt, hsa
guuauuuaugcuugcugcacagacauauuagaagaaaaaaaaaagcuuuguauuauucuuccac

SEQ ID NO: 30460 - RNA, 64 nt, hsa
uuauuuaugcuugcugcacagacauauuagaagaaaaaaaaaagcuuuguauuauucuuccaca

SEQ ID NO: 30461 - RNA, 64 nt, hsa
uauuuaugcuugcugcacagacauauuagaagaaaaaaaaaagcuuuguauuauucuuccacau

SEQ ID NO: 30462 - RNA, 64 nt, hsa
ugccuuauccaggaauaauugccccuuugcagagaaaaaaaaaaacuuaaaaaaagcacaugcc

SEQ ID NO: 30463 - RNA, 64 nt, hsa
gccuuauccaggaauaauugccccuuugcagagaaaaaaaaaaacuuaaaaaaagcacaugccu

SEQ ID NO: 30464 - RNA, 64 nt, hsa
ccuuauccaggaauaauugccccuuugcagagaaaaaaaaaaacuuaaaaaaagcacaugccua

SEQ ID NO: 30465 - RNA, 64 nt, hsa
cuuauccaggaauaauugccccuuugcagagaaaaaaaaaaacuuaaaaaaagcacaugccuac

SEQ ID NO: 30466 - RNA, 64 nt, hsa
cacuccauccugggugacagcaagaucuugucucaaaaaaaaaaaaaaaaaccaggagugaaaa

SEQ ID NO: 30467 - RNA, 64 nt, hsa
acuccauccugggugacagcaagaucuugucucaaaaaaaaaaaaaaaaaccaggagugaaaaa

SEQ ID NO: 30468 - RNA, 64 nt, hsa
cuccauccugggugacagcaagaucuugucucaaaaaaaaaaaaaaaaaccaggagugaaaaag

SEQ ID NO: 30469 - RNA, 64 nt, hsa
uccauccugggugacagcaagaucuugucucaaaaaaaaaaaaaaaaaccaggagugaaaaagg

SEQ ID NO: 30470 - RNA, 64 nt, hsa
ccauccugggugacagcaagaucuugucucaaaaaaaaaaaaaaaaaccaggagugaaaaagga

SEQ ID NO: 30471 - RNA, 64 nt, hsa
cauccugggugacagcaagaucuugucucaaaaaaaaaaaaaaaaaccaggagugaaaaaggaa

SEQ ID NO: 30472 - RNA, 64 nt, hsa
auccugggugacagcaagaucuugucucaaaaaaaaaaaaaaaaaccaggagugaaaaaggaaa

SEQ ID NO: 30473 - RNA, 64 nt, hsa
uccugggugacagcaagaucuugucucaaaaaaaaaaaaaaaaaccaggagugaaaaaggaaag

SEQ ID NO: 30474 - RNA, 64 nt, hsa
ccugggugacagcaagaucuugucucaaaaaaaaaaaaaaaaaccaggagugaaaaaggaaagu

SEQ ID NO: 30475 - RNA, 64 nt, hsa
cugggugacagcaagaucuugucucaaaaaaaaaaaaaaaaaccaggagugaaaaaggaaagua

SEQ ID NO: 30476 - RNA, 64 nt, hsa
ucuacuauucaguuccucaaacugaagcuuauugaaaaaaaaauguauaauguuauuuguuuua

SEQ ID NO: 30477 - RNA, 64 nt, hsa
cuacuauucaguuccucaaacugaagcuuauugaaaaaaaaauguauaauguuauuuguuuuau

SEQ ID NO: 30478 - RNA, 64 nt, hsa
ugcacauuuuuucauuucuuacuugucuaaaaguaaaaaaaaauaucagccugucuccuagguc

SEQ ID NO: 30479 - RNA, 64 nt, hsa
gcacauuuuuucauuucuuacuugucuaaaaguaaaaaaaaauaucagccugucuccuagguca

SEQ ID NO: 30480 - RNA, 64 nt, hsa
cugacuacuaaacagaagcagauagaaguggccgaaaaaaaaaugaauuuugagguauuuucuu

SEQ ID NO: 30481 - RNA, 64 nt, hsa
ugacuacuaaacagaagcagauagaaguggccgaaaaaaaaaugaauuuugagguauuuucuuu

SEQ ID NO: 30482 - RNA, 64 nt, hsa
cacuccagccucagcaauagagugagacugucucaaaaaaaaaaaaaaaaaaaaaaccugccaa

SEQ ID NO: 30483 - RNA, 64 nt, hsa
acuccagccucagcaauagagugagacugucucaaaaaaaaaaaaaaaaaaaaaaccugccaau

SEQ ID NO: 30484 - RNA, 64 nt, hsa
cuccagccucagcaauagagugagacugucucaaaaaaaaaaaaaaaaaaaaaaccugccaauu

SEQ ID NO: 30485 - RNA, 64 nt, hsa
uccagccucagcaauagagugagacugucucaaaaaaaaaaaaaaaaaaaaaaccugccaauuu

SEQ ID NO: 30486 - RNA, 64 nt, hsa
ccagccucagcaauagagugagacugucucaaaaaaaaaaaaaaaaaaaaaaccugccaauuuu

SEQ ID NO: 30487 - RNA, 64 nt, hsa
cagccucagcaauagagugagacugucucaaaaaaaaaaaaaaaaaaaaaaccugccaauuuuc

SEQ ID NO: 30488 - RNA, 64 nt, hsa
agccucagcaauagagugagacugucucaaaaaaaaaaaaaaaaaaaaaaccugccaauuuuca

SEQ ID NO: 30489 - RNA, 64 nt, hsa
gccucagcaauagagugagacugucucaaaaaaaaaaaaaaaaaaaaaaccugccaauuuucaa

SEQ ID NO: 30490 - RNA, 64 nt, hsa
ccucagcaauagagugagacugucucaaaaaaaaaaaaaaaaaaaaaaccugccaauuuucaaa

SEQ ID NO: 30491 - RNA, 64 nt, hsa
cucagcaauagagugagacugucucaaaaaaaaaaaaaaaaaaaaaaccugccaauuuucaaac

SEQ ID NO: 30492 - RNA, 64 nt, hsa
ucagcaauagagugagacugucucaaaaaaaaaaaaaaaaaaaaaaccugccaauuuucaaaca

SEQ ID NO: 30493 - RNA, 64 nt, hsa
cagcaauagagugagacugucucaaaaaaaaaaaaaaaaaaaaaaccugccaauuuucaaacau

SEQ ID NO: 30494 - RNA, 64 nt, hsa
agcaauagagugagacugucucaaaaaaaaaaaaaaaaaaaaaaccugccaauuuucaaacaua

SEQ ID NO: 30495 - RNA, 64 nt, hsa
gcaauagagugagacugucucaaaaaaaaaaaaaaaaaaaaaaccugccaauuuucaaacauac

SEQ ID NO: 30496 - RNA, 64 nt, hsa
caauagagugagacugucucaaaaaaaaaaaaaaaaaaaaaaccugccaauuuucaaacauacc

SEQ ID NO: 30497 - RNA, 64 nt, hsa
auguaaacugcagccaccuuuagugauacuuuugaaaaaaaaaaauaaagggauauggcuguug

SEQ ID NO: 30498 - RNA, 64 nt, hsa
uguaaacugcagccaccuuuagugauacuuuugaaaaaaaaaaauaaagggauauggcuguugu

SEQ ID NO: 30499 - RNA, 64 nt, hsa
guaaacugcagccaccuuuagugauacuuuugaaaaaaaaaaauaaagggauauggcuguugua

SEQ ID NO: 30500 - RNA, 64 nt, hsa
uaaacugcagccaccuuuagugauacuuuugaaaaaaaaaaauaaagggauauggcuguuguag

SEQ ID NO: 30501 - RNA, 64 nt, hsa
uaguuuuauaagcuguucuguaacauaguguagcaaaaaaaaaaguucaagucauguuauacag

SEQ ID NO: 30502 - RNA, 64 nt, hsa
aguuuuauaagcuguucuguaacauaguguagcaaaaaaaaaaguucaagucauguuauacagg

SEQ ID NO: 30503 - RNA, 64 nt, hsa
guuuuauaagcuguucuguaacauaguguagcaaaaaaaaaaguucaagucauguuauacaggu

SEQ ID NO: 30504 - RNA, 64 nt, hsa
aaucuuaagugaaaugggugcagcauuccuuuggaaaaaaaaaucuuuuuauuuucaagugaua

SEQ ID NO: 30505 - RNA, 64 nt, hsa
aucuuaagugaaaugggugcagcauuccuuuggaaaaaaaaaucuuuuuauuuucaagugauaa

SEQ ID NO: 30506 - RNA, 64 nt, hsa
uggggguuaagcugauguuaaaacaguuugcaauaaaaaaaaaugaaucagcuuaagucauuua

SEQ ID NO: 30507 - RNA, 64 nt, hsa
ggggguuaagcugauguuaaaacaguuugcaauaaaaaaaaaugaaucagcuuaagucauuuaa

SEQ ID NO: 30508 - RNA, 64 nt, hsa
ccugccugggcaacaagagugaaacuccaucuccaaaaaaaaaaagaaaaaguaacaaaaggaa

SEQ ID NO: 30509 - RNA, 64 nt, hsa
cugccugggcaacaagagugaaacuccaucuccaaaaaaaaaaagaaaaaguaacaaaaggaaa

SEQ ID NO: 30510 - RNA, 64 nt, hsa
ugccugggcaacaagagugaaacuccaucuccaaaaaaaaaaagaaaaaguaacaaaaggaaau

SEQ ID NO: 30511 - RNA, 64 nt, hsa
gccugggcaacaagagugaaacuccaucuccaaaaaaaaaaagaaaaaguaacaaaaggaaauu

SEQ ID NO: 30512 - RNA, 64 nt, hsa
agccugggugccacagcgagacccuaguuaagagaaaaaaaaaguaaaaacaaauuguggguca

SEQ ID NO: 30513 - RNA, 64 nt, hsa
gccugggugccacagcgagacccuaguuaagagaaaaaaaaaguaaaaacaaauugugggucaa

SEQ ID NO: 30514 - RNA, 64 nt, hsa
ggcaauguagugacaccucauuucuauuuauuuuaaaaaaaagagagaguaacuacagaagaac

SEQ ID NO: 30515 - RNA, 64 nt, hsa
uccuguuccaaugaaaaaauuaaaaccugauacgaaaaaaaaaaaauuccaguuaaccuauuuu

SEQ ID NO: 30516 - RNA, 64 nt, hsa
ccuguuccaaugaaaaaauuaaaaccugauacgaaaaaaaaaaaauuccaguuaaccuauuuug

SEQ ID NO: 30517 - RNA, 64 nt, hsa
cuguuccaaugaaaaaauuaaaaccugauacgaaaaaaaaaaaauuccaguuaaccuauuuugu

SEQ ID NO: 30518 - RNA, 64 nt, hsa
uguuccaaugaaaaaauuaaaaccugauacgaaaaaaaaaaaauuccaguuaaccuauuuugug

SEQ ID NO: 30519 - RNA, 64 nt, hsa
guuccaaugaaaaaauuaaaaccugauacgaaaaaaaaaaaauuccaguuaaccuauuuugugu

SEQ ID NO: 30520 - RNA, 64 nt, hsa
aguauuaagguuuucauguggaaaggugucauucaaaaaaaaaguaauuggcauacauauucca

SEQ ID NO: 30521 - RNA, 64 nt, hsa
guauuaagguuuucauguggaaaggugucauucaaaaaaaaaguaauuggcauacauauuccac

SEQ ID NO: 30522 - RNA, 64 nt, hsa
guuuacuuuuggggggguucccuuagaagacauuaaaaaaaaauacugccuuggucugugcagg

SEQ ID NO: 30523 - RNA, 64 nt, hsa
uuuacuuuuggggggguucccuuagaagacauuaaaaaaaaauacugccuuggucugugcaggc

SEQ ID NO: 30524 - RNA, 63 nt, hsa
uuuguuucacuaaacuuucuaaauaaaaacugagaaaaaaaaaaucacugaaaccaggugcuu

SEQ ID NO: 30525 - RNA, 62 nt, hsa
uuguuucacuaaacuuucuaaauaaaaacugagaaaaaaaaaaucacugaaaccaggugcuu

SEQ ID NO: 30526 - RNA, 64 nt, hsa
aucccgugcuuaaaaaaauaaaaaauaaaaaaauaaaaaaaaaauaagacuuuaacugcaguuc

SEQ ID NO: 30527 - RNA, 64 nt, hsa
ucccgugcuuaaaaaaauaaaaaauaaaaaaauaaaaaaaaaauaagacuuuaacugcaguucc

SEQ ID NO: 30528 - RNA, 64 nt, hsa
cccgugcuuaaaaaaauaaaaaauaaaaaaauaaaaaaaaaauaagacuuuaacugcaguucca

SEQ ID NO: 30529 - RNA, 64 nt, hsa
ugcgcuuguacuauaugcuaaaauauggaaaaggaaaaaaaaaucucacaaguucuuuuggaac

SEQ ID NO: 30530 - RNA, 64 nt, hsa
gcgcuuguacuauaugcuaaaauauggaaaaggaaaaaaaaaucucacaaguucuuuuggaacu

SEQ ID NO: 30531 - RNA, 64 nt, hsa
cugggcaacagagggagacuccgucucaaaaacuaaaaaaaaaaaauacauuuaguauagcggg

SEQ ID NO: 30532 - RNA, 64 nt, hsa
ugggcaacagagggagacuccgucucaaaaacuaaaaaaaaaaaauacauuuaguauagcgggg

SEQ ID NO: 30533 - RNA, 64 nt, hsa
gggcaacagagggagacuccgucucaaaaacuaaaaaaaaaaaauacauuuaguauagcggggg

SEQ ID NO: 30534 - RNA, 64 nt, hsa
ggcaacagagggagacuccgucucaaaaacuaaaaaaaaaaaauacauuuaguauagcgggggg

SEQ ID NO: 30535 - RNA, 64 nt, hsa
gcaacagagggagacuccgucucaaaaacuaaaaaaaaaaaauacauuuaguauagcggggggu

SEQ ID NO: 30536 - RNA, 64 nt, hsa
aagggcuuaggccaaaucuuacuuugaguauguuaaaaaaaaaaaaaugcugcuggcuuuucug

SEQ ID NO: 30537 - RNA, 64 nt, hsa
agggcuuaggccaaaucuuacuuugaguauguuaaaaaaaaaaaaaugcugcuggcuuuucuga

SEQ ID NO: 30538 - RNA, 64 nt, hsa
gggcuuaggccaaaucuuacuuugaguauguuaaaaaaaaaaaaaugcugcuggcuuuucugaa

SEQ ID NO: 30539 - RNA, 64 nt, hsa
ggcuuaggccaaaucuuacuuugaguauguuaaaaaaaaaaaaaugcugcuggcuuuucugaag

SEQ ID NO: 30540 - RNA, 64 nt, hsa
gcuuaggccaaaucuuacuuugaguauguuaaaaaaaaaaaaaugcugcuggcuuuucugaaga

SEQ ID NO: 30541 - RNA, 64 nt, hsa
cuuaggccaaaucuuacuuugaguauguuaaaaaaaaaaaaaugcugcuggcuuuucugaagac

SEQ ID NO: 30542 - RNA, 64 nt, hsa
ccguuuccuucuaacuaaugaaaaacugcuuacuaaaaaaaaauuuuauacuuuccuugcuaag

SEQ ID NO: 30543 - RNA, 64 nt, hsa
cguuuccuucuaacuaaugaaaaacugcuuacuaaaaaaaaauuuuauacuuuccuugcuaagg

SEQ ID NO: 30544 - RNA, 64 nt, hsa
ggaaccuauaguagaaaaggaaacuaguagggccaaaaaaaaaaagaaaaagaaaaagaaaaaa

SEQ ID NO: 30545 - RNA, 64 nt, hsa
gaaccuauaguagaaaaggaaacuaguagggccaaaaaaaaaaagaaaaagaaaaagaaaaaag

SEQ ID NO: 30546 - RNA, 64 nt, hsa
aaccuauaguagaaaaggaaacuaguagggccaaaaaaaaaaagaaaaagaaaaagaaaaaaga

SEQ ID NO: 30547 - RNA, 64 nt, hsa
accuauaguagaaaaggaaacuaguagggccaaaaaaaaaaagaaaaagaaaaagaaaaaagaa

SEQ ID NO: 30548 - RNA, 64 nt, hsa
gccaaaaaaaaaaagaaaaagaaaaagaaaaaagaaaaaaaaagaaaaaacugggaccuaagua

SEQ ID NO: 30549 - RNA, 64 nt, hsa
ccaaaaaaaaaaagaaaaagaaaaagaaaaaagaaaaaaaaagaaaaaacugggaccuaaguau

SEQ ID NO: 30550 - RNA, 64 nt, hsa
aaccccauuuuccuaaagaacaaaguaguaaaauaaaaaaaaauuuaaaaaauuaaaaaauaaa

SEQ ID NO: 30551 - RNA, 64 nt, hsa
accccauuuuccuaaagaacaaaguaguaaaauaaaaaaaaauuuaaaaaauuaaaaaauaaaa

SEQ ID NO: 30552 - RNA, 64 nt, hsa
guaaaauaaaaaaaaauuuaaaaaauuaaaaaauaaaaaaaagaggucacuaaaagaccaagau

SEQ ID NO: 30553 - RNA, 64 nt, hsa
gcuugaaucugggaaacaagcucaaaaaacagugaaaaaaaaaguacugguuuaggaguucaaa

SEQ ID NO: 30554 - RNA, 64 nt, hsa
cuugaaucugggaaacaagcucaaaaaacagugaaaaaaaaaguacugguuuaggaguucaaaa

SEQ ID NO: 30555 - RNA, 64 nt, hsa
gcagacugguguuaaugaguauauguaacaguuuaaaaaaaaaguugguauuuuauaagcacag

SEQ ID NO: 30556 - RNA, 64 nt, hsa
cagacugguguuaaugaguauauguaacaguuuaaaaaaaaaguugguauuuuauaagcacaga

SEQ ID NO: 30557 - RNA, 64 nt, hsa
guaaaaaaauuguugucacagcaaccagcguuacaaaaaaaaaaaaaaaaaucacagguugcaa

SEQ ID NO: 30558 - RNA, 64 nt, hsa
uaaaaaaauuguugucacagcaaccagcguuacaaaaaaaaaaaaaaaaaucacagguugcaaa

SEQ ID NO: 30559 - RNA, 64 nt, hsa
aaaaaaauuguugucacagcaaccagcguuacaaaaaaaaaaaaaaaaaucacagguugcaaac

SEQ ID NO: 30560 - RNA, 64 nt, hsa
aaaaaauuguugucacagcaaccagcguuacaaaaaaaaaaaaaaaaaucacagguugcaaacc

SEQ ID NO: 30561 - RNA, 64 nt, hsa
aaaaauuguugucacagcaaccagcguuacaaaaaaaaaaaaaaaaaucacagguugcaaaccc

SEQ ID NO: 30562 - RNA, 64 nt, hsa
aaaauuguugucacagcaaccagcguuacaaaaaaaaaaaaaaaaaucacagguugcaaacccu

SEQ ID NO: 30563 - RNA, 64 nt, hsa
aaauuguugucacagcaaccagcguuacaaaaaaaaaaaaaaaaaucacagguugcaaacccug

SEQ ID NO: 30564 - RNA, 64 nt, hsa
aauuguugucacagcaaccagcguuacaaaaaaaaaaaaaaaaaucacagguugcaaacccugg

SEQ ID NO: 30565 - RNA, 64 nt, hsa
auuguugucacagcaaccagcguuacaaaaaaaaaaaaaaaaaucacagguugcaaacccuggu

SEQ ID NO: 30566 - RNA, 64 nt, hsa
uuguugucacagcaaccagcguuacaaaaaaaaaaaaaaaaaucacagguugcaaacccuggua

SEQ ID NO: 30567 - RNA, 64 nt, hsa
aucaguguuuaguauguuguucuaaccaguccagaaaaaaaaauaagcuguuugaauuacaucu

SEQ ID NO: 30568 - RNA, 64 nt, hsa
ucaguguuuaguauguuguucuaaccaguccagaaaaaaaaauaagcuguuugaauuacaucug

SEQ ID NO: 30569 - RNA, 64 nt, hsa
uuaaguuaauacagguuucaauuguggcauuaggaaaaaaaaaaaccuugugaugcuaugguug

SEQ ID NO: 30570 - RNA, 64 nt, hsa
uaaguuaauacagguuucaauuguggcauuaggaaaaaaaaaaaccuugugaugcuaugguugg

SEQ ID NO: 30571 - RNA, 64 nt, hsa
aaguuaauacagguuucaauuguggcauuaggaaaaaaaaaaaccuugugaugcuaugguuggg

SEQ ID NO: 30572 - RNA, 64 nt, hsa
aguuaauacagguuucaauuguggcauuaggaaaaaaaaaaaccuugugaugcuaugguugggg

SEQ ID NO: 30573 - RNA, 64 nt, hsa
caaagaucacuacagaccaaaacagaagaagaagaaaaaaaagaaaaagaaaucuaagcaacau

SEQ ID NO: 30574 - RNA, 64 nt, hsa
uuugauccugaguaugcuugguguuugccuucagaaaaaaaaaaauacauuguaaauaaccuca

SEQ ID NO: 30575 - RNA, 64 nt, hsa
uugauccugaguaugcuugguguuugccuucagaaaaaaaaaaauacauuguaaauaaccucag

SEQ ID NO: 30576 - RNA, 64 nt, hsa
ugauccugaguaugcuugguguuugccuucagaaaaaaaaaaauacauuguaaauaaccucagc

SEQ ID NO: 30577 - RNA, 64 nt, hsa
gauccugaguaugcuugguguuugccuucagaaaaaaaaaaauacauuguaaauaaccucagcu

SEQ ID NO: 30578 - RNA, 64 nt, hsa
uaaaacuacuuuguugaaacaucaaccugggcagaaaaaaaaaaaaaaagacauguaaaauuuu

SEQ ID NO: 30579 - RNA, 64 nt, hsa
aaaacuacuuuguugaaacaucaaccugggcagaaaaaaaaaaaaaaagacauguaaaauuuug

SEQ ID NO: 30580 - RNA, 64 nt, hsa
aaacuacuuuguugaaacaucaaccugggcagaaaaaaaaaaaaaaagacauguaaaauuuugu

SEQ ID NO: 30581 - RNA, 64 nt, hsa
aacuacuuuguugaaacaucaaccugggcagaaaaaaaaaaaaaaagacauguaaaauuuuguu

SEQ ID NO: 30582 - RNA, 64 nt, hsa
acuacuuuguugaaacaucaaccugggcagaaaaaaaaaaaaaaagacauguaaaauuuuguua

SEQ ID NO: 30583 - RNA, 64 nt, hsa
cuacuuuguugaaacaucaaccugggcagaaaaaaaaaaaaaaagacauguaaaauuuuguuau

SEQ ID NO: 30584 - RNA, 64 nt, hsa
uacuuuguugaaacaucaaccugggcagaaaaaaaaaaaaaaagacauguaaaauuuuguuauu

SEQ ID NO: 30585 - RNA, 64 nt, hsa
acuuuguugaaacaucaaccugggcagaaaaaaaaaaaaaaagacauguaaaauuuuguuauuu

SEQ ID NO: 30586 - RNA, 64 nt, hsa
cagucuguauaugaaaaaauaggucaucaaaaggaaaaaaaauaacuuugauuaacuaguguua

SEQ ID NO: 30587 - RNA, 64 nt, hsa
gacaacauggugaaacccgucucuacuaauuuacaaaaaaaauuagccagguguguuggcacau

SEQ ID NO: 30588 - RNA, 64 nt, hsa
ugcagccugggcaacagaaugagacugugucuucaaaaaaaaaaagcacugucaugcagggcag

SEQ ID NO: 30589 - RNA, 64 nt, hsa
gcagccugggcaacagaaugagacugugucuucaaaaaaaaaaagcacugucaugcagggcagg

SEQ ID NO: 30590 - RNA, 64 nt, hsa
cagccugggcaacagaaugagacugugucuucaaaaaaaaaaagcacugucaugcagggcaggg

SEQ ID NO: 30591 - RNA, 64 nt, hsa
agccugggcaacagaaugagacugugucuucaaaaaaaaaaagcacugucaugcagggcagggu

SEQ ID NO: 30592 - RNA, 64 nt, hsa
uuaggaauagucuguuaccacagcauaagcugguaaaaaaaaaaaaaaaaaucauacagcucuu

SEQ ID NO: 30593 - RNA, 64 nt, hsa
uaggaauagucuguuaccacagcauaagcugguaaaaaaaaaaaaaaaaaucauacagcucuuc

SEQ ID NO: 30594 - RNA, 64 nt, hsa
aggaauagucuguuaccacagcauaagcugguaaaaaaaaaaaaaaaaaucauacagcucuucu

SEQ ID NO: 30595 - RNA, 64 nt, hsa
ggaauagucuguuaccacagcauaagcugguaaaaaaaaaaaaaaaaaucauacagcucuucuu

SEQ ID NO: 30596 - RNA, 64 nt, hsa
gaauagucuguuaccacagcauaagcugguaaaaaaaaaaaaaaaaaucauacagcucuucuuc

SEQ ID NO: 30597 - RNA, 64 nt, hsa
aauagucuguuaccacagcauaagcugguaaaaaaaaaaaaaaaaaucauacagcucuucuucc

SEQ ID NO: 30598 - RNA, 64 nt, hsa
auagucuguuaccacagcauaagcugguaaaaaaaaaaaaaaaaaucauacagcucuucuuccc

SEQ ID NO: 30599 - RNA, 64 nt, hsa
uagucuguuaccacagcauaagcugguaaaaaaaaaaaaaaaaaucauacagcucuucuucccg

SEQ ID NO: 30600 - RNA, 64 nt, hsa
agucuguuaccacagcauaagcugguaaaaaaaaaaaaaaaaaucauacagcucuucuucccgg

SEQ ID NO: 30601 - RNA, 64 nt, hsa
gucuguuaccacagcauaagcugguaaaaaaaaaaaaaaaaaucauacagcucuucuucccgga

SEQ ID NO: 30602 - RNA, 64 nt, hsa
auaagucuuaccucuuguauaagcauguuguacuaaaaaaaaauuuugaaacauuuuguauauu

SEQ ID NO: 30603 - RNA, 64 nt, hsa
uaagucuuaccucuuguauaagcauguuguacuaaaaaaaaauuuugaaacauuuuguauauug

SEQ ID NO: 30604 - RNA, 64 nt, hsa
cuccagccugggcgacagagcaagacucuaucuaaaaaaaaagcuuguuaauagaacaaaauca

SEQ ID NO: 30605 - RNA, 64 nt, hsa
acuccagccugggcgacagagcaagacucuaucuaaaaaaaaagcuuguuaauagaacaaaauc

SEQ ID NO: 30606 - RNA, 64 nt, hsa
cugggcagcagagcgagacuccgucucaaacagaaaaaaaaagagaauuuugaaucuccuuucc

SEQ ID NO: 30607 - RNA, 64 nt, hsa
ccugggcagcagagcgagacuccgucucaaacagaaaaaaaaagagaauuuugaaucuccuuuc

SEQ ID NO: 30608 - RNA, 64 nt, hsa
caacaagagugaaacuccauuucaagaaaaaaaaaaaaaaaagaauaugcacagucugaaugua

SEQ ID NO: 30609 - RNA, 64 nt, hsa
gcaacaagagugaaacuccauuucaagaaaaaaaaaaaaaaaagaauaugcacagucugaaugu

SEQ ID NO: 30610 - RNA, 64 nt, hsa
ugcaacaagagugaaacuccauuucaagaaaaaaaaaaaaaaaagaauaugcacagucugaaug

SEQ ID NO: 30611 - RNA, 64 nt, hsa
gugcaacaagagugaaacuccauuucaagaaaaaaaaaaaaaaaagaauaugcacagucugaau

SEQ ID NO: 30612 - RNA, 64 nt, hsa
ugugcaacaagagugaaacuccauuucaagaaaaaaaaaaaaaaaagaauaugcacagucugaa

SEQ ID NO: 30613 - RNA, 64 nt, hsa
cugugcaacaagagugaaacuccauuucaagaaaaaaaaaaaaaaaagaauaugcacagucuga

SEQ ID NO: 30614 - RNA, 64 nt, hsa
ccugugcaacaagagugaaacuccauuucaagaaaaaaaaaaaaaaaagaauaugcacagucug

SEQ ID NO: 30615 - RNA, 64 nt, hsa
gccugugcaacaagagugaaacuccauuucaagaaaaaaaaaaaaaaaagaauaugcacagucu

SEQ ID NO: 30616 - RNA, 64 nt, hsa
agccugugcaacaagagugaaacuccauuucaagaaaaaaaaaaaaaaaagaauaugcacaguc

SEQ ID NO: 30617 - RNA, 64 nt, hsa
agaauucuucauuuuucauuugugcuuuuuuaaaaaaaaaaauaacacaaagaggaaaacuaga

SEQ ID NO: 30618 - RNA, 64 nt, hsa
aagaauucuucauuuuucauuugugcuuuuuuaaaaaaaaaaauaacacaaagaggaaaacuag

SEQ ID NO: 30619 - RNA, 64 nt, hsa
aaagaauucuucauuuuucauuugugcuuuuuuaaaaaaaaaaauaacacaaagaggaaaacua

SEQ ID NO: 30620 - RNA, 64 nt, hsa
gaaagaauucuucauuuuucauuugugcuuuuuuaaaaaaaaaaauaacacaaagaggaaaacu

SEQ ID NO: 30621 - RNA, 64 nt, hsa
ggagaaggaggaguuaucuccacuccaaaagaaaaaaaaaaaguuuuuuaccuuacaccaagug

SEQ ID NO: 30622 - RNA, 64 nt, hsa
uggagaaggaggaguuaucuccacuccaaaagaaaaaaaaaaaguuuuuuaccuuacaccaagu

SEQ ID NO: 30623 - RNA, 64 nt, hsa
guggagaaggaggaguuaucuccacuccaaaagaaaaaaaaaaaguuuuuuaccuuacaccaag

SEQ ID NO: 30624 - RNA, 64 nt, hsa
gguggagaaggaggaguuaucuccacuccaaaagaaaaaaaaaaaguuuuuuaccuuacaccaa

SEQ ID NO: 30625 - RNA, 64 nt, hsa
caccaacaccgccacaccaacaccaccacuacaaaaaaaaaagaauuaauaagucacaaccccu

SEQ ID NO: 30626 - RNA, 64 nt, hsa
ccaccaacaccgccacaccaacaccaccacuacaaaaaaaaaagaauuaauaagucacaacccc

SEQ ID NO: 30627 - RNA, 64 nt, hsa
accaccaacaccgccacaccaacaccaccacuacaaaaaaaaaagaauuaauaagucacaaccc

SEQ ID NO: 30628 - RNA, 64 nt, hsa
guaauuuauaguuugacaugauguguuuguuuuaaaaaaaaaugcauaguauaaacccauuaag

SEQ ID NO: 30629 - RNA, 64 nt, hsa
uguaauuuauaguuugacaugauguguuuguuuuaaaaaaaaaugcauaguauaaacccauuaa

SEQ ID NO: 30630 - RNA, 64 nt, hsa
cuugacuggaauauguaagacugugcaaaaaaaaaaaaaaaauuuauguguauucuuauucaaa

SEQ ID NO: 30631 - RNA, 64 nt, hsa
ccuugacuggaauauguaagacugugcaaaaaaaaaaaaaaaauuuauguguauucuuauucaa

SEQ ID NO: 30632 - RNA, 64 nt, hsa
accuugacuggaauauguaagacugugcaaaaaaaaaaaaaaaauuuauguguauucuuauuca

SEQ ID NO: 30633 - RNA, 64 nt, hsa
gaccuugacuggaauauguaagacugugcaaaaaaaaaaaaaaaauuuauguguauucuuauuc

SEQ ID NO: 30634 - RNA, 64 nt, hsa
agaccuugacuggaauauguaagacugugcaaaaaaaaaaaaaaaauuuauguguauucuuauu

SEQ ID NO: 30635 - RNA, 64 nt, hsa
uagaccuugacuggaauauguaagacugugcaaaaaaaaaaaaaaaauuuauguguauucuuau

SEQ ID NO: 30636 - RNA, 64 nt, hsa
auagaccuugacuggaauauguaagacugugcaaaaaaaaaaaaaaaauuuauguguauucuua

SEQ ID NO: 30637 - RNA, 64 nt, hsa
cauagaccuugacuggaauauguaagacugugcaaaaaaaaaaaaaaaauuuauguguauucuu

SEQ ID NO: 30638 - RNA, 64 nt, hsa
ucauagaccuugacuggaauauguaagacugugcaaaaaaaaaaaaaaaauuuauguguauucu

SEQ ID NO: 30639 - RNA, 64 nt, hsa
acuggauuuggaaagaauauugagaaaaaaaaccaaaaaaaauuuugacuagaaauagaucaug

SEQ ID NO: 30640 - RNA, 64 nt, hsa
cuacugagagacuggauuuggaaagaauauugagaaaaaaaaccaaaaaaaauuuugacuagaa

SEQ ID NO: 30641 - RNA, 64 nt, hsa
gaccguuccuaucucagaucuuaauaaaaagaaaaaaaaaaacgcauucagguuaaauuuggcc

SEQ ID NO: 30642 - RNA, 64 nt, hsa
ugaccguuccuaucucagaucuuaauaaaaagaaaaaaaaaaacgcauucagguuaaauuuggc

SEQ ID NO: 30643 - RNA, 64 nt, hsa
augaccguuccuaucucagaucuuaauaaaaagaaaaaaaaaaacgcauucagguuaaauuugg

SEQ ID NO: 30644 - RNA, 64 nt, hsa
uaugaccguuccuaucucagaucuuaauaaaaagaaaaaaaaaaacgcauucagguuaaauuug

SEQ ID NO: 30645 - RNA, 64 nt, hsa
uucuuuguaauaaguauuuugccacaccuguaaaaaaaaaaaccucacuuuuaacucucugccu

SEQ ID NO: 30646 - RNA, 64 nt, hsa
uuucuuuguaauaaguauuuugccacaccuguaaaaaaaaaaaccucacuuuuaacucucugcc

SEQ ID NO: 30647 - RNA, 64 nt, hsa
cuuucuuuguaauaaguauuuugccacaccuguaaaaaaaaaaaccucacuuuuaacucucugc

SEQ ID NO: 30648 - RNA, 64 nt, hsa
gcuuucuuuguaauaaguauuuugccacaccuguaaaaaaaaaaaccucacuuuuaacucucug

SEQ ID NO: 30649 - RNA, 64 nt, hsa
aagaucuuucugguaauccgugaauauauuuaaaaaaaaaaagucugugacaaaacggugcauu

SEQ ID NO: 30650 - RNA, 64 nt, hsa
caagaucuuucugguaauccgugaauauauuuaaaaaaaaaaagucugugacaaaacggugcau

SEQ ID NO: 30651 - RNA, 64 nt, hsa
ucaagaucuuucugguaauccgugaauauauuuaaaaaaaaaaagucugugacaaaacggugca

SEQ ID NO: 30652 - RNA, 64 nt, hsa
uucaagaucuuucugguaauccgugaauauauuuaaaaaaaaaaagucugugacaaaacggugc

SEQ ID NO: 30653 - RNA, 64 nt, hsa
ugagaagcuugaaugggcaguagaugaugaagagaaaaaaaagucucccucagaaaguacugag

SEQ ID NO: 30654 - RNA, 64 nt, hsa
uggaaacacacacagacacacacacaccuugcaaaaaaaaaauuguuuuucccaccuugucgcu

SEQ ID NO: 30655 - RNA, 64 nt, hsa
auggaaacacacacagacacacacacaccuugcaaaaaaaaaauuguuuuucccaccuugucgc

SEQ ID NO: 30656 - RNA, 64 nt, hsa
aauggaaacacacacagacacacacacaccuugcaaaaaaaaaauuguuuuucccaccuugucg

SEQ ID NO: 30657 - RNA, 64 nt, hsa
cuauccagauuuuuuauaugucugcauguuuaaaaaaaaaaagcaacaaaagaaaaugcacucu

SEQ ID NO: 30658 - RNA, 64 nt, hsa
gcuauccagauuuuuuauaugucugcauguuuaaaaaaaaaaagcaacaaaagaaaaugcacuc

SEQ ID NO: 30659 - RNA, 64 nt, hsa
ugcuauccagauuuuuuauaugucugcauguuuaaaaaaaaaaagcaacaaaagaaaaugcacu

SEQ ID NO: 30660 - RNA, 64 nt, hsa
gugcuauccagauuuuuuauaugucugcauguuuaaaaaaaaaaagcaacaaaagaaaaugcac

SEQ ID NO: 30661 - RNA, 62 nt, hsa
ccucuggauacagaaccccuucuuuuccaaauaaaaaaaaaaucauccagggcuuggugcuu

SEQ ID NO: 30662 - RNA, 63 nt, hsa
cccucuggauacagaaccccuucuuuuccaaauaaaaaaaaaaucauccagggcuuggugcuu

SEQ ID NO: 30663 - RNA, 64 nt, hsa
ccccucuggauacagaaccccuucuuuuccaaauaaaaaaaaaaucauccagggcuuggugcuu

SEQ ID NO: 30664 - RNA, 64 nt, hsa
auuucacugugauguauauuguguugcaaaaaaaaaaaaaaagugucuuuguuuaaaauuacuu

SEQ ID NO: 30665 - RNA, 64 nt, hsa
cauuucacugugauguauauuguguugcaaaaaaaaaaaaaaagugucuuuguuuaaaauuacu

SEQ ID NO: 30666 - RNA, 64 nt, hsa
acauuucacugugauguauauuguguugcaaaaaaaaaaaaaaagugucuuuguuuaaaauuac

SEQ ID NO: 30667 - RNA, 64 nt, hsa
cacauuucacugugauguauauuguguugcaaaaaaaaaaaaaaagugucuuuguuuaaaauua

SEQ ID NO: 30668 - RNA, 64 nt, hsa
acacauuucacugugauguauauuguguugcaaaaaaaaaaaaaaagugucuuuguuuaaaauu

SEQ ID NO: 30669 - RNA, 64 nt, hsa
uacacauuucacugugauguauauuguguugcaaaaaaaaaaaaaaagugucuuuguuuaaaau

SEQ ID NO: 30670 - RNA, 64 nt, hsa
uuacacauuucacugugauguauauuguguugcaaaaaaaaaaaaaaagugucuuuguuuaaaa

SEQ ID NO: 30671 - RNA, 64 nt, hsa
auuacacauuucacugugauguauauuguguugcaaaaaaaaaaaaaaagugucuuuguuuaaa

SEQ ID NO: 30672 - RNA, 64 nt, hsa
cucuguaggaucguaaaaaaauagaaaaaaagaaaaaaaaaagaaagaaagagggaaaaagagc

SEQ ID NO: 30673 - RNA, 64 nt, hsa
ucucuguaggaucguaaaaaaauagaaaaaaagaaaaaaaaaagaaagaaagagggaaaaagag

SEQ ID NO: 30674 - RNA, 64 nt, hsa
aucucuguaggaucguaaaaaaauagaaaaaaagaaaaaaaaaagaaagaaagagggaaaaaga

SEQ ID NO: 30675 - RNA, 64 nt, hsa
ugucuagaagaaauaacacuguaaggaaauuuaaaaaaaaaacauuuagaggauuaugcuuguu

SEQ ID NO: 30676 - RNA, 64 nt, hsa
uugucuagaagaaauaacacuguaaggaaauuuaaaaaaaaaacauuuagaggauuaugcuugu

SEQ ID NO: 30677 - RNA, 64 nt, hsa
guugucuagaagaaauaacacuguaaggaaauuuaaaaaaaaaacauuuagaggauuaugcuug

SEQ ID NO: 30678 - RNA, 64 nt, hsa
gcccauaccauagaagaaagaauuggcagucaaaaaaaaaaauaccuuuuguaauguuugaaaa

SEQ ID NO: 30679 - RNA, 64 nt, hsa
ggcccauaccauagaagaaagaauuggcagucaaaaaaaaaaauaccuuuuguaauguuugaaa

SEQ ID NO: 30680 - RNA, 64 nt, hsa
uggcccauaccauagaagaaagaauuggcagucaaaaaaaaaaauaccuuuuguaauguuugaa

SEQ ID NO: 30681 - RNA, 64 nt, hsa
uuggcccauaccauagaagaaagaauuggcagucaaaaaaaaaaauaccuuuuguaauguuuga

SEQ ID NO: 30682 - RNA, 64 nt, hsa
uuaacaggauaacuugagcaggcuaggccucuuaaaaaaaaauuugagcuaaaacucauuuuuc

SEQ ID NO: 30683 - RNA, 64 nt, hsa
uuuaacaggauaacuugagcaggcuaggccucuuaaaaaaaaauuugagcuaaaacucauuuuu

SEQ ID NO: 30684 - RNA, 64 nt, hsa
caucccagguucugacuuuuaccaggggcaaaaaaaaaaaaagcaagagggagauaaaucccau

SEQ ID NO: 30685 - RNA, 64 nt, hsa
ucaucccagguucugacuuuuaccaggggcaaaaaaaaaaaaagcaagagggagauaaauccca

SEQ ID NO: 30686 - RNA, 64 nt, hsa
gucaucccagguucugacuuuuaccaggggcaaaaaaaaaaaaagcaagagggagauaaauccc

SEQ ID NO: 30687 - RNA, 64 nt, hsa
ggucaucccagguucugacuuuuaccaggggcaaaaaaaaaaaaagcaagagggagauaaaucc

SEQ ID NO: 30688 - RNA, 64 nt, hsa
uggucaucccagguucugacuuuuaccaggggcaaaaaaaaaaaaagcaagagggagauaaauc

SEQ ID NO: 30689 - RNA, 64 nt, hsa
cuggucaucccagguucugacuuuuaccaggggcaaaaaaaaaaaaagcaagagggagauaaau

SEQ ID NO: 30690 - RNA, 64 nt, hsa
ugaugggguuuuuuuuuuuauaacuuaguaaaaaaaaaaaaauguauguggaauucugucucuu

SEQ ID NO: 30691 - RNA, 64 nt, hsa
gugaugggguuuuuuuuuuuauaacuuaguaaaaaaaaaaaaauguauguggaauucugucucu

SEQ ID NO: 30692 - RNA, 64 nt, hsa
ggugaugggguuuuuuuuuuuauaacuuaguaaaaaaaaaaaaauguauguggaauucugucuc

SEQ ID NO: 30693 - RNA, 64 nt, hsa
uggugaugggguuuuuuuuuuuauaacuuaguaaaaaaaaaaaaauguauguggaauucugucu

SEQ ID NO: 30694 - RNA, 64 nt, hsa
uuggugaugggguuuuuuuuuuuauaacuuaguaaaaaaaaaaaaauguauguggaauucuguc

SEQ ID NO: 30695 - RNA, 64 nt, hsa
uuuggugaugggguuuuuuuuuuuauaacuuaguaaaaaaaaaaaaauguauguggaauucugu

SEQ ID NO: 30696 - RNA, 64 nt, hsa
gaauuuacuuuucuuaaaaaaaaaaaaaaaaaaaaaaaaaaagaguuucuggcugaugggugac

SEQ ID NO: 30697 - RNA, 64 nt, hsa
ugaauuuacuuuucuuaaaaaaaaaaaaaaaaaaaaaaaaaaagaguuucuggcugauggguga

SEQ ID NO: 30698 - RNA, 64 nt, hsa
augaauuuacuuuucuuaaaaaaaaaaaaaaaaaaaaaaaaaaagaguuucuggcugaugggug

SEQ ID NO: 30699 - RNA, 64 nt, hsa
gaugaauuuacuuuucuuaaaaaaaaaaaaaaaaaaaaaaaaaaagaguuucuggcugaugggu

SEQ ID NO: 30700 - RNA, 64 nt, hsa
agaugaauuuacuuuucuuaaaaaaaaaaaaaaaaaaaaaaaaaaagaguuucuggcugauggg

SEQ ID NO: 30701 - RNA, 64 nt, hsa
aagaugaauuuacuuuucuuaaaaaaaaaaaaaaaaaaaaaaaaaaagaguuucuggcugaugg

SEQ ID NO: 30702 - RNA, 64 nt, hsa
caagaugaauuuacuuuucuuaaaaaaaaaaaaaaaaaaaaaaaaaaagaguuucuggcugaug

SEQ ID NO: 30703 - RNA, 64 nt, hsa
gcaagaugaauuuacuuuucuuaaaaaaaaaaaaaaaaaaaaaaaaaaagaguuucuggcugau

SEQ ID NO: 30704 - RNA, 64 nt, hsa
agcaagaugaauuuacuuuucuuaaaaaaaaaaaaaaaaaaaaaaaaaaagaguuucuggcuga

SEQ ID NO: 30705 - RNA, 64 nt, hsa
gagcaagaugaauuuacuuuucuuaaaaaaaaaaaaaaaaaaaaaaaaaaagaguuucuggcug

SEQ ID NO: 30706 - RNA, 64 nt, hsa
ugagcaagaugaauuuacuuuucuuaaaaaaaaaaaaaaaaaaaaaaaaaaagaguuucuggcu

SEQ ID NO: 30707 - RNA, 64 nt, hsa
gugagcaagaugaauuuacuuuucuuaaaaaaaaaaaaaaaaaaaaaaaaaaagaguuucuggc

SEQ ID NO: 30708 - RNA, 64 nt, hsa
ugugagcaagaugaauuuacuuuucuuaaaaaaaaaaaaaaaaaaaaaaaaaaagaguuucugg

SEQ ID NO: 30709 - RNA, 64 nt, hsa
cugugagcaagaugaauuuacuuuucuuaaaaaaaaaaaaaaaaaaaaaaaaaaagaguuucug

SEQ ID NO: 30710 - RNA, 64 nt, hsa
acugugagcaagaugaauuuacuuuucuuaaaaaaaaaaaaaaaaaaaaaaaaaaagaguuucu

SEQ ID NO: 30711 - RNA, 64 nt, hsa
gacugugagcaagaugaauuuacuuuucuuaaaaaaaaaaaaaaaaaaaaaaaaaaagaguuuc

SEQ ID NO: 30712 - RNA, 64 nt, hsa
ggacugugagcaagaugaauuuacuuuucuuaaaaaaaaaaaaaaaaaaaaaaaaaaagaguuu

SEQ ID NO: 30713 - RNA, 64 nt, hsa
aggacugugagcaagaugaauuuacuuuucuuaaaaaaaaaaaaaaaaaaaaaaaaaaagaguu

SEQ ID NO: 30714 - RNA, 64 nt, hsa
aaggacugugagcaagaugaauuuacuuuucuuaaaaaaaaaaaaaaaaaaaaaaaaaaagagu

SEQ ID NO: 30715 - RNA, 64 nt, hsa
aaaggacugugagcaagaugaauuuacuuuucuuaaaaaaaaaaaaaaaaaaaaaaaaaaagag

SEQ ID NO: 30716 - RNA, 64 nt, hsa
aauuuucucccauugugcgaacauuuuauuuuuuaaaaaaaagaaacaaaaauauuuuuccccc

SEQ ID NO: 30717 - RNA, 64 nt, hsa
gaaagggaagaauuagguuugaauugcuuuuuaaaaaaaaaagaaaagaaaaagacagcaucuc

SEQ ID NO: 30718 - RNA, 64 nt, hsa
agaaagggaagaauuagguuugaauugcuuuuuaaaaaaaaaagaaaagaaaaagacagcaucu

SEQ ID NO: 30719 - RNA, 64 nt, hsa
aagaaagggaagaauuagguuugaauugcuuuuuaaaaaaaaaagaaaagaaaaagacagcauc

SEQ ID NO: 30720 - RNA, 64 nt, hsa
acuccagccugggcaacgggcgagacucugucucaaaaaaaagaaagaaagaaaagguacaugu

SEQ ID NO: 30721 - RNA, 64 nt, hsa
aagagccugggcaauuuuuuuaagacucugucuuaaaaaaaacuaaaaagaaaaaaagaagccc

SEQ ID NO: 30722 - RNA, 58 nt, hsa
aaaaagcaggaaagauguaaaucagcagaaaaaaaacaccgagacguuucugugacuu

SEQ ID NO: 30723 - RNA, 64 nt, hsa
gcgacagagugagacuccaucucaaaaaaaaaaaaaaaaaaaucuaugcuaguagauuacaacu

SEQ ID NO: 30724 - RNA, 64 nt, hsa
ggcgacagagugagacuccaucucaaaaaaaaaaaaaaaaaaaucuaugcuaguagauuacaac

SEQ ID NO: 30725 - RNA, 64 nt, hsa
gggcgacagagugagacuccaucucaaaaaaaaaaaaaaaaaaaucuaugcuaguagauuacaa

SEQ ID NO: 30726 - RNA, 64 nt, hsa
ugggcgacagagugagacuccaucucaaaaaaaaaaaaaaaaaaaucuaugcuaguagauuaca

SEQ ID NO: 30727 - RNA, 64 nt, hsa
gugggcgacagagugagacuccaucucaaaaaaaaaaaaaaaaaaaucuaugcuaguagauuac

SEQ ID NO: 30728 - RNA, 64 nt, hsa
cgugggcgacagagugagacuccaucucaaaaaaaaaaaaaaaaaaaucuaugcuaguagauua

SEQ ID NO: 30729 - RNA, 64 nt, hsa
gcgugggcgacagagugagacuccaucucaaaaaaaaaaaaaaaaaaaucuaugcuaguagauu

SEQ ID NO: 30730 - RNA, 64 nt, hsa
agcgugggcgacagagugagacuccaucucaaaaaaaaaaaaaaaaaaaucuaugcuaguagau

SEQ ID NO: 30731 - RNA, 64 nt, hsa
cagcgugggcgacagagugagacuccaucucaaaaaaaaaaaaaaaaaaaucuaugcuaguaga

SEQ ID NO: 30732 - RNA, 64 nt, hsa
ccagcgugggcgacagagugagacuccaucucaaaaaaaaaaaaaaaaaaaucuaugcuaguag

SEQ ID NO: 30733 - RNA, 64 nt, hsa
uccagcgugggcgacagagugagacuccaucucaaaaaaaaaaaaaaaaaaaucuaugcuagua

SEQ ID NO: 30734 - RNA, 64 nt, hsa
cuccagcgugggcgacagagugagacuccaucucaaaaaaaaaaaaaaaaaaaucuaugcuagu

SEQ ID NO: 30735 - RNA, 64 nt, hsa
cagaaauccaugugggcuuccuggaaagaaaaaaaaaaaaaagaaaacuaggcaugaaaucagu

SEQ ID NO: 30736 - RNA, 64 nt, hsa
ucagaaauccaugugggcuuccuggaaagaaaaaaaaaaaaaagaaaacuaggcaugaaaucag

SEQ ID NO: 30737 - RNA, 64 nt, hsa
gucagaaauccaugugggcuuccuggaaagaaaaaaaaaaaaaagaaaacuaggcaugaaauca

SEQ ID NO: 30738 - RNA, 64 nt, hsa
ugucagaaauccaugugggcuuccuggaaagaaaaaaaaaaaaaagaaaacuaggcaugaaauc

SEQ ID NO: 30739 - RNA, 64 nt, hsa
cugucagaaauccaugugggcuuccuggaaagaaaaaaaaaaaaaagaaaacuaggcaugaaau

SEQ ID NO: 30740 - RNA, 64 nt, hsa
ucugucagaaauccaugugggcuuccuggaaagaaaaaaaaaaaaaagaaaacuaggcaugaaa

SEQ ID NO: 30741 - RNA, 64 nt, hsa
aucugucagaaauccaugugggcuuccuggaaagaaaaaaaaaaaaaagaaaacuaggcaugaa

SEQ ID NO: 30742 - RNA, 64 nt, hsa
uucaguuuuuuuaaaugcccuuugauguuucaaaaaaaaaaaggaacuguaauuugauugacug

SEQ ID NO: 30743 - RNA, 64 nt, hsa
uuucaguuuuuuuaaaugcccuuugauguuucaaaaaaaaaaaggaacuguaauuugauugacu

SEQ ID NO: 30744 - RNA, 64 nt, hsa
guuucaguuuuuuuaaaugcccuuugauguuucaaaaaaaaaaaggaacuguaauuugauugac

SEQ ID NO: 30745 - RNA, 64 nt, hsa
uguuucaguuuuuuuaaaugcccuuugauguuucaaaaaaaaaaaggaacuguaauuugauuga

SEQ ID NO: 30746 - RNA, 64 nt, hsa
uauuucuauuuaauacucuuuucucucaagaaaaaaaaaaaaguuuguuuuuucuuuauugucc

SEQ ID NO: 30747 - RNA, 64 nt, hsa
uuauuucuauuuaauacucuuuucucucaagaaaaaaaaaaaaguuuguuuuuucuuuauuguc

SEQ ID NO: 30748 - RNA, 64 nt, hsa
auuauuucuauuuaauacucuuuucucucaagaaaaaaaaaaaaguuuguuuuuucuuuauugu

SEQ ID NO: 30749 - RNA, 64 nt, hsa
uauuauuucuauuuaauacucuuuucucucaagaaaaaaaaaaaaguuuguuuuuucuuuauug

SEQ ID NO: 30750 - RNA, 64 nt, hsa
auauuauuucuauuuaauacucuuuucucucaagaaaaaaaaaaaaguuuguuuuuucuuuauu

SEQ ID NO: 30751 - RNA, 64 nt, hsa
gugccuuagcuugguuaaaaaaaaaaaaaaaaaaaaaaaaaagggauuaacauuaaauaaaagu

SEQ ID NO: 30752 - RNA, 64 nt, hsa
agugccuuagcuugguuaaaaaaaaaaaaaaaaaaaaaaaaaagggauuaacauuaaauaaaag

SEQ ID NO: 30753 - RNA, 64 nt, hsa
uagugccuuagcuugguuaaaaaaaaaaaaaaaaaaaaaaaaaagggauuaacauuaaauaaaa

SEQ ID NO: 30754 - RNA, 64 nt, hsa
guagugccuuagcuugguuaaaaaaaaaaaaaaaaaaaaaaaaaagggauuaacauuaaauaaa

SEQ ID NO: 30755 - RNA, 64 nt, hsa
gguagugccuuagcuugguuaaaaaaaaaaaaaaaaaaaaaaaaaagggauuaacauuaaauaa

SEQ ID NO: 30756 - RNA, 64 nt, hsa
ugguagugccuuagcuugguuaaaaaaaaaaaaaaaaaaaaaaaaaagggauuaacauuaaaua

SEQ ID NO: 30757 - RNA, 64 nt, hsa
cugguagugccuuagcuugguuaaaaaaaaaaaaaaaaaaaaaaaaaagggauuaacauuaaau

SEQ ID NO: 30758 - RNA, 64 nt, hsa
ucugguagugccuuagcuugguuaaaaaaaaaaaaaaaaaaaaaaaaaagggauuaacauuaaa

SEQ ID NO: 30759 - RNA, 64 nt, hsa
uucugguagugccuuagcuugguuaaaaaaaaaaaaaaaaaaaaaaaaaagggauuaacauuaa

SEQ ID NO: 30760 - RNA, 64 nt, hsa
uuucugguagugccuuagcuugguuaaaaaaaaaaaaaaaaaaaaaaaaaagggauuaacauua

SEQ ID NO: 30761 - RNA, 64 nt, hsa
auuucugguagugccuuagcuugguuaaaaaaaaaaaaaaaaaaaaaaaaaagggauuaacauu

SEQ ID NO: 30762 - RNA, 64 nt, hsa
aauuucugguagugccuuagcuugguuaaaaaaaaaaaaaaaaaaaaaaaaaagggauuaacau

SEQ ID NO: 30763 - RNA, 64 nt, hsa
aaauuucugguagugccuuagcuugguuaaaaaaaaaaaaaaaaaaaaaaaaaagggauuaaca

SEQ ID NO: 30764 - RNA, 64 nt, hsa
gaaauuucugguagugccuuagcuugguuaaaaaaaaaaaaaaaaaaaaaaaaaagggauuaac

SEQ ID NO: 30765 - RNA, 64 nt, hsa
ugaaauuucugguagugccuuagcuugguuaaaaaaaaaaaaaaaaaaaaaaaaaagggauuaa

SEQ ID NO: 30766 - RNA, 64 nt, hsa
uugaaauuucugguagugccuuagcuugguuaaaaaaaaaaaaaaaaaaaaaaaaaagggauua

SEQ ID NO: 30767 - RNA, 64 nt, hsa
cuugaaauuucugguagugccuuagcuugguuaaaaaaaaaaaaaaaaaaaaaaaaaagggauu

SEQ ID NO: 30768 - RNA, 64 nt, hsa
ccuugaaauuucugguagugccuuagcuugguuaaaaaaaaaaaaaaaaaaaaaaaaaagggau

SEQ ID NO: 30769 - RNA, 64 nt, hsa
uccuugaaauuucugguagugccuuagcuugguuaaaaaaaaaaaaaaaaaaaaaaaaaaggga

SEQ ID NO: 30770 - RNA, 64 nt, hsa
gugggagguuuuuagaagaguauauaucucuuuaaaaaaaaacagaaagaaaaauauuucugag

SEQ ID NO: 30771 - RNA, 64 nt, hsa
ggugggagguuuuuagaagaguauauaucucuuuaaaaaaaaacagaaagaaaaauauuucuga

SEQ ID NO: 30772 - RNA, 64 nt, hsa
ucuguauuuccuuuccauucagaaaaccuuaaaaaaaaaaaacuuguuuuaugauaauauuaua

SEQ ID NO: 30773 - RNA, 64 nt, hsa
aucuguauuuccuuuccauucagaaaaccuuaaaaaaaaaaaacuuguuuuaugauaauauuau

SEQ ID NO: 30774 - RNA, 64 nt, hsa
gaucuguauuuccuuuccauucagaaaaccuuaaaaaaaaaaaacuuguuuuaugauaauauua

SEQ ID NO: 30775 - RNA, 64 nt, hsa
ugaucuguauuuccuuuccauucagaaaaccuuaaaaaaaaaaaacuuguuuuaugauaauauu

SEQ ID NO: 30776 - RNA, 64 nt, hsa
cugaucuguauuuccuuuccauucagaaaaccuuaaaaaaaaaaaacuuguuuuaugauaauau

SEQ ID NO: 30777 - RNA, 64 nt, hsa
agagguuucuuugauguuuuaacuuuugcuggcaaaaaaaaauucacgcuuggugugaauacuu

SEQ ID NO: 30778 - RNA, 64 nt, hsa
aagagguuucuuugauguuuuaacuuuugcuggcaaaaaaaaauucacgcuuggugugaauacu

SEQ ID NO: 30779 - RNA, 64 nt, hsa
ccacuuaccaauugcuaaguauugaauuucagaaaaaaaaaaugcauuuacuggcaaggagaag

SEQ ID NO: 30780 - RNA, 64 nt, hsa
gccacuuaccaauugcuaaguauugaauuucagaaaaaaaaaaugcauuuacuggcaaggagaa

SEQ ID NO: 30781 - RNA, 64 nt, hsa
agccacuuaccaauugcuaaguauugaauuucagaaaaaaaaaaugcauuuacuggcaaggaga

SEQ ID NO: 30782 - RNA, 64 nt, hsa
uucaaaaauaugucugcuauagaaauaacuugaaaaaaaaaauuaaaaccguggccagccacca

SEQ ID NO: 30783 - RNA, 64 nt, hsa
cuucaaaaauaugucugcuauagaaauaacuugaaaaaaaaaauuaaaaccguggccagccacc

SEQ ID NO: 30784 - RNA, 64 nt, hsa
acuucaaaaauaugucugcuauagaaauaacuugaaaaaaaaaauuaaaaccguggccagccac

SEQ ID NO: 30785 - RNA, 64 nt, hsa
cuuugcuuacagcuagaugaaacuuucuauagaaaaaaaaaauuguugaaagguccaguucuca

SEQ ID NO: 30786 - RNA, 64 nt, hsa
acuuugcuuacagcuagaugaaacuuucuauagaaaaaaaaaauuguugaaagguccaguucuc

SEQ ID NO: 30787 - RNA, 64 nt, hsa
gacuuugcuuacagcuagaugaaacuuucuauagaaaaaaaaaauuguugaaagguccaguucu

SEQ ID NO: 30788 - RNA, 64 nt, hsa
guuguaccgaaucaacuggagucuaugcuuaaaaaaaaaaaauuuuuuuuuaaccauccuuaaa

SEQ ID NO: 30789 - RNA, 64 nt, hsa
uguuguaccgaaucaacuggagucuaugcuuaaaaaaaaaaaauuuuuuuuuaaccauccuuaa

SEQ ID NO: 30790 - RNA, 64 nt, hsa
uuguuguaccgaaucaacuggagucuaugcuuaaaaaaaaaaaauuuuuuuuuaaccauccuua

SEQ ID NO: 30791 - RNA, 64 nt, hsa
cuuguuguaccgaaucaacuggagucuaugcuuaaaaaaaaaaaauuuuuuuuuaaccauccuu

SEQ ID NO: 30792 - RNA, 64 nt, hsa
gcuuguuguaccgaaucaacuggagucuaugcuuaaaaaaaaaaaauuuuuuuuuaaccauccu

SEQ ID NO: 30793 - RNA, 64 nt, hsa
ucuguaaguuggaacuuauuuccaaacaugauugaaaaaaaaccccgcacuuggcaacuucuuc

SEQ ID NO: 30794 - RNA, 64 nt, hsa
agucaaucagauaagaaguauacuuugauuaaguaaaaaaaaucccuauucuuggaaaauacac

SEQ ID NO: 30795 - RNA, 64 nt, hsa
gaaauaucuuguuaugccagaaaguaauguuaaaaaaaaaaauagagguauauugccaaaacau

SEQ ID NO: 30796 - RNA, 64 nt, hsa
ugaaauaucuuguuaugccagaaaguaauguuaaaaaaaaaaauagagguauauugccaaaaca

SEQ ID NO: 30797 - RNA, 64 nt, hsa
uugaaauaucuuguuaugccagaaaguaauguuaaaaaaaaaaauagagguauauugccaaaac

SEQ ID NO: 30798 - RNA, 64 nt, hsa
cuugaaauaucuuguuaugccagaaaguaauguuaaaaaaaaaaauagagguauauugccaaaa

SEQ ID NO: 30799 - RNA, 64 nt, hsa
ccuucugaagucugagcccauuucuggggggagaaaaaaaaagcaaaucagaaaacccacgguu

SEQ ID NO: 30800 - RNA, 64 nt, hsa
uccuucugaagucugagcccauuucuggggggagaaaaaaaaagcaaaucagaaaacccacggu

SEQ ID NO: 30801 - RNA, 64 nt, hsa
uauguauuagugauauuucucuaguaguuaaaaaaaaaaaaaggaaaaaaagacucuuuuuggu

SEQ ID NO: 30802 - RNA, 64 nt, hsa
guauguauuagugauauuucucuaguaguuaaaaaaaaaaaaaggaaaaaaagacucuuuuugg

SEQ ID NO: 30803 - RNA, 64 nt, hsa
uguauguauuagugauauuucucuaguaguuaaaaaaaaaaaaaggaaaaaaagacucuuuuug

SEQ ID NO: 30804 - RNA, 64 nt, hsa
cuguauguauuagugauauuucucuaguaguuaaaaaaaaaaaaaggaaaaaaagacucuuuuu

SEQ ID NO: 30805 - RNA, 64 nt, hsa
ucuguauguauuagugauauuucucuaguaguuaaaaaaaaaaaaaggaaaaaaagacucuuuu

SEQ ID NO: 30806 - RNA, 64 nt, hsa
aucuguauguauuagugauauuucucuaguaguuaaaaaaaaaaaaaggaaaaaaagacucuuu

SEQ ID NO: 30807 - RNA, 64 nt, hsa
auuugcaaugggauguaugaauacagcagcaagaaaaaaaaaugccauaauacaaaaggcucca

SEQ ID NO: 30808 - RNA, 64 nt, hsa
gauuugcaaugggauguaugaauacagcagcaagaaaaaaaaaugccauaauacaaaaggcucc

SEQ ID NO: 30809 - RNA, 64 nt, hsa
agucacaauguucuuuauauacaauaauggaaaaaaaaaaaagaggaaaacccucaagggcaug

SEQ ID NO: 30810 - RNA, 64 nt, hsa
aagucacaauguucuuuauauacaauaauggaaaaaaaaaaaagaggaaaacccucaagggcau

SEQ ID NO: 30811 - RNA, 64 nt, hsa
aaagucacaauguucuuuauauacaauaauggaaaaaaaaaaaagaggaaaacccucaagggca

SEQ ID NO: 30812 - RNA, 64 nt, hsa
aaaagucacaauguucuuuauauacaauaauggaaaaaaaaaaaagaggaaaacccucaagggc

SEQ ID NO: 30813 - RNA, 64 nt, hsa
uaaaagucacaauguucuuuauauacaauaauggaaaaaaaaaaaagaggaaaacccucaaggg

SEQ ID NO: 30814 - RNA, 64 nt, hsa
gcuauuucuaaauauuuuaaauuagcuuuucuaaaaaaaaaauccagccucauaaaguagauua

SEQ ID NO: 30815 - RNA, 64 nt, hsa
agcuauuucuaaauauuuuaaauuagcuuuucuaaaaaaaaaauccagccucauaaaguagauu

SEQ ID NO: 30816 - RNA, 64 nt, hsa
uagcuauuucuaaauauuuuaaauuagcuuuucuaaaaaaaaaauccagccucauaaaguagau

SEQ ID NO: 30817 - RNA, 64 nt, hsa
uuuguacugagugguacaagccuuggggacugaaaaaaaaaagauuaaaaccauuaaaaagaaa

SEQ ID NO: 30818 - RNA, 64 nt, hsa
auuuguacugagugguacaagccuuggggacugaaaaaaaaaagauuaaaaccauuaaaaagaa

SEQ ID NO: 30819 - RNA, 64 nt, hsa
cauuuguacugagugguacaagccuuggggacugaaaaaaaaaagauuaaaaccauuaaaaaga

SEQ ID NO: 30820 - RNA, 64 nt, hsa
acugauaauaucuguaaugacaucagaaugaaagaaaaaaaauuguacaguguauauuccuuug

SEQ ID NO: 30821 - RNA, 64 nt, hsa
ucauugguaaauaguagucuauuuuccucugcuuaaaaaaaauuuuaaguauauccuuuaaagg

SEQ ID NO: 30822 - RNA, 64 nt, hsa
aaacuuggacccuuggaaaacaaaaguuuuaauuaaaaaaaauccuugugacuuacaauuugca

SEQ ID NO: 30823 - RNA, 64 nt, hsa
cuguagacucuaagauacacugcacuuuguuuagaaaaaaaacugaagaugaaauauauauugu

SEQ ID NO: 30824 - RNA, 64 nt, hsa
uaauauacuagauguuaagguuguuaauguacaaaaaaaaaacccuuauacucaccugcguuuu

SEQ ID NO: 30825 - RNA, 64 nt, hsa
uuaauauacuagauguuaagguuguuaauguacaaaaaaaaaacccuuauacucaccugcguuu

SEQ ID NO: 30826 - RNA, 64 nt, hsa
cuuaauauacuagauguuaagguuguuaauguacaaaaaaaaaacccuuauacucaccugcguu

SEQ ID NO: 30827 - RNA, 64 nt, hsa
ggcuucuacugaagaaccauaaagaaaagaugaaaaaaaaaacuaucaaagaaagaugaaauaa

SEQ ID NO: 30828 - RNA, 64 nt, hsa
uggcuucuacugaagaaccauaaagaaaagaugaaaaaaaaaacuaucaaagaaagaugaaaua

SEQ ID NO: 30829 - RNA, 64 nt, hsa
cuggcuucuacugaagaaccauaaagaaaagaugaaaaaaaaaacuaucaaagaaagaugaaau

SEQ ID NO: 30830 - RNA, 64 nt, hsa
aagcugcagauuuagagaacauuggcuucugaaaaaaaaaaagagugaagauaguacuagcaag

SEQ ID NO: 30831 - RNA, 64 nt, hsa
gaagcugcagauuuagagaacauuggcuucugaaaaaaaaaaagagugaagauaguacuagcaa

SEQ ID NO: 30832 - RNA, 64 nt, hsa
ugaagcugcagauuuagagaacauuggcuucugaaaaaaaaaaagagugaagauaguacuagca

SEQ ID NO: 30833 - RNA, 64 nt, hsa
augaagcugcagauuuagagaacauuggcuucugaaaaaaaaaaagagugaagauaguacuagc

SEQ ID NO: 30834 - RNA, 64 nt, hsa
ugcuuuauaaacuauauuagagggacuggguuuaaaaaaaaagauauaggguagaaauaagagc

SEQ ID NO: 30835 - RNA, 64 nt, hsa
gugcuuuauaaacuauauuagagggacuggguuuaaaaaaaaagauauaggguagaaauaagag

SEQ ID NO: 30836 - RNA, 64 nt, hsa
auuucauuaaagaaguugggagaacaaauaggaaaaaaaaaacuuauuuuucuaguaaauauua

SEQ ID NO: 30837 - RNA, 64 nt, hsa
uauuucauuaaagaaguugggagaacaaauaggaaaaaaaaaacuuauuuuucuaguaaauauu

SEQ ID NO: 30838 - RNA, 64 nt, hsa
uuauuucauuaaagaaguugggagaacaaauaggaaaaaaaaaacuuauuuuucuaguaaauau

SEQ ID NO: 30839 - RNA, 64 nt, hsa
aaguucuagcuuaaguguugaaacuuuugugggaaaaaaaaaucacuuuugaaacucagacuuc

SEQ ID NO: 30840 - RNA, 64 nt, hsa
aaaguucuagcuuaaguguugaaacuuuugugggaaaaaaaaaucacuuuugaaacucagacuu

SEQ ID NO: 30841 - RNA, 64 nt, hsa
uaauuuaaaacuaugguguaagucuuugacaagaaaaaaaaacaaacaaacacuucuuuccauc

SEQ ID NO: 30842 - RNA, 64 nt, hsa
uuaauuuaaaacuaugguguaagucuuugacaagaaaaaaaaacaaacaaacacuucuuuccau

SEQ ID NO: 30843 - RNA, 64 nt, hsa
acuauccaaaaacuuagaugagcagaaugacaaaaaaaaaaaggccaaugagaacucaacuccu

SEQ ID NO: 30844 - RNA, 64 nt, hsa
aacuauccaaaaacuuagaugagcagaaugacaaaaaaaaaaaggccaaugagaacucaacucc

SEQ ID NO: 30845 - RNA, 64 nt, hsa
caacuauccaaaaacuuagaugagcagaaugacaaaaaaaaaaaggccaaugagaacucaacuc

SEQ ID NO: 30846 - RNA, 64 nt, hsa
ccaacuauccaaaaacuuagaugagcagaaugacaaaaaaaaaaaggccaaugagaacucaacu

SEQ ID NO: 30847 - RNA, 64 nt, hsa
uuacugcuugcaguaauucaacuggaaauuaaaaaaaaaaaacuagacuccauugugccuuacu

SEQ ID NO: 30848 - RNA, 64 nt, hsa
auuacugcuugcaguaauucaacuggaaauuaaaaaaaaaaaacuagacuccauugugccuuac

SEQ ID NO: 30849 - RNA, 64 nt, hsa
uauuacugcuugcaguaauucaacuggaaauuaaaaaaaaaaaacuagacuccauugugccuua

SEQ ID NO: 30850 - RNA, 64 nt, hsa
uuauuacugcuugcaguaauucaacuggaaauuaaaaaaaaaaaacuagacuccauugugccuu

SEQ ID NO: 30851 - RNA, 64 nt, hsa
cuuauuacugcuugcaguaauucaacuggaaauuaaaaaaaaaaaacuagacuccauugugccu

SEQ ID NO: 30852 - RNA, 64 nt, hsa
aaaacaugacaguggauucucuuuacaaauggaaaaaaaaaauccuuauuuuguauaaaggacu

SEQ ID NO: 30853 - RNA, 64 nt, hsa
caaaacaugacaguggauucucuuuacaaauggaaaaaaaaaauccuuauuuuguauaaaggac

SEQ ID NO: 30854 - RNA, 64 nt, hsa
gcaaaacaugacaguggauucucuuuacaaauggaaaaaaaaaauccuuauuuuguauaaagga

SEQ ID NO: 30855 - RNA, 64 nt, hsa
aaaaauuguuagaaauggguaaaaaaaaaaaaaaaaaaaaaacccugauuuauuacuaugucuu

SEQ ID NO: 30856 - RNA, 64 nt, hsa
uaaaaauuguuagaaauggguaaaaaaaaaaaaaaaaaaaaaacccugauuuauuacuaugucu

SEQ ID NO: 30857 - RNA, 64 nt, hsa
guaaaaauuguuagaaauggguaaaaaaaaaaaaaaaaaaaaaacccugauuuauuacuauguc

SEQ ID NO: 30858 - RNA, 64 nt, hsa
aguaaaaauuguuagaaauggguaaaaaaaaaaaaaaaaaaaaaacccugauuuauuacuaugu

SEQ ID NO: 30859 - RNA, 64 nt, hsa
caguaaaaauuguuagaaauggguaaaaaaaaaaaaaaaaaaaaaacccugauuuauuacuaug

SEQ ID NO: 30860 - RNA, 64 nt, hsa
acaguaaaaauuguuagaaauggguaaaaaaaaaaaaaaaaaaaaaacccugauuuauuacuau

SEQ ID NO: 30861 - RNA, 64 nt, hsa
uacaguaaaaauuguuagaaauggguaaaaaaaaaaaaaaaaaaaaaacccugauuuauuacua

SEQ ID NO: 30862 - RNA, 64 nt, hsa
uuacaguaaaaauuguuagaaauggguaaaaaaaaaaaaaaaaaaaaaacccugauuuauuacu

SEQ ID NO: 30863 - RNA, 64 nt, hsa
uuuacaguaaaaauuguuagaaauggguaaaaaaaaaaaaaaaaaaaaaacccugauuuauuac

SEQ ID NO: 30864 - RNA, 64 nt, hsa
uuuuacaguaaaaauuguuagaaauggguaaaaaaaaaaaaaaaaaaaaaacccugauuuauua

SEQ ID NO: 30865 - RNA, 64 nt, hsa
auuuuacaguaaaaauuguuagaaauggguaaaaaaaaaaaaaaaaaaaaaacccugauuuauu

SEQ ID NO: 30866 - RNA, 64 nt, hsa
aauuuuacaguaaaaauuguuagaaauggguaaaaaaaaaaaaaaaaaaaaaacccugauuuau

SEQ ID NO: 30867 - RNA, 64 nt, hsa
aaauuuuacaguaaaaauuguuagaaauggguaaaaaaaaaaaaaaaaaaaaaacccugauuua

SEQ ID NO: 30868 - RNA, 64 nt, hsa
aaaauuuuacaguaaaaauuguuagaaauggguaaaaaaaaaaaaaaaaaaaaaacccugauuu

SEQ ID NO: 30869 - RNA, 64 nt, hsa
aaaaauuuuacaguaaaaauuguuagaaauggguaaaaaaaaaaaaaaaaaaaaaacccugauu

SEQ ID NO: 30870 - RNA, 64 nt, hsa
uuauauaguauuuugaagauauggaaccuuaugaaaaaaaaauagcaaauuaguucuuuuuccc

SEQ ID NO: 30871 - RNA, 64 nt, hsa
auuauauaguauuuugaagauauggaaccuuaugaaaaaaaaauagcaaauuaguucuuuuucc

SEQ ID NO: 30872 - RNA, 64 nt, hsa
guuuuuuucaaaaaaaaaaaaaaaacaaaaacaaaaaaaaaacacaaaagcugcaugucuaaaa

SEQ ID NO: 30873 - RNA, 64 nt, hsa
gguuuuuuucaaaaaaaaaaaaaaaacaaaaacaaaaaaaaaacacaaaagcugcaugucuaaa

SEQ ID NO: 30874 - RNA, 64 nt, hsa
ugguuuuuuucaaaaaaaaaaaaaaaacaaaaacaaaaaaaaaacacaaaagcugcaugucuaa

SEQ ID NO: 30875 - RNA, 64 nt, hsa
gaucucaaaauaaacugguuuuuuucaaaaaaaaaaaaaaaacaaaaacaaaaaaaaaacacaa

SEQ ID NO: 30876 - RNA, 64 nt, hsa
ugaucucaaaauaaacugguuuuuuucaaaaaaaaaaaaaaaacaaaaacaaaaaaaaaacaca

SEQ ID NO: 30877 - RNA, 64 nt, hsa
cugaucucaaaauaaacugguuuuuuucaaaaaaaaaaaaaaaacaaaaacaaaaaaaaaacac

SEQ ID NO: 30878 - RNA, 64 nt, hsa
acugaucucaaaauaaacugguuuuuuucaaaaaaaaaaaaaaaacaaaaacaaaaaaaaaaca

SEQ ID NO: 30879 - RNA, 64 nt, hsa
cacugaucucaaaauaaacugguuuuuuucaaaaaaaaaaaaaaaacaaaaacaaaaaaaaaac

SEQ ID NO: 30880 - RNA, 64 nt, hsa
ucacugaucucaaaauaaacugguuuuuuucaaaaaaaaaaaaaaaacaaaaacaaaaaaaaaa

SEQ ID NO: 30881 - RNA, 64 nt, hsa
uucacugaucucaaaauaaacugguuuuuuucaaaaaaaaaaaaaaaacaaaaacaaaaaaaaa

SEQ ID NO: 30882 - RNA, 64 nt, hsa
uuucacugaucucaaaauaaacugguuuuuuucaaaaaaaaaaaaaaaacaaaaacaaaaaaaa

SEQ ID NO: 30883 - RNA, 64 nt, hsa
uuuucacugaucucaaaauaaacugguuuuuuucaaaaaaaaaaaaaaaacaaaaacaaaaaaa

SEQ ID NO: 30884 - RNA, 64 nt, hsa
aaguccucuguaaggugucaggcaagccaaaaaaaaaaaaaagaugcguaaguccuaaccccca

SEQ ID NO: 30885 - RNA, 64 nt, hsa
uaaguccucuguaaggugucaggcaagccaaaaaaaaaaaaaagaugcguaaguccuaaccccc

SEQ ID NO: 30886 - RNA, 64 nt, hsa
uuaaguccucuguaaggugucaggcaagccaaaaaaaaaaaaaagaugcguaaguccuaacccc

SEQ ID NO: 30887 - RNA, 64 nt, hsa
auuaaguccucuguaaggugucaggcaagccaaaaaaaaaaaaaagaugcguaaguccuaaccc

SEQ ID NO: 30888 - RNA, 64 nt, hsa
cauuaaguccucuguaaggugucaggcaagccaaaaaaaaaaaaaagaugcguaaguccuaacc

SEQ ID NO: 30889 - RNA, 64 nt, hsa
gcauuaaguccucuguaaggugucaggcaagccaaaaaaaaaaaaaagaugcguaaguccuaac

SEQ ID NO: 30890 - RNA, 64 nt, hsa
ugcauuaaguccucuguaaggugucaggcaagccaaaaaaaaaaaaaagaugcguaaguccuaa

SEQ ID NO: 30891 - RNA, 64 nt, hsa
uaacugaaauauaaucagaaacauuaaagccuguaaaaaaaaauugcugcguuuuugguaaagg

SEQ ID NO: 30892 - RNA, 64 nt, hsa
aacugaaauauaaucagaaacauuaaagccuguaaaaaaaaauugcugcguuuuugguaaaggg

SEQ ID NO: 30893 - RNA, 64 nt, hsa
aacaugugggaaaaaauauuacauuuuaagggggaaaaaaaaacccaccauucucuucuccccc

SEQ ID NO: 30894 - RNA, 64 nt, hsa
acaugugggaaaaaauauuacauuuuaagggggaaaaaaaaacccaccauucucuucucccccu

SEQ ID NO: 30895 - RNA, 64 nt, hsa
cuccagccugggcaacagaguaagacucagucucaaaaaaaaaaaaaagagugaaaugcuuuuu

SEQ ID NO: 30896 - RNA, 64 nt, hsa
uccagccugggcaacagaguaagacucagucucaaaaaaaaaaaaaagagugaaaugcuuuuug

SEQ ID NO: 30897 - RNA, 64 nt, hsa
ccagccugggcaacagaguaagacucagucucaaaaaaaaaaaaaagagugaaaugcuuuuugu

SEQ ID NO: 30898 - RNA, 64 nt, hsa
cagccugggcaacagaguaagacucagucucaaaaaaaaaaaaaagagugaaaugcuuuuuguu

SEQ ID NO: 30899 - RNA, 64 nt, hsa
agccugggcaacagaguaagacucagucucaaaaaaaaaaaaaagagugaaaugcuuuuuguuu

SEQ ID NO: 30900 - RNA, 64 nt, hsa
gccugggcaacagaguaagacucagucucaaaaaaaaaaaaaagagugaaaugcuuuuuguuug

SEQ ID NO: 30901 - RNA, 64 nt, hsa
ccugggcaacagaguaagacucagucucaaaaaaaaaaaaaagagugaaaugcuuuuuguuugc

SEQ ID NO: 30902 - RNA, 64 nt, hsa
aagaaaauggaaaaaaacccacaaaacaaacuuuaaaaaaaaaaaaaaacaaauuugccaaggu

SEQ ID NO: 30903 - RNA, 64 nt, hsa
agaaaauggaaaaaaacccacaaaacaaacuuuaaaaaaaaaaaaaaacaaauuugccaagguu

SEQ ID NO: 30904 - RNA, 64 nt, hsa
gaaaauggaaaaaaacccacaaaacaaacuuuaaaaaaaaaaaaaaacaaauuugccaagguuu

SEQ ID NO: 30905 - RNA, 64 nt, hsa
aaaauggaaaaaaacccacaaaacaaacuuuaaaaaaaaaaaaaaacaaauuugccaagguuua

SEQ ID NO: 30906 - RNA, 64 nt, hsa
aaauggaaaaaaacccacaaaacaaacuuuaaaaaaaaaaaaaaacaaauuugccaagguuuag

SEQ ID NO: 30907 - RNA, 64 nt, hsa
aauggaaaaaaacccacaaaacaaacuuuaaaaaaaaaaaaaaacaaauuugccaagguuuagc

SEQ ID NO: 30908 - RNA, 64 nt, hsa
auggaaaaaaacccacaaaacaaacuuuaaaaaaaaaaaaaaacaaauuugccaagguuuagcu

SEQ ID NO: 30909 - RNA, 64 nt, hsa
uggaaaaaaacccacaaaacaaacuuuaaaaaaaaaaaaaaacaaauuugccaagguuuagcug

SEQ ID NO: 30910 - RNA, 64 nt, hsa
ggacaacauagggagaccccaucucuaccggaggaaaaaaaaaagagucaggccugguggugug

SEQ ID NO: 30911 - RNA, 64 nt, hsa
gacaacauagggagaccccaucucuaccggaggaaaaaaaaaagagucaggccugguggugugc

SEQ ID NO: 30912 - RNA, 64 nt, hsa
acaacauagggagaccccaucucuaccggaggaaaaaaaaaagagucaggccugguggugugcg

SEQ ID NO: 30913 - RNA, 64 nt, hsa
cuccagccugggugacagagcaagacuccaucucaaaaaaaaaauaaauaaaaaaaaaugcagc

SEQ ID NO: 30914 - RNA, 64 nt, hsa
uccagccugggugacagagcaagacuccaucucaaaaaaaaaauaaauaaaaaaaaaugcagcu

SEQ ID NO: 30915 - RNA, 64 nt, hsa
ccagccugggugacagagcaagacuccaucucaaaaaaaaaauaaauaaaaaaaaaugcagcug

SEQ ID NO: 30916 - RNA, 64 nt, hsa
cagagcaagacuccaucucaaaaaaaaaauaaauaaaaaaaaaugcagcugcaggagugaggcg

SEQ ID NO: 30917 - RNA, 64 nt, hsa
agagcaagacuccaucucaaaaaaaaaauaaauaaaaaaaaaugcagcugcaggagugaggcgc

SEQ ID NO: 30918 - RNA, 64 nt, hsa
caacaugacgaaaccccaucucuacugaaaauagaaaaaaaaaauuagccaggcuugcaccugu

SEQ ID NO: 30919 - RNA, 64 nt, hsa
aacaugacgaaaccccaucucuacugaaaauagaaaaaaaaaauuagccaggcuugcaccugua

SEQ ID NO: 30920 - RNA, 64 nt, hsa
acaugacgaaaccccaucucuacugaaaauagaaaaaaaaaauuagccaggcuugcaccuguaa

SEQ ID NO: 30921 - RNA, 64 nt, hsa
ggacuguccauugacguuccuaaugugguagcagaaaaaaaaaaauggugucuuaagugcuuag

SEQ ID NO: 30922 - RNA, 64 nt, hsa
gacuguccauugacguuccuaaugugguagcagaaaaaaaaaaauggugucuuaagugcuuagu

SEQ ID NO: 30923 - RNA, 64 nt, hsa
acuguccauugacguuccuaaugugguagcagaaaaaaaaaaauggugucuuaagugcuuagug

SEQ ID NO: 30924 - RNA, 64 nt, hsa
cuguccauugacguuccuaaugugguagcagaaaaaaaaaaauggugucuuaagugcuuagugu

SEQ ID NO: 30925 - RNA, 64 nt, hsa
uugcuucuguuuauuaaaauugaccugcaaaguuaaaaaaaaauuaaaguugagaacagguaua

SEQ ID NO: 30926 - RNA, 64 nt, hsa
ugcuucuguuuauuaaaauugaccugcaaaguuaaaaaaaaauuaaaguugagaacagguauaa

SEQ ID NO: 30927 - RNA, 64 nt, hsa
aaacaaaugaaaaacguuuaaaaagaagaagaagaaaaaaaacaagaacaagcagcaacagcug

SEQ ID NO: 30928 - RNA, 64 nt, hsa
auuuuaaaguguuccagacccaaaaaggaaaaauaaaaaaaaaggaauauuuguacccaacagc

SEQ ID NO: 30929 - RNA, 64 nt, hsa
uuuuaaaguguuccagacccaaaaaggaaaaauaaaaaaaaaggaauauuuguacccaacagcu

SEQ ID NO: 30930 - RNA, 64 nt, hsa
aauuucaucacuguugaugugguucuuuuguguuaaaaaaaaaaagugcaacuaucaaaacuaa

SEQ ID NO: 30931 - RNA, 64 nt, hsa
auuucaucacuguugaugugguucuuuuguguuaaaaaaaaaaagugcaacuaucaaaacuaaa

SEQ ID NO: 30932 - RNA, 64 nt, hsa
uuucaucacuguugaugugguucuuuuguguuaaaaaaaaaaagugcaacuaucaaaacuaaaa

SEQ ID NO: 30933 - RNA, 64 nt, hsa
uucaucacuguugaugugguucuuuuguguuaaaaaaaaaaagugcaacuaucaaaacuaaaaa

SEQ ID NO: 30934 - RNA, 64 nt, hsa
uaugccuucauauuagcaaauaugaaauucugugaaaaaaaacccuuugaucuuaaaaaaaaaa

SEQ ID NO: 30935 - RNA, 64 nt, hsa
uaugaaauucugugaaaaaaaacccuuugaucuuaaaaaaaaaaaaaccaccccccccuucugu

SEQ ID NO: 30936 - RNA, 64 nt, hsa
augaaauucugugaaaaaaaacccuuugaucuuaaaaaaaaaaaaaccaccccccccuucugua

SEQ ID NO: 30937 - RNA, 64 nt, hsa
ugaaauucugugaaaaaaaacccuuugaucuuaaaaaaaaaaaaaccaccccccccuucuguag

SEQ ID NO: 30938 - RNA, 64 nt, hsa
gaaauucugugaaaaaaaacccuuugaucuuaaaaaaaaaaaaaccaccccccccuucuguagc

SEQ ID NO: 30939 - RNA, 64 nt, hsa
aaauucugugaaaaaaaacccuuugaucuuaaaaaaaaaaaaaccaccccccccuucuguagca

SEQ ID NO: 30940 - RNA, 64 nt, hsa
aauucugugaaaaaaaacccuuugaucuuaaaaaaaaaaaaaccaccccccccuucuguagcag

SEQ ID NO: 30941 - RNA, 64 nt, hsa
gagcuggccacaggcuggcagccuccaggggcuuaaaaaaaaaggcaaagaacacagaaagagg

SEQ ID NO: 30942 - RNA, 64 nt, hsa
agcuggccacaggcuggcagccuccaggggcuuaaaaaaaaaggcaaagaacacagaaagagga

SEQ ID NO: 30943 - RNA, 64 nt, hsa
uugguuggacugcucauggauuuuguagcuguuuaaaaaaaaaaaaaagguagcugugauacaa

SEQ ID NO: 30944 - RNA, 64 nt, hsa
ugguuggacugcucauggauuuuguagcuguuuaaaaaaaaaaaaaagguagcugugauacaaa

SEQ ID NO: 30945 - RNA, 64 nt, hsa
gguuggacugcucauggauuuuguagcuguuuaaaaaaaaaaaaaagguagcugugauacaaac

SEQ ID NO: 30946 - RNA, 64 nt, hsa
guuggacugcucauggauuuuguagcuguuuaaaaaaaaaaaaaagguagcugugauacaaacc

SEQ ID NO: 30947 - RNA, 64 nt, hsa
uuggacugcucauggauuuuguagcuguuuaaaaaaaaaaaaaagguagcugugauacaaaccc

SEQ ID NO: 30948 - RNA, 64 nt, hsa
uggacugcucauggauuuuguagcuguuuaaaaaaaaaaaaaagguagcugugauacaaacccc

SEQ ID NO: 30949 - RNA, 64 nt, hsa
ggacugcucauggauuuuguagcuguuuaaaaaaaaaaaaaagguagcugugauacaaacccca

SEQ ID NO: 30950 - RNA, 64 nt, hsa
uuucaaguaaauauagcauuccuuuggcaaaaagaaaaaaaaaguaaaagaaaagaaaaaaaau

SEQ ID NO: 30951 - RNA, 64 nt, hsa
uucaaguaaauauagcauuccuuuggcaaaaagaaaaaaaaaguaaaagaaaagaaaaaaaaug

SEQ ID NO: 30952 - RNA, 64 nt, hsa
cuuuggcaaaaagaaaaaaaaaguaaaagaaaagaaaaaaaauguauuaccacccgaugagccu

SEQ ID NO: 30953 - RNA, 64 nt, hsa
uuguucugcuuguuguaauggugaaugcuuuaagaaaaaaaaguguaauuugcuaagaauaauu

SEQ ID NO: 30954 - RNA, 64 nt, hsa
uuuaaacuuauugcacuaaauacaggcucuguacaaaaaaaaaaaaaaaaaaaaagccucagca

SEQ ID NO: 30955 - RNA, 64 nt, hsa
uuaaacuuauugcacuaaauacaggcucuguacaaaaaaaaaaaaaaaaaaaaagccucagcau

SEQ ID NO: 30956 - RNA, 64 nt, hsa
uaaacuuauugcacuaaauacaggcucuguacaaaaaaaaaaaaaaaaaaaaagccucagcauu

SEQ ID NO: 30957 - RNA, 64 nt, hsa
aaacuuauugcacuaaauacaggcucuguacaaaaaaaaaaaaaaaaaaaaagccucagcauuu

SEQ ID NO: 30958 - RNA, 64 nt, hsa
aacuuauugcacuaaauacaggcucuguacaaaaaaaaaaaaaaaaaaaaagccucagcauuuu

SEQ ID NO: 30959 - RNA, 64 nt, hsa
acuuauugcacuaaauacaggcucuguacaaaaaaaaaaaaaaaaaaaaagccucagcauuuua

SEQ ID NO: 30960 - RNA, 64 nt, hsa
cuuauugcacuaaauacaggcucuguacaaaaaaaaaaaaaaaaaaaaagccucagcauuuuau

SEQ ID NO: 30961 - RNA, 64 nt, hsa
uuauugcacuaaauacaggcucuguacaaaaaaaaaaaaaaaaaaaaagccucagcauuuuauc

SEQ ID NO: 30962 - RNA, 64 nt, hsa
uauugcacuaaauacaggcucuguacaaaaaaaaaaaaaaaaaaaaagccucagcauuuuauca

SEQ ID NO: 30963 - RNA, 64 nt, hsa
auugcacuaaauacaggcucuguacaaaaaaaaaaaaaaaaaaaaagccucagcauuuuaucau

SEQ ID NO: 30964 - RNA, 64 nt, hsa
uugcacuaaauacaggcucuguacaaaaaaaaaaaaaaaaaaaaagccucagcauuuuaucauu

SEQ ID NO: 30965 - RNA, 64 nt, hsa
ugcacuaaauacaggcucuguacaaaaaaaaaaaaaaaaaaaaagccucagcauuuuaucauuc

SEQ ID NO: 30966 - RNA, 64 nt, hsa
gcacuaaauacaggcucuguacaaaaaaaaaaaaaaaaaaaaagccucagcauuuuaucauucc

SEQ ID NO: 30967 - RNA, 64 nt, hsa
cacuaaauacaggcucuguacaaaaaaaaaaaaaaaaaaaaagccucagcauuuuaucauucca

SEQ ID NO: 30968 - RNA, 64 nt, hsa
agcuuuuucaagaccuaacugcagccgcuuugggaaaaaaaaacaaaaaacaaaaaacagaaaa

SEQ ID NO: 30969 - RNA, 64 nt, hsa
gcuuuuucaagaccuaacugcagccgcuuugggaaaaaaaaacaaaaaacaaaaaacagaaaac

SEQ ID NO: 30970 - RNA, 64 nt, hsa
ucugucuacucagaucauagugaaaacuggaaacaaaaaaaaaaaacagccucuucuuggaaag

SEQ ID NO: 30971 - RNA, 64 nt, hsa
cugucuacucagaucauagugaaaacuggaaacaaaaaaaaaaaacagccucuucuuggaaagu

SEQ ID NO: 30972 - RNA, 64 nt, hsa
ugucuacucagaucauagugaaaacuggaaacaaaaaaaaaaaacagccucuucuuggaaagug

SEQ ID NO: 30973 - RNA, 64 nt, hsa
gucuacucagaucauagugaaaacuggaaacaaaaaaaaaaaacagccucuucuuggaaaguga

SEQ ID NO: 30974 - RNA, 64 nt, hsa
ucuacucagaucauagugaaaacuggaaacaaaaaaaaaaaacagccucuucuuggaaagugac

SEQ ID NO: 30975 - RNA, 64 nt, hsa
gauggugggggcauuuuuagagcggcaauaauugaaaaaaaaggcgaacucugccuuggagagg

SEQ ID NO: 30976 - RNA, 64 nt, hsa
gaugagaaaauuuucaauucuggccaugagaaagaaaaaaaaauaaacagccuucuuuuuuuuu

SEQ ID NO: 30977 - RNA, 64 nt, hsa
augagaaaauuuucaauucuggccaugagaaagaaaaaaaaauaaacagccuucuuuuuuuuuc

SEQ ID NO: 30978 - RNA, 64 nt, hsa
aacuaaagaauggauuuaauuaaacuauguauugaaaaaaaaguagccuaaguguuagagaugg

SEQ ID NO: 30979 - RNA, 64 nt, hsa
cuccagccuggaugacagagcaaaaaacugucucaaaaaaaaaaaaaucuuacaaccucacaaa

SEQ ID NO: 30980 - RNA, 64 nt, hsa
uccagccuggaugacagagcaaaaaacugucucaaaaaaaaaaaaaucuuacaaccucacaaau

SEQ ID NO: 30981 - RNA, 64 nt, hsa
ccagccuggaugacagagcaaaaaacugucucaaaaaaaaaaaaaucuuacaaccucacaaaua

SEQ ID NO: 30982 - RNA, 64 nt, hsa
cagccuggaugacagagcaaaaaacugucucaaaaaaaaaaaaaucuuacaaccucacaaauaa

SEQ ID NO: 30983 - RNA, 64 nt, hsa
agccuggaugacagagcaaaaaacugucucaaaaaaaaaaaaaucuuacaaccucacaaauaac

SEQ ID NO: 30984 - RNA, 64 nt, hsa
gccuggaugacagagcaaaaaacugucucaaaaaaaaaaaaaucuuacaaccucacaaauaacc

SEQ ID NO: 30985 - RNA, 60 nt, hsa
agaugaaugccagacugugaaggaaaauauaaaaaaaaagucgacugcuaugcucaaaaa

SEQ ID NO: 30986 - RNA, 61 nt, hsa
agaugaaugccagacugugaaggaaaauauaaaaaaaaagucgacugcuaugcucaaaaag

SEQ ID NO: 30987 - RNA, 64 nt, hsa
uccagccugggugacaagagugaaacuccaucucaaaaaaaaagaaaagaagguccagcuuuug

SEQ ID NO: 30988 - RNA, 64 nt, hsa
ccagccugggugacaagagugaaacuccaucucaaaaaaaaagaaaagaagguccagcuuuugg

SEQ ID NO: 30989 - RNA, 64 nt, hsa
uccagccugggcgacaagagcaaaacuccgucucaaaaaaaaaaaaaagauacaaagucugcau

SEQ ID NO: 30990 - RNA, 64 nt, hsa
ccagccugggcgacaagagcaaaacuccgucucaaaaaaaaaaaaaagauacaaagucugcauu

SEQ ID NO: 30991 - RNA, 64 nt, hsa
cagccugggcgacaagagcaaaacuccgucucaaaaaaaaaaaaaagauacaaagucugcauuu

SEQ ID NO: 30992 - RNA, 64 nt, hsa
agccugggcgacaagagcaaaacuccgucucaaaaaaaaaaaaaagauacaaagucugcauuug

SEQ ID NO: 30993 - RNA, 64 nt, hsa
gccugggcgacaagagcaaaacuccgucucaaaaaaaaaaaaaagauacaaagucugcauuuga

SEQ ID NO: 30994 - RNA, 64 nt, hsa
ccugggcgacaagagcaaaacuccgucucaaaaaaaaaaaaaagauacaaagucugcauuugau

SEQ ID NO: 30995 - RNA, 64 nt, hsa
cugggcgacaagagcaaaacuccgucucaaaaaaaaaaaaaagauacaaagucugcauuugaua

SEQ ID NO: 30996 - RNA, 64 nt, hsa
cucuagccugugugacagagcaagacccugucucaaaaaaaaaaaaaauuuguucgaaugccuu

SEQ ID NO: 30997 - RNA, 64 nt, hsa
ucuagccugugugacagagcaagacccugucucaaaaaaaaaaaaaauuuguucgaaugccuua

SEQ ID NO: 30998 - RNA, 64 nt, hsa
cuagccugugugacagagcaagacccugucucaaaaaaaaaaaaaauuuguucgaaugccuuau

SEQ ID NO: 30999 - RNA, 64 nt, hsa
uagccugugugacagagcaagacccugucucaaaaaaaaaaaaaauuuguucgaaugccuuaua

SEQ ID NO: 31000 - RNA, 64 nt, hsa
agccugugugacagagcaagacccugucucaaaaaaaaaaaaaauuuguucgaaugccuuauag

SEQ ID NO: 31001 - RNA, 64 nt, hsa
gccugugugacagagcaagacccugucucaaaaaaaaaaaaaauuuguucgaaugccuuauagc

SEQ ID NO: 31002 - RNA, 64 nt, hsa
ccugugugacagagcaagacccugucucaaaaaaaaaaaaaauuuguucgaaugccuuauagcc

SEQ ID NO: 31003 - RNA, 64 nt, hsa
ccacauaaaauacacuaacgauagcugaugagcuaaaaaaaaaaaaaaagucuguguauaauuu

SEQ ID NO: 31004 - RNA, 64 nt, hsa
cacauaaaauacacuaacgauagcugaugagcuaaaaaaaaaaaaaaagucuguguauaauuuu

SEQ ID NO: 31005 - RNA, 64 nt, hsa
acauaaaauacacuaacgauagcugaugagcuaaaaaaaaaaaaaaagucuguguauaauuuuu

SEQ ID NO: 31006 - RNA, 64 nt, hsa
cauaaaauacacuaacgauagcugaugagcuaaaaaaaaaaaaaaagucuguguauaauuuuug

SEQ ID NO: 31007 - RNA, 64 nt, hsa
auaaaauacacuaacgauagcugaugagcuaaaaaaaaaaaaaaagucuguguauaauuuuugu

SEQ ID NO: 31008 - RNA, 64 nt, hsa
uaaaauacacuaacgauagcugaugagcuaaaaaaaaaaaaaaagucuguguauaauuuuugug

SEQ ID NO: 31009 - RNA, 64 nt, hsa
aaaauacacuaacgauagcugaugagcuaaaaaaaaaaaaaaagucuguguauaauuuuuguga

SEQ ID NO: 31010 - RNA, 64 nt, hsa
aaauacacuaacgauagcugaugagcuaaaaaaaaaaaaaaagucuguguauaauuuuugugau

SEQ ID NO: 31011 - RNA, 64 nt, hsa
ucaguguugacuuuuucuuucuuagaucuaguuuaaaaaaaaaaaaaaccacauaacaauucuu

SEQ ID NO: 31012 - RNA, 64 nt, hsa
caguguugacuuuuucuuucuuagaucuaguuuaaaaaaaaaaaaaaccacauaacaauucuuu

SEQ ID NO: 31013 - RNA, 64 nt, hsa
aguguugacuuuuucuuucuuagaucuaguuuaaaaaaaaaaaaaaccacauaacaauucuuug

SEQ ID NO: 31014 - RNA, 64 nt, hsa
guguugacuuuuucuuucuuagaucuaguuuaaaaaaaaaaaaaaccacauaacaauucuuuga

SEQ ID NO: 31015 - RNA, 64 nt, hsa
uguugacuuuuucuuucuuagaucuaguuuaaaaaaaaaaaaaaccacauaacaauucuuugaa

SEQ ID NO: 31016 - RNA, 64 nt, hsa
guugacuuuuucuuucuuagaucuaguuuaaaaaaaaaaaaaaccacauaacaauucuuugaag

SEQ ID NO: 31017 - RNA, 64 nt, hsa
uugacuuuuucuuucuuagaucuaguuuaaaaaaaaaaaaaaccacauaacaauucuuugaaga

SEQ ID NO: 31018 - RNA, 64 nt, hsa
uguacuuuuugugcaugaccuggaccugcuaaggaaaaaaaaaucuuguggauugauugcuuug

SEQ ID NO: 31019 - RNA, 64 nt, hsa
guacuuuuugugcaugaccuggaccugcuaaggaaaaaaaaaucuuguggauugauugcuuugc

SEQ ID NO: 31020 - RNA, 64 nt, hsa
ccaaggcagguguuguuaaucuaucauagcacuuaaaaaaaaaaaaaaaaagagaccaaaaaua

SEQ ID NO: 31021 - RNA, 64 nt, hsa
caaggcagguguuguuaaucuaucauagcacuuaaaaaaaaaaaaaaaaagagaccaaaaauaa

SEQ ID NO: 31022 - RNA, 64 nt, hsa
aaggcagguguuguuaaucuaucauagcacuuaaaaaaaaaaaaaaaaagagaccaaaaauaac

SEQ ID NO: 31023 - RNA, 64 nt, hsa
aggcagguguuguuaaucuaucauagcacuuaaaaaaaaaaaaaaaaagagaccaaaaauaacu

SEQ ID NO: 31024 - RNA, 64 nt, hsa
ggcagguguuguuaaucuaucauagcacuuaaaaaaaaaaaaaaaaagagaccaaaaauaacuu

SEQ ID NO: 31025 - RNA, 64 nt, hsa
gcagguguuguuaaucuaucauagcacuuaaaaaaaaaaaaaaaaagagaccaaaaauaacuuu

SEQ ID NO: 31026 - RNA, 64 nt, hsa
cagguguuguuaaucuaucauagcacuuaaaaaaaaaaaaaaaaagagaccaaaaauaacuuua

SEQ ID NO: 31027 - RNA, 64 nt, hsa
agguguuguuaaucuaucauagcacuuaaaaaaaaaaaaaaaaagagaccaaaaauaacuuuag

SEQ ID NO: 31028 - RNA, 64 nt, hsa
gguguuguuaaucuaucauagcacuuaaaaaaaaaaaaaaaaagagaccaaaaauaacuuuagg

SEQ ID NO: 31029 - RNA, 64 nt, hsa
guguuguuaaucuaucauagcacuuaaaaaaaaaaaaaaaaagagaccaaaaauaacuuuagga

SEQ ID NO: 31030 - RNA, 64 nt, hsa
uguuuuuuucuggaacuacuucaagugagaaaauaaaaaaaaauggugacaaagcuguacagau

SEQ ID NO: 31031 - RNA, 64 nt, hsa
guuuuuuucuggaacuacuucaagugagaaaauaaaaaaaaauggugacaaagcuguacagaua

SEQ ID NO: 31032 - RNA, 64 nt, hsa
gagccuuuuuuuuuuuaaucuucguaacauguuuaaaaaaaaacagugauuuuaacugcauauu

SEQ ID NO: 31033 - RNA, 64 nt, hsa
agccuuuuuuuuuuuaaucuucguaacauguuuaaaaaaaaacagugauuuuaacugcauauuu

SEQ ID NO: 31034 - RNA, 64 nt, hsa
accacauuuuaggaucucgccuggaaacagagguaaaaaaaagaagugugcgcccggcuaaugc

SEQ ID NO: 31035 - RNA, 64 nt, hsa
guauauuuaugaccagagcaaaaauguaaaaaacaaaaaaaacaacaaaaaaaguuuguuacuu

SEQ ID NO: 31036 - RNA, 64 nt, hsa
ugaugcgugcuacuugcuauuaugagagaagcuuaaaaaaaaaaaggaagauauuucugaaaga

SEQ ID NO: 31037 - RNA, 64 nt, hsa
gaugcgugcuacuugcuauuaugagagaagcuuaaaaaaaaaaaggaagauauuucugaaagac

SEQ ID NO: 31038 - RNA, 64 nt, hsa
augcgugcuacuugcuauuaugagagaagcuuaaaaaaaaaaaggaagauauuucugaaagacc

SEQ ID NO: 31039 - RNA, 64 nt, hsa
ugcgugcuacuugcuauuaugagagaagcuuaaaaaaaaaaaggaagauauuucugaaagacca

SEQ ID NO: 31040 - RNA, 64 nt, hsa
caucaaaucuuguugaguuuaaaaaauaaacagcaaaaaaaaacaaaacaaaacaaaaaaaaac

SEQ ID NO: 31041 - RNA, 64 nt, hsa
aucaaaucuuguugaguuuaaaaaauaaacagcaaaaaaaaacaaaacaaaacaaaaaaaaaca

SEQ ID NO: 31042 - RNA, 64 nt, hsa
auguaucugucuacuuucucuuguuuaaaaaaagaaaaaaaaacuuaaaaaaaugggguuauag

SEQ ID NO: 31043 - RNA, 64 nt, hsa
uguaucugucuacuuucucuuguuuaaaaaaagaaaaaaaaacuuaaaaaaaugggguuauaga

SEQ ID NO: 31044 - RNA, 64 nt, hsa
guuuuuuuuuuuuuaaucaaaaaacaauuuuuuuaaaaaaaaagcuuugaaaauggaugguuug

SEQ ID NO: 31045 - RNA, 64 nt, hsa
uuuuuuuuuuuuuaaucaaaaaacaauuuuuuuaaaaaaaaagcuuugaaaauggaugguuugg

SEQ ID NO: 31046 - RNA, 64 nt, hsa
agcuuugaaaauggaugguuuggguauuaaaaagaaaaaaaaaacuuaaaaaaaaaaagacacu

SEQ ID NO: 31047 - RNA, 64 nt, hsa
gcuuugaaaauggaugguuuggguauuaaaaagaaaaaaaaaacuuaaaaaaaaaaagacacua

SEQ ID NO: 31048 - RNA, 64 nt, hsa
cuuugaaaauggaugguuuggguauuaaaaagaaaaaaaaaacuuaaaaaaaaaaagacacuaa

SEQ ID NO: 31049 - RNA, 64 nt, hsa
gaugguuuggguauuaaaaagaaaaaaaaaacuuaaaaaaaaaaagacacuaacggccagugag

SEQ ID NO: 31050 - RNA, 64 nt, hsa
augguuuggguauuaaaaagaaaaaaaaaacuuaaaaaaaaaaagacacuaacggccagugagu

SEQ ID NO: 31051 - RNA, 64 nt, hsa
ugguuuggguauuaaaaagaaaaaaaaaacuuaaaaaaaaaaagacacuaacggccagugaguu

SEQ ID NO: 31052 - RNA, 64 nt, hsa
gguuuggguauuaaaaagaaaaaaaaaacuuaaaaaaaaaaagacacuaacggccagugaguug

SEQ ID NO: 31053 - RNA, 64 nt, hsa
uuuuguuuuuuauuuugaacagacguuuuaaaagaaaaaaaaacaacuaccuucuguccuagaa

SEQ ID NO: 31054 - RNA, 64 nt, hsa
uuuguuuuuuauuuugaacagacguuuuaaaagaaaaaaaaacaacuaccuucuguccuagaag

SEQ ID NO: 31055 - RNA, 64 nt, hsa
ugggaggaugguggccugcagcggccaagaagccaaaaaaaauuuuuuuuuuuucagauacugu

SEQ ID NO: 31056 - RNA, 64 nt, hsa
agccugggugacagagcgagacuguguuucaaagaaaaaaaaaaacaagcagccuuuugcuugg

SEQ ID NO: 31057 - RNA, 64 nt, hsa
gccugggugacagagcgagacuguguuucaaagaaaaaaaaaaacaagcagccuuuugcuuggu

SEQ ID NO: 31058 - RNA, 64 nt, hsa
ccugggugacagagcgagacuguguuucaaagaaaaaaaaaaacaagcagccuuuugcuugguu

SEQ ID NO: 31059 - RNA, 64 nt, hsa
cugggugacagagcgagacuguguuucaaagaaaaaaaaaaacaagcagccuuuugcuugguug

SEQ ID NO: 31060 - RNA, 64 nt, hsa
gauaagagaaaaugucuaaagcaucuggaaagguaaaaaaaaaaaaucuauuuuuguacaaaug

SEQ ID NO: 31061 - RNA, 64 nt, hsa
auaagagaaaaugucuaaagcaucuggaaagguaaaaaaaaaaaaucuauuuuuguacaaaugu

SEQ ID NO: 31062 - RNA, 64 nt, hsa
uaagagaaaaugucuaaagcaucuggaaagguaaaaaaaaaaaaucuauuuuuguacaaaugua

SEQ ID NO: 31063 - RNA, 64 nt, hsa
aagagaaaaugucuaaagcaucuggaaagguaaaaaaaaaaaaucuauuuuuguacaaauguaa

SEQ ID NO: 31064 - RNA, 64 nt, hsa
agagaaaaugucuaaagcaucuggaaagguaaaaaaaaaaaaucuauuuuuguacaaauguaau

SEQ ID NO: 31065 - RNA, 64 nt, hsa
gauuaauaaguggaugguuuuuguuucuaaaaagaaaaaaaaaaucaguguucacccuuauaga

SEQ ID NO: 31066 - RNA, 64 nt, hsa
auuaauaaguggaugguuuuuguuucuaaaaagaaaaaaaaaaucaguguucacccuuauagag

SEQ ID NO: 31067 - RNA, 64 nt, hsa
uuaauaaguggaugguuuuuguuucuaaaaagaaaaaaaaaaucaguguucacccuuauagaga

SEQ ID NO: 31068 - RNA, 64 nt, hsa
gaccauuucuuguucuguuuccaaugaaaucaauaaaaaaaaagaaguacuuuaaaugggguuu

SEQ ID NO: 31069 - RNA, 64 nt, hsa
accauuucuuguucuguuuccaaugaaaucaauaaaaaaaaagaaguacuuuaaaugggguuuu

SEQ ID NO: 31070 - RNA, 64 nt, hsa
acccaguuugaaaucuuaaaaaaagaaaaaaugaaaaaaaaaggaaaaaaagaaaaaaggaaaa

SEQ ID NO: 31071 - RNA, 64 nt, hsa
aacccaguuugaaaucuuaaaaaaagaaaaaaugaaaaaaaaaggaaaaaaagaaaaaaggaaa

SEQ ID NO: 31072 - RNA, 64 nt, hsa
agccauuuuauaagcacucugauuucuaaaaguuaaaaaaaauauaugaaaucucuguagccuu

SEQ ID NO: 31073 - RNA, 64 nt, hsa
acaacaauaguuuaagaaauuuuuuuuuuaaauaaaaaaaaaggaaaagaggaagacuggacaa

SEQ ID NO: 31074 - RNA, 64 nt, hsa
cacaacaauaguuuaagaaauuuuuuuuuuaaauaaaaaaaaaggaaaagaggaagacuggaca

SEQ ID NO: 31075 - RNA, 64 nt, hsa
aaacuauugccauacuucaguaagugucuuuuuuaaaaaaaauucacuuguauaaaaauggucu

SEQ ID NO: 31076 - RNA, 64 nt, hsa
guacccaugacuguugccugcaaaaauaaaagggaaaaaaaagaaaaaagaaacaaaaaggaac

SEQ ID NO: 31077 - RNA, 64 nt, hsa
uuaaaaaaaaagaauucugguccuguuuucuaaaaaaaaaaacuguuguagaaauucuuaauuu

SEQ ID NO: 31078 - RNA, 64 nt, hsa
uuuaaaaaaaaagaauucugguccuguuuucuaaaaaaaaaaacuguuguagaaauucuuaauu

SEQ ID NO: 31079 - RNA, 64 nt, hsa
auuuaaaaaaaaagaauucugguccuguuuucuaaaaaaaaaaacuguuguagaaauucuuaau

SEQ ID NO: 31080 - RNA, 64 nt, hsa
cauuuaaaaaaaaagaauucugguccuguuuucuaaaaaaaaaaacuguuguagaaauucuuaa

SEQ ID NO: 31081 - RNA, 64 nt, hsa
uggaaguaaaggcauuccacaggaucaucauuuaaaaaaaaagaauucugguccuguuuucuaa

SEQ ID NO: 31082 - RNA, 64 nt, hsa
auggaaguaaaggcauuccacaggaucaucauuuaaaaaaaaagaauucugguccuguuuucua

SEQ ID NO: 31083 - RNA, 64 nt, hsa
uccagccugggcgaaagagugagacuccaucucaaaaaaaaagaaaauuuccaagcaugguauc

SEQ ID NO: 31084 - RNA, 64 nt, hsa
cuccagccugggcgaaagagugagacuccaucucaaaaaaaaagaaaauuuccaagcaugguau

SEQ ID NO: 31085 - RNA, 64 nt, hsa
agagacuuacuagagacuggcugaccaugaaaaaaaaaaaaauaaucugaguuauucagccagu

SEQ ID NO: 31086 - RNA, 64 nt, hsa
uagagacuuacuagagacuggcugaccaugaaaaaaaaaaaaauaaucugaguuauucagccag

SEQ ID NO: 31087 - RNA, 64 nt, hsa
cuagagacuuacuagagacuggcugaccaugaaaaaaaaaaaaauaaucugaguuauucagcca

SEQ ID NO: 31088 - RNA, 64 nt, hsa
ccuagagacuuacuagagacuggcugaccaugaaaaaaaaaaaaauaaucugaguuauucagcc

SEQ ID NO: 31089 - RNA, 64 nt, hsa
cccuagagacuuacuagagacuggcugaccaugaaaaaaaaaaaaauaaucugaguuauucagc

SEQ ID NO: 31090 - RNA, 64 nt, hsa
ucccuagagacuuacuagagacuggcugaccaugaaaaaaaaaaaaauaaucugaguuauucag

SEQ ID NO: 31091 - RNA, 64 nt, hsa
acuucuaucauuuuaaacugacuuguauauuuaaaaaaaaaaucuucaguaggauguuuuguac

SEQ ID NO: 31092 - RNA, 64 nt, hsa
aacuucuaucauuuuaaacugacuuguauauuuaaaaaaaaaaucuucaguaggauguuuugua

SEQ ID NO: 31093 - RNA, 64 nt, hsa
gaacuucuaucauuuuaaacugacuuguauauuuaaaaaaaaaaucuucaguaggauguuuugu

SEQ ID NO: 31094 - RNA, 64 nt, hsa
cccccucuucucuggguguaagaagggaaauuggaaaaaaaauuauauauauauucuccuuuua

SEQ ID NO: 31095 - RNA, 64 nt, hsa
auacaaaucacauauaguuuaaucuuuuuuaaugaaaaaaaaucauguuuaaaauggcaaaagc

SEQ ID NO: 31096 - RNA, 64 nt, hsa
cucuuuauuggugguccuaagugggucacuuaagaaaaaaaaguguaacaaauucucgcuccau

SEQ ID NO: 31097 - RNA, 64 nt, hsa
ugauaaauauuacauuuacccuuggcccuuaaaaaaaaaaaagaaaaacccucacagucuuccu

SEQ ID NO: 31098 - RNA, 64 nt, hsa
augauaaauauuacauuuacccuuggcccuuaaaaaaaaaaaagaaaaacccucacagucuucc

SEQ ID NO: 31099 - RNA, 64 nt, hsa
aaugauaaauauuacauuuacccuuggcccuuaaaaaaaaaaaagaaaaacccucacagucuuc

SEQ ID NO: 31100 - RNA, 64 nt, hsa
uaaugauaaauauuacauuuacccuuggcccuuaaaaaaaaaaaagaaaaacccucacagucuu

SEQ ID NO: 31101 - RNA, 64 nt, hsa
cuaaugauaaauauuacauuuacccuuggcccuuaaaaaaaaaaaagaaaaacccucacagucu

SEQ ID NO: 31102 - RNA, 64 nt, hsa
acucucuugaaucacguuaacuuuugagauuaaaaaaaaaaacgccauagcacagcugucuuua

SEQ ID NO: 31103 - RNA, 64 nt, hsa
cacucucuugaaucacguuaacuuuugagauuaaaaaaaaaaacgccauagcacagcugucuuu

SEQ ID NO: 31104 - RNA, 64 nt, hsa
ccacucucuugaaucacguuaacuuuugagauuaaaaaaaaaaacgccauagcacagcugucuu

SEQ ID NO: 31105 - RNA, 64 nt, hsa
accacucucuugaaucacguuaacuuuugagauuaaaaaaaaaaacgccauagcacagcugucu

SEQ ID NO: 31106 - RNA, 64 nt, hsa
ugggcaacauagcgagacuccaucucuauaaauaaaaaaaaaggaaaugcauuaaauagaaggu

SEQ ID NO: 31107 - RNA, 64 nt, hsa
cugggcaacauagcgagacuccaucucuauaaauaaaaaaaaaggaaaugcauuaaauagaagg

SEQ ID NO: 31108 - RNA, 64 nt, hsa
gauuauguaggaaauguuuguguacaauucaaaaaaaaaaaagaugaaaaaaguuccuguggau

SEQ ID NO: 31109 - RNA, 64 nt, hsa
ggauuauguaggaaauguuuguguacaauucaaaaaaaaaaaagaugaaaaaaguuccugugga

SEQ ID NO: 31110 - RNA, 64 nt, hsa
uggauuauguaggaaauguuuguguacaauucaaaaaaaaaaaagaugaaaaaaguuccugugg

SEQ ID NO: 31111 - RNA, 64 nt, hsa
uuggauuauguaggaaauguuuguguacaauucaaaaaaaaaaaagaugaaaaaaguuccugug

SEQ ID NO: 31112 - RNA, 64 nt, hsa
guuggauuauguaggaaauguuuguguacaauucaaaaaaaaaaaagaugaaaaaaguuccugu

SEQ ID NO: 31113 - RNA, 64 nt, hsa
gcauugaaugaucaaauauuggauuuaccuuuaaaaaaaaaaccugaguaucauugcaugaauu

SEQ ID NO: 31114 - RNA, 64 nt, hsa
agcauugaaugaucaaauauuggauuuaccuuuaaaaaaaaaaccugaguaucauugcaugaau

SEQ ID NO: 31115 - RNA, 64 nt, hsa
uagcauugaaugaucaaauauuggauuuaccuuuaaaaaaaaaaccugaguaucauugcaugaa

SEQ ID NO: 31116 - RNA, 64 nt, hsa
cuuugcucugguuaaaacaguaauaggcacuugaaaaaaaaagauaaauuauugaaugaguagu

SEQ ID NO: 31117 - RNA, 64 nt, hsa
ccuuugcucugguuaaaacaguaauaggcacuugaaaaaaaaagauaaauuauugaaugaguag

SEQ ID NO: 31118 - RNA, 64 nt, hsa
ucauuggagagccuuacuuggguuugcacccaaaaaaaaaaacccaaucugaggaaagacugca

SEQ ID NO: 31119 - RNA, 64 nt, hsa
uucauuggagagccuuacuuggguuugcacccaaaaaaaaaaacccaaucugaggaaagacugc

SEQ ID NO: 31120 - RNA, 64 nt, hsa
auucauuggagagccuuacuuggguuugcacccaaaaaaaaaaacccaaucugaggaaagacug

SEQ ID NO: 31121 - RNA, 64 nt, hsa
cauucauuggagagccuuacuuggguuugcacccaaaaaaaaaaacccaaucugaggaaagacu

SEQ ID NO: 31122 - RNA, 64 nt, hsa
aaggaaauuuagauugguccuuuucaaaauucaaaaaaaaaagcaacaucuucauagaugaaug

SEQ ID NO: 31123 - RNA, 64 nt, hsa
aaaggaaauuuagauugguccuuuucaaaauucaaaaaaaaaagcaacaucuucauagaugaau

SEQ ID NO: 31124 - RNA, 64 nt, hsa
uaaaggaaauuuagauugguccuuuucaaaauucaaaaaaaaaagcaacaucuucauagaugaa

SEQ ID NO: 31125 - RNA, 64 nt, hsa
ggggacagagcaagacucuugucucaaaaaaaacaaaaaaaacauauauacugcuguaucaugc

SEQ ID NO: 31126 - RNA, 64 nt, hsa
cuccagccuggggacagagcaagacucuugucucaaaaaaaacaaaaaaaacauauauacugcu

SEQ ID NO: 31127 - RNA, 64 nt, hsa
ugaaaaggcuuccaggaguuuccaugaaauaacaaaaaaaaauacaagcgccucaccuuagcau

SEQ ID NO: 31128 - RNA, 64 nt, hsa
augaaaaggcuuccaggaguuuccaugaaauaacaaaaaaaaauacaagcgccucaccuuagca

SEQ ID NO: 31129 - RNA, 64 nt, hsa
acaauuaauuguacauaauguauacacacacacaaaaaaaaauaccuguagaaauauuauucca

SEQ ID NO: 31130 - RNA, 64 nt, hsa
gacaauuaauuguacauaauguauacacacacacaaaaaaaaauaccuguagaaauauuauucc

SEQ ID NO: 31131 - RNA, 64 nt, hsa
agagagguuauggagguacuguagcuuuuagggaaaaaaaaauguuaacacaucacaggucaag

SEQ ID NO: 31132 - RNA, 64 nt, hsa
aagagagguuauggagguacuguagcuuuuagggaaaaaaaaauguuaacacaucacaggucaa

SEQ ID NO: 31133 - RNA, 64 nt, hsa
ugggauaucaaacuugcaaaaaaaaaaaaaaaaaaaaaaaaacaaaaaaacuagacaaggagag

SEQ ID NO: 31134 - RNA, 64 nt, hsa
cugggauaucaaacuugcaaaaaaaaaaaaaaaaaaaaaaaaacaaaaaaacuagacaaggaga

SEQ ID NO: 31135 - RNA, 64 nt, hsa
gcugggauaucaaacuugcaaaaaaaaaaaaaaaaaaaaaaaaacaaaaaaacuagacaaggag

SEQ ID NO: 31136 - RNA, 64 nt, hsa
cgcugggauaucaaacuugcaaaaaaaaaaaaaaaaaaaaaaaaacaaaaaaacuagacaagga

SEQ ID NO: 31137 - RNA, 64 nt, hsa
gcgcugggauaucaaacuugcaaaaaaaaaaaaaaaaaaaaaaaaacaaaaaaacuagacaagg

SEQ ID NO: 31138 - RNA, 64 nt, hsa
ggcgcugggauaucaaacuugcaaaaaaaaaaaaaaaaaaaaaaaaacaaaaaaacuagacaag

SEQ ID NO: 31139 - RNA, 64 nt, hsa
aggcgcugggauaucaaacuugcaaaaaaaaaaaaaaaaaaaaaaaaacaaaaaaacuagacaa

SEQ ID NO: 31140 - RNA, 64 nt, hsa
gaggcgcugggauaucaaacuugcaaaaaaaaaaaaaaaaaaaaaaaaacaaaaaaacuagaca

SEQ ID NO: 31141 - RNA, 64 nt, hsa
ggaggcgcugggauaucaaacuugcaaaaaaaaaaaaaaaaaaaaaaaaacaaaaaaacuagac

SEQ ID NO: 31142 - RNA, 64 nt, hsa
aggaggcgcugggauaucaaacuugcaaaaaaaaaaaaaaaaaaaaaaaaacaaaaaaacuaga

SEQ ID NO: 31143 - RNA, 64 nt, hsa
aaggaggcgcugggauaucaaacuugcaaaaaaaaaaaaaaaaaaaaaaaaacaaaaaaacuag

SEQ ID NO: 31144 - RNA, 64 nt, hsa
caaggaggcgcugggauaucaaacuugcaaaaaaaaaaaaaaaaaaaaaaaaacaaaaaaacua

SEQ ID NO: 31145 - RNA, 64 nt, hsa
acaaggaggcgcugggauaucaaacuugcaaaaaaaaaaaaaaaaaaaaaaaaacaaaaaaacu

SEQ ID NO: 31146 - RNA, 64 nt, hsa
aacaaggaggcgcugggauaucaaacuugcaaaaaaaaaaaaaaaaaaaaaaaaacaaaaaaac

SEQ ID NO: 31147 - RNA, 64 nt, hsa
aaacaaggaggcgcugggauaucaaacuugcaaaaaaaaaaaaaaaaaaaaaaaaacaaaaaaa

SEQ ID NO: 31148 - RNA, 64 nt, hsa
caaacaaggaggcgcugggauaucaaacuugcaaaaaaaaaaaaaaaaaaaaaaaaacaaaaaa

SEQ ID NO: 31149 - RNA, 64 nt, hsa
gcaaacaaggaggcgcugggauaucaaacuugcaaaaaaaaaaaaaaaaaaaaaaaaacaaaaa

SEQ ID NO: 31150 - RNA, 64 nt, hsa
ugcaaacaaggaggcgcugggauaucaaacuugcaaaaaaaaaaaaaaaaaaaaaaaaacaaaa

SEQ ID NO: 31151 - RNA, 64 nt, hsa
augcauugucauuuaauauaguagccucuuaaaaaaaaaaaaccugcuaggauuuaaaaauaaa

SEQ ID NO: 31152 - RNA, 64 nt, hsa
aaugcauugucauuuaauauaguagccucuuaaaaaaaaaaaaccugcuaggauuuaaaaauaa

SEQ ID NO: 31153 - RNA, 64 nt, hsa
aaaugcauugucauuuaauauaguagccucuuaaaaaaaaaaaaccugcuaggauuuaaaaaua

SEQ ID NO: 31154 - RNA, 64 nt, hsa
aaaaugcauugucauuuaauauaguagccucuuaaaaaaaaaaaaccugcuaggauuuaaaaau

SEQ ID NO: 31155 - RNA, 64 nt, hsa
caaaaugcauugucauuuaauauaguagccucuuaaaaaaaaaaaaccugcuaggauuuaaaaa

SEQ ID NO: 31156 - RNA, 64 nt, hsa
gcuggcaacuggucuugaccaaaauagaaaaaaaaaaaaaaaguccacaaauuuaaucacuugu

SEQ ID NO: 31157 - RNA, 64 nt, hsa
agcuggcaacuggucuugaccaaaauagaaaaaaaaaaaaaaaguccacaaauuuaaucacuug

SEQ ID NO: 31158 - RNA, 64 nt, hsa
aagcuggcaacuggucuugaccaaaauagaaaaaaaaaaaaaaaguccacaaauuuaaucacuu

SEQ ID NO: 31159 - RNA, 64 nt, hsa
gaagcuggcaacuggucuugaccaaaauagaaaaaaaaaaaaaaaguccacaaauuuaaucacu

SEQ ID NO: 31160 - RNA, 64 nt, hsa
agaagcuggcaacuggucuugaccaaaauagaaaaaaaaaaaaaaaguccacaaauuuaaucac

SEQ ID NO: 31161 - RNA, 64 nt, hsa
aagaagcuggcaacuggucuugaccaaaauagaaaaaaaaaaaaaaaguccacaaauuuaauca

SEQ ID NO: 31162 - RNA, 64 nt, hsa
gaagaagcuggcaacuggucuugaccaaaauagaaaaaaaaaaaaaaaguccacaaauuuaauc

SEQ ID NO: 31163 - RNA, 64 nt, hsa
ggaagaagcuggcaacuggucuugaccaaaauagaaaaaaaaaaaaaaaguccacaaauuuaau

SEQ ID NO: 31164 - RNA, 64 nt, hsa
cuuauaaauagugcugcuaugaaugucuguaaaaaaaaaaaacugcuccuucuuuuggauuauu

SEQ ID NO: 31165 - RNA, 64 nt, hsa
ucuuauaaauagugcugcuaugaaugucuguaaaaaaaaaaaacugcuccuucuuuuggauuau

SEQ ID NO: 31166 - RNA, 64 nt, hsa
cucuuauaaauagugcugcuaugaaugucuguaaaaaaaaaaaacugcuccuucuuuuggauua

SEQ ID NO: 31167 - RNA, 64 nt, hsa
acucuuauaaauagugcugcuaugaaugucuguaaaaaaaaaaaacugcuccuucuuuuggauu

SEQ ID NO: 31168 - RNA, 64 nt, hsa
cacucuuauaaauagugcugcuaugaaugucuguaaaaaaaaaaaacugcuccuucuuuuggau

SEQ ID NO: 31169 - RNA, 64 nt, hsa
ucugugugacagaaugagaccuugucuugaaaaaaaaaaaaacaaaaaaccacauacaggaaaa

SEQ ID NO: 31170 - RNA, 64 nt, hsa
gucugugugacagaaugagaccuugucuugaaaaaaaaaaaaacaaaaaaccacauacaggaaa

SEQ ID NO: 31171 - RNA, 64 nt, hsa
agucugugugacagaaugagaccuugucuugaaaaaaaaaaaaacaaaaaaccacauacaggaa

SEQ ID NO: 31172 - RNA, 64 nt, hsa
cagucugugugacagaaugagaccuugucuugaaaaaaaaaaaaacaaaaaaccacauacagga

SEQ ID NO: 31173 - RNA, 64 nt, hsa
ccagucugugugacagaaugagaccuugucuugaaaaaaaaaaaaacaaaaaaccacauacagg

SEQ ID NO: 31174 - RNA, 64 nt, hsa
uccagucugugugacagaaugagaccuugucuugaaaaaaaaaaaaacaaaaaaccacauacag

SEQ ID NO: 31175 - RNA, 64 nt, hsa
cauugucuucuguacaucuuacuggguuuaauuaaaaaaaaagaaaaaacucuguuguaaaaac

SEQ ID NO: 31176 - RNA, 64 nt, hsa
ucauugucuucuguacaucuuacuggguuuaauuaaaaaaaaagaaaaaacucuguuguaaaaa

SEQ ID NO: 31177 - RNA, 64 nt, hsa
acaaaugcaaauuuaguucucuaaaacuugaaaaaaaaaaaagaaaccaguucugugaaaacgg

SEQ ID NO: 31178 - RNA, 64 nt, hsa
aacaaaugcaaauuuaguucucuaaaacuugaaaaaaaaaaaagaaaccaguucugugaaaacg

SEQ ID NO: 31179 - RNA, 64 nt, hsa
uaacaaaugcaaauuuaguucucuaaaacuugaaaaaaaaaaaagaaaccaguucugugaaaac

SEQ ID NO: 31180 - RNA, 64 nt, hsa
uuaacaaaugcaaauuuaguucucuaaaacuugaaaaaaaaaaaagaaaccaguucugugaaaa

SEQ ID NO: 31181 - RNA, 64 nt, hsa
uuuaacaaaugcaaauuuaguucucuaaaacuugaaaaaaaaaaaagaaaccaguucugugaaa

SEQ ID NO: 31182 - RNA, 64 nt, hsa
ccuggcgacaagagugagacuccaccucaaaaaaaaaaaaaagaauccaauacugcccaaggau

SEQ ID NO: 31183 - RNA, 64 nt, hsa
gccuggcgacaagagugagacuccaccucaaaaaaaaaaaaaagaauccaauacugcccaagga

SEQ ID NO: 31184 - RNA, 64 nt, hsa
agccuggcgacaagagugagacuccaccucaaaaaaaaaaaaaagaauccaauacugcccaagg

SEQ ID NO: 31185 - RNA, 64 nt, hsa
cagccuggcgacaagagugagacuccaccucaaaaaaaaaaaaaagaauccaauacugcccaag

SEQ ID NO: 31186 - RNA, 64 nt, hsa
ccagccuggcgacaagagugagacuccaccucaaaaaaaaaaaaaagaauccaauacugcccaa

SEQ ID NO: 31187 - RNA, 64 nt, hsa
uccagccuggcgacaagagugagacuccaccucaaaaaaaaaaaaaagaauccaauacugccca

SEQ ID NO: 31188 - RNA, 64 nt, hsa
cuccagccuggcgacaagagugagacuccaccucaaaaaaaaaaaaaagaauccaauacugccc

SEQ ID NO: 31189 - RNA, 64 nt, hsa
gacagagcaagacuccgucucaaaaaaaaaaaaaaaaaaaaagaaauugaauugggggagucau

SEQ ID NO: 31190 - RNA, 64 nt, hsa
ugacagagcaagacuccgucucaaaaaaaaaaaaaaaaaaaaagaaauugaauugggggaguca

SEQ ID NO: 31191 - RNA, 64 nt, hsa
gugacagagcaagacuccgucucaaaaaaaaaaaaaaaaaaaaagaaauugaauugggggaguc

SEQ ID NO: 31192 - RNA, 64 nt, hsa
ggugacagagcaagacuccgucucaaaaaaaaaaaaaaaaaaaaagaaauugaauugggggagu

SEQ ID NO: 31193 - RNA, 64 nt, hsa
gggugacagagcaagacuccgucucaaaaaaaaaaaaaaaaaaaaagaaauugaauugggggag

SEQ ID NO: 31194 - RNA, 64 nt, hsa
ugggugacagagcaagacuccgucucaaaaaaaaaaaaaaaaaaaaagaaauugaauuggggga

SEQ ID NO: 31195 - RNA, 64 nt, hsa
cugggugacagagcaagacuccgucucaaaaaaaaaaaaaaaaaaaaagaaauugaauuggggg

SEQ ID NO: 31196 - RNA, 64 nt, hsa
ccugggugacagagcaagacuccgucucaaaaaaaaaaaaaaaaaaaaagaaauugaauugggg

SEQ ID NO: 31197 - RNA, 64 nt, hsa
gccugggugacagagcaagacuccgucucaaaaaaaaaaaaaaaaaaaaagaaauugaauuggg

SEQ ID NO: 31198 - RNA, 64 nt, hsa
agccugggugacagagcaagacuccgucucaaaaaaaaaaaaaaaaaaaaagaaauugaauugg

SEQ ID NO: 31199 - RNA, 64 nt, hsa
cagccugggugacagagcaagacuccgucucaaaaaaaaaaaaaaaaaaaaagaaauugaauug

SEQ ID NO: 31200 - RNA, 64 nt, hsa
ccagccugggugacagagcaagacuccgucucaaaaaaaaaaaaaaaaaaaaagaaauugaauu

SEQ ID NO: 31201 - RNA, 64 nt, hsa
uccagccugggugacagagcaagacuccgucucaaaaaaaaaaaaaaaaaaaaagaaauugaau

SEQ ID NO: 31202 - RNA, 64 nt, hsa
cuccagccugggugacagagcaagacuccgucucaaaaaaaaaaaaaaaaaaaaagaaauugaa

SEQ ID NO: 31203 - RNA, 64 nt, hsa
ccugggcgacagagugagacucugucucaaaaaaaaaaaaaauuaugaaaaaaguuaugggauu

SEQ ID NO: 31204 - RNA, 64 nt, hsa
gccugggcgacagagugagacucugucucaaaaaaaaaaaaaauuaugaaaaaaguuaugggau

SEQ ID NO: 31205 - RNA, 64 nt, hsa
agccugggcgacagagugagacucugucucaaaaaaaaaaaaaauuaugaaaaaaguuauggga

SEQ ID NO: 31206 - RNA, 64 nt, hsa
cagccugggcgacagagugagacucugucucaaaaaaaaaaaaaauuaugaaaaaaguuauggg

SEQ ID NO: 31207 - RNA, 64 nt, hsa
ccagccugggcgacagagugagacucugucucaaaaaaaaaaaaaauuaugaaaaaaguuaugg

SEQ ID NO: 31208 - RNA, 64 nt, hsa
uccagccugggcgacagagugagacucugucucaaaaaaaaaaaaaauuaugaaaaaaguuaug

SEQ ID NO: 31209 - RNA, 64 nt, hsa
cuccagccugggcgacagagugagacucugucucaaaaaaaaaaaaaauuaugaaaaaaguuau

SEQ ID NO: 31210 - RNA, 64 nt, hsa
gaucacugucaucuaaaagcuggccacuaaauuaaaaaaaaauuaaaaguuaugggauuaaaaa

SEQ ID NO: 31211 - RNA, 64 nt, hsa
agaucacugucaucuaaaagcuggccacuaaauuaaaaaaaaauuaaaaguuaugggauuaaaa

SEQ ID NO: 31212 - RNA, 64 nt, hsa
uggggaacauaugagaccccugccaucucaaaaaaaaaaaaauucucaauaaacuaugugccca

SEQ ID NO: 31213 - RNA, 64 nt, hsa
cuggggaacauaugagaccccugccaucucaaaaaaaaaaaaauucucaauaaacuaugugccc

SEQ ID NO: 31214 - RNA, 64 nt, hsa
ucuggggaacauaugagaccccugccaucucaaaaaaaaaaaaauucucaauaaacuaugugcc

SEQ ID NO: 31215 - RNA, 64 nt, hsa
gucuggggaacauaugagaccccugccaucucaaaaaaaaaaaaauucucaauaaacuaugugc

SEQ ID NO: 31216 - RNA, 64 nt, hsa
agucuggggaacauaugagaccccugccaucucaaaaaaaaaaaaauucucaauaaacuaugug

SEQ ID NO: 31217 - RNA, 64 nt, hsa
uagucuggggaacauaugagaccccugccaucucaaaaaaaaaaaaauucucaauaaacuaugu

SEQ ID NO: 31218 - RNA, 64 nt, hsa
ugacuuuuacaaaauuacuuguuuguuuucauuaaaaaaaaagcauaaacuauguuucuuauua

SEQ ID NO: 31219 - RNA, 64 nt, hsa
cugacuuuuacaaaauuacuuguuuguuuucauuaaaaaaaaagcauaaacuauguuucuuauu

SEQ ID NO: 31220 - RNA, 64 nt, hsa
cugggcaacgagcaaaaaacucugucucaaaaaaaaaaaaaauggcuuccaggacagagcaugc

SEQ ID NO: 31221 - RNA, 64 nt, hsa
ccugggcaacgagcaaaaaacucugucucaaaaaaaaaaaaaauggcuuccaggacagagcaug

SEQ ID NO: 31222 - RNA, 64 nt, hsa
gccugggcaacgagcaaaaaacucugucucaaaaaaaaaaaaaauggcuuccaggacagagcau

SEQ ID NO: 31223 - RNA, 64 nt, hsa
agccugggcaacgagcaaaaaacucugucucaaaaaaaaaaaaaauggcuuccaggacagagca

SEQ ID NO: 31224 - RNA, 64 nt, hsa
cagccugggcaacgagcaaaaaacucugucucaaaaaaaaaaaaaauggcuuccaggacagagc

SEQ ID NO: 31225 - RNA, 64 nt, hsa
ccagccugggcaacgagcaaaaaacucugucucaaaaaaaaaaaaaaaaaaaaaaaagaaaaag

SEQ ID NO: 31226 - RNA, 64 nt, hsa
uccagccugggcaacgagcaaaaaacucugucucaaaaaaaaaaaaaaaaaaaaaaaagaaaaa

SEQ ID NO: 31227 - RNA, 64 nt, hsa
ggugauugaauauuuguauaaaaagcaaaaagaaaaaaaaaauguuuguuuacugauuggggag

SEQ ID NO: 31228 - RNA, 64 nt, hsa
gggugauugaauauuuguauaaaaagcaaaaagaaaaaaaaaauguuuguuuacugauugggga

SEQ ID NO: 31229 - RNA, 64 nt, hsa
ggggugauugaauauuuguauaaaaagcaaaaagaaaaaaaaaauguuuguuuacugauugggg

SEQ ID NO: 31230 - RNA, 64 nt, hsa
gaaacuccguccccacccccugccaaaaaaaaaaaaaaaaaagccagggcaaaggaccuggcgu

SEQ ID NO: 31231 - RNA, 64 nt, hsa
ugaaacuccguccccacccccugccaaaaaaaaaaaaaaaaaagccagggcaaaggaccuggcg

SEQ ID NO: 31232 - RNA, 64 nt, hsa
gugaaacuccguccccacccccugccaaaaaaaaaaaaaaaaaagccagggcaaaggaccuggc

SEQ ID NO: 31233 - RNA, 64 nt, hsa
agugaaacuccguccccacccccugccaaaaaaaaaaaaaaaaaagccagggcaaaggaccugg

SEQ ID NO: 31234 - RNA, 64 nt, hsa
gagugaaacuccguccccacccccugccaaaaaaaaaaaaaaaaaagccagggcaaaggaccug

SEQ ID NO: 31235 - RNA, 64 nt, hsa
agagugaaacuccguccccacccccugccaaaaaaaaaaaaaaaaaagccagggcaaaggaccu

SEQ ID NO: 31236 - RNA, 64 nt, hsa
gagagugaaacuccguccccacccccugccaaaaaaaaaaaaaaaaaagccagggcaaaggacc

SEQ ID NO: 31237 - RNA, 64 nt, hsa
cgagagugaaacuccguccccacccccugccaaaaaaaaaaaaaaaaaagccagggcaaaggac

SEQ ID NO: 31238 - RNA, 64 nt, hsa
acgagagugaaacuccguccccacccccugccaaaaaaaaaaaaaaaaaagccagggcaaagga

SEQ ID NO: 31239 - RNA, 64 nt, hsa
aacgagagugaaacuccguccccacccccugccaaaaaaaaaaaaaaaaaagccagggcaaagg

SEQ ID NO: 31240 - RNA, 64 nt, hsa
caacgagagugaaacuccguccccacccccugccaaaaaaaaaaaaaaaaaagccagggcaaag

SEQ ID NO: 31241 - RNA, 62 nt, hsa
uaaaaaaaaaaaaagaagaaaagauuuaaaaaaaaaaaaaaaggagacuuuuuuuguaaggu

SEQ ID NO: 31242 - RNA, 63 nt, hsa
uuaaaaaaaaaaaaagaagaaaagauuuaaaaaaaaaaaaaaaggagacuuuuuuuguaaggu

SEQ ID NO: 31243 - RNA, 64 nt, hsa
uuuaaaaaaaaaaaaagaagaaaagauuuaaaaaaaaaaaaaaaggagacuuuuuuuguaaggu

SEQ ID NO: 31244 - RNA, 64 nt, hsa
cuuuaaaaaaaaaaaaagaagaaaagauuuaaaaaaaaaaaaaaaggagacuuuuuuuguaagg

SEQ ID NO: 31245 - RNA, 64 nt, hsa
acuuuaaaaaaaaaaaaagaagaaaagauuuaaaaaaaaaaaaaaaggagacuuuuuuuguaag

SEQ ID NO: 31246 - RNA, 64 nt, hsa
aacuuuaaaaaaaaaaaaagaagaaaagauuuaaaaaaaaaaaaaaaggagacuuuuuuuguaa

SEQ ID NO: 31247 - RNA, 64 nt, hsa
caacuuuaaaaaaaaaaaaagaagaaaagauuuaaaaaaaaaaaaaaaggagacuuuuuuugua

SEQ ID NO: 31248 - RNA, 64 nt, hsa
ucaacuuuaaaaaaaaaaaaagaagaaaagauuuaaaaaaaaaaaaaaaggagacuuuuuuugu

SEQ ID NO: 31249 - RNA, 64 nt, hsa
ccauacacugaagcuuuuaccucaacuuuaaaaaaaaaaaaagaagaaaagauuuaaaaaaaaa

SEQ ID NO: 31250 - RNA, 64 nt, hsa
uccauacacugaagcuuuuaccucaacuuuaaaaaaaaaaaaagaagaaaagauuuaaaaaaaa

SEQ ID NO: 31251 - RNA, 64 nt, hsa
uuccauacacugaagcuuuuaccucaacuuuaaaaaaaaaaaaagaagaaaagauuuaaaaaaa

SEQ ID NO: 31252 - RNA, 64 nt, hsa
uuuccauacacugaagcuuuuaccucaacuuuaaaaaaaaaaaaagaagaaaagauuuaaaaaa

SEQ ID NO: 31253 - RNA, 64 nt, hsa
guuuccauacacugaagcuuuuaccucaacuuuaaaaaaaaaaaaagaagaaaagauuuaaaaa

SEQ ID NO: 31254 - RNA, 64 nt, hsa
gguuuccauacacugaagcuuuuaccucaacuuuaaaaaaaaaaaaagaagaaaagauuuaaaa

SEQ ID NO: 31255 - RNA, 64 nt, hsa
aucuggucagggaagugggggauguucuuuugauaaaaaaaaaaaaaaaaauuuauguauuuaa

SEQ ID NO: 31256 - RNA, 64 nt, hsa
ucuggucagggaagugggggauguucuuuugauaaaaaaaaaaaaaaaaauuuauguauuuaaa

SEQ ID NO: 31257 - RNA, 64 nt, hsa
cuggucagggaagugggggauguucuuuugauaaaaaaaaaaaaaaaaauuuauguauuuaaac

SEQ ID NO: 31258 - RNA, 64 nt, hsa
uggucagggaagugggggauguucuuuugauaaaaaaaaaaaaaaaaauuuauguauuuaaacu

SEQ ID NO: 31259 - RNA, 64 nt, hsa
ggucagggaagugggggauguucuuuugauaaaaaaaaaaaaaaaaauuuauguauuuaaacuu

SEQ ID NO: 31260 - RNA, 64 nt, hsa
gucagggaagugggggauguucuuuugauaaaaaaaaaaaaaaaaauuuauguauuuaaacuuu

SEQ ID NO: 31261 - RNA, 64 nt, hsa
ucagggaagugggggauguucuuuugauaaaaaaaaaaaaaaaaauuuauguauuuaaacuuuu

SEQ ID NO: 31262 - RNA, 64 nt, hsa
cagggaagugggggauguucuuuugauaaaaaaaaaaaaaaaaauuuauguauuuaaacuuuua

SEQ ID NO: 31263 - RNA, 64 nt, hsa
agggaagugggggauguucuuuugauaaaaaaaaaaaaaaaaauuuauguauuuaaacuuuuau

SEQ ID NO: 31264 - RNA, 64 nt, hsa
gggaagugggggauguucuuuugauaaaaaaaaaaaaaaaaauuuauguauuuaaacuuuuauu

SEQ ID NO: 31265 - RNA, 64 nt, hsa
ucaagugcuucaaugaugcagcauuucuugcacuaaaaaaaaaaaaaaaaaaaaaacuagaaag

SEQ ID NO: 31266 - RNA, 64 nt, hsa
caagugcuucaaugaugcagcauuucuugcacuaaaaaaaaaaaaaaaaaaaaaacuagaaagu

SEQ ID NO: 31267 - RNA, 64 nt, hsa
aagugcuucaaugaugcagcauuucuugcacuaaaaaaaaaaaaaaaaaaaaaacuagaaaguu

SEQ ID NO: 31268 - RNA, 64 nt, hsa
agugcuucaaugaugcagcauuucuugcacuaaaaaaaaaaaaaaaaaaaaaacuagaaaguuu

SEQ ID NO: 31269 - RNA, 64 nt, hsa
gugcuucaaugaugcagcauuucuugcacuaaaaaaaaaaaaaaaaaaaaaacuagaaaguuuu

SEQ ID NO: 31270 - RNA, 64 nt, hsa
ugcuucaaugaugcagcauuucuugcacuaaaaaaaaaaaaaaaaaaaaaacuagaaaguuuug

SEQ ID NO: 31271 - RNA, 64 nt, hsa
gcuucaaugaugcagcauuucuugcacuaaaaaaaaaaaaaaaaaaaaaacuagaaaguuuugg

SEQ ID NO: 31272 - RNA, 64 nt, hsa
cuucaaugaugcagcauuucuugcacuaaaaaaaaaaaaaaaaaaaaaacuagaaaguuuuggg

SEQ ID NO: 31273 - RNA, 64 nt, hsa
uucaaugaugcagcauuucuugcacuaaaaaaaaaaaaaaaaaaaaaacuagaaaguuuuggga

SEQ ID NO: 31274 - RNA, 64 nt, hsa
ucaaugaugcagcauuucuugcacuaaaaaaaaaaaaaaaaaaaaaacuagaaaguuuugggac

SEQ ID NO: 31275 - RNA, 64 nt, hsa
caaugaugcagcauuucuugcacuaaaaaaaaaaaaaaaaaaaaaacuagaaaguuuugggaca

SEQ ID NO: 31276 - RNA, 64 nt, hsa
aaugaugcagcauuucuugcacuaaaaaaaaaaaaaaaaaaaaaacuagaaaguuuugggacau

SEQ ID NO: 31277 - RNA, 64 nt, hsa
augaugcagcauuucuugcacuaaaaaaaaaaaaaaaaaaaaaacuagaaaguuuugggacaug

SEQ ID NO: 31278 - RNA, 64 nt, hsa
ugaugcagcauuucuugcacuaaaaaaaaaaaaaaaaaaaaaacuagaaaguuuugggacaugg

SEQ ID NO: 31279 - RNA, 64 nt, hsa
gaugcagcauuucuugcacuaaaaaaaaaaaaaaaaaaaaaacuagaaaguuuugggacauggg

SEQ ID NO: 31280 - RNA, 64 nt, hsa
auauccccuauuuaacagggucucuagugcugugaaaaaaaaaaugcugaacauugcauauaac

SEQ ID NO: 31281 - RNA, 64 nt, hsa
uauccccuauuuaacagggucucuagugcugugaaaaaaaaaaugcugaacauugcauauaacu

SEQ ID NO: 31282 - RNA, 64 nt, hsa
auccccuauuuaacagggucucuagugcugugaaaaaaaaaaugcugaacauugcauauaacuu

SEQ ID NO: 31283 - RNA, 64 nt, hsa
cuggccacaguuguuugaugcauuaaaagaaaauaaaaaaaagaaaaaagagaaaagaaaaaaa

SEQ ID NO: 31284 - RNA, 64 nt, hsa
uaaaagaaaauaaaaaaaagaaaaaagagaaaagaaaaaaaaagaaaaaaguuguaggcgaauc

SEQ ID NO: 31285 - RNA, 64 nt, hsa
aaaagaaaauaaaaaaaagaaaaaagagaaaagaaaaaaaaagaaaaaaguuguaggcgaauca

SEQ ID NO: 31286 - RNA, 64 nt, hsa
ucaucguuugccuagcaugucccuguggcgucucaaaaaaaaguuucaucgucccgucauuguu

SEQ ID NO: 31287 - RNA, 64 nt, hsa
gauaagacaaguuuagaauugguuuacuuaauacaaaaaaaaaaaaaagaauuucaaaaaaaaa

SEQ ID NO: 31288 - RNA, 64 nt, hsa
auaagacaaguuuagaauugguuuacuuaauacaaaaaaaaaaaaaagaauuucaaaaaaaaaa

SEQ ID NO: 31289 - RNA, 64 nt, hsa
uaagacaaguuuagaauugguuuacuuaauacaaaaaaaaaaaaaagaauuucaaaaaaaaaag

SEQ ID NO: 31290 - RNA, 64 nt, hsa
aagacaaguuuagaauugguuuacuuaauacaaaaaaaaaaaaaagaauuucaaaaaaaaaagu

SEQ ID NO: 31291 - RNA, 64 nt, hsa
agacaaguuuagaauugguuuacuuaauacaaaaaaaaaaaaaagaauuucaaaaaaaaaaguu

SEQ ID NO: 31292 - RNA, 64 nt, hsa
gacaaguuuagaauugguuuacuuaauacaaaaaaaaaaaaaagaauuucaaaaaaaaaaguug

SEQ ID NO: 31293 - RNA, 64 nt, hsa
acaaguuuagaauugguuuacuuaauacaaaaaaaaaaaaaagaauuucaaaaaaaaaaguugu

SEQ ID NO: 31294 - RNA, 64 nt, hsa
guuuacuuaauacaaaaaaaaaaaaaagaauuucaaaaaaaaaaguuguuugcuuaaaaaaaau

SEQ ID NO: 31295 - RNA, 64 nt, hsa
uuuacuuaauacaaaaaaaaaaaaaagaauuucaaaaaaaaaaguuguuugcuuaaaaaaaauu

SEQ ID NO: 31296 - RNA, 64 nt, hsa
uuacuuaauacaaaaaaaaaaaaaagaauuucaaaaaaaaaaguuguuugcuuaaaaaaaauuu

SEQ ID NO: 31297 - RNA, 64 nt, hsa
aaaaaagaauuucaaaaaaaaaaguuguuugcuuaaaaaaaauuucaugugagggaaaaaaaaa

SEQ ID NO: 31298 - RNA, 64 nt, hsa
aaguuguuugcuuaaaaaaaauuucaugugagggaaaaaaaaaaaaccuauuccagaauaaguu

SEQ ID NO: 31299 - RNA, 64 nt, hsa
aguuguuugcuuaaaaaaaauuucaugugagggaaaaaaaaaaaaccuauuccagaauaaguuu

SEQ ID NO: 31300 - RNA, 64 nt, hsa
guuguuugcuuaaaaaaaauuucaugugagggaaaaaaaaaaaaccuauuccagaauaaguuuu

SEQ ID NO: 31301 - RNA, 64 nt, hsa
uuguuugcuuaaaaaaaauuucaugugagggaaaaaaaaaaaaccuauuccagaauaaguuuug

SEQ ID NO: 31302 - RNA, 64 nt, hsa
uguuugcuuaaaaaaaauuucaugugagggaaaaaaaaaaaaccuauuccagaauaaguuuugu

SEQ ID NO: 31303 - RNA, 64 nt, hsa
uuuauuauguguuuuguauaaaucccuaauauuuaaaaaaaaaaacaaaacaaaaaaagguuac

SEQ ID NO: 31304 - RNA, 64 nt, hsa
uuauuauguguuuuguauaaaucccuaauauuuaaaaaaaaaaacaaaacaaaaaaagguuaca

SEQ ID NO: 31305 - RNA, 64 nt, hsa
uauuauguguuuuguauaaaucccuaauauuuaaaaaaaaaaacaaaacaaaaaaagguuacaa

SEQ ID NO: 31306 - RNA, 64 nt, hsa
auuauguguuuuguauaaaucccuaauauuuaaaaaaaaaaacaaaacaaaaaaagguuacaaa

SEQ ID NO: 31307 - RNA, 64 nt, hsa
uuacuguuuguuuuuauuaucuuaagugcuaauuaaaaaaaaaauaaaauuuuaaaaaaaccug

SEQ ID NO: 31308 - RNA, 64 nt, hsa
uacuguuuguuuuuauuaucuuaagugcuaauuaaaaaaaaaauaaaauuuuaaaaaaaccugu

SEQ ID NO: 31309 - RNA, 64 nt, hsa
acuguuuguuuuuauuaucuuaagugcuaauuaaaaaaaaaauaaaauuuuaaaaaaaccugua

SEQ ID NO: 31310 - RNA, 64 nt, hsa
cauuuggauuuuguuguuugauggaauuugagccaaaaaaaaaauacgcaggcuuuccuauuuc

SEQ ID NO: 31311 - RNA, 64 nt, hsa
auuuggauuuuguuguuugauggaauuugagccaaaaaaaaaauacgcaggcuuuccuauuucu

SEQ ID NO: 31312 - RNA, 64 nt, hsa
uuuggauuuuguuguuugauggaauuugagccaaaaaaaaaauacgcaggcuuuccuauuucua

SEQ ID NO: 31313 - RNA, 64 nt, hsa
uuuuguaccaguggaacuuuuuauacuggagauuaaaaaaaaaauggaaauuuuuguggcuugc

SEQ ID NO: 31314 - RNA, 64 nt, hsa
uuuguaccaguggaacuuuuuauacuggagauuaaaaaaaaaauggaaauuuuuguggcuugcu

SEQ ID NO: 31315 - RNA, 64 nt, hsa
uuguaccaguggaacuuuuuauacuggagauuaaaaaaaaaauggaaauuuuuguggcuugcuc

SEQ ID NO: 31316 - RNA, 64 nt, hsa
guccagccugggugacagagcaagacugcguuucaaaaaaaaaaaaaaaaaaacccauuaaaag

SEQ ID NO: 31317 - RNA, 64 nt, hsa
uccagccugggugacagagcaagacugcguuucaaaaaaaaaaaaaaaaaaacccauuaaaaga

SEQ ID NO: 31318 - RNA, 64 nt, hsa
ccagccugggugacagagcaagacugcguuucaaaaaaaaaaaaaaaaaaacccauuaaaagag

SEQ ID NO: 31319 - RNA, 64 nt, hsa
cagccugggugacagagcaagacugcguuucaaaaaaaaaaaaaaaaaaacccauuaaaagagg

SEQ ID NO: 31320 - RNA, 64 nt, hsa
agccugggugacagagcaagacugcguuucaaaaaaaaaaaaaaaaaaacccauuaaaagaggc

SEQ ID NO: 31321 - RNA, 64 nt, hsa
gccugggugacagagcaagacugcguuucaaaaaaaaaaaaaaaaaaacccauuaaaagaggcc

SEQ ID NO: 31322 - RNA, 64 nt, hsa
ccugggugacagagcaagacugcguuucaaaaaaaaaaaaaaaaaaacccauuaaaagaggccu

SEQ ID NO: 31323 - RNA, 64 nt, hsa
cugggugacagagcaagacugcguuucaaaaaaaaaaaaaaaaaaacccauuaaaagaggccuc

SEQ ID NO: 31324 - RNA, 64 nt, hsa
ugggugacagagcaagacugcguuucaaaaaaaaaaaaaaaaaaacccauuaaaagaggccucc

SEQ ID NO: 31325 - RNA, 64 nt, hsa
gggugacagagcaagacugcguuucaaaaaaaaaaaaaaaaaaacccauuaaaagaggccuccu

SEQ ID NO: 31326 - RNA, 64 nt, hsa
ggugacagagcaagacugcguuucaaaaaaaaaaaaaaaaaaacccauuaaaagaggccuccuu

SEQ ID NO: 31327 - RNA, 64 nt, hsa
gugacagagcaagacugcguuucaaaaaaaaaaaaaaaaaaacccauuaaaagaggccuccuuc

SEQ ID NO: 31328 - RNA, 64 nt, hsa
ucaaaaaauaaauaaauagaaagagagagagaggaaaaaaaaagaaaagaacacuucuuuauuu

SEQ ID NO: 31329 - RNA, 64 nt, hsa
caaaaaauaaauaaauagaaagagagagagaggaaaaaaaaagaaaagaacacuucuuuauuug

SEQ ID NO: 31330 - RNA, 64 nt, hsa
aaacgauuuaccaauguuguuuuuuuuuaacaagaaaaaaaauaaaagcacauugucauuuuuu

SEQ ID NO: 31331 - RNA, 64 nt, hsa
guaaccgucuaugguguguuuuuucauuaaugacaaaaaaaaaaagguuucaacuggauuauuu

SEQ ID NO: 31332 - RNA, 64 nt, hsa
uaaccgucuaugguguguuuuuucauuaaugacaaaaaaaaaaagguuucaacuggauuauuua

SEQ ID NO: 31333 - RNA, 64 nt, hsa
aaccgucuaugguguguuuuuucauuaaugacaaaaaaaaaaagguuucaacuggauuauuuaa

SEQ ID NO: 31334 - RNA, 64 nt, hsa
accgucuaugguguguuuuuucauuaaugacaaaaaaaaaaagguuucaacuggauuauuuaaa

SEQ ID NO: 31335 - RNA, 64 nt, hsa
ccugagcacuagcaauccacccaccucuguuuccaaaaaaaaaaaaaaaaugaaaggucaaccc

SEQ ID NO: 31336 - RNA, 64 nt, hsa
cugagcacuagcaauccacccaccucuguuuccaaaaaaaaaaaaaaaaugaaaggucaacccc

SEQ ID NO: 31337 - RNA, 64 nt, hsa
ugagcacuagcaauccacccaccucuguuuccaaaaaaaaaaaaaaaaugaaaggucaaccccu

SEQ ID NO: 31338 - RNA, 64 nt, hsa
gagcacuagcaauccacccaccucuguuuccaaaaaaaaaaaaaaaaugaaaggucaaccccua

SEQ ID NO: 31339 - RNA, 64 nt, hsa
agcacuagcaauccacccaccucuguuuccaaaaaaaaaaaaaaaaugaaaggucaaccccuau

SEQ ID NO: 31340 - RNA, 64 nt, hsa
gcacuagcaauccacccaccucuguuuccaaaaaaaaaaaaaaaaugaaaggucaaccccuaug

SEQ ID NO: 31341 - RNA, 64 nt, hsa
cacuagcaauccacccaccucuguuuccaaaaaaaaaaaaaaaaugaaaggucaaccccuaugc

SEQ ID NO: 31342 - RNA, 64 nt, hsa
acuagcaauccacccaccucuguuuccaaaaaaaaaaaaaaaaugaaaggucaaccccuaugca

SEQ ID NO: 31343 - RNA, 64 nt, hsa
cuagcaauccacccaccucuguuuccaaaaaaaaaaaaaaaaugaaaggucaaccccuaugcaa

SEQ ID NO: 31344 - RNA, 64 nt, hsa
cuccagccugggugacagauccagacucugucucaaaaaaaaaaaaaaaaaaaauacuucuggc

SEQ ID NO: 31345 - RNA, 64 nt, hsa
uccagccugggugacagauccagacucugucucaaaaaaaaaaaaaaaaaaaauacuucuggca

SEQ ID NO: 31346 - RNA, 64 nt, hsa
ccagccugggugacagauccagacucugucucaaaaaaaaaaaaaaaaaaaauacuucuggcag

SEQ ID NO: 31347 - RNA, 64 nt, hsa
cagccugggugacagauccagacucugucucaaaaaaaaaaaaaaaaaaaauacuucuggcaga

SEQ ID NO: 31348 - RNA, 64 nt, hsa
agccugggugacagauccagacucugucucaaaaaaaaaaaaaaaaaaaauacuucuggcagag

SEQ ID NO: 31349 - RNA, 64 nt, hsa
gccugggugacagauccagacucugucucaaaaaaaaaaaaaaaaaaaauacuucuggcagagu

SEQ ID NO: 31350 - RNA, 64 nt, hsa
ccugggugacagauccagacucugucucaaaaaaaaaaaaaaaaaaaauacuucuggcagaguc

SEQ ID NO: 31351 - RNA, 64 nt, hsa
cugggugacagauccagacucugucucaaaaaaaaaaaaaaaaaaaauacuucuggcagagucu

SEQ ID NO: 31352 - RNA, 64 nt, hsa
ugggugacagauccagacucugucucaaaaaaaaaaaaaaaaaaaauacuucuggcagagucuu

SEQ ID NO: 31353 - RNA, 64 nt, hsa
gggugacagauccagacucugucucaaaaaaaaaaaaaaaaaaaauacuucuggcagagucuuu

SEQ ID NO: 31354 - RNA, 64 nt, hsa
ggugacagauccagacucugucucaaaaaaaaaaaaaaaaaaaauacuucuggcagagucuuuu

SEQ ID NO: 31355 - RNA, 64 nt, hsa
gugacagauccagacucugucucaaaaaaaaaaaaaaaaaaaauacuucuggcagagucuuuua

SEQ ID NO: 31356 - RNA, 64 nt, hsa
ugacagauccagacucugucucaaaaaaaaaaaaaaaaaaaauacuucuggcagagucuuuuau

SEQ ID NO: 31357 - RNA, 64 nt, hsa
ggccacaauuuaauuaauugguaagauauaaugcaaaaaaaaaaagagaaauguuugccuuaug

SEQ ID NO: 31358 - RNA, 64 nt, hsa
gccacaauuuaauuaauugguaagauauaaugcaaaaaaaaaaagagaaauguuugccuuaugu

SEQ ID NO: 31359 - RNA, 64 nt, hsa
ccacaauuuaauuaauugguaagauauaaugcaaaaaaaaaaagagaaauguuugccuuaugua

SEQ ID NO: 31360 - RNA, 64 nt, hsa
cacaauuuaauuaauugguaagauauaaugcaaaaaaaaaaagagaaauguuugccuuauguau

SEQ ID NO: 31361 - RNA, 64 nt, hsa
agccaggagaacaaacuaauuccuuuaaauaaauaaaaaaaaaaaaugcaaauguccuucacca

SEQ ID NO: 31362 - RNA, 64 nt, hsa
gccaggagaacaaacuaauuccuuuaaauaaauaaaaaaaaaaaaugcaaauguccuucaccag

SEQ ID NO: 31363 - RNA, 64 nt, hsa
ccaggagaacaaacuaauuccuuuaaauaaauaaaaaaaaaaaaugcaaauguccuucaccagu

SEQ ID NO: 31364 - RNA, 64 nt, hsa
caggagaacaaacuaauuccuuuaaauaaauaaaaaaaaaaaaugcaaauguccuucaccagua

SEQ ID NO: 31365 - RNA, 64 nt, hsa
aggagaacaaacuaauuccuuuaaauaaauaaaaaaaaaaaaugcaaauguccuucaccaguaa

SEQ ID NO: 31366 - RNA, 64 nt, hsa
uguacugucagcuucacuccaccugagaaaaaagaaaaaaaaauugauagcucaaaugcaugua

SEQ ID NO: 31367 - RNA, 64 nt, hsa
guacugucagcuucacuccaccugagaaaaaagaaaaaaaaauugauagcucaaaugcauguaa

SEQ ID NO: 31368 - RNA, 64 nt, hsa
uuuuggcuuaggugcaggguugcaaagggaucagaaaaaaaaaaucauaauaaagcuuuaguuc

SEQ ID NO: 31369 - RNA, 64 nt, hsa
uuuggcuuaggugcaggguugcaaagggaucagaaaaaaaaaaucauaauaaagcuuuaguuca

SEQ ID NO: 31370 - RNA, 64 nt, hsa
uuggcuuaggugcaggguugcaaagggaucagaaaaaaaaaaucauaauaaagcuuuaguucau

SEQ ID NO: 31371 - RNA, 64 nt, hsa
auagcacaucaccugggacuuggcaaucuuuguuaaaaaaaaauuuccuuucuaaugggauuug

SEQ ID NO: 31372 - RNA, 64 nt, hsa
uagcacaucaccugggacuuggcaaucuuuguuaaaaaaaaauuuccuuucuaaugggauuugg

SEQ ID NO: 31373 - RNA, 64 nt, hsa
aaagaaguaccugaucaggaucugggagaauuugaaaaaaaaagaaaaacuagaaaaauaaaca

SEQ ID NO: 31374 - RNA, 64 nt, hsa
aagaaguaccugaucaggaucugggagaauuugaaaaaaaaagaaaaacuagaaaaauaaacaa

SEQ ID NO: 31375 - RNA, 64 nt, hsa
aagaaaaacuagaaaaauaaacaaaauuaaaaagaaaaaaaaauaccugagacugaguaacuua

SEQ ID NO: 31376 - RNA, 64 nt, hsa
agaaaaacuagaaaaauaaacaaaauuaaaaagaaaaaaaaauaccugagacugaguaacuuau

SEQ ID NO: 31377 - RNA, 64 nt, hsa
uacauguaaaccugucugcaaaauuagcuuuuuuaaaaaaaaaaaaaaaaaaauuggggggguu

SEQ ID NO: 31378 - RNA, 64 nt, hsa
acauguaaaccugucugcaaaauuagcuuuuuuaaaaaaaaaaaaaaaaaaauuggggggguua

SEQ ID NO: 31379 - RNA, 64 nt, hsa
cauguaaaccugucugcaaaauuagcuuuuuuaaaaaaaaaaaaaaaaaaauuggggggguuaa

SEQ ID NO: 31380 - RNA, 64 nt, hsa
auguaaaccugucugcaaaauuagcuuuuuuaaaaaaaaaaaaaaaaaaauuggggggguuaau

SEQ ID NO: 31381 - RNA, 64 nt, hsa
uguaaaccugucugcaaaauuagcuuuuuuaaaaaaaaaaaaaaaaaaauuggggggguuaauu

SEQ ID NO: 31382 - RNA, 64 nt, hsa
guaaaccugucugcaaaauuagcuuuuuuaaaaaaaaaaaaaaaaaaauuggggggguuaauuu

SEQ ID NO: 31383 - RNA, 64 nt, hsa
uaaaccugucugcaaaauuagcuuuuuuaaaaaaaaaaaaaaaaaaauuggggggguuaauuua

SEQ ID NO: 31384 - RNA, 64 nt, hsa
aaaccugucugcaaaauuagcuuuuuuaaaaaaaaaaaaaaaaaaauuggggggguuaauuuau

SEQ ID NO: 31385 - RNA, 64 nt, hsa
aaccugucugcaaaauuagcuuuuuuaaaaaaaaaaaaaaaaaaauuggggggguuaauuuauc

SEQ ID NO: 31386 - RNA, 64 nt, hsa
accugucugcaaaauuagcuuuuuuaaaaaaaaaaaaaaaaaaauuggggggguuaauuuauca

SEQ ID NO: 31387 - RNA, 64 nt, hsa
ccugucugcaaaauuagcuuuuuuaaaaaaaaaaaaaaaaaaauuggggggguuaauuuaucau

SEQ ID NO: 31388 - RNA, 64 nt, hsa
cugucugcaaaauuagcuuuuuuaaaaaaaaaaaaaaaaaaauuggggggguuaauuuaucauu

SEQ ID NO: 31389 - RNA, 64 nt, hsa
ggcauuugcagauuuuuauauuaguugcuuuguuaaaaaaaaaaagauuguauugcuguccuug

SEQ ID NO: 31390 - RNA, 64 nt, hsa
gcauuugcagauuuuuauauuaguugcuuuguuaaaaaaaaaaagauuguauugcuguccuuga

SEQ ID NO: 31391 - RNA, 64 nt, hsa
cauuugcagauuuuuauauuaguugcuuuguuaaaaaaaaaaagauuguauugcuguccuugaa

SEQ ID NO: 31392 - RNA, 64 nt, hsa
auuugcagauuuuuauauuaguugcuuuguuaaaaaaaaaaagauuguauugcuguccuugaau

SEQ ID NO: 31393 - RNA, 64 nt, hsa
uccagccugagugacagagagagauucaaaaaacaaaaaaaaagcaaaaauauacuuugcuauu

SEQ ID NO: 31394 - RNA, 64 nt, hsa
ccagccugagugacagagagagauucaaaaaacaaaaaaaaagcaaaaauauacuuugcuauug

SEQ ID NO: 31395 - RNA, 64 nt, hsa
uuuugaggccaguacaaccuugauaacaaaaccuaaaaaaaaaacaacaaaaaaacccauaaag

SEQ ID NO: 31396 - RNA, 64 nt, hsa
uuugaggccaguacaaccuugauaacaaaaccuaaaaaaaaaacaacaaaaaaacccauaaagc

SEQ ID NO: 31397 - RNA, 64 nt, hsa
uugaggccaguacaaccuugauaacaaaaccuaaaaaaaaaacaacaaaaaaacccauaaagcu

SEQ ID NO: 31398 - RNA, 64 nt, hsa
gaagacagagugagaccccaucucaggaaaaaagaaaaaaaaaaagaugucauucagcagguua

SEQ ID NO: 31399 - RNA, 64 nt, hsa
aagacagagugagaccccaucucaggaaaaaagaaaaaaaaaaagaugucauucagcagguuaa

SEQ ID NO: 31400 - RNA, 64 nt, hsa
agacagagugagaccccaucucaggaaaaaagaaaaaaaaaaagaugucauucagcagguuaau

SEQ ID NO: 31401 - RNA, 64 nt, hsa
gacagagugagaccccaucucaggaaaaaagaaaaaaaaaaagaugucauucagcagguuaaug

SEQ ID NO: 31402 - RNA, 64 nt, hsa
aggguuuuguuucuugaauaucuucacuuuaaacaaaaaaaaaaaacaacuuucauuugugugg

SEQ ID NO: 31403 - RNA, 64 nt, hsa
ggguuuuguuucuugaauaucuucacuuuaaacaaaaaaaaaaaacaacuuucauuuguguggc

SEQ ID NO: 31404 - RNA, 64 nt, hsa
gguuuuguuucuugaauaucuucacuuuaaacaaaaaaaaaaaacaacuuucauuuguguggca

SEQ ID NO: 31405 - RNA, 64 nt, hsa
guuuuguuucuugaauaucuucacuuuaaacaaaaaaaaaaaacaacuuucauuuguguggcau

SEQ ID NO: 31406 - RNA, 64 nt, hsa
uuuuguuucuugaauaucuucacuuuaaacaaaaaaaaaaaacaacuuucauuuguguggcauu

SEQ ID NO: 31407 - RNA, 64 nt, hsa
cuucaauuacauaggcagguuuuucuuaaaaaugaaaaaaaaaucaaagauuuuuuuaacaguu

SEQ ID NO: 31408 - RNA, 64 nt, hsa
uucaauuacauaggcagguuuuucuuaaaaaugaaaaaaaaaucaaagauuuuuuuaacaguuc

SEQ ID NO: 31409 - RNA, 64 nt, hsa
cuuguacaaacucaacacuaacuuuuuuuuuuuuaaaaaaaaaaagguacuaaguaucuucaau

SEQ ID NO: 31410 - RNA, 64 nt, hsa
uuguacaaacucaacacuaacuuuuuuuuuuuuaaaaaaaaaaagguacuaaguaucuucaauc

SEQ ID NO: 31411 - RNA, 64 nt, hsa
uguacaaacucaacacuaacuuuuuuuuuuuuaaaaaaaaaaagguacuaaguaucuucaauca

SEQ ID NO: 31412 - RNA, 64 nt, hsa
guacaaacucaacacuaacuuuuuuuuuuuuaaaaaaaaaaagguacuaaguaucuucaaucag

SEQ ID NO: 31413 - RNA, 64 nt, hsa
cagauauuuguacugaagucugauacagaauuagaaaaaaaaaauucuuguugaaauauuuuga

SEQ ID NO: 31414 - RNA, 64 nt, hsa
agauauuuguacugaagucugauacagaauuagaaaaaaaaaauucuuguugaaauauuuugaa

SEQ ID NO: 31415 - RNA, 64 nt, hsa
gauauuuguacugaagucugauacagaauuagaaaaaaaaaauucuuguugaaauauuuugaaa

SEQ ID NO: 31416 - RNA, 64 nt, hsa
agggggcgcagauuagcauugcucaagaguauguaaaaaaaaaaaaaaaaaaaaagaaccaaac

SEQ ID NO: 31417 - RNA, 64 nt, hsa
gggggcgcagauuagcauugcucaagaguauguaaaaaaaaaaaaaaaaaaaaagaaccaaacc

SEQ ID NO: 31418 - RNA, 64 nt, hsa
ggggcgcagauuagcauugcucaagaguauguaaaaaaaaaaaaaaaaaaaaagaaccaaacca

SEQ ID NO: 31419 - RNA, 64 nt, hsa
gggcgcagauuagcauugcucaagaguauguaaaaaaaaaaaaaaaaaaaaagaaccaaaccac

SEQ ID NO: 31420 - RNA, 64 nt, hsa
ggcgcagauuagcauugcucaagaguauguaaaaaaaaaaaaaaaaaaaaagaaccaaaccacu

SEQ ID NO: 31421 - RNA, 64 nt, hsa
gcgcagauuagcauugcucaagaguauguaaaaaaaaaaaaaaaaaaaaagaaccaaaccacug

SEQ ID NO: 31422 - RNA, 64 nt, hsa
cgcagauuagcauugcucaagaguauguaaaaaaaaaaaaaaaaaaaaagaaccaaaccacugg

SEQ ID NO: 31423 - RNA, 64 nt, hsa
gcagauuagcauugcucaagaguauguaaaaaaaaaaaaaaaaaaaaagaaccaaaccacugga

SEQ ID NO: 31424 - RNA, 64 nt, hsa
cagauuagcauugcucaagaguauguaaaaaaaaaaaaaaaaaaaaagaaccaaaccacuggaa

SEQ ID NO: 31425 - RNA, 64 nt, hsa
agauuagcauugcucaagaguauguaaaaaaaaaaaaaaaaaaaaagaaccaaaccacuggaaa

SEQ ID NO: 31426 - RNA, 64 nt, hsa
gauuagcauugcucaagaguauguaaaaaaaaaaaaaaaaaaaaagaaccaaaccacuggaaau

SEQ ID NO: 31427 - RNA, 64 nt, hsa
auuagcauugcucaagaguauguaaaaaaaaaaaaaaaaaaaaagaaccaaaccacuggaaaua

SEQ ID NO: 31428 - RNA, 64 nt, hsa
uuagcauugcucaagaguauguaaaaaaaaaaaaaaaaaaaaagaaccaaaccacuggaaauaa

SEQ ID NO: 31429 - RNA, 64 nt, hsa
uagcauugcucaagaguauguaaaaaaaaaaaaaaaaaaaaagaaccaaaccacuggaaauaau

SEQ ID NO: 31430 - RNA, 64 nt, hsa
aauuauaaugauaugccccuuuucuuauaaaaacaaaaaaaaaaauaaugaaacacagugaauu

SEQ ID NO: 31431 - RNA, 64 nt, hsa
auuauaaugauaugccccuuuucuuauaaaaacaaaaaaaaaaauaaugaaacacagugaauuu

SEQ ID NO: 31432 - RNA, 64 nt, hsa
uuauaaugauaugccccuuuucuuauaaaaacaaaaaaaaaaauaaugaaacacagugaauuug

SEQ ID NO: 31433 - RNA, 64 nt, hsa
uauaaugauaugccccuuuucuuauaaaaacaaaaaaaaaaauaaugaaacacagugaauuugu

SEQ ID NO: 31434 - RNA, 64 nt, hsa
ccugucuuugguuaggcucguguacuucugcaggaaaaaaaaaaaaggaugugucauuggucau

SEQ ID NO: 31435 - RNA, 64 nt, hsa
cugucuuugguuaggcucguguacuucugcaggaaaaaaaaaaaaggaugugucauuggucaug

SEQ ID NO: 31436 - RNA, 64 nt, hsa
ugucuuugguuaggcucguguacuucugcaggaaaaaaaaaaaaggaugugucauuggucauga

SEQ ID NO: 31437 - RNA, 64 nt, hsa
gucuuugguuaggcucguguacuucugcaggaaaaaaaaaaaaggaugugucauuggucaugau

SEQ ID NO: 31438 - RNA, 64 nt, hsa
ucuuugguuaggcucguguacuucugcaggaaaaaaaaaaaaggaugugucauuggucaugaua

SEQ ID NO: 31439 - RNA, 64 nt, hsa
auuauccagauuauuuggauaaguccuuuuuaagaaaaaaaaagaaaaugaaaaacaacacaaa

SEQ ID NO: 31440 - RNA, 64 nt, hsa
uuauccagauuauuuggauaaguccuuuuuaagaaaaaaaaagaaaaugaaaaacaacacaaaa

SEQ ID NO: 31441 - RNA, 64 nt, hsa
cucuagucugggugacagagcgagacucugucucaaaaaaaaaaaaauaaagccgggcguggug

SEQ ID NO: 31442 - RNA, 64 nt, hsa
ucuagucugggugacagagcgagacucugucucaaaaaaaaaaaaauaaagccgggcguggugg

SEQ ID NO: 31443 - RNA, 64 nt, hsa
cuagucugggugacagagcgagacucugucucaaaaaaaaaaaaauaaagccgggcgugguggc

SEQ ID NO: 31444 - RNA, 64 nt, hsa
uagucugggugacagagcgagacucugucucaaaaaaaaaaaaauaaagccgggcgugguggcu

SEQ ID NO: 31445 - RNA, 64 nt, hsa
agucugggugacagagcgagacucugucucaaaaaaaaaaaaauaaagccgggcgugguggcuc

SEQ ID NO: 31446 - RNA, 64 nt, hsa
gucugggugacagagcgagacucugucucaaaaaaaaaaaaauaaagccgggcgugguggcuca

SEQ ID NO: 31447 - RNA, 64 nt, hsa
caacauggugaaaccuugucucuacuaaaacuacaaaaaaaauuagccaggcgugguggcgggc

SEQ ID NO: 31448 - RNA, 64 nt, hsa
gcuccagccugagcaacaagagcgaaacugucucaaaaaaaagaagaaaauaaauaaauaaaaa

SEQ ID NO: 31449 - RNA, 64 nt, hsa
caauaucagugcucgagacacagugaagcaaauuaaaaaaaaaaaaaaaaaaaaucccugaaug

SEQ ID NO: 31450 - RNA, 64 nt, hsa
aauaucagugcucgagacacagugaagcaaauuaaaaaaaaaaaaaaaaaaaaucccugaauga

SEQ ID NO: 31451 - RNA, 64 nt, hsa
auaucagugcucgagacacagugaagcaaauuaaaaaaaaaaaaaaaaaaaaucccugaaugau

SEQ ID NO: 31452 - RNA, 64 nt, hsa
uaucagugcucgagacacagugaagcaaauuaaaaaaaaaaaaaaaaaaaaucccugaaugaug

SEQ ID NO: 31453 - RNA, 64 nt, hsa
aucagugcucgagacacagugaagcaaauuaaaaaaaaaaaaaaaaaaaaucccugaaugauga

SEQ ID NO: 31454 - RNA, 64 nt, hsa
ucagugcucgagacacagugaagcaaauuaaaaaaaaaaaaaaaaaaaaucccugaaugaugau

SEQ ID NO: 31455 - RNA, 64 nt, hsa
cagugcucgagacacagugaagcaaauuaaaaaaaaaaaaaaaaaaaaucccugaaugaugauu

SEQ ID NO: 31456 - RNA, 64 nt, hsa
agugcucgagacacagugaagcaaauuaaaaaaaaaaaaaaaaaaaaucccugaaugaugauua

SEQ ID NO: 31457 - RNA, 64 nt, hsa
gugcucgagacacagugaagcaaauuaaaaaaaaaaaaaaaaaaaaucccugaaugaugauuag

SEQ ID NO: 31458 - RNA, 64 nt, hsa
ugcucgagacacagugaagcaaauuaaaaaaaaaaaaaaaaaaaaucccugaaugaugauuaga

SEQ ID NO: 31459 - RNA, 64 nt, hsa
gcucgagacacagugaagcaaauuaaaaaaaaaaaaaaaaaaaaucccugaaugaugauuagag

SEQ ID NO: 31460 - RNA, 64 nt, hsa
cucgagacacagugaagcaaauuaaaaaaaaaaaaaaaaaaaaucccugaaugaugauuagaga

SEQ ID NO: 31461 - RNA, 64 nt, hsa
ucgagacacagugaagcaaauuaaaaaaaaaaaaaaaaaaaaucccugaaugaugauuagagac

SEQ ID NO: 31462 - RNA, 64 nt, hsa
uguauuguuuuuauuuugcgaaacaaaacaaaacaaaaaaaaaagcuuggaacuccaucacgug

SEQ ID NO: 31463 - RNA, 64 nt, hsa
guauuguuuuuauuuugcgaaacaaaacaaaacaaaaaaaaaagcuuggaacuccaucacgugg

SEQ ID NO: 31464 - RNA, 64 nt, hsa
uauuguuuuuauuuugcgaaacaaaacaaaacaaaaaaaaaagcuuggaacuccaucacgugga

SEQ ID NO: 31465 - RNA, 64 nt, hsa
cuuuuauaaugaaguaaaaguugugucuauaauuaaaaaaaaauauauauauauacacacacac

SEQ ID NO: 31466 - RNA, 64 nt, hsa
uuuuauaaugaaguaaaaguugugucuauaauuaaaaaaaaauauauauauauacacacacaca

SEQ ID NO: 31467 - RNA, 64 nt, hsa
auuauaaaaauaaugaauucucacuguaaauuucaaaaaaaaauuacaaaaguaugugaauuua

SEQ ID NO: 31468 - RNA, 64 nt, hsa
uuauaaaaauaaugaauucucacuguaaauuucaaaaaaaaauuacaaaaguaugugaauuuaa

SEQ ID NO: 31469 - RNA, 64 nt, hsa
gcagcaguggccucuacguuuuacuccuuugcugaaaaaaaaucaucuugcccacaggccugug

SEQ ID NO: 31470 - RNA, 64 nt, hsa
ccaaucuauucuaauuaccuuaaaucuaaaggggaaaaaaaaaaucacaaacaggacuggguag

SEQ ID NO: 31471 - RNA, 64 nt, hsa
caaucuauucuaauuaccuuaaaucuaaaggggaaaaaaaaaaucacaaacaggacuggguagu

SEQ ID NO: 31472 - RNA, 64 nt, hsa
aaucuauucuaauuaccuuaaaucuaaaggggaaaaaaaaaaucacaaacaggacuggguaguu

SEQ ID NO: 31473 - RNA, 64 nt, hsa
cuaggcaacagagcgagacucugucuccccccgcaaaaaaaaaaaagaaagaaagaaagagaaa

SEQ ID NO: 31474 - RNA, 64 nt, hsa
uaggcaacagagcgagacucugucuccccccgcaaaaaaaaaaaagaaagaaagaaagagaaaa

SEQ ID NO: 31475 - RNA, 64 nt, hsa
aggcaacagagcgagacucugucuccccccgcaaaaaaaaaaaagaaagaaagaaagagaaaag

SEQ ID NO: 31476 - RNA, 64 nt, hsa
ggcaacagagcgagacucugucuccccccgcaaaaaaaaaaaagaaagaaagaaagagaaaaga

SEQ ID NO: 31477 - RNA, 64 nt, hsa
gcaacagagcgagacucugucuccccccgcaaaaaaaaaaaagaaagaaagaaagagaaaagaa

SEQ ID NO: 31478 - RNA, 64 nt, hsa
cagaccuacaaagaguuaaaacaaacagacaaacaaaaaaaaacacuacuauuuuaaauagugg

SEQ ID NO: 31479 - RNA, 64 nt, hsa
agaccuacaaagaguuaaaacaaacagacaaacaaaaaaaaacacuacuauuuuaaauagugga

SEQ ID NO: 31480 - RNA, 64 nt, hsa
uauacccccaccccacaaagauuuucuucagguuaaaaaaaaaguuuaaaaaaaagauuuuaaa

SEQ ID NO: 31481 - RNA, 64 nt, hsa
auacccccaccccacaaagauuuucuucagguuaaaaaaaaaguuuaaaaaaaagauuuuaaaa

SEQ ID NO: 31482 - RNA, 64 nt, hsa
cacaaagauuuucuucagguuaaaaaaaaaguuuaaaaaaaagauuuuaaaauaaagcauuuau

SEQ ID NO: 31483 - RNA, 64 nt, hsa
acguccugggggaggggggcauuuuuuauguuacaaaaaaaaauuacgaaagaaaagaaaucuc

SEQ ID NO: 31484 - RNA, 64 nt, hsa
cguccugggggaggggggcauuuuuuauguuacaaaaaaaaauuacgaaagaaaagaaaucucu

SEQ ID NO: 31485 - RNA, 64 nt, hsa
uuauuuuucuucuguacagucuaaagcuacagagaaaaaaaaaugcacucuucccuugccggcu

SEQ ID NO: 31486 - RNA, 64 nt, hsa
uauuuuucuucuguacagucuaaagcuacagagaaaaaaaaaugcacucuucccuugccggcuc

SEQ ID NO: 31487 - RNA, 64 nt, hsa
acacauaacauggguuauuuaguuuaacucuggcaaaaaaaaaaaaaaaaauuuuguauguuga

SEQ ID NO: 31488 - RNA, 64 nt, hsa
cacauaacauggguuauuuaguuuaacucuggcaaaaaaaaaaaaaaaaauuuuguauguugau

SEQ ID NO: 31489 - RNA, 64 nt, hsa
acauaacauggguuauuuaguuuaacucuggcaaaaaaaaaaaaaaaaauuuuguauguugaug

SEQ ID NO: 31490 - RNA, 64 nt, hsa
cauaacauggguuauuuaguuuaacucuggcaaaaaaaaaaaaaaaaauuuuguauguugaugu

SEQ ID NO: 31491 - RNA, 64 nt, hsa
auaacauggguuauuuaguuuaacucuggcaaaaaaaaaaaaaaaaauuuuguauguugauguu

SEQ ID NO: 31492 - RNA, 64 nt, hsa
uaacauggguuauuuaguuuaacucuggcaaaaaaaaaaaaaaaaauuuuguauguugauguuu

SEQ ID NO: 31493 - RNA, 64 nt, hsa
aacauggguuauuuaguuuaacucuggcaaaaaaaaaaaaaaaaauuuuguauguugauguuug

SEQ ID NO: 31494 - RNA, 64 nt, hsa
acauggguuauuuaguuuaacucuggcaaaaaaaaaaaaaaaaauuuuguauguugauguuugu

SEQ ID NO: 31495 - RNA, 64 nt, hsa
cauggguuauuuaguuuaacucuggcaaaaaaaaaaaaaaaaauuuuguauguugauguuugua

SEQ ID NO: 31496 - RNA, 64 nt, hsa
auggguuauuuaguuuaacucuggcaaaaaaaaaaaaaaaaauuuuguauguugauguuuguau

SEQ ID NO: 31497 - RNA, 64 nt, hsa
aaaccaaaaugacaucuuuuuaaagcuuauccauaaaaaaaaauagaugucuuuuauaguggaa

SEQ ID NO: 31498 - RNA, 64 nt, hsa
aaccaaaaugacaucuuuuuaaagcuuauccauaaaaaaaaauagaugucuuuuauaguggaaa

SEQ ID NO: 31499 - RNA, 64 nt, hsa
auacuuuaaauaauuuaacuacccuuaauuacuuaaaaaaaaaaaaaagcuuuaugauuuucau

SEQ ID NO: 31500 - RNA, 64 nt, hsa
uacuuuaaauaauuuaacuacccuuaauuacuuaaaaaaaaaaaaaagcuuuaugauuuucaua

SEQ ID NO: 31501 - RNA, 64 nt, hsa
acuuuaaauaauuuaacuacccuuaauuacuuaaaaaaaaaaaaaagcuuuaugauuuucauaa

SEQ ID NO: 31502 - RNA, 64 nt, hsa
cuuuaaauaauuuaacuacccuuaauuacuuaaaaaaaaaaaaaagcuuuaugauuuucauaac

SEQ ID NO: 31503 - RNA, 64 nt, hsa
uuuaaauaauuuaacuacccuuaauuacuuaaaaaaaaaaaaaagcuuuaugauuuucauaacu

SEQ ID NO: 31504 - RNA, 64 nt, hsa
uuaaauaauuuaacuacccuuaauuacuuaaaaaaaaaaaaaagcuuuaugauuuucauaacuu

SEQ ID NO: 31505 - RNA, 64 nt, hsa
uaaauaauuuaacuacccuuaauuacuuaaaaaaaaaaaaaagcuuuaugauuuucauaacuua

SEQ ID NO: 31506 - RNA, 64 nt, hsa
cucguuugggcaacaagagugaaacucuugucucaaaaaaaaaaaaaaaugagguuuaagacag

SEQ ID NO: 31507 - RNA, 64 nt, hsa
ucguuugggcaacaagagugaaacucuugucucaaaaaaaaaaaaaaaugagguuuaagacagu

SEQ ID NO: 31508 - RNA, 64 nt, hsa
cguuugggcaacaagagugaaacucuugucucaaaaaaaaaaaaaaaugagguuuaagacaguu

SEQ ID NO: 31509 - RNA, 64 nt, hsa
guuugggcaacaagagugaaacucuugucucaaaaaaaaaaaaaaaugagguuuaagacaguuu

SEQ ID NO: 31510 - RNA, 64 nt, hsa
uuugggcaacaagagugaaacucuugucucaaaaaaaaaaaaaaaugagguuuaagacaguuuu

SEQ ID NO: 31511 - RNA, 64 nt, hsa
uugggcaacaagagugaaacucuugucucaaaaaaaaaaaaaaaugagguuuaagacaguuuug

SEQ ID NO: 31512 - RNA, 64 nt, hsa
ugggcaacaagagugaaacucuugucucaaaaaaaaaaaaaaaugagguuuaagacaguuuugu

SEQ ID NO: 31513 - RNA, 64 nt, hsa
gggcaacaagagugaaacucuugucucaaaaaaaaaaaaaaaugagguuuaagacaguuuuguc

SEQ ID NO: 31514 - RNA, 64 nt, hsa
acugguguaaacagugaaagguauuugcuuguugaaaaaaaaaacuggcaaagugaaaagauac

SEQ ID NO: 31515 - RNA, 64 nt, hsa
cugguguaaacagugaaagguauuugcuuguugaaaaaaaaaacuggcaaagugaaaagauaca

SEQ ID NO: 31516 - RNA, 64 nt, hsa
ugguguaaacagugaaagguauuugcuuguugaaaaaaaaaacuggcaaagugaaaagauacag

SEQ ID NO: 31517 - RNA, 64 nt, hsa
acugcacuccagccugggugacagauuuugucuuaaaaaaaaaaaaaaaaaaguugauaugagu

SEQ ID NO: 31518 - RNA, 64 nt, hsa
cugcacuccagccugggugacagauuuugucuuaaaaaaaaaaaaaaaaaaguugauaugaguu

SEQ ID NO: 31519 - RNA, 64 nt, hsa
ugcacuccagccugggugacagauuuugucuuaaaaaaaaaaaaaaaaaaguugauaugaguuu

SEQ ID NO: 31520 - RNA, 64 nt, hsa
gcacuccagccugggugacagauuuugucuuaaaaaaaaaaaaaaaaaaguugauaugaguuuu

SEQ ID NO: 31521 - RNA, 64 nt, hsa
cacuccagccugggugacagauuuugucuuaaaaaaaaaaaaaaaaaaguugauaugaguuuua

SEQ ID NO: 31522 - RNA, 64 nt, hsa
acuccagccugggugacagauuuugucuuaaaaaaaaaaaaaaaaaaguugauaugaguuuuau

SEQ ID NO: 31523 - RNA, 64 nt, hsa
cuccagccugggugacagauuuugucuuaaaaaaaaaaaaaaaaaaguugauaugaguuuuauu

SEQ ID NO: 31524 - RNA, 64 nt, hsa
uccagccugggugacagauuuugucuuaaaaaaaaaaaaaaaaaaguugauaugaguuuuauuu

SEQ ID NO: 31525 - RNA, 64 nt, hsa
ccagccugggugacagauuuugucuuaaaaaaaaaaaaaaaaaaguugauaugaguuuuauuuu

SEQ ID NO: 31526 - RNA, 64 nt, hsa
cagccugggugacagauuuugucuuaaaaaaaaaaaaaaaaaaguugauaugaguuuuauuuuc

SEQ ID NO: 31527 - RNA, 64 nt, hsa
agccugggugacagauuuugucuuaaaaaaaaaaaaaaaaaaguugauaugaguuuuauuuucu

SEQ ID NO: 31528 - RNA, 64 nt, hsa
aguauaagucaaucuauggucagugucuuugguuaaaaaaaaaaaaaaacacaggcaguucuuu

SEQ ID NO: 31529 - RNA, 64 nt, hsa
guauaagucaaucuauggucagugucuuugguuaaaaaaaaaaaaaaacacaggcaguucuuua

SEQ ID NO: 31530 - RNA, 64 nt, hsa
uauaagucaaucuauggucagugucuuugguuaaaaaaaaaaaaaaacacaggcaguucuuuac

SEQ ID NO: 31531 - RNA, 64 nt, hsa
auaagucaaucuauggucagugucuuugguuaaaaaaaaaaaaaaacacaggcaguucuuuaca

SEQ ID NO: 31532 - RNA, 64 nt, hsa
uaagucaaucuauggucagugucuuugguuaaaaaaaaaaaaaaacacaggcaguucuuuacau

SEQ ID NO: 31533 - RNA, 64 nt, hsa
aagucaaucuauggucagugucuuugguuaaaaaaaaaaaaaaacacaggcaguucuuuacaua

SEQ ID NO: 31534 - RNA, 64 nt, hsa
agucaaucuauggucagugucuuugguuaaaaaaaaaaaaaaacacaggcaguucuuuacauaa

SEQ ID NO: 31535 - RNA, 64 nt, hsa
gucaaucuauggucagugucuuugguuaaaaaaaaaaaaaaacacaggcaguucuuuacauaaa

SEQ ID NO: 31536 - RNA, 64 nt, hsa
agagacccugcaguugcacuuucucguaaaaguuaaaaaaaaaaaaaaaaaaaaaagguuuuuc

SEQ ID NO: 31537 - RNA, 64 nt, hsa
gagacccugcaguugcacuuucucguaaaaguuaaaaaaaaaaaaaaaaaaaaaagguuuuucc

SEQ ID NO: 31538 - RNA, 64 nt, hsa
agacccugcaguugcacuuucucguaaaaguuaaaaaaaaaaaaaaaaaaaaaagguuuuuccc

SEQ ID NO: 31539 - RNA, 64 nt, hsa
gacccugcaguugcacuuucucguaaaaguuaaaaaaaaaaaaaaaaaaaaaagguuuuucccg

SEQ ID NO: 31540 - RNA, 64 nt, hsa
acccugcaguugcacuuucucguaaaaguuaaaaaaaaaaaaaaaaaaaaaagguuuuucccgg

SEQ ID NO: 31541 - RNA, 64 nt, hsa
cccugcaguugcacuuucucguaaaaguuaaaaaaaaaaaaaaaaaaaaaagguuuuucccggc

SEQ ID NO: 31542 - RNA, 64 nt, hsa
ccugcaguugcacuuucucguaaaaguuaaaaaaaaaaaaaaaaaaaaaagguuuuucccggcc

SEQ ID NO: 31543 - RNA, 64 nt, hsa
cugcaguugcacuuucucguaaaaguuaaaaaaaaaaaaaaaaaaaaaagguuuuucccggccu

SEQ ID NO: 31544 - RNA, 64 nt, hsa
ugcaguugcacuuucucguaaaaguuaaaaaaaaaaaaaaaaaaaaaagguuuuucccggccuu

SEQ ID NO: 31545 - RNA, 64 nt, hsa
gcaguugcacuuucucguaaaaguuaaaaaaaaaaaaaaaaaaaaaagguuuuucccggccuuu

SEQ ID NO: 31546 - RNA, 64 nt, hsa
caguugcacuuucucguaaaaguuaaaaaaaaaaaaaaaaaaaaaagguuuuucccggccuuug

SEQ ID NO: 31547 - RNA, 64 nt, hsa
aguugcacuuucucguaaaaguuaaaaaaaaaaaaaaaaaaaaaagguuuuucccggccuuuga

SEQ ID NO: 31548 - RNA, 64 nt, hsa
guugcacuuucucguaaaaguuaaaaaaaaaaaaaaaaaaaaaagguuuuucccggccuuugaa

SEQ ID NO: 31549 - RNA, 64 nt, hsa
uugcacuuucucguaaaaguuaaaaaaaaaaaaaaaaaaaaaagguuuuucccggccuuugaac

SEQ ID NO: 31550 - RNA, 64 nt, hsa
ugcacuuucucguaaaaguuaaaaaaaaaaaaaaaaaaaaaagguuuuucccggccuuugaaca

SEQ ID NO: 31551 - RNA, 64 nt, hsa
uguuccaaggcauuuuagcggggaggggguuaucaaaaaaaaaaaaaugugacucaagacuucc

SEQ ID NO: 31552 - RNA, 64 nt, hsa
guuccaaggcauuuuagcggggaggggguuaucaaaaaaaaaaaaaugugacucaagacuucca

SEQ ID NO: 31553 - RNA, 64 nt, hsa
uuccaaggcauuuuagcggggaggggguuaucaaaaaaaaaaaaaugugacucaagacuuccag

SEQ ID NO: 31554 - RNA, 64 nt, hsa
uccaaggcauuuuagcggggaggggguuaucaaaaaaaaaaaaaugugacucaagacuuccaga

SEQ ID NO: 31555 - RNA, 64 nt, hsa
ccaaggcauuuuagcggggaggggguuaucaaaaaaaaaaaaaugugacucaagacuuccagag

SEQ ID NO: 31556 - RNA, 64 nt, hsa
caaggcauuuuagcggggaggggguuaucaaaaaaaaaaaaaugugacucaagacuuccagagc

SEQ ID NO: 31557 - RNA, 50 nt, hsa
aggaugaugaagaugaaugaaaaaaaaaaucaaacagcagaagaccaagg

SEQ ID NO: 31558 - RNA, 51 nt, hsa
aggaugaugaagaugaaugaaaaaaaaaaucaaacagcagaagaccaaggc

SEQ ID NO: 31559 - RNA, 64 nt, hsa
ugaucccauuaccagauaagauugacugacggggaaaaaaaaaaaaaaagaauggggugugaau

SEQ ID NO: 31560 - RNA, 64 nt, hsa
gaucccauuaccagauaagauugacugacggggaaaaaaaaaaaaaaagaauggggugugaaug

SEQ ID NO: 31561 - RNA, 64 nt, hsa
aucccauuaccagauaagauugacugacggggaaaaaaaaaaaaaaagaauggggugugaaugu

SEQ ID NO: 31562 - RNA, 64 nt, hsa
ucccauuaccagauaagauugacugacggggaaaaaaaaaaaaaaagaauggggugugaaugua

SEQ ID NO: 31563 - RNA, 64 nt, hsa
cccauuaccagauaagauugacugacggggaaaaaaaaaaaaaaagaauggggugugaauguac

SEQ ID NO: 31564 - RNA, 64 nt, hsa
ccauuaccagauaagauugacugacggggaaaaaaaaaaaaaaagaauggggugugaauguacc

SEQ ID NO: 31565 - RNA, 64 nt, hsa
cauuaccagauaagauugacugacggggaaaaaaaaaaaaaaagaauggggugugaauguacca

SEQ ID NO: 31566 - RNA, 64 nt, hsa
auuaccagauaagauugacugacggggaaaaaaaaaaaaaaagaauggggugugaauguaccaa

SEQ ID NO: 31567 - RNA, 64 nt, hsa
cuccagccugggcgacagagcgagacuccgucucaaaaaaaaaaaaaaaagauucaauguucau

SEQ ID NO: 31568 - RNA, 64 nt, hsa
uccagccugggcgacagagcgagacuccgucucaaaaaaaaaaaaaaaagauucaauguucauu

SEQ ID NO: 31569 - RNA, 64 nt, hsa
ccagccugggcgacagagcgagacuccgucucaaaaaaaaaaaaaaaagauucaauguucauug

SEQ ID NO: 31570 - RNA, 64 nt, hsa
cagccugggcgacagagcgagacuccgucucaaaaaaaaaaaaaaaagauucaauguucauugu

SEQ ID NO: 31571 - RNA, 64 nt, hsa
agccugggcgacagagcgagacuccgucucaaaaaaaaaaaaaaaagauucaauguucauuguu

SEQ ID NO: 31572 - RNA, 64 nt, hsa
gccugggcgacagagcgagacuccgucucaaaaaaaaaaaaaaaagauucaauguucauuguua

SEQ ID NO: 31573 - RNA, 64 nt, hsa
ccugggcgacagagcgagacuccgucucaaaaaaaaaaaaaaaagauucaauguucauuguuau

SEQ ID NO: 31574 - RNA, 64 nt, hsa
cugggcgacagagcgagacuccgucucaaaaaaaaaaaaaaaagauucaauguucauuguuauu

SEQ ID NO: 31575 - RNA, 64 nt, hsa
ugggcgacagagcgagacuccgucucaaaaaaaaaaaaaaaagauucaauguucauuguuauuu

SEQ ID NO: 31576 - RNA, 64 nt, hsa
aauauuuucacaaaggguuaucugauaaccaaaaaaaaaaaagacauuucaucuaagccacuua

SEQ ID NO: 31577 - RNA, 64 nt, hsa
aaauauuuucacaaaggguuaucugauaaccaaaaaaaaaaaagacauuucaucuaagccacuu

SEQ ID NO: 31578 - RNA, 64 nt, hsa
aaaauauuuucacaaaggguuaucugauaaccaaaaaaaaaaaagacauuucaucuaagccacu

SEQ ID NO: 31579 - RNA, 64 nt, hsa
gaaaauauuuucacaaaggguuaucugauaaccaaaaaaaaaaaagacauuucaucuaagccac

SEQ ID NO: 31580 - RNA, 64 nt, hsa
ggaaaauauuuucacaaaggguuaucugauaaccaaaaaaaaaaaagacauuucaucuaagcca

SEQ ID NO: 31581 - RNA, 64 nt, hsa
cagccugggcaacagagcaagacuccgucuccaaaaaaaaaagaauuccuggggccugcccagu

SEQ ID NO: 31582 - RNA, 64 nt, hsa
ccagccugggcaacagagcaagacuccgucuccaaaaaaaaaagaauuccuggggccugcccag

SEQ ID NO: 31583 - RNA, 64 nt, hsa
uccagccugggcaacagagcaagacuccgucuccaaaaaaaaaaaaaaaaaaaaagaauuccug

SEQ ID NO: 31584 - RNA, 64 nt, hsa
gcaaacagguggauguguaaaaauggaauaaaaaaaaaaaaagaguccucuuaaucguuuacuu

SEQ ID NO: 31585 - RNA, 64 nt, hsa
ggcaaacagguggauguguaaaaauggaauaaaaaaaaaaaaagaguccucuuaaucguuuacu

SEQ ID NO: 31586 - RNA, 64 nt, hsa
uggcaaacagguggauguguaaaaauggaauaaaaaaaaaaaaagaguccucuuaaucguuuac

SEQ ID NO: 31587 - RNA, 64 nt, hsa
auggcaaacagguggauguguaaaaauggaauaaaaaaaaaaaaagaguccucuuaaucguuua

SEQ ID NO: 31588 - RNA, 64 nt, hsa
cauggcaaacagguggauguguaaaaauggaauaaaaaaaaaaaaagaguccucuuaaucguuu

SEQ ID NO: 31589 - RNA, 64 nt, hsa
ucauggcaaacagguggauguguaaaaauggaauaaaaaaaaaaaaagaguccucuuaaucguu

SEQ ID NO: 31590 - RNA, 64 nt, hsa
agccaaacuccgucaaaaaaaaacaaaacaaaacaaaaaaaagacaugggagagaugguguuuu

SEQ ID NO: 31591 - RNA, 64 nt, hsa
acuccagcuggagugacagagccaaacuccgucaaaaaaaaacaaaacaaaacaaaaaaaagac

SEQ ID NO: 31592 - RNA, 64 nt, hsa
cacuccagcuggagugacagagccaaacuccgucaaaaaaaaacaaaacaaaacaaaaaaaaga

SEQ ID NO: 31593 - RNA, 64 nt, hsa
ccaagcuuauaguuaggaccuuugcauuugauaaaaaaaaaauauaguauuuucuguuguccag

SEQ ID NO: 31594 - RNA, 64 nt, hsa
accaagcuuauaguuaggaccuuugcauuugauaaaaaaaaaauauaguauuuucuguugucca

SEQ ID NO: 31595 - RNA, 64 nt, hsa
uaccaagcuuauaguuaggaccuuugcauuugauaaaaaaaaaauauaguauuuucuguugucc

SEQ ID NO: 31596 - RNA, 64 nt, hsa
aguuuugcagcacaaugguguugcuuuaauggaaaaaaaaaacaguaaaagugaaauauuacug

SEQ ID NO: 31597 - RNA, 64 nt, hsa
uaguuuugcagcacaaugguguugcuuuaauggaaaaaaaaaacaguaaaagugaaauauuacu

SEQ ID NO: 31598 - RNA, 64 nt, hsa
uuaguuuugcagcacaaugguguugcuuuaauggaaaaaaaaaacaguaaaagugaaauauuac

SEQ ID NO: 31599 - RNA, 64 nt, hsa
ugaaaugugucucuacuuacaaaaaaaaaaaaaaaaaaaaaagccaggcaugguggugggcuac

SEQ ID NO: 31600 - RNA, 64 nt, hsa
gugaaaugugucucuacuuacaaaaaaaaaaaaaaaaaaaaaagccaggcaugguggugggcua

SEQ ID NO: 31601 - RNA, 64 nt, hsa
agugaaaugugucucuacuuacaaaaaaaaaaaaaaaaaaaaaagccaggcaugguggugggcu

SEQ ID NO: 31602 - RNA, 64 nt, hsa
cagugaaaugugucucuacuuacaaaaaaaaaaaaaaaaaaaaaagccaggcaugguggugggc

SEQ ID NO: 31603 - RNA, 64 nt, hsa
acagugaaaugugucucuacuuacaaaaaaaaaaaaaaaaaaaaaagccaggcauggugguggg

SEQ ID NO: 31604 - RNA, 64 nt, hsa
cacagugaaaugugucucuacuuacaaaaaaaaaaaaaaaaaaaaaagccaggcaugguggugg

SEQ ID NO: 31605 - RNA, 64 nt, hsa
acacagugaaaugugucucuacuuacaaaaaaaaaaaaaaaaaaaaaagccaggcaugguggug

SEQ ID NO: 31606 - RNA, 64 nt, hsa
aacacagugaaaugugucucuacuuacaaaaaaaaaaaaaaaaaaaaaagccaggcaugguggu

SEQ ID NO: 31607 - RNA, 64 nt, hsa
caacacagugaaaugugucucuacuuacaaaaaaaaaaaaaaaaaaaaaagccaggcauggugg

SEQ ID NO: 31608 - RNA, 64 nt, hsa
ccaacacagugaaaugugucucuacuuacaaaaaaaaaaaaaaaaaaaaaagccaggcauggug

SEQ ID NO: 31609 - RNA, 64 nt, hsa
gccaacacagugaaaugugucucuacuuacaaaaaaaaaaaaaaaaaaaaaagccaggcauggu

SEQ ID NO: 31610 - RNA, 64 nt, hsa
ggccaacacagugaaaugugucucuacuuacaaaaaaaaaaaaaaaaaaaaaagccaggcaugg

SEQ ID NO: 31611 - RNA, 64 nt, hsa
uggccaacacagugaaaugugucucuacuuacaaaaaaaaaaaaaaaaaaaaaagccaggcaug

SEQ ID NO: 31612 - RNA, 64 nt, hsa
cuggccaacacagugaaaugugucucuacuuacaaaaaaaaaaaaaaaaaaaaaagccaggcau

SEQ ID NO: 31613 - RNA, 64 nt, hsa
ccuggccaacacagugaaaugugucucuacuuacaaaaaaaaaaaaaaaaaaaaaagccaggca

SEQ ID NO: 31614 - RNA, 64 nt, hsa
gggugacagagcgugagacuccgucucaaaaaaaaaaaaaaagaaagagccuguacccgcgacu

SEQ ID NO: 31615 - RNA, 64 nt, hsa
ugggugacagagcgugagacuccgucucaaaaaaaaaaaaaaagaaagagccuguacccgcgac

SEQ ID NO: 31616 - RNA, 64 nt, hsa
cugggugacagagcgugagacuccgucucaaaaaaaaaaaaaaagaaagagccuguacccgcga

SEQ ID NO: 31617 - RNA, 64 nt, hsa
ccugggugacagagcgugagacuccgucucaaaaaaaaaaaaaaagaaagagccuguacccgcg

SEQ ID NO: 31618 - RNA, 64 nt, hsa
gccugggugacagagcgugagacuccgucucaaaaaaaaaaaaaaagaaagagccuguacccgc

SEQ ID NO: 31619 - RNA, 64 nt, hsa
agccugggugacagagcgugagacuccgucucaaaaaaaaaaaaaaagaaagagccuguacccg

SEQ ID NO: 31620 - RNA, 64 nt, hsa
cagccugggugacagagcgugagacuccgucucaaaaaaaaaaaaaaagaaagagccuguaccc

SEQ ID NO: 31621 - RNA, 64 nt, hsa
ccagccugggugacagagcgugagacuccgucucaaaaaaaaaaaaaaagaaagagccuguacc

SEQ ID NO: 31622 - RNA, 55 nt, hsa
acaagaccccugaggcaugacaagaaaaaaaaagaagaccaaagaccucaaacac

SEQ ID NO: 31623 - RNA, 54 nt, hsa
acaagaccccugaggcaugacaagaaaaaaaaagaagaccaaagaccucaaaca

SEQ ID NO: 31624 - RNA, 64 nt, hsa
gccugggcgacagagcaagauuccguucccaagaaaaaaaaauuguucaacaauaagggcaaag

SEQ ID NO: 31625 - RNA, 64 nt, hsa
agccugggcgacagagcaagauuccguucccaagaaaaaaaaauuguucaacaauaagggcaaa

SEQ ID NO: 31626 - RNA, 64 nt, hsa
acugaaagggcugucaaccccagaaggccgacacaaaaaaaaugguaugugaagaugcaccguc

SEQ ID NO: 31627 - RNA, 64 nt, hsa
aaaaccaaagugcuauuuuuaaaagcaucauuuaaaaaaaaaugacaugccugaacaacuuuuc

SEQ ID NO: 31628 - RNA, 64 nt, hsa
uaaaaccaaagugcuauuuuuaaaagcaucauuuaaaaaaaaaugacaugccugaacaacuuuu

SEQ ID NO: 31629 - RNA, 64 nt, hsa
auuuaaaaaguuuucugaaaaaacuuuugcaauaaaaaaaaauaaauugcccaucaauaaguuu

SEQ ID NO: 31630 - RNA, 64 nt, hsa
cauuuaaaaaguuuucugaaaaaacuuuugcaauaaaaaaaaauaaauugcccaucaauaaguu

SEQ ID NO: 31631 - RNA, 64 nt, hsa
aagguuuuuguccuuuccuucacugauuugcuuuaaaaaaaauaaaagauaaugauuuauugca

SEQ ID NO: 31632 - RNA, 64 nt, hsa
cuggucagacuuuuuuuguuagauucucucauuuaaaaaaaauacuguuuguuuaaagcaugca

SEQ ID NO: 31633 - RNA, 64 nt, hsa
uccagccugggugacagagugagacucugucucaaaaaaaaauuaaauaaauuauuauaaccuu

SEQ ID NO: 31634 - RNA, 64 nt, hsa
cuccagccugggugacagagugagacucugucucaaaaaaaaauuaaauaaauuauuauaaccu

SEQ ID NO: 31635 - RNA, 64 nt, hsa
gccucaaaaaaaaauuaaaauaaauuuaaauacaaaaaaaaauagccagguguggggugcaugc

SEQ ID NO: 31636 - RNA, 64 nt, hsa
ugccucaaaaaaaaauuaaaauaaauuuaaauacaaaaaaaaauagccagguguggggugcaug

SEQ ID NO: 31637 - RNA, 64 nt, hsa
uccagccugggcaacagagcaagacucugccucaaaaaaaaauuaaaauaaauuuaaauacaaa

SEQ ID NO: 31638 - RNA, 64 nt, hsa
cuccagccugggcaacagagcaagacucugccucaaaaaaaaauuaaaauaaauuuaaauacaa

SEQ ID NO: 31639 - RNA, 64 nt, hsa
ggauguauuuauauaauuauuuguuaaauuguaaaaaaaaaaguguaaaauauguauauaucca

SEQ ID NO: 31640 - RNA, 64 nt, hsa
aggauguauuuauauaauuauuuguuaaauuguaaaaaaaaaaguguaaaauauguauauaucc

SEQ ID NO: 31641 - RNA, 64 nt, hsa
gaggauguauuuauauaauuauuuguuaaauuguaaaaaaaaaaguguaaaauauguauauauc

SEQ ID NO: 31642 - RNA, 64 nt, hsa
auuauuuguauuuugugaauuacgcugcaaaaaaaaaaaaaauguuggcuacccaacauucauu

SEQ ID NO: 31643 - RNA, 64 nt, hsa
cauuauuuguauuuugugaauuacgcugcaaaaaaaaaaaaaauguuggcuacccaacauucau

SEQ ID NO: 31644 - RNA, 64 nt, hsa
ucauuauuuguauuuugugaauuacgcugcaaaaaaaaaaaaaauguuggcuacccaacauuca

SEQ ID NO: 31645 - RNA, 64 nt, hsa
aucauuauuuguauuuugugaauuacgcugcaaaaaaaaaaaaaauguuggcuacccaacauuc

SEQ ID NO: 31646 - RNA, 64 nt, hsa
caucauuauuuguauuuugugaauuacgcugcaaaaaaaaaaaaaauguuggcuacccaacauu

SEQ ID NO: 31647 - RNA, 64 nt, hsa
ucaucauuauuuguauuuugugaauuacgcugcaaaaaaaaaaaaaauguuggcuacccaacau

SEQ ID NO: 31648 - RNA, 64 nt, hsa
aucaucauuauuuguauuuugugaauuacgcugcaaaaaaaaaaaaaauguuggcuacccaaca

SEQ ID NO: 31649 - RNA, 64 nt, hsa
uguacuggaagugcuaucuaaugcagugauaccaaaaaaaaaggaaauaaaaugcacauaaauu

SEQ ID NO: 31650 - RNA, 64 nt, hsa
uuguacuggaagugcuaucuaaugcagugauaccaaaaaaaaaggaaauaaaaugcacauaaau

SEQ ID NO: 31651 - RNA, 64 nt, hsa
uuaaaaguuauaaaucaaaauaacagauuaucugaaaaaaaaucuauccuguacgugugaagau

SEQ ID NO: 31652 - RNA, 64 nt, hsa
uaaaaucagcaaaggcaguguuucaaaaagugcaaaaaaaaagauucuguuauaaagugauuuu

SEQ ID NO: 31653 - RNA, 64 nt, hsa
guaaaaucagcaaaggcaguguuucaaaaagugcaaaaaaaaagauucuguuauaaagugauuu

SEQ ID NO: 31654 - RNA, 64 nt, hsa
auuuaagaauaagacacacaaaacucuauuaaaaaaaaaaaagaaauaaaccucuaacucgguc

SEQ ID NO: 31655 - RNA, 64 nt, hsa
aauuuaagaauaagacacacaaaacucuauuaaaaaaaaaaaagaaauaaaccucuaacucggu

SEQ ID NO: 31656 - RNA, 64 nt, hsa
aaauuuaagaauaagacacacaaaacucuauuaaaaaaaaaaaagaaauaaaccucuaacucgg

SEQ ID NO: 31657 - RNA, 64 nt, hsa
uaaauuuaagaauaagacacacaaaacucuauuaaaaaaaaaaaagaaauaaaccucuaacucg

SEQ ID NO: 31658 - RNA, 64 nt, hsa
uuaaauuuaagaauaagacacacaaaacucuauuaaaaaaaaaaaagaaauaaaccucuaacuc

SEQ ID NO: 31659 - RNA, 64 nt, hsa
caagguuaguaaauaaaauaagugacauaaaaaaaaaaaaaacuaaacuacuuguuguguugaa

SEQ ID NO: 31660 - RNA, 64 nt, hsa
ucaagguuaguaaauaaaauaagugacauaaaaaaaaaaaaaacuaaacuacuuguuguguuga

SEQ ID NO: 31661 - RNA, 64 nt, hsa
gucaagguuaguaaauaaaauaagugacauaaaaaaaaaaaaaacuaaacuacuuguuguguug

SEQ ID NO: 31662 - RNA, 64 nt, hsa
ugucaagguuaguaaauaaaauaagugacauaaaaaaaaaaaaaacuaaacuacuuguuguguu

SEQ ID NO: 31663 - RNA, 64 nt, hsa
cugucaagguuaguaaauaaaauaagugacauaaaaaaaaaaaaaacuaaacuacuuguugugu

SEQ ID NO: 31664 - RNA, 64 nt, hsa
ccugucaagguuaguaaauaaaauaagugacauaaaaaaaaaaaaaacuaaacuacuuguugug

SEQ ID NO: 31665 - RNA, 64 nt, hsa
cccugucaagguuaguaaauaaaauaagugacauaaaaaaaaaaaaaacuaaacuacuuguugu

SEQ ID NO: 31666 - RNA, 64 nt, hsa
cuucgaaugcauauuuaagaguuaacagaaugaaaaaaaaaagucuuguuggauaauaguguuu

SEQ ID NO: 31667 - RNA, 64 nt, hsa
ccuucgaaugcauauuuaagaguuaacagaaugaaaaaaaaaagucuuguuggauaauaguguu

SEQ ID NO: 31668 - RNA, 64 nt, hsa
gccuucgaaugcauauuuaagaguuaacagaaugaaaaaaaaaagucuuguuggauaauagugu

SEQ ID NO: 31669 - RNA, 64 nt, hsa
gccaauuuuucaaugaaaugaccuaaaaacaacaaaaaaaaauaaccuauacgguaguugcuuu

SEQ ID NO: 31670 - RNA, 64 nt, hsa
ugccaauuuuucaaugaaaugaccuaaaaacaacaaaaaaaaauaaccuauacgguaguugcuu

SEQ ID NO: 31671 - RNA, 64 nt, hsa
uguuuguauaugcaaaacugcuagcuugauuuuaaaaaaaaacaaaucuuuaaaaucugcugca

SEQ ID NO: 31672 - RNA, 64 nt, hsa
auguuuguauaugcaaaacugcuagcuugauuuuaaaaaaaaacaaaucuuuaaaaucugcugc

SEQ ID NO: 31673 - RNA, 64 nt, hsa
uuuagucuguuauuuuguuucuuuuuauacaaagaaaaaaaauucagcuuucauguuucugauu

SEQ ID NO: 31674 - RNA, 60 nt, hsa
caucuccagcaguggccugaagaggaagagaaaaaaaacaaaaaacagaaaccaaucggu

SEQ ID NO: 31675 - RNA, 64 nt, hsa
cuacucucuuauacuggcugcuuuuauaauaggaaaaaaaaauaugcauuugcuuaguuuauuu

SEQ ID NO: 31676 - RNA, 64 nt, hsa
ccuacucucuuauacuggcugcuuuuauaauaggaaaaaaaaauaugcauuugcuuaguuuauu

SEQ ID NO: 31677 - RNA, 64 nt, hsa
cugucucuccuuccucccuuccuuuacaguuuaaaaaaaaaaucuaaaaauaguuaagcacugu

SEQ ID NO: 31678 - RNA, 64 nt, hsa
ucugucucuccuuccucccuuccuuuacaguuuaaaaaaaaaaucuaaaaauaguuaagcacug

SEQ ID NO: 31679 - RNA, 64 nt, hsa
uucugucucuccuuccucccuuccuuuacaguuuaaaaaaaaaaucuaaaaauaguuaagcacu

SEQ ID NO: 31680 - RNA, 64 nt, hsa
gcagaaauaaaaauacugaauaucuuugcucuuaaaaaaaaaguaacacuauagauuuguuuuu

SEQ ID NO: 31681 - RNA, 64 nt, hsa
ggcagaaauaaaaauacugaauaucuuugcucuuaaaaaaaaaguaacacuauagauuuguuuu

SEQ ID NO: 31682 - RNA, 64 nt, hsa
uagaguggauaguguguuaaaacuguguacuuuaaaaaaaaauucaaccuuuacaucuagaaua

SEQ ID NO: 31683 - RNA, 64 nt, hsa
auagaguggauaguguguuaaaacuguguacuuuaaaaaaaaauucaaccuuuacaucuagaau

SEQ ID NO: 31684 - RNA, 64 nt, hsa
ugggccaguaggagggauuuuuuuuuuuuuaaugaaaaaaaauuucuauucauagcuuauccuu

SEQ ID NO: 31685 - RNA, 64 nt, hsa
uaagaaaaaaaaaaaagaaaaaaagauuguuuaaaaaaaaaaggaauccauaccaugaugcguu

SEQ ID NO: 31686 - RNA, 64 nt, hsa
uuaagaaaaaaaaaaaagaaaaaaagauuguuuaaaaaaaaaaggaauccauaccaugaugcgu

SEQ ID NO: 31687 - RNA, 64 nt, hsa
uuuaagaaaaaaaaaaaagaaaaaaagauuguuuaaaaaaaaaaggaauccauaccaugaugcg

SEQ ID NO: 31688 - RNA, 64 nt, hsa
ugcuguaccgagguguuuuuuacauuuaagaaaaaaaaaaaagaaaaaaagauuguuuaaaaaa

SEQ ID NO: 31689 - RNA, 64 nt, hsa
cugcuguaccgagguguuuuuuacauuuaagaaaaaaaaaaaagaaaaaaagauuguuuaaaaa

SEQ ID NO: 31690 - RNA, 64 nt, hsa
ucugcuguaccgagguguuuuuuacauuuaagaaaaaaaaaaaagaaaaaaagauuguuuaaaa

SEQ ID NO: 31691 - RNA, 64 nt, hsa
cucugcuguaccgagguguuuuuuacauuuaagaaaaaaaaaaaagaaaaaaagauuguuuaaa

SEQ ID NO: 31692 - RNA, 64 nt, hsa
ucucugcuguaccgagguguuuuuuacauuuaagaaaaaaaaaaaagaaaaaaagauuguuuaa

SEQ ID NO: 31693 - RNA, 64 nt, hsa
aaaguugaaaaaauaucauuugacuuuuuauagaaaaaaaaaggaaaaaauaauugagaaagug

SEQ ID NO: 31694 - RNA, 64 nt, hsa
aaaaguugaaaaaauaucauuugacuuuuuauagaaaaaaaaaggaaaaaauaauugagaaagu

SEQ ID NO: 31695 - RNA, 64 nt, hsa
uuacugccaaacucacuccuuuuuagaaaaaacaaaaaaaaagggccagaaagucauuccuucc

SEQ ID NO: 31696 - RNA, 64 nt, hsa
guuacugccaaacucacuccuuuuuagaaaaaacaaaaaaaaagggccagaaagucauuccuuc

SEQ ID NO: 31697 - RNA, 64 nt, hsa
aaaugauugauauucaagcaaguucucuaggaaaaaaaaaaacuucccaacucagauuucugug

SEQ ID NO: 31698 - RNA, 64 nt, hsa
gaaaugauugauauucaagcaaguucucuaggaaaaaaaaaaacuucccaacucagauuucugu

SEQ ID NO: 31699 - RNA, 64 nt, hsa
ggaaaugauugauauucaagcaaguucucuaggaaaaaaaaaaacuucccaacucagauuucug

SEQ ID NO: 31700 - RNA, 64 nt, hsa
gggaaaugauugauauucaagcaaguucucuaggaaaaaaaaaaacuucccaacucagauuucu

SEQ ID NO: 31701 - RNA, 64 nt, hsa
aauacuguuuguacuguuuguauaaaaaauagaaaaaaaaaagaaaagaaaaaaggcauaaauc

SEQ ID NO: 31702 - RNA, 64 nt, hsa
caauacuguuuguacuguuuguauaaaaaauagaaaaaaaaaagaaaagaaaaaaggcauaaau

SEQ ID NO: 31703 - RNA, 64 nt, hsa
gcaauacuguuuguacuguuuguauaaaaaauagaaaaaaaaaagaaaagaaaaaaggcauaaa

SEQ ID NO: 31704 - RNA, 64 nt, hsa
aucuuuugcagucucucugggaucaguaaaagaaaaaaaaaauaaugugcuuaagaagugggac

SEQ ID NO: 31705 - RNA, 64 nt, hsa
uaucuuuugcagucucucugggaucaguaaaagaaaaaaaaaauaaugugcuuaagaaguggga

SEQ ID NO: 31706 - RNA, 64 nt, hsa
uuaucuuuugcagucucucugggaucaguaaaagaaaaaaaaaauaaugugcuuaagaaguggg

SEQ ID NO: 31707 - RNA, 64 nt, hsa
cauacccaaaguagccagcuggucuucagcaaaaaaaaaaaagcuaaugucuucuaauauccug

SEQ ID NO: 31708 - RNA, 64 nt, hsa
acauacccaaaguagccagcuggucuucagcaaaaaaaaaaaagcuaaugucuucuaauauccu

SEQ ID NO: 31709 - RNA, 64 nt, hsa
gacauacccaaaguagccagcuggucuucagcaaaaaaaaaaaagcuaaugucuucuaauaucc

SEQ ID NO: 31710 - RNA, 64 nt, hsa
ugacauacccaaaguagccagcuggucuucagcaaaaaaaaaaaagcuaaugucuucuaauauc

SEQ ID NO: 31711 - RNA, 64 nt, hsa
uugacauacccaaaguagccagcuggucuucagcaaaaaaaaaaaagcuaaugucuucuaauau

SEQ ID NO: 31712 - RNA, 64 nt, hsa
ugggcaacauagcaagacccugucucuaaagaaaaaaaaaaaguaaaagaaaaauaaagcacgu

SEQ ID NO: 31713 - RNA, 64 nt, hsa
cugggcaacauagcaagacccugucucuaaagaaaaaaaaaaaguaaaagaaaaauaaagcacg

SEQ ID NO: 31714 - RNA, 64 nt, hsa
ccugggcaacauagcaagacccugucucuaaagaaaaaaaaaaaguaaaagaaaaauaaagcac

SEQ ID NO: 31715 - RNA, 64 nt, hsa
gccugggcaacauagcaagacccugucucuaaagaaaaaaaaaaaguaaaagaaaaauaaagca

SEQ ID NO: 31716 - RNA, 64 nt, hsa
acguauguaauccucacucuuuggacagaaaaaaaaaaaaaagucuuucuugcagacaagucac

SEQ ID NO: 31717 - RNA, 64 nt, hsa
uacguauguaauccucacucuuuggacagaaaaaaaaaaaaaagucuuucuugcagacaaguca

SEQ ID NO: 31718 - RNA, 64 nt, hsa
cuacguauguaauccucacucuuuggacagaaaaaaaaaaaaaagucuuucuugcagacaaguc

SEQ ID NO: 31719 - RNA, 64 nt, hsa
acuacguauguaauccucacucuuuggacagaaaaaaaaaaaaaagucuuucuugcagacaagu

SEQ ID NO: 31720 - RNA, 64 nt, hsa
gacuacguauguaauccucacucuuuggacagaaaaaaaaaaaaaagucuuucuugcagacaag

SEQ ID NO: 31721 - RNA, 64 nt, hsa
agacuacguauguaauccucacucuuuggacagaaaaaaaaaaaaaagucuuucuugcagacaa

SEQ ID NO: 31722 - RNA, 64 nt, hsa
gagacuacguauguaauccucacucuuuggacagaaaaaaaaaaaaaagucuuucuugcagaca

SEQ ID NO: 31723 - RNA, 64 nt, hsa
acaauuccagugggcuuuuuuuuccucucaaaaaaaaaaaaagaaaaagaaaaagaggaagaag

SEQ ID NO: 31724 - RNA, 64 nt, hsa
gacaauuccagugggcuuuuuuuuccucucaaaaaaaaaaaaagaaaaagaaaaagaggaagaa

SEQ ID NO: 31725 - RNA, 64 nt, hsa
agacaauuccagugggcuuuuuuuuccucucaaaaaaaaaaaaagaaaaagaaaaagaggaaga

SEQ ID NO: 31726 - RNA, 64 nt, hsa
uagacaauuccagugggcuuuuuuuuccucucaaaaaaaaaaaaagaaaaagaaaaagaggaag

SEQ ID NO: 31727 - RNA, 64 nt, hsa
uuagacaauuccagugggcuuuuuuuuccucucaaaaaaaaaaaaagaaaaagaaaaagaggaa

SEQ ID NO: 31728 - RNA, 64 nt, hsa
uuuagacaauuccagugggcuuuuuuuuccucucaaaaaaaaaaaaagaaaaagaaaaagagga

SEQ ID NO: 31729 - RNA, 64 nt, hsa
ugccgacuuauuuuuauaggaagccaauuaaaaaaaaaaaaaguuuucuuauaguauuggaacu

SEQ ID NO: 31730 - RNA, 64 nt, hsa
uugccgacuuauuuuuauaggaagccaauuaaaaaaaaaaaaaguuuucuuauaguauuggaac

SEQ ID NO: 31731 - RNA, 64 nt, hsa
uuugccgacuuauuuuuauaggaagccaauuaaaaaaaaaaaaaguuuucuuauaguauuggaa

SEQ ID NO: 31732 - RNA, 64 nt, hsa
auuugccgacuuauuuuuauaggaagccaauuaaaaaaaaaaaaaguuuucuuauaguauugga

SEQ ID NO: 31733 - RNA, 64 nt, hsa
cauuugccgacuuauuuuuauaggaagccaauuaaaaaaaaaaaaaguuuucuuauaguauugg

SEQ ID NO: 31734 - RNA, 64 nt, hsa
ucauuugccgacuuauuuuuauaggaagccaauuaaaaaaaaaaaaaguuuucuuauaguauug

SEQ ID NO: 31735 - RNA, 64 nt, hsa
ccuucuucaggggaagacuguggucaaguuaaaaaaaaaaaacaauauuaaacaacaugaaacu

SEQ ID NO: 31736 - RNA, 64 nt, hsa
cccuucuucaggggaagacuguggucaaguuaaaaaaaaaaaacaauauuaaacaacaugaaac

SEQ ID NO: 31737 - RNA, 64 nt, hsa
gcccuucuucaggggaagacuguggucaaguuaaaaaaaaaaaacaauauuaaacaacaugaaa

SEQ ID NO: 31738 - RNA, 64 nt, hsa
ugcccuucuucaggggaagacuguggucaaguuaaaaaaaaaaaacaauauuaaacaacaugaa

SEQ ID NO: 31739 - RNA, 64 nt, hsa
augcccuucuucaggggaagacuguggucaaguuaaaaaaaaaaaacaauauuaaacaacauga

SEQ ID NO: 31740 - RNA, 64 nt, hsa
aagggugcuuauucuuuaacaaagagaaucuaaaaaaaaaaacaaaaaacuguugucuaauaua

SEQ ID NO: 31741 - RNA, 64 nt, hsa
gaagggugcuuauucuuuaacaaagagaaucuaaaaaaaaaaacaaaaaacuguugucuaauau

SEQ ID NO: 31742 - RNA, 64 nt, hsa
ggaagggugcuuauucuuuaacaaagagaaucuaaaaaaaaaaacaaaaaacuguugucuaaua

SEQ ID NO: 31743 - RNA, 64 nt, hsa
cggaagggugcuuauucuuuaacaaagagaaucuaaaaaaaaaaacaaaaaacuguugucuaau

SEQ ID NO: 31744 - RNA, 64 nt, hsa
ggcaaguuaccaaacacagugagccgggacucuaaaaaaaaauuguaauucaugauaggcuucg

SEQ ID NO: 31745 - RNA, 64 nt, hsa
uggcaaguuaccaaacacagugagccgggacucuaaaaaaaaauuguaauucaugauaggcuuc

SEQ ID NO: 31746 - RNA, 64 nt, hsa
auguugcugccucauugaccugggaaaaaugaaaaaaaaaaauaaagcaaaugguaagacccuu

SEQ ID NO: 31747 - RNA, 64 nt, hsa
aauguugcugccucauugaccugggaaaaaugaaaaaaaaaaauaaagcaaaugguaagacccu

SEQ ID NO: 31748 - RNA, 64 nt, hsa
uaauguugcugccucauugaccugggaaaaaugaaaaaaaaaaauaaagcaaaugguaagaccc

SEQ ID NO: 31749 - RNA, 64 nt, hsa
uuaauguugcugccucauugaccugggaaaaaugaaaaaaaaaaauaaagcaaaugguaagacc

SEQ ID NO: 31750 - RNA, 64 nt, hsa
aguucaguaaaacccucugaugaugcaaaaaaaaaaaaaaaaguauuaaguuucacaagcuguu

SEQ ID NO: 31751 - RNA, 64 nt, hsa
aaguucaguaaaacccucugaugaugcaaaaaaaaaaaaaaaaguauuaaguuucacaagcugu

SEQ ID NO: 31752 - RNA, 64 nt, hsa
uaaguucaguaaaacccucugaugaugcaaaaaaaaaaaaaaaaguauuaaguuucacaagcug

SEQ ID NO: 31753 - RNA, 64 nt, hsa
guaaguucaguaaaacccucugaugaugcaaaaaaaaaaaaaaaaguauuaaguuucacaagcu

SEQ ID NO: 31754 - RNA, 64 nt, hsa
uguaaguucaguaaaacccucugaugaugcaaaaaaaaaaaaaaaaguauuaaguuucacaagc

SEQ ID NO: 31755 - RNA, 64 nt, hsa
uuguaaguucaguaaaacccucugaugaugcaaaaaaaaaaaaaaaaguauuaaguuucacaag

SEQ ID NO: 31756 - RNA, 64 nt, hsa
guuguaaguucaguaaaacccucugaugaugcaaaaaaaaaaaaaaaaguauuaaguuucacaa

SEQ ID NO: 31757 - RNA, 64 nt, hsa
gguuguaaguucaguaaaacccucugaugaugcaaaaaaaaaaaaaaaaguauuaaguuucaca

SEQ ID NO: 31758 - RNA, 64 nt, hsa
cgguuguaaguucaguaaaacccucugaugaugcaaaaaaaaaaaaaaaaguauuaaguuucac

SEQ ID NO: 31759 - RNA, 64 nt, hsa
aaaucugugucuacuuuaaaaaacuggaaauggaaaaaaaaauaaaucuuugccaaauccuuca

SEQ ID NO: 31760 - RNA, 64 nt, hsa
caaaucugugucuacuuuaaaaaacuggaaauggaaaaaaaaauaaaucuuugccaaauccuuc

SEQ ID NO: 31761 - RNA, 64 nt, hsa
gcugagcuggcagagagcuccaccauuuggugcuaaaaaaaaaaacguccugagguucaugacc

SEQ ID NO: 31762 - RNA, 64 nt, hsa
cugagcuggcagagagcuccaccauuuggugcuaaaaaaaaaaacguccugagguucaugacca

SEQ ID NO: 31763 - RNA, 64 nt, hsa
ugagcuggcagagagcuccaccauuuggugcuaaaaaaaaaaacguccugagguucaugaccac

SEQ ID NO: 31764 - RNA, 64 nt, hsa
gagcuggcagagagcuccaccauuuggugcuaaaaaaaaaaacguccugagguucaugaccacc

SEQ ID NO: 31765 - RNA, 64 nt, hsa
ggauuuucaccaaaauaaugcuuuugaaaaaaagaaaaaaaaaacggauauauugagaaucaaa

SEQ ID NO: 31766 - RNA, 64 nt, hsa
gauuuucaccaaaauaaugcuuuugaaaaaaagaaaaaaaaaacggauauauugagaaucaaag

SEQ ID NO: 31767 - RNA, 64 nt, hsa
auuuucaccaaaauaaugcuuuugaaaaaaagaaaaaaaaaacggauauauugagaaucaaagu

SEQ ID NO: 31768 - RNA, 64 nt, hsa
uccucucuacauuuaagaguagcaauagaacaauaaaaaaaaauacgucuuucaaauuaauugc

SEQ ID NO: 31769 - RNA, 64 nt, hsa
ccucucuacauuuaagaguagcaauagaacaauaaaaaaaaauacgucuuucaaauuaauugca

SEQ ID NO: 31770 - RNA, 64 nt, hsa
uggagucuuaugauggauuuuuaacuucccguggaaaaaaaaauaaaggcuguaucuaaaauau

SEQ ID NO: 31771 - RNA, 64 nt, hsa
ggagucuuaugauggauuuuuaacuucccguggaaaaaaaaauaaaggcuguaucuaaaauauc

SEQ ID NO: 31772 - RNA, 64 nt, hsa
caaccuggugaaacccugucucuacuaaaaauacaaaaaaaauuagcugagcgugguggcgggc

SEQ ID NO: 31773 - RNA, 64 nt, hsa
uuuaucuuccugcaaacaaggguuaccugaaaagaaaaaaaaagucaacauugucaagcuguuu

SEQ ID NO: 31774 - RNA, 64 nt, hsa
uuaucuuccugcaaacaaggguuaccugaaaagaaaaaaaaagucaacauugucaagcuguuug

SEQ ID NO: 31775 - RNA, 64 nt, hsa
guacuguaaagugaaaagggaugugcaaaaaaauaaaaaaaaacaacaaaaaaagcuaaccuuc

SEQ ID NO: 31776 - RNA, 64 nt, hsa
uacuguaaagugaaaagggaugugcaaaaaaauaaaaaaaaacaacaaaaaaagcuaaccuucu

SEQ ID NO: 31777 - RNA, 64 nt, hsa
uggauuacagaaaugaguuaauugucucugugauaaaaaaaaaaaaugaaauauuuucuuauug

SEQ ID NO: 31778 - RNA, 64 nt, hsa
ggauuacagaaaugaguuaauugucucugugauaaaaaaaaaaaaugaaauauuuucuuauuga

SEQ ID NO: 31779 - RNA, 64 nt, hsa
gauuacagaaaugaguuaauugucucugugauaaaaaaaaaaaaugaaauauuuucuuauugaa

SEQ ID NO: 31780 - RNA, 64 nt, hsa
auuacagaaaugaguuaauugucucugugauaaaaaaaaaaaaugaaauauuuucuuauugaau

SEQ ID NO: 31781 - RNA, 64 nt, hsa
uuacagaaaugaguuaauugucucugugauaaaaaaaaaaaaugaaauauuuucuuauugaauu

SEQ ID NO: 31782 - RNA, 64 nt, hsa
uaaucauugcauagugacugaaaagccuaagugcaaaaaaaaaaaaaaaagauguucuuguuuc

SEQ ID NO: 31783 - RNA, 64 nt, hsa
aaucauugcauagugacugaaaagccuaagugcaaaaaaaaaaaaaaaagauguucuuguuucu

SEQ ID NO: 31784 - RNA, 64 nt, hsa
aucauugcauagugacugaaaagccuaagugcaaaaaaaaaaaaaaaagauguucuuguuucug

SEQ ID NO: 31785 - RNA, 64 nt, hsa
ucauugcauagugacugaaaagccuaagugcaaaaaaaaaaaaaaaagauguucuuguuucuga

SEQ ID NO: 31786 - RNA, 64 nt, hsa
cauugcauagugacugaaaagccuaagugcaaaaaaaaaaaaaaaagauguucuuguuucugaa

SEQ ID NO: 31787 - RNA, 64 nt, hsa
auugcauagugacugaaaagccuaagugcaaaaaaaaaaaaaaaagauguucuuguuucugaac

SEQ ID NO: 31788 - RNA, 64 nt, hsa
uugcauagugacugaaaagccuaagugcaaaaaaaaaaaaaaaagauguucuuguuucugaacu

SEQ ID NO: 31789 - RNA, 64 nt, hsa
ugcauagugacugaaaagccuaagugcaaaaaaaaaaaaaaaagauguucuuguuucugaacuu

SEQ ID NO: 31790 - RNA, 64 nt, hsa
gcauagugacugaaaagccuaagugcaaaaaaaaaaaaaaaagauguucuuguuucugaacuuc

SEQ ID NO: 31791 - RNA, 64 nt, hsa
gauggacuuuucugauaaaucuuggcagacaucuaaaaaaaaaaccauauuuuucacaagaaaa

SEQ ID NO: 31792 - RNA, 64 nt, hsa
auggacuuuucugauaaaucuuggcagacaucuaaaaaaaaaaccauauuuuucacaagaaaau

SEQ ID NO: 31793 - RNA, 64 nt, hsa
uggacuuuucugauaaaucuuggcagacaucuaaaaaaaaaaccauauuuuucacaagaaaaug

SEQ ID NO: 31794 - RNA, 64 nt, hsa
ucaucgccguugaaaugaaaagagagacagagagaaaaaaaaaaagagaacccacaugaagcuc

SEQ ID NO: 31795 - RNA, 64 nt, hsa
caucgccguugaaaugaaaagagagacagagagaaaaaaaaaaagagaacccacaugaagcucu

SEQ ID NO: 31796 - RNA, 64 nt, hsa
aucgccguugaaaugaaaagagagacagagagaaaaaaaaaaagagaacccacaugaagcucug

SEQ ID NO: 31797 - RNA, 64 nt, hsa
ucgccguugaaaugaaaagagagacagagagaaaaaaaaaaagagaacccacaugaagcucuga

SEQ ID NO: 31798 - RNA, 64 nt, hsa
cucauuuguguggaugcgugaccaugggaaaaagaaaaaaaaaaagauccauuuuuuagguucu

SEQ ID NO: 31799 - RNA, 64 nt, hsa
ucauuuguguggaugcgugaccaugggaaaaagaaaaaaaaaaagauccauuuuuuagguucuu

SEQ ID NO: 31800 - RNA, 64 nt, hsa
cauuuguguggaugcgugaccaugggaaaaagaaaaaaaaaaagauccauuuuuuagguucuuu

SEQ ID NO: 31801 - RNA, 64 nt, hsa
auuuguguggaugcgugaccaugggaaaaagaaaaaaaaaaagauccauuuuuuagguucuuuu

SEQ ID NO: 31802 - RNA, 64 nt, hsa
auuacaacuuuguacugguuguaacuugcauuagaaaaaaaagagauauauacaccacaaagaa

SEQ ID NO: 31803 - RNA, 64 nt, hsa
guuuaaaaaaaugcaaaucauucuuuaccuuaagaaaaaaaaaauacccuuugcuuugugccuc

SEQ ID NO: 31804 - RNA, 64 nt, hsa
uuuaaaaaaaugcaaaucauucuuuaccuuaagaaaaaaaaaauacccuuugcuuugugccuca

SEQ ID NO: 31805 - RNA, 64 nt, hsa
uuaaaaaaaugcaaaucauucuuuaccuuaagaaaaaaaaaauacccuuugcuuugugccucaa

SEQ ID NO: 31806 - RNA, 64 nt, hsa
cuccagugugagcaacagaacgagacucugucucaaaaaaaaaaaaaaaaaggaagaaagagaa

SEQ ID NO: 31807 - RNA, 64 nt, hsa
uccagugugagcaacagaacgagacucugucucaaaaaaaaaaaaaaaaaggaagaaagagaag

SEQ ID NO: 31808 - RNA, 64 nt, hsa
ccagugugagcaacagaacgagacucugucucaaaaaaaaaaaaaaaaaggaagaaagagaaga

SEQ ID NO: 31809 - RNA, 64 nt, hsa
cagugugagcaacagaacgagacucugucucaaaaaaaaaaaaaaaaaggaagaaagagaagau

SEQ ID NO: 31810 - RNA, 64 nt, hsa
agugugagcaacagaacgagacucugucucaaaaaaaaaaaaaaaaaggaagaaagagaagaua

SEQ ID NO: 31811 - RNA, 64 nt, hsa
gugugagcaacagaacgagacucugucucaaaaaaaaaaaaaaaaaggaagaaagagaagauag

SEQ ID NO: 31812 - RNA, 64 nt, hsa
ugugagcaacagaacgagacucugucucaaaaaaaaaaaaaaaaaggaagaaagagaagauaga

SEQ ID NO: 31813 - RNA, 64 nt, hsa
gugagcaacagaacgagacucugucucaaaaaaaaaaaaaaaaaggaagaaagagaagauagag

SEQ ID NO: 31814 - RNA, 64 nt, hsa
ugagcaacagaacgagacucugucucaaaaaaaaaaaaaaaaaggaagaaagagaagauagaga

SEQ ID NO: 31815 - RNA, 64 nt, hsa
gagcaacagaacgagacucugucucaaaaaaaaaaaaaaaaaggaagaaagagaagauagagac

SEQ ID NO: 31816 - RNA, 64 nt, hsa
ggggaaaaugaagguuaggauuuaacagucauuuaaaaaaaaaauuuguuuugacggaugauug

SEQ ID NO: 31817 - RNA, 64 nt, hsa
gggaaaaugaagguuaggauuuaacagucauuuaaaaaaaaaauuuguuuugacggaugauugg

SEQ ID NO: 31818 - RNA, 64 nt, hsa
ggaaaaugaagguuaggauuuaacagucauuuaaaaaaaaaauuuguuuugacggaugauugga

SEQ ID NO: 31819 - RNA, 64 nt, hsa
caaaauuuugacaacgaugauguucaccagaaggaaaaaaaaaaaucaguuuuaugcacuuuau

SEQ ID NO: 31820 - RNA, 64 nt, hsa
aaaauuuugacaacgaugauguucaccagaaggaaaaaaaaaaaucaguuuuaugcacuuuauu

SEQ ID NO: 31821 - RNA, 64 nt, hsa
aaauuuugacaacgaugauguucaccagaaggaaaaaaaaaaaucaguuuuaugcacuuuauuu

SEQ ID NO: 31822 - RNA, 64 nt, hsa
aauuuugacaacgaugauguucaccagaaggaaaaaaaaaaaucaguuuuaugcacuuuauuuu

SEQ ID NO: 31823 - RNA, 64 nt, hsa
ugaguuuucagcaccaguagauuuguauuaaaagaaaaaaaaauggggccuuagcuucuggcuu

SEQ ID NO: 31824 - RNA, 64 nt, hsa
gaguuuucagcaccaguagauuuguauuaaaagaaaaaaaaauggggccuuagcuucuggcuuu

SEQ ID NO: 31825 - RNA, 64 nt, hsa
aucagcucagcacaugcuuuaagaaagcaaaaccaaaaaaaaaaaaaaaaagaugcagcaucaa

SEQ ID NO: 31826 - RNA, 64 nt, hsa
ucagcucagcacaugcuuuaagaaagcaaaaccaaaaaaaaaaaaaaaaagaugcagcaucaac

SEQ ID NO: 31827 - RNA, 64 nt, hsa
cagcucagcacaugcuuuaagaaagcaaaaccaaaaaaaaaaaaaaaaagaugcagcaucaacu

SEQ ID NO: 31828 - RNA, 64 nt, hsa
agcucagcacaugcuuuaagaaagcaaaaccaaaaaaaaaaaaaaaaagaugcagcaucaacuc

SEQ ID NO: 31829 - RNA, 64 nt, hsa
gcucagcacaugcuuuaagaaagcaaaaccaaaaaaaaaaaaaaaaagaugcagcaucaacucc

SEQ ID NO: 31830 - RNA, 64 nt, hsa
cucagcacaugcuuuaagaaagcaaaaccaaaaaaaaaaaaaaaaagaugcagcaucaacuccu

SEQ ID NO: 31831 - RNA, 64 nt, hsa
ucagcacaugcuuuaagaaagcaaaaccaaaaaaaaaaaaaaaaagaugcagcaucaacuccug

SEQ ID NO: 31832 - RNA, 64 nt, hsa
cagcacaugcuuuaagaaagcaaaaccaaaaaaaaaaaaaaaaagaugcagcaucaacuccuga

SEQ ID NO: 31833 - RNA, 64 nt, hsa
agcacaugcuuuaagaaagcaaaaccaaaaaaaaaaaaaaaaagaugcagcaucaacuccugac

SEQ ID NO: 31834 - RNA, 64 nt, hsa
gcacaugcuuuaagaaagcaaaaccaaaaaaaaaaaaaaaaagaugcagcaucaacuccugacu

SEQ ID NO: 31835 - RNA, 64 nt, hsa
auagcccaagauagccaugugaccuggaacuuuuaaaaaaaaauuuuuuuuuaagagccagagu

SEQ ID NO: 31836 - RNA, 64 nt, hsa
uagcccaagauagccaugugaccuggaacuuuuaaaaaaaaauuuuuuuuuaagagccagaguc

SEQ ID NO: 31837 - RNA, 64 nt, hsa
agcucagacuuuguauuuaaaaguuaaaaaggacaaaaaaaaaaucuaaagcauuuaaaaucua

SEQ ID NO: 31838 - RNA, 64 nt, hsa
gcucagacuuuguauuuaaaaguuaaaaaggacaaaaaaaaaaucuaaagcauuuaaaaucuag

SEQ ID NO: 31839 - RNA, 64 nt, hsa
cucagacuuuguauuuaaaaguuaaaaaggacaaaaaaaaaaucuaaagcauuuaaaaucuagu

SEQ ID NO: 31840 - RNA, 64 nt, hsa
augauggcucuuggaaagaaugacguuuugcuggaaaaaaaaaaaagaacaguuuguguuucac

SEQ ID NO: 31841 - RNA, 64 nt, hsa
ugauggcucuuggaaagaaugacguuuugcuggaaaaaaaaaaaagaacaguuuguguuucaca

SEQ ID NO: 31842 - RNA, 64 nt, hsa
gauggcucuuggaaagaaugacguuuugcuggaaaaaaaaaaaagaacaguuuguguuucacaa

SEQ ID NO: 31843 - RNA, 64 nt, hsa
auggcucuuggaaagaaugacguuuugcuggaaaaaaaaaaaagaacaguuuguguuucacaaa

SEQ ID NO: 31844 - RNA, 64 nt, hsa
uggcucuuggaaagaaugacguuuugcuggaaaaaaaaaaaagaacaguuuguguuucacaaac

SEQ ID NO: 31845 - RNA, 64 nt, hsa
aguaggaaauaaaaauggaagcuauuaugaccucaaaaaaaaaaagccaacuuugagcuaggau

SEQ ID NO: 31846 - RNA, 64 nt, hsa
guaggaaauaaaaauggaagcuauuaugaccucaaaaaaaaaaagccaacuuugagcuaggaua

SEQ ID NO: 31847 - RNA, 64 nt, hsa
uaggaaauaaaaauggaagcuauuaugaccucaaaaaaaaaaagccaacuuugagcuaggauaa

SEQ ID NO: 31848 - RNA, 64 nt, hsa
aggaaauaaaaauggaagcuauuaugaccucaaaaaaaaaaagccaacuuugagcuaggauaaa

SEQ ID NO: 31849 - RNA, 64 nt, hsa
caacauagugaaaccccgucucuacuaaaaauacaaaaaaaaaauuagcugggugugguggcag

SEQ ID NO: 31850 - RNA, 64 nt, hsa
aacauagugaaaccccgucucuacuaaaaauacaaaaaaaaaauuagcugggugugguggcagu

SEQ ID NO: 31851 - RNA, 64 nt, hsa
acauagugaaaccccgucucuacuaaaaauacaaaaaaaaaauuagcugggugugguggcaguc

SEQ ID NO: 31852 - RNA, 64 nt, hsa
cuccagccuuggugacaaugggagacuccaucucaaaaaaaaaaaaaaaaaaaaaaaagauaaa

SEQ ID NO: 31853 - RNA, 64 nt, hsa
uccagccuuggugacaaugggagacuccaucucaaaaaaaaaaaaaaaaaaaaaaaagauaaaa

SEQ ID NO: 31854 - RNA, 64 nt, hsa
ccagccuuggugacaaugggagacuccaucucaaaaaaaaaaaaaaaaaaaaaaaagauaaaaa

SEQ ID NO: 31855 - RNA, 64 nt, hsa
cagccuuggugacaaugggagacuccaucucaaaaaaaaaaaaaaaaaaaaaaaagauaaaaag

SEQ ID NO: 31856 - RNA, 64 nt, hsa
agccuuggugacaaugggagacuccaucucaaaaaaaaaaaaaaaaaaaaaaaagauaaaaagu

SEQ ID NO: 31857 - RNA, 64 nt, hsa
gccuuggugacaaugggagacuccaucucaaaaaaaaaaaaaaaaaaaaaaaagauaaaaaguc

SEQ ID NO: 31858 - RNA, 64 nt, hsa
ccuuggugacaaugggagacuccaucucaaaaaaaaaaaaaaaaaaaaaaaagauaaaaaguca

SEQ ID NO: 31859 - RNA, 64 nt, hsa
cuuggugacaaugggagacuccaucucaaaaaaaaaaaaaaaaaaaaaaaagauaaaaagucag

SEQ ID NO: 31860 - RNA, 64 nt, hsa
uuggugacaaugggagacuccaucucaaaaaaaaaaaaaaaaaaaaaaaagauaaaaagucaga

SEQ ID NO: 31861 - RNA, 64 nt, hsa
uggugacaaugggagacuccaucucaaaaaaaaaaaaaaaaaaaaaaaagauaaaaagucagaa

SEQ ID NO: 31862 - RNA, 64 nt, hsa
ggugacaaugggagacuccaucucaaaaaaaaaaaaaaaaaaaaaaaagauaaaaagucagaaa

SEQ ID NO: 31863 - RNA, 64 nt, hsa
gugacaaugggagacuccaucucaaaaaaaaaaaaaaaaaaaaaaaagauaaaaagucagaaau

SEQ ID NO: 31864 - RNA, 64 nt, hsa
ugacaaugggagacuccaucucaaaaaaaaaaaaaaaaaaaaaaaagauaaaaagucagaaauc

SEQ ID NO: 31865 - RNA, 64 nt, hsa
gacaaugggagacuccaucucaaaaaaaaaaaaaaaaaaaaaaaagauaaaaagucagaaaucu

SEQ ID NO: 31866 - RNA, 64 nt, hsa
acaaugggagacuccaucucaaaaaaaaaaaaaaaaaaaaaaaagauaaaaagucagaaaucug

SEQ ID NO: 31867 - RNA, 64 nt, hsa
caaugggagacuccaucucaaaaaaaaaaaaaaaaaaaaaaaagauaaaaagucagaaaucuga

SEQ ID NO: 31868 - RNA, 64 nt, hsa
aaugggagacuccaucucaaaaaaaaaaaaaaaaaaaaaaaagauaaaaagucagaaaucugaa

SEQ ID NO: 31869 - RNA, 64 nt, hsa
aaucucugccauuuuagauacugugaaacaaacuaaaaaaaaaaaagcuuuuguuuuguauuug

SEQ ID NO: 31870 - RNA, 64 nt, hsa
aucucugccauuuuagauacugugaaacaaacuaaaaaaaaaaaagcuuuuguuuuguauuugu

SEQ ID NO: 31871 - RNA, 64 nt, hsa
ucucugccauuuuagauacugugaaacaaacuaaaaaaaaaaaagcuuuuguuuuguauuuguu

SEQ ID NO: 31872 - RNA, 64 nt, hsa
cucugccauuuuagauacugugaaacaaacuaaaaaaaaaaaagcuuuuguuuuguauuuguuu

SEQ ID NO: 31873 - RNA, 64 nt, hsa
ucugccauuuuagauacugugaaacaaacuaaaaaaaaaaaagcuuuuguuuuguauuuguuua

SEQ ID NO: 31874 - RNA, 64 nt, hsa
ggagucccuuuugcaucauuguuuuaaggaugauaaaaaaaaauaacaacuagggacaauacag

SEQ ID NO: 31875 - RNA, 64 nt, hsa
gagucccuuuugcaucauuguuuuaaggaugauaaaaaaaaauaacaacuagggacaauacaga

SEQ ID NO: 31876 - RNA, 64 nt, hsa
uuccuguaaaauuucaaauugaugugguauuaauaaaaaaaaaaaaaacacaaacaaugacugu

SEQ ID NO: 31877 - RNA, 64 nt, hsa
uccuguaaaauuucaaauugaugugguauuaauaaaaaaaaaaaaaacacaaacaaugacugug

SEQ ID NO: 31878 - RNA, 64 nt, hsa
ccuguaaaauuucaaauugaugugguauuaauaaaaaaaaaaaaaacacaaacaaugacugugg

SEQ ID NO: 31879 - RNA, 64 nt, hsa
cuguaaaauuucaaauugaugugguauuaauaaaaaaaaaaaaaacacaaacaaugacuguggc

SEQ ID NO: 31880 - RNA, 64 nt, hsa
uguaaaauuucaaauugaugugguauuaauaaaaaaaaaaaaaacacaaacaaugacuguggca

SEQ ID NO: 31881 - RNA, 64 nt, hsa
guaaaauuucaaauugaugugguauuaauaaaaaaaaaaaaaacacaaacaaugacuguggcau

SEQ ID NO: 31882 - RNA, 64 nt, hsa
uaaaauuucaaauugaugugguauuaauaaaaaaaaaaaaaacacaaacaaugacuguggcauc

SEQ ID NO: 31883 - RNA, 64 nt, hsa
ucacugcauucuuugaacaaucauguagucgauuaaaaaaaaaaaacaaacuuuuuuuuccuag

SEQ ID NO: 31884 - RNA, 64 nt, hsa
cacugcauucuuugaacaaucauguagucgauuaaaaaaaaaaaacaaacuuuuuuuuccuagg

SEQ ID NO: 31885 - RNA, 64 nt, hsa
acugcauucuuugaacaaucauguagucgauuaaaaaaaaaaaacaaacuuuuuuuuccuaggc

SEQ ID NO: 31886 - RNA, 64 nt, hsa
cugcauucuuugaacaaucauguagucgauuaaaaaaaaaaaacaaacuuuuuuuuccuaggcu

SEQ ID NO: 31887 - RNA, 64 nt, hsa
ugcauucuuugaacaaucauguagucgauuaaaaaaaaaaaacaaacuuuuuuuuccuaggcug

SEQ ID NO: 31888 - RNA, 64 nt, hsa
ggggagaggcccccaucagggaccagacuguuccaaaaaaaaaacaaaaaacaaaaacaaacaa

SEQ ID NO: 31889 - RNA, 64 nt, hsa
gggagaggcccccaucagggaccagacuguuccaaaaaaaaaacaaaaaacaaaaacaaacaaa

SEQ ID NO: 31890 - RNA, 64 nt, hsa
ggagaggcccccaucagggaccagacuguuccaaaaaaaaaacaaaaaacaaaaacaaacaaaa

SEQ ID NO: 31891 - RNA, 64 nt, hsa
gaggagagaagguagagcuguucuuaaauuuauuaaaaaaaaaaauaaaagggaaucucagugu

SEQ ID NO: 31892 - RNA, 64 nt, hsa
aggagagaagguagagcuguucuuaaauuuauuaaaaaaaaaaauaaaagggaaucucaguguc

SEQ ID NO: 31893 - RNA, 64 nt, hsa
ggagagaagguagagcuguucuuaaauuuauuaaaaaaaaaaauaaaagggaaucucagugucu

SEQ ID NO: 31894 - RNA, 64 nt, hsa
gagagaagguagagcuguucuuaaauuuauuaaaaaaaaaaauaaaagggaaucucagugucug

SEQ ID NO: 31895 - RNA, 64 nt, hsa
cacugcagccuaggugacagucagacccugucucaaaaaaaauaaaaaaaauuuaaaauaaucu

SEQ ID NO: 31896 - RNA, 64 nt, hsa
cuaggugacagucagacccugucucaaaaaaaauaaaaaaaauuuaaaauaaucuuggggugag

SEQ ID NO: 31897 - RNA, 64 nt, hsa
ucucucuagggcagcagagagcuuuuugcacuuuaaaaaaaaaaagaaagaaagaaaggucgga

SEQ ID NO: 31898 - RNA, 64 nt, hsa
cucucuagggcagcagagagcuuuuugcacuuuaaaaaaaaaaagaaagaaagaaaggucggaa

SEQ ID NO: 31899 - RNA, 64 nt, hsa
ucucuagggcagcagagagcuuuuugcacuuuaaaaaaaaaaagaaagaaagaaaggucggaau

SEQ ID NO: 31900 - RNA, 64 nt, hsa
cucuagggcagcagagagcuuuuugcacuuuaaaaaaaaaaagaaagaaagaaaggucggaauu

SEQ ID NO: 31901 - RNA, 64 nt, hsa
cuccggccugggugacagaaggaggcucugccuuaaaaaaaaaaaaaaaaaaaaccuccuggga

SEQ ID NO: 31902 - RNA, 64 nt, hsa
uccggccugggugacagaaggaggcucugccuuaaaaaaaaaaaaaaaaaaaaccuccugggac

SEQ ID NO: 31903 - RNA, 64 nt, hsa
ccggccugggugacagaaggaggcucugccuuaaaaaaaaaaaaaaaaaaaaccuccugggacu

SEQ ID NO: 31904 - RNA, 64 nt, hsa
cggccugggugacagaaggaggcucugccuuaaaaaaaaaaaaaaaaaaaaccuccugggacug

SEQ ID NO: 31905 - RNA, 64 nt, hsa
ggccugggugacagaaggaggcucugccuuaaaaaaaaaaaaaaaaaaaaccuccugggacugu

SEQ ID NO: 31906 - RNA, 64 nt, hsa
gccugggugacagaaggaggcucugccuuaaaaaaaaaaaaaaaaaaaaccuccugggacuguu

SEQ ID NO: 31907 - RNA, 64 nt, hsa
ccugggugacagaaggaggcucugccuuaaaaaaaaaaaaaaaaaaaaccuccugggacuguug

SEQ ID NO: 31908 - RNA, 64 nt, hsa
cugggugacagaaggaggcucugccuuaaaaaaaaaaaaaaaaaaaaccuccugggacuguugc

SEQ ID NO: 31909 - RNA, 64 nt, hsa
ugggugacagaaggaggcucugccuuaaaaaaaaaaaaaaaaaaaaccuccugggacuguugca

SEQ ID NO: 31910 - RNA, 64 nt, hsa
gggugacagaaggaggcucugccuuaaaaaaaaaaaaaaaaaaaaccuccugggacuguugcaa

SEQ ID NO: 31911 - RNA, 64 nt, hsa
ggugacagaaggaggcucugccuuaaaaaaaaaaaaaaaaaaaaccuccugggacuguugcaag

SEQ ID NO: 31912 - RNA, 64 nt, hsa
gugacagaaggaggcucugccuuaaaaaaaaaaaaaaaaaaaaccuccugggacuguugcaagg

SEQ ID NO: 31913 - RNA, 64 nt, hsa
ugacagaaggaggcucugccuuaaaaaaaaaaaaaaaaaaaaccuccugggacuguugcaagga

SEQ ID NO: 31914 - RNA, 64 nt, hsa
uuacccaaaaacugucuuuaaaagagagagagagaaaaaaaaaauaguauuugcauaacccuga

SEQ ID NO: 31915 - RNA, 64 nt, hsa
uacccaaaaacugucuuuaaaagagagagagagaaaaaaaaaauaguauuugcauaacccugag

SEQ ID NO: 31916 - RNA, 64 nt, hsa
acccaaaaacugucuuuaaaagagagagagagaaaaaaaaaauaguauuugcauaacccugagc

SEQ ID NO: 31917 - RNA, 64 nt, hsa
cgggagaggauuagguuccauccuuuacguguuuaaaaaaaagcauaaaaacauuuuaaaaaca

SEQ ID NO: 31918 - RNA, 64 nt, hsa
acaagauaaaacucacaggggaauguacuuuuuuaaaaaaaaaugaaaaagaaaaaaaaagcug

SEQ ID NO: 31919 - RNA, 64 nt, hsa
caagauaaaacucacaggggaauguacuuuuuuaaaaaaaaaugaaaaagaaaaaaaaagcugc

SEQ ID NO: 31920 - RNA, 64 nt, hsa
ggggaauguacuuuuuuaaaaaaaaaugaaaaagaaaaaaaaagcugcacauuuacagugacuu

SEQ ID NO: 31921 - RNA, 64 nt, hsa
gggaauguacuuuuuuaaaaaaaaaugaaaaagaaaaaaaaagcugcacauuuacagugacuua

SEQ ID NO: 31922 - RNA, 64 nt, hsa
ggccgggcaugguggcagagcgagacuccgucucaaaaaaaaaaaaaaaaaaaaaaaagaaaag

SEQ ID NO: 31923 - RNA, 64 nt, hsa
gccgggcaugguggcagagcgagacuccgucucaaaaaaaaaaaaaaaaaaaaaaaagaaaaga

SEQ ID NO: 31924 - RNA, 64 nt, hsa
ccgggcaugguggcagagcgagacuccgucucaaaaaaaaaaaaaaaaaaaaaaaagaaaagaa

SEQ ID NO: 31925 - RNA, 64 nt, hsa
cgggcaugguggcagagcgagacuccgucucaaaaaaaaaaaaaaaaaaaaaaaagaaaagaaa

SEQ ID NO: 31926 - RNA, 64 nt, hsa
gggcaugguggcagagcgagacuccgucucaaaaaaaaaaaaaaaaaaaaaaaagaaaagaaaa

SEQ ID NO: 31927 - RNA, 64 nt, hsa
ggcaugguggcagagcgagacuccgucucaaaaaaaaaaaaaaaaaaaaaaaagaaaagaaaag

SEQ ID NO: 31928 - RNA, 64 nt, hsa
gcaugguggcagagcgagacuccgucucaaaaaaaaaaaaaaaaaaaaaaaagaaaagaaaaga

SEQ ID NO: 31929 - RNA, 64 nt, hsa
caugguggcagagcgagacuccgucucaaaaaaaaaaaaaaaaaaaaaaaagaaaagaaaagaa

SEQ ID NO: 31930 - RNA, 64 nt, hsa
augguggcagagcgagacuccgucucaaaaaaaaaaaaaaaaaaaaaaaagaaaagaaaagaaa

SEQ ID NO: 31931 - RNA, 64 nt, hsa
ugguggcagagcgagacuccgucucaaaaaaaaaaaaaaaaaaaaaaaagaaaagaaaagaaaa

SEQ ID NO: 31932 - RNA, 64 nt, hsa
gguggcagagcgagacuccgucucaaaaaaaaaaaaaaaaaaaaaaaagaaaagaaaagaaaau

SEQ ID NO: 31933 - RNA, 64 nt, hsa
guggcagagcgagacuccgucucaaaaaaaaaaaaaaaaaaaaaaaauauaaggauguaaaaga

SEQ ID NO: 31934 - RNA, 64 nt, hsa
uggcagagcgagacuccgucucaaaaaaaaaaaaaaaaaaaaaaaauauaaggauguaaaagaa

SEQ ID NO: 31935 - RNA, 64 nt, hsa
ggcagagcgagacuccgucucaaaaaaaaaaaaaaaaaaaaaaaauauaaggauguaaaagaag

SEQ ID NO: 31936 - RNA, 64 nt, hsa
gcagagcgagacuccgucucaaaaaaaaaaaaaaaaaaaaaaaauauaaggauguaaaagaagc

SEQ ID NO: 31937 - RNA, 64 nt, hsa
cagagcgagacuccgucucaaaaaaaaaaaaaaaaaaaaaaaauauaaggauguaaaagaagca

SEQ ID NO: 31938 - RNA, 64 nt, hsa
agagcgagacuccgucucaaaaaaaaaaaaaaaaaaaaaaaauauaaggauguaaaagaagcaa

SEQ ID NO: 31939 - RNA, 64 nt, hsa
gaagcugccuuauaguuuucaucacugggacuuuaaaaaaaaauuacugugaaaaugagguauu

SEQ ID NO: 31940 - RNA, 64 nt, hsa
aagcugccuuauaguuuucaucacugggacuuuaaaaaaaaauuacugugaaaaugagguauuc

SEQ ID NO: 31941 - RNA, 64 nt, hsa
auugaggcuaaaaccacaaaguggcucaggcuuuaaaaaaaaaacacuguggauaaugacaaaa

SEQ ID NO: 31942 - RNA, 64 nt, hsa
uugaggcuaaaaccacaaaguggcucaggcuuuaaaaaaaaaacacuguggauaaugacaaaaa

SEQ ID NO: 31943 - RNA, 64 nt, hsa
ugaggcuaaaaccacaaaguggcucaggcuuuaaaaaaaaaacacuguggauaaugacaaaaag

SEQ ID NO: 31944 - RNA, 64 nt, hsa
caccagccugggugacagugugagacccagccucaaaaaaaaaaaaaaaaaagugaugaaucaa

SEQ ID NO: 31945 - RNA, 64 nt, hsa
accagccugggugacagugugagacccagccucaaaaaaaaaaaaaaaaaagugaugaaucaaa

SEQ ID NO: 31946 - RNA, 64 nt, hsa
ccagccugggugacagugugagacccagccucaaaaaaaaaaaaaaaaaagugaugaaucaaaa

SEQ ID NO: 31947 - RNA, 64 nt, hsa
cagccugggugacagugugagacccagccucaaaaaaaaaaaaaaaaaagugaugaaucaaaau

SEQ ID NO: 31948 - RNA, 64 nt, hsa
agccugggugacagugugagacccagccucaaaaaaaaaaaaaaaaaagugaugaaucaaaauu

SEQ ID NO: 31949 - RNA, 64 nt, hsa
gccugggugacagugugagacccagccucaaaaaaaaaaaaaaaaaagugaugaaucaaaauua

SEQ ID NO: 31950 - RNA, 64 nt, hsa
ccugggugacagugugagacccagccucaaaaaaaaaaaaaaaaaagugaugaaucaaaauuag

SEQ ID NO: 31951 - RNA, 64 nt, hsa
cugggugacagugugagacccagccucaaaaaaaaaaaaaaaaaagugaugaaucaaaauuaga

SEQ ID NO: 31952 - RNA, 64 nt, hsa
ugggugacagugugagacccagccucaaaaaaaaaaaaaaaaaagugaugaaucaaaauuagaa

SEQ ID NO: 31953 - RNA, 64 nt, hsa
gggugacagugugagacccagccucaaaaaaaaaaaaaaaaaagugaugaaucaaaauuagaaa

SEQ ID NO: 31954 - RNA, 64 nt, hsa
ggugacagugugagacccagccucaaaaaaaaaaaaaaaaaagugaugaaucaaaauuagaaau

SEQ ID NO: 31955 - RNA, 64 nt, hsa
uuccaagcaccucagaugaaaacucacuuuuauuaaaaaaaaaaaagacaaggguuuauauuca

SEQ ID NO: 31956 - RNA, 64 nt, hsa
uccaagcaccucagaugaaaacucacuuuuauuaaaaaaaaaaaagacaaggguuuauauucau

SEQ ID NO: 31957 - RNA, 64 nt, hsa
ccaagcaccucagaugaaaacucacuuuuauuaaaaaaaaaaaagacaaggguuuauauucaua

SEQ ID NO: 31958 - RNA, 64 nt, hsa
caagcaccucagaugaaaacucacuuuuauuaaaaaaaaaaaagacaaggguuuauauucauau

SEQ ID NO: 31959 - RNA, 64 nt, hsa
aagcaccucagaugaaaacucacuuuuauuaaaaaaaaaaaagacaaggguuuauauucauaua

SEQ ID NO: 31960 - RNA, 64 nt, hsa
ugaaaauaguuaagauccaaagucagaauaggccaaaaaaaaaaaaaaaaaaagccuaaauagu

SEQ ID NO: 31961 - RNA, 64 nt, hsa
gaaaauaguuaagauccaaagucagaauaggccaaaaaaaaaaaaaaaaaaagccuaaauagua

SEQ ID NO: 31962 - RNA, 64 nt, hsa
aaaauaguuaagauccaaagucagaauaggccaaaaaaaaaaaaaaaaaaagccuaaauaguaa

SEQ ID NO: 31963 - RNA, 64 nt, hsa
aaauaguuaagauccaaagucagaauaggccaaaaaaaaaaaaaaaaaaagccuaaauaguaag

SEQ ID NO: 31964 - RNA, 64 nt, hsa
aauaguuaagauccaaagucagaauaggccaaaaaaaaaaaaaaaaaaagccuaaauaguaagc

SEQ ID NO: 31965 - RNA, 64 nt, hsa
auaguuaagauccaaagucagaauaggccaaaaaaaaaaaaaaaaaaagccuaaauaguaagcu

SEQ ID NO: 31966 - RNA, 64 nt, hsa
uaguuaagauccaaagucagaauaggccaaaaaaaaaaaaaaaaaaagccuaaauaguaagcug

SEQ ID NO: 31967 - RNA, 64 nt, hsa
aguuaagauccaaagucagaauaggccaaaaaaaaaaaaaaaaaaagccuaaauaguaagcugg

SEQ ID NO: 31968 - RNA, 64 nt, hsa
guuaagauccaaagucagaauaggccaaaaaaaaaaaaaaaaaaagccuaaauaguaagcuggu

SEQ ID NO: 31969 - RNA, 64 nt, hsa
uuaagauccaaagucagaauaggccaaaaaaaaaaaaaaaaaaagccuaaauaguaagcuggug

SEQ ID NO: 31970 - RNA, 64 nt, hsa
uaagauccaaagucagaauaggccaaaaaaaaaaaaaaaaaaagccuaaauaguaagcugguga

SEQ ID NO: 31971 - RNA, 64 nt, hsa
aagauccaaagucagaauaggccaaaaaaaaaaaaaaaaaaagccuaaauaguaagcuggugaa

SEQ ID NO: 31972 - RNA, 64 nt, hsa
accugagugacagagcaacacucugucuuaaaagaaaaaaaaaaaagagagagauaguaaucuc

SEQ ID NO: 31973 - RNA, 64 nt, hsa
ccugagugacagagcaacacucugucuuaaaagaaaaaaaaaaaagagagagauaguaaucucu

SEQ ID NO: 31974 - RNA, 64 nt, hsa
cugagugacagagcaacacucugucuuaaaagaaaaaaaaaaaagagagagauaguaaucucuu

SEQ ID NO: 31975 - RNA, 64 nt, hsa
ugagugacagagcaacacucugucuuaaaagaaaaaaaaaaaagagagagauaguaaucucuug

SEQ ID NO: 31976 - RNA, 64 nt, hsa
gagugacagagcaacacucugucuuaaaagaaaaaaaaaaaagagagagauaguaaucucuugg

SEQ ID NO: 31977 - RNA, 64 nt, hsa
aaaguuuuuuuaaagaacagaaacuuuuccaauuaaaaaaaaaaagcagacuucugguucaaga

SEQ ID NO: 31978 - RNA, 64 nt, hsa
aaguuuuuuuaaagaacagaaacuuuuccaauuaaaaaaaaaaagcagacuucugguucaagau

SEQ ID NO: 31979 - RNA, 64 nt, hsa
aguuuuuuuaaagaacagaaacuuuuccaauuaaaaaaaaaaagcagacuucugguucaagaua

SEQ ID NO: 31980 - RNA, 64 nt, hsa
guuuuuuuaaagaacagaaacuuuuccaauuaaaaaaaaaaagcagacuucugguucaagauag

SEQ ID NO: 31981 - RNA, 64 nt, hsa
ucuuuaaguaauuuaacaacagauuugcuaauuuaaaaaaaaaugaaaaaaaaaaucuuaccag

SEQ ID NO: 31982 - RNA, 64 nt, hsa
cuuuaaguaauuuaacaacagauuugcuaauuuaaaaaaaaaugaaaaaaaaaaucuuaccagc

SEQ ID NO: 31983 - RNA, 64 nt, hsa
uuuaacaacagauuugcuaauuuaaaaaaaaaugaaaaaaaaaaucuuaccagcaguuuguaaa

SEQ ID NO: 31984 - RNA, 64 nt, hsa
uuaacaacagauuugcuaauuuaaaaaaaaaugaaaaaaaaaaucuuaccagcaguuuguaaag

SEQ ID NO: 31985 - RNA, 64 nt, hsa
uaacaacagauuugcuaauuuaaaaaaaaaugaaaaaaaaaaucuuaccagcaguuuguaaagg

SEQ ID NO: 31986 - RNA, 64 nt, hsa
aucuuguccuggaauauuuuugggguuggaacucaaaaaaaaaaaaaaaaaaucaaucuuuucu

SEQ ID NO: 31987 - RNA, 64 nt, hsa
ucuuguccuggaauauuuuugggguuggaacucaaaaaaaaaaaaaaaaaaucaaucuuuucuc

SEQ ID NO: 31988 - RNA, 64 nt, hsa
cuuguccuggaauauuuuugggguuggaacucaaaaaaaaaaaaaaaaaaucaaucuuuucuca

SEQ ID NO: 31989 - RNA, 64 nt, hsa
uuguccuggaauauuuuugggguuggaacucaaaaaaaaaaaaaaaaaaucaaucuuuucucag

SEQ ID NO: 31990 - RNA, 64 nt, hsa
uguccuggaauauuuuugggguuggaacucaaaaaaaaaaaaaaaaaaucaaucuuuucucagg

SEQ ID NO: 31991 - RNA, 64 nt, hsa
guccuggaauauuuuugggguuggaacucaaaaaaaaaaaaaaaaaaucaaucuuuucucaggc

SEQ ID NO: 31992 - RNA, 64 nt, hsa
uccuggaauauuuuugggguuggaacucaaaaaaaaaaaaaaaaaaucaaucuuuucucaggcc

SEQ ID NO: 31993 - RNA, 64 nt, hsa
ccuggaauauuuuugggguuggaacucaaaaaaaaaaaaaaaaaaucaaucuuuucucaggccu

SEQ ID NO: 31994 - RNA, 64 nt, hsa
cuggaauauuuuugggguuggaacucaaaaaaaaaaaaaaaaaaucaaucuuuucucaggccug

SEQ ID NO: 31995 - RNA, 64 nt, hsa
uggaauauuuuugggguuggaacucaaaaaaaaaaaaaaaaaaucaaucuuuucucaggccugg

SEQ ID NO: 31996 - RNA, 64 nt, hsa
ggaauauuuuugggguuggaacucaaaaaaaaaaaaaaaaaaucaaucuuuucucaggccuggc

SEQ ID NO: 31997 - RNA, 64 nt, hsa
uuuguaaauccuuguauuccuauuuuuuuuaaagaaaaaaaaaaaaccuuaagcugcauuuguu

SEQ ID NO: 31998 - RNA, 64 nt, hsa
uuguaaauccuuguauuccuauuuuuuuuaaagaaaaaaaaaaaaccuuaagcugcauuuguua

SEQ ID NO: 31999 - RNA, 64 nt, hsa
uguaaauccuuguauuccuauuuuuuuuaaagaaaaaaaaaaaaccuuaagcugcauuuguuac

SEQ ID NO: 32000 - RNA, 64 nt, hsa
guaaauccuuguauuccuauuuuuuuuaaagaaaaaaaaaaaaccuuaagcugcauuuguuacu

SEQ ID NO: 32001 - RNA, 64 nt, hsa
uaaauccuuguauuccuauuuuuuuuaaagaaaaaaaaaaaaccuuaagcugcauuuguuacug

SEQ ID NO: 32002 - RNA, 64 nt, hsa
uguuuaaauauugaaggccuagacaaagaacuagaaaaaaaaaagcaguuuccaggcccaucca

SEQ ID NO: 32003 - RNA, 64 nt, hsa
guuuaaauauugaaggccuagacaaagaacuagaaaaaaaaaagcaguuuccaggcccauccau

SEQ ID NO: 32004 - RNA, 64 nt, hsa
uuuaaauauugaaggccuagacaaagaacuagaaaaaaaaaagcaguuuccaggcccauccaua

SEQ ID NO: 32005 - RNA, 64 nt, hsa
uuugaaaaugucucuguaauauuuuaucuucuuuaaaaaaaagggggggaaauaccaaagugug

SEQ ID NO: 32006 - RNA, 64 nt, hsa
auguaacaugaagccauuccagaaaugguaacuuaaaaaaaaaaagacuacaugucuaggaaac

SEQ ID NO: 32007 - RNA, 64 nt, hsa
uguaacaugaagccauuccagaaaugguaacuuaaaaaaaaaaagacuacaugucuaggaaacu

SEQ ID NO: 32008 - RNA, 64 nt, hsa
guaacaugaagccauuccagaaaugguaacuuaaaaaaaaaaagacuacaugucuaggaaacug

SEQ ID NO: 32009 - RNA, 64 nt, hsa
uaacaugaagccauuccagaaaugguaacuuaaaaaaaaaaagacuacaugucuaggaaacugu

SEQ ID NO: 32010 - RNA, 64 nt, hsa
cuccagccugggcaacagagggagacucugucucaaaaaaaaagaaguuacuuccaagacagac

SEQ ID NO: 32011 - RNA, 64 nt, hsa
uccagccugggcaacagagggagacucugucucaaaaaaaaagaaguuacuuccaagacagacu

SEQ ID NO: 32012 - RNA, 64 nt, hsa
ucagguuagguuuuggucucucuugcuccacugcaaaaaaaaaaaaaaaaaaaaaaaaaaaaaa

SEQ ID NO: 32013 - RNA, 64 nt, hsa
cagguuagguuuuggucucucuugcuccacugcaaaaaaaaaaaaaaaaaaaaaaaaaaaaaaa

SEQ ID NO: 32014 - RNA, 64 nt, hsa
agguuagguuuuggucucucuugcuccacugcaaaaaaaaaaaaaaaaaaaaaaaaaaaaaaaa

SEQ ID NO: 32015 - RNA, 64 nt, hsa
gguuagguuuuggucucucuugcuccacugcaaaaaaaaaaaaaaaaaaaaaaaaaaaaaaaaa

SEQ ID NO: 32016 - RNA, 64 nt, hsa
guuagguuuuggucucucuugcuccacugcaaaaaaaaaaaaaaaaaaaaaaaaaaaaaaaaag

SEQ ID NO: 32017 - RNA, 64 nt, hsa
uuagguuuuggucucucuugcuccacugcaaaaaaaaaaaaaaaaaaaaaaaaaaaaaaaaagc

SEQ ID NO: 32018 - RNA, 64 nt, hsa
uagguuuuggucucucuugcuccacugcaaaaaaaaaaaaaaaaaaaaaaaaaaaaaaaaagcc

SEQ ID NO: 32019 - RNA, 64 nt, hsa
agguuuuggucucucuugcuccacugcaaaaaaaaaaaaaaaaaaaaaaaaaaaaaaaaagccu

SEQ ID NO: 32020 - RNA, 64 nt, hsa
gguuuuggucucucuugcuccacugcaaaaaaaaaaaaaaaaaaaaaaaaaaaaaaaaagccug

SEQ ID NO: 32021 - RNA, 64 nt, hsa
guuuuggucucucuugcuccacugcaaaaaaaaaaaaaaaaaaaaaaaaaaaaaaaaagccuga

SEQ ID NO: 32022 - RNA, 64 nt, hsa
uuuuggucucucuugcuccacugcaaaaaaaaaaaaaaaaaaaaaaaaaaaaaaaaagccugaa

SEQ ID NO: 32023 - RNA, 64 nt, hsa
uuuggucucucuugcuccacugcaaaaaaaaaaaaaaaaaaaaaaaaaaaaaaaaagccugaag

SEQ ID NO: 32024 - RNA, 64 nt, hsa
uuggucucucuugcuccacugcaaaaaaaaaaaaaaaaaaaaaaaaaaaaaaaaagccugaaga

SEQ ID NO: 32025 - RNA, 64 nt, hsa
uggucucucuugcuccacugcaaaaaaaaaaaaaaaaaaaaaaaaaaaaaaaaagccugaagag

SEQ ID NO: 32026 - RNA, 64 nt, hsa
ggucucucuugcuccacugcaaaaaaaaaaaaaaaaaaaaaaaaaaaaaaaaagccugaagaga

SEQ ID NO: 32027 - RNA, 64 nt, hsa
gucucucuugcuccacugcaaaaaaaaaaaaaaaaaaaaaaaaaaaaaaaaagccugaagagau

SEQ ID NO: 32028 - RNA, 64 nt, hsa
ucucucuugcuccacugcaaaaaaaaaaaaaaaaaaaaaaaaaaaaaaaaagccugaagagaug

SEQ ID NO: 32029 - RNA, 64 nt, hsa
cucucuugcuccacugcaaaaaaaaaaaaaaaaaaaaaaaaaaaaaaaaagccugaagagauga

SEQ ID NO: 32030 - RNA, 64 nt, hsa
ucucuugcuccacugcaaaaaaaaaaaaaaaaaaaaaaaaaaaaaaaaagccugaagagaugag

SEQ ID NO: 32031 - RNA, 64 nt, hsa
cucuugcuccacugcaaaaaaaaaaaaaaaaaaaaaaaaaaaaaaaaagccugaagagaugaga

SEQ ID NO: 32032 - RNA, 64 nt, hsa
ucuugcuccacugcaaaaaaaaaaaaaaaaaaaaaaaaaaaaaaaaagccugaagagaugagau

SEQ ID NO: 32033 - RNA, 64 nt, hsa
cuugcuccacugcaaaaaaaaaaaaaaaaaaaaaaaaaaaaaaaaagccugaagagaugagaua

SEQ ID NO: 32034 - RNA, 64 nt, hsa
uugcuccacugcaaaaaaaaaaaaaaaaaaaaaaaaaaaaaaaaagccugaagagaugagauag

SEQ ID NO: 32035 - RNA, 64 nt, hsa
ugcuccacugcaaaaaaaaaaaaaaaaaaaaaaaaaaaaaaaaagccugaagagaugagauagg

SEQ ID NO: 32036 - RNA, 64 nt, hsa
gcuccacugcaaaaaaaaaaaaaaaaaaaaaaaaaaaaaaaaagccugaagagaugagauagga

SEQ ID NO: 32037 - RNA, 64 nt, hsa
cuccacugcaaaaaaaaaaaaaaaaaaaaaaaaaaaaaaaaagccugaagagaugagauaggag

SEQ ID NO: 32038 - RNA, 64 nt, hsa
cuccagccugggcgacagagcgagacuccaucucaaaaaaaaaaaaaacaucagcaucugcccc

SEQ ID NO: 32039 - RNA, 64 nt, hsa
uccagccugggcgacagagcgagacuccaucucaaaaaaaaaaaaaacaucagcaucugcccca

SEQ ID NO: 32040 - RNA, 64 nt, hsa
ccagccugggcgacagagcgagacuccaucucaaaaaaaaaaaaaacaucagcaucugccccag

SEQ ID NO: 32041 - RNA, 64 nt, hsa
cagccugggcgacagagcgagacuccaucucaaaaaaaaaaaaaacaucagcaucugccccagu

SEQ ID NO: 32042 - RNA, 64 nt, hsa
agccugggcgacagagcgagacuccaucucaaaaaaaaaaaaaacaucagcaucugccccaguu

SEQ ID NO: 32043 - RNA, 64 nt, hsa
gccugggcgacagagcgagacuccaucucaaaaaaaaaaaaaacaucagcaucugccccaguug

SEQ ID NO: 32044 - RNA, 63 nt, hsa
ccugggcgacagagcgagacuccaucucaaaaaaaaaaaaaacaucagcaucugccccaguug

SEQ ID NO: 32045 - RNA, 64 nt, hsa
acaugucagagacauuuauaaaaagugaaaggauaaaaaaaaaaaaaaacaacuaauaccgggc

SEQ ID NO: 32046 - RNA, 64 nt, hsa
caugucagagacauuuauaaaaagugaaaggauaaaaaaaaaaaaaaacaacuaauaccgggcg

SEQ ID NO: 32047 - RNA, 64 nt, hsa
augucagagacauuuauaaaaagugaaaggauaaaaaaaaaaaaaaacaacuaauaccgggcgc

SEQ ID NO: 32048 - RNA, 64 nt, hsa
ugucagagacauuuauaaaaagugaaaggauaaaaaaaaaaaaaaacaacuaauaccgggcgca

SEQ ID NO: 32049 - RNA, 64 nt, hsa
gucagagacauuuauaaaaagugaaaggauaaaaaaaaaaaaaaacaacuaauaccgggcgcag

SEQ ID NO: 32050 - RNA, 64 nt, hsa
ucagagacauuuauaaaaagugaaaggauaaaaaaaaaaaaaaacaacuaauaccgggcgcagc

SEQ ID NO: 32051 - RNA, 64 nt, hsa
cagagacauuuauaaaaagugaaaggauaaaaaaaaaaaaaaacaacuaauaccgggcgcagca

SEQ ID NO: 32052 - RNA, 64 nt, hsa
agagacauuuauaaaaagugaaaggauaaaaaaaaaaaaaaacaacuaauaccgggcgcagcau

SEQ ID NO: 32053 - RNA, 64 nt, hsa
ggucucuuuccuuccuguugucuccaucuguuuaaaaaaaaauaacaaaauaaugaaugaauuu

SEQ ID NO: 32054 - RNA, 64 nt, hsa
aggucucuuuccuuccuguugucuccaucuguuuaaaaaaaaauaacaaaauaaugaaugaauu

SEQ ID NO: 32055 - RNA, 64 nt, hsa
cccaggaacuugaguucuaagcagugcucgugaaaaaaaaaagcagaaagaauuagaaauaaau

SEQ ID NO: 32056 - RNA, 64 nt, hsa
ucccaggaacuugaguucuaagcagugcucgugaaaaaaaaaagcagaaagaauuagaaauaaa

SEQ ID NO: 32057 - RNA, 64 nt, hsa
aucccaggaacuugaguucuaagcagugcucgugaaaaaaaaaagcagaaagaauuagaaauaa

SEQ ID NO: 32058 - RNA, 64 nt, hsa
ccagccugggagacagaacgagacuccuaaucaaaaaaaaaacacaagaaaauagagugaggcu

SEQ ID NO: 32059 - RNA, 64 nt, hsa
uccagccugggagacagaacgagacuccuaaucaaaaaaaaaacacaagaaaauagagugaggc

SEQ ID NO: 32060 - RNA, 64 nt, hsa
cuccagccugggagacagaacgagacuccuaaucaaaaaaaaaacacaagaaaauagagugagg

SEQ ID NO: 32061 - RNA, 64 nt, hsa
ccaggcugggugacagagcgagacuccaugucaaaaaaaaaagaaugugggaacucaaauuuuc

SEQ ID NO: 32062 - RNA, 64 nt, hsa
uccaggcugggugacagagcgagacuccaugucaaaaaaaaaagaaugugggaacucaaauuuu

SEQ ID NO: 32063 - RNA, 64 nt, hsa
cuccaggcugggugacagagcgagacuccaugucaaaaaaaaaagaaugugggaacucaaauuu

SEQ ID NO: 32064 - RNA, 64 nt, hsa
uuauaaaagagcacuucuguggcucauuuaaaagaaaaaaaagguuaagucuuuuaaauuuugg

SEQ ID NO: 32065 - RNA, 64 nt, hsa
caaucuuuuauuguuccuuugcuacuuugaaaggaaaaaaaagguugucucuugauuucuguaa

SEQ ID NO: 32066 - RNA, 64 nt, hsa
ggagugaacauuuggguaaaucauggcuaagcuuaaaaaaaacucauggugaggcuuaacaaug

SEQ ID NO: 32067 - RNA, 64 nt, hsa
aauugauaauaaacuguccucuuucagaaaacagaaaaaaaacacacacacacacaacaaaaau

SEQ ID NO: 32068 - RNA, 64 nt, hsa
uugccguugccaagaacugaaaacauaaaaaguuaaaaaaaauaauaaauugcaugcugcuuua

SEQ ID NO: 32069 - RNA, 64 nt, hsa
ccuagauuauaucaaaguauuugucguguguagaaaaaaaaacagcucugcaggcuuaauaaaa

SEQ ID NO: 32070 - RNA, 64 nt, hsa
uccuagauuauaucaaaguauuugucguguguagaaaaaaaaacagcucugcaggcuuaauaaa

SEQ ID NO: 32071 - RNA, 64 nt, hsa
aaacauuuacagaguuacaaaaaacaaacaaucaaaaaaaaagacaguuuauuaaaaaugacac

SEQ ID NO: 32072 - RNA, 64 nt, hsa
aaaacauuuacagaguuacaaaaaacaaacaaucaaaaaaaaagacaguuuauuaaaaaugaca

SEQ ID NO: 32073 - RNA, 64 nt, hsa
acccccucacucugccccccacaaaaaaaaaaaaaaaaaaaacuauuaaaucaugucccccccu

SEQ ID NO: 32074 - RNA, 64 nt, hsa
gacccccucacucugccccccacaaaaaaaaaaaaaaaaaaaacuauuaaaucauguccccccc

SEQ ID NO: 32075 - RNA, 64 nt, hsa
agacccccucacucugccccccacaaaaaaaaaaaaaaaaaaaaaaaaaaaaauuaaggccaaa

SEQ ID NO: 32076 - RNA, 64 nt, hsa
aagacccccucacucugccccccacaaaaaaaaaaaaaaaaaaaaaaaaaaaaauuaaggccaa

SEQ ID NO: 32077 - RNA, 64 nt, hsa
caagacccccucacucugccccccacaaaaaaaaaaaaaaaaaaaaaaaaaaaaauuaaggcca

SEQ ID NO: 32078 - RNA, 64 nt, hsa
gcaagacccccucacucugccccccacaaaaaaaaaaaaaaaaaaaaaaaaaaaaauuaaggcc

SEQ ID NO: 32079 - RNA, 64 nt, hsa
ggcaagacccccucacucugccccccacaaaaaaaaaaaaaaaaaaaaaaaaaaaaauuaaggc

SEQ ID NO: 32080 - RNA, 64 nt, hsa
acugccucccgcugcugcccaccccccacaaaaaaaaaaaaaaaaaaaaaaaaaaaaauuaagg

SEQ ID NO: 32081 - RNA, 64 nt, hsa
cacugccucccgcugcugcccaccccccacaaaaaaaaaaaaaaaaaaaaaaaaaaaaauuaag

SEQ ID NO: 32082 - RNA, 64 nt, hsa
ccacugccucccgcugcugcccaccccccacaaaaaaaaaaaaaaaaaaaaaaaaaaaaauuaa

SEQ ID NO: 32083 - RNA, 64 nt, hsa
accacugccucccgcugcugcccaccccccacaaaaaaaaaaaaaaaaaaaaaaaaaaaaauua

SEQ ID NO: 32084 - RNA, 64 nt, hsa
caccacugccucccgcugcugcccaccccccacaaaaaaaaaaaaaaaaaaaaaaaaaaaaauu

SEQ ID NO: 32085 - RNA, 64 nt, hsa
ccaccacugccucccgcugcugcccaccccccacaaaaaaaaaaaaaaaaaaaaaaaaaaaaau

SEQ ID NO: 32086 - RNA, 64 nt, hsa
gguccaucugugauauuucuuugugccaaaaagaaaaaaaaagaguggaucaguuugcuaaaug

SEQ ID NO: 32087 - RNA, 64 nt, hsa
ggguccaucugugauauuucuuugugccaaaaagaaaaaaaaagaguggaucaguuugcuaaau

SEQ ID NO: 32088 - RNA, 64 nt, hsa
uacuuaaauuaagaucaagguaagaaacauuguaaaaaaaaauuacaaaagugcuauuuguuuc

SEQ ID NO: 32089 - RNA, 64 nt, hsa
uuacuuaaauuaagaucaagguaagaaacauuguaaaaaaaaauuacaaaagugcuauuuguuu

SEQ ID NO: 32090 - RNA, 64 nt, hsa
uuuuaugcaagggcaaaaaucuuuguaucuggggaaaaaaaacuuuuuuuuaaauuaaaaagga

SEQ ID NO: 32091 - RNA, 64 nt, hsa
ugauuuaggacuuguucuguguuuucuuuaaaaaaaaaaaaauuacauuuaucaaacuggcuga

SEQ ID NO: 32092 - RNA, 64 nt, hsa
cugauuuaggacuuguucuguguuuucuuuaaaaaaaaaaaaauuacauuuaucaaacuggcug

SEQ ID NO: 32093 - RNA, 64 nt, hsa
ucugauuuaggacuuguucuguguuuucuuuaaaaaaaaaaaaauuacauuuaucaaacuggcu

SEQ ID NO: 32094 - RNA, 64 nt, hsa
gucugauuuaggacuuguucuguguuuucuuuaaaaaaaaaaaaauuacauuuaucaaacuggc

SEQ ID NO: 32095 - RNA, 64 nt, hsa
ugucugauuuaggacuuguucuguguuuucuuuaaaaaaaaaaaaauuacauuuaucaaacugg

SEQ ID NO: 32096 - RNA, 64 nt, hsa
uugucugauuuaggacuuguucuguguuuucuuuaaaaaaaaaaaaauuacauuuaucaaacug

SEQ ID NO: 32097 - RNA, 64 nt, hsa
ucaguuuuuuugccuuauugauuuuuuuccaaaaaaaaaaaacuacuaaauuaaauaauuuuuu

SEQ ID NO: 32098 - RNA, 64 nt, hsa
uucaguuuuuuugccuuauugauuuuuuuccaaaaaaaaaaaacuacuaaauuaaauaauuuuu

SEQ ID NO: 32099 - RNA, 64 nt, hsa
uuucaguuuuuuugccuuauugauuuuuuuccaaaaaaaaaaaacuacuaaauuaaauaauuuu

SEQ ID NO: 32100 - RNA, 64 nt, hsa
uuuucaguuuuuuugccuuauugauuuuuuuccaaaaaaaaaaaacuacuaaauuaaauaauuu

SEQ ID NO: 32101 - RNA, 64 nt, hsa
auuuucaguuuuuuugccuuauugauuuuuuuccaaaaaaaaaaaacuacuaaauuaaauaauu

SEQ ID NO: 32102 - RNA, 64 nt, hsa
gcagcgaagagaaaugaagaaaaacugaagaaaaaaaaaaaacaggaaaaaaagaaccauacaa

SEQ ID NO: 32103 - RNA, 64 nt, hsa
ugcagcgaagagaaaugaagaaaaacugaagaaaaaaaaaaaacaggaaaaaaagaaccauaca

SEQ ID NO: 32104 - RNA, 64 nt, hsa
uugcagcgaagagaaaugaagaaaaacugaagaaaaaaaaaaaacaggaaaaaaagaaccauac

SEQ ID NO: 32105 - RNA, 64 nt, hsa
uuugcagcgaagagaaaugaagaaaaacugaagaaaaaaaaaaaacaggaaaaaaagaaccaua

SEQ ID NO: 32106 - RNA, 64 nt, hsa
uuuugcagcgaagagaaaugaagaaaaacugaagaaaaaaaaaaaacaggaaaaaaagaaccau

SEQ ID NO: 32107 - RNA, 64 nt, hsa
uauaaaaaauaaaacaaaaacccaccaucacaaaaaaaaaaauuuugcagcgaagagaaaugaa

SEQ ID NO: 32108 - RNA, 64 nt, hsa
uuauaaaaaauaaaacaaaaacccaccaucacaaaaaaaaaaauuuugcagcgaagagaaauga

SEQ ID NO: 32109 - RNA, 64 nt, hsa
uuuauaaaaaauaaaacaaaaacccaccaucacaaaaaaaaaaauuuugcagcgaagagaaaug

SEQ ID NO: 32110 - RNA, 64 nt, hsa
uuuuauaaaaaauaaaacaaaaacccaccaucacaaaaaaaaaaauuuugcagcgaagagaaau

SEQ ID NO: 32111 - RNA, 64 nt, hsa
cuggggugauagaacaagacccugucucaaaaaaaaaaaaaacaacaaaaacuuagaauugagg

SEQ ID NO: 32112 - RNA, 64 nt, hsa
ccuggggugauagaacaagacccugucucaaaaaaaaaaaaaacaacaaaaacuuagaauugag

SEQ ID NO: 32113 - RNA, 64 nt, hsa
gccuggggugauagaacaagacccugucucaaaaaaaaaaaaaacaacaaaaacuuagaauuga

SEQ ID NO: 32114 - RNA, 64 nt, hsa
agccuggggugauagaacaagacccugucucaaaaaaaaaaaaaacaacaaaaacuuagaauug

SEQ ID NO: 32115 - RNA, 64 nt, hsa
cagccuggggugauagaacaagacccugucucaaaaaaaaaaaaaacaacaaaaacuuagaauu

SEQ ID NO: 32116 - RNA, 64 nt, hsa
ccagccuggggugauagaacaagacccugucucaaaaaaaaaaaaaacaacaaaaacuuagaau

SEQ ID NO: 32117 - RNA, 64 nt, hsa
uccagccuggggugauagaacaagacccugucucaaaaaaaaaaaaaacaacaaaaacuuagaa

SEQ ID NO: 32118 - RNA, 64 nt, hsa
ugggcgacagagcaagacuccauuucaaaaaaaaaaaaaaaauccacucauauaaaaggugagc

SEQ ID NO: 32119 - RNA, 64 nt, hsa
cugggcgacagagcaagacuccauuucaaaaaaaaaaaaaaaauccacucauauaaaaggugag

SEQ ID NO: 32120 - RNA, 64 nt, hsa
ccugggcgacagagcaagacuccauuucaaaaaaaaaaaaaaaauccacucauauaaaagguga

SEQ ID NO: 32121 - RNA, 64 nt, hsa
gccugggcgacagagcaagacuccauuucaaaaaaaaaaaaaaaauccacucauauaaaaggug

SEQ ID NO: 32122 - RNA, 64 nt, hsa
agccugggcgacagagcaagacuccauuucaaaaaaaaaaaaaaaauccacucauauaaaaggu

SEQ ID NO: 32123 - RNA, 64 nt, hsa
cagccugggcgacagagcaagacuccauuucaaaaaaaaaaaaaaaauccacucauauaaaagg

SEQ ID NO: 32124 - RNA, 64 nt, hsa
ccagccugggcgacagagcaagacuccauuucaaaaaaaaaaaaaaaauccacucauauaaaag

SEQ ID NO: 32125 - RNA, 64 nt, hsa
uccagccugggcgacagagcaagacuccauuucaaaaaaaaaaaaaaaauccacucauauaaaa

SEQ ID NO: 32126 - RNA, 64 nt, hsa
cuccagccugggcgacagagcaagacuccauuucaaaaaaaaaaaaaaaauccacucauauaaa

SEQ ID NO: 32127 - RNA, 64 nt, hsa
ggaagcaggaccaguaagggaccuucgauuaaaaaaaaaaaagacaauaauaaaaaggcucauu

SEQ ID NO: 32128 - RNA, 64 nt, hsa
uggaagcaggaccaguaagggaccuucgauuaaaaaaaaaaaagacaauaauaaaaaggcucau

SEQ ID NO: 32129 - RNA, 64 nt, hsa
auggaagcaggaccaguaagggaccuucgauuaaaaaaaaaaaagacaauaauaaaaaggcuca

SEQ ID NO: 32130 - RNA, 64 nt, hsa
cauggaagcaggaccaguaagggaccuucgauuaaaaaaaaaaaagacaauaauaaaaaggcuc

SEQ ID NO: 32131 - RNA, 64 nt, hsa
ucauggaagcaggaccaguaagggaccuucgauuaaaaaaaaaaaagacaauaauaaaaaggcu

SEQ ID NO: 32132 - RNA, 64 nt, hsa
uugguugggagucagauugguuucuuaaaaaaaaaaaaaaaaugacauacgugacagcucacuu

SEQ ID NO: 32133 - RNA, 64 nt, hsa
auugguugggagucagauugguuucuuaaaaaaaaaaaaaaaaugacauacgugacagcucacu

SEQ ID NO: 32134 - RNA, 64 nt, hsa
cauugguugggagucagauugguuucuuaaaaaaaaaaaaaaaaugacauacgugacagcucac

SEQ ID NO: 32135 - RNA, 64 nt, hsa
ccauugguugggagucagauugguuucuuaaaaaaaaaaaaaaaaugacauacgugacagcuca

SEQ ID NO: 32136 - RNA, 64 nt, hsa
accauugguugggagucagauugguuucuuaaaaaaaaaaaaaaaaugacauacgugacagcuc

SEQ ID NO: 32137 - RNA, 64 nt, hsa
aaccauugguugggagucagauugguuucuuaaaaaaaaaaaaaaaaugacauacgugacagcu

SEQ ID NO: 32138 - RNA, 64 nt, hsa
aaaccauugguugggagucagauugguuucuuaaaaaaaaaaaaaaaaugacauacgugacagc

SEQ ID NO: 32139 - RNA, 64 nt, hsa
caaaccauugguugggagucagauugguuucuuaaaaaaaaaaaaaaaaugacauacgugacag

SEQ ID NO: 32140 - RNA, 64 nt, hsa
gcaaaccauugguugggagucagauugguuucuuaaaaaaaaaaaaaaaaugacauacgugaca

SEQ ID NO: 32141 - RNA, 64 nt, hsa
uugugcuuuuauucuuuuuagacuuuauaaaaaaaaaaaaaagcuccuguaauuugcacuuucu

SEQ ID NO: 32142 - RNA, 64 nt, hsa
uuugugcuuuuauucuuuuuagacuuuauaaaaaaaaaaaaaagcuccuguaauuugcacuuuc

SEQ ID NO: 32143 - RNA, 64 nt, hsa
uuuugugcuuuuauucuuuuuagacuuuauaaaaaaaaaaaaaagcuccuguaauuugcacuuu

SEQ ID NO: 32144 - RNA, 64 nt, hsa
cuuuugugcuuuuauucuuuuuagacuuuauaaaaaaaaaaaaaagcuccuguaauuugcacuu

SEQ ID NO: 32145 - RNA, 64 nt, hsa
acuuuugugcuuuuauucuuuuuagacuuuauaaaaaaaaaaaaaagcuccuguaauuugcacu

SEQ ID NO: 32146 - RNA, 64 nt, hsa
uacuuuugugcuuuuauucuuuuuagacuuuauaaaaaaaaaaaaaagcuccuguaauuugcac

SEQ ID NO: 32147 - RNA, 64 nt, hsa
uuacuuuugugcuuuuauucuuuuuagacuuuauaaaaaaaaaaaaaagcuccuguaauuugca

SEQ ID NO: 32148 - RNA, 64 nt, hsa
ccuuugugccacuucagugcuagaaaguuaaagaaaaaaaaacuuuugugauuuaauaauacua

SEQ ID NO: 32149 - RNA, 64 nt, hsa
gccuuugugccacuucagugcuagaaaguuaaagaaaaaaaaacuuuugugauuuaauaauacu

SEQ ID NO: 32150 - RNA, 64 nt, hsa
uuguacagauaguuuauaagcacaauauuuuaagaaaaaaaaguggcuggucuacuaggcagcc

SEQ ID NO: 32151 - RNA, 64 nt, hsa
ggaugacagagugagaccuuaucucaaaaaaaaaaaaaaaaagagagagagagagaaaaagaaa

SEQ ID NO: 32152 - RNA, 64 nt, hsa
uggaugacagagugagaccuuaucucaaaaaaaaaaaaaaaaagagagagagagagaaaaagaa

SEQ ID NO: 32153 - RNA, 64 nt, hsa
cuggaugacagagugagaccuuaucucaaaaaaaaaaaaaaaaagagagagagagagaaaaaga

SEQ ID NO: 32154 - RNA, 64 nt, hsa
ccuggaugacagagugagaccuuaucucaaaaaaaaaaaaaaaaagagagagagagagaaaaag

SEQ ID NO: 32155 - RNA, 64 nt, hsa
gccuggaugacagagugagaccuuaucucaaaaaaaaaaaaaaaaagagagagagagagaaaaa

SEQ ID NO: 32156 - RNA, 64 nt, hsa
agccuggaugacagagugagaccuuaucucaaaaaaaaaaaaaaaaagagagagagagagaaaa

SEQ ID NO: 32157 - RNA, 64 nt, hsa
aagccuggaugacagagugagaccuuaucucaaaaaaaaaaaaaaaaagagagagagagagaaa

SEQ ID NO: 32158 - RNA, 64 nt, hsa
gaagccuggaugacagagugagaccuuaucucaaaaaaaaaaaaaaaaagagagagagagagaa

SEQ ID NO: 32159 - RNA, 64 nt, hsa
ugaagccuggaugacagagugagaccuuaucucaaaaaaaaaaaaaaaaagagagagagagaga

SEQ ID NO: 32160 - RNA, 64 nt, hsa
cugaagccuggaugacagagugagaccuuaucucaaaaaaaaaaaaaaaaagagagagagagag

SEQ ID NO: 32161 - RNA, 64 nt, hsa
gccugggcaacagagggagacuccaucucaaaaaaaaaaaaagucacuuuuggcuaaucaugca

SEQ ID NO: 32162 - RNA, 64 nt, hsa
agccugggcaacagagggagacuccaucucaaaaaaaaaaaaagucacuuuuggcuaaucaugc

SEQ ID NO: 32163 - RNA, 64 nt, hsa
cagccugggcaacagagggagacuccaucucaaaaaaaaaaaaagucacuuuuggcuaaucaug

SEQ ID NO: 32164 - RNA, 64 nt, hsa
ccagccugggcaacagagggagacuccaucucaaaaaaaaaaaaagucacuuuuggcuaaucau

SEQ ID NO: 32165 - RNA, 64 nt, hsa
uccagccugggcaacagagggagacuccaucucaaaaaaaaaaaaagucacuuuuggcuaauca

SEQ ID NO: 32166 - RNA, 64 nt, hsa
cuccagccugggcaacagagggagacuccaucucaaaaaaaaaaaaagucacuuuuggcuaauc

SEQ ID NO: 32167 - RNA, 64 nt, hsa
uaucucguaauuguguauagcaugguaaaagaaaaaaaaaaagacagguaaauguuauauaauu

SEQ ID NO: 32168 - RNA, 64 nt, hsa
guaucucguaauuguguauagcaugguaaaagaaaaaaaaaaagacagguaaauguuauauaau

SEQ ID NO: 32169 - RNA, 64 nt, hsa
uguaucucguaauuguguauagcaugguaaaagaaaaaaaaaaagacagguaaauguuauauaa

SEQ ID NO: 32170 - RNA, 64 nt, hsa
cuguaucucguaauuguguauagcaugguaaaagaaaaaaaaaaagacagguaaauguuauaua

SEQ ID NO: 32171 - RNA, 64 nt, hsa
uccagccugggugacagagcaaggcucugucucaaaaaaaaacaaaaacaaaaacaaaaaagac

SEQ ID NO: 32172 - RNA, 64 nt, hsa
cuccagccugggugacagagcaaggcucugucucaaaaaaaaacaaaaacaaaaacaaaaaaga

SEQ ID NO: 32173 - RNA, 64 nt, hsa
guguuguaggaauuagucagggaguuguugugaaaaaaaaaaccccagugcuugugagggaacu

SEQ ID NO: 32174 - RNA, 64 nt, hsa
uguguuguaggaauuagucagggaguuguugugaaaaaaaaaaccccagugcuugugagggaac

SEQ ID NO: 32175 - RNA, 64 nt, hsa
uuguguuguaggaauuagucagggaguuguugugaaaaaaaaaaccccagugcuugugagggaa

SEQ ID NO: 32176 - RNA, 64 nt, hsa
ccuaaauuuuuguuauagcagaguuucuuguuuaaaaaaaaauaaaaucaucugaaaagcauuu

SEQ ID NO: 32177 - RNA, 64 nt, hsa
accuaaauuuuuguuauagcagaguuucuuguuuaaaaaaaaauaaaaucaucugaaaagcauu

SEQ ID NO: 32178 - RNA, 64 nt, hsa
acuccagccugggugacaaaggagaccccgucaaaaaaaaaaguacuugucccaaaaguuuuug

SEQ ID NO: 32179 - RNA, 64 nt, hsa
cacuccagccugggugacaaaggagaccccgucaaaaaaaaaaguacuugucccaaaaguuuuu

SEQ ID NO: 32180 - RNA, 64 nt, hsa
acacuccagccugggugacaaaggagaccccgucaaaaaaaaaaguacuugucccaaaaguuuu

SEQ ID NO: 32181 - RNA, 64 nt, hsa
gcagggaauggagacagacaucagugaugauaaaaaaaaaaauggaccuuaagaaacuauuuac

SEQ ID NO: 32182 - RNA, 64 nt, hsa
agcagggaauggagacagacaucagugaugauaaaaaaaaaaauggaccuuaagaaacuauuua

SEQ ID NO: 32183 - RNA, 64 nt, hsa
gagcagggaauggagacagacaucagugaugauaaaaaaaaaaauggaccuuaagaaacuauuu

SEQ ID NO: 32184 - RNA, 64 nt, hsa
ggagcagggaauggagacagacaucagugaugauaaaaaaaaaaauggaccuuaagaaacuauu

SEQ ID NO: 32185 - RNA, 64 nt, hsa
gaaugccaaaguaaacuuuauguacaguguaaaaaaaaaaaaucucaguuauguuuuuauuagc

SEQ ID NO: 32186 - RNA, 64 nt, hsa
ugaaugccaaaguaaacuuuauguacaguguaaaaaaaaaaaaucucaguuauguuuuuauuag

SEQ ID NO: 32187 - RNA, 64 nt, hsa
gugaaugccaaaguaaacuuuauguacaguguaaaaaaaaaaaaucucaguuauguuuuuauua

SEQ ID NO: 32188 - RNA, 64 nt, hsa
ugugaaugccaaaguaaacuuuauguacaguguaaaaaaaaaaaaucucaguuauguuuuuauu

SEQ ID NO: 32189 - RNA, 64 nt, hsa
cugugaaugccaaaguaaacuuuauguacaguguaaaaaaaaaaaaucucaguuauguuuuuau

SEQ ID NO: 32190 - RNA, 64 nt, hsa
aggaaaaaaggaauaaaguuuuuuuccuuaaaaaaaaaaaaauugcucuuggcugugaaaagag

SEQ ID NO: 32191 - RNA, 64 nt, hsa
uaggaaaaaaggaauaaaguuuuuuuccuuaaaaaaaaaaaaauugcucuuggcugugaaaaga

SEQ ID NO: 32192 - RNA, 64 nt, hsa
cuaggaaaaaaggaauaaaguuuuuuuccuuaaaaaaaaaaaaauugcucuuggcugugaaaag

SEQ ID NO: 32193 - RNA, 64 nt, hsa
ccuaggaaaaaaggaauaaaguuuuuuuccuuaaaaaaaaaaaaauugcucuuggcugugaaaa

SEQ ID NO: 32194 - RNA, 64 nt, hsa
uccuaggaaaaaaggaauaaaguuuuuuuccuuaaaaaaaaaaaaauugcucuuggcugugaaa

SEQ ID NO: 32195 - RNA, 64 nt, hsa
uuccuaggaaaaaaggaauaaaguuuuuuuccuuaaaaaaaaaaaaauugcucuuggcugugaa

SEQ ID NO: 32196 - RNA, 64 nt, hsa
caguauauuauagugauaauuuuguauuuucacaaaaaaaaaguuaaacucuucuuuucuuuuu

SEQ ID NO: 32197 - RNA, 64 nt, hsa
gcaguauauuauagugauaauuuuguauuuucacaaaaaaaaaguuaaacucuucuuuucuuuu

SEQ ID NO: 32198 - RNA, 64 nt, hsa
aaauauuuugcuuuggaccauauuucuuaagcauaaaaaaaaugcucaguuuugcuugcauucc

SEQ ID NO: 32199 - RNA, 64 nt, hsa
ucuagccugggccauagagcgagaguccaucucaaaaaaaaacaacuauuuuucacauaaucaa

SEQ ID NO: 32200 - RNA, 64 nt, hsa
cucuagccugggccauagagcgagaguccaucucaaaaaaaaacaacuauuuuucacauaauca

SEQ ID NO: 32201 - RNA, 64 nt, hsa
gggauguggguuuguacaaaaaaaaaaaaaaaaaaaaaaaaaccagcauacauaugcaaaacua

SEQ ID NO: 32202 - RNA, 64 nt, hsa
agggauguggguuuguacaaaaaaaaaaaaaaaaaaaaaaaaaccagcauacauaugcaaaacu

SEQ ID NO: 32203 - RNA, 64 nt, hsa
aagggauguggguuuguacaaaaaaaaaaaaaaaaaaaaaaaaaccagcauacauaugcaaaac

SEQ ID NO: 32204 - RNA, 64 nt, hsa
uaagggauguggguuuguacaaaaaaaaaaaaaaaaaaaaaaaaaccagcauacauaugcaaaa

SEQ ID NO: 32205 - RNA, 64 nt, hsa
guaagggauguggguuuguacaaaaaaaaaaaaaaaaaaaaaaaaaccagcauacauaugcaaa

SEQ ID NO: 32206 - RNA, 64 nt, hsa
aguaagggauguggguuuguacaaaaaaaaaaaaaaaaaaaaaaaaaccagcauacauaugcaa

SEQ ID NO: 32207 - RNA, 64 nt, hsa
aaguaagggauguggguuuguacaaaaaaaaaaaaaaaaaaaaaaaaaccagcauacauaugca

SEQ ID NO: 32208 - RNA, 64 nt, hsa
aaaguaagggauguggguuuguacaaaaaaaaaaaaaaaaaaaaaaaaaccagcauacauaugc

SEQ ID NO: 32209 - RNA, 64 nt, hsa
aaaaguaagggauguggguuuguacaaaaaaaaaaaaaaaaaaaaaaaaaccagcauacauaug

SEQ ID NO: 32210 - RNA, 64 nt, hsa
uaaaaguaagggauguggguuuguacaaaaaaaaaaaaaaaaaaaaaaaaaccagcauacauau

SEQ ID NO: 32211 - RNA, 64 nt, hsa
uuaaaaguaagggauguggguuuguacaaaaaaaaaaaaaaaaaaaaaaaaaccagcauacaua

SEQ ID NO: 32212 - RNA, 64 nt, hsa
cuuaaaaguaagggauguggguuuguacaaaaaaaaaaaaaaaaaaaaaaaaaccagcauacau

SEQ ID NO: 32213 - RNA, 64 nt, hsa
ccuuaaaaguaagggauguggguuuguacaaaaaaaaaaaaaaaaaaaaaaaaaccagcauaca

SEQ ID NO: 32214 - RNA, 64 nt, hsa
cccuuaaaaguaagggauguggguuuguacaaaaaaaaaaaaaaaaaaaaaaaaaccagcauac

SEQ ID NO: 32215 - RNA, 64 nt, hsa
gcccuuaaaaguaagggauguggguuuguacaaaaaaaaaaaaaaaaaaaaaaaaaccagcaua

SEQ ID NO: 32216 - RNA, 64 nt, hsa
ugcccuuaaaaguaagggauguggguuuguacaaaaaaaaaaaaaaaaaaaaaaaaaccagcau

SEQ ID NO: 32217 - RNA, 64 nt, hsa
uugcccuuaaaaguaagggauguggguuuguacaaaaaaaaaaaaaaaaaaaaaaaaaccagca

SEQ ID NO: 32218 - RNA, 64 nt, hsa
uuugcccuuaaaaguaagggauguggguuuguacaaaaaaaaaaaaaaaaaaaaaaaaaccagc

SEQ ID NO: 32219 - RNA, 64 nt, hsa
gacugggaaggcuugggauuugcuguguaaaaaaaaaaaaaauguucuuuggaaaguacacucu

SEQ ID NO: 32220 - RNA, 64 nt, hsa
agacugggaaggcuugggauuugcuguguaaaaaaaaaaaaaauguucuuuggaaaguacacuc

SEQ ID NO: 32221 - RNA, 64 nt, hsa
gagacugggaaggcuugggauuugcuguguaaaaaaaaaaaaaauguucuuuggaaaguacacu

SEQ ID NO: 32222 - RNA, 64 nt, hsa
ugagacugggaaggcuugggauuugcuguguaaaaaaaaaaaaaauguucuuuggaaaguacac

SEQ ID NO: 32223 - RNA, 64 nt, hsa
gugagacugggaaggcuugggauuugcuguguaaaaaaaaaaaaaauguucuuuggaaaguaca

SEQ ID NO: 32224 - RNA, 64 nt, hsa
ugugagacugggaaggcuugggauuugcuguguaaaaaaaaaaaaaauguucuuuggaaaguac

SEQ ID NO: 32225 - RNA, 64 nt, hsa
gugugagacugggaaggcuugggauuugcuguguaaaaaaaaaaaaaauguucuuuggaaagua

SEQ ID NO: 32226 - RNA, 64 nt, hsa
cuuucucauuuuauguugaacuaaaaaggauuaaaaaaaaaaucuccagacucaaguugcuaag

SEQ ID NO: 32227 - RNA, 64 nt, hsa
ucuuucucauuuuauguugaacuaaaaaggauuaaaaaaaaaaucuccagacucaaguugcuaa

SEQ ID NO: 32228 - RNA, 64 nt, hsa
uucuuucucauuuuauguugaacuaaaaaggauuaaaaaaaaaaucuccagacucaaguugcua

SEQ ID NO: 32229 - RNA, 64 nt, hsa
ccuacuaaccgugccaucuugcaaacuacacuuuaaaaaaaacucauugcuuuguauuguagua

SEQ ID NO: 32230 - RNA, 64 nt, hsa
uaguaccuguaagcauuuuaggucccagaauggaaaaaaaaaucagcuauugguaauauaauaa

SEQ ID NO: 32231 - RNA, 64 nt, hsa
cuaguaccuguaagcauuuuaggucccagaauggaaaaaaaaaucagcuauugguaauauaaua

SEQ ID NO: 32232 - RNA, 64 nt, hsa
uccuuccugccccaaaauuauaaacucuaaguguaaaaaaaagucuuaacaacagcuucuugcu

SEQ ID NO: 32233 - RNA, 64 nt, hsa
uaacauuggugcaaagauugccucuugaauuaaaaaaaaaaacuagauugacuauuuauacaaa

SEQ ID NO: 32234 - RNA, 64 nt, hsa
cuaacauuggugcaaagauugccucuugaauuaaaaaaaaaaacuagauugacuauuuauacaa

SEQ ID NO: 32235 - RNA, 64 nt, hsa
ccuaacauuggugcaaagauugccucuugaauuaaaaaaaaaaacuagauugacuauuuauaca

SEQ ID NO: 32236 - RNA, 64 nt, hsa
gccuaacauuggugcaaagauugccucuugaauuaaaaaaaaaaacuagauugacuauuuauac

SEQ ID NO: 32237 - RNA, 64 nt, hsa
uagagagacuccaucucaaaaaaaaaaaaaaaaaaaaaaaaaggcaauugugcggagccaacca

SEQ ID NO: 32238 - RNA, 64 nt, hsa
auagagagacuccaucucaaaaaaaaaaaaaaaaaaaaaaaaaggcaauugugcggagccaacc

SEQ ID NO: 32239 - RNA, 64 nt, hsa
cauagagagacuccaucucaaaaaaaaaaaaaaaaaaaaaaaaaggcaauugugcggagccaac

SEQ ID NO: 32240 - RNA, 64 nt, hsa
acauagagagacuccaucucaaaaaaaaaaaaaaaaaaaaaaaaaggcaauugugcggagccaa

SEQ ID NO: 32241 - RNA, 64 nt, hsa
gacauagagagacuccaucucaaaaaaaaaaaaaaaaaaaaaaaaaggcaauugugcggagcca

SEQ ID NO: 32242 - RNA, 64 nt, hsa
ugacauagagagacuccaucucaaaaaaaaaaaaaaaaaaaaaaaaaggcaauugugcggagcc

SEQ ID NO: 32243 - RNA, 64 nt, hsa
gugacauagagagacuccaucucaaaaaaaaaaaaaaaaaaaaaaaaaggcaauugugcggagc

SEQ ID NO: 32244 - RNA, 64 nt, hsa
ggugacauagagagacuccaucucaaaaaaaaaaaaaaaaaaaaaaaaaggcaauugugcggag

SEQ ID NO: 32245 - RNA, 64 nt, hsa
gggugacauagagagacuccaucucaaaaaaaaaaaaaaaaaaaaaaaaaggcaauugugcgga

SEQ ID NO: 32246 - RNA, 64 nt, hsa
ugggugacauagagagacuccaucucaaaaaaaaaaaaaaaaaaaaaaaaaggcaauugugcgg

SEQ ID NO: 32247 - RNA, 64 nt, hsa
cugggugacauagagagacuccaucucaaaaaaaaaaaaaaaaaaaaaaaaaggcaauugugcg

SEQ ID NO: 32248 - RNA, 64 nt, hsa
ccugggugacauagagagacuccaucucaaaaaaaaaaaaaaaaaaaaaaaaaggcaauugugc

SEQ ID NO: 32249 - RNA, 64 nt, hsa
gccugggugacauagagagacuccaucucaaaaaaaaaaaaaaaaaaaaaaaaaggcaauugug

SEQ ID NO: 32250 - RNA, 64 nt, hsa
agccugggugacauagagagacuccaucucaaaaaaaaaaaaaaaaaaaaaaaaaggcaauugu

SEQ ID NO: 32251 - RNA, 64 nt, hsa
cagccugggugacauagagagacuccaucucaaaaaaaaaaaaaaaaaaaaaaaaaggcaauug

SEQ ID NO: 32252 - RNA, 64 nt, hsa
ucagccugggugacauagagagacuccaucucaaaaaaaaaaaaaaaaaaaaaaaaaggcaauu

SEQ ID NO: 32253 - RNA, 64 nt, hsa
uucagccugggugacauagagagacuccaucucaaaaaaaaaaaaaaaaaaaaaaaaaggcaau

SEQ ID NO: 32254 - RNA, 64 nt, hsa
auucagccugggugacauagagagacuccaucucaaaaaaaaaaaaaaaaaaaaaaaaaggcaa

SEQ ID NO: 32255 - RNA, 64 nt, hsa
gcuguauuucuguguuuugauagaagucacacaaaaaaaaaaggauaaaagaaacccuuccccc

SEQ ID NO: 32256 - RNA, 64 nt, hsa
ugcuguauuucuguguuuugauagaagucacacaaaaaaaaaaggauaaaagaaacccuucccc

SEQ ID NO: 32257 - RNA, 64 nt, hsa
gugcuguauuucuguguuuugauagaagucacacaaaaaaaaaaggauaaaagaaacccuuccc

SEQ ID NO: 32258 - RNA, 64 nt, hsa
gccugggcaacacagcgagacuccgucucgaggaaaaaaaaagaaaagauacgugccugcggug

SEQ ID NO: 32259 - RNA, 64 nt, hsa
agccugggcaacacagcgagacuccgucucgaggaaaaaaaaagaaaagauacgugccugcggu

SEQ ID NO: 32260 - RNA, 64 nt, hsa
aacacggugaaacccugucucuacuaaaaauacaaaaaaaaauuagcuaggcguagugguuggc

SEQ ID NO: 32261 - RNA, 64 nt, hsa
uaacacggugaaacccugucucuacuaaaaauacaaaaaaaaauuagcuaggcguagugguugg

SEQ ID NO: 32262 - RNA, 64 nt, hsa
aacugagcaucuccagcauucucagccacaaccaaaaaaaaauaaaaagggcagcccuccuuac

SEQ ID NO: 32263 - RNA, 64 nt, hsa
gaacugagcaucuccagcauucucagccacaaccaaaaaaaaauaaaaagggcagcccuccuua

SEQ ID NO: 32264 - RNA, 64 nt, hsa
gaggcugaaaguaaagccacaugacaagcauauaaaaaaaaaugcagaugauacaaauaugaaa

SEQ ID NO: 32265 - RNA, 64 nt, hsa
ugaggcugaaaguaaagccacaugacaagcauauaaaaaaaaaugcagaugauacaaauaugaa

SEQ ID NO: 32266 - RNA, 64 nt, hsa
uacuaggaauucagaugaucagcucuuaaaagaaaaaaaaaagcaaaaagacuaaagcccuauu

SEQ ID NO: 32267 - RNA, 64 nt, hsa
guacuaggaauucagaugaucagcucuuaaaagaaaaaaaaaagcaaaaagacuaaagcccuau

SEQ ID NO: 32268 - RNA, 64 nt, hsa
aguacuaggaauucagaugaucagcucuuaaaagaaaaaaaaaagcaaaaagacuaaagcccua

SEQ ID NO: 32269 - RNA, 64 nt, hsa
accaccuaaugguagguggacagaaaaggaaaaaaaaaaaaauuuacuugcaaguacuaggaau

SEQ ID NO: 32270 - RNA, 64 nt, hsa
aaccaccuaaugguagguggacagaaaaggaaaaaaaaaaaaauuuacuugcaaguacuaggaa

SEQ ID NO: 32271 - RNA, 64 nt, hsa
gaaccaccuaaugguagguggacagaaaaggaaaaaaaaaaaaauuuacuugcaaguacuagga

SEQ ID NO: 32272 - RNA, 64 nt, hsa
ggaaccaccuaaugguagguggacagaaaaggaaaaaaaaaaaaauuuacuugcaaguacuagg

SEQ ID NO: 32273 - RNA, 64 nt, hsa
aggaaccaccuaaugguagguggacagaaaaggaaaaaaaaaaaaauuuacuugcaaguacuag

SEQ ID NO: 32274 - RNA, 64 nt, hsa
uaggaaccaccuaaugguagguggacagaaaaggaaaaaaaaaaaaauuuacuugcaaguacua

SEQ ID NO: 32275 - RNA, 64 nt, hsa
gagauguagcgauguaagugucgauguuuuuuuaaaaaaaaaugcaaaaaaauucuuauggcgg

SEQ ID NO: 32276 - RNA, 64 nt, hsa
agagauguagcgauguaagugucgauguuuuuuuaaaaaaaaaugcaaaaaaauucuuauggcg

SEQ ID NO: 32277 - RNA, 64 nt, hsa
aggggaauuaugugugugaaugucaucuacaauuaaaaaaaauuagcacaucccuuuacuuacu

SEQ ID NO: 32278 - RNA, 64 nt, hsa
uaaucuuuuuaaaaaagguuuaaacuuuuuuuaaaaaaaaaaucuuuaaacuggccuuuauuac

SEQ ID NO: 32279 - RNA, 64 nt, hsa
uuaaucuuuuuaaaaaagguuuaaacuuuuuuuaaaaaaaaaaucuuuaaacuggccuuuauua

SEQ ID NO: 32280 - RNA, 64 nt, hsa
uuuaaucuuuuuaaaaaagguuuaaacuuuuuuuaaaaaaaaaaucuuuaaacuggccuuuauu

SEQ ID NO: 32281 - RNA, 64 nt, hsa
uuaaaaauuuucuaaauauuaauacuaacugggaaaaaaaaacuagugugaaguuuacaguuag

SEQ ID NO: 32282 - RNA, 64 nt, hsa
auuaaaaauuuucuaaauauuaauacuaacugggaaaaaaaaacuagugugaaguuuacaguua

SEQ ID NO: 32283 - RNA, 64 nt, hsa
agagagauggcaguauugaccauuuaguuuaguuaaaaaaaaaaaaaaaaagguggcaggagag

SEQ ID NO: 32284 - RNA, 64 nt, hsa
gagagauggcaguauugaccauuuaguuuaguuaaaaaaaaaaaaaaaaagguggcaggagagg

SEQ ID NO: 32285 - RNA, 64 nt, hsa
agagauggcaguauugaccauuuaguuuaguuaaaaaaaaaaaaaaaaagguggcaggagaggc

SEQ ID NO: 32286 - RNA, 64 nt, hsa
gagauggcaguauugaccauuuaguuuaguuaaaaaaaaaaaaaaaaagguggcaggagaggcu

SEQ ID NO: 32287 - RNA, 64 nt, hsa
agauggcaguauugaccauuuaguuuaguuaaaaaaaaaaaaaaaaagguggcaggagaggcuu

SEQ ID NO: 32288 - RNA, 64 nt, hsa
gauggcaguauugaccauuuaguuuaguuaaaaaaaaaaaaaaaaagguggcaggagaggcuuu

SEQ ID NO: 32289 - RNA, 64 nt, hsa
auggcaguauugaccauuuaguuuaguuaaaaaaaaaaaaaaaaagguggcaggagaggcuuug

SEQ ID NO: 32290 - RNA, 64 nt, hsa
uggcaguauugaccauuuaguuuaguuaaaaaaaaaaaaaaaaagguggcaggagaggcuuugg

SEQ ID NO: 32291 - RNA, 64 nt, hsa
ggcaguauugaccauuuaguuuaguuaaaaaaaaaaaaaaaaagguggcaggagaggcuuuggg

SEQ ID NO: 32292 - RNA, 64 nt, hsa
gcaguauugaccauuuaguuuaguuaaaaaaaaaaaaaaaaagguggcaggagaggcuuugggg

SEQ ID NO: 32293 - RNA, 64 nt, hsa
uuguuuuuguucuuuguguuuuagggugaaacuuaaaaaaaaaauucugcccccaccuagauca

SEQ ID NO: 32294 - RNA, 64 nt, hsa
uguuuuuguucuuuguguuuuagggugaaacuuaaaaaaaaaauucugcccccaccuagaucau

SEQ ID NO: 32295 - RNA, 64 nt, hsa
guuuuuguucuuuguguuuuagggugaaacuuaaaaaaaaaauucugcccccaccuagaucaua

SEQ ID NO: 32296 - RNA, 64 nt, hsa
ucccuuguaaaauauuugucugucucuuuuuuuuaaaaaaaaaaaaggccgggcacuguggcuc

SEQ ID NO: 32297 - RNA, 64 nt, hsa
cccuuguaaaauauuugucugucucuuuuuuuuaaaaaaaaaaaaggccgggcacuguggcuca

SEQ ID NO: 32298 - RNA, 64 nt, hsa
ccuuguaaaauauuugucugucucuuuuuuuuaaaaaaaaaaaaggccgggcacuguggcucac

SEQ ID NO: 32299 - RNA, 64 nt, hsa
cuuguaaaauauuugucugucucuuuuuuuuaaaaaaaaaaaaggccgggcacuguggcucacg

SEQ ID NO: 32300 - RNA, 64 nt, hsa
uuguaaaauauuugucugucucuuuuuuuuaaaaaaaaaaaaggccgggcacuguggcucacgc

SEQ ID NO: 32301 - RNA, 64 nt, hsa
uugguggggaagggaaggguauauagauuguauuaaaaaaaaaaagguauauaugcauauaucu

SEQ ID NO: 32302 - RNA, 64 nt, hsa
ugguggggaagggaaggguauauagauuguauuaaaaaaaaaaagguauauaugcauauaucua

SEQ ID NO: 32303 - RNA, 64 nt, hsa
gguggggaagggaaggguauauagauuguauuaaaaaaaaaaagguauauaugcauauaucuau

SEQ ID NO: 32304 - RNA, 64 nt, hsa
guggggaagggaaggguauauagauuguauuaaaaaaaaaaagguauauaugcauauaucuaua

SEQ ID NO: 32305 - RNA, 64 nt, hsa
uuguugucauuguuuuuuugcaugcuuucuuaauaaaaaaaaaaaaagaauguuuacaguuuua

SEQ ID NO: 32306 - RNA, 64 nt, hsa
uguugucauuguuuuuuugcaugcuuucuuaauaaaaaaaaaaaaagaauguuuacaguuuuau

SEQ ID NO: 32307 - RNA, 64 nt, hsa
guugucauuguuuuuuugcaugcuuucuuaauaaaaaaaaaaaaagaauguuuacaguuuuauc

SEQ ID NO: 32308 - RNA, 64 nt, hsa
uugucauuguuuuuuugcaugcuuucuuaauaaaaaaaaaaaaagaauguuuacaguuuuaucu

SEQ ID NO: 32309 - RNA, 64 nt, hsa
ugucauuguuuuuuugcaugcuuucuuaauaaaaaaaaaaaaagaauguuuacaguuuuaucuu

SEQ ID NO: 32310 - RNA, 64 nt, hsa
gucauuguuuuuuugcaugcuuucuuaauaaaaaaaaaaaaagaauguuuacaguuuuaucuua

SEQ ID NO: 32311 - RNA, 64 nt, hsa
uccagccugggagauagagcaagacuccaucucuaaaaaaaaaaaaaaaugcuaaugugagaau

SEQ ID NO: 32312 - RNA, 64 nt, hsa
ccagccugggagauagagcaagacuccaucucuaaaaaaaaaaaaaaaugcuaaugugagaaua

SEQ ID NO: 32313 - RNA, 64 nt, hsa
cagccugggagauagagcaagacuccaucucuaaaaaaaaaaaaaaaugcuaaugugagaauau

SEQ ID NO: 32314 - RNA, 64 nt, hsa
agccugggagauagagcaagacuccaucucuaaaaaaaaaaaaaaaugcuaaugugagaauaua

SEQ ID NO: 32315 - RNA, 64 nt, hsa
gccugggagauagagcaagacuccaucucuaaaaaaaaaaaaaaaugcuaaugugagaauauaa

SEQ ID NO: 32316 - RNA, 64 nt, hsa
ccugggagauagagcaagacuccaucucuaaaaaaaaaaaaaaaugcuaaugugagaauauaaa

SEQ ID NO: 32317 - RNA, 64 nt, hsa
cugggagauagagcaagacuccaucucuaaaaaaaaaaaaaaaugcuaaugugagaauauaaau

SEQ ID NO: 32318 - RNA, 64 nt, hsa
ugggagauagagcaagacuccaucucuaaaaaaaaaaaaaaaugcuaaugugagaauauaaauu

SEQ ID NO: 32319 - RNA, 64 nt, hsa
aauugaugacuuuauaaugcaaccaggaguauugaaaaaaaaguaagcaaugagcucaaauaau

SEQ ID NO: 32320 - RNA, 64 nt, hsa
augcugaaaagaagagaaauaccccaaguucuugaaaaaaaauuuuuugauaugacuacucuaa

SEQ ID NO: 32321 - RNA, 64 nt, hsa
cauuauuuguuuuggauaaugaagucagcagaggaaaaaaaaauaugaccaucucaaaagaugc

SEQ ID NO: 32322 - RNA, 64 nt, hsa
auuauuuguuuuggauaaugaagucagcagaggaaaaaaaaauaugaccaucucaaaagaugcc

SEQ ID NO: 32323 - RNA, 64 nt, hsa
caggucuguuccuguuacuguugggucuuggcugaaaaaaaaaaaugcuuuuaaaaaagauaaa

SEQ ID NO: 32324 - RNA, 64 nt, hsa
aggucuguuccuguuacuguugggucuuggcugaaaaaaaaaaaugcuuuuaaaaaagauaaaa

SEQ ID NO: 32325 - RNA, 64 nt, hsa
ggucuguuccuguuacuguugggucuuggcugaaaaaaaaaaaugcuuuuaaaaaagauaaaau

SEQ ID NO: 32326 - RNA, 64 nt, hsa
gucuguuccuguuacuguugggucuuggcugaaaaaaaaaaaugcuuuuaaaaaagauaaaaug

SEQ ID NO: 32327 - RNA, 64 nt, hsa
acacacacacacauacacaaauauuccaggauacaaaaaaaaacauuuaaaaauccgagaccca

SEQ ID NO: 32328 - RNA, 64 nt, hsa
cacacacacacauacacaaauauuccaggauacaaaaaaaaacauuuaaaaauccgagacccag

SEQ ID NO: 32329 - RNA, 64 nt, hsa
gcuuaaacacaaauguuacugcuuaucuuuucuuaaaaaaaaaaaaaacaaaguguagguauuu

SEQ ID NO: 32330 - RNA, 64 nt, hsa
cuuaaacacaaauguuacugcuuaucuuuucuuaaaaaaaaaaaaaacaaaguguagguauuuu

SEQ ID NO: 32331 - RNA, 64 nt, hsa
uuaaacacaaauguuacugcuuaucuuuucuuaaaaaaaaaaaaaacaaaguguagguauuuug

SEQ ID NO: 32332 - RNA, 64 nt, hsa
uaaacacaaauguuacugcuuaucuuuucuuaaaaaaaaaaaaaacaaaguguagguauuuuga

SEQ ID NO: 32333 - RNA, 64 nt, hsa
aaacacaaauguuacugcuuaucuuuucuuaaaaaaaaaaaaaacaaaguguagguauuuugaa

SEQ ID NO: 32334 - RNA, 64 nt, hsa
aacacaaauguuacugcuuaucuuuucuuaaaaaaaaaaaaaacaaaguguagguauuuugaag

SEQ ID NO: 32335 - RNA, 64 nt, hsa
acacaaauguuacugcuuaucuuuucuuaaaaaaaaaaaaaacaaaguguagguauuuugaagu

SEQ ID NO: 32336 - RNA, 64 nt, hsa
uaaacugacugugguuucuuaagaacaugacacuaaaaaaaaaguguuuuuuuuccaccguugc

SEQ ID NO: 32337 - RNA, 64 nt, hsa
aaacugacugugguuucuuaagaacaugacacuaaaaaaaaaguguuuuuuuuccaccguugcu

SEQ ID NO: 32338 - RNA, 64 nt, hsa
cuccagccuggguaacagagugagacuccaucucaaaaaaaaaaaaaauagauauuuuuccaaa

SEQ ID NO: 32339 - RNA, 64 nt, hsa
uccagccuggguaacagagugagacuccaucucaaaaaaaaaaaaaauagauauuuuuccaaag

SEQ ID NO: 32340 - RNA, 64 nt, hsa
ccagccuggguaacagagugagacuccaucucaaaaaaaaaaaaaauagauauuuuuccaaaga

SEQ ID NO: 32341 - RNA, 64 nt, hsa
cagccuggguaacagagugagacuccaucucaaaaaaaaaaaaaauagauauuuuuccaaagaa

SEQ ID NO: 32342 - RNA, 64 nt, hsa
agccuggguaacagagugagacuccaucucaaaaaaaaaaaaaauagauauuuuuccaaagaag

SEQ ID NO: 32343 - RNA, 64 nt, hsa
gccuggguaacagagugagacuccaucucaaaaaaaaaaaaaauagauauuuuuccaaagaaga

SEQ ID NO: 32344 - RNA, 64 nt, hsa
ccuggguaacagagugagacuccaucucaaaaaaaaaaaaaauagauauuuuuccaaagaagac

SEQ ID NO: 32345 - RNA, 64 nt, hsa
aaguagcacauggaguagcugagguuaaacaaacaaaaaaaaauuuuaaacaaagaaaggaaaa

SEQ ID NO: 32346 - RNA, 64 nt, hsa
aguagcacauggaguagcugagguuaaacaaacaaaaaaaaauuuuaaacaaagaaaggaaaaa

SEQ ID NO: 32347 - RNA, 64 nt, hsa
agauucuuucuucugaaagccaagcaccacaaggaaaaaaaaaauuauuaauagcucagguuaa

SEQ ID NO: 32348 - RNA, 64 nt, hsa
gauucuuucuucugaaagccaagcaccacaaggaaaaaaaaaauuauuaauagcucagguuaaa

SEQ ID NO: 32349 - RNA, 64 nt, hsa
auucuuucuucugaaagccaagcaccacaaggaaaaaaaaaauuauuaauagcucagguuaaaa

SEQ ID NO: 32350 - RNA, 64 nt, hsa
ccuuuuuuuuuuccuuuaaguauucuugagauacaaaaaaaaaaaguaaauacaauuucaaaaa

SEQ ID NO: 32351 - RNA, 64 nt, hsa
cuuuuuuuuuuccuuuaaguauucuugagauacaaaaaaaaaaaguaaauacaauuucaaaaaa

SEQ ID NO: 32352 - RNA, 64 nt, hsa
uuuuuuuuuuccuuuaaguauucuugagauacaaaaaaaaaaaguaaauacaauuucaaaaaaa

SEQ ID NO: 32353 - RNA, 64 nt, hsa
uuuuuuuuuccuuuaaguauucuugagauacaaaaaaaaaaaguaaauacaauuucaaaaaaaa

SEQ ID NO: 32354 - RNA, 64 nt, hsa
uugagauacaaaaaaaaaaaguaaauacaauuucaaaaaaaaaguuccggaucuguuuuuaagc

SEQ ID NO: 32355 - RNA, 64 nt, hsa
ugagauacaaaaaaaaaaaguaaauacaauuucaaaaaaaaaguuccggaucuguuuuuaagcu

SEQ ID NO: 32356 - RNA, 64 nt, hsa
gcaugugccucacuuuaagaaaguccuguaggggaaaaaaaaaacugucagagcgaauucaugc

SEQ ID NO: 32357 - RNA, 64 nt, hsa
caugugccucacuuuaagaaaguccuguaggggaaaaaaaaaacugucagagcgaauucaugca

SEQ ID NO: 32358 - RNA, 64 nt, hsa
augugccucacuuuaagaaaguccuguaggggaaaaaaaaaacugucagagcgaauucaugcau

SEQ ID NO: 32359 - RNA, 64 nt, hsa
uccagccugggcgacagugcaagacucugucuccaaaaaaaaaaaaagaaaaaagaaaaucccc

SEQ ID NO: 32360 - RNA, 64 nt, hsa
ccagccugggcgacagugcaagacucugucuccaaaaaaaaaaaaagaaaaaagaaaauccccc

SEQ ID NO: 32361 - RNA, 64 nt, hsa
cagccugggcgacagugcaagacucugucuccaaaaaaaaaaaaagaaaaaagaaaaucccccu

SEQ ID NO: 32362 - RNA, 64 nt, hsa
agccugggcgacagugcaagacucugucuccaaaaaaaaaaaaagaaaaaagaaaaucccccuu

SEQ ID NO: 32363 - RNA, 64 nt, hsa
gccugggcgacagugcaagacucugucuccaaaaaaaaaaaaagaaaaaagaaaaucccccuuc

SEQ ID NO: 32364 - RNA, 64 nt, hsa
ccugggcgacagugcaagacucugucuccaaaaaaaaaaaaagaaaaaagaaaaucccccuuca

SEQ ID NO: 32365 - RNA, 64 nt, hsa
gaugagaccuaccuuccaguugucagcaagcaggaaaaaaaaauugggaccucaguugcaacca

SEQ ID NO: 32366 - RNA, 64 nt, hsa
augagaccuaccuuccaguugucagcaagcaggaaaaaaaaauugggaccucaguugcaaccac

SEQ ID NO: 32367 - RNA, 64 nt, hsa
guucucuguuuaaaaaaaucuaaaaagaaaaaggaaaaaaaaaaaagaacugcugugggauugu

SEQ ID NO: 32368 - RNA, 64 nt, hsa
uucucuguuuaaaaaaaucuaaaaagaaaaaggaaaaaaaaaaaagaacugcugugggauuguc

SEQ ID NO: 32369 - RNA, 64 nt, hsa
ucucuguuuaaaaaaaucuaaaaagaaaaaggaaaaaaaaaaaagaacugcugugggauuguca

SEQ ID NO: 32370 - RNA, 64 nt, hsa
cucuguuuaaaaaaaucuaaaaagaaaaaggaaaaaaaaaaaagaacugcugugggauugucaa

SEQ ID NO: 32371 - RNA, 64 nt, hsa
ucuguuuaaaaaaaucuaaaaagaaaaaggaaaaaaaaaaaagaacugcugugggauugucaac

SEQ ID NO: 32372 - RNA, 64 nt, hsa
aagucuaugagaaaguagcauuuaauuaaaguuuaaaaaaaaaaagguugggcguuguggcuca

SEQ ID NO: 32373 - RNA, 64 nt, hsa
agucuaugagaaaguagcauuuaauuaaaguuuaaaaaaaaaaagguugggcguuguggcucau

SEQ ID NO: 32374 - RNA, 64 nt, hsa
gucuaugagaaaguagcauuuaauuaaaguuuaaaaaaaaaaagguugggcguuguggcucaug

SEQ ID NO: 32375 - RNA, 64 nt, hsa
ucuaugagaaaguagcauuuaauuaaaguuuaaaaaaaaaaagguugggcguuguggcucaugc

SEQ ID NO: 32376 - RNA, 64 nt, hsa
ccccugccucuaccuguccccaaauuuuuauauuaaaaaaaaaaaauaaaauaaacuacuuugg

SEQ ID NO: 32377 - RNA, 64 nt, hsa
cccugccucuaccuguccccaaauuuuuauauuaaaaaaaaaaaauaaaauaaacuacuuugga

SEQ ID NO: 32378 - RNA, 64 nt, hsa
ccugccucuaccuguccccaaauuuuuauauuaaaaaaaaaaaauaaaauaaacuacuuuggaa

SEQ ID NO: 32379 - RNA, 64 nt, hsa
cugccucuaccuguccccaaauuuuuauauuaaaaaaaaaaaauaaaauaaacuacuuuggaac

SEQ ID NO: 32380 - RNA, 64 nt, hsa
ugccucuaccuguccccaaauuuuuauauuaaaaaaaaaaaauaaaauaaacuacuuuggaacc

SEQ ID NO: 32381 - RNA, 64 nt, hsa
accucucaaucuauuuguuuuuaaagaaaucccuaaaaaaaaaaauuauccaauugaacgcaca

SEQ ID NO: 32382 - RNA, 64 nt, hsa
ccucucaaucuauuuguuuuuaaagaaaucccuaaaaaaaaaaauuauccaauugaacgcacau

SEQ ID NO: 32383 - RNA, 64 nt, hsa
cucucaaucuauuuguuuuuaaagaaaucccuaaaaaaaaaaauuauccaauugaacgcacaua

SEQ ID NO: 32384 - RNA, 64 nt, hsa
ucucaaucuauuuguuuuuaaagaaaucccuaaaaaaaaaaauuauccaauugaacgcacauag

SEQ ID NO: 32385 - RNA, 64 nt, hsa
guuguaucuuuugcauguagcuuccuuaauggagaaaaaaaaaccuaauaaauuuccagaauca

SEQ ID NO: 32386 - RNA, 64 nt, hsa
uuguaucuuuugcauguagcuuccuuaauggagaaaaaaaaaccuaauaaauuuccagaaucau

SEQ ID NO: 32387 - RNA, 64 nt, hsa
cgggccuggggcgcucugcgugcagauuuuguacaaaaaaaaaaaagacacacacacauacaug

SEQ ID NO: 32388 - RNA, 64 nt, hsa
gggccuggggcgcucugcgugcagauuuuguacaaaaaaaaaaaagacacacacacauacauga

SEQ ID NO: 32389 - RNA, 64 nt, hsa
ggccuggggcgcucugcgugcagauuuuguacaaaaaaaaaaaagacacacacacauacaugau

SEQ ID NO: 32390 - RNA, 64 nt, hsa
gccuggggcgcucugcgugcagauuuuguacaaaaaaaaaaaagacacacacacauacaugaua

SEQ ID NO: 32391 - RNA, 64 nt, hsa
ccuggggcgcucugcgugcagauuuuguacaaaaaaaaaaaagacacacacacauacaugauaa

SEQ ID NO: 32392 - RNA, 64 nt, hsa
cuauaggagaaaaaaagagaaaaaaauaaaaaucaaaaaaaaaaaaaagaaagaaagaaaccuc

SEQ ID NO: 32393 - RNA, 64 nt, hsa
uauaggagaaaaaaagagaaaaaaauaaaaaucaaaaaaaaaaaaaagaaagaaagaaaccucc

SEQ ID NO: 32394 - RNA, 64 nt, hsa
auaggagaaaaaaagagaaaaaaauaaaaaucaaaaaaaaaaaaaagaaagaaagaaaccucca

SEQ ID NO: 32395 - RNA, 64 nt, hsa
uaggagaaaaaaagagaaaaaaauaaaaaucaaaaaaaaaaaaaagaaagaaagaaaccuccag

SEQ ID NO: 32396 - RNA, 64 nt, hsa
aggagaaaaaaagagaaaaaaauaaaaaucaaaaaaaaaaaaaagaaagaaagaaaccuccagc

SEQ ID NO: 32397 - RNA, 64 nt, hsa
ggagaaaaaaagagaaaaaaauaaaaaucaaaaaaaaaaaaaagaaagaaagaaaccuccagcg

SEQ ID NO: 32398 - RNA, 64 nt, hsa
gagaaaaaaagagaaaaaaauaaaaaucaaaaaaaaaaaaaagaaagaaagaaaccuccagcgu

SEQ ID NO: 32399 - RNA, 64 nt, hsa
aaauagucauguacauacaaauaugaacaaacuuaaaaaaaaaauacaaacccuuggaucacau

SEQ ID NO: 32400 - RNA, 64 nt, hsa
aauagucauguacauacaaauaugaacaaacuuaaaaaaaaaauacaaacccuuggaucacaug

SEQ ID NO: 32401 - RNA, 64 nt, hsa
auagucauguacauacaaauaugaacaaacuuaaaaaaaaaauacaaacccuuggaucacaugg

SEQ ID NO: 32402 - RNA, 64 nt, hsa
caugugcaccuugggguuuuguaaugacagugcuaaaaaaaaaaagcauuuuuuuuuuaugauu

SEQ ID NO: 32403 - RNA, 64 nt, hsa
augugcaccuugggguuuuguaaugacagugcuaaaaaaaaaaagcauuuuuuuuuuaugauuu

SEQ ID NO: 32404 - RNA, 64 nt, hsa
ugugcaccuugggguuuuguaaugacagugcuaaaaaaaaaaagcauuuuuuuuuuaugauuug

SEQ ID NO: 32405 - RNA, 64 nt, hsa
gugcaccuugggguuuuguaaugacagugcuaaaaaaaaaaagcauuuuuuuuuuaugauuugu

SEQ ID NO: 32406 - RNA, 64 nt, hsa
auucaaaccaaaggcuguuuuucuauguuuaaagaaaaaaaaaaguaaaaaccaaacacaacac

SEQ ID NO: 32407 - RNA, 64 nt, hsa
uucaaaccaaaggcuguuuuucuauguuuaaagaaaaaaaaaaguaaaaaccaaacacaacacc

SEQ ID NO: 32408 - RNA, 64 nt, hsa
ucaaaccaaaggcuguuuuucuauguuuaaagaaaaaaaaaaguaaaaaccaaacacaacaccu

SEQ ID NO: 32409 - RNA, 64 nt, hsa
agcuuagccaacauaguaagacccccaucucuuuaaaaaaaaaaaaaaaaaaaaaaaaaaaacu

SEQ ID NO: 32410 - RNA, 64 nt, hsa
gcuuagccaacauaguaagacccccaucucuuuaaaaaaaaaaaaaaaaaaaaaaaaaaaacuu

SEQ ID NO: 32411 - RNA, 64 nt, hsa
cuuagccaacauaguaagacccccaucucuuuaaaaaaaaaaaaaaaaaaaaaaaaaaaacuuu

SEQ ID NO: 32412 - RNA, 64 nt, hsa
uuagccaacauaguaagacccccaucucuuuaaaaaaaaaaaaaaaaaaaaaaaaaaaacuuua

SEQ ID NO: 32413 - RNA, 64 nt, hsa
uagccaacauaguaagacccccaucucuuuaaaaaaaaaaaaaaaaaaaaaaaaaaaacuuuag

SEQ ID NO: 32414 - RNA, 64 nt, hsa
agccaacauaguaagacccccaucucuuuaaaaaaaaaaaaaaaaaaaaaaaaaaaacuuuaga

SEQ ID NO: 32415 - RNA, 64 nt, hsa
gccaacauaguaagacccccaucucuuuaaaaaaaaaaaaaaaaaaaaaaaaaaaacuuuagaa

SEQ ID NO: 32416 - RNA, 64 nt, hsa
ccaacauaguaagacccccaucucuuuaaaaaaaaaaaaaaaaaaaaaaaaaaaacuuuagaac

SEQ ID NO: 32417 - RNA, 64 nt, hsa
caacauaguaagacccccaucucuuuaaaaaaaaaaaaaaaaaaaaaaaaaaaacuuuagaacu

SEQ ID NO: 32418 - RNA, 64 nt, hsa
aacauaguaagacccccaucucuuuaaaaaaaaaaaaaaaaaaaaaaaaaaaacuuuagaacug

SEQ ID NO: 32419 - RNA, 64 nt, hsa
acauaguaagacccccaucucuuuaaaaaaaaaaaaaaaaaaaaaaaaaaaacuuuagaacugg

SEQ ID NO: 32420 - RNA, 64 nt, hsa
cauaguaagacccccaucucuuuaaaaaaaaaaaaaaaaaaaaaaaaaaaacuuuagaacuggg

SEQ ID NO: 32421 - RNA, 64 nt, hsa
auaguaagacccccaucucuuuaaaaaaaaaaaaaaaaaaaaaaaaaaaacuuuagaacugggu

SEQ ID NO: 32422 - RNA, 64 nt, hsa
uaguaagacccccaucucuuuaaaaaaaaaaaaaaaaaaaaaaaaaaaacuuuagaacugggug

SEQ ID NO: 32423 - RNA, 64 nt, hsa
aguaagacccccaucucuuuaaaaaaaaaaaaaaaaaaaaaaaaaaaacuuuagaacugggugc

SEQ ID NO: 32424 - RNA, 64 nt, hsa
guaagacccccaucucuuuaaaaaaaaaaaaaaaaaaaaaaaaaaaacuuuagaacugggugca

SEQ ID NO: 32425 - RNA, 64 nt, hsa
uaagacccccaucucuuuaaaaaaaaaaaaaaaaaaaaaaaaaaaacuuuagaacugggugcag

SEQ ID NO: 32426 - RNA, 64 nt, hsa
aagacccccaucucuuuaaaaaaaaaaaaaaaaaaaaaaaaaaaacuuuagaacugggugcagu

SEQ ID NO: 32427 - RNA, 64 nt, hsa
agacccccaucucuuuaaaaaaaaaaaaaaaaaaaaaaaaaaaacuuuagaacugggugcagug

SEQ ID NO: 32428 - RNA, 64 nt, hsa
gacccccaucucuuuaaaaaaaaaaaaaaaaaaaaaaaaaaaacuuuagaacugggugcagugg

SEQ ID NO: 32429 - RNA, 64 nt, hsa
acccccaucucuuuaaaaaaaaaaaaaaaaaaaaaaaaaaaacuuuagaacugggugcaguggc

SEQ ID NO: 32430 - RNA, 64 nt, hsa
auggaaacauagcaagacacugucucuacaggggaaaaaaaaaaaagaaacugagccuuaaaga

SEQ ID NO: 32431 - RNA, 64 nt, hsa
uggaaacauagcaagacacugucucuacaggggaaaaaaaaaaaagaaacugagccuuaaagag

SEQ ID NO: 32432 - RNA, 64 nt, hsa
ggaaacauagcaagacacugucucuacaggggaaaaaaaaaaaagaaacugagccuuaaagaga

SEQ ID NO: 32433 - RNA, 64 nt, hsa
gaaacauagcaagacacugucucuacaggggaaaaaaaaaaaagaaacugagccuuaaagagau

SEQ ID NO: 32434 - RNA, 64 nt, hsa
aaacauagcaagacacugucucuacaggggaaaaaaaaaaaagaaacugagccuuaaagagaug

SEQ ID NO: 32435 - RNA, 64 nt, hsa
cacaauggcaaagccaaacagaggaagaaacauuaaaaaaaaaaaaaagaccauuauuucuuug

SEQ ID NO: 32436 - RNA, 64 nt, hsa
acaauggcaaagccaaacagaggaagaaacauuaaaaaaaaaaaaaagaccauuauuucuuugu

SEQ ID NO: 32437 - RNA, 64 nt, hsa
caauggcaaagccaaacagaggaagaaacauuaaaaaaaaaaaaaagaccauuauuucuuuguu

SEQ ID NO: 32438 - RNA, 64 nt, hsa
aauggcaaagccaaacagaggaagaaacauuaaaaaaaaaaaaaagaccauuauuucuuuguuu

SEQ ID NO: 32439 - RNA, 64 nt, hsa
auggcaaagccaaacagaggaagaaacauuaaaaaaaaaaaaaagaccauuauuucuuuguuuu

SEQ ID NO: 32440 - RNA, 64 nt, hsa
uggcaaagccaaacagaggaagaaacauuaaaaaaaaaaaaaagaccauuauuucuuuguuuug

SEQ ID NO: 32441 - RNA, 64 nt, hsa
ggcaaagccaaacagaggaagaaacauuaaaaaaaaaaaaaagaccauuauuucuuuguuuugu

SEQ ID NO: 32442 - RNA, 64 nt, hsa
auuuuuauauuacagagcuuccaucaucaugaagaaaaaaaaauuugguucucaagugaacaaa

SEQ ID NO: 32443 - RNA, 64 nt, hsa
uuuuuauauuacagagcuuccaucaucaugaagaaaaaaaaauuugguucucaagugaacaaac

SEQ ID NO: 32444 - RNA, 64 nt, hsa
uacacagaguaucuggagaauaaaacccaaauucaaaaaaaaaaaugauaauuuauuuuuaagg

SEQ ID NO: 32445 - RNA, 64 nt, hsa
acacagaguaucuggagaauaaaacccaaauucaaaaaaaaaaaugauaauuuauuuuuaaggu

SEQ ID NO: 32446 - RNA, 64 nt, hsa
cacagaguaucuggagaauaaaacccaaauucaaaaaaaaaaaugauaauuuauuuuuaaggua

SEQ ID NO: 32447 - RNA, 64 nt, hsa
acagaguaucuggagaauaaaacccaaauucaaaaaaaaaaaugauaauuuauuuuuaagguaa

SEQ ID NO: 32448 - RNA, 64 nt, hsa
ucuuuugcuauaguuauacaucaauuuaaaaagcaaaaaaaaaaaaggggggggcaaucucucu

SEQ ID NO: 32449 - RNA, 64 nt, hsa
cuuuugcuauaguuauacaucaauuuaaaaagcaaaaaaaaaaaaggggggggcaaucucucuc

SEQ ID NO: 32450 - RNA, 64 nt, hsa
uuuugcuauaguuauacaucaauuuaaaaagcaaaaaaaaaaaaggggggggcaaucucucucu

SEQ ID NO: 32451 - RNA, 64 nt, hsa
uuugcuauaguuauacaucaauuuaaaaagcaaaaaaaaaaaaggggggggcaaucucucucug

SEQ ID NO: 32452 - RNA, 64 nt, hsa
uugcuauaguuauacaucaauuuaaaaagcaaaaaaaaaaaaggggggggcaaucucucucugu

SEQ ID NO: 32453 - RNA, 64 nt, hsa
ucuuaagucccaguauaccucauuuuucauacugaaaaaaaaagcuuguggccaauggaacagu

SEQ ID NO: 32454 - RNA, 64 nt, hsa
cuuaagucccaguauaccucauuuuucauacugaaaaaaaaagcuuguggccaauggaacagua

SEQ ID NO: 32455 - RNA, 64 nt, hsa
aagauaaaaaauauuguuaagugugcaaguuauuaaaaaaaaaaaauugggccaggcacggugg

SEQ ID NO: 32456 - RNA, 64 nt, hsa
agauaaaaaauauuguuaagugugcaaguuauuaaaaaaaaaaaauugggccaggcacgguggc

SEQ ID NO: 32457 - RNA, 64 nt, hsa
gauaaaaaauauuguuaagugugcaaguuauuaaaaaaaaaaaauugggccaggcacgguggcu

SEQ ID NO: 32458 - RNA, 64 nt, hsa
auaaaaaauauuguuaagugugcaaguuauuaaaaaaaaaaaauugggccaggcacgguggcuc

SEQ ID NO: 32459 - RNA, 64 nt, hsa
uaaaaaauauuguuaagugugcaaguuauuaaaaaaaaaaaauugggccaggcacgguggcuca

SEQ ID NO: 32460 - RNA, 64 nt, hsa
uccagccugggcaacaagagcgaaacuccauuucaaaaaaaaaaaauuggugacagacucaaug

SEQ ID NO: 32461 - RNA, 64 nt, hsa
ccagccugggcaacaagagcgaaacuccauuucaaaaaaaaaaaauuggugacagacucaauga

SEQ ID NO: 32462 - RNA, 64 nt, hsa
cagccugggcaacaagagcgaaacuccauuucaaaaaaaaaaaauuggugacagacucaaugau

SEQ ID NO: 32463 - RNA, 64 nt, hsa
agccugggcaacaagagcgaaacuccauuucaaaaaaaaaaaauuggugacagacucaaugaug

SEQ ID NO: 32464 - RNA, 64 nt, hsa
gccugggcaacaagagcgaaacuccauuucaaaaaaaaaaaauuggugacagacucaaugaugg

SEQ ID NO: 32465 - RNA, 64 nt, hsa
ccagguguacuagugaauguaauuuauaguugccaaaaaaaaaaaaaaccugaaauaaauaaau

SEQ ID NO: 32466 - RNA, 64 nt, hsa
cagguguacuagugaauguaauuuauaguugccaaaaaaaaaaaaaaccugaaauaaauaaaug

SEQ ID NO: 32467 - RNA, 64 nt, hsa
agguguacuagugaauguaauuuauaguugccaaaaaaaaaaaaaaccugaaauaaauaaaugu

SEQ ID NO: 32468 - RNA, 64 nt, hsa
gguguacuagugaauguaauuuauaguugccaaaaaaaaaaaaaaccugaaauaaauaaauguu

SEQ ID NO: 32469 - RNA, 64 nt, hsa
guguacuagugaauguaauuuauaguugccaaaaaaaaaaaaaaccugaaauaaauaaauguua

SEQ ID NO: 32470 - RNA, 64 nt, hsa
uguacuagugaauguaauuuauaguugccaaaaaaaaaaaaaaccugaaauaaauaaauguuag

SEQ ID NO: 32471 - RNA, 64 nt, hsa
guacuagugaauguaauuuauaguugccaaaaaaaaaaaaaaccugaaauaaauaaauguuaga

SEQ ID NO: 32472 - RNA, 64 nt, hsa
uauuuccuuuuuuaugcuuagaacaccaggguuuaaaaaaaaaaaaaaggugaggacaucuggg

SEQ ID NO: 32473 - RNA, 64 nt, hsa
auuuccuuuuuuaugcuuagaacaccaggguuuaaaaaaaaaaaaaaggugaggacaucugggu

SEQ ID NO: 32474 - RNA, 64 nt, hsa
uuuccuuuuuuaugcuuagaacaccaggguuuaaaaaaaaaaaaaaggugaggacaucuggguc

SEQ ID NO: 32475 - RNA, 64 nt, hsa
uuccuuuuuuaugcuuagaacaccaggguuuaaaaaaaaaaaaaaggugaggacaucugggucu

SEQ ID NO: 32476 - RNA, 64 nt, hsa
uccuuuuuuaugcuuagaacaccaggguuuaaaaaaaaaaaaaaggugaggacaucugggucuc

SEQ ID NO: 32477 - RNA, 64 nt, hsa
ccuuuuuuaugcuuagaacaccaggguuuaaaaaaaaaaaaaaggugaggacaucugggucuca

SEQ ID NO: 32478 - RNA, 64 nt, hsa
cuuuuuuaugcuuagaacaccaggguuuaaaaaaaaaaaaaaggugaggacaucugggucucau

SEQ ID NO: 32479 - RNA, 64 nt, hsa
gaacuauaaccuuaggauuccugaaaagaauuucaaaaaaaaaauaaagacacuguugccaaug

SEQ ID NO: 32480 - RNA, 64 nt, hsa
aacuauaaccuuaggauuccugaaaagaauuucaaaaaaaaaauaaagacacuguugccaaugu

SEQ ID NO: 32481 - RNA, 64 nt, hsa
acuauaaccuuaggauuccugaaaagaauuucaaaaaaaaaauaaagacacuguugccaaugug

SEQ ID NO: 32482 - RNA, 64 nt, hsa
aucaaauaaaaauggaaaaaaugaucauggcuuuaaaaaaaaaacaaaaacacacacacaugaa

SEQ ID NO: 32483 - RNA, 64 nt, hsa
ucaaauaaaaauggaaaaaaugaucauggcuuuaaaaaaaaaacaaaaacacacacacaugaac

SEQ ID NO: 32484 - RNA, 64 nt, hsa
caaauaaaaauggaaaaaaugaucauggcuuuaaaaaaaaaacaaaaacacacacacaugaacu

SEQ ID NO: 32485 - RNA, 64 nt, hsa
uguggucuuuuucuuuccuccuaauguugaagagaaaaaaaaaaaaaaaaguuugcccagauug

SEQ ID NO: 32486 - RNA, 64 nt, hsa
guggucuuuuucuuuccuccuaauguugaagagaaaaaaaaaaaaaaaaguuugcccagauugc

SEQ ID NO: 32487 - RNA, 64 nt, hsa
uggucuuuuucuuuccuccuaauguugaagagaaaaaaaaaaaaaaaaguuugcccagauugcu

SEQ ID NO: 32488 - RNA, 64 nt, hsa
ggucuuuuucuuuccuccuaauguugaagagaaaaaaaaaaaaaaaaguuugcccagauugcuu

SEQ ID NO: 32489 - RNA, 64 nt, hsa
gucuuuuucuuuccuccuaauguugaagagaaaaaaaaaaaaaaaaguuugcccagauugcuua

SEQ ID NO: 32490 - RNA, 64 nt, hsa
ucuuuuucuuuccuccuaauguugaagagaaaaaaaaaaaaaaaaguuugcccagauugcuuaa

SEQ ID NO: 32491 - RNA, 64 nt, hsa
cuuuuucuuuccuccuaauguugaagagaaaaaaaaaaaaaaaaguuugcccagauugcuuaau

SEQ ID NO: 32492 - RNA, 64 nt, hsa
uuuuucuuuccuccuaauguugaagagaaaaaaaaaaaaaaaaguuugcccagauugcuuaauu

SEQ ID NO: 32493 - RNA, 64 nt, hsa
uuuucuuuccuccuaauguugaagagaaaaaaaaaaaaaaaaguuugcccagauugcuuaauua

SEQ ID NO: 32494 - RNA, 64 nt, hsa
gucaguggcguugggagggggagaaaaggaaaagaaaaaaaaaagaagaagaagaagaaaagag

SEQ ID NO: 32495 - RNA, 64 nt, hsa
ucaguggcguugggagggggagaaaaggaaaagaaaaaaaaaagaagaagaagaagaaaagaga

SEQ ID NO: 32496 - RNA, 64 nt, hsa
caguggcguugggagggggagaaaaggaaaagaaaaaaaaaagaagaagaagaagaaaagagaa

SEQ ID NO: 32497 - RNA, 64 nt, hsa
uuaaaaguuuuucugguagcuuuagcuuuaugcuaaaaaaaauaaugacauuggguaucuauuu

SEQ ID NO: 32498 - RNA, 64 nt, hsa
cuaaguuccauguauuuuuguuacaaaucuucugaaaaaaaacaaaacaaugugaaacauuaaa

SEQ ID NO: 32499 - RNA, 64 nt, hsa
gaauucccuugcguauucucucucuaaaacaaccaaaaaaaaauggagaggcuuuuuauauacu

SEQ ID NO: 32500 - RNA, 64 nt, hsa
aauucccuugcguauucucucucuaaaacaaccaaaaaaaaauggagaggcuuuuuauauacuc

SEQ ID NO: 32501 - RNA, 64 nt, hsa
ugcaguuagacgggguuacgggggcuaaaagcagaaaaaaaauuccauuucaucgggauggaac

SEQ ID NO: 32502 - RNA, 64 nt, hsa
uaugugaucaguuuaauaguaacuuuauuuauuuaaaaaaaagaaacacaauuaguuacuguua

SEQ ID NO: 32503 - RNA, 64 nt, hsa
uuuuaggggugggaacuuuuuuaaauguucauuuaaaaaaaaacaaaaacagggcagucuugua

SEQ ID NO: 32504 - RNA, 64 nt, hsa
uuuaggggugggaacuuuuuuaaauguucauuuaaaaaaaaacaaaaacagggcagucuuguag

SEQ ID NO: 32505 - RNA, 64 nt, hsa
aaauccucagugacaaaggcuguccugagguaggaaaaaaaaaaagaaacagcauuucuagaaa

SEQ ID NO: 32506 - RNA, 64 nt, hsa
aauccucagugacaaaggcuguccugagguaggaaaaaaaaaaagaaacagcauuucuagaaac

SEQ ID NO: 32507 - RNA, 64 nt, hsa
auccucagugacaaaggcuguccugagguaggaaaaaaaaaaagaaacagcauuucuagaaacc

SEQ ID NO: 32508 - RNA, 64 nt, hsa
uccucagugacaaaggcuguccugagguaggaaaaaaaaaaagaaacagcauuucuagaaaccu

SEQ ID NO: 32509 - RNA, 64 nt, hsa
cuccagccuggguggcaaagugagacucuggcucaaaaaaaaaaacaaaaaacaaaaccaucug

SEQ ID NO: 32510 - RNA, 64 nt, hsa
uccagccuggguggcaaagugagacucuggcucaaaaaaaaaaacaaaaaacaaaaccaucugc

SEQ ID NO: 32511 - RNA, 64 nt, hsa
ccagccuggguggcaaagugagacucuggcucaaaaaaaaaaacaaaaaacaaaaccaucugcc

SEQ ID NO: 32512 - RNA, 64 nt, hsa
cagccuggguggcaaagugagacucuggcucaaaaaaaaaaacaaaaaacaaaaccaucugccc

SEQ ID NO: 32513 - RNA, 64 nt, hsa
cugggaugauggagaaagcucgaggugaaguuuuaaaaaaaaaguuguggaaaggaaaguucca

SEQ ID NO: 32514 - RNA, 64 nt, hsa
ugggaugauggagaaagcucgaggugaaguuuuaaaaaaaaaguuguggaaaggaaaguuccaa

SEQ ID NO: 32515 - RNA, 64 nt, hsa
aaagaauuaucuggcacauuagguauuggaguuuaaaaaaaaagccaaauuucacagucuuaau

SEQ ID NO: 32516 - RNA, 64 nt, hsa
aagaauuaucuggcacauuagguauuggaguuuaaaaaaaaagccaaauuucacagucuuaaua

SEQ ID NO: 32517 - RNA, 64 nt, hsa
aaagccaaauuucacagucuuaauaacuuuuuuuaaaaaaaacuaaaaggcgcuucauguccag

SEQ ID NO: 32518 - RNA, 64 nt, hsa
guguaagucacuguacccagcccaaaagcaguuuaaaaaaaaaaaagacaaaauauacaacucu

SEQ ID NO: 32519 - RNA, 64 nt, hsa
uguaagucacuguacccagcccaaaagcaguuuaaaaaaaaaaaagacaaaauauacaacucuu

SEQ ID NO: 32520 - RNA, 64 nt, hsa
guaagucacuguacccagcccaaaagcaguuuaaaaaaaaaaaagacaaaauauacaacucuug

SEQ ID NO: 32521 - RNA, 64 nt, hsa
uaagucacuguacccagcccaaaagcaguuuaaaaaaaaaaaagacaaaauauacaacucuuga

SEQ ID NO: 32522 - RNA, 64 nt, hsa
aagucacuguacccagcccaaaagcaguuuaaaaaaaaaaaagacaaaauauacaacucuugau

SEQ ID NO: 32523 - RNA, 64 nt, hsa
gagcaaagcaucaaagaaucuuuaagggagguuuaaaaaaaaaaaaaaaaaaaaagauugguug

SEQ ID NO: 32524 - RNA, 64 nt, hsa
agcaaagcaucaaagaaucuuuaagggagguuuaaaaaaaaaaaaaaaaaaaaagauugguugc

SEQ ID NO: 32525 - RNA, 64 nt, hsa
gcaaagcaucaaagaaucuuuaagggagguuuaaaaaaaaaaaaaaaaaaaaagauugguugcc

SEQ ID NO: 32526 - RNA, 64 nt, hsa
caaagcaucaaagaaucuuuaagggagguuuaaaaaaaaaaaaaaaaaaaaagauugguugccu

SEQ ID NO: 32527 - RNA, 64 nt, hsa
aaagcaucaaagaaucuuuaagggagguuuaaaaaaaaaaaaaaaaaaaaagauugguugccuc

SEQ ID NO: 32528 - RNA, 64 nt, hsa
aagcaucaaagaaucuuuaagggagguuuaaaaaaaaaaaaaaaaaaaaagauugguugccucu

SEQ ID NO: 32529 - RNA, 64 nt, hsa
agcaucaaagaaucuuuaagggagguuuaaaaaaaaaaaaaaaaaaaaagauugguugccucug

SEQ ID NO: 32530 - RNA, 64 nt, hsa
gcaucaaagaaucuuuaagggagguuuaaaaaaaaaaaaaaaaaaaaagauugguugccucugc

SEQ ID NO: 32531 - RNA, 64 nt, hsa
caucaaagaaucuuuaagggagguuuaaaaaaaaaaaaaaaaaaaaagauugguugccucugcc

SEQ ID NO: 32532 - RNA, 64 nt, hsa
aucaaagaaucuuuaagggagguuuaaaaaaaaaaaaaaaaaaaaagauugguugccucugccu

SEQ ID NO: 32533 - RNA, 64 nt, hsa
ucaaagaaucuuuaagggagguuuaaaaaaaaaaaaaaaaaaaaagauugguugccucugccuu

SEQ ID NO: 32534 - RNA, 64 nt, hsa
caaagaaucuuuaagggagguuuaaaaaaaaaaaaaaaaaaaaagauugguugccucugccuuu

SEQ ID NO: 32535 - RNA, 64 nt, hsa
aaagaaucuuuaagggagguuuaaaaaaaaaaaaaaaaaaaaagauugguugccucugccuuug

SEQ ID NO: 32536 - RNA, 64 nt, hsa
aagaaucuuuaagggagguuuaaaaaaaaaaaaaaaaaaaaagauugguugccucugccuuugu

SEQ ID NO: 32537 - RNA, 64 nt, hsa
caggggaaagcacaaagcuauuucugaaauuaggaaaaaaaaaaaaaagguggaaggagcagcc

SEQ ID NO: 32538 - RNA, 64 nt, hsa
aggggaaagcacaaagcuauuucugaaauuaggaaaaaaaaaaaaaagguggaaggagcagcca

SEQ ID NO: 32539 - RNA, 64 nt, hsa
ggggaaagcacaaagcuauuucugaaauuaggaaaaaaaaaaaaaagguggaaggagcagccag

SEQ ID NO: 32540 - RNA, 64 nt, hsa
gggaaagcacaaagcuauuucugaaauuaggaaaaaaaaaaaaaagguggaaggagcagccaga

SEQ ID NO: 32541 - RNA, 64 nt, hsa
ggaaagcacaaagcuauuucugaaauuaggaaaaaaaaaaaaaagguggaaggagcagccagau

SEQ ID NO: 32542 - RNA, 64 nt, hsa
gaaagcacaaagcuauuucugaaauuaggaaaaaaaaaaaaaagguggaaggagcagccagaug

SEQ ID NO: 32543 - RNA, 64 nt, hsa
aaagcacaaagcuauuucugaaauuaggaaaaaaaaaaaaaagguggaaggagcagccagaugu

SEQ ID NO: 32544 - RNA, 64 nt, hsa
gugugaagggguagaauuugugcgguaaagacuuaaaaaaaaaaguagggagauuaaaaaaaaa

SEQ ID NO: 32545 - RNA, 64 nt, hsa
ugugaagggguagaauuugugcgguaaagacuuaaaaaaaaaaguagggagauuaaaaaaaaag

SEQ ID NO: 32546 - RNA, 64 nt, hsa
gugaagggguagaauuugugcgguaaagacuuaaaaaaaaaaguagggagauuaaaaaaaaaga

SEQ ID NO: 32547 - RNA, 64 nt, hsa
gcgguaaagacuuaaaaaaaaaaguagggagauuaaaaaaaaagaaagaaaaugcuuccuuauc

SEQ ID NO: 32548 - RNA, 64 nt, hsa
cgguaaagacuuaaaaaaaaaaguagggagauuaaaaaaaaagaaagaaaaugcuuccuuaucu

SEQ ID NO: 32549 - RNA, 64 nt, hsa
ucuccagccugggaggcacagcaaacugucccccaaaaaaaaaaaagaguccuuaccaauagca

SEQ ID NO: 32550 - RNA, 64 nt, hsa
cuccagccugggaggcacagcaaacugucccccaaaaaaaaaaaagaguccuuaccaauagcag

SEQ ID NO: 32551 - RNA, 64 nt, hsa
uccagccugggaggcacagcaaacugucccccaaaaaaaaaaaagaguccuuaccaauagcagg

SEQ ID NO: 32552 - RNA, 64 nt, hsa
ccagccugggaggcacagcaaacugucccccaaaaaaaaaaaagaguccuuaccaauagcaggg

SEQ ID NO: 32553 - RNA, 64 nt, hsa
cagccugggaggcacagcaaacugucccccaaaaaaaaaaaagaguccuuaccaauagcagggg

SEQ ID NO: 32554 - RNA, 64 nt, hsa
cuccaggcugggugacagagcgagacuccaucucaaaaaaaaaaaaaagaaaaaaaaaaugucu

SEQ ID NO: 32555 - RNA, 64 nt, hsa
uccaggcugggugacagagcgagacuccaucucaaaaaaaaaaaaaagaaaaaaaaaaugucug

SEQ ID NO: 32556 - RNA, 64 nt, hsa
ccaggcugggugacagagcgagacuccaucucaaaaaaaaaaaaaagaaaaaaaaaaugucugc

SEQ ID NO: 32557 - RNA, 64 nt, hsa
caggcugggugacagagcgagacuccaucucaaaaaaaaaaaaaagaaaaaaaaaaugucugcc

SEQ ID NO: 32558 - RNA, 64 nt, hsa
aggcugggugacagagcgagacuccaucucaaaaaaaaaaaaaagaaaaaaaaaaugucugccu

SEQ ID NO: 32559 - RNA, 64 nt, hsa
ggcugggugacagagcgagacuccaucucaaaaaaaaaaaaaagaaaaaaaaaaugucugccua

SEQ ID NO: 32560 - RNA, 63 nt, hsa
gcugggugacagagcgagacuccaucucaaaaaaaaaaaaaagaaaaaaaaaaugucugccua

SEQ ID NO: 32561 - RNA, 64 nt, hsa
aauaccucaugcaaaaugucuccugaaauaagggaaaaaaaaaaaaccacaacuuugaaaaucu

SEQ ID NO: 32562 - RNA, 64 nt, hsa
auaccucaugcaaaaugucuccugaaauaagggaaaaaaaaaaaaccacaacuuugaaaaucuu

SEQ ID NO: 32563 - RNA, 64 nt, hsa
uaccucaugcaaaaugucuccugaaauaagggaaaaaaaaaaaaccacaacuuugaaaaucuua

SEQ ID NO: 32564 - RNA, 64 nt, hsa
accucaugcaaaaugucuccugaaauaagggaaaaaaaaaaaaccacaacuuugaaaaucuuaa

SEQ ID NO: 32565 - RNA, 64 nt, hsa
ccucaugcaaaaugucuccugaaauaagggaaaaaaaaaaaaccacaacuuugaaaaucuuaau

SEQ ID NO: 32566 - RNA, 64 nt, hsa
guugaaguuagcaaugccgaaagguuucugucuuaaaaaaaaaaauccuuguacuuaucaauuu

SEQ ID NO: 32567 - RNA, 64 nt, hsa
uugaaguuagcaaugccgaaagguuucugucuuaaaaaaaaaaauccuuguacuuaucaauuuu

SEQ ID NO: 32568 - RNA, 64 nt, hsa
ugaaguuagcaaugccgaaagguuucugucuuaaaaaaaaaaauccuuguacuuaucaauuuug

SEQ ID NO: 32569 - RNA, 64 nt, hsa
gaaguuagcaaugccgaaagguuucugucuuaaaaaaaaaaauccuuguacuuaucaauuuugc

SEQ ID NO: 32570 - RNA, 64 nt, hsa
cuacacuguccuggcagaaaacaaaagugacgagaaaaaaaaaucaggagucagcucugacaau

SEQ ID NO: 32571 - RNA, 64 nt, hsa
uacacuguccuggcagaaaacaaaagugacgagaaaaaaaaaucaggagucagcucugacaaug

SEQ ID NO: 32572 - RNA, 64 nt, hsa
uaauauggcccacacuuuauucaccacccuggagaaaaaaaaacccaggaauauguggaaaagc

SEQ ID NO: 32573 - RNA, 64 nt, hsa
aauauggcccacacuuuauucaccacccuggagaaaaaaaaacccaggaauauguggaaaagcc

SEQ ID NO: 32574 - RNA, 64 nt, hsa
aagagcagguacauggauccaggcuucugccaaaaaaaaaaagagaagaagaugacgaugauga

SEQ ID NO: 32575 - RNA, 64 nt, hsa
gaagagcagguacauggauccaggcuucugccaaaaaaaaaaagagaagaagaugacgaugaug

SEQ ID NO: 32576 - RNA, 64 nt, hsa
ggaagagcagguacauggauccaggcuucugccaaaaaaaaaaagagaagaagaugacgaugau

SEQ ID NO: 32577 - RNA, 64 nt, hsa
gggaagagcagguacauggauccaggcuucugccaaaaaaaaaaagagaagaagaugacgauga

SEQ ID NO: 32578 - RNA, 64 nt, hsa
aguguuguuuccuucaauguuucugccuuuuuuaaaaaaaaaguauguguaauaugaaguaaaa

SEQ ID NO: 32579 - RNA, 64 nt, hsa
gaguguuguuuccuucaauguuucugccuuuuuuaaaaaaaaaguauguguaauaugaaguaaa

SEQ ID NO: 32580 - RNA, 64 nt, hsa
uuuuaagcauaaaaaaaaaaaaaaaaaaaaaaaaaaaaaaaagcaguggguuccugagcucaag

SEQ ID NO: 32581 - RNA, 64 nt, hsa
cuuuuaagcauaaaaaaaaaaaaaaaaaaaaaaaaaaaaaaaagcaguggguuccugagcucaa

SEQ ID NO: 32582 - RNA, 64 nt, hsa
acuuuuaagcauaaaaaaaaaaaaaaaaaaaaaaaaaaaaaaaagcaguggguuccugagcuca

SEQ ID NO: 32583 - RNA, 64 nt, hsa
cacuuuuaagcauaaaaaaaaaaaaaaaaaaaaaaaaaaaaaaaagcaguggguuccugagcuc

SEQ ID NO: 32584 - RNA, 64 nt, hsa
ucacuuuuaagcauaaaaaaaaaaaaaaaaaaaaaaaaaaaaaaaagcaguggguuccugagcu

SEQ ID NO: 32585 - RNA, 64 nt, hsa
aucacuuuuaagcauaaaaaaaaaaaaaaaaaaaaaaaaaaaaaaaagcaguggguuccugagc

SEQ ID NO: 32586 - RNA, 64 nt, hsa
uaucacuuuuaagcauaaaaaaaaaaaaaaaaaaaaaaaaaaaaaaaagcaguggguuccugag

SEQ ID NO: 32587 - RNA, 64 nt, hsa
uuaucacuuuuaagcauaaaaaaaaaaaaaaaaaaaaaaaaaaaaaaaagcaguggguuccuga

SEQ ID NO: 32588 - RNA, 64 nt, hsa
uuuaucacuuuuaagcauaaaaaaaaaaaaaaaaaaaaaaaaaaaaaaaagcaguggguuccug

SEQ ID NO: 32589 - RNA, 64 nt, hsa
cuuuaucacuuuuaagcauaaaaaaaaaaaaaaaaaaaaaaaaaaaaaaaagcaguggguuccu

SEQ ID NO: 32590 - RNA, 64 nt, hsa
ucuuuaucacuuuuaagcauaaaaaaaaaaaaaaaaaaaaaaaaaaaaaaaagcaguggguucc

SEQ ID NO: 32591 - RNA, 64 nt, hsa
cucuuuaucacuuuuaagcauaaaaaaaaaaaaaaaaaaaaaaaaaaaaaaaagcaguggguuc

SEQ ID NO: 32592 - RNA, 64 nt, hsa
ccucuuuaucacuuuuaagcauaaaaaaaaaaaaaaaaaaaaaaaaaaaaaaaagcaguggguu

SEQ ID NO: 32593 - RNA, 64 nt, hsa
uccucuuuaucacuuuuaagcauaaaaaaaaaaaaaaaaaaaaaaaaaaaaaaaagcagugggu

SEQ ID NO: 32594 - RNA, 64 nt, hsa
cuccucuuuaucacuuuuaagcauaaaaaaaaaaaaaaaaaaaaaaaaaaaaaaaagcaguggg

SEQ ID NO: 32595 - RNA, 64 nt, hsa
ucuccucuuuaucacuuuuaagcauaaaaaaaaaaaaaaaaaaaaaaaaaaaaaaaagcagugg

SEQ ID NO: 32596 - RNA, 64 nt, hsa
cucuccucuuuaucacuuuuaagcauaaaaaaaaaaaaaaaaaaaaaaaaaaaaaaaagcagug

SEQ ID NO: 32597 - RNA, 64 nt, hsa
ccucuccucuuuaucacuuuuaagcauaaaaaaaaaaaaaaaaaaaaaaaaaaaaaaaagcagu

SEQ ID NO: 32598 - RNA, 64 nt, hsa
gccucuccucuuuaucacuuuuaagcauaaaaaaaaaaaaaaaaaaaaaaaaaaaaaaaagcag

SEQ ID NO: 32599 - RNA, 64 nt, hsa
ugccucuccucuuuaucacuuuuaagcauaaaaaaaaaaaaaaaaaaaaaaaaaaaaaaaagca

SEQ ID NO: 32600 - RNA, 64 nt, hsa
gugccucuccucuuuaucacuuuuaagcauaaaaaaaaaaaaaaaaaaaaaaaaaaaaaaaagc

SEQ ID NO: 32601 - RNA, 64 nt, hsa
ugugccucuccucuuuaucacuuuuaagcauaaaaaaaaaaaaaaaaaaaaaaaaaaaaaaaag

SEQ ID NO: 32602 - RNA, 64 nt, hsa
uugugccucuccucuuuaucacuuuuaagcauaaaaaaaaaaaaaaaaaaaaaaaaaaaaaaaa

SEQ ID NO: 32603 - RNA, 64 nt, hsa
cuugugccucuccucuuuaucacuuuuaagcauaaaaaaaaaaaaaaaaaaaaaaaaaaaaaaa

SEQ ID NO: 32604 - RNA, 64 nt, hsa
ccuugugccucuccucuuuaucacuuuuaagcauaaaaaaaaaaaaaaaaaaaaaaaaaaaaaa

SEQ ID NO: 32605 - RNA, 64 nt, hsa
ccacugagcggcuaaaugaaauaaaguggaaaaaaaaaaaaaggaaaaaaccaaaagcauaaaa

SEQ ID NO: 32606 - RNA, 64 nt, hsa
gccacugagcggcuaaaugaaauaaaguggaaaaaaaaaaaaaggaaaaaaccaaaagcauaaa

SEQ ID NO: 32607 - RNA, 64 nt, hsa
agccacugagcggcuaaaugaaauaaaguggaaaaaaaaaaaaaggaaaaaaccaaaagcauaa

SEQ ID NO: 32608 - RNA, 64 nt, hsa
uagccacugagcggcuaaaugaaauaaaguggaaaaaaaaaaaaaggaaaaaaccaaaagcaua

SEQ ID NO: 32609 - RNA, 64 nt, hsa
cuagccacugagcggcuaaaugaaauaaaguggaaaaaaaaaaaaaggaaaaaaccaaaagcau

SEQ ID NO: 32610 - RNA, 64 nt, hsa
ucuagccacugagcggcuaaaugaaauaaaguggaaaaaaaaaaaaaggaaaaaaccaaaagca

SEQ ID NO: 32611 - RNA, 64 nt, hsa
ucacuagguucgaauccagagagcaguguggaaaaaaaaaaacaaaaaacaacugaccaguugu

SEQ ID NO: 32612 - RNA, 64 nt, hsa
uucacuagguucgaauccagagagcaguguggaaaaaaaaaaacaaaaaacaacugaccaguug

SEQ ID NO: 32613 - RNA, 64 nt, hsa
auucacuagguucgaauccagagagcaguguggaaaaaaaaaaacaaaaaacaacugaccaguu

SEQ ID NO: 32614 - RNA, 64 nt, hsa
aauucacuagguucgaauccagagagcaguguggaaaaaaaaaaacaaaaaacaacugaccagu

SEQ ID NO: 32615 - RNA, 64 nt, hsa
gccugcggacagaccaagacuucaucccccccaaaaaaaaaagauuggaggugauuuacaguga

SEQ ID NO: 32616 - RNA, 64 nt, hsa
agccugcggacagaccaagacuucaucccccccaaaaaaaaaagauuggaggugauuuacagug

SEQ ID NO: 32617 - RNA, 64 nt, hsa
cagccugcggacagaccaagacuucaucccccccaaaaaaaaaagauuggaggugauuuacagu

SEQ ID NO: 32618 - RNA, 64 nt, hsa
gccugggccacagggcgagacuccgucucaaaaaaaaaaaaaugcacauagcuaucaagugugc

SEQ ID NO: 32619 - RNA, 64 nt, hsa
agccugggccacagggcgagacuccgucucaaaaaaaaaaaaaugcacauagcuaucaagugug

SEQ ID NO: 32620 - RNA, 64 nt, hsa
uagccugggccacagggcgagacuccgucucaaaaaaaaaaaaaugcacauagcuaucaagugu

SEQ ID NO: 32621 - RNA, 64 nt, hsa
cuagccugggccacagggcgagacuccgucucaaaaaaaaaaaaaugcacauagcuaucaagug

SEQ ID NO: 32622 - RNA, 64 nt, hsa
ucuagccugggccacagggcgagacuccgucucaaaaaaaaaaaaaugcacauagcuaucaagu

SEQ ID NO: 32623 - RNA, 64 nt, hsa
cucuagccugggccacagggcgagacuccgucucaaaaaaaaaaaaaugcacauagcuaucaag

SEQ ID NO: 32624 - RNA, 64 nt, hsa
gcgacaagagcaagacucugucucagaaaaaaaaaaaaaaaagagagagagagagaaagagaac

SEQ ID NO: 32625 - RNA, 64 nt, hsa
ggcgacaagagcaagacucugucucagaaaaaaaaaaaaaaaagagagagagagagaaagagaa

SEQ ID NO: 32626 - RNA, 64 nt, hsa
gggcgacaagagcaagacucugucucagaaaaaaaaaaaaaaaagagagagagagagaaagaga

SEQ ID NO: 32627 - RNA, 64 nt, hsa
ugggcgacaagagcaagacucugucucagaaaaaaaaaaaaaaaagagagagagagagaaagag

SEQ ID NO: 32628 - RNA, 64 nt, hsa
cugggcgacaagagcaagacucugucucagaaaaaaaaaaaaaaaagagagagagagagaaaga

SEQ ID NO: 32629 - RNA, 64 nt, hsa
ccugggcgacaagagcaagacucugucucagaaaaaaaaaaaaaaaagagagagagagagaaag

SEQ ID NO: 32630 - RNA, 64 nt, hsa
gccugggcgacaagagcaagacucugucucagaaaaaaaaaaaaaaaagagagagagagagaaa

SEQ ID NO: 32631 - RNA, 64 nt, hsa
agccugggcgacaagagcaagacucugucucagaaaaaaaaaaaaaaaagagagagagagagaa

SEQ ID NO: 32632 - RNA, 64 nt, hsa
cagccugggcgacaagagcaagacucugucucagaaaaaaaaaaaaaaaagagagagagagaga

SEQ ID NO: 32633 - RNA, 64 nt, hsa
acauaacaagauccugucucucaaaaaaaaaaaaaaaaaaaagaaagagagagggccgggcgug

SEQ ID NO: 32634 - RNA, 64 nt, hsa
aacauaacaagauccugucucucaaaaaaaaaaaaaaaaaaaagaaagagagagggccgggcgu

SEQ ID NO: 32635 - RNA, 64 nt, hsa
caacauaacaagauccugucucucaaaaaaaaaaaaaaaaaaaagaaagagagagggccgggcg

SEQ ID NO: 32636 - RNA, 64 nt, hsa
gcaacauaacaagauccugucucucaaaaaaaaaaaaaaaaaaaagaaagagagagggccgggc

SEQ ID NO: 32637 - RNA, 64 nt, hsa
ggcaacauaacaagauccugucucucaaaaaaaaaaaaaaaaaaaagaaagagagagggccggg

SEQ ID NO: 32638 - RNA, 64 nt, hsa
gggcaacauaacaagauccugucucucaaaaaaaaaaaaaaaaaaaagaaagagagagggccgg

SEQ ID NO: 32639 - RNA, 64 nt, hsa
ugggcaacauaacaagauccugucucucaaaaaaaaaaaaaaaaaaaagaaagagagagggccg

SEQ ID NO: 32640 - RNA, 64 nt, hsa
cugggcaacauaacaagauccugucucucaaaaaaaaaaaaaaaaaaaagaaagagagagggcc

SEQ ID NO: 32641 - RNA, 64 nt, hsa
ccugggcaacauaacaagauccugucucucaaaaaaaaaaaaaaaaaaaagaaagagagagggc

SEQ ID NO: 32642 - RNA, 64 nt, hsa
gccugggcaacauaacaagauccugucucucaaaaaaaaaaaaaaaaaaaagaaagagagaggg

SEQ ID NO: 32643 - RNA, 64 nt, hsa
agccugggcaacauaacaagauccugucucucaaaaaaaaaaaaaaaaaaaagaaagagagagg

SEQ ID NO: 32644 - RNA, 64 nt, hsa
cagccugggcaacauaacaagauccugucucucaaaaaaaaaaaaaaaaaaaagaaagagagag

SEQ ID NO: 32645 - RNA, 64 nt, hsa
ccagccugggcaacauaacaagauccugucucucaaaaaaaaaaaaaaaaaaaagaaagagaga

SEQ ID NO: 32646 - RNA, 64 nt, hsa
ucccucccccacacccugguguuuuaaaaugaagaaaaaaaaccaucaccuuuuguacaaaaac

SEQ ID NO: 32647 - RNA, 64 nt, hsa
acaaguuuuugagacacuggauuucuuuaauuaaaaaaaaaaugccaagaaacauuauuuauac

SEQ ID NO: 32648 - RNA, 64 nt, hsa
cacaaguuuuugagacacuggauuucuuuaauuaaaaaaaaaaugccaagaaacauuauuuaua

SEQ ID NO: 32649 - RNA, 64 nt, hsa
ucacaaguuuuugagacacuggauuucuuuaauuaaaaaaaaaaugccaagaaacauuauuuau

SEQ ID NO: 32650 - RNA, 64 nt, hsa
gaugauuuuauguuauguggauuucauuucaauaaaaaaaaacucuuaucaaaaaacccauggc

SEQ ID NO: 32651 - RNA, 64 nt, hsa
ggaugauuuuauguuauguggauuucauuucaauaaaaaaaaacucuuaucaaaaaacccaugg

SEQ ID NO: 32652 - RNA, 64 nt, hsa
ggugcuaaaccuccaagugucaugauuuaaaaaaaaaaaaaauuuauguccuucuuauuuauuu

SEQ ID NO: 32653 - RNA, 64 nt, hsa
uggugcuaaaccuccaagugucaugauuuaaaaaaaaaaaaaauuuauguccuucuuauuuauu

SEQ ID NO: 32654 - RNA, 64 nt, hsa
cuggugcuaaaccuccaagugucaugauuuaaaaaaaaaaaaaauuuauguccuucuuauuuau

SEQ ID NO: 32655 - RNA, 64 nt, hsa
gcuggugcuaaaccuccaagugucaugauuuaaaaaaaaaaaaaauuuauguccuucuuauuua

SEQ ID NO: 32656 - RNA, 64 nt, hsa
ugcuggugcuaaaccuccaagugucaugauuuaaaaaaaaaaaaaauuuauguccuucuuauuu

SEQ ID NO: 32657 - RNA, 64 nt, hsa
augcuggugcuaaaccuccaagugucaugauuuaaaaaaaaaaaaaauuuauguccuucuuauu

SEQ ID NO: 32658 - RNA, 64 nt, hsa
gaugcuggugcuaaaccuccaagugucaugauuuaaaaaaaaaaaaaauuuauguccuucuuau

SEQ ID NO: 32659 - RNA, 64 nt, hsa
gugcugugggcacuggaguagagauuucuggagaaaaaaaaacaguuuauuucaucuugccuuu

SEQ ID NO: 32660 - RNA, 64 nt, hsa
ugugcugugggcacuggaguagagauuucuggagaaaaaaaaacaguuuauuucaucuugccuu

SEQ ID NO: 32661 - RNA, 64 nt, hsa
agauuuauuuaaaguucuuaaugccaacaguuuaaaaaaaaauuaaaacauuugaaugaacugu

SEQ ID NO: 32662 - RNA, 64 nt, hsa
uagauuuauuuaaaguucuuaaugccaacaguuuaaaaaaaaauuaaaacauuugaaugaacug

SEQ ID NO: 32663 - RNA, 64 nt, hsa
agauucauuuuucuugauguaauuuaucaccauaaaaaaaaacccaugcaaaccugagugagca

SEQ ID NO: 32664 - RNA, 64 nt, hsa
cagauucauuuuucuugauguaauuuaucaccauaaaaaaaaacccaugcaaaccugagugagc

SEQ ID NO: 32665 - RNA, 64 nt, hsa
uugcuguaagaaaaaauguaagacaaaaaaaaaaaaaaaaaacaaacagaggcagaggcaggca

SEQ ID NO: 32666 - RNA, 64 nt, hsa
auugcuguaagaaaaaauguaagacaaaaaaaaaaaaaaaaaacaaacagaggcagaggcaggc

SEQ ID NO: 32667 - RNA, 64 nt, hsa
gauugcuguaagaaaaaauguaagacaaaaaaaaaaaaaaaaaacaaacagaggcagaggcagg

SEQ ID NO: 32668 - RNA, 64 nt, hsa
agauugcuguaagaaaaaauguaagacaaaaaaaaaaaaaaaaaacaaacagaggcagaggcag

SEQ ID NO: 32669 - RNA, 64 nt, hsa
aagauugcuguaagaaaaaauguaagacaaaaaaaaaaaaaaaaaacaaacagaggcagaggca

SEQ ID NO: 32670 - RNA, 64 nt, hsa
aaagauugcuguaagaaaaaauguaagacaaaaaaaaaaaaaaaaaacaaacagaggcagaggc

SEQ ID NO: 32671 - RNA, 64 nt, hsa
aaaagauugcuguaagaaaaaauguaagacaaaaaaaaaaaaaaaaaacaaacagaggcagagg

SEQ ID NO: 32672 - RNA, 64 nt, hsa
caaaagauugcuguaagaaaaaauguaagacaaaaaaaaaaaaaaaaaacaaacagaggcagag

SEQ ID NO: 32673 - RNA, 64 nt, hsa
ucaaaagauugcuguaagaaaaaauguaagacaaaaaaaaaaaaaaaaaacaaacagaggcaga

SEQ ID NO: 32674 - RNA, 64 nt, hsa
cucaaaagauugcuguaagaaaaaauguaagacaaaaaaaaaaaaaaaaaacaaacagaggcag

SEQ ID NO: 32675 - RNA, 64 nt, hsa
ucucaaaagauugcuguaagaaaaaauguaagacaaaaaaaaaaaaaaaaaacaaacagaggca

SEQ ID NO: 32676 - RNA, 64 nt, hsa
agcguuuuuauguaugcuguuccugcaguuaggaaaaaaaaauccaagaaauguauugaauacu

SEQ ID NO: 32677 - RNA, 64 nt, hsa
gagcguuuuuauguaugcuguuccugcaguuaggaaaaaaaaauccaagaaauguauugaauac

SEQ ID NO: 32678 - RNA, 64 nt, hsa
aaagaauugugaucaggucacauuguuaauaaaaaaaaaaaacgggcuagucccuauguuauag

SEQ ID NO: 32679 - RNA, 64 nt, hsa
uaaagaauugugaucaggucacauuguuaauaaaaaaaaaaaacgggcuagucccuauguuaua

SEQ ID NO: 32680 - RNA, 64 nt, hsa
uuaaagaauugugaucaggucacauuguuaauaaaaaaaaaaaacgggcuagucccuauguuau

SEQ ID NO: 32681 - RNA, 64 nt, hsa
uuuaaagaauugugaucaggucacauuguuaauaaaaaaaaaaaacgggcuagucccuauguua

SEQ ID NO: 32682 - RNA, 64 nt, hsa
cuuuaaagaauugugaucaggucacauuguuaauaaaaaaaaaaaacgggcuagucccuauguu

SEQ ID NO: 32683 - RNA, 64 nt, hsa
ugaaggaaauaagugaaacuacaucuaugggaaaaaaaaaaacauugagaagugcaaauguucg

SEQ ID NO: 32684 - RNA, 64 nt, hsa
cugaaggaaauaagugaaacuacaucuaugggaaaaaaaaaaacauugagaagugcaaauguuc

SEQ ID NO: 32685 - RNA, 64 nt, hsa
ccugaaggaaauaagugaaacuacaucuaugggaaaaaaaaaaacauugagaagugcaaauguu

SEQ ID NO: 32686 - RNA, 64 nt, hsa
gccugaaggaaauaagugaaacuacaucuaugggaaaaaaaaaaacauugagaagugcaaaugu

SEQ ID NO: 32687 - RNA, 64 nt, hsa
caaauaagcagaaaacauacuuauuuuaaaaaagaaaaaaaaggauaaaaaaacccaaacugaa

SEQ ID NO: 32688 - RNA, 64 nt, hsa
ggugacugagguuuuuauguagaaggggaacaaaaaaaaaaauaucugaauuuugaaaaaccac

SEQ ID NO: 32689 - RNA, 64 nt, hsa
uggugacugagguuuuuauguagaaggggaacaaaaaaaaaaauaucugaauuuugaaaaacca

SEQ ID NO: 32690 - RNA, 64 nt, hsa
guggugacugagguuuuuauguagaaggggaacaaaaaaaaaaauaucugaauuuugaaaaacc

SEQ ID NO: 32691 - RNA, 64 nt, hsa
aguggugacugagguuuuuauguagaaggggaacaaaaaaaaaaauaucugaauuuugaaaaac

SEQ ID NO: 32692 - RNA, 64 nt, hsa
uggccaacauggugaaaccccgucucuacuaaaaaaaaaaaauagacaaaaauuagcggggggg

SEQ ID NO: 32693 - RNA, 64 nt, hsa
cuggccaacauggugaaaccccgucucuacuaaaaaaaaaaaauagacaaaaauuagcgggggg

SEQ ID NO: 32694 - RNA, 64 nt, hsa
acuggccaacauggugaaaccccgucucuacuaaaaaaaaaaaauagacaaaaauuagcggggg

SEQ ID NO: 32695 - RNA, 64 nt, hsa
gacuggccaacauggugaaaccccgucucuacuaaaaaaaaaaaauagacaaaaauuagcgggg

SEQ ID NO: 32696 - RNA, 64 nt, hsa
agacuggccaacauggugaaaccccgucucuacuaaaaaaaaaaaauagacaaaaauuagcggg

SEQ ID NO: 32697 - RNA, 64 nt, hsa
acacuuuucucauuuuccugagaauuuaccagaaaaaaaaaagauacauagauuugucucugug

SEQ ID NO: 32698 - RNA, 64 nt, hsa
cacacuuuucucauuuuccugagaauuuaccagaaaaaaaaaagauacauagauuugucucugu

SEQ ID NO: 32699 - RNA, 64 nt, hsa
gcacacuuuucucauuuuccugagaauuuaccagaaaaaaaaaagauacauagauuugucucug

SEQ ID NO: 32700 - RNA, 64 nt, hsa
cuccuaacuucagggaauaaagugcuaaaguguaaaaaaaaauaaaaauaaaaauaaauaaaua

SEQ ID NO: 32701 - RNA, 64 nt, hsa
ccuccuaacuucagggaauaaagugcuaaaguguaaaaaaaaauaaaaauaaaaauaaauaaau

SEQ ID NO: 32702 - RNA, 64 nt, hsa
auauugaaaaauugacaaauuguguacaaacacuaaaaaaaacuuguuuaaauuguauuugcaa

SEQ ID NO: 32703 - RNA, 64 nt, hsa
gggagaagauacuguggcaaccaggaaggaauggaaaaaaaauucuuuucucuacagcaaauua

SEQ ID NO: 32704 - RNA, 64 nt, hsa
acccugucucuauuaaaaauacaaaaaaaaaaaaaaaaaaaauagccgggcaugguggcgcaag

SEQ ID NO: 32705 - RNA, 64 nt, hsa
aacccugucucuauuaaaaauacaaaaaaaaaaaaaaaaaaaauagccgggcaugguggcgcaa

SEQ ID NO: 32706 - RNA, 64 nt, hsa
aaacccugucucuauuaaaaauacaaaaaaaaaaaaaaaaaaaauagccgggcaugguggcgca

SEQ ID NO: 32707 - RNA, 64 nt, hsa
gaaacccugucucuauuaaaaauacaaaaaaaaaaaaaaaaaaaauagccgggcaugguggcgc

SEQ ID NO: 32708 - RNA, 64 nt, hsa
agaaacccugucucuauuaaaaauacaaaaaaaaaaaaaaaaaaaauagccgggcaugguggcg

SEQ ID NO: 32709 - RNA, 64 nt, hsa
gagaaacccugucucuauuaaaaauacaaaaaaaaaaaaaaaaaaaauagccgggcaugguggc

SEQ ID NO: 32710 - RNA, 64 nt, hsa
ggagaaacccugucucuauuaaaaauacaaaaaaaaaaaaaaaaaaaauagccgggcauggugg

SEQ ID NO: 32711 - RNA, 64 nt, hsa
uggagaaacccugucucuauuaaaaauacaaaaaaaaaaaaaaaaaaaauagccgggcauggug

SEQ ID NO: 32712 - RNA, 64 nt, hsa
auggagaaacccugucucuauuaaaaauacaaaaaaaaaaaaaaaaaaaauagccgggcauggu

SEQ ID NO: 32713 - RNA, 64 nt, hsa
cauggagaaacccugucucuauuaaaaauacaaaaaaaaaaaaaaaaaaaauagccgggcaugg

SEQ ID NO: 32714 - RNA, 64 nt, hsa
acauggagaaacccugucucuauuaaaaauacaaaaaaaaaaaaaaaaaaaauagccgggcaug

SEQ ID NO: 32715 - RNA, 64 nt, hsa
aacauggagaaacccugucucuauuaaaaauacaaaaaaaaaaaaaaaaaaaauagccgggcau

SEQ ID NO: 32716 - RNA, 64 nt, hsa
caacauggagaaacccugucucuauuaaaaauacaaaaaaaaaaaaaaaaaaaauagccgggca

SEQ ID NO: 32717 - RNA, 64 nt, hsa
cuuuguuuagggguaggcuuugaugaccaggaaaaaaaaaaagguauuucugcauuuuauggcc

SEQ ID NO: 32718 - RNA, 64 nt, hsa
ccuuuguuuagggguaggcuuugaugaccaggaaaaaaaaaaagguauuucugcauuuuauggc

SEQ ID NO: 32719 - RNA, 64 nt, hsa
cccuuuguuuagggguaggcuuugaugaccaggaaaaaaaaaaagguauuucugcauuuuaugg

SEQ ID NO: 32720 - RNA, 64 nt, hsa
ccccuuuguuuagggguaggcuuugaugaccaggaaaaaaaaaaagguauuucugcauuuuaug

SEQ ID NO: 32721 - RNA, 64 nt, hsa
gagguuacagagggaggugauauuuucagcuaaaaaaaaaaacggguggaguuuggacugauca

SEQ ID NO: 32722 - RNA, 64 nt, hsa
agagguuacagagggaggugauauuuucagcuaaaaaaaaaaacggguggaguuuggacugauc

SEQ ID NO: 32723 - RNA, 64 nt, hsa
uagagguuacagagggaggugauauuuucagcuaaaaaaaaaaacggguggaguuuggacugau

SEQ ID NO: 32724 - RNA, 64 nt, hsa
guagagguuacagagggaggugauauuuucagcuaaaaaaaaaaacggguggaguuuggacuga

SEQ ID NO: 32725 - RNA, 64 nt, hsa
ccuauugaugcugguguuuaaaaaacaucacuuaaaaaaaaagaauaaauaguucuaaaagcaa

SEQ ID NO: 32726 - RNA, 64 nt, hsa
uccuauugaugcugguguuuaaaaaacaucacuuaaaaaaaaagaauaaauaguucuaaaagca

SEQ ID NO: 32727 - RNA, 64 nt, hsa
caagagcaaaacugucucaaaaaaaaaaaaaaaaaaaaaaaaccauuuuaauugaucugugaaa

SEQ ID NO: 32728 - RNA, 64 nt, hsa
acaagagcaaaacugucucaaaaaaaaaaaaaaaaaaaaaaaaccauuuuaauugaucugugaa

SEQ ID NO: 32729 - RNA, 64 nt, hsa
aacaagagcaaaacugucucaaaaaaaaaaaaaaaaaaaaaaaaccauuuuaauugaucuguga

SEQ ID NO: 32730 - RNA, 64 nt, hsa
caacaagagcaaaacugucucaaaaaaaaaaaaaaaaaaaaaaaaccauuuuaauugaucugug

SEQ ID NO: 32731 - RNA, 64 nt, hsa
acaacaagagcaaaacugucucaaaaaaaaaaaaaaaaaaaaaaaaccauuuuaauugaucugu

SEQ ID NO: 32732 - RNA, 64 nt, hsa
gacaacaagagcaaaacugucucaaaaaaaaaaaaaaaaaaaaaaaaccauuuuaauugaucug

SEQ ID NO: 32733 - RNA, 64 nt, hsa
ggacaacaagagcaaaacugucucaaaaaaaaaaaaaaaaaaaaaaaaccauuuuaauugaucu

SEQ ID NO: 32734 - RNA, 64 nt, hsa
uggacaacaagagcaaaacugucucaaaaaaaaaaaaaaaaaaaaaaaaccauuuuaauugauc

SEQ ID NO: 32735 - RNA, 64 nt, hsa
cuggacaacaagagcaaaacugucucaaaaaaaaaaaaaaaaaaaaaaaaccauuuuaauugau

SEQ ID NO: 32736 - RNA, 64 nt, hsa
ccuggacaacaagagcaaaacugucucaaaaaaaaaaaaaaaaaaaaaaaaccauuuuaauuga

SEQ ID NO: 32737 - RNA, 64 nt, hsa
gccuggacaacaagagcaaaacugucucaaaaaaaaaaaaaaaaaaaaaaaaccauuuuaauug

SEQ ID NO: 32738 - RNA, 64 nt, hsa
agccuggacaacaagagcaaaacugucucaaaaaaaaaaaaaaaaaaaaaaaaccauuuuaauu

SEQ ID NO: 32739 - RNA, 64 nt, hsa
cagccuggacaacaagagcaaaacugucucaaaaaaaaaaaaaaaaaaaaaaaaccauuuuaau

SEQ ID NO: 32740 - RNA, 64 nt, hsa
ccagccuggacaacaagagcaaaacugucucaaaaaaaaaaaaaaaaaaaaaaaaccauuuuaa

SEQ ID NO: 32741 - RNA, 64 nt, hsa
uccagccuggacaacaagagcaaaacugucucaaaaaaaaaaaaaaaaaaaaaaaaccauuuua

SEQ ID NO: 32742 - RNA, 64 nt, hsa
cuccagccuggacaacaagagcaaaacugucucaaaaaaaaaaaaaaaaaaaaaaaaccauuuu

SEQ ID NO: 32743 - RNA, 64 nt, hsa
acuccagccuggacaacaagagcaaaacugucucaaaaaaaaaaaaaaaaaaaaaaaaccauuu

SEQ ID NO: 32744 - RNA, 64 nt, hsa
uagcaccuccccuucccaaaccaaacaacccaacaaaaaaaaucccucacuuuuguuuucuguu

SEQ ID NO: 32745 - RNA, 64 nt, hsa
ccauuuaaccguauguaaacuugguuucuaauuaaaaaaaaauuucuuuuuccaauuugguuuc

SEQ ID NO: 32746 - RNA, 64 nt, hsa
accauuuaaccguauguaaacuugguuucuaauuaaaaaaaaauuucuuuuuccaauuugguuu

SEQ ID NO: 32747 - RNA, 64 nt, hsa
cuggcugcaguaggaaaggccaaacugacgacaaaaaaaaaauucuuuauaaagaugauauggu

SEQ ID NO: 32748 - RNA, 64 nt, hsa
ccuggcugcaguaggaaaggccaaacugacgacaaaaaaaaaauucuuuauaaagaugauaugg

SEQ ID NO: 32749 - RNA, 64 nt, hsa
accuggcugcaguaggaaaggccaaacugacgacaaaaaaaaaauucuuuauaaagaugauaug

SEQ ID NO: 32750 - RNA, 64 nt, hsa
ggauaugcaugauucuuaaccaggcuauauguuaaaaaaaaauuggaaaaugcaauacauuuuu

SEQ ID NO: 32751 - RNA, 64 nt, hsa
aggauaugcaugauucuuaaccaggcuauauguuaaaaaaaaauuggaaaaugcaauacauuuu

SEQ ID NO: 32752 - RNA, 64 nt, hsa
cuccagccugggcaacagguaagacucugucucaaaaaaaaacaaaaaagaagaagaaaaguac

SEQ ID NO: 32753 - RNA, 64 nt, hsa
acuccagccugggcaacagguaagacucugucucaaaaaaaaacaaaaaagaagaagaaaagua

SEQ ID NO: 32754 - RNA, 64 nt, hsa
aucccaucucuacgcccacccuccccccggcaaaaaaaaaaagcuggguaugguggcuuaugcc

SEQ ID NO: 32755 - RNA, 64 nt, hsa
gaucccaucucuacgcccacccuccccccggcaaaaaaaaaaagcuggguaugguggcuuaugc

SEQ ID NO: 32756 - RNA, 64 nt, hsa
ggaucccaucucuacgcccacccuccccccggcaaaaaaaaaaagcuggguaugguggcuuaug

SEQ ID NO: 32757 - RNA, 64 nt, hsa
aggaucccaucucuacgcccacccuccccccggcaaaaaaaaaaagcuggguaugguggcuuau

SEQ ID NO: 32758 - RNA, 64 nt, hsa
uuuaaaacagacuccuuuaaaaaaacaaacaaacaaaaaaaacauagacuucuuuauaucuuuu

SEQ ID NO: 32759 - RNA, 64 nt, hsa
cuccaggcugggcaacaguacgagacucuguuccaaaaaaaauaaaaaagaacagccuuuuuag

SEQ ID NO: 32760 - RNA, 64 nt, hsa
guguuuuuguuuuugauuauguugcuuguuaauaaaaaaaaauagaaaagagaacaauguguuu

SEQ ID NO: 32761 - RNA, 64 nt, hsa
uguguuuuuguuuuugauuauguugcuuguuaauaaaaaaaaauagaaaagagaacaauguguu

SEQ ID NO: 32762 - RNA, 64 nt, hsa
cuuccuuuuuuuuuuuuuaagaaaggaaaaaagaaaaaaaaaucaaacuugaaacuuuucuuuu

SEQ ID NO: 32763 - RNA, 64 nt, hsa
acuuccuuuuuuuuuuuuuaagaaaggaaaaaagaaaaaaaaaucaaacuugaaacuuuucuuu

SEQ ID NO: 32764 - RNA, 64 nt, hsa
acagagcgagaccaugucucaaaaaauaaaaauaaaaaaaaauuguuuucauuaccucagcccu

SEQ ID NO: 32765 - RNA, 64 nt, hsa
gacagagcgagaccaugucucaaaaaauaaaaauaaaaaaaaauuguuuucauuaccucagccc

SEQ ID NO: 32766 - RNA, 64 nt, hsa
gcagcuguagaaaagugcuugucaguuguugaauaaaaaaaaccacauuugauagagauucaaa

SEQ ID NO: 32767 - RNA, 64 nt, hsa
aggaccaaucucauuuuuaauaagguuaaaaagaaaaaaaaagucuagcgaaaaaacuccuguu

SEQ ID NO: 32768 - RNA, 64 nt, hsa
uaggaccaaucucauuuuuaauaagguuaaaaagaaaaaaaaagucuagcgaaaaaacuccugu

SEQ ID NO: 32769 - RNA, 64 nt, hsa
uuucucuucucccaaaucuuuucccuucaaaggaaaaaaaaauguucagaggucccugucuucu

SEQ ID NO: 32770 - RNA, 64 nt, hsa
uuuucucuucucccaaaucuuuucccuucaaaggaaaaaaaaauguucagaggucccugucuuc

SEQ ID NO: 32771 - RNA, 64 nt, hsa
uuggggggagguugguuuuguuuuuaaauauaaaaaaaaaaaucugucacuggacaucagucac

SEQ ID NO: 32772 - RNA, 64 nt, hsa
uuuggggggagguugguuuuguuuuuaaauauaaaaaaaaaaaucugucacuggacaucaguca

SEQ ID NO: 32773 - RNA, 64 nt, hsa
auuuggggggagguugguuuuguuuuuaaauauaaaaaaaaaaaucugucacuggacaucaguc

SEQ ID NO: 32774 - RNA, 64 nt, hsa
uauuuggggggagguugguuuuguuuuuaaauauaaaaaaaaaaaucugucacuggacaucagu

SEQ ID NO: 32775 - RNA, 64 nt, hsa
uauuauauacaaguguaauacaugcauauaauagaaaaaaaacauggaauuucaaauauacuaa

SEQ ID NO: 32776 - RNA, 64 nt, hsa
uuuucacaauggcucaagacuauaugaaauuauaaaaaaaaaguugcccugggguuucugcauc

SEQ ID NO: 32777 - RNA, 64 nt, hsa
auuuucacaauggcucaagacuauaugaaauuauaaaaaaaaaguugcccugggguuucugcau

SEQ ID NO: 32778 - RNA, 64 nt, hsa
ccuuaccauuauuccagagauucaguauuaaaaaaaaaaaaauuacacugugguaguggcauuu

SEQ ID NO: 32779 - RNA, 64 nt, hsa
accuuaccauuauuccagagauucaguauuaaaaaaaaaaaaauuacacugugguaguggcauu

SEQ ID NO: 32780 - RNA, 64 nt, hsa
gaccuuaccauuauuccagagauucaguauuaaaaaaaaaaaaauuacacugugguaguggcau

SEQ ID NO: 32781 - RNA, 64 nt, hsa
ugaccuuaccauuauuccagagauucaguauuaaaaaaaaaaaaauuacacugugguaguggca

SEQ ID NO: 32782 - RNA, 64 nt, hsa
uugaccuuaccauuauuccagagauucaguauuaaaaaaaaaaaaauuacacugugguaguggc

SEQ ID NO: 32783 - RNA, 64 nt, hsa
uuugaccuuaccauuauuccagagauucaguauuaaaaaaaaaaaaauuacacugugguagugg

SEQ ID NO: 32784 - RNA, 64 nt, hsa
gccggggugacagagcgaaccucugucucaaaaaaaaaaaaagaaaaaagaaagaaagaaaaaa

SEQ ID NO: 32785 - RNA, 64 nt, hsa
agccggggugacagagcgaaccucugucucaaaaaaaaaaaaagaaaaaagaaagaaagaaaaa

SEQ ID NO: 32786 - RNA, 64 nt, hsa
cagccggggugacagagcgaaccucugucucaaaaaaaaaaaaagaaaaaagaaagaaagaaaa

SEQ ID NO: 32787 - RNA, 64 nt, hsa
ccagccggggugacagagcgaaccucugucucaaaaaaaaaaaaagaaaaaagaaagaaagaaa

SEQ ID NO: 32788 - RNA, 64 nt, hsa
uccagccggggugacagagcgaaccucugucucaaaaaaaaaaaaagaaaaaagaaagaaagaa

SEQ ID NO: 32789 - RNA, 64 nt, hsa
cuccagccggggugacagagcgaaccucugucucaaaaaaaaaaaaagaaaaaagaaagaaaga

SEQ ID NO: 32790 - RNA, 64 nt, hsa
gccuggccaacacggugaaaccccaucucuacuaaaaaaaaauacaaaaauuagccgggcgugg

SEQ ID NO: 32791 - RNA, 64 nt, hsa
agccuggccaacacggugaaaccccaucucuacuaaaaaaaaauacaaaaauuagccgggcgug

SEQ ID NO: 32792 - RNA, 64 nt, hsa
cugguaauuugugcagcagcaauagaugauaaccaaaaaaaacucauaauaaucugaauaucuu

SEQ ID NO: 32793 - RNA, 64 nt, hsa
agaauuaagggguaaagcacuaaacagaaaagaaaaaaaaaauagcaacucuggugagcagauu

SEQ ID NO: 32794 - RNA, 64 nt, hsa
aagaauuaagggguaaagcacuaaacagaaaagaaaaaaaaaauagcaacucuggugagcagau

SEQ ID NO: 32795 - RNA, 64 nt, hsa
uaagaauuaagggguaaagcacuaaacagaaaagaaaaaaaaaauagcaacucuggugagcaga

SEQ ID NO: 32796 - RNA, 64 nt, hsa
cagccugggugaagaagugagacucugucuuaaaaaaaaaaauuggugcugauaaauauugaug

SEQ ID NO: 32797 - RNA, 64 nt, hsa
ccagccugggugaagaagugagacucugucuuaaaaaaaaaaauuggugcugauaaauauugau

SEQ ID NO: 32798 - RNA, 64 nt, hsa
uccagccugggugaagaagugagacucugucuuaaaaaaaaaaauuggugcugauaaauauuga

SEQ ID NO: 32799 - RNA, 64 nt, hsa
cuccagccugggugaagaagugagacucugucuuaaaaaaaaaaauuggugcugauaaauauug

SEQ ID NO: 32800 - RNA, 64 nt, hsa
caacauggugaaaccccaucucuacuaaaaaaaaaaaaaaaauuagucgggcgugguggugcau

SEQ ID NO: 32801 - RNA, 64 nt, hsa
ccaacauggugaaaccccaucucuacuaaaaaaaaaaaaaaaauuagucgggcgugguggugca

SEQ ID NO: 32802 - RNA, 64 nt, hsa
gccaacauggugaaaccccaucucuacuaaaaaaaaaaaaaaaauuagucgggcgugguggugc

SEQ ID NO: 32803 - RNA, 64 nt, hsa
ggccaacauggugaaaccccaucucuacuaaaaaaaaaaaaaaaauuagucgggcgugguggug

SEQ ID NO: 32804 - RNA, 64 nt, hsa
uggccaacauggugaaaccccaucucuacuaaaaaaaaaaaaaaaauuagucgggcgugguggu

SEQ ID NO: 32805 - RNA, 64 nt, hsa
cuggccaacauggugaaaccccaucucuacuaaaaaaaaaaaaaaaauuagucgggcguggugg

SEQ ID NO: 32806 - RNA, 64 nt, hsa
ccuggccaacauggugaaaccccaucucuacuaaaaaaaaaaaaaaaauuagucgggcguggug

SEQ ID NO: 32807 - RNA, 64 nt, hsa
gccuggccaacauggugaaaccccaucucuacuaaaaaaaaaaaaaaaauuagucgggcguggu

SEQ ID NO: 32808 - RNA, 64 nt, hsa
agccuggccaacauggugaaaccccaucucuacuaaaaaaaaaaaaaaaauuagucgggcgugg

SEQ ID NO: 32809 - RNA, 64 nt, hsa
ugucucaaaaaaaaaaaaacaaaaacaaacaaacaaaaaaaacaccucaccaugagugcuacau

SEQ ID NO: 32810 - RNA, 64 nt, hsa
gcuugggcaacagaguaagacucugucucaaaaaaaaaaaaacaaaaacaaacaaacaaaaaaa

SEQ ID NO: 32811 - RNA, 64 nt, hsa
agcuugggcaacagaguaagacucugucucaaaaaaaaaaaaacaaaaacaaacaaacaaaaaa

SEQ ID NO: 32812 - RNA, 64 nt, hsa
cagcuugggcaacagaguaagacucugucucaaaaaaaaaaaaacaaaaacaaacaaacaaaaa

SEQ ID NO: 32813 - RNA, 64 nt, hsa
ccagcuugggcaacagaguaagacucugucucaaaaaaaaaaaaacaaaaacaaacaaacaaaa

SEQ ID NO: 32814 - RNA, 64 nt, hsa
uccagcuugggcaacagaguaagacucugucucaaaaaaaaaaaaacaaaaacaaacaaacaaa

SEQ ID NO: 32815 - RNA, 64 nt, hsa
cuccagcuugggcaacagaguaagacucugucucaaaaaaaaaaaaacaaaaacaaacaaacaa

SEQ ID NO: 32816 - RNA, 64 nt, hsa
cugucgguuaacuguaaaguuagggggaagaaagaaaaaaaauuaaaaggguagacacaguuga

SEQ ID NO: 32817 - RNA, 64 nt, hsa
uuaaaauagaaguacaccuaauuguuauugguuaaaaaaaaagccauaugugaaugagguuggu

SEQ ID NO: 32818 - RNA, 64 nt, hsa
uuuaaaauagaaguacaccuaauuguuauugguuaaaaaaaaagccauaugugaaugagguugg

SEQ ID NO: 32819 - RNA, 64 nt, hsa
uaagugauugaugcuguuuucuuuuaaaaaaaaaaaaaaaaauucauuuucuuuggguuagagc

SEQ ID NO: 32820 - RNA, 64 nt, hsa
uuaagugauugaugcuguuuucuuuuaaaaaaaaaaaaaaaaauucauuuucuuuggguuagag

SEQ ID NO: 32821 - RNA, 64 nt, hsa
cuuaagugauugaugcuguuuucuuuuaaaaaaaaaaaaaaaaauucauuuucuuuggguuaga

SEQ ID NO: 32822 - RNA, 64 nt, hsa
ucuuaagugauugaugcuguuuucuuuuaaaaaaaaaaaaaaaaauucauuuucuuuggguuag

SEQ ID NO: 32823 - RNA, 64 nt, hsa
aucuuaagugauugaugcuguuuucuuuuaaaaaaaaaaaaaaaaauucauuuucuuuggguua

SEQ ID NO: 32824 - RNA, 64 nt, hsa
aaucuuaagugauugaugcuguuuucuuuuaaaaaaaaaaaaaaaaauucauuuucuuuggguu

SEQ ID NO: 32825 - RNA, 64 nt, hsa
aaaucuuaagugauugaugcuguuuucuuuuaaaaaaaaaaaaaaaaauucauuuucuuugggu

SEQ ID NO: 32826 - RNA, 64 nt, hsa
aaaaucuuaagugauugaugcuguuuucuuuuaaaaaaaaaaaaaaaaauucauuuucuuuggg

SEQ ID NO: 32827 - RNA, 64 nt, hsa
gaaaaucuuaagugauugaugcuguuuucuuuuaaaaaaaaaaaaaaaaauucauuuucuuugg

SEQ ID NO: 32828 - RNA, 64 nt, hsa
agaaaaucuuaagugauugaugcuguuuucuuuuaaaaaaaaaaaaaaaaauucauuuucuuug

SEQ ID NO: 32829 - RNA, 64 nt, hsa
gagaugcuauacuaauaagcaaguguaaaaaaaaaaaaaaaagaggaagaaaaucuuaagugau

SEQ ID NO: 32830 - RNA, 64 nt, hsa
cgagaugcuauacuaauaagcaaguguaaaaaaaaaaaaaaaagaggaagaaaaucuuaaguga

SEQ ID NO: 32831 - RNA, 64 nt, hsa
acgagaugcuauacuaauaagcaaguguaaaaaaaaaaaaaaaagaggaagaaaaucuuaagug

SEQ ID NO: 32832 - RNA, 64 nt, hsa
aacgagaugcuauacuaauaagcaaguguaaaaaaaaaaaaaaaagaggaagaaaaucuuaagu

SEQ ID NO: 32833 - RNA, 64 nt, hsa
gaacgagaugcuauacuaauaagcaaguguaaaaaaaaaaaaaaaagaggaagaaaaucuuaag

SEQ ID NO: 32834 - RNA, 64 nt, hsa
ggaacgagaugcuauacuaauaagcaaguguaaaaaaaaaaaaaaaagaggaagaaaaucuuaa

SEQ ID NO: 32835 - RNA, 64 nt, hsa
uggaacgagaugcuauacuaauaagcaaguguaaaaaaaaaaaaaaaagaggaagaaaaucuua

SEQ ID NO: 32836 - RNA, 64 nt, hsa
uuggaacgagaugcuauacuaauaagcaaguguaaaaaaaaaaaaaaaagaggaagaaaaucuu

SEQ ID NO: 32837 - RNA, 64 nt, hsa
uuuggaacgagaugcuauacuaauaagcaaguguaaaaaaaaaaaaaaaagaggaagaaaaucu

SEQ ID NO: 32838 - RNA, 64 nt, hsa
gcagugacuuauacuaagacaauuuauuguuuaaaaaaaaaauuggcaagacaacuauaugguu

SEQ ID NO: 32839 - RNA, 64 nt, hsa
ugcagugacuuauacuaagacaauuuauuguuuaaaaaaaaaauuggcaagacaacuauauggu

SEQ ID NO: 32840 - RNA, 64 nt, hsa
augcagugacuuauacuaagacaauuuauuguuuaaaaaaaaaauuggcaagacaacuauaugg

SEQ ID NO: 32841 - RNA, 64 nt, hsa
acuguuuuacaguaucaaaauuuuucacuuaaagaaaaaaaaugccaugaaacauuugaacuga

SEQ ID NO: 32842 - RNA, 64 nt, hsa
uaaaauguagcuggcccaggacauguaaaaaaaaaaaaaaaacaacaacaauaaauagggcaug

SEQ ID NO: 32843 - RNA, 64 nt, hsa
guaaaauguagcuggcccaggacauguaaaaaaaaaaaaaaaacaacaacaauaaauagggcau

SEQ ID NO: 32844 - RNA, 64 nt, hsa
aguaaaauguagcuggcccaggacauguaaaaaaaaaaaaaaaacaacaacaauaaauagggca

SEQ ID NO: 32845 - RNA, 64 nt, hsa
uaguaaaauguagcuggcccaggacauguaaaaaaaaaaaaaaaacaacaacaauaaauagggc

SEQ ID NO: 32846 - RNA, 64 nt, hsa
uuaguaaaauguagcuggcccaggacauguaaaaaaaaaaaaaaaacaacaacaauaaauaggg

SEQ ID NO: 32847 - RNA, 64 nt, hsa
uuuaguaaaauguagcuggcccaggacauguaaaaaaaaaaaaaaaacaacaacaauaaauagg

SEQ ID NO: 32848 - RNA, 64 nt, hsa
auuuaguaaaauguagcuggcccaggacauguaaaaaaaaaaaaaaaacaacaacaauaaauag

SEQ ID NO: 32849 - RNA, 64 nt, hsa
cauuuaguaaaauguagcuggcccaggacauguaaaaaaaaaaaaaaaacaacaacaauaaaua

SEQ ID NO: 32850 - RNA, 64 nt, hsa
ccauuuaguaaaauguagcuggcccaggacauguaaaaaaaaaaaaaaaacaacaacaauaaau

SEQ ID NO: 32851 - RNA, 64 nt, hsa
uauacauuucaguggccuuuuuuuuuuuuuaaggaaaaaaaagcgcaaaaccaaguacauagug

SEQ ID NO: 32852 - RNA, 53 nt, hsa
uaagcaaacuuuccaaauaaaaaaaaaaaaagcagcaaguaauggaauugcac

SEQ ID NO: 32853 - RNA, 52 nt, hsa
uaagcaaacuuuccaaauaaaaaaaaaaaaagcagcaaguaauggaauugca

SEQ ID NO: 32854 - RNA, 51 nt, hsa
uaagcaaacuuuccaaauaaaaaaaaaaaaagcagcaaguaauggaauugc

SEQ ID NO: 32855 - RNA, 50 nt, hsa
uaagcaaacuuuccaaauaaaaaaaaaaaaagcagcaaguaauggaauug

SEQ ID NO: 32856 - RNA, 64 nt, hsa
gauuucagcucuguauuugugguaucaguuuggaaaaaaaaaucugauacuccauuugauuauu

SEQ ID NO: 32857 - RNA, 64 nt, hsa
agauuucagcucuguauuugugguaucaguuuggaaaaaaaaaucugauacuccauuugauuau

SEQ ID NO: 32858 - RNA, 64 nt, hsa
agguugacuaucuaaauaggcauuuuuagucauuaaaaaaaaucuagucaccaggaggaucccu

SEQ ID NO: 32859 - RNA, 64 nt, hsa
agccugggcgacagagcaagacucugucucaaaaaaaaaaaauaauaauaaaauaagugagcug

SEQ ID NO: 32860 - RNA, 64 nt, hsa
cagccugggcgacagagcaagacucugucucaaaaaaaaaaaauaauaauaaaauaagugagcu

SEQ ID NO: 32861 - RNA, 64 nt, hsa
ccagccugggcgacagagcaagacucugucucaaaaaaaaaaaauaauaauaaaauaagugagc

SEQ ID NO: 32862 - RNA, 64 nt, hsa
uccagccugggcgacagagcaagacucugucucaaaaaaaaaaaauaauaauaaaauaagugag

SEQ ID NO: 32863 - RNA, 64 nt, hsa
cuccagccugggcgacagagcaagacucugucucaaaaaaaaaaaauaauaauaaaauaaguga

SEQ ID NO: 32864 - RNA, 64 nt, hsa
aguccuucaaauacugcuguauuuucaggaaaaaaaaaaaaagggguguuucuauugaaacugu

SEQ ID NO: 32865 - RNA, 64 nt, hsa
uaguccuucaaauacugcuguauuuucaggaaaaaaaaaaaaagggguguuucuauugaaacug

SEQ ID NO: 32866 - RNA, 64 nt, hsa
uuaguccuucaaauacugcuguauuuucaggaaaaaaaaaaaaagggguguuucuauugaaacu

SEQ ID NO: 32867 - RNA, 64 nt, hsa
auuaguccuucaaauacugcuguauuuucaggaaaaaaaaaaaaagggguguuucuauugaaac

SEQ ID NO: 32868 - RNA, 64 nt, hsa
aauuaguccuucaaauacugcuguauuuucaggaaaaaaaaaaaaagggguguuucuauugaaa

SEQ ID NO: 32869 - RNA, 64 nt, hsa
aaauuaguccuucaaauacugcuguauuuucaggaaaaaaaaaaaaagggguguuucuauugaa

SEQ ID NO: 32870 - RNA, 64 nt, hsa
acacuuguacgaauguagauuuauuuuuuuaaaaaaaaaaaagcaaagcuuucugccagacuga

SEQ ID NO: 32871 - RNA, 64 nt, hsa
cacacuuguacgaauguagauuuauuuuuuuaaaaaaaaaaaagcaaagcuuucugccagacug

SEQ ID NO: 32872 - RNA, 64 nt, hsa
acacacuuguacgaauguagauuuauuuuuuuaaaaaaaaaaaagcaaagcuuucugccagacu

SEQ ID NO: 32873 - RNA, 64 nt, hsa
gacacacuuguacgaauguagauuuauuuuuuuaaaaaaaaaaaagcaaagcuuucugccagac

SEQ ID NO: 32874 - RNA, 64 nt, hsa
agacacacuuguacgaauguagauuuauuuuuuuaaaaaaaaaaaagcaaagcuuucugccaga

SEQ ID NO: 32875 - RNA, 64 nt, hsa
gugaagaucuggcacaagauagaaugguaaaaaaaaaaaaaauuuuaagugacagugccauagu

SEQ ID NO: 32876 - RNA, 64 nt, hsa
ugugaagaucuggcacaagauagaaugguaaaaaaaaaaaaaauuuuaagugacagugccauag

SEQ ID NO: 32877 - RNA, 64 nt, hsa
cugugaagaucuggcacaagauagaaugguaaaaaaaaaaaaaauuuuaagugacagugccaua

SEQ ID NO: 32878 - RNA, 64 nt, hsa
gcugugaagaucuggcacaagauagaaugguaaaaaaaaaaaaaauuuuaagugacagugccau

SEQ ID NO: 32879 - RNA, 64 nt, hsa
agcugugaagaucuggcacaagauagaaugguaaaaaaaaaaaaaauuuuaagugacagugcca

SEQ ID NO: 32880 - RNA, 64 nt, hsa
cagcugugaagaucuggcacaagauagaaugguaaaaaaaaaaaaaauuuuaagugacagugcc

SEQ ID NO: 32881 - RNA, 64 nt, hsa
acagcugugaagaucuggcacaagauagaaugguaaaaaaaaaaaaaauuuuaagugacagugc

SEQ ID NO: 32882 - RNA, 64 nt, hsa
uuccaaaguaauaaaacuuuucuugagacaaacaaaaaaaaaguuugcuuacuauuugauuaaa

SEQ ID NO: 32883 - RNA, 64 nt, hsa
auuccaaaguaauaaaacuuuucuugagacaaacaaaaaaaaaguuugcuuacuauuugauuaa

SEQ ID NO: 32884 - RNA, 64 nt, hsa
aaaauuucuuuuucuagaaaaaauaaauacaaaaaaaaaaaagaagaaauuccaaaguaauaaa

SEQ ID NO: 32885 - RNA, 64 nt, hsa
aaaaauuucuuuuucuagaaaaaauaaauacaaaaaaaaaaaagaagaaauuccaaaguaauaa

SEQ ID NO: 32886 - RNA, 64 nt, hsa
caaaaauuucuuuuucuagaaaaaauaaauacaaaaaaaaaaaagaagaaauuccaaaguaaua

SEQ ID NO: 32887 - RNA, 64 nt, hsa
gcaaaaauuucuuuuucuagaaaaaauaaauacaaaaaaaaaaaagaagaaauuccaaaguaau

SEQ ID NO: 32888 - RNA, 64 nt, hsa
ugcaaaaauuucuuuuucuagaaaaaauaaauacaaaaaaaaaaaagaagaaauuccaaaguaa

SEQ ID NO: 32889 - RNA, 64 nt, hsa
aaucuucacaguguuuuaaagaacauguuaaaaaaaaaaaaaucuagugcuccugcugucaaga

SEQ ID NO: 32890 - RNA, 64 nt, hsa
uaaucuucacaguguuuuaaagaacauguuaaaaaaaaaaaaaucuagugcuccugcugucaag

SEQ ID NO: 32891 - RNA, 64 nt, hsa
uuaaucuucacaguguuuuaaagaacauguuaaaaaaaaaaaaaucuagugcuccugcugucaa

SEQ ID NO: 32892 - RNA, 64 nt, hsa
uuuaaucuucacaguguuuuaaagaacauguuaaaaaaaaaaaaaucuagugcuccugcuguca

SEQ ID NO: 32893 - RNA, 64 nt, hsa
uuuuaaucuucacaguguuuuaaagaacauguuaaaaaaaaaaaaaucuagugcuccugcuguc

SEQ ID NO: 32894 - RNA, 64 nt, hsa
uuuuuaaucuucacaguguuuuaaagaacauguuaaaaaaaaaaaaaucuagugcuccugcugu

SEQ ID NO: 32895 - RNA, 64 nt, hsa
aaauaauaccuuuucuuuaaaaaaaaaaaaaaaaaaaaaaaaguaaaggggaucucuaauacug

SEQ ID NO: 32896 - RNA, 64 nt, hsa
aaaauaauaccuuuucuuuaaaaaaaaaaaaaaaaaaaaaaaaguaaaggggaucucuaauacu

SEQ ID NO: 32897 - RNA, 64 nt, hsa
gaaaauaauaccuuuucuuuaaaaaaaaaaaaaaaaaaaaaaaaguaaaggggaucucuaauac

SEQ ID NO: 32898 - RNA, 64 nt, hsa
ggaaaauaauaccuuuucuuuaaaaaaaaaaaaaaaaaaaaaaaaguaaaggggaucucuaaua

SEQ ID NO: 32899 - RNA, 64 nt, hsa
gggaaaauaauaccuuuucuuuaaaaaaaaaaaaaaaaaaaaaaaaguaaaggggaucucuaau

SEQ ID NO: 32900 - RNA, 64 nt, hsa
ggggaaaauaauaccuuuucuuuaaaaaaaaaaaaaaaaaaaaaaaaguaaaggggaucucuaa

SEQ ID NO: 32901 - RNA, 64 nt, hsa
uggggaaaauaauaccuuuucuuuaaaaaaaaaaaaaaaaaaaaaaaaguaaaggggaucucua

SEQ ID NO: 32902 - RNA, 64 nt, hsa
uuggggaaaauaauaccuuuucuuuaaaaaaaaaaaaaaaaaaaaaaaaguaaaggggaucucu

SEQ ID NO: 32903 - RNA, 64 nt, hsa
uuuggggaaaauaauaccuuuucuuuaaaaaaaaaaaaaaaaaaaaaaaaguaaaggggaucuc

SEQ ID NO: 32904 - RNA, 64 nt, hsa
auuuggggaaaauaauaccuuuucuuuaaaaaaaaaaaaaaaaaaaaaaaaguaaaggggaucu

SEQ ID NO: 32905 - RNA, 64 nt, hsa
cauuuggggaaaauaauaccuuuucuuuaaaaaaaaaaaaaaaaaaaaaaaaguaaaggggauc

SEQ ID NO: 32906 - RNA, 64 nt, hsa
ucauuuggggaaaauaauaccuuuucuuuaaaaaaaaaaaaaaaaaaaaaaaaguaaaggggau

SEQ ID NO: 32907 - RNA, 64 nt, hsa
uucauuuggggaaaauaauaccuuuucuuuaaaaaaaaaaaaaaaaaaaaaaaaguaaagggga

SEQ ID NO: 32908 - RNA, 64 nt, hsa
cuucauuuggggaaaauaauaccuuuucuuuaaaaaaaaaaaaaaaaaaaaaaaaguaaagggg

SEQ ID NO: 32909 - RNA, 64 nt, hsa
gcuucauuuggggaaaauaauaccuuuucuuuaaaaaaaaaaaaaaaaaaaaaaaaguaaaggg

SEQ ID NO: 32910 - RNA, 64 nt, hsa
ugcuucauuuggggaaaauaauaccuuuucuuuaaaaaaaaaaaaaaaaaaaaaaaaguaaagg

SEQ ID NO: 32911 - RNA, 64 nt, hsa
uugcuucauuuggggaaaauaauaccuuuucuuuaaaaaaaaaaaaaaaaaaaaaaaaguaaag

SEQ ID NO: 32912 - RNA, 64 nt, hsa
agaccucaucucuacaaaaauaaaaaauaaaaauaaaaaaaacuuagcuaggcauguugccaca

SEQ ID NO: 32913 - RNA, 64 nt, hsa
guugcuaacugacaauguuaagaaauuuaaaaaaaaaaaaaagccugggcaugauggcucaugc

SEQ ID NO: 32914 - RNA, 64 nt, hsa
gguugcuaacugacaauguuaagaaauuuaaaaaaaaaaaaaagccugggcaugauggcucaug

SEQ ID NO: 32915 - RNA, 64 nt, hsa
agguugcuaacugacaauguuaagaaauuuaaaaaaaaaaaaaagccugggcaugauggcucau

SEQ ID NO: 32916 - RNA, 64 nt, hsa
gagguugcuaacugacaauguuaagaaauuuaaaaaaaaaaaaaagccugggcaugauggcuca

SEQ ID NO: 32917 - RNA, 64 nt, hsa
agagguugcuaacugacaauguuaagaaauuuaaaaaaaaaaaaaagccugggcaugauggcuc

SEQ ID NO: 32918 - RNA, 64 nt, hsa
uagagguugcuaacugacaauguuaagaaauuuaaaaaaaaaaaaaagccugggcaugauggcu

SEQ ID NO: 32919 - RNA, 64 nt, hsa
uuagagguugcuaacugacaauguuaagaaauuuaaaaaaaaaaaaaagccugggcaugauggc

SEQ ID NO: 32920 - RNA, 64 nt, hsa
ucuggccuaugauuguguugugucuugcauuaaaaaaaaaaauuugagagugguagaauuacuu

SEQ ID NO: 32921 - RNA, 64 nt, hsa
cucuggccuaugauuguguugugucuugcauuaaaaaaaaaaauuugagagugguagaauuacu

SEQ ID NO: 32922 - RNA, 64 nt, hsa
acucuggccuaugauuguguugugucuugcauuaaaaaaaaaaauuugagagugguagaauuac

SEQ ID NO: 32923 - RNA, 64 nt, hsa
aacucuggccuaugauuguguugugucuugcauuaaaaaaaaaaauuugagagugguagaauua

SEQ ID NO: 32924 - RNA, 64 nt, hsa
uguaagugucauuuuauaguacuuuacaguugucaaaaaaaaucuuacauauauugaucuaguu

SEQ ID NO: 32925 - RNA, 64 nt, hsa
agaaaguacuugacuaaaaaaaaaagaaaaaaagaaaaaaaagaaagcauagacauauuuuuuu

SEQ ID NO: 32926 - RNA, 64 nt, hsa
gugcuauuguuucuuuaagaaaguacuugacuaaaaaaaaaagaaaaaaagaaaaaaaagaaag

SEQ ID NO: 32927 - RNA, 64 nt, hsa
ggugcuauuguuucuuuaagaaaguacuugacuaaaaaaaaaagaaaaaaagaaaaaaaagaaa

SEQ ID NO: 32928 - RNA, 64 nt, hsa
uggugcuauuguuucuuuaagaaaguacuugacuaaaaaaaaaagaaaaaaagaaaaaaaagaa

SEQ ID NO: 32929 - RNA, 64 nt, hsa
ugggucaccucaaggaucagaggccaggaaaaaaaaaaaaaagacucccuggaucucugaauau

SEQ ID NO: 32930 - RNA, 64 nt, hsa
cugggucaccucaaggaucagaggccaggaaaaaaaaaaaaaagacucccuggaucucugaaua

SEQ ID NO: 32931 - RNA, 64 nt, hsa
acugggucaccucaaggaucagaggccaggaaaaaaaaaaaaaagacucccuggaucucugaau

SEQ ID NO: 32932 - RNA, 64 nt, hsa
cacugggucaccucaaggaucagaggccaggaaaaaaaaaaaaaagacucccuggaucucugaa

SEQ ID NO: 32933 - RNA, 64 nt, hsa
ccacugggucaccucaaggaucagaggccaggaaaaaaaaaaaaaagacucccuggaucucuga

SEQ ID NO: 32934 - RNA, 64 nt, hsa
cccacugggucaccucaaggaucagaggccaggaaaaaaaaaaaaaagacucccuggaucucug

SEQ ID NO: 32935 - RNA, 64 nt, hsa
ucccacugggucaccucaaggaucagaggccaggaaaaaaaaaaaaaagacucccuggaucucu

SEQ ID NO: 32936 - RNA, 64 nt, hsa
ugaucuuuuaucaauaauguucuauagaaaagaaaaaaaaaauauauauauauauauaucuuag

SEQ ID NO: 32937 - RNA, 64 nt, hsa
uugaucuuuuaucaauaauguucuauagaaaagaaaaaaaaaauauauauauauauauaucuua

SEQ ID NO: 32938 - RNA, 64 nt, hsa
guugaucuuuuaucaauaauguucuauagaaaagaaaaaaaaaauauauauauauauauaucuu

SEQ ID NO: 32939 - RNA, 64 nt, hsa
aaaaagagagaaacuugacugcacauuaaaaaaaaaaaaaaauccacauugugacuuuuauuua

SEQ ID NO: 32940 - RNA, 64 nt, hsa
aaaaaagagagaaacuugacugcacauuaaaaaaaaaaaaaaauccacauugugacuuuuauuu

SEQ ID NO: 32941 - RNA, 64 nt, hsa
aaaaaaagagagaaacuugacugcacauuaaaaaaaaaaaaaaauccacauugugacuuuuauu

SEQ ID NO: 32942 - RNA, 64 nt, hsa
gaaaaaaagagagaaacuugacugcacauuaaaaaaaaaaaaaaauccacauugugacuuuuau

SEQ ID NO: 32943 - RNA, 64 nt, hsa
agaaaaaaagagagaaacuugacugcacauuaaaaaaaaaaaaaaauccacauugugacuuuua

SEQ ID NO: 32944 - RNA, 64 nt, hsa
aagaaaaaaagagagaaacuugacugcacauuaaaaaaaaaaaaaaauccacauugugacuuuu

SEQ ID NO: 32945 - RNA, 64 nt, hsa
gaagaaaaaaagagagaaacuugacugcacauuaaaaaaaaaaaaaaauccacauugugacuuu

SEQ ID NO: 32946 - RNA, 64 nt, hsa
agaagaaaaaaagagagaaacuugacugcacauuaaaaaaaaaaaaaaauccacauugugacuu

SEQ ID NO: 32947 - RNA, 64 nt, hsa
uccuuccugaacucuaauagagguuaaaagggaaaaaaaaaauucuguagauagcaaauugugu

SEQ ID NO: 32948 - RNA, 64 nt, hsa
cuccuuccugaacucuaauagagguuaaaagggaaaaaaaaaauucuguagauagcaaauugug

SEQ ID NO: 32949 - RNA, 64 nt, hsa
ccuccuuccugaacucuaauagagguuaaaagggaaaaaaaaaauucuguagauagcaaauugu

SEQ ID NO: 32950 - RNA, 64 nt, hsa
cuguauuguucuuuaauggcugucuugcccuuccaaaaaaaauugaaaaaaaaaaaaaaaaaaa

SEQ ID NO: 32951 - RNA, 64 nt, hsa
aauccugucuggcuggcagauuucaaguaaaaaaaaaaaaaagguggguuggggggacccuuuu

SEQ ID NO: 32952 - RNA, 64 nt, hsa
aaauccugucuggcuggcagauuucaaguaaaaaaaaaaaaaagguggguuggggggacccuuu

SEQ ID NO: 32953 - RNA, 64 nt, hsa
gaaauccugucuggcuggcagauuucaaguaaaaaaaaaaaaaagguggguuggggggacccuu

SEQ ID NO: 32954 - RNA, 64 nt, hsa
agaaauccugucuggcuggcagauuucaaguaaaaaaaaaaaaaagguggguuggggggacccu

SEQ ID NO: 32955 - RNA, 64 nt, hsa
cagaaauccugucuggcuggcagauuucaaguaaaaaaaaaaaaaagguggguuggggggaccc

SEQ ID NO: 32956 - RNA, 64 nt, hsa
ucagaaauccugucuggcuggcagauuucaaguaaaaaaaaaaaaaagguggguuggggggacc

SEQ ID NO: 32957 - RNA, 64 nt, hsa
cucagaaauccugucuggcuggcagauuucaaguaaaaaaaaaaaaaagguggguuggggggac

SEQ ID NO: 32958 - RNA, 64 nt, hsa
aaagcgaaacucugucucaaaaaagaaaaaaaagaaaaaaaagcacgugaccuuaugaggcucu

SEQ ID NO: 32959 - RNA, 64 nt, hsa
ugggcaacaaaagcgaaacucugucucaaaaaagaaaaaaaagaaaaaaaagcacgugaccuua

SEQ ID NO: 32960 - RNA, 64 nt, hsa
cugggcaacaagagcgaaacucugucucaaaaaaaaaaaaaagagguggguggauuacuugagg

SEQ ID NO: 32961 - RNA, 64 nt, hsa
ccugggcaacaagagcgaaacucugucucaaaaaaaaaaaaaagagguggguggauuacuugag

SEQ ID NO: 32962 - RNA, 64 nt, hsa
gccugggcaacaagagcgaaacucugucucaaaaaaaaaaaaaagagguggguggauuacuuga

SEQ ID NO: 32963 - RNA, 64 nt, hsa
agccugggcaacaagagcgaaacucugucucaaaaaaaaaaaaaagagguggguggauuacuug

SEQ ID NO: 32964 - RNA, 64 nt, hsa
cagccugggcaacaagagcgaaacucugucucaaaaaaaaaaaaaagagguggguggauuacuu

SEQ ID NO: 32965 - RNA, 64 nt, hsa
ccagccugggcaacaagagcgaaacucugucucaaaaaaaaaaaaaagagguggguggauuacu

SEQ ID NO: 32966 - RNA, 64 nt, hsa
uccagccugggcaacaagagcgaaacucugucucaaaaaaaaaaaaaagagguggguggauuac

SEQ ID NO: 32967 - RNA, 64 nt, hsa
uucauuuauacuuugauaaccuguauuuaauuuaaaaaaaaacauaaaaaugaggaaccaagug

SEQ ID NO: 32968 - RNA, 64 nt, hsa
uuucauuuauacuuugauaaccuguauuuaauuuaaaaaaaaacauaaaaaugaggaaccaagu

SEQ ID NO: 32969 - RNA, 64 nt, hsa
cuuuuacuuuguagauaauauaaaauaaaaacuuaaaaaaaauuuaaaaaauaaaaaaaguuuu

SEQ ID NO: 32970 - RNA, 64 nt, hsa
auucuugcugcuauuacugcuaaaaaaaaaaaaaaaaaaaaaucaagacuuggaacgcccuuuu

SEQ ID NO: 32971 - RNA, 64 nt, hsa
gauucuugcugcuauuacugcuaaaaaaaaaaaaaaaaaaaaaucaagacuuggaacgcccuuu

SEQ ID NO: 32972 - RNA, 64 nt, hsa
ugauucuugcugcuauuacugcuaaaaaaaaaaaaaaaaaaaaaucaagacuuggaacgcccuu

SEQ ID NO: 32973 - RNA, 64 nt, hsa
gugauucuugcugcuauuacugcuaaaaaaaaaaaaaaaaaaaaaucaagacuuggaacgcccu

SEQ ID NO: 32974 - RNA, 64 nt, hsa
agugauucuugcugcuauuacugcuaaaaaaaaaaaaaaaaaaaaaucaagacuuggaacgccc

SEQ ID NO: 32975 - RNA, 64 nt, hsa
gagugauucuugcugcuauuacugcuaaaaaaaaaaaaaaaaaaaaaucaagacuuggaacgcc

SEQ ID NO: 32976 - RNA, 64 nt, hsa
agagugauucuugcugcuauuacugcuaaaaaaaaaaaaaaaaaaaaaucaagacuuggaacgc

SEQ ID NO: 32977 - RNA, 64 nt, hsa
aagagugauucuugcugcuauuacugcuaaaaaaaaaaaaaaaaaaaaaucaagacuuggaacg

SEQ ID NO: 32978 - RNA, 64 nt, hsa
caagagugauucuugcugcuauuacugcuaaaaaaaaaaaaaaaaaaaaaucaagacuuggaac

SEQ ID NO: 32979 - RNA, 64 nt, hsa
acaagagugauucuugcugcuauuacugcuaaaaaaaaaaaaaaaaaaaaaucaagacuuggaa

SEQ ID NO: 32980 - RNA, 64 nt, hsa
aacaagagugauucuugcugcuauuacugcuaaaaaaaaaaaaaaaaaaaaaucaagacuugga

SEQ ID NO: 32981 - RNA, 64 nt, hsa
uaacaagagugauucuugcugcuauuacugcuaaaaaaaaaaaaaaaaaaaaaucaagacuugg

SEQ ID NO: 32982 - RNA, 64 nt, hsa
guaacaagagugauucuugcugcuauuacugcuaaaaaaaaaaaaaaaaaaaaaucaagacuug

SEQ ID NO: 32983 - RNA, 64 nt, hsa
aguaacaagagugauucuugcugcuauuacugcuaaaaaaaaaaaaaaaaaaaaaucaagacuu

SEQ ID NO: 32984 - RNA, 64 nt, hsa
aagaaaagggauucaacugucucuuuuccaaauaaaaaaaaagucaaaauuucaaguguagaga

SEQ ID NO: 32985 - RNA, 64 nt, hsa
aaagaaaagggauucaacugucucuuuuccaaauaaaaaaaaagucaaaauuucaaguguagag

SEQ ID NO: 32986 - RNA, 64 nt, hsa
ugugucaaguggaaacaaaaacaaaaucuuucaaaaaaaaaaucgggacaagugaacacauuaa

SEQ ID NO: 32987 - RNA, 64 nt, hsa
cugugucaaguggaaacaaaaacaaaaucuuucaaaaaaaaaaucgggacaagugaacacauua

SEQ ID NO: 32988 - RNA, 64 nt, hsa
acugugucaaguggaaacaaaaacaaaaucuuucaaaaaaaaaaucgggacaagugaacacauu

SEQ ID NO: 32989 - RNA, 64 nt, hsa
cacaaaaaauaaaaaaccccuacaaaaaaacuuuaaaaaaaauggcagcaaaggguaguuuuca

SEQ ID NO: 32990 - RNA, 64 nt, hsa
ucuucccuagaaacccaauucuaagcagaaaaagaaaaaaaacacaaaaaauaaaaaaccccua

SEQ ID NO: 32991 - RNA, 64 nt, hsa
cuugaaauaaucuaaaguuuaaaacauuauauuaaaaaaaaaguuguguggugggaaugugaaa

SEQ ID NO: 32992 - RNA, 64 nt, hsa
ucuugaaauaaucuaaaguuuaaaacauuauauuaaaaaaaaaguuguguggugggaaugugaa

SEQ ID NO: 32993 - RNA, 64 nt, hsa
gugggacuucgcuguuuuuaucuccaauaaaaaaaaaaaaaagguuuguuaauuaauguggccu

SEQ ID NO: 32994 - RNA, 64 nt, hsa
ugugggacuucgcuguuuuuaucuccaauaaaaaaaaaaaaaagguuuguuaauuaauguggcc

SEQ ID NO: 32995 - RNA, 64 nt, hsa
augugggacuucgcuguuuuuaucuccaauaaaaaaaaaaaaaagguuuguuaauuaauguggc

SEQ ID NO: 32996 - RNA, 64 nt, hsa
uaugugggacuucgcuguuuuuaucuccaauaaaaaaaaaaaaaagguuuguuaauuaaugugg

SEQ ID NO: 32997 - RNA, 64 nt, hsa
guaugugggacuucgcuguuuuuaucuccaauaaaaaaaaaaaaaagguuuguuaauuaaugug

SEQ ID NO: 32998 - RNA, 64 nt, hsa
gguaugugggacuucgcuguuuuuaucuccaauaaaaaaaaaaaaaagguuuguuaauuaaugu

SEQ ID NO: 32999 - RNA, 64 nt, hsa
ugguaugugggacuucgcuguuuuuaucuccaauaaaaaaaaaaaaaagguuuguuaauuaaug

SEQ ID NO: 33000 - RNA, 64 nt, hsa
caggaaaaaaaaaaauuaaugaaccuuaaaaaaaaaaaaaaagguuuugaagggaaaaaaagug

SEQ ID NO: 33001 - RNA, 64 nt, hsa
ucaggaaaaaaaaaaauuaaugaaccuuaaaaaaaaaaaaaaagguuuugaagggaaaaaaagu

SEQ ID NO: 33002 - RNA, 64 nt, hsa
aucaggaaaaaaaaaaauuaaugaaccuuaaaaaaaaaaaaaaagguuuugaagggaaaaaaag

SEQ ID NO: 33003 - RNA, 64 nt, hsa
aaucaggaaaaaaaaaaauuaaugaaccuuaaaaaaaaaaaaaaagguuuugaagggaaaaaaa

SEQ ID NO: 33004 - RNA, 64 nt, hsa
uaaucaggaaaaaaaaaaauuaaugaaccuuaaaaaaaaaaaaaaagguuuugaagggaaaaaa

SEQ ID NO: 33005 - RNA, 64 nt, hsa
guaaucaggaaaaaaaaaaauuaaugaaccuuaaaaaaaaaaaaaaagguuuugaagggaaaaa

SEQ ID NO: 33006 - RNA, 64 nt, hsa
uguaaucaggaaaaaaaaaaauuaaugaaccuuaaaaaaaaaaaaaaagguuuugaagggaaaa

SEQ ID NO: 33007 - RNA, 64 nt, hsa
uuguaaucaggaaaaaaaaaaauuaaugaaccuuaaaaaaaaaaaaaaagguuuugaagggaaa

SEQ ID NO: 33008 - RNA, 64 nt, hsa
caaaaaaugagguuuugcuuuuguaaucaggaaaaaaaaaaauuaaugaaccuuaaaaaaaaaa

SEQ ID NO: 33009 - RNA, 64 nt, hsa
ccaaaaaaugagguuuugcuuuuguaaucaggaaaaaaaaaaauuaaugaaccuuaaaaaaaaa

SEQ ID NO: 33010 - RNA, 64 nt, hsa
accaaaaaaugagguuuugcuuuuguaaucaggaaaaaaaaaaauuaaugaaccuuaaaaaaaa

SEQ ID NO: 33011 - RNA, 64 nt, hsa
gaccaaaaaaugagguuuugcuuuuguaaucaggaaaaaaaaaaauuaaugaaccuuaaaaaaa

SEQ ID NO: 33012 - RNA, 64 nt, hsa
uuuggcucucuguuucauuuuuuuccauuaagaaaaaaaaaaguccccuuuuaaaacaagcagg

SEQ ID NO: 33013 - RNA, 64 nt, hsa
uuuuggcucucuguuucauuuuuuuccauuaagaaaaaaaaaaguccccuuuuaaaacaagcag

SEQ ID NO: 33014 - RNA, 64 nt, hsa
cuuuuggcucucuguuucauuuuuuuccauuaagaaaaaaaaaaguccccuuuuaaaacaagca

SEQ ID NO: 33015 - RNA, 64 nt, hsa
acuguguauuuucuuacaauaaaaaaugaugaaaaaaaaaaaggcuuuacuucuuuugcaugca

SEQ ID NO: 33016 - RNA, 64 nt, hsa
aacuguguauuuucuuacaauaaaaaaugaugaaaaaaaaaaaggcuuuacuucuuuugcaugc

SEQ ID NO: 33017 - RNA, 64 nt, hsa
aaacuguguauuuucuuacaauaaaaaaugaugaaaaaaaaaaaggcuuuacuucuuuugcaug

SEQ ID NO: 33018 - RNA, 64 nt, hsa
caaacuguguauuuucuuacaauaaaaaaugaugaaaaaaaaaaaggcuuuacuucuuuugcau

SEQ ID NO: 33019 - RNA, 64 nt, hsa
uauuuuauuuuuuugguauuuauucaucaggaauaaaaaaaacaaaguuuuauuaaagauugaa

SEQ ID NO: 33020 - RNA, 64 nt, hsa
gagauuaaauuuuuugccauuuacaaaaaaaaaaaaaaaaaagaaaacagaaaaaaauucagac

SEQ ID NO: 33021 - RNA, 64 nt, hsa
ugagauuaaauuuuuugccauuuacaaaaaaaaaaaaaaaaaagaaaacagaaaaaaauucaga

SEQ ID NO: 33022 - RNA, 64 nt, hsa
augagauuaaauuuuuugccauuuacaaaaaaaaaaaaaaaaaagaaaacagaaaaaaauucag

SEQ ID NO: 33023 - RNA, 64 nt, hsa
gaugagauuaaauuuuuugccauuuacaaaaaaaaaaaaaaaaaagaaaacagaaaaaaauuca

SEQ ID NO: 33024 - RNA, 64 nt, hsa
agaugagauuaaauuuuuugccauuuacaaaaaaaaaaaaaaaaaagaaaacagaaaaaaauuc

SEQ ID NO: 33025 - RNA, 64 nt, hsa
cagaugagauuaaauuuuuugccauuuacaaaaaaaaaaaaaaaaaagaaaacagaaaaaaauu

SEQ ID NO: 33026 - RNA, 64 nt, hsa
acagaugagauuaaauuuuuugccauuuacaaaaaaaaaaaaaaaaaagaaaacagaaaaaaau

SEQ ID NO: 33027 - RNA, 64 nt, hsa
uacagaugagauuaaauuuuuugccauuuacaaaaaaaaaaaaaaaaaagaaaacagaaaaaaa

SEQ ID NO: 33028 - RNA, 64 nt, hsa
cuacagaugagauuaaauuuuuugccauuuacaaaaaaaaaaaaaaaaaagaaaacagaaaaaa

SEQ ID NO: 33029 - RNA, 64 nt, hsa
acuacagaugagauuaaauuuuuugccauuuacaaaaaaaaaaaaaaaaaagaaaacagaaaaa

SEQ ID NO: 33030 - RNA, 64 nt, hsa
gacuacagaugagauuaaauuuuuugccauuuacaaaaaaaaaaaaaaaaaagaaaacagaaaa

SEQ ID NO: 33031 - RNA, 64 nt, hsa
uguacauauuuacaagaaacuuuauauucguaaaaaaaaaaagaggaaauugaauugguuucua

SEQ ID NO: 33032 - RNA, 64 nt, hsa
cuguacauauuuacaagaaacuuuauauucguaaaaaaaaaaagaggaaauugaauugguuucu

SEQ ID NO: 33033 - RNA, 64 nt, hsa
acuguacauauuuacaagaaacuuuauauucguaaaaaaaaaaagaggaaauugaauugguuuc

SEQ ID NO: 33034 - RNA, 64 nt, hsa
gacuguacauauuuacaagaaacuuuauauucguaaaaaaaaaaagaggaaauugaauugguuu

SEQ ID NO: 33035 - RNA, 64 nt, hsa
uguauauuuuccaugcccucacuccuuuaagaaaaaaaaaaaggaaaaaagcaacacaauccug

SEQ ID NO: 33036 - RNA, 64 nt, hsa
cuguauauuuuccaugcccucacuccuuuaagaaaaaaaaaaaggaaaaaagcaacacaauccu

SEQ ID NO: 33037 - RNA, 64 nt, hsa
gcuguauauuuuccaugcccucacuccuuuaagaaaaaaaaaaaggaaaaaagcaacacaaucc

SEQ ID NO: 33038 - RNA, 64 nt, hsa
ugcuguauauuuuccaugcccucacuccuuuaagaaaaaaaaaaaggaaaaaagcaacacaauc

SEQ ID NO: 33039 - RNA, 64 nt, hsa
guuuuuuccuuuguuguuuuaaaggggacaaaaaaaaaaaaaggacuugacuccaugacgucga

SEQ ID NO: 33040 - RNA, 64 nt, hsa
uguuuuuuccuuuguuguuuuaaaggggacaaaaaaaaaaaaaggacuugacuccaugacgucg

SEQ ID NO: 33041 - RNA, 64 nt, hsa
uuguuuuuuccuuuguuguuuuaaaggggacaaaaaaaaaaaaaggacuugacuccaugacguc

SEQ ID NO: 33042 - RNA, 64 nt, hsa
uuuguuuuuuccuuuguuguuuuaaaggggacaaaaaaaaaaaaaggacuugacuccaugacgu

SEQ ID NO: 33043 - RNA, 64 nt, hsa
auuuguuuuuuccuuuguuguuuuaaaggggacaaaaaaaaaaaaaggacuugacuccaugacg

SEQ ID NO: 33044 - RNA, 64 nt, hsa
uauuuguuuuuuccuuuguuguuuuaaaggggacaaaaaaaaaaaaaggacuugacuccaugac

SEQ ID NO: 33045 - RNA, 64 nt, hsa
aucaccugcuucccauagccauaucucacuguaaaaaaaaaauuaauaaacuguuacuuauauu

SEQ ID NO: 33046 - RNA, 64 nt, hsa
uaucaccugcuucccauagccauaucucacuguaaaaaaaaaauuaauaaacuguuacuuauau

SEQ ID NO: 33047 - RNA, 64 nt, hsa
guaucaccugcuucccauagccauaucucacuguaaaaaaaaaauuaauaaacuguuacuuaua

SEQ ID NO: 33048 - RNA, 64 nt, hsa
ugguagacuuaaggcuucauugugggguuaaaaaaaaaaaaagauacaaagaaauaugucucaa

SEQ ID NO: 33049 - RNA, 64 nt, hsa
gugguagacuuaaggcuucauugugggguuaaaaaaaaaaaaagauacaaagaaauaugucuca

SEQ ID NO: 33050 - RNA, 64 nt, hsa
ugugguagacuuaaggcuucauugugggguuaaaaaaaaaaaaagauacaaagaaauaugucuc

SEQ ID NO: 33051 - RNA, 64 nt, hsa
gugugguagacuuaaggcuucauugugggguuaaaaaaaaaaaaagauacaaagaaauaugucu

SEQ ID NO: 33052 - RNA, 64 nt, hsa
agugugguagacuuaaggcuucauugugggguuaaaaaaaaaaaaagauacaaagaaauauguc

SEQ ID NO: 33053 - RNA, 64 nt, hsa
cagugugguagacuuaaggcuucauugugggguuaaaaaaaaaaaaagauacaaagaaauaugu

SEQ ID NO: 33054 - RNA, 64 nt, hsa
agccugggcaacaagagcaaaacuccgucucaaaaaaaaaaauugccgggcgcgguggcaaaug

SEQ ID NO: 33055 - RNA, 64 nt, hsa
cagccugggcaacaagagcaaaacuccgucucaaaaaaaaaaauugccgggcgcgguggcaaau

SEQ ID NO: 33056 - RNA, 64 nt, hsa
ccagccugggcaacaagagcaaaacuccgucucaaaaaaaaaaauugccgggcgcgguggcaaa

SEQ ID NO: 33057 - RNA, 64 nt, hsa
uccagccugggcaacaagagcaaaacuccgucucaaaaaaaaaaauugccgggcgcgguggcaa

SEQ ID NO: 33058 - RNA, 64 nt, hsa
caguagccaauugaaaauguauaucccaaaauuuaaaaaaaaaaguaccagcagcaauaaaauu

SEQ ID NO: 33059 - RNA, 64 nt, hsa
aguagccaauugaaaauguauaucccaaaauuuaaaaaaaaaaguaccagcagcaauaaaauug

SEQ ID NO: 33060 - RNA, 64 nt, hsa
guagccaauugaaaauguauaucccaaaauuuaaaaaaaaaaguaccagcagcaauaaaauugc

SEQ ID NO: 33061 - RNA, 64 nt, hsa
uggccaaggugauaaaacccgucucuacuaauacaaaaaaaauuagcuggguauguuggugcag

SEQ ID NO: 33062 - RNA, 64 nt, hsa
aaaccccaucucuacuaaaaauauaaaaaucagcaaaaaaaauuuagccaggcuuggucaugca

SEQ ID NO: 33063 - RNA, 64 nt, hsa
gugaacuuaaagcaaagaccucuuaguaaaaaauaaaaaaaaauaaaaaauaaaaauaaaaaaa

SEQ ID NO: 33064 - RNA, 64 nt, hsa
ugaacuuaaagcaaagaccucuuaguaaaaaauaaaaaaaaauaaaaaauaaaaauaaaaaaag

SEQ ID NO: 33065 - RNA, 64 nt, hsa
gaagaaaaauaucuaaacaucgagaaacuaugggaaaaaaaauugcaaaaucuaaaauaaaaaa

SEQ ID NO: 33066 - RNA, 64 nt, hsa
augcuaguccuagauuacuuauugauuuaaaaacaaaaaaaagauuacuuaauuuugauuuaaa

SEQ ID NO: 33067 - RNA, 58 nt, hsa
ccuaugaauucauggcauaauagguguuaaaaaaaaaaauaaaggaccucugggcuac

SEQ ID NO: 33068 - RNA, 59 nt, hsa
ccuaugaauucauggcauaauagguguuaaaaaaaaaaauaaaggaccucugggcuaca

SEQ ID NO: 33069 - RNA, 60 nt, hsa
ccuaugaauucauggcauaauagguguuaaaaaaaaaaauaaaggaccucugggcuacaa

SEQ ID NO: 33070 - RNA, 61 nt, hsa
ccuaugaauucauggcauaauagguguuaaaaaaaaaaauaaaggaccucugggcuacaaa

SEQ ID NO: 33071 - RNA, 64 nt, hsa
uaauugauauucuguucagaacuuucuuuagacuaaaaaaaaaaaaaaagacaaaauacacguu

SEQ ID NO: 33072 - RNA, 64 nt, hsa
aauugauauucuguucagaacuuucuuuagacuaaaaaaaaaaaaaaagacaaaauacacguug

SEQ ID NO: 33073 - RNA, 64 nt, hsa
auugauauucuguucagaacuuucuuuagacuaaaaaaaaaaaaaaagacaaaauacacguuga

SEQ ID NO: 33074 - RNA, 64 nt, hsa
uugauauucuguucagaacuuucuuuagacuaaaaaaaaaaaaaaagacaaaauacacguugac

SEQ ID NO: 33075 - RNA, 64 nt, hsa
ugauauucuguucagaacuuucuuuagacuaaaaaaaaaaaaaaagacaaaauacacguugacc

SEQ ID NO: 33076 - RNA, 64 nt, hsa
gauauucuguucagaacuuucuuuagacuaaaaaaaaaaaaaaagacaaaauacacguugacca

SEQ ID NO: 33077 - RNA, 64 nt, hsa
auauucuguucagaacuuucuuuagacuaaaaaaaaaaaaaaagacaaaauacacguugaccau

SEQ ID NO: 33078 - RNA, 64 nt, hsa
uauucuguucagaacuuucuuuagacuaaaaaaaaaaaaaaagacaaaauacacguugaccaug

SEQ ID NO: 33079 - RNA, 64 nt, hsa
ugggcaacauagggagacccccaucuuuacaaagaaaaaaaaaaggggaaaagaaaaucuuuua

SEQ ID NO: 33080 - RNA, 64 nt, hsa
gggcaacauagggagacccccaucuuuacaaagaaaaaaaaaaggggaaaagaaaaucuuuuaa

SEQ ID NO: 33081 - RNA, 64 nt, hsa
ggcaacauagggagacccccaucuuuacaaagaaaaaaaaaaggggaaaagaaaaucuuuuaaa

SEQ ID NO: 33082 - RNA, 64 nt, hsa
cugcaucccauuuccagccucuuuucaagcugagaaaaaaaaaaaaaaacacguuugauacuuu

SEQ ID NO: 33083 - RNA, 64 nt, hsa
ugcaucccauuuccagccucuuuucaagcugagaaaaaaaaaaaaaaacacguuugauacuuug

SEQ ID NO: 33084 - RNA, 64 nt, hsa
gcaucccauuuccagccucuuuucaagcugagaaaaaaaaaaaaaaacacguuugauacuuugu

SEQ ID NO: 33085 - RNA, 64 nt, hsa
caucccauuuccagccucuuuucaagcugagaaaaaaaaaaaaaaacacguuugauacuuugua

SEQ ID NO: 33086 - RNA, 64 nt, hsa
aucccauuuccagccucuuuucaagcugagaaaaaaaaaaaaaaacacguuugauacuuuguac

SEQ ID NO: 33087 - RNA, 64 nt, hsa
ucccauuuccagccucuuuucaagcugagaaaaaaaaaaaaaaacacguuugauacuuuguaca

SEQ ID NO: 33088 - RNA, 64 nt, hsa
cccauuuccagccucuuuucaagcugagaaaaaaaaaaaaaaacacguuugauacuuuguacau

SEQ ID NO: 33089 - RNA, 64 nt, hsa
ccauuuccagccucuuuucaagcugagaaaaaaaaaaaaaaacacguuugauacuuuguacauc

SEQ ID NO: 33090 - RNA, 64 nt, hsa
aggaacagaguauuauugcacagaucugaagaucaaaaaaaagcucaaggaaauacagaucgga

SEQ ID NO: 33091 - RNA, 64 nt, hsa
ucuucucuaucauaggcccuaaguucauugggggaaaaaaaauaagaagauucaacagaaucag

SEQ ID NO: 33092 - RNA, 64 nt, hsa
aucccagugugccugauuugacauucuugucagcaaaaaaaaacuuaauuucuaguaaaucuau

SEQ ID NO: 33093 - RNA, 64 nt, hsa
ucccagugugccugauuugacauucuugucagcaaaaaaaaacuuaauuucuaguaaaucuaua

SEQ ID NO: 33094 - RNA, 64 nt, hsa
cuccagacugggugacacagcgagacuucaucucaaaaaaaaaaagaaaagaaaagcaauugua

SEQ ID NO: 33095 - RNA, 64 nt, hsa
uccagacugggugacacagcgagacuucaucucaaaaaaaaaaagaaaagaaaagcaauuguac

SEQ ID NO: 33096 - RNA, 64 nt, hsa
ccagacugggugacacagcgagacuucaucucaaaaaaaaaaagaaaagaaaagcaauuguacu

SEQ ID NO: 33097 - RNA, 64 nt, hsa
cagacugggugacacagcgagacuucaucucaaaaaaaaaaagaaaagaaaagcaauuguacuu

SEQ ID NO: 33098 - RNA, 64 nt, hsa
accaaacauugaugcuuaaggaccacacugaaggaaaaaaaaagaggggacuucgaaaaaaaaa

SEQ ID NO: 33099 - RNA, 64 nt, hsa
ccaaacauugaugcuuaaggaccacacugaaggaaaaaaaaagaggggacuucgaaaaaaaaaa

SEQ ID NO: 33100 - RNA, 64 nt, hsa
accacacugaaggaaaaaaaaagaggggacuucgaaaaaaaaaaaagcccugcaaaauauucua

SEQ ID NO: 33101 - RNA, 64 nt, hsa
ccacacugaaggaaaaaaaaagaggggacuucgaaaaaaaaaaaagcccugcaaaauauucuaa

SEQ ID NO: 33102 - RNA, 64 nt, hsa
cacacugaaggaaaaaaaaagaggggacuucgaaaaaaaaaaaagcccugcaaaauauucuaaa

SEQ ID NO: 33103 - RNA, 64 nt, hsa
acacugaaggaaaaaaaaagaggggacuucgaaaaaaaaaaaagcccugcaaaauauucuaaaa

SEQ ID NO: 33104 - RNA, 64 nt, hsa
cacugaaggaaaaaaaaagaggggacuucgaaaaaaaaaaaagcccugcaaaauauucuaaaac

SEQ ID NO: 33105 - RNA, 64 nt, hsa
cugggugaaaaagacaggcugugucuccaaaaagaaaaaaaaaagucaaauucaaauaucaucu

SEQ ID NO: 33106 - RNA, 64 nt, hsa
ugggugaaaaagacaggcugugucuccaaaaagaaaaaaaaaagucaaauucaaauaucaucug

SEQ ID NO: 33107 - RNA, 64 nt, hsa
gggugaaaaagacaggcugugucuccaaaaagaaaaaaaaaagucaaauucaaauaucaucugg

SEQ ID NO: 33108 - RNA, 64 nt, hsa
ucaauaaaauauuuuauuuauucauuaauuuaacaaaaaaaacagagcauuuaguuuguggcaa

SEQ ID NO: 33109 - RNA, 64 nt, hsa
uaaguggcuaugcaagcaaaagcauagauagguuaaaaaaaaggaucagcuggcugggcagggu

SEQ ID NO: 33110 - RNA, 64 nt, hsa
agcuucguaaacauagcaagacccagucucuaccaaaaaaaaaaaaaaaaaaaaaaaaaaaaaa

SEQ ID NO: 33111 - RNA, 64 nt, hsa
gcuucguaaacauagcaagacccagucucuaccaaaaaaaaaaaaaaaaaaaaaaaaaaaaaaa

SEQ ID NO: 33112 - RNA, 64 nt, hsa
cuucguaaacauagcaagacccagucucuaccaaaaaaaaaaaaaaaaaaaaaaaaaaaaaaaa

SEQ ID NO: 33113 - RNA, 64 nt, hsa
uucguaaacauagcaagacccagucucuaccaaaaaaaaaaaaaaaaaaaaaaaaaaaaaaaau

SEQ ID NO: 33114 - RNA, 64 nt, hsa
ucguaaacauagcaagacccagucucuaccaaaaaaaaaaaaaaaaaaaaaaaaaaaaaaaaua

SEQ ID NO: 33115 - RNA, 64 nt, hsa
cguaaacauagcaagacccagucucuaccaaaaaaaaaaaaaaaaaaaaaaaaaaaaaaaauau

SEQ ID NO: 33116 - RNA, 64 nt, hsa
guaaacauagcaagacccagucucuaccaaaaaaaaaaaaaaaaaaaaaaaaaaaaaaaauaua

SEQ ID NO: 33117 - RNA, 64 nt, hsa
uaaacauagcaagacccagucucuaccaaaaaaaaaaaaaaaaaaaaaaaaaaaaaaaauauau

SEQ ID NO: 33118 - RNA, 64 nt, hsa
aaacauagcaagacccagucucuaccaaaaaaaaaaaaaaaaaaaaaaaaaaaaaaaauauaua

SEQ ID NO: 33119 - RNA, 64 nt, hsa
aacauagcaagacccagucucuaccaaaaaaaaaaaaaaaaaaaaaaaaaaaaaaaauauauau

SEQ ID NO: 33120 - RNA, 64 nt, hsa
acauagcaagacccagucucuaccaaaaaaaaaaaaaaaaaaaaaaaaaaaaaaaauauauaua

SEQ ID NO: 33121 - RNA, 64 nt, hsa
cauagcaagacccagucucuaccaaaaaaaaaaaaaaaaaaaaaaaaaaaaaaaauauauauau

SEQ ID NO: 33122 - RNA, 64 nt, hsa
auagcaagacccagucucuaccaaaaaaaaaaaaaaaaaaaaaaaaaaaaaaaauauauauaua

SEQ ID NO: 33123 - RNA, 64 nt, hsa
uagcaagacccagucucuaccaaaaaaaaaaaaaaaaaaaaaaaaaaaaaaaauauauauauau

SEQ ID NO: 33124 - RNA, 64 nt, hsa
agcaagacccagucucuaccaaaaaaaaaaaaaaaaaaaaaaaaaaaaaaaauauauauauaua

SEQ ID NO: 33125 - RNA, 64 nt, hsa
gcaagacccagucucuaccaaaaaaaaaaaaaaaaaaaaaaaaaaaaaaaauauauauauauau

SEQ ID NO: 33126 - RNA, 64 nt, hsa
caagacccagucucuaccaaaaaaaaaaaaaaaaaaaaaaaaaaaaaaaauauauauauauaua

SEQ ID NO: 33127 - RNA, 64 nt, hsa
aagacccagucucuaccaaaaaaaaaaaaaaaaaaaaaaaaaaaaaaaauauauauauauauau

SEQ ID NO: 33128 - RNA, 64 nt, hsa
agacccagucucuaccaaaaaaaaaaaaaaaaaaaaaaaaaaaaaaaauauauauauauauaua

SEQ ID NO: 33129 - RNA, 64 nt, hsa
gacccagucucuaccaaaaaaaaaaaaaaaaaaaaaaaaaaaaaaaauauauauauauauauac

SEQ ID NO: 33130 - RNA, 64 nt, hsa
acccagucucuaccaaaaaaaaaaaaaaaaaaaaaaaaaaaaaaaauauauauauauauauaca

SEQ ID NO: 33131 - RNA, 64 nt, hsa
cccagucucuaccaaaaaaaaaaaaaaaaaaaaaaaaaaaaaaaauauauauauauauauacac

SEQ ID NO: 33132 - RNA, 64 nt, hsa
ccagucucuaccaaaaaaaaaaaaaaaaaaaaaaaaaaaaaaaauauauauauauauauacaca

SEQ ID NO: 33133 - RNA, 64 nt, hsa
cagucucuaccaaaaaaaaaaaaaaaaaaaaaaaaaaaaaaaauauauauauauauauacacac

SEQ ID NO: 33134 - RNA, 64 nt, hsa
agucucuaccaaaaaaaaaaaaaaaaaaaaaaaaaaaaaaaauauauauauauauauacacaca

SEQ ID NO: 33135 - RNA, 64 nt, hsa
uggggagggagaaugcuuuuccccucccaguaauaaaaaaaaaaaaaaaaaaaauauauauaua

SEQ ID NO: 33136 - RNA, 64 nt, hsa
ggggagggagaaugcuuuuccccucccaguaauaaaaaaaaaaaaaaaaaaaauauauauauau

SEQ ID NO: 33137 - RNA, 64 nt, hsa
gggagggagaaugcuuuuccccucccaguaauaaaaaaaaaaaaaaaaaaaauauauauauaua

SEQ ID NO: 33138 - RNA, 64 nt, hsa
ggagggagaaugcuuuuccccucccaguaauaaaaaaaaaaaaaaaaaaaauauauauauauau

SEQ ID NO: 33139 - RNA, 64 nt, hsa
gagggagaaugcuuuuccccucccaguaauaaaaaaaaaaaaaaaaaaaauauauauauauaua

SEQ ID NO: 33140 - RNA, 64 nt, hsa
agggagaaugcuuuuccccucccaguaauaaaaaaaaaaaaaaaaaaaauauauauauauauau

SEQ ID NO: 33141 - RNA, 64 nt, hsa
gggagaaugcuuuuccccucccaguaauaaaaaaaaaaaaaaaaaaaauauauauauauauaua

SEQ ID NO: 33142 - RNA, 64 nt, hsa
ggagaaugcuuuuccccucccaguaauaaaaaaaaaaaaaaaaaaaauauauauauauauauau

SEQ ID NO: 33143 - RNA, 64 nt, hsa
gagaaugcuuuuccccucccaguaauaaaaaaaaaaaaaaaaaaaauauauauauauauauaua

SEQ ID NO: 33144 - RNA, 64 nt, hsa
agaaugcuuuuccccucccaguaauaaaaaaaaaaaaaaaaaaaauauauauauauauauauau

SEQ ID NO: 33145 - RNA, 64 nt, hsa
gaaugcuuuuccccucccaguaauaaaaaaaaaaaaaaaaaaaauauauauauauauauauaua

SEQ ID NO: 33146 - RNA, 64 nt, hsa
aaugcuuuuccccucccaguaauaaaaaaaaaaaaaaaaaaaauauauauauauauauauauau

SEQ ID NO: 33147 - RNA, 64 nt, hsa
augcuuuuccccucccaguaauaaaaaaaaaaaaaaaaaaaauauauauauauauauauauaua

SEQ ID NO: 33148 - RNA, 64 nt, hsa
cacacuagcuugggugacagaggaagacugucucaaaaaaaaaaaaauugaucaaacugaugga

SEQ ID NO: 33149 - RNA, 64 nt, hsa
acacuagcuugggugacagaggaagacugucucaaaaaaaaaaaaauugaucaaacugauggau

SEQ ID NO: 33150 - RNA, 64 nt, hsa
cacuagcuugggugacagaggaagacugucucaaaaaaaaaaaaauugaucaaacugauggaua

SEQ ID NO: 33151 - RNA, 64 nt, hsa
acuagcuugggugacagaggaagacugucucaaaaaaaaaaaaauugaucaaacugauggauac

SEQ ID NO: 33152 - RNA, 64 nt, hsa
cuagcuugggugacagaggaagacugucucaaaaaaaaaaaaauugaucaaacugauggauacc

SEQ ID NO: 33153 - RNA, 64 nt, hsa
uagcuugggugacagaggaagacugucucaaaaaaaaaaaaauugaucaaacugauggauaccc

SEQ ID NO: 33154 - RNA, 64 nt, hsa
aaacgacccuguggcugugagaaagugaaaaaagaaaaaaaaaaaggcauuggcauuuucuugu

SEQ ID NO: 33155 - RNA, 64 nt, hsa
aacgacccuguggcugugagaaagugaaaaaagaaaaaaaaaaaggcauuggcauuuucuuguc

SEQ ID NO: 33156 - RNA, 64 nt, hsa
acgacccuguggcugugagaaagugaaaaaagaaaaaaaaaaaggcauuggcauuuucuugucu

SEQ ID NO: 33157 - RNA, 64 nt, hsa
cgacccuguggcugugagaaagugaaaaaagaaaaaaaaaaaggcauuggcauuuucuugucuc

SEQ ID NO: 33158 - RNA, 64 nt, hsa
ggaacauuccauaucauuagucgaaaacaaaaacaaaaaaaaaaccuuuggucauuuguaagac

SEQ ID NO: 33159 - RNA, 64 nt, hsa
gaacauuccauaucauuagucgaaaacaaaaacaaaaaaaaaaccuuuggucauuuguaagaca

SEQ ID NO: 33160 - RNA, 64 nt, hsa
aacauuccauaucauuagucgaaaacaaaaacaaaaaaaaaaccuuuggucauuuguaagacau

SEQ ID NO: 33161 - RNA, 64 nt, hsa
ggauguguuuguaugcauucuggacauuugaauuaaaaaaaaaguauugugauccuguaaagga

SEQ ID NO: 33162 - RNA, 64 nt, hsa
gauguguuuguaugcauucuggacauuugaauuaaaaaaaaaguauugugauccuguaaaggau

SEQ ID NO: 33163 - RNA, 64 nt, hsa
cuccagccugggcgcaagaccaagacuuaaacgcaaaaaaaaaaaaaaaaaaaaaaaaaaaguu

SEQ ID NO: 33164 - RNA, 64 nt, hsa
uccagccugggcgcaagaccaagacuuaaacgcaaaaaaaaaaaaaaaaaaaaaaaaaaaguuu

SEQ ID NO: 33165 - RNA, 64 nt, hsa
ccagccugggcgcaagaccaagacuuaaacgcaaaaaaaaaaaaaaaaaaaaaaaaaaaguuuc

SEQ ID NO: 33166 - RNA, 64 nt, hsa
cagccugggcgcaagaccaagacuuaaacgcaaaaaaaaaaaaaaaaaaaaaaaaaaaguuuca

SEQ ID NO: 33167 - RNA, 64 nt, hsa
agccugggcgcaagaccaagacuuaaacgcaaaaaaaaaaaaaaaaaaaaaaaaaaaguuucau

SEQ ID NO: 33168 - RNA, 64 nt, hsa
gccugggcgcaagaccaagacuuaaacgcaaaaaaaaaaaaaaaaaaaaaaaaaaaguuucaua

SEQ ID NO: 33169 - RNA, 64 nt, hsa
ccugggcgcaagaccaagacuuaaacgcaaaaaaaaaaaaaaaaaaaaaaaaaaaguuucauaa

SEQ ID NO: 33170 - RNA, 64 nt, hsa
cugggcgcaagaccaagacuuaaacgcaaaaaaaaaaaaaaaaaaaaaaaaaaaguuucauaau

SEQ ID NO: 33171 - RNA, 64 nt, hsa
ugggcgcaagaccaagacuuaaacgcaaaaaaaaaaaaaaaaaaaaaaaaaaaguuucauaaua

SEQ ID NO: 33172 - RNA, 64 nt, hsa
gggcgcaagaccaagacuuaaacgcaaaaaaaaaaaaaaaaaaaaaaaaaaaguuucauaauac

SEQ ID NO: 33173 - RNA, 64 nt, hsa
ggcgcaagaccaagacuuaaacgcaaaaaaaaaaaaaaaaaaaaaaaaaaaguuucauaauaca

SEQ ID NO: 33174 - RNA, 64 nt, hsa
gcgcaagaccaagacuuaaacgcaaaaaaaaaaaaaaaaaaaaaaaaaaaguuucauaauacag

SEQ ID NO: 33175 - RNA, 64 nt, hsa
cgcaagaccaagacuuaaacgcaaaaaaaaaaaaaaaaaaaaaaaaaaaguuucauaauacagc

SEQ ID NO: 33176 - RNA, 64 nt, hsa
gcaagaccaagacuuaaacgcaaaaaaaaaaaaaaaaaaaaaaaaaaaguuucauaauacagca

SEQ ID NO: 33177 - RNA, 64 nt, hsa
caagaccaagacuuaaacgcaaaaaaaaaaaaaaaaaaaaaaaaaaaguuucauaauacagcau

SEQ ID NO: 33178 - RNA, 64 nt, hsa
aagaccaagacuuaaacgcaaaaaaaaaaaaaaaaaaaaaaaaaaaguuucauaauacagcaug

SEQ ID NO: 33179 - RNA, 64 nt, hsa
agaccaagacuuaaacgcaaaaaaaaaaaaaaaaaaaaaaaaaaaguuucauaauacagcaugg

SEQ ID NO: 33180 - RNA, 64 nt, hsa
gaccaagacuuaaacgcaaaaaaaaaaaaaaaaaaaaaaaaaaaguuucauaauacagcauggu

SEQ ID NO: 33181 - RNA, 64 nt, hsa
accaagacuuaaacgcaaaaaaaaaaaaaaaaaaaaaaaaaaaguuucauaauacagcaugguc

SEQ ID NO: 33182 - RNA, 64 nt, hsa
ccaagacuuaaacgcaaaaaaaaaaaaaaaaaaaaaaaaaaaguuucauaauacagcauggucu

SEQ ID NO: 33183 - RNA, 64 nt, hsa
aguguuuaauaacuggcauuaagcuuagagggugaaaaaaaaaaaaaagauugauaguauuuuu

SEQ ID NO: 33184 - RNA, 64 nt, hsa
guguuuaauaacuggcauuaagcuuagagggugaaaaaaaaaaaaaagauugauaguauuuuuc

SEQ ID NO: 33185 - RNA, 64 nt, hsa
uguuuaauaacuggcauuaagcuuagagggugaaaaaaaaaaaaaagauugauaguauuuuuca

SEQ ID NO: 33186 - RNA, 64 nt, hsa
guuuaauaacuggcauuaagcuuagagggugaaaaaaaaaaaaaagauugauaguauuuuucau

SEQ ID NO: 33187 - RNA, 64 nt, hsa
uuuaauaacuggcauuaagcuuagagggugaaaaaaaaaaaaaagauugauaguauuuuucaua

SEQ ID NO: 33188 - RNA, 64 nt, hsa
uuaauaacuggcauuaagcuuagagggugaaaaaaaaaaaaaagauugauaguauuuuucauaa

SEQ ID NO: 33189 - RNA, 64 nt, hsa
uaauaacuggcauuaagcuuagagggugaaaaaaaaaaaaaagauugauaguauuuuucauaau

SEQ ID NO: 33190 - RNA, 64 nt, hsa
ccuaagaccaagauguaaaguaccaucugcccuuaaaaaaaauuggggcugucaauuucuaguu

SEQ ID NO: 33191 - RNA, 64 nt, hsa
cuccagccugggcgacagggcaagacucugucucaaaaaaaaaaaaaaaaaaaaagacggaucc

SEQ ID NO: 33192 - RNA, 64 nt, hsa
uccagccugggcgacagggcaagacucugucucaaaaaaaaaaaaaaaaaaaaagacggauccu

SEQ ID NO: 33193 - RNA, 64 nt, hsa
ccagccugggcgacagggcaagacucugucucaaaaaaaaaaaaaaaaaaaaagacggauccuu

SEQ ID NO: 33194 - RNA, 64 nt, hsa
cagccugggcgacagggcaagacucugucucaaaaaaaaaaaaaaaaaaaaagacggauccuuu

SEQ ID NO: 33195 - RNA, 64 nt, hsa
agccugggcgacagggcaagacucugucucaaaaaaaaaaaaaaaaaaaaagacggauccuuuu

SEQ ID NO: 33196 - RNA, 64 nt, hsa
gccugggcgacagggcaagacucugucucaaaaaaaaaaaaaaaaaaaaagacggauccuuuuu

SEQ ID NO: 33197 - RNA, 64 nt, hsa
ccugggcgacagggcaagacucugucucaaaaaaaaaaaaaaaaaaaaagacggauccuuuuuu

SEQ ID NO: 33198 - RNA, 64 nt, hsa
cugggcgacagggcaagacucugucucaaaaaaaaaaaaaaaaaaaaagacggauccuuuuuuu

SEQ ID NO: 33199 - RNA, 64 nt, hsa
ugggcgacagggcaagacucugucucaaaaaaaaaaaaaaaaaaaaagacggauccuuuuuuuu

SEQ ID NO: 33200 - RNA, 64 nt, hsa
gggcgacagggcaagacucugucucaaaaaaaaaaaaaaaaaaaaagacggauccuuuuuuuug

SEQ ID NO: 33201 - RNA, 64 nt, hsa
ggcgacagggcaagacucugucucaaaaaaaaaaaaaaaaaaaaagacggauccuuuuuuuugg

SEQ ID NO: 33202 - RNA, 64 nt, hsa
gcgacagggcaagacucugucucaaaaaaaaaaaaaaaaaaaaagacggauccuuuuuuuuggu

SEQ ID NO: 33203 - RNA, 64 nt, hsa
cgacagggcaagacucugucucaaaaaaaaaaaaaaaaaaaaagacggauccuuuuuuuuggug

SEQ ID NO: 33204 - RNA, 64 nt, hsa
gacagggcaagacucugucucaaaaaaaaaaaaaaaaaaaaagacggauccuuuuuuuuggugc

SEQ ID NO: 33205 - RNA, 64 nt, hsa
auaccuuauauuuguaucauucuuuaaaguuuacaaaaaaaaaccuuauguuuuuauguaauca

SEQ ID NO: 33206 - RNA, 64 nt, hsa
uaccuuauauuuguaucauucuuuaaaguuuacaaaaaaaaaccuuauguuuuuauguaaucag

SEQ ID NO: 33207 - RNA, 64 nt, hsa
gugccaacccaaaaauugguuuuauuuuuuucuuaaaaaaaaaaaagucuaccaaaggaauuug

SEQ ID NO: 33208 - RNA, 64 nt, hsa
ugccaacccaaaaauugguuuuauuuuuuucuuaaaaaaaaaaaagucuaccaaaggaauuugc

SEQ ID NO: 33209 - RNA, 64 nt, hsa
gccaacccaaaaauugguuuuauuuuuuucuuaaaaaaaaaaaagucuaccaaaggaauuugca

SEQ ID NO: 33210 - RNA, 64 nt, hsa
ccaacccaaaaauugguuuuauuuuuuucuuaaaaaaaaaaaagucuaccaaaggaauuugcau

SEQ ID NO: 33211 - RNA, 64 nt, hsa
caacccaaaaauugguuuuauuuuuuucuuaaaaaaaaaaaagucuaccaaaggaauuugcauc

SEQ ID NO: 33212 - RNA, 64 nt, hsa
agaauuacuagguugccauguggcucacuuauuuaaaaaaaaaaaaaaaaaacucacccguuuu

SEQ ID NO: 33213 - RNA, 64 nt, hsa
gaauuacuagguugccauguggcucacuuauuuaaaaaaaaaaaaaaaaaacucacccguuuuc

SEQ ID NO: 33214 - RNA, 64 nt, hsa
aauuacuagguugccauguggcucacuuauuuaaaaaaaaaaaaaaaaaacucacccguuuucc

SEQ ID NO: 33215 - RNA, 64 nt, hsa
auuacuagguugccauguggcucacuuauuuaaaaaaaaaaaaaaaaaacucacccguuuuccu

SEQ ID NO: 33216 - RNA, 64 nt, hsa
uuacuagguugccauguggcucacuuauuuaaaaaaaaaaaaaaaaaacucacccguuuuccug

SEQ ID NO: 33217 - RNA, 64 nt, hsa
uacuagguugccauguggcucacuuauuuaaaaaaaaaaaaaaaaaacucacccguuuuccugg

SEQ ID NO: 33218 - RNA, 64 nt, hsa
acuagguugccauguggcucacuuauuuaaaaaaaaaaaaaaaaaacucacccguuuuccuggg

SEQ ID NO: 33219 - RNA, 64 nt, hsa
cuagguugccauguggcucacuuauuuaaaaaaaaaaaaaaaaaacucacccguuuuccuggga

SEQ ID NO: 33220 - RNA, 64 nt, hsa
uagguugccauguggcucacuuauuuaaaaaaaaaaaaaaaaaacucacccguuuuccugggau

SEQ ID NO: 33221 - RNA, 64 nt, hsa
agguugccauguggcucacuuauuuaaaaaaaaaaaaaaaaaacucacccguuuuccugggauu

SEQ ID NO: 33222 - RNA, 64 nt, hsa
gguugccauguggcucacuuauuuaaaaaaaaaaaaaaaaaacucacccguuuuccugggauuu

SEQ ID NO: 33223 - RNA, 64 nt, hsa
guugcauauggcaaugaaguguuuguuuuauauuaaaaaaaaccuguuauguacaguugaaaua

SEQ ID NO: 33224 - RNA, 64 nt, hsa
uaaucacaacguuaagaugaaauuauauuuuuggaaaaaaaaaacacuugaagcccagauggaa

SEQ ID NO: 33225 - RNA, 64 nt, hsa
aaucacaacguuaagaugaaauuauauuuuuggaaaaaaaaaacacuugaagcccagauggaaa

SEQ ID NO: 33226 - RNA, 64 nt, hsa
aucacaacguuaagaugaaauuauauuuuuggaaaaaaaaaacacuugaagcccagauggaaau

SEQ ID NO: 33227 - RNA, 64 nt, hsa
gcaaucuuuuguugucuaaaggugcugcaguuaaaaaaaaaacaaccuuuucuuucaauauggc

SEQ ID NO: 33228 - RNA, 64 nt, hsa
ugcaaucuuuuguugucuaaaggugcugcaguuaaaaaaaaaacaaccuuuucuuucaauaugg

SEQ ID NO: 33229 - RNA, 64 nt, hsa
augcaaucuuuuguugucuaaaggugcugcaguuaaaaaaaaaacaaccuuuucuuucaauaug

SEQ ID NO: 33230 - RNA, 62 nt, hsa
uuaugcaacaaaaagugugaagauauuuaacgaaaaaaaagguagaucuugaauguguugua

SEQ ID NO: 33231 - RNA, 64 nt, hsa
uuccuucccuucuuuccucuuuccuuuccaguuaaaaaaaaacaaaaacaaaaacaaaacccuu

SEQ ID NO: 33232 - RNA, 64 nt, hsa
cuuccuucccuucuuuccucuuuccuuuccaguuaaaaaaaaacaaaaacaaaaacaaaacccu

SEQ ID NO: 33233 - RNA, 64 nt, hsa
uauuaguuuugaauauaaacaucuuuuucagaccaaaaaaaacuuuauuguaugagagcuuauc

SEQ ID NO: 33234 - RNA, 64 nt, hsa
guggagcauuauuuuucuucuuguuaaauauagaaaaaaaaagagauucuaguacaaaguuacu

SEQ ID NO: 33235 - RNA, 64 nt, hsa
uguggagcauuauuuuucuucuuguuaaauauagaaaaaaaaagagauucuaguacaaaguuac

SEQ ID NO: 33236 - RNA, 64 nt, hsa
uuucuuucccugaaauaaaaauacacacaagcaaaaaaaaaaugauaguuucacaucucuuagu

SEQ ID NO: 33237 - RNA, 64 nt, hsa
auuucuuucccugaaauaaaaauacacacaagcaaaaaaaaaaugauaguuucacaucucuuag

SEQ ID NO: 33238 - RNA, 64 nt, hsa
cauuucuuucccugaaauaaaaauacacacaagcaaaaaaaaaaugauaguuucacaucucuua

SEQ ID NO: 33239 - RNA, 64 nt, hsa
cgcuuaauaccuaauaucauaguuguacaauaugaaaaaaaagaauaaaaaguagcaguaaaau

SEQ ID NO: 33240 - RNA, 64 nt, hsa
cuguacuuacagauucuuccuguaaacuaaauaaaaaaaaaaugauagugcauuuuggugguaa

SEQ ID NO: 33241 - RNA, 64 nt, hsa
ccuguacuuacagauucuuccuguaaacuaaauaaaaaaaaaaugauagugcauuuugguggua

SEQ ID NO: 33242 - RNA, 64 nt, hsa
accuguacuuacagauucuuccuguaaacuaaauaaaaaaaaaaugauagugcauuuugguggu

SEQ ID NO: 33243 - RNA, 64 nt, hsa
uacuccuuagaguucagaugaauucuuaaaauuaaaaaaaaacuccauaguacuaauuuuguuu

SEQ ID NO: 33244 - RNA, 64 nt, hsa
uuacuccuuagaguucagaugaauucuuaaaauuaaaaaaaaacuccauaguacuaauuuuguu

SEQ ID NO: 33245 - RNA, 64 nt, hsa
auuuuuuucaguggagugguuuucgcuuaaaggaaaaaaaaaucuaaaacugcgaagaauacua

SEQ ID NO: 33246 - RNA, 64 nt, hsa
aauuuuuuucaguggagugguuuucgcuuaaaggaaaaaaaaaucuaaaacugcgaagaauacu

SEQ ID NO: 33247 - RNA, 64 nt, hsa
guuaacugaauaccacucuguaauugcaaaaaaaaaaaaaaaguugcagcuguuuuguugacau

SEQ ID NO: 33248 - RNA, 64 nt, hsa
uguuaacugaauaccacucuguaauugcaaaaaaaaaaaaaaaguugcagcuguuuuguugaca

SEQ ID NO: 33249 - RNA, 64 nt, hsa
cuguuaacugaauaccacucuguaauugcaaaaaaaaaaaaaaaguugcagcuguuuuguugac

SEQ ID NO: 33250 - RNA, 64 nt, hsa
ucuguuaacugaauaccacucuguaauugcaaaaaaaaaaaaaaaguugcagcuguuuuguuga

SEQ ID NO: 33251 - RNA, 64 nt, hsa
uucuguuaacugaauaccacucuguaauugcaaaaaaaaaaaaaaaguugcagcuguuuuguug

SEQ ID NO: 33252 - RNA, 64 nt, hsa
guucuguuaacugaauaccacucuguaauugcaaaaaaaaaaaaaaaguugcagcuguuuuguu

SEQ ID NO: 33253 - RNA, 64 nt, hsa
uguucuguuaacugaauaccacucuguaauugcaaaaaaaaaaaaaaaguugcagcuguuuugu

SEQ ID NO: 33254 - RNA, 64 nt, hsa
uuguucuguuaacugaauaccacucuguaauugcaaaaaaaaaaaaaaaguugcagcuguuuug

SEQ ID NO: 33255 - RNA, 64 nt, hsa
acuuacacguggugcauauuaaaauaagcagagaaaaaaaaaugugaauaaacuacugaaaaca

SEQ ID NO: 33256 - RNA, 64 nt, hsa
aacuuacacguggugcauauuaaaauaagcagagaaaaaaaaaugugaauaaacuacugaaaac

SEQ ID NO: 33257 - RNA, 64 nt, hsa
uaaaugaugucacuuuuagugcuguuggcaagaaaaaaaaaacaacaaacuuguacaaugaauu

SEQ ID NO: 33258 - RNA, 64 nt, hsa
uuaaaugaugucacuuuuagugcuguuggcaagaaaaaaaaaacaacaaacuuguacaaugaau

SEQ ID NO: 33259 - RNA, 64 nt, hsa
uuuaaaugaugucacuuuuagugcuguuggcaagaaaaaaaaaacaacaaacuuguacaaugaa

SEQ ID NO: 33260 - RNA, 64 nt, hsa
uuuucugguuuuaguuugggaauaaucauucauuaaaaaaaauguauugugguuuaugcgaaca

SEQ ID NO: 33261 - RNA, 64 nt, hsa
ucugcuaaauuaauggacuuguuaaacuuuuggaaaaaaaaagauuaaaugccagcuuuguaca

SEQ ID NO: 33262 - RNA, 64 nt, hsa
aucugcuaaauuaauggacuuguuaaacuuuuggaaaaaaaaagauuaaaugccagcuuuguac

SEQ ID NO: 33263 - RNA, 64 nt, hsa
ccuuuuaguuuucuugguuaaaaaaaaaaacaaaaaaaaaaacccuccuuuuuuccuuucguca

SEQ ID NO: 33264 - RNA, 64 nt, hsa
cccuuuuaguuuucuugguuaaaaaaaaaaacaaaaaaaaaaacccuccuuuuuuccuuucguc

SEQ ID NO: 33265 - RNA, 64 nt, hsa
ucccuuuuaguuuucuugguuaaaaaaaaaaacaaaaaaaaaaacccuccuuuuuuccuuucgu

SEQ ID NO: 33266 - RNA, 64 nt, hsa
cucccuuuuaguuuucuugguuaaaaaaaaaaacaaaaaaaaaaacccuccuuuuuuccuuucg

SEQ ID NO: 33267 - RNA, 64 nt, hsa
uuucaccaacucccuuuuaguuuucuugguuaaaaaaaaaaacaaaaaaaaaaacccuccuuuu

SEQ ID NO: 33268 - RNA, 64 nt, hsa
cuuucaccaacucccuuuuaguuuucuugguuaaaaaaaaaaacaaaaaaaaaaacccuccuuu

SEQ ID NO: 33269 - RNA, 64 nt, hsa
ucuuucaccaacucccuuuuaguuuucuugguuaaaaaaaaaaacaaaaaaaaaaacccuccuu

SEQ ID NO: 33270 - RNA, 64 nt, hsa
gucuuucaccaacucccuuuuaguuuucuugguuaaaaaaaaaaacaaaaaaaaaaacccuccu

SEQ ID NO: 33271 - RNA, 64 nt, hsa
aaaaaaaaaaaaaaaaaaaggaaaaaaaaaaaagaaaaaaaaccauauguguauuagggugacu

SEQ ID NO: 33272 - RNA, 64 nt, hsa
cgucucaaaaaaaaaaaaaaaaaaaaaaggaaaaaaaaaaaagaaaaaaaaccauauguguauu

SEQ ID NO: 33273 - RNA, 64 nt, hsa
ccgucucaaaaaaaaaaaaaaaaaaaaaaggaaaaaaaaaaaagaaaaaaaaccauauguguau

SEQ ID NO: 33274 - RNA, 64 nt, hsa
uccgucucaaaaaaaaaaaaaaaaaaaaaaggaaaaaaaaaaaagaaaaaaaaccauaugugua

SEQ ID NO: 33275 - RNA, 64 nt, hsa
cuccgucucaaaaaaaaaaaaaaaaaaaaaaggaaaaaaaaaaaagaaaaaaaaccauaugugu

SEQ ID NO: 33276 - RNA, 64 nt, hsa
acuccgucucaaaaaaaaaaaaaaaaaaaaaaggaaaaaaaaaaaagaaaaaaaaccauaugug

SEQ ID NO: 33277 - RNA, 64 nt, hsa
acagagugagacuccgucucaaaaaaaaaaaaaaaaaaaaaaggaaaaaaaaaaaagaaaaaaa

SEQ ID NO: 33278 - RNA, 64 nt, hsa
gacagagugagacuccgucucaaaaaaaaaaaaaaaaaaaaaaggaaaaaaaaaaaagaaaaaa

SEQ ID NO: 33279 - RNA, 64 nt, hsa
ugacagagugagacuccgucucaaaaaaaaaaaaaaaaaaaaaaggaaaaaaaaaaaagaaaaa

SEQ ID NO: 33280 - RNA, 64 nt, hsa
augacagagugagacuccgucucaaaaaaaaaaaaaaaaaaaaaaggaaaaaaaaaaaagaaaa

SEQ ID NO: 33281 - RNA, 64 nt, hsa
gaugacagagugagacuccgucucaaaaaaaaaaaaaaaaaaaaaaggaaaaaaaaaaaagaaa

SEQ ID NO: 33282 - RNA, 64 nt, hsa
ggaugacagagugagacuccgucucaaaaaaaaaaaaaaaaaaaaaaggaaaaaaaaaaaagaa

SEQ ID NO: 33283 - RNA, 64 nt, hsa
uggaugacagagugagacuccgucucaaaaaaaaaaaaaaaaaaaaaaggaaaaaaaaaaaaga

SEQ ID NO: 33284 - RNA, 64 nt, hsa
cuggaugacagagugagacuccgucucaaaaaaaaaaaaaaaaaaaaaaggaaaaaaaaaaaag

SEQ ID NO: 33285 - RNA, 64 nt, hsa
ccuggaugacagagugagacuccgucucaaaaaaaaaaaaaaaaaaaaaaggaaaaaaaaaaaa

SEQ ID NO: 33286 - RNA, 64 nt, hsa
gccuggaugacagagugagacuccgucucaaaaaaaaaaaaaaaaaaaaaaggaaaaaaaaaaa

SEQ ID NO: 33287 - RNA, 64 nt, hsa
agccuggaugacagagugagacuccgucucaaaaaaaaaaaaaaaaaaaaaaggaaaaaaaaaa

SEQ ID NO: 33288 - RNA, 64 nt, hsa
cagccuggaugacagagugagacuccgucucaaaaaaaaaaaaaaaaaaaaaaggaaaaaaaaa

SEQ ID NO: 33289 - RNA, 64 nt, hsa
ccagccuggaugacagagugagacuccgucucaaaaaaaaaaaaaaaaaaaaaaggaaaaaaaa

SEQ ID NO: 33290 - RNA, 64 nt, hsa
uccagccuggaugacagagugagacuccgucucaaaaaaaaaaaaaaaaaaaaaaggaaaaaaa

SEQ ID NO: 33291 - RNA, 64 nt, hsa
cuccagccuggaugacagagugagacuccgucucaaaaaaaaaaaaaaaaaaaaaaggaaaaaa

SEQ ID NO: 33292 - RNA, 64 nt, hsa
accuaggugacagagcaagacccugucucaaaaaaaaaaaaacaaauuaaccaauaaguucuaa

SEQ ID NO: 33293 - RNA, 64 nt, hsa
aaccuaggugacagagcaagacccugucucaaaaaaaaaaaaacaaauuaaccaauaaguucua

SEQ ID NO: 33294 - RNA, 64 nt, hsa
caaccuaggugacagagcaagacccugucucaaaaaaaaaaaaacaaauuaaccaauaaguucu

SEQ ID NO: 33295 - RNA, 64 nt, hsa
ccaaccuaggugacagagcaagacccugucucaaaaaaaaaaaaacaaauuaaccaauaaguuc

SEQ ID NO: 33296 - RNA, 64 nt, hsa
uccaaccuaggugacagagcaagacccugucucaaaaaaaaaaaaacaaauuaaccaauaaguu

SEQ ID NO: 33297 - RNA, 64 nt, hsa
cuccaaccuaggugacagagcaagacccugucucaaaaaaaaaaaaacaaauuaaccaauaagu

SEQ ID NO: 33298 - RNA, 64 nt, hsa
guuguaaaaugcaacuguauugcugagcaaaaaaaaaaaaaauucaaaacauuggauuuuauag

SEQ ID NO: 33299 - RNA, 64 nt, hsa
aguuguaaaaugcaacuguauugcugagcaaaaaaaaaaaaaauucaaaacauuggauuuuaua

SEQ ID NO: 33300 - RNA, 64 nt, hsa
aaguuguaaaaugcaacuguauugcugagcaaaaaaaaaaaaaauucaaaacauuggauuuuau

SEQ ID NO: 33301 - RNA, 64 nt, hsa
aaaguuguaaaaugcaacuguauugcugagcaaaaaaaaaaaaaauucaaaacauuggauuuua

SEQ ID NO: 33302 - RNA, 64 nt, hsa
aaaaguuguaaaaugcaacuguauugcugagcaaaaaaaaaaaaaauucaaaacauuggauuuu

SEQ ID NO: 33303 - RNA, 64 nt, hsa
uaaaaguuguaaaaugcaacuguauugcugagcaaaaaaaaaaaaaauucaaaacauuggauuu

SEQ ID NO: 33304 - RNA, 64 nt, hsa
auaaaaguuguaaaaugcaacuguauugcugagcaaaaaaaaaaaaaauucaaaacauuggauu

SEQ ID NO: 33305 - RNA, 64 nt, hsa
ccuggguaacaaagugagaccucccugucucuacaaaaaaaaucaaaaaauuaucugauccuug

SEQ ID NO: 33306 - RNA, 64 nt, hsa
uaaaacuuacuaugguauauauuuugaaaggagaaaaaaaaagccacuaaggucaguguuauaa

SEQ ID NO: 33307 - RNA, 64 nt, hsa
uuaaaacuuacuaugguauauauuuugaaaggagaaaaaaaaagccacuaaggucaguguuaua

SEQ ID NO: 33308 - RNA, 64 nt, hsa
aggcacacugagcaaguuuucaccuaucuggaaaaaaaaaaauaugagauuggaaaaaauuaga

SEQ ID NO: 33309 - RNA, 64 nt, hsa
aaggcacacugagcaaguuuucaccuaucuggaaaaaaaaaaauaugagauuggaaaaaauuag

SEQ ID NO: 33310 - RNA, 64 nt, hsa
gaaggcacacugagcaaguuuucaccuaucuggaaaaaaaaaaauaugagauuggaaaaaauua

SEQ ID NO: 33311 - RNA, 64 nt, hsa
ggaaggcacacugagcaaguuuucaccuaucuggaaaaaaaaaaauaugagauuggaaaaaauu

SEQ ID NO: 33312 - RNA, 64 nt, hsa
uauaaaggaaaaacagcaaaacaaaaagcaaacaaaaaaaaacugcaaaagucuaaaauaccca

SEQ ID NO: 33313 - RNA, 64 nt, hsa
guauaaaggaaaaacagcaaaacaaaaagcaaacaaaaaaaaacugcaaaagucuaaaauaccc

SEQ ID NO: 33314 - RNA, 64 nt, hsa
uugguuauugaauaaacagauaaguuuaaaaaaaaaaaaaaacuacuucaucuaccaguaauug

SEQ ID NO: 33315 - RNA, 64 nt, hsa
cuugguuauugaauaaacagauaaguuuaaaaaaaaaaaaaaacuacuucaucuaccaguaauu

SEQ ID NO: 33316 - RNA, 64 nt, hsa
acuugguuauugaauaaacagauaaguuuaaaaaaaaaaaaaaacuacuucaucuaccaguaau

SEQ ID NO: 33317 - RNA, 64 nt, hsa
aacuugguuauugaauaaacagauaaguuuaaaaaaaaaaaaaaacuacuucaucuaccaguaa

SEQ ID NO: 33318 - RNA, 64 nt, hsa
aaacuugguuauugaauaaacagauaaguuuaaaaaaaaaaaaaaacuacuucaucuaccagua

SEQ ID NO: 33319 - RNA, 64 nt, hsa
gaaacuugguuauugaauaaacagauaaguuuaaaaaaaaaaaaaaacuacuucaucuaccagu

SEQ ID NO: 33320 - RNA, 64 nt, hsa
agaaacuugguuauugaauaaacagauaaguuuaaaaaaaaaaaaaaacuacuucaucuaccag

SEQ ID NO: 33321 - RNA, 64 nt, hsa
aagaaacuugguuauugaauaaacagauaaguuuaaaaaaaaaaaaaaacuacuucaucuacca

SEQ ID NO: 33322 - RNA, 64 nt, hsa
aauugucaccucuguuaagguugaacuuugccaaaaaaaaaagaaguuacuuuguaauuuuugg

SEQ ID NO: 33323 - RNA, 64 nt, hsa
aaauugucaccucuguuaagguugaacuuugccaaaaaaaaaagaaguuacuuuguaauuuuug

SEQ ID NO: 33324 - RNA, 64 nt, hsa
aaaauugucaccucuguuaagguugaacuuugccaaaaaaaaaagaaguuacuuuguaauuuuu

SEQ ID NO: 33325 - RNA, 64 nt, hsa
guacuaacagcuauaggacuuguauuuaaaaaaaaaaaaaaagcuuggacaugguuugcagcuu

SEQ ID NO: 33326 - RNA, 64 nt, hsa
aguacuaacagcuauaggacuuguauuuaaaaaaaaaaaaaaagcuuggacaugguuugcagcu

SEQ ID NO: 33327 - RNA, 64 nt, hsa
uaguacuaacagcuauaggacuuguauuuaaaaaaaaaaaaaaagcuuggacaugguuugcagc

SEQ ID NO: 33328 - RNA, 64 nt, hsa
uuaguacuaacagcuauaggacuuguauuuaaaaaaaaaaaaaaagcuuggacaugguuugcag

SEQ ID NO: 33329 - RNA, 64 nt, hsa
auuaguacuaacagcuauaggacuuguauuuaaaaaaaaaaaaaaagcuuggacaugguuugca

SEQ ID NO: 33330 - RNA, 64 nt, hsa
aauuaguacuaacagcuauaggacuuguauuuaaaaaaaaaaaaaaagcuuggacaugguuugc

SEQ ID NO: 33331 - RNA, 64 nt, hsa
aaauuaguacuaacagcuauaggacuuguauuuaaaaaaaaaaaaaaagcuuggacaugguuug

SEQ ID NO: 33332 - RNA, 64 nt, hsa
aaaauuaguacuaacagcuauaggacuuguauuuaaaaaaaaaaaaaaagcuuggacaugguuu

SEQ ID NO: 33333 - RNA, 64 nt, hsa
aaaguaaaaaaaacaaaaaaaaaacaaaaaauuuaaaaaaaagguuugcuaaucugauaguuaa

SEQ ID NO: 33334 - RNA, 64 nt, hsa
cgguucaccaucaauuuaaaaguaaaaaaaacaaaaaaaaaacaaaaaauuuaaaaaaaagguu

SEQ ID NO: 33335 - RNA, 64 nt, hsa
acgguucaccaucaauuuaaaaguaaaaaaaacaaaaaaaaaacaaaaaauuuaaaaaaaaggu

SEQ ID NO: 33336 - RNA, 64 nt, hsa
cacgguucaccaucaauuuaaaaguaaaaaaaacaaaaaaaaaacaaaaaauuuaaaaaaaagg

SEQ ID NO: 33337 - RNA, 64 nt, hsa
ucuuaaugccacgguucaccaucaauuuaaaaguaaaaaaaacaaaaaaaaaacaaaaaauuua

SEQ ID NO: 33338 - RNA, 64 nt, hsa
agcuuucacugaagguuuuuuuuucuuaaaaauaaaaaaaaauauauaaguguaacauguuuuc

SEQ ID NO: 33339 - RNA, 64 nt, hsa
aagcuuucacugaagguuuuuuuuucuuaaaaauaaaaaaaaauauauaaguguaacauguuuu

SEQ ID NO: 33340 - RNA, 64 nt, hsa
augaacuuguagggggcauagaggauucuugaaaaaaaaaaaugcaagagugauuuucuguuac

SEQ ID NO: 33341 - RNA, 64 nt, hsa
aaugaacuuguagggggcauagaggauucuugaaaaaaaaaaaugcaagagugauuuucuguua

SEQ ID NO: 33342 - RNA, 64 nt, hsa
gaaugaacuuguagggggcauagaggauucuugaaaaaaaaaaaugcaagagugauuuucuguu

SEQ ID NO: 33343 - RNA, 64 nt, hsa
cgaaugaacuuguagggggcauagaggauucuugaaaaaaaaaaaugcaagagugauuuucugu

SEQ ID NO: 33344 - RNA, 64 nt, hsa
aauguucuuuaaaaguuuaaguauucuacaaaaaaaaaaaaaguuuucuccauugauuuucacc

SEQ ID NO: 33345 - RNA, 64 nt, hsa
uaauguucuuuaaaaguuuaaguauucuacaaaaaaaaaaaaaguuuucuccauugauuuucac

SEQ ID NO: 33346 - RNA, 64 nt, hsa
uuaauguucuuuaaaaguuuaaguauucuacaaaaaaaaaaaaaguuuucuccauugauuuuca

SEQ ID NO: 33347 - RNA, 64 nt, hsa
auuaauguucuuuaaaaguuuaaguauucuacaaaaaaaaaaaaaguuuucuccauugauuuuc

SEQ ID NO: 33348 - RNA, 64 nt, hsa
uauuaauguucuuuaaaaguuuaaguauucuacaaaaaaaaaaaaaguuuucuccauugauuuu

SEQ ID NO: 33349 - RNA, 64 nt, hsa
guauuaauguucuuuaaaaguuuaaguauucuacaaaaaaaaaaaaaguuuucuccauugauuu

SEQ ID NO: 33350 - RNA, 64 nt, hsa
cagccugggugacagaacaagacugucucaaaaaaaaaaaaagagaagaaaaacugccuacagg

SEQ ID NO: 33351 - RNA, 64 nt, hsa
ccagccugggugacagaacaagacugucucaaaaaaaaaaaaagagaagaaaaacugccuacag

SEQ ID NO: 33352 - RNA, 64 nt, hsa
uccagccugggugacagaacaagacugucucaaaaaaaaaaaaagagaagaaaaacugccuaca

SEQ ID NO: 33353 - RNA, 64 nt, hsa
cuccagccugggugacagaacaagacugucucaaaaaaaaaaaaagagaagaaaaacugccuac

SEQ ID NO: 33354 - RNA, 64 nt, hsa
acuccagccugggugacagaacaagacugucucaaaaaaaaaaaaagagaagaaaaacugccua

SEQ ID NO: 33355 - RNA, 64 nt, hsa
cacuccagccugggugacagaacaagacugucucaaaaaaaaaaaaagagaagaaaaacugccu

SEQ ID NO: 33356 - RNA, 64 nt, hsa
ugaugagagugagacuccaucgcaaaaaaaaaaaaaaaaaaagaaaagaaaauuagccaggugu

SEQ ID NO: 33357 - RNA, 64 nt, hsa
augaugagagugagacuccaucgcaaaaaaaaaaaaaaaaaaagaaaagaaaauuagccaggug

SEQ ID NO: 33358 - RNA, 64 nt, hsa
gaugaugagagugagacuccaucgcaaaaaaaaaaaaaaaaaaagaaaagaaaauuagccaggu

SEQ ID NO: 33359 - RNA, 64 nt, hsa
ggaugaugagagugagacuccaucgcaaaaaaaaaaaaaaaaaaagaaaagaaaauuagccagg

SEQ ID NO: 33360 - RNA, 64 nt, hsa
uggaugaugagagugagacuccaucgcaaaaaaaaaaaaaaaaaaagaaaagaaaauuagccag

SEQ ID NO: 33361 - RNA, 64 nt, hsa
cuggaugaugagagugagacuccaucgcaaaaaaaaaaaaaaaaaaagaaaagaaaauuagcca

SEQ ID NO: 33362 - RNA, 64 nt, hsa
ccuggaugaugagagugagacuccaucgcaaaaaaaaaaaaaaaaaaagaaaagaaaauuagcc

SEQ ID NO: 33363 - RNA, 64 nt, hsa
gccuggaugaugagagugagacuccaucgcaaaaaaaaaaaaaaaaaaagaaaagaaaauuagc

SEQ ID NO: 33364 - RNA, 64 nt, hsa
agccuggaugaugagagugagacuccaucgcaaaaaaaaaaaaaaaaaaagaaaagaaaauuag

SEQ ID NO: 33365 - RNA, 64 nt, hsa
cagccuggaugaugagagugagacuccaucgcaaaaaaaaaaaaaaaaaaagaaaagaaaauua

SEQ ID NO: 33366 - RNA, 64 nt, hsa
ucagccuggaugaugagagugagacuccaucgcaaaaaaaaaaaaaaaaaaagaaaagaaaauu

SEQ ID NO: 33367 - RNA, 64 nt, hsa
uucagccuggaugaugagagugagacuccaucgcaaaaaaaaaaaaaaaaaaagaaaagaaaau

SEQ ID NO: 33368 - RNA, 64 nt, hsa
uuaaaaagguguagacaauggugguuaaaaaaaaaaaaaaaacagguaccagguucuguguguu

SEQ ID NO: 33369 - RNA, 64 nt, hsa
uuuaaaaagguguagacaauggugguuaaaaaaaaaaaaaaaacagguaccagguucugugugu

SEQ ID NO: 33370 - RNA, 64 nt, hsa
uuuuaaaaagguguagacaauggugguuaaaaaaaaaaaaaaaacagguaccagguucugugug

SEQ ID NO: 33371 - RNA, 64 nt, hsa
uuuuuaaaaagguguagacaauggugguuaaaaaaaaaaaaaaaacagguaccagguucugugu

SEQ ID NO: 33372 - RNA, 64 nt, hsa
auuuuuaaaaagguguagacaauggugguuaaaaaaaaaaaaaaaacagguaccagguucugug

SEQ ID NO: 33373 - RNA, 64 nt, hsa
aauuuuuaaaaagguguagacaauggugguuaaaaaaaaaaaaaaaacagguaccagguucugu

SEQ ID NO: 33374 - RNA, 64 nt, hsa
uaauuuuuaaaaagguguagacaauggugguuaaaaaaaaaaaaaaaacagguaccagguucug

SEQ ID NO: 33375 - RNA, 64 nt, hsa
uuaauuuuuaaaaagguguagacaauggugguuaaaaaaaaaaaaaaaacagguaccagguucu

SEQ ID NO: 33376 - RNA, 64 nt, hsa
cuuaauuuuuaaaaagguguagacaauggugguuaaaaaaaaaaaaaaaacagguaccagguuc

SEQ ID NO: 33377 - RNA, 64 nt, hsa
gguuuucugaaauguuauauucucuaugcauuuaaaaaaaaauguaaacuugacauuuuagggu

SEQ ID NO: 33378 - RNA, 64 nt, hsa
agguuuucugaaauguuauauucucuaugcauuuaaaaaaaaauguaaacuugacauuuuaggg

SEQ ID NO: 33379 - RNA, 64 nt, hsa
uucugguuuauuuccuagacuguuauuuaaaaaaaaaaaaaacauuguguuaggacagcauaua

SEQ ID NO: 33380 - RNA, 64 nt, hsa
auucugguuuauuuccuagacuguuauuuaaaaaaaaaaaaaacauuguguuaggacagcauau

SEQ ID NO: 33381 - RNA, 64 nt, hsa
uauucugguuuauuuccuagacuguuauuuaaaaaaaaaaaaaacauuguguuaggacagcaua

SEQ ID NO: 33382 - RNA, 64 nt, hsa
auauucugguuuauuuccuagacuguuauuuaaaaaaaaaaaaaacauuguguuaggacagcau

SEQ ID NO: 33383 - RNA, 64 nt, hsa
aauauucugguuuauuuccuagacuguuauuuaaaaaaaaaaaaaacauuguguuaggacagca

SEQ ID NO: 33384 - RNA, 64 nt, hsa
gaauauucugguuuauuuccuagacuguuauuuaaaaaaaaaaaaaacauuguguuaggacagc

SEQ ID NO: 33385 - RNA, 64 nt, hsa
ggaauauucugguuuauuuccuagacuguuauuuaaaaaaaaaaaaaacauuguguuaggacag

SEQ ID NO: 33386 - RNA, 64 nt, hsa
gauguuauaauaaaguggaauggucucuuuaaaaaaaaaaaaggaaagaaaagagaaaagcaau

SEQ ID NO: 33387 - RNA, 64 nt, hsa
agauguuauaauaaaguggaauggucucuuuaaaaaaaaaaaaggaaagaaaagagaaaagcaa

SEQ ID NO: 33388 - RNA, 64 nt, hsa
cagauguuauaauaaaguggaauggucucuuuaaaaaaaaaaaaggaaagaaaagagaaaagca

SEQ ID NO: 33389 - RNA, 64 nt, hsa
ccagauguuauaauaaaguggaauggucucuuuaaaaaaaaaaaaggaaagaaaagagaaaagc

SEQ ID NO: 33390 - RNA, 64 nt, hsa
uccagauguuauaauaaaguggaauggucucuuuaaaaaaaaaaaaggaaagaaaagagaaaag

SEQ ID NO: 33391 - RNA, 64 nt, hsa
aucagaaccuaagcacagcaguaaacuauggggaaaaaaaaagaagaagaaaaagaaacucagg

SEQ ID NO: 33392 - RNA, 64 nt, hsa
aaucagaaccuaagcacagcaguaaacuauggggaaaaaaaaagaagaagaaaaagaaacucag

SEQ ID NO: 33393 - RNA, 64 nt, hsa
uaaaauaauguuuuuauuuugcuguagaaaaauaaaaaaaaauuugauuauauauuuuuaaucc

SEQ ID NO: 33394 - RNA, 64 nt, hsa
uuaaaauaauguuuuuauuuugcuguagaaaaauaaaaaaaaauuugauuauauauuuuuaauc

SEQ ID NO: 33395 - RNA, 64 nt, hsa
aguagggaguguguaccccuuacuccccaucaaaaaaaaaaauggauacaugguuaaaggauag

SEQ ID NO: 33396 - RNA, 64 nt, hsa
uaguagggaguguguaccccuuacuccccaucaaaaaaaaaaauggauacaugguuaaaggaua

SEQ ID NO: 33397 - RNA, 64 nt, hsa
guaguagggaguguguaccccuuacuccccaucaaaaaaaaaaauggauacaugguuaaaggau

SEQ ID NO: 33398 - RNA, 64 nt, hsa
uguaguagggaguguguaccccuuacuccccaucaaaaaaaaaaauggauacaugguuaaagga

SEQ ID NO: 33399 - RNA, 64 nt, hsa
gaggcugcccugaacaaaaaaaacaaaaagaaaaaaaaaaaaggaaagaaagaaacugauaaaa

SEQ ID NO: 33400 - RNA, 64 nt, hsa
ugaggcugcccugaacaaaaaaaacaaaaagaaaaaaaaaaaaggaaagaaagaaacugauaaa

SEQ ID NO: 33401 - RNA, 64 nt, hsa
gugaggcugcccugaacaaaaaaaacaaaaagaaaaaaaaaaaaggaaagaaagaaacugauaa

SEQ ID NO: 33402 - RNA, 64 nt, hsa
agugaggcugcccugaacaaaaaaaacaaaaagaaaaaaaaaaaaggaaagaaagaaacugaua

SEQ ID NO: 33403 - RNA, 64 nt, hsa
cagugaggcugcccugaacaaaaaaaacaaaaagaaaaaaaaaaaaggaaagaaagaaacugau

SEQ ID NO: 33404 - RNA, 64 nt, hsa
uguuauuaugucaaccagugaggcugcccugaacaaaaaaaacaaaaagaaaaaaaaaaaagga

SEQ ID NO: 33405 - RNA, 64 nt, hsa
ccaagauuuuuuauuugaggguuuuuuguuuuuuaaaaaaaaauugaacaaagacuacuaauga

SEQ ID NO: 33406 - RNA, 64 nt, hsa
caagauuuuuuauuugaggguuuuuuguuuuuuaaaaaaaaauugaacaaagacuacuaaugac

SEQ ID NO: 33407 - RNA, 64 nt, hsa
cuccaaccugggcgacagggcgagacuccgucucaaaaaaaaaaaaaaauuuaccuccuuugca

SEQ ID NO: 33408 - RNA, 64 nt, hsa
uccaaccugggcgacagggcgagacuccgucucaaaaaaaaaaaaaaauuuaccuccuuugcag

SEQ ID NO: 33409 - RNA, 64 nt, hsa
ccaaccugggcgacagggcgagacuccgucucaaaaaaaaaaaaaaauuuaccuccuuugcagg

SEQ ID NO: 33410 - RNA, 64 nt, hsa
caaccugggcgacagggcgagacuccgucucaaaaaaaaaaaaaaauuuaccuccuuugcaggc

SEQ ID NO: 33411 - RNA, 64 nt, hsa
aaccugggcgacagggcgagacuccgucucaaaaaaaaaaaaaaauuuaccuccuuugcaggcc

SEQ ID NO: 33412 - RNA, 64 nt, hsa
accugggcgacagggcgagacuccgucucaaaaaaaaaaaaaaauuuaccuccuuugcaggcca

SEQ ID NO: 33413 - RNA, 64 nt, hsa
ccugggcgacagggcgagacuccgucucaaaaaaaaaaaaaaauuuaccuccuuugcaggccau

SEQ ID NO: 33414 - RNA, 64 nt, hsa
cugggcgacagggcgagacuccgucucaaaaaaaaaaaaaaauuuaccuccuuugcaggccaua

SEQ ID NO: 33415 - RNA, 64 nt, hsa
aggaggagagagaggaaaaaaagaggaaagaaggaaaaaaaaaagaauuaaaaaaaaaaaaaag

SEQ ID NO: 33416 - RNA, 64 nt, hsa
ggaggagagagaggaaaaaaagaggaaagaaggaaaaaaaaaagaauuaaaaaaaaaaaaaaga

SEQ ID NO: 33417 - RNA, 64 nt, hsa
gaggagagagaggaaaaaaagaggaaagaaggaaaaaaaaaagaauuaaaaaaaaaaaaaagaa

SEQ ID NO: 33418 - RNA, 64 nt, hsa
aaaaaaagaggaaagaaggaaaaaaaaaagaauuaaaaaaaaaaaaaagaaaaacagaagauga

SEQ ID NO: 33419 - RNA, 64 nt, hsa
aaaaaagaggaaagaaggaaaaaaaaaagaauuaaaaaaaaaaaaaagaaaaacagaagaugac

SEQ ID NO: 33420 - RNA, 64 nt, hsa
aaaaagaggaaagaaggaaaaaaaaaagaauuaaaaaaaaaaaaaagaaaaacagaagaugacc

SEQ ID NO: 33421 - RNA, 64 nt, hsa
aaaagaggaaagaaggaaaaaaaaaagaauuaaaaaaaaaaaaaagaaaaacagaagaugaccu

SEQ ID NO: 33422 - RNA, 64 nt, hsa
aaagaggaaagaaggaaaaaaaaaagaauuaaaaaaaaaaaaaagaaaaacagaagaugaccuu

SEQ ID NO: 33423 - RNA, 64 nt, hsa
aagaggaaagaaggaaaaaaaaaagaauuaaaaaaaaaaaaaagaaaaacagaagaugaccuug

SEQ ID NO: 33424 - RNA, 64 nt, hsa
agaggaaagaaggaaaaaaaaaagaauuaaaaaaaaaaaaaagaaaaacagaagaugaccuuga

SEQ ID NO: 33425 - RNA, 64 nt, hsa
aaaaaaaaagaaaaacagaagaugaccuugauggaaaaaaaauauuuuuuaaaaaaaagauaua

SEQ ID NO: 33426 - RNA, 64 nt, hsa
agaagaugaccuugauggaaaaaaaauauuuuuuaaaaaaaagauauacuguggaaggggggag

SEQ ID NO: 33427 - RNA, 64 nt, hsa
ucaagcuugggcaacgagagcaaaacucugucucaaaaaaaaaauuagccagauguggugacgc

SEQ ID NO: 33428 - RNA, 64 nt, hsa
caagcuugggcaacgagagcaaaacucugucucaaaaaaaaaauuagccagauguggugacgca

SEQ ID NO: 33429 - RNA, 64 nt, hsa
aagcuugggcaacgagagcaaaacucugucucaaaaaaaaaauuagccagauguggugacgcau

SEQ ID NO: 33430 - RNA, 64 nt, hsa
uaaacuuaauuucuggccugugacuagaauguuuaaaaaaaaaaaagucggacuaaauguuaau

SEQ ID NO: 33431 - RNA, 64 nt, hsa
aaacuuaauuucuggccugugacuagaauguuuaaaaaaaaaaaagucggacuaaauguuaauu

SEQ ID NO: 33432 - RNA, 64 nt, hsa
aacuuaauuucuggccugugacuagaauguuuaaaaaaaaaaaagucggacuaaauguuaauua

SEQ ID NO: 33433 - RNA, 63 nt, hsa
acuuaauuucuggccugugacuagaauguuuaaaaaaaaaaaagucggacuaaauguuaauua

SEQ ID NO: 33434 - RNA, 62 nt, hsa
cuuaauuucuggccugugacuagaauguuuaaaaaaaaaaaagucggacuaaauguuaauua

SEQ ID NO: 33435 - RNA, 64 nt, hsa
uuccucucuauucgcuuucuccuguuuuuuuuuuaaaaaaaaagcaugaaaaaggaagagaaaa

SEQ ID NO: 33436 - RNA, 64 nt, hsa
uccucucuauucgcuuucuccuguuuuuuuuuuaaaaaaaaagcaugaaaaaggaagagaaaaa

SEQ ID NO: 33437 - RNA, 64 nt, hsa
aauaugucacauuuucagucaaagaaccaugauuaaaaaaaaaaagacaacuuacaauuuaaau

SEQ ID NO: 33438 - RNA, 64 nt, hsa
auaugucacauuuucagucaaagaaccaugauuaaaaaaaaaaagacaacuuacaauuuaaauc

SEQ ID NO: 33439 - RNA, 64 nt, hsa
uaugucacauuuucagucaaagaaccaugauuaaaaaaaaaaagacaacuuacaauuuaaaucc

SEQ ID NO: 33440 - RNA, 64 nt, hsa
augucacauuuucagucaaagaaccaugauuaaaaaaaaaaagacaacuuacaauuuaaauccu

SEQ ID NO: 33441 - RNA, 64 nt, hsa
guugcuuaaauaucaaguauuguuuauaaccaccaaaaaaaaaaagcccugguaguuuuuuggc

SEQ ID NO: 33442 - RNA, 64 nt, hsa
uugcuuaaauaucaaguauuguuuauaaccaccaaaaaaaaaaagcccugguaguuuuuuggca

SEQ ID NO: 33443 - RNA, 64 nt, hsa
ugcuuaaauaucaaguauuguuuauaaccaccaaaaaaaaaaagcccugguaguuuuuuggcac

SEQ ID NO: 33444 - RNA, 64 nt, hsa
gcuuaaauaucaaguauuguuuauaaccaccaaaaaaaaaaagcccugguaguuuuuuggcacc

SEQ ID NO: 33445 - RNA, 64 nt, hsa
cauauaccaugauauaaucugaaaggggcagauuaaaaaaaaaaaaagaaucuaaaccuuacau

SEQ ID NO: 33446 - RNA, 64 nt, hsa
auauaccaugauauaaucugaaaggggcagauuaaaaaaaaaaaaagaaucuaaaccuuacaug

SEQ ID NO: 33447 - RNA, 64 nt, hsa
uauaccaugauauaaucugaaaggggcagauuaaaaaaaaaaaaagaaucuaaaccuuacaugu

SEQ ID NO: 33448 - RNA, 64 nt, hsa
auaccaugauauaaucugaaaggggcagauuaaaaaaaaaaaaagaaucuaaaccuuacaugug

SEQ ID NO: 33449 - RNA, 64 nt, hsa
uaccaugauauaaucugaaaggggcagauuaaaaaaaaaaaaagaaucuaaaccuuacaugugu

SEQ ID NO: 33450 - RNA, 64 nt, hsa
accaugauauaaucugaaaggggcagauuaaaaaaaaaaaaagaaucuaaaccuuacaugugua

SEQ ID NO: 33451 - RNA, 64 nt, hsa
ucuaauccuuguuagacuacugauuuaaagaaggaaaaaaaaaagccaacucuguagacaccuu

SEQ ID NO: 33452 - RNA, 64 nt, hsa
cuaauccuuguuagacuacugauuuaaagaaggaaaaaaaaaagccaacucuguagacaccuuc

SEQ ID NO: 33453 - RNA, 64 nt, hsa
uaauccuuguuagacuacugauuuaaagaaggaaaaaaaaaagccaacucuguagacaccuuca

SEQ ID NO: 33454 - RNA, 64 nt, hsa
gaaauauuuuucaguuguuuaugucguuuacuacaaaaaaaaagauucagaguggauggaguac

SEQ ID NO: 33455 - RNA, 64 nt, hsa
aaauauuuuucaguuguuuaugucguuuacuacaaaaaaaaagauucagaguggauggaguaca

SEQ ID NO: 33456 - RNA, 64 nt, hsa
uaaaauaaucuaagcaucauugaagcaguaacacaaaaaaaagguucaguauuuucuuuuuagu

SEQ ID NO: 33457 - RNA, 64 nt, hsa
uaauaccagaccaaagacauuuucuguuuccuggaaaaaaaaaaugaaucauguuaggcuuuag

SEQ ID NO: 33458 - RNA, 64 nt, hsa
aauaccagaccaaagacauuuucuguuuccuggaaaaaaaaaaugaaucauguuaggcuuuagg

SEQ ID NO: 33459 - RNA, 64 nt, hsa
auaccagaccaaagacauuuucuguuuccuggaaaaaaaaaaugaaucauguuaggcuuuaggu

SEQ ID NO: 33460 - RNA, 64 nt, hsa
guuuuacugucuuagaucguucuuggaaaucacuaaaaaaaaaaaaaguuaauuugauguuugc

SEQ ID NO: 33461 - RNA, 64 nt, hsa
uuuuacugucuuagaucguucuuggaaaucacuaaaaaaaaaaaaaguuaauuugauguuugcu

SEQ ID NO: 33462 - RNA, 64 nt, hsa
uuuacugucuuagaucguucuuggaaaucacuaaaaaaaaaaaaaguuaauuugauguuugcuu

SEQ ID NO: 33463 - RNA, 64 nt, hsa
uuacugucuuagaucguucuuggaaaucacuaaaaaaaaaaaaaguuaauuugauguuugcuua

SEQ ID NO: 33464 - RNA, 64 nt, hsa
uacugucuuagaucguucuuggaaaucacuaaaaaaaaaaaaaguuaauuugauguuugcuuau

SEQ ID NO: 33465 - RNA, 64 nt, hsa
acugucuuagaucguucuuggaaaucacuaaaaaaaaaaaaaguuaauuugauguuugcuuauu

SEQ ID NO: 33466 - RNA, 64 nt, hsa
gguauaaagauauuuugagcagacuguaaacaagaaaaaaaaaaucaugcauucuuagcaaaau

SEQ ID NO: 33467 - RNA, 64 nt, hsa
guauaaagauauuuugagcagacuguaaacaagaaaaaaaaaaucaugcauucuuagcaaaauu

SEQ ID NO: 33468 - RNA, 64 nt, hsa
uauaaagauauuuugagcagacuguaaacaagaaaaaaaaaaucaugcauucuuagcaaaauug

SEQ ID NO: 33469 - RNA, 64 nt, hsa
ugugucucugguacagaauaguugauauuaacagaaaaaaaaaaaucuguagcuucaugaauau

SEQ ID NO: 33470 - RNA, 64 nt, hsa
gugucucugguacagaauaguugauauuaacagaaaaaaaaaaaucuguagcuucaugaauaug

SEQ ID NO: 33471 - RNA, 64 nt, hsa
ugucucugguacagaauaguugauauuaacagaaaaaaaaaaaucuguagcuucaugaauaugc

SEQ ID NO: 33472 - RNA, 64 nt, hsa
gucucugguacagaauaguugauauuaacagaaaaaaaaaaaucuguagcuucaugaauaugcc

SEQ ID NO: 33473 - RNA, 64 nt, hsa
cuccagccugggcaacagagugagacuucgucucaaaaaaaaaaaaaaguuuggguugaagauc

SEQ ID NO: 33474 - RNA, 64 nt, hsa
uccagccugggcaacagagugagacuucgucucaaaaaaaaaaaaaaguuuggguugaagauca

SEQ ID NO: 33475 - RNA, 64 nt, hsa
ccagccugggcaacagagugagacuucgucucaaaaaaaaaaaaaaguuuggguugaagaucaa

SEQ ID NO: 33476 - RNA, 64 nt, hsa
cagccugggcaacagagugagacuucgucucaaaaaaaaaaaaaaguuuggguugaagaucaaa

SEQ ID NO: 33477 - RNA, 64 nt, hsa
agccugggcaacagagugagacuucgucucaaaaaaaaaaaaaaguuuggguugaagaucaaau

SEQ ID NO: 33478 - RNA, 64 nt, hsa
gccugggcaacagagugagacuucgucucaaaaaaaaaaaaaaguuuggguugaagaucaaauu

SEQ ID NO: 33479 - RNA, 64 nt, hsa
ccugggcaacagagugagacuucgucucaaaaaaaaaaaaaaguuuggguugaagaucaaauuc

SEQ ID NO: 33480 - RNA, 64 nt, hsa
aucuugugccacagaaaaaugaaguacugaaauuaaaaaaaaaaaaucauagugauugggagua

SEQ ID NO: 33481 - RNA, 64 nt, hsa
ucuugugccacagaaaaaugaaguacugaaauuaaaaaaaaaaaaucauagugauugggaguau

SEQ ID NO: 33482 - RNA, 64 nt, hsa
cuugugccacagaaaaaugaaguacugaaauuaaaaaaaaaaaaucauagugauugggaguaug

SEQ ID NO: 33483 - RNA, 64 nt, hsa
uugugccacagaaaaaugaaguacugaaauuaaaaaaaaaaaaucauagugauugggaguaugu

SEQ ID NO: 33484 - RNA, 64 nt, hsa
ugugccacagaaaaaugaaguacugaaauuaaaaaaaaaaaaucauagugauugggaguauguc

SEQ ID NO: 33485 - RNA, 64 nt, hsa
augugacauuugcccuagccuaagaguagcagguaaaaaaaaguuucuuucaucuuuugccuua

SEQ ID NO: 33486 - RNA, 64 nt, hsa
uccuucuuggcaaaaguagcuuuugaacugauauaaaaaaaaaugcugaguaacagaaaaguau

SEQ ID NO: 33487 - RNA, 64 nt, hsa
ccuucuuggcaaaaguagcuuuugaacugauauaaaaaaaaaugcugaguaacagaaaaguauu

SEQ ID NO: 33488 - RNA, 64 nt, hsa
acuacccuccuuugaucuauuuuuggucauagguaaaaaaaaaaaucucucuugggagcauaua

SEQ ID NO: 33489 - RNA, 64 nt, hsa
cuacccuccuuugaucuauuuuuggucauagguaaaaaaaaaaaucucucuugggagcauauaa

SEQ ID NO: 33490 - RNA, 64 nt, hsa
uacccuccuuugaucuauuuuuggucauagguaaaaaaaaaaaucucucuugggagcauauaaa

SEQ ID NO: 33491 - RNA, 64 nt, hsa
acccuccuuugaucuauuuuuggucauagguaaaaaaaaaaaucucucuugggagcauauaaac

SEQ ID NO: 33492 - RNA, 64 nt, hsa
auguagcgggauuuuuaaggaaucagagagacugaaaaaaaaaaaaaaauuaaugauggucaaa

SEQ ID NO: 33493 - RNA, 64 nt, hsa
uguagcgggauuuuuaaggaaucagagagacugaaaaaaaaaaaaaaauuaaugauggucaaag

SEQ ID NO: 33494 - RNA, 64 nt, hsa
guagcgggauuuuuaaggaaucagagagacugaaaaaaaaaaaaaaauuaaugauggucaaagg

SEQ ID NO: 33495 - RNA, 64 nt, hsa
uagcgggauuuuuaaggaaucagagagacugaaaaaaaaaaaaaaauuaaugauggucaaaggg

SEQ ID NO: 33496 - RNA, 64 nt, hsa
agcgggauuuuuaaggaaucagagagacugaaaaaaaaaaaaaaauuaaugauggucaaagggu

SEQ ID NO: 33497 - RNA, 64 nt, hsa
gcgggauuuuuaaggaaucagagagacugaaaaaaaaaaaaaaauuaaugauggucaaagggua

SEQ ID NO: 33498 - RNA, 64 nt, hsa
cgggauuuuuaaggaaucagagagacugaaaaaaaaaaaaaaauuaaugauggucaaaggguau

SEQ ID NO: 33499 - RNA, 64 nt, hsa
gggauuuuuaaggaaucagagagacugaaaaaaaaaaaaaaauuaaugauggucaaaggguaua

SEQ ID NO: 33500 - RNA, 64 nt, hsa
uccuugcaaugugggagugcacaggaguccaccuaaaaaaaaaauccuugauacuguugccugc

SEQ ID NO: 33501 - RNA, 64 nt, hsa
ccuugcaaugugggagugcacaggaguccaccuaaaaaaaaaauccuugauacuguugccugcc

SEQ ID NO: 33502 - RNA, 64 nt, hsa
cuugcaaugugggagugcacaggaguccaccuaaaaaaaaaauccuugauacuguugccugccu

SEQ ID NO: 33503 - RNA, 64 nt, hsa
uuuccuuuuuuuuuuuuuuuuuaauauuuuuuacaaaaaaaaagauuuuauacaagcaauauau

SEQ ID NO: 33504 - RNA, 64 nt, hsa
uuccuuuuuuuuuuuuuuuuuaauauuuuuuacaaaaaaaaagauuuuauacaagcaauauaua

SEQ ID NO: 33505 - RNA, 64 nt, hsa
aaaaagaaaaaaacaccaaaaaacaaaaacaaacaaaaaaaaaaacccacaacccuuaucuggu

SEQ ID NO: 33506 - RNA, 64 nt, hsa
aaaagaaaaaaacaccaaaaaacaaaaacaaacaaaaaaaaaaacccacaacccuuaucugguu

SEQ ID NO: 33507 - RNA, 64 nt, hsa
aaagaaaaaaacaccaaaaaacaaaaacaaacaaaaaaaaaaacccacaacccuuaucugguuc

SEQ ID NO: 33508 - RNA, 64 nt, hsa
aagaaaaaaacaccaaaaaacaaaaacaaacaaaaaaaaaaacccacaacccuuaucugguucu

SEQ ID NO: 33509 - RNA, 64 nt, hsa
aguuuugucacaguuaacugugucaaagagaauuaaaaaaaaaaacuucagauuuuguuuacau

SEQ ID NO: 33510 - RNA, 64 nt, hsa
guuuugucacaguuaacugugucaaagagaauuaaaaaaaaaaacuucagauuuuguuuacaua

SEQ ID NO: 33511 - RNA, 64 nt, hsa
uuuugucacaguuaacugugucaaagagaauuaaaaaaaaaaacuucagauuuuguuuacauau

SEQ ID NO: 33512 - RNA, 64 nt, hsa
uuugucacaguuaacugugucaaagagaauuaaaaaaaaaaacuucagauuuuguuuacauauu

SEQ ID NO: 33513 - RNA, 64 nt, hsa
aaacaguuuuguaacucuuugcuuuuuaaaucuuaaaaaaaaaaaaguugcugaaguacuguac

SEQ ID NO: 33514 - RNA, 64 nt, hsa
aacaguuuuguaacucuuugcuuuuuaaaucuuaaaaaaaaaaaaguugcugaaguacuguaca

SEQ ID NO: 33515 - RNA, 64 nt, hsa
acaguuuuguaacucuuugcuuuuuaaaucuuaaaaaaaaaaaaguugcugaaguacuguacag

SEQ ID NO: 33516 - RNA, 64 nt, hsa
caguuuuguaacucuuugcuuuuuaaaucuuaaaaaaaaaaaaguugcugaaguacuguacagg

SEQ ID NO: 33517 - RNA, 64 nt, hsa
aguuuuguaacucuuugcuuuuuaaaucuuaaaaaaaaaaaaguugcugaaguacuguacaggg

SEQ ID NO: 33518 - RNA, 64 nt, hsa
gacugcaacauucucaggaccaaauuaaacugcuaaaaaaaaaaaaaaaguucauugacuugcu

SEQ ID NO: 33519 - RNA, 64 nt, hsa
acugcaacauucucaggaccaaauuaaacugcuaaaaaaaaaaaaaaaguucauugacuugcuu

SEQ ID NO: 33520 - RNA, 64 nt, hsa
cugcaacauucucaggaccaaauuaaacugcuaaaaaaaaaaaaaaaguucauugacuugcuua

SEQ ID NO: 33521 - RNA, 64 nt, hsa
ugcaacauucucaggaccaaauuaaacugcuaaaaaaaaaaaaaaaguucauugacuugcuuag

SEQ ID NO: 33522 - RNA, 64 nt, hsa
gcaacauucucaggaccaaauuaaacugcuaaaaaaaaaaaaaaaguucauugacuugcuuagu

SEQ ID NO: 33523 - RNA, 64 nt, hsa
caacauucucaggaccaaauuaaacugcuaaaaaaaaaaaaaaaguucauugacuugcuuaguc

SEQ ID NO: 33524 - RNA, 64 nt, hsa
aacauucucaggaccaaauuaaacugcuaaaaaaaaaaaaaaaguucauugacuugcuuagucg

SEQ ID NO: 33525 - RNA, 64 nt, hsa
acauucucaggaccaaauuaaacugcuaaaaaaaaaaaaaaaguucauugacuugcuuagucgu

SEQ ID NO: 33526 - RNA, 64 nt, hsa
aagaaucaaauugaaucuuuuacuuaccucuugcaaaaaaaaugaaaaaugaaaaaacaaauuc

SEQ ID NO: 33527 - RNA, 64 nt, hsa
uuaaugaucuauucaggcaguagagcucuuaaggaaaaaaaaaaacccacuuucucucaagcau

SEQ ID NO: 33528 - RNA, 64 nt, hsa
uaaugaucuauucaggcaguagagcucuuaaggaaaaaaaaaaacccacuuucucucaagcaug

SEQ ID NO: 33529 - RNA, 64 nt, hsa
aaugaucuauucaggcaguagagcucuuaaggaaaaaaaaaaacccacuuucucucaagcaugu

SEQ ID NO: 33530 - RNA, 64 nt, hsa
augaucuauucaggcaguagagcucuuaaggaaaaaaaaaaacccacuuucucucaagcaugua

SEQ ID NO: 33531 - RNA, 64 nt, hsa
gauaagugagaauuauuuagaaaagacaugcuccaaaaaaaaaacaaaacugauaaaacaguuu

SEQ ID NO: 33532 - RNA, 64 nt, hsa
auaagugagaauuauuuagaaaagacaugcuccaaaaaaaaaacaaaacugauaaaacaguuuu

SEQ ID NO: 33533 - RNA, 64 nt, hsa
uaagugagaauuauuuagaaaagacaugcuccaaaaaaaaaacaaaacugauaaaacaguuuuu

SEQ ID NO: 33534 - RNA, 64 nt, hsa
cauuuuucuuuaacuaacuucuauuuuuuuuaagaaaaaaaaauagacugguggguacucacag

SEQ ID NO: 33535 - RNA, 64 nt, hsa
auuuuucuuuaacuaacuucuauuuuuuuuaagaaaaaaaaauagacugguggguacucacaga

SEQ ID NO: 33536 - RNA, 64 nt, hsa
guuuuuucuuaaaauccacucuuggcaaugcaauaaaaaaaaccgucaccauaagccagugaca

SEQ ID NO: 33537 - RNA, 64 nt, hsa
gauggauguauuuuccuaccccuaacuuaaggagaaaaaaaaaaagacuuccuuuuuuugccaa

SEQ ID NO: 33538 - RNA, 64 nt, hsa
auggauguauuuuccuaccccuaacuuaaggagaaaaaaaaaaagacuuccuuuuuuugccaaa

SEQ ID NO: 33539 - RNA, 64 nt, hsa
uggauguauuuuccuaccccuaacuuaaggagaaaaaaaaaaagacuuccuuuuuuugccaaag

SEQ ID NO: 33540 - RNA, 64 nt, hsa
ggauguauuuuccuaccccuaacuuaaggagaaaaaaaaaaagacuuccuuuuuuugccaaagu

SEQ ID NO: 33541 - RNA, 64 nt, hsa
cagcacaaagacauaauuuaauuccuucuaccuuaaaaaaaaaaaaaaaaaaaaaacagcucuc

SEQ ID NO: 33542 - RNA, 64 nt, hsa
agcacaaagacauaauuuaauuccuucuaccuuaaaaaaaaaaaaaaaaaaaaaacagcucucc

SEQ ID NO: 33543 - RNA, 64 nt, hsa
gcacaaagacauaauuuaauuccuucuaccuuaaaaaaaaaaaaaaaaaaaaaacagcucuccc

SEQ ID NO: 33544 - RNA, 64 nt, hsa
cacaaagacauaauuuaauuccuucuaccuuaaaaaaaaaaaaaaaaaaaaaacagcucucccu

SEQ ID NO: 33545 - RNA, 64 nt, hsa
acaaagacauaauuuaauuccuucuaccuuaaaaaaaaaaaaaaaaaaaaaacagcucucccuc

SEQ ID NO: 33546 - RNA, 64 nt, hsa
caaagacauaauuuaauuccuucuaccuuaaaaaaaaaaaaaaaaaaaaaacagcucucccucu

SEQ ID NO: 33547 - RNA, 64 nt, hsa
aaagacauaauuuaauuccuucuaccuuaaaaaaaaaaaaaaaaaaaaaacagcucucccucuc

SEQ ID NO: 33548 - RNA, 64 nt, hsa
aagacauaauuuaauuccuucuaccuuaaaaaaaaaaaaaaaaaaaaaacagcucucccucucu

SEQ ID NO: 33549 - RNA, 64 nt, hsa
agacauaauuuaauuccuucuaccuuaaaaaaaaaaaaaaaaaaaaaacagcucucccucucuu

SEQ ID NO: 33550 - RNA, 64 nt, hsa
gacauaauuuaauuccuucuaccuuaaaaaaaaaaaaaaaaaaaaaacagcucucccucucuua

SEQ ID NO: 33551 - RNA, 64 nt, hsa
acauaauuuaauuccuucuaccuuaaaaaaaaaaaaaaaaaaaaaacagcucucccucucuuag

SEQ ID NO: 33552 - RNA, 64 nt, hsa
cauaauuuaauuccuucuaccuuaaaaaaaaaaaaaaaaaaaaaacagcucucccucucuuagg

SEQ ID NO: 33553 - RNA, 64 nt, hsa
auaauuuaauuccuucuaccuuaaaaaaaaaaaaaaaaaaaaaacagcucucccucucuuaggg

SEQ ID NO: 33554 - RNA, 64 nt, hsa
uaauuuaauuccuucuaccuuaaaaaaaaaaaaaaaaaaaaaacagcucucccucucuuagggu

SEQ ID NO: 33555 - RNA, 64 nt, hsa
aauuuaauuccuucuaccuuaaaaaaaaaaaaaaaaaaaaaacagcucucccucucuuagggug

SEQ ID NO: 33556 - RNA, 64 nt, hsa
ccaauccaacucugaauuuuaaagcaaaagcgucaaaaaaaagauucccuccuuacccccaacc

SEQ ID NO: 33557 - RNA, 64 nt, hsa
gaaugaagucaaacugugccacacauggugaaugaaaaaaaaaaaaagaggcuguguuuuguca

SEQ ID NO: 33558 - RNA, 64 nt, hsa
aaugaagucaaacugugccacacauggugaaugaaaaaaaaaaaaagaggcuguguuuugucac

SEQ ID NO: 33559 - RNA, 64 nt, hsa
augaagucaaacugugccacacauggugaaugaaaaaaaaaaaaagaggcuguguuuugucaca

SEQ ID NO: 33560 - RNA, 64 nt, hsa
ugaagucaaacugugccacacauggugaaugaaaaaaaaaaaaagaggcuguguuuugucacac

SEQ ID NO: 33561 - RNA, 64 nt, hsa
gaagucaaacugugccacacauggugaaugaaaaaaaaaaaaagaggcuguguuuugucacaca

SEQ ID NO: 33562 - RNA, 64 nt, hsa
aagucaaacugugccacacauggugaaugaaaaaaaaaaaaagaggcuguguuuugucacacag

SEQ ID NO: 33563 - RNA, 64 nt, hsa
aguugcauuaacuauuucaaaaauuacugccuuuaaaaaaaacaaccucaagcuauauuuguau

SEQ ID NO: 33564 - RNA, 64 nt, hsa
aacagaugauguauuucuccauugaaaacacaauaaaaaaaaaacagcacaaucucacaguugc

SEQ ID NO: 33565 - RNA, 64 nt, hsa
acagaugauguauuucuccauugaaaacacaauaaaaaaaaaacagcacaaucucacaguugcc

SEQ ID NO: 33566 - RNA, 64 nt, hsa
cagaugauguauuucuccauugaaaacacaauaaaaaaaaaacagcacaaucucacaguugccu

SEQ ID NO: 33567 - RNA, 64 nt, hsa
cuaagggacauguuuugauaaaguaguaaaaauuaaaaaaaaaaaacuuuacuaagaugacauu

SEQ ID NO: 33568 - RNA, 64 nt, hsa
uaagggacauguuuugauaaaguaguaaaaauuaaaaaaaaaaaacuuuacuaagaugacauug

SEQ ID NO: 33569 - RNA, 64 nt, hsa
aagggacauguuuugauaaaguaguaaaaauuaaaaaaaaaaaacuuuacuaagaugacauugc

SEQ ID NO: 33570 - RNA, 64 nt, hsa
agggacauguuuugauaaaguaguaaaaauuaaaaaaaaaaaacuuuacuaagaugacauugcu

SEQ ID NO: 33571 - RNA, 64 nt, hsa
gggacauguuuugauaaaguaguaaaaauuaaaaaaaaaaaacuuuacuaagaugacauugcua

SEQ ID NO: 33572 - RNA, 64 nt, hsa
caguuacaugcauacuucaaaaguauuuuccuguaaaaaaaaaaaaguuauauagguuuuguuu

SEQ ID NO: 33573 - RNA, 64 nt, hsa
aguuacaugcauacuucaaaaguauuuuccuguaaaaaaaaaaaaguuauauagguuuuguuug

SEQ ID NO: 33574 - RNA, 64 nt, hsa
guuacaugcauacuucaaaaguauuuuccuguaaaaaaaaaaaaguuauauagguuuuguuugc

SEQ ID NO: 33575 - RNA, 64 nt, hsa
uuacaugcauacuucaaaaguauuuuccuguaaaaaaaaaaaaguuauauagguuuuguuugcu

SEQ ID NO: 33576 - RNA, 64 nt, hsa
uacaugcauacuucaaaaguauuuuccuguaaaaaaaaaaaaguuauauagguuuuguuugcua

SEQ ID NO: 33577 - RNA, 64 nt, hsa
ccagccugggcaacagagugagacccuguuucuaaaaaaaaauaaagauaauuuagcuaacuuu

SEQ ID NO: 33578 - RNA, 64 nt, hsa
uccagccugggcaacagagugagacccuguuucuaaaaaaaaauaaagauaauuuagcuaacuu

SEQ ID NO: 33579 - RNA, 64 nt, hsa
auuuuuuuuauuauuaaaugauguggucuauggaaaaaaaaauaaaaaucugacuuaguuuuaa

SEQ ID NO: 33580 - RNA, 64 nt, hsa
uauuuuuuuuauuauuaaaugauguggucuauggaaaaaaaaauaaaaaucugacuuaguuuua

SEQ ID NO: 33581 - RNA, 64 nt, hsa
aaagaaaaacguaaacuuggaaaauacagaaaaaaaaaaaaaggaagaaaacucccaucagaca

SEQ ID NO: 33582 - RNA, 64 nt, hsa
uaaagaaaaacguaaacuuggaaaauacagaaaaaaaaaaaaaggaagaaaacucccaucagac

SEQ ID NO: 33583 - RNA, 64 nt, hsa
cuaaagaaaaacguaaacuuggaaaauacagaaaaaaaaaaaaaggaagaaaacucccaucaga

SEQ ID NO: 33584 - RNA, 64 nt, hsa
acuaaagaaaaacguaaacuuggaaaauacagaaaaaaaaaaaaaggaagaaaacucccaucag

SEQ ID NO: 33585 - RNA, 64 nt, hsa
aacuaaagaaaaacguaaacuuggaaaauacagaaaaaaaaaaaaaggaagaaaacucccauca

SEQ ID NO: 33586 - RNA, 64 nt, hsa
gaacuaaagaaaaacguaaacuuggaaaauacagaaaaaaaaaaaaaggaagaaaacucccauc

SEQ ID NO: 33587 - RNA, 64 nt, hsa
ugcccaccaacggcaaauccaaaguucuuucaaaaaaaaaaacugaaacacaaccaaaaaagca

SEQ ID NO: 33588 - RNA, 64 nt, hsa
cugcccaccaacggcaaauccaaaguucuuucaaaaaaaaaaacugaaacacaaccaaaaaagc

SEQ ID NO: 33589 - RNA, 64 nt, hsa
acugcccaccaacggcaaauccaaaguucuuucaaaaaaaaaaacugaaacacaaccaaaaaag

SEQ ID NO: 33590 - RNA, 64 nt, hsa
cacugcccaccaacggcaaauccaaaguucuuucaaaaaaaaaaacugaaacacaaccaaaaaa

SEQ ID NO: 33591 - RNA, 64 nt, hsa
gauucccuuuuaaacuuauuuugcuuuaaaaaaaaaaaaaaagaaaaagaaaauuuaacuuaaa

SEQ ID NO: 33592 - RNA, 64 nt, hsa
agauucccuuuuaaacuuauuuugcuuuaaaaaaaaaaaaaaagaaaaagaaaauuuaacuuaa

SEQ ID NO: 33593 - RNA, 64 nt, hsa
cagauucccuuuuaaacuuauuuugcuuuaaaaaaaaaaaaaaagaaaaagaaaauuuaacuua

SEQ ID NO: 33594 - RNA, 64 nt, hsa
acagauucccuuuuaaacuuauuuugcuuuaaaaaaaaaaaaaaagaaaaagaaaauuuaacuu

SEQ ID NO: 33595 - RNA, 64 nt, hsa
cacagauucccuuuuaaacuuauuuugcuuuaaaaaaaaaaaaaaagaaaaagaaaauuuaacu

SEQ ID NO: 33596 - RNA, 64 nt, hsa
ccacagauucccuuuuaaacuuauuuugcuuuaaaaaaaaaaaaaaagaaaaagaaaauuuaac

SEQ ID NO: 33597 - RNA, 64 nt, hsa
gccacagauucccuuuuaaacuuauuuugcuuuaaaaaaaaaaaaaaagaaaaagaaaauuuaa

SEQ ID NO: 33598 - RNA, 64 nt, hsa
ugccacagauucccuuuuaaacuuauuuugcuuuaaaaaaaaaaaaaaagaaaaagaaaauuua

SEQ ID NO: 33599 - RNA, 64 nt, hsa
gggcugaaagaacauggacuuguauauuuguacaaaaaaaaaguuuuauuuuucuaaaaaaaga

SEQ ID NO: 33600 - RNA, 64 nt, hsa
ggggcugaaagaacauggacuuguauauuuguacaaaaaaaaaguuuuauuuuucuaaaaaaag

SEQ ID NO: 33601 - RNA, 64 nt, hsa
cugaaaaaacaaaacaaaaaaaaaaaaaaaagaaaaaaaaaacaugcaccuguuucacugugaa

SEQ ID NO: 33602 - RNA, 64 nt, hsa
ucugaaaaaacaaaacaaaaaaaaaaaaaaaagaaaaaaaaaacaugcaccuguuucacuguga

SEQ ID NO: 33603 - RNA, 64 nt, hsa
cucugaaaaaacaaaacaaaaaaaaaaaaaaaagaaaaaaaaaacaugcaccuguuucacugug

SEQ ID NO: 33604 - RNA, 64 nt, hsa
accucagaacucugaaaaaacaaaacaaaaaaaaaaaaaaaagaaaaaaaaaacaugcaccugu

SEQ ID NO: 33605 - RNA, 64 nt, hsa
aaccucagaacucugaaaaaacaaaacaaaaaaaaaaaaaaaagaaaaaaaaaacaugcaccug

SEQ ID NO: 33606 - RNA, 64 nt, hsa
caaccucagaacucugaaaaaacaaaacaaaaaaaaaaaaaaaagaaaaaaaaaacaugcaccu

SEQ ID NO: 33607 - RNA, 64 nt, hsa
gcaaccucagaacucugaaaaaacaaaacaaaaaaaaaaaaaaaagaaaaaaaaaacaugcacc

SEQ ID NO: 33608 - RNA, 64 nt, hsa
agcaaccucagaacucugaaaaaacaaaacaaaaaaaaaaaaaaaagaaaaaaaaaacaugcac

SEQ ID NO: 33609 - RNA, 64 nt, hsa
cagcaaccucagaacucugaaaaaacaaaacaaaaaaaaaaaaaaaagaaaaaaaaaacaugca

SEQ ID NO: 33610 - RNA, 64 nt, hsa
ucagcaaccucagaacucugaaaaaacaaaacaaaaaaaaaaaaaaaagaaaaaaaaaacaugc

SEQ ID NO: 33611 - RNA, 64 nt, hsa
gucagcaaccucagaacucugaaaaaacaaaacaaaaaaaaaaaaaaaagaaaaaaaaaacaug

SEQ ID NO: 33612 - RNA, 64 nt, hsa
agucagcaaccucagaacucugaaaaaacaaaacaaaaaaaaaaaaaaaagaaaaaaaaaacau

SEQ ID NO: 33613 - RNA, 64 nt, hsa
auaguacuagguuagaacauugcuuaauccuuuuaaaaaaaaugcauuuacguaaacacgaaua

SEQ ID NO: 33614 - RNA, 64 nt, hsa
acucuggaaaaaaaaaaaaaaaugaaaaaaagaaaaaaaaaagagcuauagaaauccuugucaa

SEQ ID NO: 33615 - RNA, 64 nt, hsa
aacucuggaaaaaaaaaaaaaaaugaaaaaaagaaaaaaaaaagagcuauagaaauccuuguca

SEQ ID NO: 33616 - RNA, 64 nt, hsa
gaacucuggaaaaaaaaaaaaaaaugaaaaaaagaaaaaaaaaagagcuauagaaauccuuguc

SEQ ID NO: 33617 - RNA, 64 nt, hsa
uuacagcgucaucugguugaacucuggaaaaaaaaaaaaaaaugaaaaaaagaaaaaaaaaaga

SEQ ID NO: 33618 - RNA, 64 nt, hsa
auuacagcgucaucugguugaacucuggaaaaaaaaaaaaaaaugaaaaaaagaaaaaaaaaag

SEQ ID NO: 33619 - RNA, 64 nt, hsa
gauuacagcgucaucugguugaacucuggaaaaaaaaaaaaaaaugaaaaaaagaaaaaaaaaa

SEQ ID NO: 33620 - RNA, 64 nt, hsa
agauuacagcgucaucugguugaacucuggaaaaaaaaaaaaaaaugaaaaaaagaaaaaaaaa

SEQ ID NO: 33621 - RNA, 64 nt, hsa
aagauuacagcgucaucugguugaacucuggaaaaaaaaaaaaaaaugaaaaaaagaaaaaaaa

SEQ ID NO: 33622 - RNA, 64 nt, hsa
aaagauuacagcgucaucugguugaacucuggaaaaaaaaaaaaaaaugaaaaaaagaaaaaaa

SEQ ID NO: 33623 - RNA, 64 nt, hsa
aaaagauuacagcgucaucugguugaacucuggaaaaaaaaaaaaaaaugaaaaaaagaaaaaa

SEQ ID NO: 33624 - RNA, 64 nt, hsa
aaaaagauuacagcgucaucugguugaacucuggaaaaaaaaaaaaaaaugaaaaaaagaaaaa

SEQ ID NO: 33625 - RNA, 64 nt, hsa
uauguagguauucauuuugaguagguugaagaagaaaaaaaauauuuaaaugaauugaauuccu

SEQ ID NO: 33626 - RNA, 64 nt, hsa
aguccucuaguuccaggaaacacagucuuuuuuuaaaaaaaacaauguuuguaacaagggugcc

SEQ ID NO: 33627 - RNA, 64 nt, hsa
ggguuaagcuaccaaaaaugacaaccagggauucaaaaaaaauuuuuggucauuaaaucgaaug

SEQ ID NO: 33628 - RNA, 64 nt, hsa
uuaaaaaaaaaaaagaaucugcgguauuuuuuuaaaaaaaaaguuuaccgcuguagugugaaau

SEQ ID NO: 33629 - RNA, 64 nt, hsa
uuuaaaaaaaaaaaagaaucugcgguauuuuuuuaaaaaaaaaguuuaccgcuguagugugaaa

SEQ ID NO: 33630 - RNA, 64 nt, hsa
uuaacuucuuacagcaguaguaccuucuuuaaaaaaaaaaaagaaucugcgguauuuuuuuaaa

SEQ ID NO: 33631 - RNA, 64 nt, hsa
guuaacuucuuacagcaguaguaccuucuuuaaaaaaaaaaaagaaucugcgguauuuuuuuaa

SEQ ID NO: 33632 - RNA, 64 nt, hsa
uguuaacuucuuacagcaguaguaccuucuuuaaaaaaaaaaaagaaucugcgguauuuuuuua

SEQ ID NO: 33633 - RNA, 64 nt, hsa
uuguuaacuucuuacagcaguaguaccuucuuuaaaaaaaaaaaagaaucugcgguauuuuuuu

SEQ ID NO: 33634 - RNA, 64 nt, hsa
cuuguuaacuucuuacagcaguaguaccuucuuuaaaaaaaaaaaagaaucugcgguauuuuuu

SEQ ID NO: 33635 - RNA, 64 nt, hsa
cuaugauaccacgccuuaaaaauugacaguugaaaaaaaaaagagugaccagagggcaaaggac

SEQ ID NO: 33636 - RNA, 64 nt, hsa
gcuaugauaccacgccuuaaaaauugacaguugaaaaaaaaaagagugaccagagggcaaagga

SEQ ID NO: 33637 - RNA, 64 nt, hsa
ugcuaugauaccacgccuuaaaaauugacaguugaaaaaaaaaagagugaccagagggcaaagg

SEQ ID NO: 33638 - RNA, 64 nt, hsa
auacugaauaauuacuaaaaaugauuuucucagaaaaaaaaacucccacaauucuggaacuaua

SEQ ID NO: 33639 - RNA, 64 nt, hsa
aauacugaauaauuacuaaaaaugauuuucucagaaaaaaaaacucccacaauucuggaacuau

SEQ ID NO: 33640 - RNA, 64 nt, hsa
ggcgacagagagagacuccaucucaaaacaaaacaaaaaaaauuagccuacuuaaaggcacaac

SEQ ID NO: 33641 - RNA, 64 nt, hsa
agccugaccaaaauggugaaacccugucucuacuaaaaaaaagaaaaauuagccagacguggug

SEQ ID NO: 33642 - RNA, 64 nt, hsa
aacauauauuugaauuuaaaagcacuuuauuuaaaaaaaaaagaaguuuucaguucugaagaag

SEQ ID NO: 33643 - RNA, 64 nt, hsa
caacauauauuugaauuuaaaagcacuuuauuuaaaaaaaaaagaaguuuucaguucugaagaa

SEQ ID NO: 33644 - RNA, 64 nt, hsa
gcaacauauauuugaauuuaaaagcacuuuauuuaaaaaaaaaagaaguuuucaguucugaaga

SEQ ID NO: 33645 - RNA, 64 nt, hsa
uuccuuauagcuggacuuuuauuuaaaaaaaaaaaaaaaaaaggaaaaaaucccuaaacauuca

SEQ ID NO: 33646 - RNA, 64 nt, hsa
cuuccuuauagcuggacuuuuauuuaaaaaaaaaaaaaaaaaaggaaaaaaucccuaaacauuc

SEQ ID NO: 33647 - RNA, 64 nt, hsa
gcuuccuuauagcuggacuuuuauuuaaaaaaaaaaaaaaaaaaggaaaaaaucccuaaacauu

SEQ ID NO: 33648 - RNA, 64 nt, hsa
ugcuuccuuauagcuggacuuuuauuuaaaaaaaaaaaaaaaaaaggaaaaaaucccuaaacau

SEQ ID NO: 33649 - RNA, 64 nt, hsa
cugcuuccuuauagcuggacuuuuauuuaaaaaaaaaaaaaaaaaaggaaaaaaucccuaaaca

SEQ ID NO: 33650 - RNA, 64 nt, hsa
acugcuuccuuauagcuggacuuuuauuuaaaaaaaaaaaaaaaaaaggaaaaaaucccuaaac

SEQ ID NO: 33651 - RNA, 64 nt, hsa
gacugcuuccuuauagcuggacuuuuauuuaaaaaaaaaaaaaaaaaaggaaaaaaucccuaaa

SEQ ID NO: 33652 - RNA, 64 nt, hsa
agacugcuuccuuauagcuggacuuuuauuuaaaaaaaaaaaaaaaaaaggaaaaaaucccuaa

SEQ ID NO: 33653 - RNA, 64 nt, hsa
cagacugcuuccuuauagcuggacuuuuauuuaaaaaaaaaaaaaaaaaaggaaaaaaucccua

SEQ ID NO: 33654 - RNA, 64 nt, hsa
acagacugcuuccuuauagcuggacuuuuauuuaaaaaaaaaaaaaaaaaaggaaaaaaucccu

SEQ ID NO: 33655 - RNA, 64 nt, hsa
cacagacugcuuccuuauagcuggacuuuuauuuaaaaaaaaaaaaaaaaaaggaaaaaauccc

SEQ ID NO: 33656 - RNA, 64 nt, hsa
uuauccuaaacagauggucuuucucugagggaaaaaaaaaaaugugucaugugaggcaauaugc

SEQ ID NO: 33657 - RNA, 64 nt, hsa
uuuauccuaaacagauggucuuucucugagggaaaaaaaaaaaugugucaugugaggcaauaug

SEQ ID NO: 33658 - RNA, 64 nt, hsa
auuuauccuaaacagauggucuuucucugagggaaaaaaaaaaaugugucaugugaggcaauau

SEQ ID NO: 33659 - RNA, 64 nt, hsa
aauuuauccuaaacagauggucuuucucugagggaaaaaaaaaaaugugucaugugaggcaaua

SEQ ID NO: 33660 - RNA, 64 nt, hsa
uuguacagugucaauuuguaaaaaagaaaaaacgaaaaaaaaucucaaauaaaacaugagauaa

SEQ ID NO: 33661 - RNA, 64 nt, hsa
uauuuauucauuauuuuaauauuauaagggaaguaaaaaaaagugagguauagucuaaauggug

SEQ ID NO: 33662 - RNA, 64 nt, hsa
ugcaucgugaccaaauuguuuaagaaaaaaaaacaaaaaaaacaaaaucuagggcuguauuuua

SEQ ID NO: 33663 - RNA, 64 nt, hsa
uaucaaaggugcaucgugaccaaauuguuuaagaaaaaaaaacaaaaaaaacaaaaucuagggc

SEQ ID NO: 33664 - RNA, 64 nt, hsa
auaucaaaggugcaucgugaccaaauuguuuaagaaaaaaaaacaaaaaaaacaaaaucuaggg

SEQ ID NO: 33665 - RNA, 64 nt, hsa
gcaaacauaaucauuguucucacccucuuuuaaaaaaaaaaaucggucuucaaagaucuguuga

SEQ ID NO: 33666 - RNA, 64 nt, hsa
ugcaaacauaaucauuguucucacccucuuuuaaaaaaaaaaaucggucuucaaagaucuguug

SEQ ID NO: 33667 - RNA, 64 nt, hsa
uugcaaacauaaucauuguucucacccucuuuuaaaaaaaaaaaucggucuucaaagaucuguu

SEQ ID NO: 33668 - RNA, 64 nt, hsa
uuugcaaacauaaucauuguucucacccucuuuuaaaaaaaaaaaucggucuucaaagaucugu

SEQ ID NO: 33669 - RNA, 64 nt, hsa
aaaaaaaaaaaaaaaauccuaaaaacaaacaaacaaaaaaaacaauucuucauucagaaaaauu

SEQ ID NO: 33670 - RNA, 64 nt, hsa
aaaccaguguggcaaaaaaaaaaaaaaaaaaaaaaaaaaaaauccuaaaaacaaacaaacaaaa

SEQ ID NO: 33671 - RNA, 64 nt, hsa
aaaaccaguguggcaaaaaaaaaaaaaaaaaaaaaaaaaaaaauccuaaaaacaaacaaacaaa

SEQ ID NO: 33672 - RNA, 64 nt, hsa
aaaaaccaguguggcaaaaaaaaaaaaaaaaaaaaaaaaaaaaauccuaaaaacaaacaaacaa

SEQ ID NO: 33673 - RNA, 64 nt, hsa
caaaaaccaguguggcaaaaaaaaaaaaaaaaaaaaaaaaaaaaauccuaaaaacaaacaaaca

SEQ ID NO: 33674 - RNA, 64 nt, hsa
acaaaaaccaguguggcaaaaaaaaaaaaaaaaaaaaaaaaaaaaauccuaaaaacaaacaaac

SEQ ID NO: 33675 - RNA, 64 nt, hsa
aacaaaaaccaguguggcaaaaaaaaaaaaaaaaaaaaaaaaaaaaauccuaaaaacaaacaaa

SEQ ID NO: 33676 - RNA, 64 nt, hsa
uaacaaaaaccaguguggcaaaaaaaaaaaaaaaaaaaaaaaaaaaaauccuaaaaacaaacaa

SEQ ID NO: 33677 - RNA, 64 nt, hsa
uuaacaaaaaccaguguggcaaaaaaaaaaaaaaaaaaaaaaaaaaaaauccuaaaaacaaaca

SEQ ID NO: 33678 - RNA, 64 nt, hsa
cuuaacaaaaaccaguguggcaaaaaaaaaaaaaaaaaaaaaaaaaaaaauccuaaaaacaaac

SEQ ID NO: 33679 - RNA, 64 nt, hsa
ucuuaacaaaaaccaguguggcaaaaaaaaaaaaaaaaaaaaaaaaaaaaauccuaaaaacaaa

SEQ ID NO: 33680 - RNA, 64 nt, hsa
gucuuaacaaaaaccaguguggcaaaaaaaaaaaaaaaaaaaaaaaaaaaaauccuaaaaacaa

SEQ ID NO: 33681 - RNA, 64 nt, hsa
ggucuuaacaaaaaccaguguggcaaaaaaaaaaaaaaaaaaaaaaaaaaaaauccuaaaaaca

SEQ ID NO: 33682 - RNA, 64 nt, hsa
aggucuuaacaaaaaccaguguggcaaaaaaaaaaaaaaaaaaaaaaaaaaaaauccuaaaaac

SEQ ID NO: 33683 - RNA, 64 nt, hsa
gaggucuuaacaaaaaccaguguggcaaaaaaaaaaaaaaaaaaaaaaaaaaaaauccuaaaaa

SEQ ID NO: 33684 - RNA, 64 nt, hsa
ugaggucuuaacaaaaaccaguguggcaaaaaaaaaaaaaaaaaaaaaaaaaaaaauccuaaaa

SEQ ID NO: 33685 - RNA, 64 nt, hsa
augaggucuuaacaaaaaccaguguggcaaaaaaaaaaaaaaaaaaaaaaaaaaaaauccuaaa

SEQ ID NO: 33686 - RNA, 64 nt, hsa
gaugaggucuuaacaaaaaccaguguggcaaaaaaaaaaaaaaaaaaaaaaaaaaaaauccuaa

SEQ ID NO: 33687 - RNA, 64 nt, hsa
ugaugaggucuuaacaaaaaccaguguggcaaaaaaaaaaaaaaaaaaaaaaaaaaaaauccua

SEQ ID NO: 33688 - RNA, 64 nt, hsa
cugaugaggucuuaacaaaaaccaguguggcaaaaaaaaaaaaaaaaaaaaaaaaaaaaauccu

SEQ ID NO: 33689 - RNA, 64 nt, hsa
acugaugaggucuuaacaaaaaccaguguggcaaaaaaaaaaaaaaaaaaaaaaaaaaaaaucc

SEQ ID NO: 33690 - RNA, 64 nt, hsa
gacugaugaggucuuaacaaaaaccaguguggcaaaaaaaaaaaaaaaaaaaaaaaaaaaaauc

SEQ ID NO: 33691 - RNA, 64 nt, hsa
ggacugaugaggucuuaacaaaaaccaguguggcaaaaaaaaaaaaaaaaaaaaaaaaaaaaau

SEQ ID NO: 33692 - RNA, 64 nt, hsa
auuucucuuucuuugugugaauuuauuuaaaagaaaaaaaaacuuuuuguaacgacuauuugca

SEQ ID NO: 33693 - RNA, 64 nt, hsa
uauuucucuuucuuugugugaauuuauuuaaaagaaaaaaaaacuuuuuguaacgacuauuugc

SEQ ID NO: 33694 - RNA, 64 nt, hsa
aacuuuuuauguauagcuucuaaaaggggaaaaaaaaaaaaagagaaacccuuugacuuccacg

SEQ ID NO: 33695 - RNA, 64 nt, hsa
caacuuuuuauguauagcuucuaaaaggggaaaaaaaaaaaaagagaaacccuuugacuuccac

SEQ ID NO: 33696 - RNA, 64 nt, hsa
acaacuuuuuauguauagcuucuaaaaggggaaaaaaaaaaaaagagaaacccuuugacuucca

SEQ ID NO: 33697 - RNA, 64 nt, hsa
aacaacuuuuuauguauagcuucuaaaaggggaaaaaaaaaaaaagagaaacccuuugacuucc

SEQ ID NO: 33698 - RNA, 64 nt, hsa
aaacaacuuuuuauguauagcuucuaaaaggggaaaaaaaaaaaaagagaaacccuuugacuuc

SEQ ID NO: 33699 - RNA, 64 nt, hsa
aaaacaacuuuuuauguauagcuucuaaaaggggaaaaaaaaaaaaagagaaacccuuugacuu

SEQ ID NO: 33700 - RNA, 64 nt, hsa
uaacaacaaaaaaaaaaugagagaaaagcuaaaaaaaaaaaaguaaggggugagcaguuaaugg

SEQ ID NO: 33701 - RNA, 64 nt, hsa
auaacaacaaaaaaaaaaugagagaaaagcuaaaaaaaaaaaaguaaggggugagcaguuaaug

SEQ ID NO: 33702 - RNA, 64 nt, hsa
aauaacaacaaaaaaaaaaugagagaaaagcuaaaaaaaaaaaaguaaggggugagcaguuaau

SEQ ID NO: 33703 - RNA, 64 nt, hsa
aaauaacaacaaaaaaaaaaugagagaaaagcuaaaaaaaaaaaaguaaggggugagcaguuaa

SEQ ID NO: 33704 - RNA, 64 nt, hsa
aaaauaacaacaaaaaaaaaaugagagaaaagcuaaaaaaaaaaaaguaaggggugagcaguua

SEQ ID NO: 33705 - RNA, 64 nt, hsa
auaugugacaucuuuuuaaaaaaaauaacaacaaaaaaaaaaugagagaaaagcuaaaaaaaaa

SEQ ID NO: 33706 - RNA, 64 nt, hsa
cauaugugacaucuuuuuaaaaaaaauaacaacaaaaaaaaaaugagagaaaagcuaaaaaaaa

SEQ ID NO: 33707 - RNA, 64 nt, hsa
ucauaugugacaucuuuuuaaaaaaaauaacaacaaaaaaaaaaugagagaaaagcuaaaaaaa

SEQ ID NO: 33708 - RNA, 64 nt, hsa
cuaaaguuccccaguucauaugugacaucuuuuuaaaaaaaauaacaacaaaaaaaaaaugaga

SEQ ID NO: 33709 - RNA, 64 nt, hsa
guauuaaauuggaauuuuuuaauccuuuauauacaaaaaaaauacgaucacucaguguguguuu

SEQ ID NO: 33710 - RNA, 64 nt, hsa
uggccauuggcuugugcuguguuaagaaaggggaaaaaaaaauaacccaagugacuccuuucua

SEQ ID NO: 33711 - RNA, 64 nt, hsa
cuggccauuggcuugugcuguguuaagaaaggggaaaaaaaaauaacccaagugacuccuuucu

SEQ ID NO: 33712 - RNA, 64 nt, hsa
aaaacaaaaagcuacaaaaguagccuuacaaaaaaaaaaaaauuguuuagugaauacagaggaa

SEQ ID NO: 33713 - RNA, 64 nt, hsa
gaaaacaaaaagcuacaaaaguagccuuacaaaaaaaaaaaaauuguuuagugaauacagagga

SEQ ID NO: 33714 - RNA, 64 nt, hsa
ggaaaacaaaaagcuacaaaaguagccuuacaaaaaaaaaaaaauuguuuagugaauacagagg

SEQ ID NO: 33715 - RNA, 64 nt, hsa
gggaaaacaaaaagcuacaaaaguagccuuacaaaaaaaaaaaaauuguuuagugaauacagag

SEQ ID NO: 33716 - RNA, 64 nt, hsa
agggaaaacaaaaagcuacaaaaguagccuuacaaaaaaaaaaaaauuguuuagugaauacaga

SEQ ID NO: 33717 - RNA, 64 nt, hsa
aagggaaaacaaaaagcuacaaaaguagccuuacaaaaaaaaaaaaauuguuuagugaauacag

SEQ ID NO: 33718 - RNA, 64 nt, hsa
gacaguugccaguggaaauguuggguugguucaaaaaaaaaauaaaagcuauacuauaucucuc

SEQ ID NO: 33719 - RNA, 64 nt, hsa
ugacaguugccaguggaaauguuggguugguucaaaaaaaaaauaaaagcuauacuauaucucu

SEQ ID NO: 33720 - RNA, 64 nt, hsa
uugacaguugccaguggaaauguuggguugguucaaaaaaaaaauaaaagcuauacuauaucuc

SEQ ID NO: 33721 - RNA, 64 nt, hsa
uguaguugaagaagccuaaauuagguacuagaaaaaaaaaaaggacagaaacacugccugauau

SEQ ID NO: 33722 - RNA, 64 nt, hsa
auguaguugaagaagccuaaauuagguacuagaaaaaaaaaaaggacagaaacacugccugaua

SEQ ID NO: 33723 - RNA, 64 nt, hsa
cauguaguugaagaagccuaaauuagguacuagaaaaaaaaaaaggacagaaacacugccugau

SEQ ID NO: 33724 - RNA, 64 nt, hsa
acauguaguugaagaagccuaaauuagguacuagaaaaaaaaaaaggacagaaacacugccuga

SEQ ID NO: 33725 - RNA, 64 nt, hsa
cugccuaaaaaaaaaaaaaaaaaaaaaaaaaaaaaaaaaaaaugcuauaaaauggugaaagcuu

SEQ ID NO: 33726 - RNA, 64 nt, hsa
gcugccuaaaaaaaaaaaaaaaaaaaaaaaaaaaaaaaaaaaaugcuauaaaauggugaaagcu

SEQ ID NO: 33727 - RNA, 64 nt, hsa
ugcugccuaaaaaaaaaaaaaaaaaaaaaaaaaaaaaaaaaaaaugcuauaaaauggugaaagc

SEQ ID NO: 33728 - RNA, 64 nt, hsa
uugcugccuaaaaaaaaaaaaaaaaaaaaaaaaaaaaaaaaaaaaugcuauaaaauggugaaag

SEQ ID NO: 33729 - RNA, 64 nt, hsa
guugcugccuaaaaaaaaaaaaaaaaaaaaaaaaaaaaaaaaaaaaugcuauaaaauggugaaa

SEQ ID NO: 33730 - RNA, 64 nt, hsa
uguugcugccuaaaaaaaaaaaaaaaaaaaaaaaaaaaaaaaaaaaaugcuauaaaauggugaa

SEQ ID NO: 33731 - RNA, 64 nt, hsa
guguugcugccuaaaaaaaaaaaaaaaaaaaaaaaaaaaaaaaaaaaaugcuauaaaaugguga

SEQ ID NO: 33732 - RNA, 64 nt, hsa
aguguugcugccuaaaaaaaaaaaaaaaaaaaaaaaaaaaaaaaaaaaaugcuauaaaauggug

SEQ ID NO: 33733 - RNA, 64 nt, hsa
caguguugcugccuaaaaaaaaaaaaaaaaaaaaaaaaaaaaaaaaaaaaugcuauaaaauggu

SEQ ID NO: 33734 - RNA, 64 nt, hsa
ccaguguugcugccuaaaaaaaaaaaaaaaaaaaaaaaaaaaaaaaaaaaaugcuauaaaaugg

SEQ ID NO: 33735 - RNA, 64 nt, hsa
gccaguguugcugccuaaaaaaaaaaaaaaaaaaaaaaaaaaaaaaaaaaaaugcuauaaaaug

SEQ ID NO: 33736 - RNA, 64 nt, hsa
ggccaguguugcugccuaaaaaaaaaaaaaaaaaaaaaaaaaaaaaaaaaaaaugcuauaaaau

SEQ ID NO: 33737 - RNA, 64 nt, hsa
aggccaguguugcugccuaaaaaaaaaaaaaaaaaaaaaaaaaaaaaaaaaaaaugcuauaaaa

SEQ ID NO: 33738 - RNA, 64 nt, hsa
aaggccaguguugcugccuaaaaaaaaaaaaaaaaaaaaaaaaaaaaaaaaaaaaugcuauaaa

SEQ ID NO: 33739 - RNA, 64 nt, hsa
caaggccaguguugcugccuaaaaaaaaaaaaaaaaaaaaaaaaaaaaaaaaaaaaugcuauaa

SEQ ID NO: 33740 - RNA, 64 nt, hsa
ccaaggccaguguugcugccuaaaaaaaaaaaaaaaaaaaaaaaaaaaaaaaaaaaaugcuaua

SEQ ID NO: 33741 - RNA, 64 nt, hsa
gccaaggccaguguugcugccuaaaaaaaaaaaaaaaaaaaaaaaaaaaaaaaaaaaaugcuau

SEQ ID NO: 33742 - RNA, 64 nt, hsa
ugccaaggccaguguugcugccuaaaaaaaaaaaaaaaaaaaaaaaaaaaaaaaaaaaaugcua

SEQ ID NO: 33743 - RNA, 64 nt, hsa
uugccaaggccaguguugcugccuaaaaaaaaaaaaaaaaaaaaaaaaaaaaaaaaaaaaugcu

SEQ ID NO: 33744 - RNA, 64 nt, hsa
uuugccaaggccaguguugcugccuaaaaaaaaaaaaaaaaaaaaaaaaaaaaaaaaaaaaugc

SEQ ID NO: 33745 - RNA, 64 nt, hsa
uuuugccaaggccaguguugcugccuaaaaaaaaaaaaaaaaaaaaaaaaaaaaaaaaaaaaug

SEQ ID NO: 33746 - RNA, 64 nt, hsa
uuuuugccaaggccaguguugcugccuaaaaaaaaaaaaaaaaaaaaaaaaaaaaaaaaaaaau

SEQ ID NO: 33747 - RNA, 64 nt, hsa
uuuuuugccaaggccaguguugcugccuaaaaaaaaaaaaaaaaaaaaaaaaaaaaaaaaaaaa

SEQ ID NO: 33748 - RNA, 64 nt, hsa
uuuuuuugccaaggccaguguugcugccuaaaaaaaaaaaaaaaaaaaaaaaaaaaaaaaaaaa

SEQ ID NO: 33749 - RNA, 64 nt, hsa
uuuuuuuugccaaggccaguguugcugccuaaaaaaaaaaaaaaaaaaaaaaaaaaaaaaaaaa

SEQ ID NO: 33750 - RNA, 64 nt, hsa
uuuuuuuuugccaaggccaguguugcugccuaaaaaaaaaaaaaaaaaaaaaaaaaaaaaaaaa

SEQ ID NO: 33751 - RNA, 64 nt, hsa
uuuuuuuuuugccaaggccaguguugcugccuaaaaaaaaaaaaaaaaaaaaaaaaaaaaaaaa

SEQ ID NO: 33752 - RNA, 64 nt, hsa
uuuuuuuuuuugccaaggccaguguugcugccuaaaaaaaaaaaaaaaaaaaaaaaaaaaaaaa

SEQ ID NO: 33753 - RNA, 64 nt, hsa
uuuuuuuuuuuugccaaggccaguguugcugccuaaaaaaaaaaaaaaaaaaaaaaaaaaaaaa

SEQ ID NO: 33754 - RNA, 64 nt, hsa
cuccagccagcuucuugagccuauuugguuuaaaaaaaaaaagucuucuaaucagaagccacug

SEQ ID NO: 33755 - RNA, 64 nt, hsa
ccuccagccagcuucuugagccuauuugguuuaaaaaaaaaaagucuucuaaucagaagccacu

SEQ ID NO: 33756 - RNA, 64 nt, hsa
accuccagccagcuucuugagccuauuugguuuaaaaaaaaaaagucuucuaaucagaagccac

SEQ ID NO: 33757 - RNA, 64 nt, hsa
aaccuccagccagcuucuugagccuauuugguuuaaaaaaaaaaagucuucuaaucagaagcca

SEQ ID NO: 33758 - RNA, 64 nt, hsa
ucauuaggggcuuaagcuagcuccuuuggcuuuuaaaaaaaauuuuuuuucaaauuucuucauu

SEQ ID NO: 33759 - RNA, 64 nt, hsa
cuagccugggugacagagcaaaacugugucucaaaaaaaaaagucauguuacacauuuaaguuu

SEQ ID NO: 33760 - RNA, 64 nt, hsa
ucuagccugggugacagagcaaaacugugucucaaaaaaaaaagucauguuacacauuuaaguu

SEQ ID NO: 33761 - RNA, 64 nt, hsa
cucuagccugggugacagagcaaaacugugucucaaaaaaaaaagucauguuacacauuuaagu

SEQ ID NO: 33762 - RNA, 64 nt, hsa
ugcuccuagagaggagaaaggggugauugaaagaaaaaaaaauacuuaaauauuuguaauugug

SEQ ID NO: 33763 - RNA, 64 nt, hsa
augcuccuagagaggagaaaggggugauugaaagaaaaaaaaauacuuaaauauuuguaauugu

SEQ ID NO: 33764 - RNA, 64 nt, hsa
gucugaaaauagaacuugccuuuuaaguuaaaaaaaaaaaaagcuaucuugaaaauguuuugga

SEQ ID NO: 33765 - RNA, 64 nt, hsa
agucugaaaauagaacuugccuuuuaaguuaaaaaaaaaaaaagcuaucuugaaaauguuuugg

SEQ ID NO: 33766 - RNA, 64 nt, hsa
aagucugaaaauagaacuugccuuuuaaguuaaaaaaaaaaaaagcuaucuugaaaauguuuug

SEQ ID NO: 33767 - RNA, 64 nt, hsa
aaagucugaaaauagaacuugccuuuuaaguuaaaaaaaaaaaaagcuaucuugaaaauguuuu

SEQ ID NO: 33768 - RNA, 64 nt, hsa
gaaagucugaaaauagaacuugccuuuuaaguuaaaaaaaaaaaaagcuaucuugaaaauguuu

SEQ ID NO: 33769 - RNA, 64 nt, hsa
cgaaagucugaaaauagaacuugccuuuuaaguuaaaaaaaaaaaaagcuaucuugaaaauguu

SEQ ID NO: 33770 - RNA, 64 nt, hsa
uacggggccagucaugugaagcguuuacagcuuaaaaaaaaagcgcuugccuaacucauacuuu

SEQ ID NO: 33771 - RNA, 64 nt, hsa
uuacggggccagucaugugaagcguuuacagcuuaaaaaaaaagcgcuugccuaacucauacuu

SEQ ID NO: 33772 - RNA, 64 nt, hsa
auuucugauccacaaugcauggauuccuuugaagaaaaaaaagaaaaagagaaaaaaaucacaa

SEQ ID NO: 33773 - RNA, 64 nt, hsa
uauuuuuaagauuaaagguacacugauggacaaaaaaaaaaaguaaaacauggcaaaaaauaaa

SEQ ID NO: 33774 - RNA, 64 nt, hsa
guauuuuuaagauuaaagguacacugauggacaaaaaaaaaaaguaaaacauggcaaaaaauaa

SEQ ID NO: 33775 - RNA, 64 nt, hsa
uguauuuuuaagauuaaagguacacugauggacaaaaaaaaaaaguaaaacauggcaaaaaaua

SEQ ID NO: 33776 - RNA, 64 nt, hsa
guguauuuuuaagauuaaagguacacugauggacaaaaaaaaaaaguaaaacauggcaaaaaau

SEQ ID NO: 33777 - RNA, 64 nt, hsa
gucuaucaaaacuauuugauccaagugaaaaaaaaaaaaaaacuagaaagcuacggaaccugcc

SEQ ID NO: 33778 - RNA, 64 nt, hsa
ugucuaucaaaacuauuugauccaagugaaaaaaaaaaaaaaacuagaaagcuacggaaccugc

SEQ ID NO: 33779 - RNA, 64 nt, hsa
cugucuaucaaaacuauuugauccaagugaaaaaaaaaaaaaaacuagaaagcuacggaaccug

SEQ ID NO: 33780 - RNA, 64 nt, hsa
ucugucuaucaaaacuauuugauccaagugaaaaaaaaaaaaaaacuagaaagcuacggaaccu

SEQ ID NO: 33781 - RNA, 64 nt, hsa
uucugucuaucaaaacuauuugauccaagugaaaaaaaaaaaaaaacuagaaagcuacggaacc

SEQ ID NO: 33782 - RNA, 64 nt, hsa
uuucugucuaucaaaacuauuugauccaagugaaaaaaaaaaaaaaacuagaaagcuacggaac

SEQ ID NO: 33783 - RNA, 64 nt, hsa
uuuucugucuaucaaaacuauuugauccaagugaaaaaaaaaaaaaaacuagaaagcuacggaa

SEQ ID NO: 33784 - RNA, 64 nt, hsa
uuuuucugucuaucaaaacuauuugauccaagugaaaaaaaaaaaaaaacuagaaagcuacgga

SEQ ID NO: 33785 - RNA, 64 nt, hsa
cuauuauuaaacuuuuucuaaaaagugaaaaaaaaaaaaaaagauauaagaacucaagguccca

SEQ ID NO: 33786 - RNA, 64 nt, hsa
gcuauuauuaaacuuuuucuaaaaagugaaaaaaaaaaaaaaagauauaagaacucaagguccc

SEQ ID NO: 33787 - RNA, 64 nt, hsa
ugcuauuauuaaacuuuuucuaaaaagugaaaaaaaaaaaaaaagauauaagaacucaaggucc

SEQ ID NO: 33788 - RNA, 64 nt, hsa
cugcuauuauuaaacuuuuucuaaaaagugaaaaaaaaaaaaaaagauauaagaacucaagguc

SEQ ID NO: 33789 - RNA, 64 nt, hsa
ccugcuauuauuaaacuuuuucuaaaaagugaaaaaaaaaaaaaaagauauaagaacucaaggu

SEQ ID NO: 33790 - RNA, 64 nt, hsa
accugcuauuauuaaacuuuuucuaaaaagugaaaaaaaaaaaaaaagauauaagaacucaagg

SEQ ID NO: 33791 - RNA, 64 nt, hsa
aaccugcuauuauuaaacuuuuucuaaaaagugaaaaaaaaaaaaaaagauauaagaacucaag

SEQ ID NO: 33792 - RNA, 64 nt, hsa
uaaccugcuauuauuaaacuuuuucuaaaaagugaaaaaaaaaaaaaaagauauaagaacucaa

SEQ ID NO: 33793 - RNA, 64 nt, hsa
augugaagucugaguaagguugcucucagaaaaaaaaaaaaagcauauauauauauaaaauaaa

SEQ ID NO: 33794 - RNA, 64 nt, hsa
aaugugaagucugaguaagguugcucucagaaaaaaaaaaaaagcauauauauauauaaaauaa

SEQ ID NO: 33795 - RNA, 64 nt, hsa
aaaugugaagucugaguaagguugcucucagaaaaaaaaaaaaagcauauauauauauaaaaua

SEQ ID NO: 33796 - RNA, 64 nt, hsa
uaaaugugaagucugaguaagguugcucucagaaaaaaaaaaaaagcauauauauauauaaaau

SEQ ID NO: 33797 - RNA, 64 nt, hsa
auaaaugugaagucugaguaagguugcucucagaaaaaaaaaaaaagcauauauauauauaaaa

SEQ ID NO: 33798 - RNA, 64 nt, hsa
gauaaaugugaagucugaguaagguugcucucagaaaaaaaaaaaaagcauauauauauauaaa

SEQ ID NO: 33799 - RNA, 64 nt, hsa
accugggcaacagugagacccugucucaaaaaaaaaaaaaaaggcaguggaaauagagaaguaa

SEQ ID NO: 33800 - RNA, 64 nt, hsa
caccugggcaacagugagacccugucucaaaaaaaaaaaaaaaggcaguggaaauagagaagua

SEQ ID NO: 33801 - RNA, 64 nt, hsa
ccaccugggcaacagugagacccugucucaaaaaaaaaaaaaaaggcaguggaaauagagaagu

SEQ ID NO: 33802 - RNA, 64 nt, hsa
cccaccugggcaacagugagacccugucucaaaaaaaaaaaaaaaggcaguggaaauagagaag

SEQ ID NO: 33803 - RNA, 64 nt, hsa
ucccaccugggcaacagugagacccugucucaaaaaaaaaaaaaaaggcaguggaaauagagaa

SEQ ID NO: 33804 - RNA, 64 nt, hsa
cucccaccugggcaacagugagacccugucucaaaaaaaaaaaaaaaggcaguggaaauagaga

SEQ ID NO: 33805 - RNA, 64 nt, hsa
gcucccaccugggcaacagugagacccugucucaaaaaaaaaaaaaaaggcaguggaaauagag

SEQ ID NO: 33806 - RNA, 64 nt, hsa
ugcucccaccugggcaacagugagacccugucucaaaaaaaaaaaaaaaggcaguggaaauaga

SEQ ID NO: 33807 - RNA, 64 nt, hsa
uggcgaaacuccauuucuauaaaaaauacaaaaaaaaaaaaaucuagccaggcgugguggugcg

SEQ ID NO: 33808 - RNA, 64 nt, hsa
auggcgaaacuccauuucuauaaaaaauacaaaaaaaaaaaaaucuagccaggcgugguggugc

SEQ ID NO: 33809 - RNA, 64 nt, hsa
cauggcgaaacuccauuucuauaaaaaauacaaaaaaaaaaaaaucuagccaggcgugguggug

SEQ ID NO: 33810 - RNA, 64 nt, hsa
acauggcgaaacuccauuucuauaaaaaauacaaaaaaaaaaaaaucuagccaggcgugguggu

SEQ ID NO: 33811 - RNA, 64 nt, hsa
aacauggcgaaacuccauuucuauaaaaaauacaaaaaaaaaaaaaucuagccaggcguggugg

SEQ ID NO: 33812 - RNA, 64 nt, hsa
caacauggcgaaacuccauuucuauaaaaaauacaaaaaaaaaaaaaucuagccaggcguggug

SEQ ID NO: 33813 - RNA, 64 nt, hsa
uuguugaaauguuuugcaucugucaauuaaggaaaaaaaaaaucacucuauguugccccacuuu

SEQ ID NO: 33814 - RNA, 64 nt, hsa
cuuguugaaauguuuugcaucugucaauuaaggaaaaaaaaaaucacucuauguugccccacuu

SEQ ID NO: 33815 - RNA, 64 nt, hsa
gcuuguugaaauguuuugcaucugucaauuaaggaaaaaaaaaaucacucuauguugccccacu

SEQ ID NO: 33816 - RNA, 64 nt, hsa
uagcucauuauuuccaucuuuggaaaaggaaaaaaaaaaaaacuucuuuaggcauuugccuaag

SEQ ID NO: 33817 - RNA, 64 nt, hsa
cuagcucauuauuuccaucuuuggaaaaggaaaaaaaaaaaaacuucuuuaggcauuugccuaa

SEQ ID NO: 33818 - RNA, 64 nt, hsa
acuagcucauuauuuccaucuuuggaaaaggaaaaaaaaaaaaacuucuuuaggcauuugccua

SEQ ID NO: 33819 - RNA, 64 nt, hsa
aacuagcucauuauuuccaucuuuggaaaaggaaaaaaaaaaaaacuucuuuaggcauuugccu

SEQ ID NO: 33820 - RNA, 64 nt, hsa
aaacuagcucauuauuuccaucuuuggaaaaggaaaaaaaaaaaaacuucuuuaggcauuugcc

SEQ ID NO: 33821 - RNA, 64 nt, hsa
uaaacuagcucauuauuuccaucuuuggaaaaggaaaaaaaaaaaaacuucuuuaggcauuugc

SEQ ID NO: 33822 - RNA, 64 nt, hsa
accgcuuuuuaaaauucaaaacaagaaacaaaacaaaaaaaauuaaggggaaaauuauuuaaau

SEQ ID NO: 33823 - RNA, 64 nt, hsa
cucuuuccuccuugccacuuaccuuugcaaaguuaaaaaaaaggggggagggaaugggagagaa

SEQ ID NO: 33824 - RNA, 64 nt, hsa
uauauuuuuuuaauuuggcaggauaaaauauugcaaaaaaaacacauuuguauguuaaguccua

SEQ ID NO: 33825 - RNA, 64 nt, hsa
accuuuuuguuagugaauuuggaaauaaaaagaaaaaaaaaacaaaaacaaacaggcugccaua

SEQ ID NO: 33826 - RNA, 64 nt, hsa
uaccuuuuuguuagugaauuuggaaauaaaaagaaaaaaaaaacaaaaacaaacaggcugccau

SEQ ID NO: 33827 - RNA, 64 nt, hsa
guaccuuuuuguuagugaauuuggaaauaaaaagaaaaaaaaaacaaaaacaaacaggcugcca

SEQ ID NO: 33828 - RNA, 64 nt, hsa
aaagugcuuaauauuguuauugcuuugcagaaaaaaaaaaaaucacauuucugaccuguacuua

SEQ ID NO: 33829 - RNA, 64 nt, hsa
aaaagugcuuaauauuguuauugcuuugcagaaaaaaaaaaaaucacauuucugaccuguacuu

SEQ ID NO: 33830 - RNA, 64 nt, hsa
aaaaagugcuuaauauuguuauugcuuugcagaaaaaaaaaaaaucacauuucugaccuguacu

SEQ ID NO: 33831 - RNA, 64 nt, hsa
aaaaaagugcuuaauauuguuauugcuuugcagaaaaaaaaaaaaucacauuucugaccuguac

SEQ ID NO: 33832 - RNA, 64 nt, hsa
aaaaaaagugcuuaauauuguuauugcuuugcagaaaaaaaaaaaaucacauuucugaccugua

SEQ ID NO: 33833 - RNA, 64 nt, hsa
uuuuuuucugccuuggguguugaauuuuuauuucaaaaaaaauguauagaaacuuguauuuggg

SEQ ID NO: 33834 - RNA, 64 nt, hsa
uaaucgagaaugccugggcauuuuacaaaacaagaaaaaaaauacccuuuucuuuuccuugaaa

SEQ ID NO: 33835 - RNA, 64 nt, hsa
auacguuuacaguauuggguacauacaaggguaaaaaaaaaauuguguguauguguguuggagc

SEQ ID NO: 33836 - RNA, 64 nt, hsa
aauacguuuacaguauuggguacauacaaggguaaaaaaaaaauuguguguauguguguuggag

SEQ ID NO: 33837 - RNA, 64 nt, hsa
aaauacguuuacaguauuggguacauacaaggguaaaaaaaaaauuguguguauguguguugga

SEQ ID NO: 33838 - RNA, 64 nt, hsa
aacuaacaaagccacauuuacuuuaaguaaaaaaaaaaaaaauucugguugaagauagaggaua

SEQ ID NO: 33839 - RNA, 64 nt, hsa
aaacuaacaaagccacauuuacuuuaaguaaaaaaaaaaaaaauucugguugaagauagaggau

SEQ ID NO: 33840 - RNA, 64 nt, hsa
gaaacuaacaaagccacauuuacuuuaaguaaaaaaaaaaaaaauucugguugaagauagagga

SEQ ID NO: 33841 - RNA, 64 nt, hsa
agaaacuaacaaagccacauuuacuuuaaguaaaaaaaaaaaaaauucugguugaagauagagg

SEQ ID NO: 33842 - RNA, 64 nt, hsa
uagaaacuaacaaagccacauuuacuuuaaguaaaaaaaaaaaaaauucugguugaagauagag

SEQ ID NO: 33843 - RNA, 64 nt, hsa
uuagaaacuaacaaagccacauuuacuuuaaguaaaaaaaaaaaaaauucugguugaagauaga

SEQ ID NO: 33844 - RNA, 64 nt, hsa
uuuagaaacuaacaaagccacauuuacuuuaaguaaaaaaaaaaaaaauucugguugaagauag

SEQ ID NO: 33845 - RNA, 64 nt, hsa
gaacauuuaaauuaaguuaaugggccuuuaaaaaaaaaaaaaggaaacacucauaccuguaguu

SEQ ID NO: 33846 - RNA, 64 nt, hsa
ggaacauuuaaauuaaguuaaugggccuuuaaaaaaaaaaaaaggaaacacucauaccuguagu

SEQ ID NO: 33847 - RNA, 64 nt, hsa
gggaacauuuaaauuaaguuaaugggccuuuaaaaaaaaaaaaaggaaacacucauaccuguag

SEQ ID NO: 33848 - RNA, 64 nt, hsa
ugggaacauuuaaauuaaguuaaugggccuuuaaaaaaaaaaaaaggaaacacucauaccugua

SEQ ID NO: 33849 - RNA, 64 nt, hsa
augggaacauuuaaauuaaguuaaugggccuuuaaaaaaaaaaaaaggaaacacucauaccugu

SEQ ID NO: 33850 - RNA, 64 nt, hsa
gaugggaacauuuaaauuaaguuaaugggccuuuaaaaaaaaaaaaaggaaacacucauaccug

SEQ ID NO: 33851 - RNA, 64 nt, hsa
aucugaaaugugacauuuucuaaaugccucccuuaaaaaaaaaacugcugaaaaucugugcuau

SEQ ID NO: 33852 - RNA, 64 nt, hsa
ucugaaaugugacauuuucuaaaugccucccuuaaaaaaaaaacugcugaaaaucugugcuauu

SEQ ID NO: 33853 - RNA, 64 nt, hsa
cugaaaugugacauuuucuaaaugccucccuuaaaaaaaaaacugcugaaaaucugugcuauuu

SEQ ID NO: 33854 - RNA, 64 nt, hsa
uuauuagaagaaaaguacuguacugaaaauucagaaaaaaaaucucaaccuuaugccaaaaugg

SEQ ID NO: 33855 - RNA, 64 nt, hsa
caacauggugaaacccugucucuacuaaaaauacaaaaaaaaauuagcugggcauagugguggg

SEQ ID NO: 33856 - RNA, 64 nt, hsa
aacauggugaaacccugucucuacuaaaaauacaaaaaaaaauuagcugggcauaguggugggu

SEQ ID NO: 33857 - RNA, 64 nt, hsa
cuccaaccuaggugacaaagcuacacgccaucucaaaaaaaaaaaagaaaaaggguuacaaaag

SEQ ID NO: 33858 - RNA, 64 nt, hsa
uccaaccuaggugacaaagcuacacgccaucucaaaaaaaaaaaagaaaaaggguuacaaaagg

SEQ ID NO: 33859 - RNA, 64 nt, hsa
ccaaccuaggugacaaagcuacacgccaucucaaaaaaaaaaaagaaaaaggguuacaaaaggu

SEQ ID NO: 33860 - RNA, 64 nt, hsa
caaccuaggugacaaagcuacacgccaucucaaaaaaaaaaaagaaaaaggguuacaaaagguu

SEQ ID NO: 33861 - RNA, 64 nt, hsa
aaccuaggugacaaagcuacacgccaucucaaaaaaaaaaaagaaaaaggguuacaaaagguuc

SEQ ID NO: 33862 - RNA, 64 nt, hsa
uugguaccuacaacaugcuugauuuugagugauuaaaaaaaaauaauuuggcugggugcugugg

SEQ ID NO: 33863 - RNA, 64 nt, hsa
ugguaccuacaacaugcuugauuuugagugauuaaaaaaaaauaauuuggcugggugcuguggc

SEQ ID NO: 33864 - RNA, 64 nt, hsa
uccagccuuggugacagagcaagacuccgucuccaaaaaaaagaaaaaaaaauuucuugaagug

SEQ ID NO: 33865 - RNA, 64 nt, hsa
ggugacagagcaagacuccgucuccaaaaaaaagaaaaaaaaauuucuugaaguggaaugaugu

SEQ ID NO: 33866 - RNA, 64 nt, hsa
gugacagagcaagacuccgucuccaaaaaaaagaaaaaaaaauuucuugaaguggaaugaugua

SEQ ID NO: 33867 - RNA, 64 nt, hsa
gcuaggcugcauagcauuauaaccugggaacguuaaaaaaaauacagacauucuugauucuuag

SEQ ID NO: 33868 - RNA, 64 nt, hsa
uacuuucagaauuguauuucaguuuugaagauuuaaaaaaaaugugaaaauaaauauauauuag

SEQ ID NO: 33869 - RNA, 64 nt, hsa
aagaacagaaaacaagaagucauaccuuuuucuuaaaaaaaaaaaaaaaguuuuugcuucaagu

SEQ ID NO: 33870 - RNA, 64 nt, hsa
agaacagaaaacaagaagucauaccuuuuucuuaaaaaaaaaaaaaaaguuuuugcuucaagug

SEQ ID NO: 33871 - RNA, 64 nt, hsa
gaacagaaaacaagaagucauaccuuuuucuuaaaaaaaaaaaaaaaguuuuugcuucaagugu

SEQ ID NO: 33872 - RNA, 64 nt, hsa
aacagaaaacaagaagucauaccuuuuucuuaaaaaaaaaaaaaaaguuuuugcuucaaguguu

SEQ ID NO: 33873 - RNA, 64 nt, hsa
acagaaaacaagaagucauaccuuuuucuuaaaaaaaaaaaaaaaguuuuugcuucaaguguuu

SEQ ID NO: 33874 - RNA, 64 nt, hsa
cagaaaacaagaagucauaccuuuuucuuaaaaaaaaaaaaaaaguuuuugcuucaaguguuuu

SEQ ID NO: 33875 - RNA, 64 nt, hsa
agaaaacaagaagucauaccuuuuucuuaaaaaaaaaaaaaaaguuuuugcuucaaguguuuug

SEQ ID NO: 33876 - RNA, 64 nt, hsa
gaaaacaagaagucauaccuuuuucuuaaaaaaaaaaaaaaaguuuuugcuucaaguguuuugg

SEQ ID NO: 33877 - RNA, 64 nt, hsa
uuuacuuuuuuuuaugaucaaggaaaagaucauuaaaaaaaaacacaaagaaguuuuucuuugu

SEQ ID NO: 33878 - RNA, 64 nt, hsa
uuacuuuuuuuuaugaucaaggaaaagaucauuaaaaaaaaacacaaagaaguuuuucuuugug

SEQ ID NO: 33879 - RNA, 64 nt, hsa
cuucuuaaaaucaaauguaaaucaauuacagauuaaaaaaaaaagccuguauuuaacucauaug

SEQ ID NO: 33880 - RNA, 64 nt, hsa
uucuuaaaaucaaauguaaaucaauuacagauuaaaaaaaaaagccuguauuuaacucauauga

SEQ ID NO: 33881 - RNA, 64 nt, hsa
ucuuaaaaucaaauguaaaucaauuacagauuaaaaaaaaaagccuguauuuaacucauaugau

SEQ ID NO: 33882 - RNA, 64 nt, hsa
gugaaaaauuauaaucuacuuaaacucuaaucagaaaaaaaauucucaaaaaaacuauuaugaa

SEQ ID NO: 33883 - RNA, 64 nt, hsa
uuauuguuuuguuauuuaaguuuauguuauuuauaaaaaaaaaaccuuaauaagcuguaucugu

SEQ ID NO: 33884 - RNA, 64 nt, hsa
uauuguuuuguuauuuaaguuuauguuauuuauaaaaaaaaaaccuuaauaagcuguaucuguu

SEQ ID NO: 33885 - RNA, 64 nt, hsa
auuguuuuguuauuuaaguuuauguuauuuauaaaaaaaaaaccuuaauaagcuguaucuguuu

SEQ ID NO: 33886 - RNA, 64 nt, hsa
uuugggcuguauuugugcacuaaaucuuuauucuaaaaaaaaaaauggaaacuuuaauuuuuuu

SEQ ID NO: 33887 - RNA, 64 nt, hsa
uugggcuguauuugugcacuaaaucuuuauucuaaaaaaaaaaauggaaacuuuaauuuuuuua

SEQ ID NO: 33888 - RNA, 64 nt, hsa
ugggcuguauuugugcacuaaaucuuuauucuaaaaaaaaaaauggaaacuuuaauuuuuuuaa

SEQ ID NO: 33889 - RNA, 64 nt, hsa
gggcuguauuugugcacuaaaucuuuauucuaaaaaaaaaaauggaaacuuuaauuuuuuuaaa

SEQ ID NO: 33890 - RNA, 64 nt, hsa
aaaccuaaaacuguucuaaaauagaaagucugugaaaaaaaacaaaaguaaaguuauaaaagga

SEQ ID NO: 33891 - RNA, 64 nt, hsa
uuuuauaaaaugaauuuuguaauuuuuuucugagaaaaaaaaguucuuaaauacaauaaaauug

SEQ ID NO: 33892 - RNA, 64 nt, hsa
cuaaucucuuauucuaauaaauauacuaugaaauaaaaaaaaaaggaugaaagcuacuuuugcu

SEQ ID NO: 33893 - RNA, 64 nt, hsa
uaaucucuuauucuaauaaauauacuaugaaauaaaaaaaaaaggaugaaagcuacuuuugcuu

SEQ ID NO: 33894 - RNA, 64 nt, hsa
aaucucuuauucuaauaaauauacuaugaaauaaaaaaaaaaggaugaaagcuacuuuugcuuu

SEQ ID NO: 33895 - RNA, 64 nt, hsa
uauggaagucgugucuuacuccaggugaagggggaaaaaaaaagccuauacuuuggcagguuau

SEQ ID NO: 33896 - RNA, 64 nt, hsa
auggaagucgugucuuacuccaggugaagggggaaaaaaaaagccuauacuuuggcagguuaug

SEQ ID NO: 33897 - RNA, 64 nt, hsa
cagccuggccaacauagugggacccugucucuacaaaaaaaaaauuugccaagagccugaguga

SEQ ID NO: 33898 - RNA, 64 nt, hsa
agccuggccaacauagugggacccugucucuacaaaaaaaaaauuugccaagagccugagugac

SEQ ID NO: 33899 - RNA, 64 nt, hsa
gccuggccaacauagugggacccugucucuacaaaaaaaaaauuugccaagagccugagugaca

SEQ ID NO: 33900 - RNA, 64 nt, hsa
caagagccugagugacagagcaagaccccaucucaaaaaaaaaaacaaacaaacaaaaaaaaaa

SEQ ID NO: 33901 - RNA, 64 nt, hsa
aagagccugagugacagagcaagaccccaucucaaaaaaaaaaacaaacaaacaaaaaaaaaac

SEQ ID NO: 33902 - RNA, 64 nt, hsa
agagccugagugacagagcaagaccccaucucaaaaaaaaaaacaaacaaacaaaaaaaaaacc

SEQ ID NO: 33903 - RNA, 64 nt, hsa
gagccugagugacagagcaagaccccaucucaaaaaaaaaaacaaacaaacaaaaaaaaaacca

SEQ ID NO: 33904 - RNA, 64 nt, hsa
caagaccccaucucaaaaaaaaaaacaaacaaacaaaaaaaaaaccauauauauacauauauau

SEQ ID NO: 33905 - RNA, 64 nt, hsa
aagaccccaucucaaaaaaaaaaacaaacaaacaaaaaaaaaaccauauauauacauauauaua

SEQ ID NO: 33906 - RNA, 64 nt, hsa
agaccccaucucaaaaaaaaaaacaaacaaacaaaaaaaaaaccauauauauacauauauauau

SEQ ID NO: 33907 - RNA, 64 nt, hsa
aucuuaauguagauuauaauuuuggucuuuuaggaaaaaaaaacaaaaaucugauauuuauuuc

SEQ ID NO: 33908 - RNA, 64 nt, hsa
ucuuaauguagauuauaauuuuggucuuuuaggaaaaaaaaacaaaaaucugauauuuauuuca

SEQ ID NO: 33909 - RNA, 64 nt, hsa
cuccagccugggcgacagagugagacuccgucucaaaaaaaaaaaaaaaaagaaauguuucauu

SEQ ID NO: 33910 - RNA, 64 nt, hsa
uccagccugggcgacagagugagacuccgucucaaaaaaaaaaaaaaaaagaaauguuucauuu

SEQ ID NO: 33911 - RNA, 64 nt, hsa
ccagccugggcgacagagugagacuccgucucaaaaaaaaaaaaaaaaagaaauguuucauuuu

SEQ ID NO: 33912 - RNA, 64 nt, hsa
cagccugggcgacagagugagacuccgucucaaaaaaaaaaaaaaaaagaaauguuucauuuug

SEQ ID NO: 33913 - RNA, 64 nt, hsa
agccugggcgacagagugagacuccgucucaaaaaaaaaaaaaaaaagaaauguuucauuuugg

SEQ ID NO: 33914 - RNA, 64 nt, hsa
gccugggcgacagagugagacuccgucucaaaaaaaaaaaaaaaaagaaauguuucauuuuggu

SEQ ID NO: 33915 - RNA, 64 nt, hsa
ccugggcgacagagugagacuccgucucaaaaaaaaaaaaaaaaagaaauguuucauuuugguu

SEQ ID NO: 33916 - RNA, 64 nt, hsa
cugggcgacagagugagacuccgucucaaaaaaaaaaaaaaaaagaaauguuucauuuugguuu

SEQ ID NO: 33917 - RNA, 64 nt, hsa
ugggcgacagagugagacuccgucucaaaaaaaaaaaaaaaaagaaauguuucauuuugguuuu

SEQ ID NO: 33918 - RNA, 64 nt, hsa
gggcgacagagugagacuccgucucaaaaaaaaaaaaaaaaagaaauguuucauuuugguuuuu

SEQ ID NO: 33919 - RNA, 64 nt, hsa
acaucaccaucaucuaagagcgggucaaggaauuaaaaaaaaacaacaaaacguuuaagggguu

SEQ ID NO: 33920 - RNA, 64 nt, hsa
caucaccaucaucuaagagcgggucaaggaauuaaaaaaaaacaacaaaacguuuaagggguua

SEQ ID NO: 33921 - RNA, 64 nt, hsa
uauuuuaugagccccaguuuucugggcuuaguuuaaaaaaaaaaucaagucuaaacauugcauu

SEQ ID NO: 33922 - RNA, 64 nt, hsa
auuuuaugagccccaguuuucugggcuuaguuuaaaaaaaaaaucaagucuaaacauugcauuu

SEQ ID NO: 33923 - RNA, 64 nt, hsa
uuuuaugagccccaguuuucugggcuuaguuuaaaaaaaaaaucaagucuaaacauugcauuua

SEQ ID NO: 33924 - RNA, 64 nt, hsa
agcuuuuguucuuggauaaaaagucauacacuuuaaaaaaaaaaaaaacuuuuuccaggaaaau

SEQ ID NO: 33925 - RNA, 64 nt, hsa
gcuuuuguucuuggauaaaaagucauacacuuuaaaaaaaaaaaaaacuuuuuccaggaaaaua

SEQ ID NO: 33926 - RNA, 64 nt, hsa
cuuuuguucuuggauaaaaagucauacacuuuaaaaaaaaaaaaaacuuuuuccaggaaaauau

SEQ ID NO: 33927 - RNA, 64 nt, hsa
uuuuguucuuggauaaaaagucauacacuuuaaaaaaaaaaaaaacuuuuuccaggaaaauaua

SEQ ID NO: 33928 - RNA, 64 nt, hsa
uuuguucuuggauaaaaagucauacacuuuaaaaaaaaaaaaaacuuuuuccaggaaaauauau

SEQ ID NO: 33929 - RNA, 64 nt, hsa
uuguucuuggauaaaaagucauacacuuuaaaaaaaaaaaaaacuuuuuccaggaaaauauauu

SEQ ID NO: 33930 - RNA, 64 nt, hsa
uguucuuggauaaaaagucauacacuuuaaaaaaaaaaaaaacuuuuuccaggaaaauauauug

SEQ ID NO: 33931 - RNA, 64 nt, hsa
caugccacugcacuccagccugggugacacagccaaaaaaaaaaccacuaaguuagaucucuac

SEQ ID NO: 33932 - RNA, 64 nt, hsa
augccacugcacuccagccugggugacacagccaaaaaaaaaaccacuaaguuagaucucuacc

SEQ ID NO: 33933 - RNA, 64 nt, hsa
ugccacugcacuccagccugggugacacagccaaaaaaaaaaccacuaaguuagaucucuaccu

SEQ ID NO: 33934 - RNA, 64 nt, hsa
ucuuuuccccuuauugagauuaauauuuaagauuaaaaaaaaaauacccaaagccaaaugcagu

SEQ ID NO: 33935 - RNA, 64 nt, hsa
cuuuuccccuuauugagauuaauauuuaagauuaaaaaaaaaauacccaaagccaaaugcaguu

SEQ ID NO: 33936 - RNA, 64 nt, hsa
uuuuccccuuauugagauuaauauuuaagauuaaaaaaaaaauacccaaagccaaaugcaguuc

SEQ ID NO: 33937 - RNA, 64 nt, hsa
agagaggggaagaauuuaauggacugugaauuucaaaaaaaaaaaaaaagacugucaaaugaac

SEQ ID NO: 33938 - RNA, 64 nt, hsa
gagaggggaagaauuuaauggacugugaauuucaaaaaaaaaaaaaaagacugucaaaugaacu

SEQ ID NO: 33939 - RNA, 64 nt, hsa
agaggggaagaauuuaauggacugugaauuucaaaaaaaaaaaaaaagacugucaaaugaacuu

SEQ ID NO: 33940 - RNA, 64 nt, hsa
gaggggaagaauuuaauggacugugaauuucaaaaaaaaaaaaaaagacugucaaaugaacuuu

SEQ ID NO: 33941 - RNA, 64 nt, hsa
aggggaagaauuuaauggacugugaauuucaaaaaaaaaaaaaaagacugucaaaugaacuuuu

SEQ ID NO: 33942 - RNA, 64 nt, hsa
ggggaagaauuuaauggacugugaauuucaaaaaaaaaaaaaaagacugucaaaugaacuuuua

SEQ ID NO: 33943 - RNA, 64 nt, hsa
gggaagaauuuaauggacugugaauuucaaaaaaaaaaaaaaagacugucaaaugaacuuuuac

SEQ ID NO: 33944 - RNA, 64 nt, hsa
ggaagaauuuaauggacugugaauuucaaaaaaaaaaaaaaagacugucaaaugaacuuuuaca

SEQ ID NO: 33945 - RNA, 64 nt, hsa
aaagacugucaaaugaacuuuuacagaaugcauuaaaaaaaaaaaaaaacuccugugucgguca

SEQ ID NO: 33946 - RNA, 64 nt, hsa
aagacugucaaaugaacuuuuacagaaugcauuaaaaaaaaaaaaaaacuccugugucggucag

SEQ ID NO: 33947 - RNA, 64 nt, hsa
agacugucaaaugaacuuuuacagaaugcauuaaaaaaaaaaaaaaacuccugugucggucaga

SEQ ID NO: 33948 - RNA, 64 nt, hsa
gacugucaaaugaacuuuuacagaaugcauuaaaaaaaaaaaaaaacuccugugucggucagaa

SEQ ID NO: 33949 - RNA, 64 nt, hsa
acugucaaaugaacuuuuacagaaugcauuaaaaaaaaaaaaaaacuccugugucggucagaac

SEQ ID NO: 33950 - RNA, 64 nt, hsa
cugucaaaugaacuuuuacagaaugcauuaaaaaaaaaaaaaaacuccugugucggucagaaca

SEQ ID NO: 33951 - RNA, 64 nt, hsa
ugucaaaugaacuuuuacagaaugcauuaaaaaaaaaaaaaaacuccugugucggucagaacaa

SEQ ID NO: 33952 - RNA, 64 nt, hsa
gucaaaugaacuuuuacagaaugcauuaaaaaaaaaaaaaaacuccugugucggucagaacaac

SEQ ID NO: 33953 - RNA, 63 nt, hsa
ggaaaacaaaaauaucuugcaagcagaaccuuggaaaaaaaaagccaugaacacuuauucuaa

SEQ ID NO: 33954 - RNA, 62 nt, hsa
gaaaacaaaaauaucuugcaagcagaaccuuggaaaaaaaaagccaugaacacuuauucuaa

SEQ ID NO: 33955 - RNA, 64 nt, hsa
acuugaaauauuuucauuaucauacuauucuuugaaaaaaaagaugcuuacuguauacuuguuu

SEQ ID NO: 33956 - RNA, 64 nt, hsa
auugaauaguacccaauuaaaguuccucaguaagaaaaaaaauguguuuuuguaggcaaaaaga

SEQ ID NO: 33957 - RNA, 64 nt, hsa
aaacaaaacaaaauaaaacaaaaaaaaggaaggaaaaaaaaagaaaaaauuuaaaaaauuuuaa

SEQ ID NO: 33958 - RNA, 64 nt, hsa
aaaacaaaacaaaauaaaacaaaaaaaaggaaggaaaaaaaaagaaaaaauuuaaaaaauuuua

SEQ ID NO: 33959 - RNA, 64 nt, hsa
gcaugcuguaaaacaaaacaaaacaaaauaaaacaaaaaaaaggaaggaaaaaaaaagaaaaaa

SEQ ID NO: 33960 - RNA, 64 nt, hsa
acagcuugaugcuguuucuacaucaaaaaaaaaaaaaaaaaagacagacuguuggucuuacuaa

SEQ ID NO: 33961 - RNA, 64 nt, hsa
aacagcuugaugcuguuucuacaucaaaaaaaaaaaaaaaaaagacagacuguuggucuuacua

SEQ ID NO: 33962 - RNA, 64 nt, hsa
aaacagcuugaugcuguuucuacaucaaaaaaaaaaaaaaaaaagacagacuguuggucuuacu

SEQ ID NO: 33963 - RNA, 64 nt, hsa
gaaacagcuugaugcuguuucuacaucaaaaaaaaaaaaaaaaaagacagacuguuggucuuac

SEQ ID NO: 33964 - RNA, 64 nt, hsa
agaaacagcuugaugcuguuucuacaucaaaaaaaaaaaaaaaaaagacagacuguuggucuua

SEQ ID NO: 33965 - RNA, 64 nt, hsa
gagaaacagcuugaugcuguuucuacaucaaaaaaaaaaaaaaaaaagacagacuguuggucuu

SEQ ID NO: 33966 - RNA, 64 nt, hsa
agagaaacagcuugaugcuguuucuacaucaaaaaaaaaaaaaaaaaagacagacuguuggucu

SEQ ID NO: 33967 - RNA, 64 nt, hsa
gagagaaacagcuugaugcuguuucuacaucaaaaaaaaaaaaaaaaaagacagacuguugguc

SEQ ID NO: 33968 - RNA, 64 nt, hsa
agagagaaacagcuugaugcuguuucuacaucaaaaaaaaaaaaaaaaaagacagacuguuggu

SEQ ID NO: 33969 - RNA, 64 nt, hsa
uagagagaaacagcuugaugcuguuucuacaucaaaaaaaaaaaaaaaaaagacagacuguugg

SEQ ID NO: 33970 - RNA, 64 nt, hsa
guagagagaaacagcuugaugcuguuucuacaucaaaaaaaaaaaaaaaaaagacagacuguug

SEQ ID NO: 33971 - RNA, 64 nt, hsa
aauacuuguaugaggacugugacguuauguuaaaaaaaaaaagguguuaagucacaaaaagcgg

SEQ ID NO: 33972 - RNA, 64 nt, hsa
aaauacuuguaugaggacugugacguuauguuaaaaaaaaaaagguguuaagucacaaaaagcg

SEQ ID NO: 33973 - RNA, 64 nt, hsa
aaaauacuuguaugaggacugugacguuauguuaaaaaaaaaaagguguuaagucacaaaaagc

SEQ ID NO: 33974 - RNA, 64 nt, hsa
uaaaauacuuguaugaggacugugacguuauguuaaaaaaaaaaagguguuaagucacaaaaag

SEQ ID NO: 33975 - RNA, 64 nt, hsa
auguuagauauucuauguguuuaccucaauugaaaaaaaaaagaauguuuuugcuaguaucaga

SEQ ID NO: 33976 - RNA, 64 nt, hsa
cauguuagauauucuauguguuuaccucaauugaaaaaaaaaagaauguuuuugcuaguaucag

SEQ ID NO: 33977 - RNA, 64 nt, hsa
ucauguuagauauucuauguguuuaccucaauugaaaaaaaaaagaauguuuuugcuaguauca

SEQ ID NO: 33978 - RNA, 64 nt, hsa
aaacaaucuuaaguugggcagcuuuccucaacacaaaaaaaaguuauuaauggucauugaacca

SEQ ID NO: 33979 - RNA, 64 nt, hsa
gccguuauguugccucaaauaguuuuagaagagaaaaaaaaauauauccuuguuuuccacacua

SEQ ID NO: 33980 - RNA, 64 nt, hsa
cgccguuauguugccucaaauaguuuuagaagagaaaaaaaaauauauccuuguuuuccacacu

SEQ ID NO: 33981 - RNA, 64 nt, hsa
uggggcuagugggaucacagaaaucuggaaaaaaaaaaaaaaggcuuuggcuuaucaagccuag

SEQ ID NO: 33982 - RNA, 64 nt, hsa
auggggcuagugggaucacagaaaucuggaaaaaaaaaaaaaaggcuuuggcuuaucaagccua

SEQ ID NO: 33983 - RNA, 64 nt, hsa
cauggggcuagugggaucacagaaaucuggaaaaaaaaaaaaaaggcuuuggcuuaucaagccu

SEQ ID NO: 33984 - RNA, 64 nt, hsa
acauggggcuagugggaucacagaaaucuggaaaaaaaaaaaaaaggcuuuggcuuaucaagcc

SEQ ID NO: 33985 - RNA, 64 nt, hsa
aacauggggcuagugggaucacagaaaucuggaaaaaaaaaaaaaaggcuuuggcuuaucaagc

SEQ ID NO: 33986 - RNA, 64 nt, hsa
caacauggggcuagugggaucacagaaaucuggaaaaaaaaaaaaaaggcuuuggcuuaucaag

SEQ ID NO: 33987 - RNA, 64 nt, hsa
gcaacauggggcuagugggaucacagaaaucuggaaaaaaaaaaaaaaggcuuuggcuuaucaa

SEQ ID NO: 33988 - RNA, 64 nt, hsa
ucauuugucagccucuuuuuaguucucuuaaaaaaaaaaaaaucauaugaucauuuuccuuuuu

SEQ ID NO: 33989 - RNA, 64 nt, hsa
uucauuugucagccucuuuuuaguucucuuaaaaaaaaaaaaaucauaugaucauuuuccuuuu

SEQ ID NO: 33990 - RNA, 64 nt, hsa
auucauuugucagccucuuuuuaguucucuuaaaaaaaaaaaaaucauaugaucauuuuccuuu

SEQ ID NO: 33991 - RNA, 64 nt, hsa
aauucauuugucagccucuuuuuaguucucuuaaaaaaaaaaaaaucauaugaucauuuuccuu

SEQ ID NO: 33992 - RNA, 64 nt, hsa
aaauucauuugucagccucuuuuuaguucucuuaaaaaaaaaaaaaucauaugaucauuuuccu

SEQ ID NO: 33993 - RNA, 64 nt, hsa
caaauucauuugucagccucuuuuuaguucucuuaaaaaaaaaaaaaucauaugaucauuuucc

SEQ ID NO: 33994 - RNA, 64 nt, hsa
cuacaguggauagaauuaggaauugauggcuuaaaaaaaaaagucuaugaagagucuguuuaac

SEQ ID NO: 33995 - RNA, 64 nt, hsa
ucuacaguggauagaauuaggaauugauggcuuaaaaaaaaaagucuaugaagagucuguuuaa

SEQ ID NO: 33996 - RNA, 64 nt, hsa
uucuacaguggauagaauuaggaauugauggcuuaaaaaaaaaagucuaugaagagucuguuua

SEQ ID NO: 33997 - RNA, 64 nt, hsa
gggcgacaagagugaaacuccaccucaaaaaaaaaaaaaaaagaguuaaucuaggagauaauga

SEQ ID NO: 33998 - RNA, 64 nt, hsa
ugggcgacaagagugaaacuccaccucaaaaaaaaaaaaaaaagaguuaaucuaggagauaaug

SEQ ID NO: 33999 - RNA, 64 nt, hsa
cugggcgacaagagugaaacuccaccucaaaaaaaaaaaaaaaagaguuaaucuaggagauaau

SEQ ID NO: 34000 - RNA, 64 nt, hsa
ccugggcgacaagagugaaacuccaccucaaaaaaaaaaaaaaaagaguuaaucuaggagauaa

SEQ ID NO: 34001 - RNA, 64 nt, hsa
gccugggcgacaagagugaaacuccaccucaaaaaaaaaaaaaaaagaguuaaucuaggagaua

SEQ ID NO: 34002 - RNA, 64 nt, hsa
agccugggcgacaagagugaaacuccaccucaaaaaaaaaaaaaaaagaguuaaucuaggagau

SEQ ID NO: 34003 - RNA, 64 nt, hsa
cagccugggcgacaagagugaaacuccaccucaaaaaaaaaaaaaaaagaguuaaucuaggaga

SEQ ID NO: 34004 - RNA, 64 nt, hsa
ccagccugggcgacaagagugaaacuccaccucaaaaaaaaaaaaaaaagaguuaaucuaggag

SEQ ID NO: 34005 - RNA, 64 nt, hsa
uccagccugggcgacaagagugaaacuccaccucaaaaaaaaaaaaaaaagaguuaaucuagga

SEQ ID NO: 34006 - RNA, 64 nt, hsa
uggugacagagugagacuccgucucaaaaaaaaaaaaaaaaacucagcuucuucagagagauaa

SEQ ID NO: 34007 - RNA, 64 nt, hsa
cuggugacagagugagacuccgucucaaaaaaaaaaaaaaaaacucagcuucuucagagagaua

SEQ ID NO: 34008 - RNA, 64 nt, hsa
ccuggugacagagugagacuccgucucaaaaaaaaaaaaaaaaacucagcuucuucagagagau

SEQ ID NO: 34009 - RNA, 64 nt, hsa
gccuggugacagagugagacuccgucucaaaaaaaaaaaaaaaaacucagcuucuucagagaga

SEQ ID NO: 34010 - RNA, 64 nt, hsa
agccuggugacagagugagacuccgucucaaaaaaaaaaaaaaaaacucagcuucuucagagag

SEQ ID NO: 34011 - RNA, 64 nt, hsa
cagccuggugacagagugagacuccgucucaaaaaaaaaaaaaaaaacucagcuucuucagaga

SEQ ID NO: 34012 - RNA, 64 nt, hsa
ccagccuggugacagagugagacuccgucucaaaaaaaaaaaaaaaaacucagcuucuucagag

SEQ ID NO: 34013 - RNA, 64 nt, hsa
uccagccuggugacagagugagacuccgucucaaaaaaaaaaaaaaaaacucagcuucuucaga

SEQ ID NO: 34014 - RNA, 64 nt, hsa
cuccagccuggugacagagugagacuccgucucaaaaaaaaaaaaaaaaacucagcuucuucag

SEQ ID NO: 34015 - RNA, 64 nt, hsa
acuccagccuggugacagagugagacuccgucucaaaaaaaaaaaaaaaaacucagcuucuuca

SEQ ID NO: 34016 - RNA, 64 nt, hsa
ucguauagauaugaucagacaaaaugcagaaggaaaaaaaaacauauugaaugaagcacuugga

SEQ ID NO: 34017 - RNA, 64 nt, hsa
cucguauagauaugaucagacaaaaugcagaaggaaaaaaaaacauauugaaugaagcacuugg

SEQ ID NO: 34018 - RNA, 64 nt, hsa
gcuaaaaagacaaaaaacaaaaaacaaaaaaaacaaaaaaaaccucaugagugcauggauuuaa

SEQ ID NO: 34019 - RNA, 64 nt, hsa
ccucuuccugcuaaaaagacaaaaaacaaaaaacaaaaaaaacaaaaaaaaccucaugagugca

SEQ ID NO: 34020 - RNA, 64 nt, hsa
cuucauguucuaugacuauagaaccauuugccaaaaaaaaaagcuuuucuugcuacaaaaaaua

SEQ ID NO: 34021 - RNA, 64 nt, hsa
ucuucauguucuaugacuauagaaccauuugccaaaaaaaaaagcuuuucuugcuacaaaaaau

SEQ ID NO: 34022 - RNA, 64 nt, hsa
aucuucauguucuaugacuauagaaccauuugccaaaaaaaaaagcuuuucuugcuacaaaaaa

SEQ ID NO: 34023 - RNA, 64 nt, hsa
uuaaguauuauuagggcccugugucugcuguagaaaaaaaaauucacaugaugcacuucaaauu

SEQ ID NO: 34024 - RNA, 64 nt, hsa
guuaaguauuauuagggcccugugucugcuguagaaaaaaaaauucacaugaugcacuucaaau

SEQ ID NO: 34025 - RNA, 64 nt, hsa
cugggugacaaagcgagacuccgucucaaaaaaaaaaaaaaauuauauucauauguauugcauu

SEQ ID NO: 34026 - RNA, 64 nt, hsa
ccugggugacaaagcgagacuccgucucaaaaaaaaaaaaaaauuauauucauauguauugcau

SEQ ID NO: 34027 - RNA, 64 nt, hsa
gccugggugacaaagcgagacuccgucucaaaaaaaaaaaaaaauuauauucauauguauugca

SEQ ID NO: 34028 - RNA, 64 nt, hsa
agccugggugacaaagcgagacuccgucucaaaaaaaaaaaaaaauuauauucauauguauugc

SEQ ID NO: 34029 - RNA, 64 nt, hsa
cagccugggugacaaagcgagacuccgucucaaaaaaaaaaaaaaauuauauucauauguauug

SEQ ID NO: 34030 - RNA, 64 nt, hsa
gcagccugggugacaaagcgagacuccgucucaaaaaaaaaaaaaaauuauauucauauguauu

SEQ ID NO: 34031 - RNA, 64 nt, hsa
ugcagccugggugacaaagcgagacuccgucucaaaaaaaaaaaaaaauuauauucauauguau

SEQ ID NO: 34032 - RNA, 64 nt, hsa
cugcagccugggugacaaagcgagacuccgucucaaaaaaaaaaaaaaauuauauucauaugua

SEQ ID NO: 34033 - RNA, 64 nt, hsa
aagauagcagguuuauacuuagaaauauuugaagaaaaaaaagcguuauuuauaguccaaagaa

SEQ ID NO: 34034 - RNA, 64 nt, hsa
acaaacuaaaaccucgguggaaaagcuuuaaauuaaaaaaaauuuuuaaaagaccaggaccuca

SEQ ID NO: 34035 - RNA, 64 nt, hsa
uucugaaaacauuccuucauaguucaguuaguuaaaaaaaaacaaacauuuuuuccuauuacaa

SEQ ID NO: 34036 - RNA, 64 nt, hsa
auucugaaaacauuccuucauaguucaguuaguuaaaaaaaaacaaacauuuuuuccuauuaca

SEQ ID NO: 34037 - RNA, 64 nt, hsa
aaaaaagaagagaaaagaucgucugagaaaucugaaaaaaaagaaagcaaggauacuaagaaaa

SEQ ID NO: 34038 - RNA, 64 nt, hsa
ugaugaaaagaguaguucaagaaguucuggagauaaaaaaaauacgagugauagaaguagcaag

SEQ ID NO: 34039 - RNA, 64 nt, hsa
cacugucaucuaaaagcaggccaccaaauuuaaaaaaaaaaaguuaugggaaaaaauuuauggg

SEQ ID NO: 34040 - RNA, 64 nt, hsa
ucacugucaucuaaaagcaggccaccaaauuuaaaaaaaaaaaguuaugggaaaaaauuuaugg

SEQ ID NO: 34041 - RNA, 64 nt, hsa
aucacugucaucuaaaagcaggccaccaaauuuaaaaaaaaaaaguuaugggaaaaaauuuaug

SEQ ID NO: 34042 - RNA, 64 nt, hsa
gaucacugucaucuaaaagcaggccaccaaauuuaaaaaaaaaaaguuaugggaaaaaauuuau

SEQ ID NO: 34043 - RNA, 64 nt, hsa
gugacagagcgagacuccaucucaaaaaaaaaaaaaaaaaaauuauucuguaccaucacaacuu

SEQ ID NO: 34044 - RNA, 64 nt, hsa
ggugacagagcgagacuccaucucaaaaaaaaaaaaaaaaaaauuauucuguaccaucacaacu

SEQ ID NO: 34045 - RNA, 64 nt, hsa
gggugacagagcgagacuccaucucaaaaaaaaaaaaaaaaaaauuauucuguaccaucacaac

SEQ ID NO: 34046 - RNA, 64 nt, hsa
ugggugacagagcgagacuccaucucaaaaaaaaaaaaaaaaaaauuauucuguaccaucacaa

SEQ ID NO: 34047 - RNA, 64 nt, hsa
cugggugacagagcgagacuccaucucaaaaaaaaaaaaaaaaaaauuauucuguaccaucaca

SEQ ID NO: 34048 - RNA, 64 nt, hsa
ccugggugacagagcgagacuccaucucaaaaaaaaaaaaaaaaaaauuauucuguaccaucac

SEQ ID NO: 34049 - RNA, 64 nt, hsa
gccugggugacagagcgagacuccaucucaaaaaaaaaaaaaaaaaaauuauucuguaccauca

SEQ ID NO: 34050 - RNA, 64 nt, hsa
agccugggugacagagcgagacuccaucucaaaaaaaaaaaaaaaaaaauuauucuguaccauc

SEQ ID NO: 34051 - RNA, 64 nt, hsa
uagccugggugacagagcgagacuccaucucaaaaaaaaaaaaaaaaaaauuauucuguaccau

SEQ ID NO: 34052 - RNA, 64 nt, hsa
cuagccugggugacagagcgagacuccaucucaaaaaaaaaaaaaaaaaaauuauucuguacca

SEQ ID NO: 34053 - RNA, 64 nt, hsa
ucuagccugggugacagagcgagacuccaucucaaaaaaaaaaaaaaaaaaauuauucuguacc

SEQ ID NO: 34054 - RNA, 64 nt, hsa
cucuagccugggugacagagcgagacuccaucucaaaaaaaaaaaaaaaaaaauuauucuguac

SEQ ID NO: 34055 - RNA, 64 nt, hsa
agucugggugacagagagagaccauauccaaaaaaaaaaaaaguugccagagacgaguaugccc

SEQ ID NO: 34056 - RNA, 64 nt, hsa
cagucugggugacagagagagaccauauccaaaaaaaaaaaaaguugccagagacgaguaugcc

SEQ ID NO: 34057 - RNA, 64 nt, hsa
ccagucugggugacagagagagaccauauccaaaaaaaaaaaaaguugccagagacgaguaugc

SEQ ID NO: 34058 - RNA, 64 nt, hsa
uccagucugggugacagagagagaccauauccaaaaaaaaaaaaaguugccagagacgaguaug

SEQ ID NO: 34059 - RNA, 64 nt, hsa
cuccagucugggugacagagagagaccauauccaaaaaaaaaaaaaguugccagagacgaguau

SEQ ID NO: 34060 - RNA, 64 nt, hsa
acuccagucugggugacagagagagaccauauccaaaaaaaaaaaaaguugccagagacgagua

SEQ ID NO: 34061 - RNA, 64 nt, hsa
uuuuguaacaaacuccuaccaacacugaccaauaaaaaaaaauguggguuuuuuuuuuuuuaau

SEQ ID NO: 34062 - RNA, 64 nt, hsa
cuuuuguaacaaacuccuaccaacacugaccaauaaaaaaaaauguggguuuuuuuuuuuuuaa

SEQ ID NO: 34063 - RNA, 64 nt, hsa
aaacagcucaucccagagaaggagaugcuuaacaaaaaaaaauugaaauuguuucccaugcugc

SEQ ID NO: 34064 - RNA, 64 nt, hsa
gaaacagcucaucccagagaaggagaugcuuaacaaaaaaaaauugaaauuguuucccaugcug

SEQ ID NO: 34065 - RNA, 64 nt, hsa
agaaaacugacuuuguugcacuuuuaguuuuuuuaaaaaaaacaaaaacaaaaacauggcagau

SEQ ID NO: 34066 - RNA, 64 nt, hsa
gccugggagacagagcaagacuccgucucaaaaaaaaaaaaaguaaaauuuauuuuuuauauuc

SEQ ID NO: 34067 - RNA, 64 nt, hsa
agccugggagacagagcaagacuccgucucaaaaaaaaaaaaaguaaaauuuauuuuuuauauu

SEQ ID NO: 34068 - RNA, 64 nt, hsa
cagccugggagacagagcaagacuccgucucaaaaaaaaaaaaaguaaaauuuauuuuuuauau

SEQ ID NO: 34069 - RNA, 64 nt, hsa
ccagccugggagacagagcaagacuccgucucaaaaaaaaaaaaaguaaaauuuauuuuuuaua

SEQ ID NO: 34070 - RNA, 64 nt, hsa
uccagccugggagacagagcaagacuccgucucaaaaaaaaaaaaaguaaaauuuauuuuuuau

SEQ ID NO: 34071 - RNA, 64 nt, hsa
cuccagccugggagacagagcaagacuccgucucaaaaaaaaaaaaaguaaaauuuauuuuuua

SEQ ID NO: 34072 - RNA, 64 nt, hsa
aacauuuuucuuuaaaaagcaaaacuuaaaaaaaaaaaaaaagaggagagagauagaggaaggu

SEQ ID NO: 34073 - RNA, 64 nt, hsa
uaacauuuuucuuuaaaaagcaaaacuuaaaaaaaaaaaaaaagaggagagagauagaggaagg

SEQ ID NO: 34074 - RNA, 64 nt, hsa
cuaacauuuuucuuuaaaaagcaaaacuuaaaaaaaaaaaaaaagaggagagagauagaggaag

SEQ ID NO: 34075 - RNA, 64 nt, hsa
acuaacauuuuucuuuaaaaagcaaaacuuaaaaaaaaaaaaaaagaggagagagauagaggaa

SEQ ID NO: 34076 - RNA, 64 nt, hsa
aacuaacauuuuucuuuaaaaagcaaaacuuaaaaaaaaaaaaaaagaggagagagauagagga

SEQ ID NO: 34077 - RNA, 64 nt, hsa
gaacuaacauuuuucuuuaaaaagcaaaacuuaaaaaaaaaaaaaaagaggagagagauagagg

SEQ ID NO: 34078 - RNA, 64 nt, hsa
ugaacuaacauuuuucuuuaaaaagcaaaacuuaaaaaaaaaaaaaaagaggagagagauagag

SEQ ID NO: 34079 - RNA, 64 nt, hsa
cugaacuaacauuuuucuuuaaaaagcaaaacuuaaaaaaaaaaaaaaagaggagagagauaga

SEQ ID NO: 34080 - RNA, 64 nt, hsa
uuuugcugguuugauuuuuuuuuuuuaaagaagaaaaaaaaacugcccugaauuaaauggcugu

SEQ ID NO: 34081 - RNA, 64 nt, hsa
auuuugcugguuugauuuuuuuuuuuuaaagaagaaaaaaaaacugcccugaauuaaauggcug

SEQ ID NO: 34082 - RNA, 64 nt, hsa
uuuucuauaauaaacauggauuaccuguguuuaaaaaaaaaagugugaauggcguuaggguaag

SEQ ID NO: 34083 - RNA, 64 nt, hsa
uuuuucuauaauaaacauggauuaccuguguuuaaaaaaaaaagugugaauggcguuaggguaa

SEQ ID NO: 34084 - RNA, 64 nt, hsa
auuuuucuauaauaaacauggauuaccuguguuuaaaaaaaaaagugugaauggcguuagggua

SEQ ID NO: 34085 - RNA, 64 nt, hsa
gagggacagggaauuuuuucccccucuauguacaaaaaaaaacaaagcucucuuuccuucucug

SEQ ID NO: 34086 - RNA, 64 nt, hsa
ggagggacagggaauuuuuucccccucuauguacaaaaaaaaacaaagcucucuuuccuucucu

SEQ ID NO: 34087 - RNA, 64 nt, hsa
cagacacccuggucacccaggacagagcggaaaaaaaaaaaagaggucaggguuuuaacgagcu

SEQ ID NO: 34088 - RNA, 64 nt, hsa
gcagacacccuggucacccaggacagagcggaaaaaaaaaaaagaggucaggguuuuaacgagc

SEQ ID NO: 34089 - RNA, 64 nt, hsa
ggcagacacccuggucacccaggacagagcggaaaaaaaaaaaagaggucaggguuuuaacgag

SEQ ID NO: 34090 - RNA, 64 nt, hsa
uggcagacacccuggucacccaggacagagcggaaaaaaaaaaaagaggucaggguuuuaacga

SEQ ID NO: 34091 - RNA, 64 nt, hsa
cuggcagacacccuggucacccaggacagagcggaaaaaaaaaaaagaggucaggguuuuaacg

SEQ ID NO: 34092 - RNA, 64 nt, hsa
acaccacaaauauauccuguggcccuuucagcaaaaaaaaaaccuuaaccaggaagggggccug

SEQ ID NO: 34093 - RNA, 64 nt, hsa
uacaccacaaauauauccuguggcccuuucagcaaaaaaaaaaccuuaaccaggaagggggccu

SEQ ID NO: 34094 - RNA, 64 nt, hsa
uuacaccacaaauauauccuguggcccuuucagcaaaaaaaaaaccuuaaccaggaagggggcc

SEQ ID NO: 34095 - RNA, 64 nt, hsa
uacuuauuuuccacuuaucuuggaaucaugcaaaaaaaaaaaugucaagaguauuuauuaccga

SEQ ID NO: 34096 - RNA, 64 nt, hsa
uuacuuauuuuccacuuaucuuggaaucaugcaaaaaaaaaaaugucaagaguauuuauuaccg

SEQ ID NO: 34097 - RNA, 64 nt, hsa
uuuacuuauuuuccacuuaucuuggaaucaugcaaaaaaaaaaaugucaagaguauuuauuacc

SEQ ID NO: 34098 - RNA, 64 nt, hsa
guuuacuuauuuuccacuuaucuuggaaucaugcaaaaaaaaaaaugucaagaguauuuauuac

SEQ ID NO: 34099 - RNA, 64 nt, hsa
auuuugcagaugaaaagcggggaaaaaaaaaaaaaaaaaaaagguauugacacggaugccuaca

SEQ ID NO: 34100 - RNA, 64 nt, hsa
cauuuugcagaugaaaagcggggaaaaaaaaaaaaaaaaaaaagguauugacacggaugccuac

SEQ ID NO: 34101 - RNA, 64 nt, hsa
ucauuuugcagaugaaaagcggggaaaaaaaaaaaaaaaaaaaagguauugacacggaugccua

SEQ ID NO: 34102 - RNA, 64 nt, hsa
cucauuuugcagaugaaaagcggggaaaaaaaaaaaaaaaaaaaaaacuacguguccagaaggu

SEQ ID NO: 34103 - RNA, 64 nt, hsa
ccucauuuugcagaugaaaagcggggaaaaaaaaaaaaaaaaaaaaaacuacguguccagaagg

SEQ ID NO: 34104 - RNA, 64 nt, hsa
uccucauuuugcagaugaaaagcggggaaaaaaaaaaaaaaaaaaaaaacuacguguccagaag

SEQ ID NO: 34105 - RNA, 64 nt, hsa
uuccucauuuugcagaugaaaagcggggaaaaaaaaaaaaaaaaaaaaaacuacguguccagaa

SEQ ID NO: 34106 - RNA, 64 nt, hsa
guuccucauuuugcagaugaaaagcggggaaaaaaaaaaaaaaaaaaaaaacuacguguccaga

SEQ ID NO: 34107 - RNA, 64 nt, hsa
aguuccucauuuugcagaugaaaagcggggaaaaaaaaaaaaaaaaaaaaaacuacguguccag

SEQ ID NO: 34108 - RNA, 64 nt, hsa
uaguuccucauuuugcagaugaaaagcggggaaaaaaaaaaaaaaaaaaaaaacuacgugucca

SEQ ID NO: 34109 - RNA, 64 nt, hsa
uuaguuccucauuuugcagaugaaaagcggggaaaaaaaaaaaaaaaaaaaaaacuacgugucc

SEQ ID NO: 34110 - RNA, 64 nt, hsa
uuuaguuccucauuuugcagaugaaaagcggggaaaaaaaaaaaaaaaaaaaaaacuacguguc

SEQ ID NO: 34111 - RNA, 64 nt, hsa
uuuuaguuccucauuuugcagaugaaaagcggggaaaaaaaaaaaaaaaaaaaaaacuacgugu

SEQ ID NO: 34112 - RNA, 64 nt, hsa
gggagacuuuaggaucuuaaaaaaccauuuaauaaaaaaaaaucuuugaagggacaaaugggaa

SEQ ID NO: 34113 - RNA, 64 nt, hsa
ugggagacuuuaggaucuuaaaaaaccauuuaauaaaaaaaaaucuuugaagggacaaauggga

SEQ ID NO: 34114 - RNA, 64 nt, hsa
cagccuagacaacauacuacgacccugucuauacaaaaaaaaacuucucuaaauuagccggaug

SEQ ID NO: 34115 - RNA, 64 nt, hsa
agccuagacaacauacuacgacccugucuauacaaaaaaaaacuucucuaaauuagccggaugu

SEQ ID NO: 34116 - RNA, 64 nt, hsa
acuguacuccugggcaacagcgagacuccgucucaaaaaaaaaaaaaaaaaaagaaaccauuua

SEQ ID NO: 34117 - RNA, 64 nt, hsa
cuguacuccugggcaacagcgagacuccgucucaaaaaaaaaaaaaaaaaaagaaaccauuuau

SEQ ID NO: 34118 - RNA, 64 nt, hsa
uguacuccugggcaacagcgagacuccgucucaaaaaaaaaaaaaaaaaaagaaaccauuuauu

SEQ ID NO: 34119 - RNA, 64 nt, hsa
guacuccugggcaacagcgagacuccgucucaaaaaaaaaaaaaaaaaaagaaaccauuuauuu

SEQ ID NO: 34120 - RNA, 64 nt, hsa
uacuccugggcaacagcgagacuccgucucaaaaaaaaaaaaaaaaaaagaaaccauuuauuuu

SEQ ID NO: 34121 - RNA, 64 nt, hsa
acuccugggcaacagcgagacuccgucucaaaaaaaaaaaaaaaaaaagaaaccauuuauuuua

SEQ ID NO: 34122 - RNA, 64 nt, hsa
cuccugggcaacagcgagacuccgucucaaaaaaaaaaaaaaaaaaagaaaccauuuauuuuaa

SEQ ID NO: 34123 - RNA, 64 nt, hsa
uccugggcaacagcgagacuccgucucaaaaaaaaaaaaaaaaaaagaaaccauuuauuuuaaa

SEQ ID NO: 34124 - RNA, 64 nt, hsa
ccugggcaacagcgagacuccgucucaaaaaaaaaaaaaaaaaaagaaaccauuuauuuuaaaa

SEQ ID NO: 34125 - RNA, 64 nt, hsa
cugggcaacagcgagacuccgucucaaaaaaaaaaaaaaaaaaagaaaccauuuauuuuaaaaa

SEQ ID NO: 34126 - RNA, 64 nt, hsa
ugggcaacagcgagacuccgucucaaaaaaaaaaaaaaaaaaagaaaccauuuauuuuaaaaau

SEQ ID NO: 34127 - RNA, 64 nt, hsa
gggcaacagcgagacuccgucucaaaaaaaaaaaaaaaaaaagaaaccauuuauuuuaaaaaug

SEQ ID NO: 34128 - RNA, 64 nt, hsa
aauacaugcaguaguacaucauuuuagcaacucuaaaaaaaaaaaaaauacaaauaaaaaggaa

SEQ ID NO: 34129 - RNA, 64 nt, hsa
auacaugcaguaguacaucauuuuagcaacucuaaaaaaaaaaaaaauacaaauaaaaaggaaa

SEQ ID NO: 34130 - RNA, 64 nt, hsa
uacaugcaguaguacaucauuuuagcaacucuaaaaaaaaaaaaaauacaaauaaaaaggaaaa

SEQ ID NO: 34131 - RNA, 64 nt, hsa
acaugcaguaguacaucauuuuagcaacucuaaaaaaaaaaaaaauacaaauaaaaaggaaaaa

SEQ ID NO: 34132 - RNA, 64 nt, hsa
caugcaguaguacaucauuuuagcaacucuaaaaaaaaaaaaaauacaaauaaaaaggaaaaaa

SEQ ID NO: 34133 - RNA, 64 nt, hsa
augcaguaguacaucauuuuagcaacucuaaaaaaaaaaaaaauacaaauaaaaaggaaaaaaa

SEQ ID NO: 34134 - RNA, 64 nt, hsa
ugcaguaguacaucauuuuagcaacucuaaaaaaaaaaaaaauacaaauaaaaaggaaaaaaaa

SEQ ID NO: 34135 - RNA, 64 nt, hsa
aacucuaaaaaaaaaaaaaauacaaauaaaaaggaaaaaaaauuacauuuuuuaucuuauaccu

SEQ ID NO: 34136 - RNA, 64 nt, hsa
gcuuaggggauuggaacugggguuuggcugaaagaaaaaaaaaaaaauguaacugaugaaucua

SEQ ID NO: 34137 - RNA, 64 nt, hsa
cuuaggggauuggaacugggguuuggcugaaagaaaaaaaaaaaaauguaacugaugaaucuaa

SEQ ID NO: 34138 - RNA, 64 nt, hsa
uuaggggauuggaacugggguuuggcugaaagaaaaaaaaaaaaauguaacugaugaaucuaaa

SEQ ID NO: 34139 - RNA, 64 nt, hsa
uaggggauuggaacugggguuuggcugaaagaaaaaaaaaaaaauguaacugaugaaucuaaac

SEQ ID NO: 34140 - RNA, 64 nt, hsa
aggggauuggaacugggguuuggcugaaagaaaaaaaaaaaaauguaacugaugaaucuaaacg

SEQ ID NO: 34141 - RNA, 64 nt, hsa
ggggauuggaacugggguuuggcugaaagaaaaaaaaaaaaauguaacugaugaaucuaaacga

SEQ ID NO: 34142 - RNA, 64 nt, hsa
caguauucagcuucuuaaccagucgcuauuuaggaaaaaaaacccacuaguuaggccaucaaca

SEQ ID NO: 34143 - RNA, 64 nt, hsa
aaaguaauaaaaacuuaaauucuuuguaccaguuaaaaaaaauguauaaaauuuacaucugugc

SEQ ID NO: 34144 - RNA, 64 nt, hsa
aacucugcuuuaaaacaaaaccaaacaaaacuuuaaaaaaaaaugugugauccagcuuucucuu

SEQ ID NO: 34145 - RNA, 64 nt, hsa
acucugcuuuaaaacaaaaccaaacaaaacuuuaaaaaaaaaugugugauccagcuuucucuug

SEQ ID NO: 34146 - RNA, 64 nt, hsa
cacaaguaaucuguugacagugccaauaaaugauaaaaaaaaaauuaacaugucacaauguaac

SEQ ID NO: 34147 - RNA, 64 nt, hsa
acaaguaaucuguugacagugccaauaaaugauaaaaaaaaaauuaacaugucacaauguaacg

SEQ ID NO: 34148 - RNA, 64 nt, hsa
caaguaaucuguugacagugccaauaaaugauaaaaaaaaaauuaacaugucacaauguaacgg

SEQ ID NO: 34149 - RNA, 64 nt, hsa
cuccagccugggcaaaaagagcaaaacucucccuaaaaaaaaaauguagaauaucucuuaagau

SEQ ID NO: 34150 - RNA, 64 nt, hsa
uccagccugggcaaaaagagcaaaacucucccuaaaaaaaaaauguagaauaucucuuaagauu

SEQ ID NO: 34151 - RNA, 64 nt, hsa
ccagccugggcaaaaagagcaaaacucucccuaaaaaaaaaauguagaauaucucuuaagauuu

SEQ ID NO: 34152 - RNA, 64 nt, hsa
ugagggcugcagggaaggcagcuuucauuuguuuaaaaaaaaaaaaaaaagacggaaaaaaaug

SEQ ID NO: 34153 - RNA, 64 nt, hsa
gagggcugcagggaaggcagcuuucauuuguuuaaaaaaaaaaaaaaaagacggaaaaaaaugu

SEQ ID NO: 34154 - RNA, 64 nt, hsa
agggcugcagggaaggcagcuuucauuuguuuaaaaaaaaaaaaaaaagacggaaaaaaaugug

SEQ ID NO: 34155 - RNA, 64 nt, hsa
gggcugcagggaaggcagcuuucauuuguuuaaaaaaaaaaaaaaaagacggaaaaaaaugugu

SEQ ID NO: 34156 - RNA, 64 nt, hsa
ggcugcagggaaggcagcuuucauuuguuuaaaaaaaaaaaaaaaagacggaaaaaaauguguc

SEQ ID NO: 34157 - RNA, 64 nt, hsa
gcugcagggaaggcagcuuucauuuguuuaaaaaaaaaaaaaaaagacggaaaaaaauguguca

SEQ ID NO: 34158 - RNA, 64 nt, hsa
cugcagggaaggcagcuuucauuuguuuaaaaaaaaaaaaaaaagacggaaaaaaaugugucac

SEQ ID NO: 34159 - RNA, 64 nt, hsa
ugcagggaaggcagcuuucauuuguuuaaaaaaaaaaaaaaaagacggaaaaaaaugugucaca

SEQ ID NO: 34160 - RNA, 64 nt, hsa
gcagggaaggcagcuuucauuuguuuaaaaaaaaaaaaaaaagacggaaaaaaaugugucacau

SEQ ID NO: 34161 - RNA, 64 nt, hsa
cuccagucggguuaacagagcaagacacugucucaaaaaaaaaaaaaaaaaaaaguaucaacca

SEQ ID NO: 34162 - RNA, 64 nt, hsa
uccagucggguuaacagagcaagacacugucucaaaaaaaaaaaaaaaaaaaaguaucaaccaa

SEQ ID NO: 34163 - RNA, 64 nt, hsa
ccagucggguuaacagagcaagacacugucucaaaaaaaaaaaaaaaaaaaaguaucaaccaac

SEQ ID NO: 34164 - RNA, 64 nt, hsa
cagucggguuaacagagcaagacacugucucaaaaaaaaaaaaaaaaaaaaguaucaaccaaca

SEQ ID NO: 34165 - RNA, 64 nt, hsa
agucggguuaacagagcaagacacugucucaaaaaaaaaaaaaaaaaaaaguaucaaccaacaa

SEQ ID NO: 34166 - RNA, 64 nt, hsa
gucggguuaacagagcaagacacugucucaaaaaaaaaaaaaaaaaaaaguaucaaccaacaaa

SEQ ID NO: 34167 - RNA, 64 nt, hsa
ucggguuaacagagcaagacacugucucaaaaaaaaaaaaaaaaaaaaguaucaaccaacaaau

SEQ ID NO: 34168 - RNA, 64 nt, hsa
cggguuaacagagcaagacacugucucaaaaaaaaaaaaaaaaaaaaguaucaaccaacaaaug

SEQ ID NO: 34169 - RNA, 64 nt, hsa
ggguuaacagagcaagacacugucucaaaaaaaaaaaaaaaaaaaaguaucaaccaacaaaugu

SEQ ID NO: 34170 - RNA, 64 nt, hsa
gguuaacagagcaagacacugucucaaaaaaaaaaaaaaaaaaaaguaucaaccaacaaauguu

SEQ ID NO: 34171 - RNA, 64 nt, hsa
guuaacagagcaagacacugucucaaaaaaaaaaaaaaaaaaaaguaucaaccaacaaauguua

SEQ ID NO: 34172 - RNA, 64 nt, hsa
uuaacagagcaagacacugucucaaaaaaaaaaaaaaaaaaaaguaucaaccaacaaauguuac

SEQ ID NO: 34173 - RNA, 64 nt, hsa
uaacagagcaagacacugucucaaaaaaaaaaaaaaaaaaaaguaucaaccaacaaauguuacc

SEQ ID NO: 34174 - RNA, 64 nt, hsa
gcuguuaauuuuuucacucaugugaaacaaaaugaaaaaaaaaauccaaaacagaacaagcccu

SEQ ID NO: 34175 - RNA, 64 nt, hsa
cuguuaauuuuuucacucaugugaaacaaaaugaaaaaaaaaauccaaaacagaacaagcccuu

SEQ ID NO: 34176 - RNA, 64 nt, hsa
uguuaauuuuuucacucaugugaaacaaaaugaaaaaaaaaauccaaaacagaacaagcccuuc

SEQ ID NO: 34177 - RNA, 64 nt, hsa
cuuugggguuuuguuucuguuguuguucaaaugcaaaaaaaagaaaaaaaaagaaaaaaaaagg

SEQ ID NO: 34178 - RNA, 64 nt, hsa
uuuguuucuguuguuguucaaaugcaaaaaaaagaaaaaaaaagaaaaaaaaaggugacucaca

SEQ ID NO: 34179 - RNA, 64 nt, hsa
uuguuucuguuguuguucaaaugcaaaaaaaagaaaaaaaaagaaaaaaaaaggugacucacau

SEQ ID NO: 34180 - RNA, 64 nt, hsa
uuguuguucaaaugcaaaaaaaagaaaaaaaaagaaaaaaaaaggugacucacauuguuacaca

SEQ ID NO: 34181 - RNA, 64 nt, hsa
uguuguucaaaugcaaaaaaaagaaaaaaaaagaaaaaaaaaggugacucacauuguuacacau

SEQ ID NO: 34182 - RNA, 64 nt, hsa
augugccauuuuucuucuagcaucgagauacaauaaaaaaaaaaaaaaagaaaagaagaagaaa

SEQ ID NO: 34183 - RNA, 64 nt, hsa
ugugccauuuuucuucuagcaucgagauacaauaaaaaaaaaaaaaaagaaaagaagaagaaau

SEQ ID NO: 34184 - RNA, 64 nt, hsa
gugccauuuuucuucuagcaucgagauacaauaaaaaaaaaaaaaaagaaaagaagaagaaaua

SEQ ID NO: 34185 - RNA, 64 nt, hsa
ugccauuuuucuucuagcaucgagauacaauaaaaaaaaaaaaaaagaaaagaagaagaaauac

SEQ ID NO: 34186 - RNA, 64 nt, hsa
gccauuuuucuucuagcaucgagauacaauaaaaaaaaaaaaaaagaaaagaagaagaaauacu

SEQ ID NO: 34187 - RNA, 64 nt, hsa
ccauuuuucuucuagcaucgagauacaauaaaaaaaaaaaaaaagaaaagaagaagaaauacua

SEQ ID NO: 34188 - RNA, 64 nt, hsa
cauuuuucuucuagcaucgagauacaauaaaaaaaaaaaaaaagaaaagaagaagaaauacuau

SEQ ID NO: 34189 - RNA, 63 nt, hsa
auuuuucuucuagcaucgagauacaauaaaaaaaaaaaaaaagaaaagaagaagaaauacuau

SEQ ID NO: 34190 - RNA, 64 nt, hsa
ucuuguuuacagauuuuuuuguuuguuuuuugagaaaaaaaaauguuuacucuuccaucauuua

SEQ ID NO: 34191 - RNA, 64 nt, hsa
cuuguuuacagauuuuuuuguuuguuuuuugagaaaaaaaaauguuuacucuuccaucauuuaa

SEQ ID NO: 34192 - RNA, 64 nt, hsa
uugagaaaaaaaaauguuuacucuuccaucauuuaaaaaaaauguaaaagacaaaaaaaaaaug

SEQ ID NO: 34193 - RNA, 64 nt, hsa
uacucuuccaucauuuaaaaaaaauguaaaagacaaaaaaaaaauggaggaugauuuaaaagau

SEQ ID NO: 34194 - RNA, 64 nt, hsa
acucuuccaucauuuaaaaaaaauguaaaagacaaaaaaaaaauggaggaugauuuaaaagaug

SEQ ID NO: 34195 - RNA, 64 nt, hsa
cucuuccaucauuuaaaaaaaauguaaaagacaaaaaaaaaauggaggaugauuuaaaagaugc

SEQ ID NO: 34196 - RNA, 64 nt, hsa
agcaugguucucaggaaaaccaguuccccaguuuaaaaaaaaaaaaaaaaauuccuuguaguuu

SEQ ID NO: 34197 - RNA, 64 nt, hsa
gcaugguucucaggaaaaccaguuccccaguuuaaaaaaaaaaaaaaaaauuccuuguaguuuc

SEQ ID NO: 34198 - RNA, 64 nt, hsa
caugguucucaggaaaaccaguuccccaguuuaaaaaaaaaaaaaaaaauuccuuguaguuucu

SEQ ID NO: 34199 - RNA, 64 nt, hsa
augguucucaggaaaaccaguuccccaguuuaaaaaaaaaaaaaaaaauuccuuguaguuucuu

SEQ ID NO: 34200 - RNA, 64 nt, hsa
ugguucucaggaaaaccaguuccccaguuuaaaaaaaaaaaaaaaaauuccuuguaguuucuua

SEQ ID NO: 34201 - RNA, 64 nt, hsa
gguucucaggaaaaccaguuccccaguuuaaaaaaaaaaaaaaaaauuccuuguaguuucuuag

SEQ ID NO: 34202 - RNA, 64 nt, hsa
guucucaggaaaaccaguuccccaguuuaaaaaaaaaaaaaaaaauuccuuguaguuucuuaga

SEQ ID NO: 34203 - RNA, 64 nt, hsa
uucucaggaaaaccaguuccccaguuuaaaaaaaaaaaaaaaaauuccuuguaguuucuuagag

SEQ ID NO: 34204 - RNA, 64 nt, hsa
ucucaggaaaaccaguuccccaguuuaaaaaaaaaaaaaaaaauuccuuguaguuucuuagagg

SEQ ID NO: 34205 - RNA, 64 nt, hsa
cucaggaaaaccaguuccccaguuuaaaaaaaaaaaaaaaaauuccuuguaguuucuuagagga

SEQ ID NO: 34206 - RNA, 64 nt, hsa
uagccugggcaacauagcgagaccucgucucuacaaaaaaaaauuaaaaagggggcuuugggag

SEQ ID NO: 34207 - RNA, 64 nt, hsa
agccugggcaacauagcgagaccucgucucuacaaaaaaaaauuaaaaagggggcuuugggagg

SEQ ID NO: 34208 - RNA, 64 nt, hsa
cacuccagccuggcgacagagcaaggcuccacucaaaaaaaagauuuaaaggggaaaaaauuga

SEQ ID NO: 34209 - RNA, 64 nt, hsa
cacaucagccugagugacagagagacuuugucucaaaaaaaaaagaaaauuuuaauuuuaaugu

SEQ ID NO: 34210 - RNA, 64 nt, hsa
acaucagccugagugacagagagacuuugucucaaaaaaaaaagaaaauuuuaauuuuaaugua

SEQ ID NO: 34211 - RNA, 64 nt, hsa
caucagccugagugacagagagacuuugucucaaaaaaaaaagaaaauuuuaauuuuaauguag

SEQ ID NO: 34212 - RNA, 64 nt, hsa
acuccagccuggcugacagagcgagacugucucuaaaaaaaaaagacucaaguggacccuacaa

SEQ ID NO: 34213 - RNA, 64 nt, hsa
cuccagccuggcugacagagcgagacugucucuaaaaaaaaaagacucaaguggacccuacaau

SEQ ID NO: 34214 - RNA, 64 nt, hsa
uccagccuggcugacagagcgagacugucucuaaaaaaaaaagacucaaguggacccuacaaug

SEQ ID NO: 34215 - RNA, 64 nt, hsa
gauggaugacauaaaaauguaaacaucuccacacaaaaaaaaaaaugucuuaaccaaccgaaaa

SEQ ID NO: 34216 - RNA, 64 nt, hsa
auggaugacauaaaaauguaaacaucuccacacaaaaaaaaaaaugucuuaaccaaccgaaaag

SEQ ID NO: 34217 - RNA, 64 nt, hsa
uggaugacauaaaaauguaaacaucuccacacaaaaaaaaaaaugucuuaaccaaccgaaaaga

SEQ ID NO: 34218 - RNA, 64 nt, hsa
ggaugacauaaaaauguaaacaucuccacacaaaaaaaaaaaugucuuaaccaaccgaaaagaa

SEQ ID NO: 34219 - RNA, 64 nt, hsa
auguggggauguuugugcugcagacaaaaagaacaaaaaaaaauuuuuaaauaccacaagaugg

SEQ ID NO: 34220 - RNA, 64 nt, hsa
uguggggauguuugugcugcagacaaaaagaacaaaaaaaaauuuuuaaauaccacaagaugga

SEQ ID NO: 34221 - RNA, 64 nt, hsa
gaacaaaaaaaaauuuuuaaauaccacaagauggaaaaaaaaaacaaaaaaauuuaaaaagaug

SEQ ID NO: 34222 - RNA, 64 nt, hsa
aacaaaaaaaaauuuuuaaauaccacaagauggaaaaaaaaaacaaaaaaauuuaaaaagaugg

SEQ ID NO: 34223 - RNA, 64 nt, hsa
acaaaaaaaaauuuuuaaauaccacaagauggaaaaaaaaaacaaaaaaauuuaaaaagaugga

SEQ ID NO: 34224 - RNA, 64 nt, hsa
uguuucuagaagucucuuuuaagcauuauuuuugaaaaaaaaaauauuuuuauagaugaauacu

SEQ ID NO: 34225 - RNA, 64 nt, hsa
guuucuagaagucucuuuuaagcauuauuuuugaaaaaaaaaauauuuuuauagaugaauacuc

SEQ ID NO: 34226 - RNA, 64 nt, hsa
uuucuagaagucucuuuuaagcauuauuuuugaaaaaaaaaauauuuuuauagaugaauacuca

SEQ ID NO: 34227 - RNA, 64 nt, hsa
gaccagccagggcaacacagugagaccccuucucaaaaaaaaaaaaaaaaaagagagagugugu

SEQ ID NO: 34228 - RNA, 64 nt, hsa
accagccagggcaacacagugagaccccuucucaaaaaaaaaaaaaaaaaagagagagugugug

SEQ ID NO: 34229 - RNA, 64 nt, hsa
ccagccagggcaacacagugagaccccuucucaaaaaaaaaaaaaaaaaagagagaguguguga

SEQ ID NO: 34230 - RNA, 64 nt, hsa
cagccagggcaacacagugagaccccuucucaaaaaaaaaaaaaaaaaagagagagugugugau

SEQ ID NO: 34231 - RNA, 64 nt, hsa
agccagggcaacacagugagaccccuucucaaaaaaaaaaaaaaaaaagagagagugugugauu

SEQ ID NO: 34232 - RNA, 64 nt, hsa
gccagggcaacacagugagaccccuucucaaaaaaaaaaaaaaaaaagagagagugugugauua

SEQ ID NO: 34233 - RNA, 64 nt, hsa
ccagggcaacacagugagaccccuucucaaaaaaaaaaaaaaaaaagagagagugugugauuag

SEQ ID NO: 34234 - RNA, 64 nt, hsa
cagggcaacacagugagaccccuucucaaaaaaaaaaaaaaaaaagagagagugugugauuaga

SEQ ID NO: 34235 - RNA, 64 nt, hsa
agggcaacacagugagaccccuucucaaaaaaaaaaaaaaaaaagagagagugugugauuagaa

SEQ ID NO: 34236 - RNA, 64 nt, hsa
gggcaacacagugagaccccuucucaaaaaaaaaaaaaaaaaagagagagugugugauuagaag

SEQ ID NO: 34237 - RNA, 64 nt, hsa
ggcaacacagugagaccccuucucaaaaaaaaaaaaaaaaaagagagagugugugauuagaagc

SEQ ID NO: 34238 - RNA, 64 nt, hsa
aaaauaggaacuuuugauaagaccuucuagaagcaaaaaaaaaaaaaaaaaaaaaaaaaagaaa

SEQ ID NO: 34239 - RNA, 64 nt, hsa
aaauaggaacuuuugauaagaccuucuagaagcaaaaaaaaaaaaaaaaaaaaaaaaaagaaaa

SEQ ID NO: 34240 - RNA, 64 nt, hsa
aauaggaacuuuugauaagaccuucuagaagcaaaaaaaaaaaaaaaaaaaaaaaaaagaaaaa

SEQ ID NO: 34241 - RNA, 64 nt, hsa
auaggaacuuuugauaagaccuucuagaagcaaaaaaaaaaaaaaaaaaaaaaaaaagaaaaaa

SEQ ID NO: 34242 - RNA, 64 nt, hsa
uaggaacuuuugauaagaccuucuagaagcaaaaaaaaaaaaaaaaaaaaaaaaaagaaaaaaa

SEQ ID NO: 34243 - RNA, 64 nt, hsa
aggaacuuuugauaagaccuucuagaagcaaaaaaaaaaaaaaaaaaaaaaaaaagaaaaaaaa

SEQ ID NO: 34244 - RNA, 64 nt, hsa
ggaacuuuugauaagaccuucuagaagcaaaaaaaaaaaaaaaaaaaaaaaaaagaaaaaaaaa

SEQ ID NO: 34245 - RNA, 64 nt, hsa
gaacuuuugauaagaccuucuagaagcaaaaaaaaaaaaaaaaaaaaaaaaaagaaaaaaaaag

SEQ ID NO: 34246 - RNA, 64 nt, hsa
aacuuuugauaagaccuucuagaagcaaaaaaaaaaaaaaaaaaaaaaaaaagaaaaaaaaaga

SEQ ID NO: 34247 - RNA, 64 nt, hsa
acuuuugauaagaccuucuagaagcaaaaaaaaaaaaaaaaaaaaaaaaaagaaaaaaaaagaa

SEQ ID NO: 34248 - RNA, 64 nt, hsa
cuuuugauaagaccuucuagaagcaaaaaaaaaaaaaaaaaaaaaaaaaagaaaaaaaaagaaa

SEQ ID NO: 34249 - RNA, 64 nt, hsa
uuuugauaagaccuucuagaagcaaaaaaaaaaaaaaaaaaaaaaaaaagaaaaaaaaagaaaa

SEQ ID NO: 34250 - RNA, 64 nt, hsa
uuugauaagaccuucuagaagcaaaaaaaaaaaaaaaaaaaaaaaaaagaaaaaaaaagaaaag

SEQ ID NO: 34251 - RNA, 64 nt, hsa
uugauaagaccuucuagaagcaaaaaaaaaaaaaaaaaaaaaaaaaagaaaaaaaaagaaaaga

SEQ ID NO: 34252 - RNA, 64 nt, hsa
ugauaagaccuucuagaagcaaaaaaaaaaaaaaaaaaaaaaaaaagaaaaaaaaagaaaagaa

SEQ ID NO: 34253 - RNA, 64 nt, hsa
gauaagaccuucuagaagcaaaaaaaaaaaaaaaaaaaaaaaaaagaaaaaaaaagaaaagaaa

SEQ ID NO: 34254 - RNA, 64 nt, hsa
auaagaccuucuagaagcaaaaaaaaaaaaaaaaaaaaaaaaaagaaaaaaaaagaaaagaaaa

SEQ ID NO: 34255 - RNA, 64 nt, hsa
uaagaccuucuagaagcaaaaaaaaaaaaaaaaaaaaaaaaaagaaaaaaaaagaaaagaaaaa

SEQ ID NO: 34256 - RNA, 64 nt, hsa
aagaccuucuagaagcaaaaaaaaaaaaaaaaaaaaaaaaaagaaaaaaaaagaaaagaaaaaa

SEQ ID NO: 34257 - RNA, 64 nt, hsa
uagaagcaaaaaaaaaaaaaaaaaaaaaaaaaagaaaaaaaaagaaaagaaaaaaagaaaaaga

SEQ ID NO: 34258 - RNA, 63 nt, hsa
agaagcaaaaaaaaaaaaaaaaaaaaaaaaaagaaaaaaaaagaaaagaaaaaaagaaaaaga

SEQ ID NO: 34259 - RNA, 64 nt, hsa
uucagcucccuucccuugagaugaguuucuggggaaaaaaaagagacugguuagugaugcaguu

SEQ ID NO: 34260 - RNA, 64 nt, hsa
cucuaguucuguuguuuuguguauauaauuuuuuaaaaaaaauuugugugcuucugcucauuac

SEQ ID NO: 34261 - RNA, 64 nt, hsa
agccuggccaacauggugaaaccccaucucuacuaaaaaaaaaaaaaaaauuagguguggugac

SEQ ID NO: 34262 - RNA, 64 nt, hsa
gccuggccaacauggugaaaccccaucucuacuaaaaaaaaaaaaaaaauuagguguggugaca

SEQ ID NO: 34263 - RNA, 64 nt, hsa
ccuggccaacauggugaaaccccaucucuacuaaaaaaaaaaaaaaaauuagguguggugacac

SEQ ID NO: 34264 - RNA, 64 nt, hsa
cuggccaacauggugaaaccccaucucuacuaaaaaaaaaaaaaaaauuagguguggugacaca

SEQ ID NO: 34265 - RNA, 64 nt, hsa
uggccaacauggugaaaccccaucucuacuaaaaaaaaaaaaaaaauuagguguggugacacau

SEQ ID NO: 34266 - RNA, 64 nt, hsa
ggccaacauggugaaaccccaucucuacuaaaaaaaaaaaaaaaauuagguguggugacacaug

SEQ ID NO: 34267 - RNA, 64 nt, hsa
gccaacauggugaaaccccaucucuacuaaaaaaaaaaaaaaaauuagguguggugacacaugg

SEQ ID NO: 34268 - RNA, 64 nt, hsa
ccaacauggugaaaccccaucucuacuaaaaaaaaaaaaaaaauuagguguggugacacauggc

SEQ ID NO: 34269 - RNA, 64 nt, hsa
caacauggugaaaccccaucucuacuaaaaaaaaaaaaaaaauuagguguggugacacauggcu

SEQ ID NO: 34270 - RNA, 64 nt, hsa
gccugggcaacauagcgagaccccuaucuguauuaaaaaaaaaucugauuuaauucuuuuauuu

SEQ ID NO: 34271 - RNA, 64 nt, hsa
ccugggcaacauagcgagaccccuaucuguauuaaaaaaaaaucugauuuaauucuuuuauuua

SEQ ID NO: 34272 - RNA, 64 nt, hsa
uucccucuaauaggaaacaguauaaauuuuaauuaaaaaaaaaaggcaaacuaaaauuucuuga

SEQ ID NO: 34273 - RNA, 64 nt, hsa
ucccucuaauaggaaacaguauaaauuuuaauuaaaaaaaaaaggcaaacuaaaauuucuugaa

SEQ ID NO: 34274 - RNA, 64 nt, hsa
cccucuaauaggaaacaguauaaauuuuaauuaaaaaaaaaaggcaaacuaaaauuucuugaaa

SEQ ID NO: 34275 - RNA, 64 nt, hsa
aaaggcauugugggucugucuuuaaaguguuuacaaaaaaaaauuauauaaaaaaaaagucuag

SEQ ID NO: 34276 - RNA, 64 nt, hsa
aaggcauugugggucugucuuuaaaguguuuacaaaaaaaaauuauauaaaaaaaaagucuagu

SEQ ID NO: 34277 - RNA, 64 nt, hsa
cugucuuuaaaguguuuacaaaaaaaaauuauauaaaaaaaaagucuagugucgacugguguuu

SEQ ID NO: 34278 - RNA, 64 nt, hsa
ugucuuuaaaguguuuacaaaaaaaaauuauauaaaaaaaaagucuagugucgacugguguuuu

SEQ ID NO: 34279 - RNA, 64 nt, hsa
caagauagguuucuguauuuauauauuaaaauacaaaaaaaaacuuauaaaauguuuaaaaaaa

SEQ ID NO: 34280 - RNA, 64 nt, hsa
aagauagguuucuguauuuauauauuaaaauacaaaaaaaaacuuauaaaauguuuaaaaaaau

SEQ ID NO: 34281 - RNA, 64 nt, hsa
acauuugccuuuucacagcuagucuuuucauguuaaaaaaaaaaauguauuucauaucuauaaa

SEQ ID NO: 34282 - RNA, 64 nt, hsa
cauuugccuuuucacagcuagucuuuucauguuaaaaaaaaaaauguauuucauaucuauaaaa

SEQ ID NO: 34283 - RNA, 64 nt, hsa
auuugccuuuucacagcuagucuuuucauguuaaaaaaaaaaauguauuucauaucuauaaaac

SEQ ID NO: 34284 - RNA, 64 nt, hsa
uuugccuuuucacagcuagucuuuucauguuaaaaaaaaaaauguauuucauaucuauaaaacc

SEQ ID NO: 34285 - RNA, 64 nt, hsa
cuccaaccuggguaacagggcaagacccuaucucaaaaaaaaaaaaagucgccagcaacaagca

SEQ ID NO: 34286 - RNA, 64 nt, hsa
uccaaccuggguaacagggcaagacccuaucucaaaaaaaaaaaaagucgccagcaacaagcac

SEQ ID NO: 34287 - RNA, 64 nt, hsa
ccaaccuggguaacagggcaagacccuaucucaaaaaaaaaaaaagucgccagcaacaagcacg

SEQ ID NO: 34288 - RNA, 64 nt, hsa
caaccuggguaacagggcaagacccuaucucaaaaaaaaaaaaagucgccagcaacaagcacgu

SEQ ID NO: 34289 - RNA, 64 nt, hsa
aaccuggguaacagggcaagacccuaucucaaaaaaaaaaaaagucgccagcaacaagcacgua

SEQ ID NO: 34290 - RNA, 64 nt, hsa
accuggguaacagggcaagacccuaucucaaaaaaaaaaaaagucgccagcaacaagcacguag

SEQ ID NO: 34291 - RNA, 64 nt, hsa
uuuuuaaaggaaacaaacagacaacaaaaagaagaaaaaaaaaaagaaccuccuuggaaaaauu

SEQ ID NO: 34292 - RNA, 64 nt, hsa
uuuuaaaggaaacaaacagacaacaaaaagaagaaaaaaaaaaagaaccuccuuggaaaaauua

SEQ ID NO: 34293 - RNA, 64 nt, hsa
uuuaaaggaaacaaacagacaacaaaaagaagaaaaaaaaaaagaaccuccuuggaaaaauuaa

SEQ ID NO: 34294 - RNA, 64 nt, hsa
uuaaaggaaacaaacagacaacaaaaagaagaaaaaaaaaaagaaccuccuuggaaaaauuaau

SEQ ID NO: 34295 - RNA, 64 nt, hsa
cccccccacuaugcccucauuuuuuuaaaaaaggaaaaaaaaaagaaacuggguuccagucuua

SEQ ID NO: 34296 - RNA, 64 nt, hsa
ccccccacuaugcccucauuuuuuuaaaaaaggaaaaaaaaaagaaacuggguuccagucuuaa

SEQ ID NO: 34297 - RNA, 64 nt, hsa
cccccacuaugcccucauuuuuuuaaaaaaggaaaaaaaaaagaaacuggguuccagucuuaau

SEQ ID NO: 34298 - RNA, 64 nt, hsa
uucacagcacucuggugcgggaagaagcagaagcaaaaaaaauaaaaauaaaaaaauaaauaaa

SEQ ID NO: 34299 - RNA, 64 nt, hsa
caaaaaaaauaaaaauaaaaaaauaaauaaaaauaaaaaaaauaaaaaaggaaaaaaaaaaaag

SEQ ID NO: 34300 - RNA, 64 nt, hsa
aaaaaauaaauaaaaauaaaaaaaauaaaaaaggaaaaaaaaaaaagaagaaacaagacaugcc

SEQ ID NO: 34301 - RNA, 64 nt, hsa
aaaaauaaauaaaaauaaaaaaaauaaaaaaggaaaaaaaaaaaagaagaaacaagacaugcca

SEQ ID NO: 34302 - RNA, 64 nt, hsa
aaaauaaauaaaaauaaaaaaaauaaaaaaggaaaaaaaaaaaagaagaaacaagacaugccac

SEQ ID NO: 34303 - RNA, 64 nt, hsa
aaauaaauaaaaauaaaaaaaauaaaaaaggaaaaaaaaaaaagaagaaacaagacaugccacc

SEQ ID NO: 34304 - RNA, 64 nt, hsa
aauaaauaaaaauaaaaaaaauaaaaaaggaaaaaaaaaaaagaagaaacaagacaugccaccu

SEQ ID NO: 34305 - RNA, 64 nt, hsa
ugaagcuugacucccaaguuuccauagcaacaggaaaaaaaaaaaucuauccaaaucugaagau

SEQ ID NO: 34306 - RNA, 64 nt, hsa
gaagcuugacucccaaguuuccauagcaacaggaaaaaaaaaaaucuauccaaaucugaagauu

SEQ ID NO: 34307 - RNA, 64 nt, hsa
aagcuugacucccaaguuuccauagcaacaggaaaaaaaaaaaucuauccaaaucugaagauug

SEQ ID NO: 34308 - RNA, 64 nt, hsa
agcuugacucccaaguuuccauagcaacaggaaaaaaaaaaaucuauccaaaucugaagauugc

SEQ ID NO: 34309 - RNA, 64 nt, hsa
aaggugcuucagccuuguacuguguauauauauuaaaaaaaaaacaaaguuuuguauguuuuua

SEQ ID NO: 34310 - RNA, 64 nt, hsa
aggugcuucagccuuguacuguguauauauauuaaaaaaaaaacaaaguuuuguauguuuuuau

SEQ ID NO: 34311 - RNA, 64 nt, hsa
ggugcuucagccuuguacuguguauauauauuaaaaaaaaaacaaaguuuuguauguuuuuauu

SEQ ID NO: 34312 - RNA, 64 nt, hsa
gggguuuuguuuguuguuuugguuuuuuuugggcaaaaaaaaaaaaaaaaccuugcuuuuagug

SEQ ID NO: 34313 - RNA, 64 nt, hsa
ggguuuuguuuguuguuuugguuuuuuuugggcaaaaaaaaaaaaaaaaccuugcuuuuagugu

SEQ ID NO: 34314 - RNA, 64 nt, hsa
gguuuuguuuguuguuuugguuuuuuuugggcaaaaaaaaaaaaaaaaccuugcuuuuaguguu

SEQ ID NO: 34315 - RNA, 64 nt, hsa
guuuuguuuguuguuuugguuuuuuuugggcaaaaaaaaaaaaaaaaccuugcuuuuaguguuu

SEQ ID NO: 34316 - RNA, 64 nt, hsa
uuuuguuuguuguuuugguuuuuuuugggcaaaaaaaaaaaaaaaaccuugcuuuuaguguuug

SEQ ID NO: 34317 - RNA, 64 nt, hsa
uuuguuuguuguuuugguuuuuuuugggcaaaaaaaaaaaaaaaaccuugcuuuuaguguuugu

SEQ ID NO: 34318 - RNA, 64 nt, hsa
uuguuuguuguuuugguuuuuuuugggcaaaaaaaaaaaaaaaaccuugcuuuuaguguuugua

SEQ ID NO: 34319 - RNA, 64 nt, hsa
uguuuguuguuuugguuuuuuuugggcaaaaaaaaaaaaaaaaccuugcuuuuaguguuuguac

SEQ ID NO: 34320 - RNA, 64 nt, hsa
guuuguuguuuugguuuuuuuugggcaaaaaaaaaaaaaaaaccuugcuuuuaguguuuguacu

SEQ ID NO: 34321 - RNA, 64 nt, hsa
agcucuucuagaauuguuuaaacccuuaccaaggaaaaaaaagggauguuaccaacugagaucg

SEQ ID NO: 34322 - RNA, 64 nt, hsa
aguaagauuccuguaagaaauacugcuuuuuaagaaaaaaaauaacaugcugaggggugaccua

SEQ ID NO: 34323 - RNA, 64 nt, hsa
uugcuaugguguuuauaacaaaaaagaaaauuugaaaaaaaaaaucccaggggaguagcaggag

SEQ ID NO: 34324 - RNA, 64 nt, hsa
ugcuaugguguuuauaacaaaaaagaaaauuugaaaaaaaaaaucccaggggaguagcaggagc

SEQ ID NO: 34325 - RNA, 64 nt, hsa
gcuaugguguuuauaacaaaaaagaaaauuugaaaaaaaaaaucccaggggaguagcaggagcc

SEQ ID NO: 34326 - RNA, 64 nt, hsa
cuccagccugggugacagagcgagacuccgucucaaaaaaaaaaauuucaagacuggagaggug

SEQ ID NO: 34327 - RNA, 64 nt, hsa
uccagccugggugacagagcgagacuccgucucaaaaaaaaaaauuucaagacuggagagguga

SEQ ID NO: 34328 - RNA, 64 nt, hsa
ccagccugggugacagagcgagacuccgucucaaaaaaaaaaauuucaagacuggagaggugau

SEQ ID NO: 34329 - RNA, 64 nt, hsa
cagccugggugacagagcgagacuccgucucaaaaaaaaaaauuucaagacuggagaggugauc

SEQ ID NO: 34330 - RNA, 64 nt, hsa
uccagccugggcgacagagcgagacucugucucgaaaaaaaaaaagguccgugccaagcugcuc

SEQ ID NO: 34331 - RNA, 64 nt, hsa
ccagccugggcgacagagcgagacucugucucgaaaaaaaaaaagguccgugccaagcugcucc

SEQ ID NO: 34332 - RNA, 64 nt, hsa
cagccugggcgacagagcgagacucugucucgaaaaaaaaaaagguccgugccaagcugcuccc

SEQ ID NO: 34333 - RNA, 64 nt, hsa
agccugggcgacagagcgagacucugucucgaaaaaaaaaaagguccgugccaagcugcucccu

SEQ ID NO: 34334 - RNA, 64 nt, hsa
ccacaguguugggcacaacuuugacguuucuuaaaaaaaaaauuuaaaaaaugccgaaaaccag

SEQ ID NO: 34335 - RNA, 64 nt, hsa
uccacaguguugggcacaacuuugacguuucuuaaaaaaaaaauuuaaaaaaugccgaaaacca

SEQ ID NO: 34336 - RNA, 64 nt, hsa
auccacaguguugggcacaacuuugacguuucuuaaaaaaaaaauuuaaaaaaugccgaaaacc

SEQ ID NO: 34337 - RNA, 64 nt, hsa
gauaggggaccggggggggcuuggaauguugcaaaaaaaaaaguuacccaagggaugucaguuu

SEQ ID NO: 34338 - RNA, 64 nt, hsa
ggauaggggaccggggggggcuuggaauguugcaaaaaaaaaaguuacccaagggaugucaguu

SEQ ID NO: 34339 - RNA, 64 nt, hsa
uggauaggggaccggggggggcuuggaauguugcaaaaaaaaaaguuacccaagggaugucagu

SEQ ID NO: 34340 - RNA, 64 nt, hsa
aaaaaaaaaaaaaaaaaaaaaaaagaaaaaagaaaaaaaaaauccaaaagagagaagaguuuuu

SEQ ID NO: 34341 - RNA, 64 nt, hsa
aaaaaaaaaaaaaaaaaaaaaaaaagaaaaaagaaaaaaaaaauccaaaagagagaagaguuuu

SEQ ID NO: 34342 - RNA, 64 nt, hsa
aaaaaaaaaaaaaaaaaaaaaaaaaagaaaaaagaaaaaaaaaauccaaaagagagaagaguuu

SEQ ID NO: 34343 - RNA, 64 nt, hsa
uuccuuuaaaagccaaaaaaaaaaaaaaaaaaaaaaaaaaaagaaaaaagaaaaaaaaaaucca

SEQ ID NO: 34344 - RNA, 64 nt, hsa
uuuccuuuaaaagccaaaaaaaaaaaaaaaaaaaaaaaaaaaagaaaaaagaaaaaaaaaaucc

SEQ ID NO: 34345 - RNA, 64 nt, hsa
guuuccuuuaaaagccaaaaaaaaaaaaaaaaaaaaaaaaaaaagaaaaaagaaaaaaaaaauc

SEQ ID NO: 34346 - RNA, 64 nt, hsa
uguuuccuuuaaaagccaaaaaaaaaaaaaaaaaaaaaaaaaaaagaaaaaagaaaaaaaaaau

SEQ ID NO: 34347 - RNA, 64 nt, hsa
uuguuuccuuuaaaagccaaaaaaaaaaaaaaaaaaaaaaaaaaaagaaaaaagaaaaaaaaaa

SEQ ID NO: 34348 - RNA, 64 nt, hsa
auuguuuccuuuaaaagccaaaaaaaaaaaaaaaaaaaaaaaaaaaagaaaaaagaaaaaaaaa

SEQ ID NO: 34349 - RNA, 64 nt, hsa
uauuguuuccuuuaaaagccaaaaaaaaaaaaaaaaaaaaaaaaaaaagaaaaaagaaaaaaaa

SEQ ID NO: 34350 - RNA, 64 nt, hsa
guauuguuuccuuuaaaagccaaaaaaaaaaaaaaaaaaaaaaaaaaaagaaaaaagaaaaaaa

SEQ ID NO: 34351 - RNA, 64 nt, hsa
cguauuguuuccuuuaaaagccaaaaaaaaaaaaaaaaaaaaaaaaaaaagaaaaaagaaaaaa

SEQ ID NO: 34352 - RNA, 64 nt, hsa
acguauuguuuccuuuaaaagccaaaaaaaaaaaaaaaaaaaaaaaaaaaagaaaaaagaaaaa

SEQ ID NO: 34353 - RNA, 64 nt, hsa
aacguauuguuuccuuuaaaagccaaaaaaaaaaaaaaaaaaaaaaaaaaaagaaaaaagaaaa

SEQ ID NO: 34354 - RNA, 64 nt, hsa
aaacguauuguuuccuuuaaaagccaaaaaaaaaaaaaaaaaaaaaaaaaaaagaaaaaagaaa

SEQ ID NO: 34355 - RNA, 64 nt, hsa
caaacguauuguuuccuuuaaaagccaaaaaaaaaaaaaaaaaaaaaaaaaaaagaaaaaagaa

SEQ ID NO: 34356 - RNA, 64 nt, hsa
gcaaacguauuguuuccuuuaaaagccaaaaaaaaaaaaaaaaaaaaaaaaaaaagaaaaaaga

SEQ ID NO: 34357 - RNA, 64 nt, hsa
agcaaacguauuguuuccuuuaaaagccaaaaaaaaaaaaaaaaaaaaaaaaaaaagaaaaaag

SEQ ID NO: 34358 - RNA, 64 nt, hsa
uagcaaacguauuguuuccuuuaaaagccaaaaaaaaaaaaaaaaaaaaaaaaaaaagaaaaaa

SEQ ID NO: 34359 - RNA, 64 nt, hsa
cuagcaaacguauuguuuccuuuaaaagccaaaaaaaaaaaaaaaaaaaaaaaaaaaagaaaaa

SEQ ID NO: 34360 - RNA, 64 nt, hsa
ucuagcaaacguauuguuuccuuuaaaagccaaaaaaaaaaaaaaaaaaaaaaaaaaaagaaaa

SEQ ID NO: 34361 - RNA, 64 nt, hsa
uucuagcaaacguauuguuuccuuuaaaagccaaaaaaaaaaaaaaaaaaaaaaaaaaaagaaa

SEQ ID NO: 34362 - RNA, 64 nt, hsa
uuucuagcaaacguauuguuuccuuuaaaagccaaaaaaaaaaaaaaaaaaaaaaaaaaaagaa

SEQ ID NO: 34363 - RNA, 64 nt, hsa
uuuucuagcaaacguauuguuuccuuuaaaagccaaaaaaaaaaaaaaaaaaaaaaaaaaaaga

SEQ ID NO: 34364 - RNA, 64 nt, hsa
aagcaauacuuaggaggcuuacuucuuuggauuaaaaaaaaauguaugcaacuccaaccccugg

SEQ ID NO: 34365 - RNA, 64 nt, hsa
uaagcaauacuuaggaggcuuacuucuuuggauuaaaaaaaaauguaugcaacuccaaccccug

SEQ ID NO: 34366 - RNA, 64 nt, hsa
cugaaauacuuuugaacagaauuucuuuuuuuuaaaaaaaaacagagauggggucuuacuaugu

SEQ ID NO: 34367 - RNA, 64 nt, hsa
ucugaaauacuuuugaacagaauuucuuuuuuuuaaaaaaaaacagagauggggucuuacuaug

SEQ ID NO: 34368 - RNA, 64 nt, hsa
uagacucugugucaaaaauaaaugacuagauaaaaaaaaaaauuguuugaguacauuuucccug

SEQ ID NO: 34369 - RNA, 64 nt, hsa
cuagacucugugucaaaaauaaaugacuagauaaaaaaaaaaauuguuugaguacauuuucccu

SEQ ID NO: 34370 - RNA, 64 nt, hsa
gcuagacucugugucaaaaauaaaugacuagauaaaaaaaaaaauuguuugaguacauuuuccc

SEQ ID NO: 34371 - RNA, 64 nt, hsa
agcuagacucugugucaaaaauaaaugacuagauaaaaaaaaaaauuguuugaguacauuuucc

SEQ ID NO: 34372 - RNA, 64 nt, hsa
uaacacggugaaaccccgucuuuacuaaaaauacaaaaaaaauuagccgggcgugguggcgggc

SEQ ID NO: 34373 - RNA, 64 nt, hsa
gaaccugacucuuaaaaaaaaaaaaaaaaaaaaaaaaaaaaagauaacuagaacuucuagaaca

SEQ ID NO: 34374 - RNA, 64 nt, hsa
agaaccugacucuuaaaaaaaaaaaaaaaaaaaaaaaaaaaaagauaacuagaacuucuagaac

SEQ ID NO: 34375 - RNA, 64 nt, hsa
gagaaccugacucuuaaaaaaaaaaaaaaaaaaaaaaaaaaaaagauaacuagaacuucuagaa

SEQ ID NO: 34376 - RNA, 64 nt, hsa
ugagaaccugacucuuaaaaaaaaaaaaaaaaaaaaaaaaaaaaagauaacuagaacuucuaga

SEQ ID NO: 34377 - RNA, 64 nt, hsa
gugagaaccugacucuuaaaaaaaaaaaaaaaaaaaaaaaaaaaaagauaacuagaacuucuag

SEQ ID NO: 34378 - RNA, 64 nt, hsa
agugagaaccugacucuuaaaaaaaaaaaaaaaaaaaaaaaaaaaaagauaacuagaacuucua

SEQ ID NO: 34379 - RNA, 64 nt, hsa
cagugagaaccugacucuuaaaaaaaaaaaaaaaaaaaaaaaaaaaaagauaacuagaacuucu

SEQ ID NO: 34380 - RNA, 64 nt, hsa
acagugagaaccugacucuuaaaaaaaaaaaaaaaaaaaaaaaaaaaaagauaacuagaacuuc

SEQ ID NO: 34381 - RNA, 64 nt, hsa
cacagugagaaccugacucuuaaaaaaaaaaaaaaaaaaaaaaaaaaaaagauaacuagaacuu

SEQ ID NO: 34382 - RNA, 64 nt, hsa
gcacagugagaaccugacucuuaaaaaaaaaaaaaaaaaaaaaaaaaaaaagauaacuagaacu

SEQ ID NO: 34383 - RNA, 64 nt, hsa
ggcacagugagaaccugacucuuaaaaaaaaaaaaaaaaaaaaaaaaaaaaagauaacuagaac

SEQ ID NO: 34384 - RNA, 64 nt, hsa
uggcacagugagaaccugacucuuaaaaaaaaaaaaaaaaaaaaaaaaaaaaagauaacuagaa

SEQ ID NO: 34385 - RNA, 64 nt, hsa
guggcacagugagaaccugacucuuaaaaaaaaaaaaaaaaaaaaaaaaaaaaagauaacuaga

SEQ ID NO: 34386 - RNA, 64 nt, hsa
gguggcacagugagaaccugacucuuaaaaaaaaaaaaaaaaaaaaaaaaaaaaagauaacuag

SEQ ID NO: 34387 - RNA, 64 nt, hsa
ugguggcacagugagaaccugacucuuaaaaaaaaaaaaaaaaaaaaaaaaaaaaagauaacua

SEQ ID NO: 34388 - RNA, 64 nt, hsa
uugguggcacagugagaaccugacucuuaaaaaaaaaaaaaaaaaaaaaaaaaaaaagauaacu

SEQ ID NO: 34389 - RNA, 64 nt, hsa
cuugguggcacagugagaaccugacucuuaaaaaaaaaaaaaaaaaaaaaaaaaaaaagauaac

SEQ ID NO: 34390 - RNA, 64 nt, hsa
ccuugguggcacagugagaaccugacucuuaaaaaaaaaaaaaaaaaaaaaaaaaaaaagauaa

SEQ ID NO: 34391 - RNA, 64 nt, hsa
accuugguggcacagugagaaccugacucuuaaaaaaaaaaaaaaaaaaaaaaaaaaaaagaua

SEQ ID NO: 34392 - RNA, 64 nt, hsa
aaccuugguggcacagugagaaccugacucuuaaaaaaaaaaaaaaaaaaaaaaaaaaaaagau

SEQ ID NO: 34393 - RNA, 64 nt, hsa
caaccuugguggcacagugagaaccugacucuuaaaaaaaaaaaaaaaaaaaaaaaaaaaaaga

SEQ ID NO: 34394 - RNA, 64 nt, hsa
acaaccuugguggcacagugagaaccugacucuuaaaaaaaaaaaaaaaaaaaaaaaaaaaaag

SEQ ID NO: 34395 - RNA, 64 nt, hsa
aacagagcaagacucugucucaggaaaaaaaaaaaaaaaaaagaaaagcaacauagugggguuu

SEQ ID NO: 34396 - RNA, 64 nt, hsa
caacagagcaagacucugucucaggaaaaaaaaaaaaaaaaaagaaaagcaacauagugggguu

SEQ ID NO: 34397 - RNA, 64 nt, hsa
gcaacagagcaagacucugucucaggaaaaaaaaaaaaaaaaaagaaaagcaacauaguggggu

SEQ ID NO: 34398 - RNA, 64 nt, hsa
ggcaacagagcaagacucugucucaggaaaaaaaaaaaaaaaaaagaaaagcaacauagugggg

SEQ ID NO: 34399 - RNA, 64 nt, hsa
gggcaacagagcaagacucugucucaggaaaaaaaaaaaaaaaaaagaaaagcaacauaguggg

SEQ ID NO: 34400 - RNA, 64 nt, hsa
ugggcaacagagcaagacucugucucaggaaaaaaaaaaaaaaaaaagaaaagcaacauagugg

SEQ ID NO: 34401 - RNA, 64 nt, hsa
cugggcaacagagcaagacucugucucaggaaaaaaaaaaaaaaaaaagaaaagcaacauagug

SEQ ID NO: 34402 - RNA, 64 nt, hsa
ccugggcaacagagcaagacucugucucaggaaaaaaaaaaaaaaaaaagaaaagcaacauagu

SEQ ID NO: 34403 - RNA, 64 nt, hsa
gccugggcaacagagcaagacucugucucaggaaaaaaaaaaaaaaaaaagaaaagcaacauag

SEQ ID NO: 34404 - RNA, 64 nt, hsa
agccugggcaacagagcaagacucugucucaggaaaaaaaaaaaaaaaaaagaaaagcaacaua

SEQ ID NO: 34405 - RNA, 64 nt, hsa
cagccugggcaacagagcaagacucugucucaggaaaaaaaaaaaaaaaaaagaaaagcaacau

SEQ ID NO: 34406 - RNA, 64 nt, hsa
guugucuccauaagucauuuugcguuauuaaaaaaaaaaaaagaaauccugauguugacauuau

SEQ ID NO: 34407 - RNA, 64 nt, hsa
gguugucuccauaagucauuuugcguuauuaaaaaaaaaaaaagaaauccugauguugacauua

SEQ ID NO: 34408 - RNA, 64 nt, hsa
ugguugucuccauaagucauuuugcguuauuaaaaaaaaaaaaagaaauccugauguugacauu

SEQ ID NO: 34409 - RNA, 64 nt, hsa
gugguugucuccauaagucauuuugcguuauuaaaaaaaaaaaaagaaauccugauguugacau

SEQ ID NO: 34410 - RNA, 64 nt, hsa
agugguugucuccauaagucauuuugcguuauuaaaaaaaaaaaaagaaauccugauguugaca

SEQ ID NO: 34411 - RNA, 64 nt, hsa
cagugguugucuccauaagucauuuugcguuauuaaaaaaaaaaaaagaaauccugauguugac

SEQ ID NO: 34412 - RNA, 64 nt, hsa
augcaacugaaaaauaccuuccaaauuugccaagaaaaaaaauucuauuuuaaacuuguauccu

SEQ ID NO: 34413 - RNA, 64 nt, hsa
ggcaguguuaaugaacauauaucaucaggucuuaaaaaaaaauaaagguaaacugaaaagacaa

SEQ ID NO: 34414 - RNA, 64 nt, hsa
uggcaguguuaaugaacauauaucaucaggucuuaaaaaaaaauaaagguaaacugaaaagaca

SEQ ID NO: 34415 - RNA, 64 nt, hsa
gauuaggggagguucagaggaggagaaugucucaaaaaaaaaggacaaaaaacaaacccagagc

SEQ ID NO: 34416 - RNA, 64 nt, hsa
ggauuaggggagguucagaggaggagaaugucucaaaaaaaaaggacaaaaaacaaacccagag

SEQ ID NO: 34417 - RNA, 64 nt, hsa
ggcaacacgagcaaaacuuccucucaaaaaaaaaaaaaaaaagaaagaaaagaaaacucugucu

SEQ ID NO: 34418 - RNA, 64 nt, hsa
aggcaacacgagcaaaacuuccucucaaaaaaaaaaaaaaaaagaaagaaaagaaaacucuguc

SEQ ID NO: 34419 - RNA, 64 nt, hsa
uaggcaacacgagcaaaacuuccucucaaaaaaaaaaaaaaaaagaaagaaaagaaaacucugu

SEQ ID NO: 34420 - RNA, 64 nt, hsa
cuaggcaacacgagcaaaacuuccucucaaaaaaaaaaaaaaaaagaaagaaaagaaaacucug

SEQ ID NO: 34421 - RNA, 64 nt, hsa
ccuaggcaacacgagcaaaacuuccucucaaaaaaaaaaaaaaaaagaaagaaaagaaaacucu

SEQ ID NO: 34422 - RNA, 64 nt, hsa
gccuaggcaacacgagcaaaacuuccucucaaaaaaaaaaaaaaaaagaaagaaaagaaaacuc

SEQ ID NO: 34423 - RNA, 64 nt, hsa
agccuaggcaacacgagcaaaacuuccucucaaaaaaaaaaaaaaaaagaaagaaaagaaaacu

SEQ ID NO: 34424 - RNA, 64 nt, hsa
cagccuaggcaacacgagcaaaacuuccucucaaaaaaaaaaaaaaaaagaaagaaaagaaaac

SEQ ID NO: 34425 - RNA, 64 nt, hsa
ccagccuaggcaacacgagcaaaacuuccucucaaaaaaaaaaaaaaaaagaaagaaaagaaaa

SEQ ID NO: 34426 - RNA, 64 nt, hsa
uccagccuaggcaacacgagcaaaacuuccucucaaaaaaaaaaaaaaaaagaaagaaaagaaa

SEQ ID NO: 34427 - RNA, 64 nt, hsa
cugccugggcgacagcgagacucuaucucaaaaaaaaaaaaacccacacaaccuuaugagguag

SEQ ID NO: 34428 - RNA, 64 nt, hsa
gcugccugggcgacagcgagacucuaucucaaaaaaaaaaaaacccacacaaccuuaugaggua

SEQ ID NO: 34429 - RNA, 64 nt, hsa
ugcugccugggcgacagcgagacucuaucucaaaaaaaaaaaaacccacacaaccuuaugaggu

SEQ ID NO: 34430 - RNA, 64 nt, hsa
cugcugccugggcgacagcgagacucuaucucaaaaaaaaaaaaacccacacaaccuuaugagg

SEQ ID NO: 34431 - RNA, 64 nt, hsa
acugcugccugggcgacagcgagacucuaucucaaaaaaaaaaaaacccacacaaccuuaugag

SEQ ID NO: 34432 - RNA, 64 nt, hsa
cacugcugccugggcgacagcgagacucuaucucaaaaaaaaaaaaacccacacaaccuuauga

SEQ ID NO: 34433 - RNA, 64 nt, hsa
cuugggcgacagagcgagacccagucucaaaaaaaaaaaaaaguauuuuucucuuaccguuaca

SEQ ID NO: 34434 - RNA, 64 nt, hsa
gcuugggcgacagagcgagacccagucucaaaaaaaaaaaaaaguauuuuucucuuaccguuac

SEQ ID NO: 34435 - RNA, 64 nt, hsa
agcuugggcgacagagcgagacccagucucaaaaaaaaaaaaaaguauuuuucucuuaccguua

SEQ ID NO: 34436 - RNA, 64 nt, hsa
cagcuugggcgacagagcgagacccagucucaaaaaaaaaaaaaaguauuuuucucuuaccguu

SEQ ID NO: 34437 - RNA, 64 nt, hsa
ccagcuugggcgacagagcgagacccagucucaaaaaaaaaaaaaaguauuuuucucuuaccgu

SEQ ID NO: 34438 - RNA, 64 nt, hsa
uccagcuugggcgacagagcgagacccagucucaaaaaaaaaaaaaaguauuuuucucuuaccg

SEQ ID NO: 34439 - RNA, 64 nt, hsa
uuccagcuugggcgacagagcgagacccagucucaaaaaaaaaaaaaaguauuuuucucuuacc

SEQ ID NO: 34440 - RNA, 64 nt, hsa
auagugagacccugucucuacuaaaaauaaauuuaaaaaaaauuagcugagugugguggugcau

SEQ ID NO: 34441 - RNA, 64 nt, hsa
uuuaaaauuccugugaucuguaaaaaaaaaaaaaaaaaaaaacacaaaacccacaagcacuuau

SEQ ID NO: 34442 - RNA, 64 nt, hsa
auuuaaaauuccugugaucuguaaaaaaaaaaaaaaaaaaaaacacaaaacccacaagcacuua

SEQ ID NO: 34443 - RNA, 64 nt, hsa
aauuuaaaauuccugugaucuguaaaaaaaaaaaaaaaaaaaaacacaaaacccacaagcacuu

SEQ ID NO: 34444 - RNA, 64 nt, hsa
caauuuaaaauuccugugaucuguaaaaaaaaaaaaaaaaaaaaacacaaaacccacaagcacu

SEQ ID NO: 34445 - RNA, 64 nt, hsa
gcaauuuaaaauuccugugaucuguaaaaaaaaaaaaaaaaaaaaacacaaaacccacaagcac

SEQ ID NO: 34446 - RNA, 64 nt, hsa
ugcaauuuaaaauuccugugaucuguaaaaaaaaaaaaaaaaaaaaacacaaaacccacaagca

SEQ ID NO: 34447 - RNA, 64 nt, hsa
cugcaauuuaaaauuccugugaucuguaaaaaaaaaaaaaaaaaaaaacacaaaacccacaagc

SEQ ID NO: 34448 - RNA, 64 nt, hsa
ucugcaauuuaaaauuccugugaucuguaaaaaaaaaaaaaaaaaaaaacacaaaacccacaag

SEQ ID NO: 34449 - RNA, 64 nt, hsa
aucugcaauuuaaaauuccugugaucuguaaaaaaaaaaaaaaaaaaaaacacaaaacccacaa

SEQ ID NO: 34450 - RNA, 64 nt, hsa
gaucugcaauuuaaaauuccugugaucuguaaaaaaaaaaaaaaaaaaaaacacaaaacccaca

SEQ ID NO: 34451 - RNA, 64 nt, hsa
ugaucugcaauuuaaaauuccugugaucuguaaaaaaaaaaaaaaaaaaaaacacaaaacccac

SEQ ID NO: 34452 - RNA, 64 nt, hsa
cugaucugcaauuuaaaauuccugugaucuguaaaaaaaaaaaaaaaaaaaaacacaaaaccca

SEQ ID NO: 34453 - RNA, 64 nt, hsa
acugaucugcaauuuaaaauuccugugaucuguaaaaaaaaaaaaaaaaaaaaacacaaaaccc

SEQ ID NO: 34454 - RNA, 64 nt, hsa
gacugaucugcaauuuaaaauuccugugaucuguaaaaaaaaaaaaaaaaaaaaacacaaaacc

SEQ ID NO: 34455 - RNA, 64 nt, hsa
caaauggauaugguuagccuuuauaaauaaauaaaaaaaaaaguguugcuuucuuaaggaaagc

SEQ ID NO: 34456 - RNA, 64 nt, hsa
acaaauggauaugguuagccuuuauaaauaaauaaaaaaaaaaguguugcuuucuuaaggaaag

SEQ ID NO: 34457 - RNA, 64 nt, hsa
gacaaauggauaugguuagccuuuauaaauaaauaaaaaaaaaaguguugcuuucuuaaggaaa

SEQ ID NO: 34458 - RNA, 64 nt, hsa
aaacuuauuucccaguguaaacgcaguuguacagaaaaaaaauguuuuggguauaaaucugggu

SEQ ID NO: 34459 - RNA, 64 nt, hsa
aaaaaacuuuuuuuaaucguuguaauaauuguauaaaaaaaaucgcucuguauaguuacaacuu

SEQ ID NO: 34460 - RNA, 64 nt, hsa
ccucauccuaguucuuuaaaaaaaacaaaaaaacaaaaaaaacuuuuuuuaaucguuguaauaa

SEQ ID NO: 34461 - RNA, 56 nt, hsa
cggcucucuccucauccuaguucuuuaaaaaaaacaaaaaaacaaaaaaaacuuuu

SEQ ID NO: 34462 - RNA, 64 nt, hsa
caaauauugaaguuguuuaucaacuucgcuagaaaaaaaaaacacuuggcauacaaaauauuua

SEQ ID NO: 34463 - RNA, 64 nt, hsa
gcaaauauugaaguuguuuaucaacuucgcuagaaaaaaaaaacacuuggcauacaaaauauuu

SEQ ID NO: 34464 - RNA, 64 nt, hsa
ggcaaauauugaaguuguuuaucaacuucgcuagaaaaaaaaaacacuuggcauacaaaauauu

SEQ ID NO: 34465 - RNA, 64 nt, hsa
acacuucguauguauuuuaaagaagaaaaaaaacaaaaaaaauucccuggcuauuccucuuucc

SEQ ID NO: 34466 - RNA, 64 nt, hsa
uuucucuuuacacuucguauguauuuuaaagaagaaaaaaaacaaaaaaaauucccuggcuauu

SEQ ID NO: 34467 - RNA, 64 nt, hsa
aaugguuacaucugcuuuuugucuuuaaaauaaaaaaaaaaaucagagaaaagcccaccuuuga

SEQ ID NO: 34468 - RNA, 64 nt, hsa
uaaugguuacaucugcuuuuugucuuuaaaauaaaaaaaaaaaucagagaaaagcccaccuuug

SEQ ID NO: 34469 - RNA, 64 nt, hsa
auaaugguuacaucugcuuuuugucuuuaaaauaaaaaaaaaaaucagagaaaagcccaccuuu

SEQ ID NO: 34470 - RNA, 64 nt, hsa
uauaaugguuacaucugcuuuuugucuuuaaaauaaaaaaaaaaaucagagaaaagcccaccuu

SEQ ID NO: 34471 - RNA, 64 nt, hsa
uuuuuggggcaggggagaugaacuuuaaaaaaaaaaaaaaaacuucauuggcuuguccgagugu

SEQ ID NO: 34472 - RNA, 64 nt, hsa
uuuuuuggggcaggggagaugaacuuuaaaaaaaaaaaaaaaacuucauuggcuuguccgagug

SEQ ID NO: 34473 - RNA, 64 nt, hsa
guuuuuuggggcaggggagaugaacuuuaaaaaaaaaaaaaaaacuucauuggcuuguccgagu

SEQ ID NO: 34474 - RNA, 64 nt, hsa
aguuuuuuggggcaggggagaugaacuuuaaaaaaaaaaaaaaaacuucauuggcuuguccgag

SEQ ID NO: 34475 - RNA, 64 nt, hsa
caguuuuuuggggcaggggagaugaacuuuaaaaaaaaaaaaaaaacuucauuggcuuguccga

SEQ ID NO: 34476 - RNA, 64 nt, hsa
ucaguuuuuuggggcaggggagaugaacuuuaaaaaaaaaaaaaaaacuucauuggcuuguccg

SEQ ID NO: 34477 - RNA, 64 nt, hsa
aucaguuuuuuggggcaggggagaugaacuuuaaaaaaaaaaaaaaaacuucauuggcuugucc

SEQ ID NO: 34478 - RNA, 64 nt, hsa
uaucaguuuuuuggggcaggggagaugaacuuuaaaaaaaaaaaaaaaacuucauuggcuuguc

SEQ ID NO: 34479 - RNA, 64 nt, hsa
cuaucaguuuuuuggggcaggggagaugaacuuuaaaaaaaaaaaaaaaacuucauuggcuugu

SEQ ID NO: 34480 - RNA, 64 nt, hsa
aaaacaucuuauuaaaauuguacuugagagacaaaaaaaaaacucuguuguauuuugacagaau

SEQ ID NO: 34481 - RNA, 64 nt, hsa
caaaacaucuuauuaaaauuguacuugagagacaaaaaaaaaacucuguuguauuuugacagaa

SEQ ID NO: 34482 - RNA, 64 nt, hsa
acaaaacaucuuauuaaaauuguacuugagagacaaaaaaaaaacucuguuguauuuugacaga

SEQ ID NO: 34483 - RNA, 64 nt, hsa
gauuauauauauauauauaaaaauauauauauuaaaaaaaaagacaguauuuaucguagcauua

SEQ ID NO: 34484 - RNA, 64 nt, hsa
agauuauauauauauauauaaaaauauauauauuaaaaaaaaagacaguauuuaucguagcauu

SEQ ID NO: 34485 - RNA, 64 nt, hsa
ucuaauuauugcagacauauuuuugagauguaaaaaaaaaaauuuaaaguuaaaugauaagucu

SEQ ID NO: 34486 - RNA, 64 nt, hsa
cucuaauuauugcagacauauuuuugagauguaaaaaaaaaaauuuaaaguuaaaugauaaguc

SEQ ID NO: 34487 - RNA, 64 nt, hsa
gcucuaauuauugcagacauauuuuugagauguaaaaaaaaaaauuuaaaguuaaaugauaagu

SEQ ID NO: 34488 - RNA, 64 nt, hsa
agcucuaauuauugcagacauauuuuugagauguaaaaaaaaaaauuuaaaguuaaaugauaag

SEQ ID NO: 34489 - RNA, 64 nt, hsa
ccuuggcuaauaaaauucuaguaauuugaaaaaaaaaaaaaagagagaaaguuaaacaacauua

SEQ ID NO: 34490 - RNA, 64 nt, hsa
cccuuggcuaauaaaauucuaguaauuugaaaaaaaaaaaaaagagagaaaguuaaacaacauu

SEQ ID NO: 34491 - RNA, 64 nt, hsa
ucccuuggcuaauaaaauucuaguaauuugaaaaaaaaaaaaaagagagaaaguuaaacaacau

SEQ ID NO: 34492 - RNA, 64 nt, hsa
aucccuuggcuaauaaaauucuaguaauuugaaaaaaaaaaaaaagagagaaaguuaaacaaca

SEQ ID NO: 34493 - RNA, 64 nt, hsa
uaucccuuggcuaauaaaauucuaguaauuugaaaaaaaaaaaaaagagagaaaguuaaacaac

SEQ ID NO: 34494 - RNA, 64 nt, hsa
cuaucccuuggcuaauaaaauucuaguaauuugaaaaaaaaaaaaaagagagaaaguuaaacaa

SEQ ID NO: 34495 - RNA, 64 nt, hsa
gcuaucccuuggcuaauaaaauucuaguaauuugaaaaaaaaaaaaaagagagaaaguuaaaca

SEQ ID NO: 34496 - RNA, 64 nt, hsa
gcccuaggauugagcuaacagcaaaaaaaaaaaaaaaaaaaagagagaaagaaaggaguaaaca

SEQ ID NO: 34497 - RNA, 64 nt, hsa
ugcccuaggauugagcuaacagcaaaaaaaaaaaaaaaaaaaagagagaaagaaaggaguaaac

SEQ ID NO: 34498 - RNA, 64 nt, hsa
uugcccuaggauugagcuaacagcaaaaaaaaaaaaaaaaaaaagagagaaagaaaggaguaaa

SEQ ID NO: 34499 - RNA, 64 nt, hsa
uuugcccuaggauugagcuaacagcaaaaaaaaaaaaaaaaaaaagagagaaagaaaggaguaa

SEQ ID NO: 34500 - RNA, 64 nt, hsa
auuugcccuaggauugagcuaacagcaaaaaaaaaaaaaaaaaaaagagagaaagaaaggagua

SEQ ID NO: 34501 - RNA, 64 nt, hsa
aauuugcccuaggauugagcuaacagcaaaaaaaaaaaaaaaaaaaagagagaaagaaaggagu

SEQ ID NO: 34502 - RNA, 64 nt, hsa
aaauuugcccuaggauugagcuaacagcaaaaaaaaaaaaaaaaaaaagagagaaagaaaggag

SEQ ID NO: 34503 - RNA, 64 nt, hsa
uaaauuugcccuaggauugagcuaacagcaaaaaaaaaaaaaaaaaaaagagagaaagaaagga

SEQ ID NO: 34504 - RNA, 64 nt, hsa
uuaaauuugcccuaggauugagcuaacagcaaaaaaaaaaaaaaaaaaaagagagaaagaaagg

SEQ ID NO: 34505 - RNA, 64 nt, hsa
uuuaaauuugcccuaggauugagcuaacagcaaaaaaaaaaaaaaaaaaaagagagaaagaaag

SEQ ID NO: 34506 - RNA, 64 nt, hsa
guuuaaauuugcccuaggauugagcuaacagcaaaaaaaaaaaaaaaaaaaagagagaaagaaa

SEQ ID NO: 34507 - RNA, 64 nt, hsa
cguuuaaauuugcccuaggauugagcuaacagcaaaaaaaaaaaaaaaaaaaagagagaaagaa

SEQ ID NO: 34508 - RNA, 64 nt, hsa
acguuuaaauuugcccuaggauugagcuaacagcaaaaaaaaaaaaaaaaaaaagagagaaaga

SEQ ID NO: 34509 - RNA, 64 nt, hsa
cuugaaaaugggaagcgaugacaaaucugacuuuaaaaaaaaucuuugauuugcacuguuauau

SEQ ID NO: 34510 - RNA, 64 nt, hsa
uuagaauagaaacuuuuaguauuaccgauggggaaaaaaaaacuacuguuaacacugcuaauga

SEQ ID NO: 34511 - RNA, 64 nt, hsa
cuuagaauagaaacuuuuaguauuaccgauggggaaaaaaaaacuacuguuaacacugcuaaug

SEQ ID NO: 34512 - RNA, 64 nt, hsa
agccuugagacagagcgagacccugucucaaaaaaaaaaaaagaacgugggaaauaugaaccuu

SEQ ID NO: 34513 - RNA, 64 nt, hsa
cagccuugagacagagcgagacccugucucaaaaaaaaaaaaagaacgugggaaauaugaaccu

SEQ ID NO: 34514 - RNA, 64 nt, hsa
ccagccuugagacagagcgagacccugucucaaaaaaaaaaaaagaacgugggaaauaugaacc

SEQ ID NO: 34515 - RNA, 64 nt, hsa
uccagccuugagacagagcgagacccugucucaaaaaaaaaaaaagaacgugggaaauaugaac

SEQ ID NO: 34516 - RNA, 64 nt, hsa
cuccagccuugagacagagcgagacccugucucaaaaaaaaaaaaagaacgugggaaauaugaa

SEQ ID NO: 34517 - RNA, 64 nt, hsa
acuccagccuugagacagagcgagacccugucucaaaaaaaaaaaaagaacgugggaaauauga

SEQ ID NO: 34518 - RNA, 64 nt, hsa
agggcccuagaaagugcuaggaggaagggguuaaaaaaaaaauuuguccgcguugcaaacuauu

SEQ ID NO: 34519 - RNA, 64 nt, hsa
cagggcccuagaaagugcuaggaggaagggguuaaaaaaaaaauuuguccgcguugcaaacuau

SEQ ID NO: 34520 - RNA, 64 nt, hsa
ucagggcccuagaaagugcuaggaggaagggguuaaaaaaaaaauuuguccgcguugcaaacua

SEQ ID NO: 34521 - RNA, 64 nt, hsa
ccucacuauuaaacugccaugaugccucaguuaaaaaaaaaauuaaauguccgucagugucugu

SEQ ID NO: 34522 - RNA, 64 nt, hsa
accucacuauuaaacugccaugaugccucaguuaaaaaaaaaauuaaauguccgucagugucug

SEQ ID NO: 34523 - RNA, 64 nt, hsa
uaccucacuauuaaacugccaugaugccucaguuaaaaaaaaaauuaaauguccgucagugucu

SEQ ID NO: 34524 - RNA, 64 nt, hsa
uuaaggcuuuugaacuaucuuuuuuuaaaaaaaaaaaaaaaagcccacaucuuauacuccaaug

SEQ ID NO: 34525 - RNA, 64 nt, hsa
uuuaaggcuuuugaacuaucuuuuuuuaaaaaaaaaaaaaaaagcccacaucuuauacuccaau

SEQ ID NO: 34526 - RNA, 64 nt, hsa
uuuuaaggcuuuugaacuaucuuuuuuuaaaaaaaaaaaaaaaagcccacaucuuauacuccaa

SEQ ID NO: 34527 - RNA, 64 nt, hsa
uuuuuaaggcuuuugaacuaucuuuuuuuaaaaaaaaaaaaaaaagcccacaucuuauacucca

SEQ ID NO: 34528 - RNA, 64 nt, hsa
cuuuuuaaggcuuuugaacuaucuuuuuuuaaaaaaaaaaaaaaaagcccacaucuuauacucc

SEQ ID NO: 34529 - RNA, 64 nt, hsa
acuuuuuaaggcuuuugaacuaucuuuuuuuaaaaaaaaaaaaaaaagcccacaucuuauacuc

SEQ ID NO: 34530 - RNA, 64 nt, hsa
uacuuuuuaaggcuuuugaacuaucuuuuuuuaaaaaaaaaaaaaaaagcccacaucuuauacu

SEQ ID NO: 34531 - RNA, 64 nt, hsa
auacuuuuuaaggcuuuugaacuaucuuuuuuuaaaaaaaaaaaaaaaagcccacaucuuauac

SEQ ID NO: 34532 - RNA, 64 nt, hsa
aauacuuuuuaaggcuuuugaacuaucuuuuuuuaaaaaaaaaaaaaaaagcccacaucuuaua

SEQ ID NO: 34533 - RNA, 64 nt, hsa
uucuuggcauuaauuauugcugucuuuuuuuuaaaaaaaaaaguuuaaauaaaaugucucagag

SEQ ID NO: 34534 - RNA, 64 nt, hsa
guucuuggcauuaauuauugcugucuuuuuuuuaaaaaaaaaaguuuaaauaaaaugucucaga

SEQ ID NO: 34535 - RNA, 64 nt, hsa
uguucuuggcauuaauuauugcugucuuuuuuuuaaaaaaaaaaguuuaaauaaaaugucucag

SEQ ID NO: 34536 - RNA, 64 nt, hsa
acaggagugaaacuccgucucaaaaaaaaaaaagaaaaaaaagaaguacaagaguauaauaccu

SEQ ID NO: 34537 - RNA, 64 nt, hsa
uccuggacaacaggagugaaacuccgucucaaaaaaaaaaaagaaaaaaaagaaguacaagagu

SEQ ID NO: 34538 - RNA, 64 nt, hsa
auccuggacaacaggagugaaacuccgucucaaaaaaaaaaaagaaaaaaaagaaguacaagag

SEQ ID NO: 34539 - RNA, 64 nt, hsa
cauccuggacaacaggagugaaacuccgucucaaaaaaaaaaaagaaaaaaaagaaguacaaga

SEQ ID NO: 34540 - RNA, 64 nt, hsa
ccauccuggacaacaggagugaaacuccgucucaaaaaaaaaaaagaaaaaaaagaaguacaag

SEQ ID NO: 34541 - RNA, 64 nt, hsa
uccauccuggacaacaggagugaaacuccgucucaaaaaaaaaaaagaaaaaaaagaaguacaa

SEQ ID NO: 34542 - RNA, 64 nt, hsa
uauuuuguauugaaacuuuuaaacaauacugaagaaaaaaaaacuuuuccgacaucuguucuug

SEQ ID NO: 34543 - RNA, 64 nt, hsa
auuuuguauugaaacuuuuaaacaauacugaagaaaaaaaaacuuuuccgacaucuguucuugg

SEQ ID NO: 34544 - RNA, 64 nt, hsa
aucaaacuaccaauaacauucuucacagaaucagaaaaaaaaagcauuaaaauuuauuugaaac

SEQ ID NO: 34545 - RNA, 64 nt, hsa
ucaaacuaccaauaacauucuucacagaaucagaaaaaaaaagcauuaaaauuuauuugaaacc

SEQ ID NO: 34546 - RNA, 64 nt, hsa
cuccagccugggcaaccaagcgagacucugccuuaaaaaaaaaaaaaagaaaauguggcacaua

SEQ ID NO: 34547 - RNA, 64 nt, hsa
uccagccugggcaaccaagcgagacucugccuuaaaaaaaaaaaaaagaaaauguggcacauau

SEQ ID NO: 34548 - RNA, 64 nt, hsa
ccagccugggcaaccaagcgagacucugccuuaaaaaaaaaaaaaagaaaauguggcacauaua

SEQ ID NO: 34549 - RNA, 64 nt, hsa
cagccugggcaaccaagcgagacucugccuuaaaaaaaaaaaaaagaaaauguggcacauauac

SEQ ID NO: 34550 - RNA, 64 nt, hsa
agccugggcaaccaagcgagacucugccuuaaaaaaaaaaaaaagaaaauguggcacauauaca

SEQ ID NO: 34551 - RNA, 64 nt, hsa
gccugggcaaccaagcgagacucugccuuaaaaaaaaaaaaaagaaaauguggcacauauacac

SEQ ID NO: 34552 - RNA, 64 nt, hsa
ccugggcaaccaagcgagacucugccuuaaaaaaaaaaaaaagaaaauguggcacauauacacc

SEQ ID NO: 34553 - RNA, 64 nt, hsa
uauauagcaagccuacacaugugccccugaaccuaaaaaaaaaguuaaaagaaaaacguuugga

SEQ ID NO: 34554 - RNA, 64 nt, hsa
auauagcaagccuacacaugugccccugaaccuaaaaaaaaaguuaaaagaaaaacguuuggau

SEQ ID NO: 34555 - RNA, 64 nt, hsa
uccagccugggcaacaagagcgaaacuccaucucaaaaaaaaaaaagugucuuguucacugcag

SEQ ID NO: 34556 - RNA, 64 nt, hsa
ccagccugggcaacaagagcgaaacuccaucucaaaaaaaaaaaagugucuuguucacugcagc

SEQ ID NO: 34557 - RNA, 64 nt, hsa
cagccugggcaacaagagcgaaacuccaucucaaaaaaaaaaaagugucuuguucacugcagca

SEQ ID NO: 34558 - RNA, 64 nt, hsa
agccugggcaacaagagcgaaacuccaucucaaaaaaaaaaaagugucuuguucacugcagcau

SEQ ID NO: 34559 - RNA, 64 nt, hsa
gccugggcaacaagagcgaaacuccaucucaaaaaaaaaaaagugucuuguucacugcagcaug

SEQ ID NO: 34560 - RNA, 64 nt, hsa
ucuuggcuccaucucuucagaccccuuugccuuuaaaaaaaaaacaaaaacaaaaacaaaaaaa

SEQ ID NO: 34561 - RNA, 64 nt, hsa
cuuggcuccaucucuucagaccccuuugccuuuaaaaaaaaaacaaaaacaaaaacaaaaaaac

SEQ ID NO: 34562 - RNA, 64 nt, hsa
uuggcuccaucucuucagaccccuuugccuuuaaaaaaaaaacaaaaacaaaaacaaaaaaacc

SEQ ID NO: 34563 - RNA, 64 nt, hsa
uuccuuaagaguaaaaaacagucauugcauucagaaaaaaaaaaaaaaaaaagucaauaaagau

SEQ ID NO: 34564 - RNA, 64 nt, hsa
uccuuaagaguaaaaaacagucauugcauucagaaaaaaaaaaaaaaaaaagucaauaaagaua

SEQ ID NO: 34565 - RNA, 64 nt, hsa
ccuuaagaguaaaaaacagucauugcauucagaaaaaaaaaaaaaaaaaagucaauaaagauac

SEQ ID NO: 34566 - RNA, 64 nt, hsa
cuuaagaguaaaaaacagucauugcauucagaaaaaaaaaaaaaaaaaagucaauaaagauaca

SEQ ID NO: 34567 - RNA, 64 nt, hsa
uuaagaguaaaaaacagucauugcauucagaaaaaaaaaaaaaaaaaagucaauaaagauacaa

SEQ ID NO: 34568 - RNA, 64 nt, hsa
uaagaguaaaaaacagucauugcauucagaaaaaaaaaaaaaaaaaagucaauaaagauacaac

SEQ ID NO: 34569 - RNA, 64 nt, hsa
aagaguaaaaaacagucauugcauucagaaaaaaaaaaaaaaaaaagucaauaaagauacaacg

SEQ ID NO: 34570 - RNA, 64 nt, hsa
agaguaaaaaacagucauugcauucagaaaaaaaaaaaaaaaaaagucaauaaagauacaacga

SEQ ID NO: 34571 - RNA, 64 nt, hsa
gaguaaaaaacagucauugcauucagaaaaaaaaaaaaaaaaaagucaauaaagauacaacgau

SEQ ID NO: 34572 - RNA, 64 nt, hsa
aguaaaaaacagucauugcauucagaaaaaaaaaaaaaaaaaagucaauaaagauacaacgauu

SEQ ID NO: 34573 - RNA, 64 nt, hsa
guaaaaaacagucauugcauucagaaaaaaaaaaaaaaaaaagucaauaaagauacaacgauug

SEQ ID NO: 34574 - RNA, 64 nt, hsa
guauuuugcagagcuaucaauguccaaauaauuuaaaaaaaaaaauaaagguauuuaagcagug

SEQ ID NO: 34575 - RNA, 64 nt, hsa
uauuuugcagagcuaucaauguccaaauaauuuaaaaaaaaaaauaaagguauuuaagcaguga

SEQ ID NO: 34576 - RNA, 64 nt, hsa
auuuugcagagcuaucaauguccaaauaauuuaaaaaaaaaaauaaagguauuuaagcagugag

SEQ ID NO: 34577 - RNA, 64 nt, hsa
uuuugcagagcuaucaauguccaaauaauuuaaaaaaaaaaauaaagguauuuaagcagugagu

SEQ ID NO: 34578 - RNA, 64 nt, hsa
gaauuugauuacacauagaugaugauguuuauuuaaaaaaaaaacaacagcaacaaaaaauccu

SEQ ID NO: 34579 - RNA, 64 nt, hsa
aauuugauuacacauagaugaugauguuuauuuaaaaaaaaaacaacagcaacaaaaaauccua

SEQ ID NO: 34580 - RNA, 64 nt, hsa
auuugauuacacauagaugaugauguuuauuuaaaaaaaaaacaacagcaacaaaaaauccuag

SEQ ID NO: 34581 - RNA, 64 nt, hsa
uuucuuuuagaaauaauguauugugucugugcagaaaaaaaaaaaaccaaaaaggauugcuuua

SEQ ID NO: 34582 - RNA, 64 nt, hsa
uucuuuuagaaauaauguauugugucugugcagaaaaaaaaaaaaccaaaaaggauugcuuuac

SEQ ID NO: 34583 - RNA, 64 nt, hsa
ucuuuuagaaauaauguauugugucugugcagaaaaaaaaaaaaccaaaaaggauugcuuuacu

SEQ ID NO: 34584 - RNA, 64 nt, hsa
cuuuuagaaauaauguauugugucugugcagaaaaaaaaaaaaccaaaaaggauugcuuuacuc

SEQ ID NO: 34585 - RNA, 64 nt, hsa
uuuuagaaauaauguauugugucugugcagaaaaaaaaaaaaccaaaaaggauugcuuuacucc

SEQ ID NO: 34586 - RNA, 64 nt, hsa
cuguauauuuuuuuaaaaaucugguaguuucuggaaaaaaaagagaaggggguuuguaguacuu

SEQ ID NO: 34587 - RNA, 64 nt, hsa
aaacaugaugaaacccugucucuacuaaaaauacaaaaaaaaaaaaaauuagccaggcguggug

SEQ ID NO: 34588 - RNA, 64 nt, hsa
aacaugaugaaacccugucucuacuaaaaauacaaaaaaaaaaaaaauuagccaggcguggugg

SEQ ID NO: 34589 - RNA, 64 nt, hsa
acaugaugaaacccugucucuacuaaaaauacaaaaaaaaaaaaaauuagccaggcgugguggu

SEQ ID NO: 34590 - RNA, 64 nt, hsa
caugaugaaacccugucucuacuaaaaauacaaaaaaaaaaaaaauuagccaggcgugguggug

SEQ ID NO: 34591 - RNA, 64 nt, hsa
augaugaaacccugucucuacuaaaaauacaaaaaaaaaaaaaauuagccaggcgugguggugc

SEQ ID NO: 34592 - RNA, 64 nt, hsa
ugaugaaacccugucucuacuaaaaauacaaaaaaaaaaaaaauuagccaggcgugguggugca

SEQ ID NO: 34593 - RNA, 64 nt, hsa
gaugaaacccugucucuacuaaaaauacaaaaaaaaaaaaaauuagccaggcgugguggugcac

SEQ ID NO: 34594 - RNA, 64 nt, hsa
cuccaaccuggacaacagagcgagacuccaucucaaaaaaaaaaaaaaauuguguugccucaua

SEQ ID NO: 34595 - RNA, 64 nt, hsa
uccaaccuggacaacagagcgagacuccaucucaaaaaaaaaaaaaaauuguguugccucauac

SEQ ID NO: 34596 - RNA, 64 nt, hsa
ccaaccuggacaacagagcgagacuccaucucaaaaaaaaaaaaaaauuguguugccucauacg

SEQ ID NO: 34597 - RNA, 64 nt, hsa
caaccuggacaacagagcgagacuccaucucaaaaaaaaaaaaaaauuguguugccucauacga

SEQ ID NO: 34598 - RNA, 64 nt, hsa
aaccuggacaacagagcgagacuccaucucaaaaaaaaaaaaaaauuguguugccucauacgaa

SEQ ID NO: 34599 - RNA, 64 nt, hsa
accuggacaacagagcgagacuccaucucaaaaaaaaaaaaaaauuguguugccucauacgaaa

SEQ ID NO: 34600 - RNA, 64 nt, hsa
ccuggacaacagagcgagacuccaucucaaaaaaaaaaaaaaauuguguugccucauacgaaau

SEQ ID NO: 34601 - RNA, 64 nt, hsa
cuggacaacagagcgagacuccaucucaaaaaaaaaaaaaaauuguguugccucauacgaaaug

SEQ ID NO: 34602 - RNA, 64 nt, hsa
uacuaagggacaauuauuuuaagaccauggauuuaaaaaaaaaaaaaaaaacucuguuucugca

SEQ ID NO: 34603 - RNA, 64 nt, hsa
acuaagggacaauuauuuuaagaccauggauuuaaaaaaaaaaaaaaaaacucuguuucugcag

SEQ ID NO: 34604 - RNA, 64 nt, hsa
cuaagggacaauuauuuuaagaccauggauuuaaaaaaaaaaaaaaaaacucuguuucugcagg

SEQ ID NO: 34605 - RNA, 64 nt, hsa
uaagggacaauuauuuuaagaccauggauuuaaaaaaaaaaaaaaaaacucuguuucugcaggg

SEQ ID NO: 34606 - RNA, 64 nt, hsa
aagggacaauuauuuuaagaccauggauuuaaaaaaaaaaaaaaaaacucuguuucugcagggg

SEQ ID NO: 34607 - RNA, 64 nt, hsa
agggacaauuauuuuaagaccauggauuuaaaaaaaaaaaaaaaaacucuguuucugcagggga

SEQ ID NO: 34608 - RNA, 64 nt, hsa
gggacaauuauuuuaagaccauggauuuaaaaaaaaaaaaaaaaacucuguuucugcaggggau

SEQ ID NO: 34609 - RNA, 64 nt, hsa
ggacaauuauuuuaagaccauggauuuaaaaaaaaaaaaaaaaacucuguuucugcaggggaug

SEQ ID NO: 34610 - RNA, 64 nt, hsa
gacaauuauuuuaagaccauggauuuaaaaaaaaaaaaaaaaacucuguuucugcaggggauga

SEQ ID NO: 34611 - RNA, 64 nt, hsa
acaauuauuuuaagaccauggauuuaaaaaaaaaaaaaaaaacucuguuucugcaggggaugau

SEQ ID NO: 34612 - RNA, 64 nt, hsa
caguaaaaaaauaauaaaagacaaaaacaaauuuaaaaaaaaauuuaagccacaaaaaaaggca

SEQ ID NO: 34613 - RNA, 64 nt, hsa
aguaaaaaaauaauaaaagacaaaaacaaauuuaaaaaaaaauuuaagccacaaaaaaaggcac

SEQ ID NO: 34614 - RNA, 64 nt, hsa
aucaaucugagggaggggauaaagaggaagcaauaaaaaaaaaacauccgacagagcagcucug

SEQ ID NO: 34615 - RNA, 64 nt, hsa
ucaaucugagggaggggauaaagaggaagcaauaaaaaaaaaacauccgacagagcagcucugg

SEQ ID NO: 34616 - RNA, 64 nt, hsa
caaucugagggaggggauaaagaggaagcaauaaaaaaaaaacauccgacagagcagcucuggc

SEQ ID NO: 34617 - RNA, 64 nt, hsa
cuccagccugggcgacagaaccagacuccgucucaaaaaaaaaaaaaaaacaaaaaaggcugaa

SEQ ID NO: 34618 - RNA, 64 nt, hsa
uccagccugggcgacagaaccagacuccgucucaaaaaaaaaaaaaaaacaaaaaaggcugaag

SEQ ID NO: 34619 - RNA, 64 nt, hsa
ccagccugggcgacagaaccagacuccgucucaaaaaaaaaaaaaaaacaaaaaaggcugaagg

SEQ ID NO: 34620 - RNA, 64 nt, hsa
cagccugggcgacagaaccagacuccgucucaaaaaaaaaaaaaaaacaaaaaaggcugaaggc

SEQ ID NO: 34621 - RNA, 64 nt, hsa
agccugggcgacagaaccagacuccgucucaaaaaaaaaaaaaaaacaaaaaaggcugaaggca

SEQ ID NO: 34622 - RNA, 64 nt, hsa
gccugggcgacagaaccagacuccgucucaaaaaaaaaaaaaaaacaaaaaaggcugaaggcag

SEQ ID NO: 34623 - RNA, 64 nt, hsa
ccugggcgacagaaccagacuccgucucaaaaaaaaaaaaaaaacaaaaaaggcugaaggcagc

SEQ ID NO: 34624 - RNA, 64 nt, hsa
cugggcgacagaaccagacuccgucucaaaaaaaaaaaaaaaacaaaaaaggcugaaggcagcu

SEQ ID NO: 34625 - RNA, 64 nt, hsa
ugggcgacagaaccagacuccgucucaaaaaaaaaaaaaaaacaaaaaaggcugaaggcagcug

SEQ ID NO: 34626 - RNA, 64 nt, hsa
uccagccugggcaaaaagagugagacucugucucaaaaaaaaaacaaaacaaaaaaaaccucuu

SEQ ID NO: 34627 - RNA, 64 nt, hsa
ccagccugggcaaaaagagugagacucugucucaaaaaaaaaacaaaacaaaaaaaaccucuuu

SEQ ID NO: 34628 - RNA, 64 nt, hsa
cagccugggcaaaaagagugagacucugucucaaaaaaaaaacaaaacaaaaaaaaccucuuug

SEQ ID NO: 34629 - RNA, 64 nt, hsa
agagugagacucugucucaaaaaaaaaacaaaacaaaaaaaaccucuuugcugguauauuugaa

SEQ ID NO: 34630 - RNA, 64 nt, hsa
ugaacuucccuuccuuaaaguacucuaaaccuuuaaaaaaaaaucugauuuaugcagcagagau

SEQ ID NO: 34631 - RNA, 64 nt, hsa
gaacuucccuuccuuaaaguacucuaaaccuuuaaaaaaaaaucugauuuaugcagcagagaug

SEQ ID NO: 34632 - RNA, 64 nt, hsa
agucgaaagcuuuuaaguauagcuuccucccuugaaaaaaaauguaaacuaugacugcugagug

SEQ ID NO: 34633 - RNA, 64 nt, hsa
cuguguuuucuaacacauuuuucuguuuuuaauuaaaaaaaaaaaaaaaagguuuucaguugcu

SEQ ID NO: 34634 - RNA, 64 nt, hsa
uguguuuucuaacacauuuuucuguuuuuaauuaaaaaaaaaaaaaaaagguuuucaguugcuu

SEQ ID NO: 34635 - RNA, 64 nt, hsa
guguuuucuaacacauuuuucuguuuuuaauuaaaaaaaaaaaaaaaagguuuucaguugcuuu

SEQ ID NO: 34636 - RNA, 64 nt, hsa
uguuuucuaacacauuuuucuguuuuuaauuaaaaaaaaaaaaaaaagguuuucaguugcuuuu

SEQ ID NO: 34637 - RNA, 64 nt, hsa
guuuucuaacacauuuuucuguuuuuaauuaaaaaaaaaaaaaaaagguuuucaguugcuuuug

SEQ ID NO: 34638 - RNA, 64 nt, hsa
uuuucuaacacauuuuucuguuuuuaauuaaaaaaaaaaaaaaaagguuuucaguugcuuuugu

SEQ ID NO: 34639 - RNA, 64 nt, hsa
uuucuaacacauuuuucuguuuuuaauuaaaaaaaaaaaaaaaagguuuucaguugcuuuuguc

SEQ ID NO: 34640 - RNA, 64 nt, hsa
uucuaacacauuuuucuguuuuuaauuaaaaaaaaaaaaaaaagguuuucaguugcuuuugucu

SEQ ID NO: 34641 - RNA, 64 nt, hsa
ucuaacacauuuuucuguuuuuaauuaaaaaaaaaaaaaaaagguuuucaguugcuuuugucuc

SEQ ID NO: 34642 - RNA, 64 nt, hsa
ccccucugcgagaaacacccaagaaugaucaauuaaaaaaaaaauaauauaauaauaauucuug

SEQ ID NO: 34643 - RNA, 64 nt, hsa
cccucugcgagaaacacccaagaaugaucaauuaaaaaaaaaauaauauaauaauaauucuugu

SEQ ID NO: 34644 - RNA, 64 nt, hsa
ccucugcgagaaacacccaagaaugaucaauuaaaaaaaaaauaauauaauaauaauucuuguc

SEQ ID NO: 34645 - RNA, 64 nt, hsa
aggcacccacagcaucaugcaaguggcaucuuguaaaaaaaaaaaaaaaguuuaaucugaaucu

SEQ ID NO: 34646 - RNA, 64 nt, hsa
ggcacccacagcaucaugcaaguggcaucuuguaaaaaaaaaaaaaaaguuuaaucugaaucua

SEQ ID NO: 34647 - RNA, 64 nt, hsa
gcacccacagcaucaugcaaguggcaucuuguaaaaaaaaaaaaaaaguuuaaucugaaucuaa

SEQ ID NO: 34648 - RNA, 64 nt, hsa
cacccacagcaucaugcaaguggcaucuuguaaaaaaaaaaaaaaaguuuaaucugaaucuaac

SEQ ID NO: 34649 - RNA, 64 nt, hsa
acccacagcaucaugcaaguggcaucuuguaaaaaaaaaaaaaaaguuuaaucugaaucuaacc

SEQ ID NO: 34650 - RNA, 64 nt, hsa
cccacagcaucaugcaaguggcaucuuguaaaaaaaaaaaaaaaguuuaaucugaaucuaacca

SEQ ID NO: 34651 - RNA, 64 nt, hsa
ccacagcaucaugcaaguggcaucuuguaaaaaaaaaaaaaaaguuuaaucugaaucuaaccau

SEQ ID NO: 34652 - RNA, 64 nt, hsa
cacagcaucaugcaaguggcaucuuguaaaaaaaaaaaaaaaguuuaaucugaaucuaaccaug

SEQ ID NO: 34653 - RNA, 64 nt, hsa
cugggcaacauagugagaccccaucucuacaaagaaaaaaaaauuagcuggacaugguaaugaa

SEQ ID NO: 34654 - RNA, 64 nt, hsa
ugggcaacauagugagaccccaucucuacaaagaaaaaaaaauuagcuggacaugguaaugaau

SEQ ID NO: 34655 - RNA, 64 nt, hsa
acuuagccugggugacagagugagacccuaucucaaaaaaaaaaaaaaucuaugcauuguaugg

SEQ ID NO: 34656 - RNA, 64 nt, hsa
cuuagccugggugacagagugagacccuaucucaaaaaaaaaaaaaaucuaugcauuguauggg

SEQ ID NO: 34657 - RNA, 64 nt, hsa
uuagccugggugacagagugagacccuaucucaaaaaaaaaaaaaaucuaugcauuguauggga

SEQ ID NO: 34658 - RNA, 64 nt, hsa
uagccugggugacagagugagacccuaucucaaaaaaaaaaaaaaucuaugcauuguaugggac

SEQ ID NO: 34659 - RNA, 64 nt, hsa
agccugggugacagagugagacccuaucucaaaaaaaaaaaaaaucuaugcauuguaugggacu

SEQ ID NO: 34660 - RNA, 64 nt, hsa
gccugggugacagagugagacccuaucucaaaaaaaaaaaaaaucuaugcauuguaugggacuu

SEQ ID NO: 34661 - RNA, 64 nt, hsa
ccugggugacagagugagacccuaucucaaaaaaaaaaaaaaucuaugcauuguaugggacuuu

SEQ ID NO: 34662 - RNA, 64 nt, hsa
gcaacauagugauaccuugucucuaccaaaaguuaaaaaaaaaaaaaaaaaagcucaagaaccu

SEQ ID NO: 34663 - RNA, 64 nt, hsa
caacauagugauaccuugucucuaccaaaaguuaaaaaaaaaaaaaaaaaagcucaagaaccug

SEQ ID NO: 34664 - RNA, 64 nt, hsa
aacauagugauaccuugucucuaccaaaaguuaaaaaaaaaaaaaaaaaagcucaagaaccugc

SEQ ID NO: 34665 - RNA, 64 nt, hsa
acauagugauaccuugucucuaccaaaaguuaaaaaaaaaaaaaaaaaagcucaagaaccugca

SEQ ID NO: 34666 - RNA, 64 nt, hsa
cauagugauaccuugucucuaccaaaaguuaaaaaaaaaaaaaaaaaagcucaagaaccugcac

SEQ ID NO: 34667 - RNA, 64 nt, hsa
auagugauaccuugucucuaccaaaaguuaaaaaaaaaaaaaaaaaagcucaagaaccugcacg

SEQ ID NO: 34668 - RNA, 64 nt, hsa
uagugauaccuugucucuaccaaaaguuaaaaaaaaaaaaaaaaaagcucaagaaccugcacga

SEQ ID NO: 34669 - RNA, 64 nt, hsa
agugauaccuugucucuaccaaaaguuaaaaaaaaaaaaaaaaaagcucaagaaccugcacgag

SEQ ID NO: 34670 - RNA, 64 nt, hsa
gugauaccuugucucuaccaaaaguuaaaaaaaaaaaaaaaaaagcucaagaaccugcacgagg

SEQ ID NO: 34671 - RNA, 64 nt, hsa
ugauaccuugucucuaccaaaaguuaaaaaaaaaaaaaaaaaagcucaagaaccugcacgaggg

SEQ ID NO: 34672 - RNA, 64 nt, hsa
gauaccuugucucuaccaaaaguuaaaaaaaaaaaaaaaaaagcucaagaaccugcacgagggc

SEQ ID NO: 34673 - RNA, 64 nt, hsa
aguauuaaguucuuagucauugauuuuuguguuuaaaaaaaaauaggaaagagggaaacugcag

SEQ ID NO: 34674 - RNA, 64 nt, hsa
guauuaaguucuuagucauugauuuuuguguuuaaaaaaaaauaggaaagagggaaacugcagc

SEQ ID NO: 34675 - RNA, 64 nt, hsa
cgggcuuuaauuugcuaaagcugugcacauauguaaaaaaaaaaaaaaaaagauuauuuuaggg

SEQ ID NO: 34676 - RNA, 64 nt, hsa
gggcuuuaauuugcuaaagcugugcacauauguaaaaaaaaaaaaaaaaagauuauuuuagggg

SEQ ID NO: 34677 - RNA, 64 nt, hsa
ggcuuuaauuugcuaaagcugugcacauauguaaaaaaaaaaaaaaaaagauuauuuuagggga

SEQ ID NO: 34678 - RNA, 64 nt, hsa
gcuuuaauuugcuaaagcugugcacauauguaaaaaaaaaaaaaaaaagauuauuuuaggggag

SEQ ID NO: 34679 - RNA, 64 nt, hsa
cuuuaauuugcuaaagcugugcacauauguaaaaaaaaaaaaaaaaagauuauuuuaggggaga

SEQ ID NO: 34680 - RNA, 64 nt, hsa
uuuaauuugcuaaagcugugcacauauguaaaaaaaaaaaaaaaaagauuauuuuaggggagau

SEQ ID NO: 34681 - RNA, 64 nt, hsa
uuaauuugcuaaagcugugcacauauguaaaaaaaaaaaaaaaaagauuauuuuaggggagaug

SEQ ID NO: 34682 - RNA, 64 nt, hsa
uaauuugcuaaagcugugcacauauguaaaaaaaaaaaaaaaaagauuauuuuaggggagaugu

SEQ ID NO: 34683 - RNA, 64 nt, hsa
aauuugcuaaagcugugcacauauguaaaaaaaaaaaaaaaaagauuauuuuaggggagaugua

SEQ ID NO: 34684 - RNA, 64 nt, hsa
auuugcuaaagcugugcacauauguaaaaaaaaaaaaaaaaagauuauuuuaggggagauguag

SEQ ID NO: 34685 - RNA, 64 nt, hsa
agaugauaaagcauuugaaugguacaguagauguaaaaaaaauucaguuuaaaagaacauuugu

SEQ ID NO: 34686 - RNA, 64 nt, hsa
uuacuggcccaacuugggaguggggaaauugcuuaaaaaaaaagaaaaagaaaaaaaaaaagau

SEQ ID NO: 34687 - RNA, 64 nt, hsa
uacuggcccaacuugggaguggggaaauugcuuaaaaaaaaagaaaaagaaaaaaaaaaagauu

SEQ ID NO: 34688 - RNA, 64 nt, hsa
ggaguggggaaauugcuuaaaaaaaaagaaaaagaaaaaaaaaaagauuauucuaaauaaaagg

SEQ ID NO: 34689 - RNA, 64 nt, hsa
gaguggggaaauugcuuaaaaaaaaagaaaaagaaaaaaaaaaagauuauucuaaauaaaagga

SEQ ID NO: 34690 - RNA, 64 nt, hsa
aguggggaaauugcuuaaaaaaaaagaaaaagaaaaaaaaaaagauuauucuaaauaaaaggaa

SEQ ID NO: 34691 - RNA, 64 nt, hsa
guggggaaauugcuuaaaaaaaaagaaaaagaaaaaaaaaaagauuauucuaaauaaaaggaaa

SEQ ID NO: 34692 - RNA, 64 nt, hsa
augcugcuaugaagacuacuuuuagaucaacaauaaaaaaaaaccuacaaaaaaaccuuuauuc

SEQ ID NO: 34693 - RNA, 64 nt, hsa
ugcugcuaugaagacuacuuuuagaucaacaauaaaaaaaaaccuacaaaaaaaccuuuauucu

SEQ ID NO: 34694 - RNA, 64 nt, hsa
auggguuuuauuauauauauauauuuuuuuuuuuaaaaaaaaaacguauugcauuuaauuuauu

SEQ ID NO: 34695 - RNA, 64 nt, hsa
uggguuuuauuauauauauauauuuuuuuuuuuaaaaaaaaaacguauugcauuuaauuuauug

SEQ ID NO: 34696 - RNA, 64 nt, hsa
ggguuuuauuauauauauauauuuuuuuuuuuaaaaaaaaaacguauugcauuuaauuuauuga

SEQ ID NO: 34697 - RNA, 64 nt, hsa
uucuaagaaauucuguuuucuuaguucucugguuaaaaaaaaaaauacauaaacuguauccuuc

SEQ ID NO: 34698 - RNA, 64 nt, hsa
ucuaagaaauucuguuuucuuaguucucugguuaaaaaaaaaaauacauaaacuguauccuucu

SEQ ID NO: 34699 - RNA, 64 nt, hsa
cuaagaaauucuguuuucuuaguucucugguuaaaaaaaaaaauacauaaacuguauccuucuu

SEQ ID NO: 34700 - RNA, 64 nt, hsa
uaagaaauucuguuuucuuaguucucugguuaaaaaaaaaaauacauaaacuguauccuucuuu

SEQ ID NO: 34701 - RNA, 64 nt, hsa
cuccagccugggcaacaaagugagacucugucucaaaaaaaaaaaaacaaaaaaaaaccuuuaa

SEQ ID NO: 34702 - RNA, 64 nt, hsa
uccagccugggcaacaaagugagacucugucucaaaaaaaaaaaaacaaaaaaaaaccuuuaau

SEQ ID NO: 34703 - RNA, 64 nt, hsa
ccagccugggcaacaaagugagacucugucucaaaaaaaaaaaaacaaaaaaaaaccuuuaaug

SEQ ID NO: 34704 - RNA, 64 nt, hsa
cagccugggcaacaaagugagacucugucucaaaaaaaaaaaaacaaaaaaaaaccuuuaaugu

SEQ ID NO: 34705 - RNA, 64 nt, hsa
agccugggcaacaaagugagacucugucucaaaaaaaaaaaaacaaaaaaaaaccuuuaauguc

SEQ ID NO: 34706 - RNA, 64 nt, hsa
gccugggcaacaaagugagacucugucucaaaaaaaaaaaaacaaaaaaaaaccuuuaaugucu

SEQ ID NO: 34707 - RNA, 64 nt, hsa
acaaagugagacucugucucaaaaaaaaaaaaacaaaaaaaaaccuuuaaugucuggcuuugua

SEQ ID NO: 34708 - RNA, 64 nt, hsa
caaagugagacucugucucaaaaaaaaaaaaacaaaaaaaaaccuuuaaugucuggcuuuguac

SEQ ID NO: 34709 - RNA, 64 nt, hsa
agccuggucaacagagcaagacuccaucucgaagaaaaaaaaaaaaaauuccccaccccuacca

SEQ ID NO: 34710 - RNA, 64 nt, hsa
gccuggucaacagagcaagacuccaucucgaagaaaaaaaaaaaaaauuccccaccccuaccaa

SEQ ID NO: 34711 - RNA, 64 nt, hsa
ccuggucaacagagcaagacuccaucucgaagaaaaaaaaaaaaaauuccccaccccuaccaau

SEQ ID NO: 34712 - RNA, 64 nt, hsa
cuggucaacagagcaagacuccaucucgaagaaaaaaaaaaaaaauuccccaccccuaccaauu

SEQ ID NO: 34713 - RNA, 64 nt, hsa
uggucaacagagcaagacuccaucucgaagaaaaaaaaaaaaaauuccccaccccuaccaauug

SEQ ID NO: 34714 - RNA, 64 nt, hsa
ggucaacagagcaagacuccaucucgaagaaaaaaaaaaaaaauuccccaccccuaccaauugu

SEQ ID NO: 34715 - RNA, 64 nt, hsa
gucaacagagcaagacuccaucucgaagaaaaaaaaaaaaaauuccccaccccuaccaauuguu

SEQ ID NO: 34716 - RNA, 64 nt, hsa
cuccagccugggcgacagagugagacuccgucucaaaaaaaaaaagaagguuguacccacagua

SEQ ID NO: 34717 - RNA, 64 nt, hsa
uccagccugggcgacagagugagacuccgucucaaaaaaaaaaagaagguuguacccacaguau

SEQ ID NO: 34718 - RNA, 64 nt, hsa
ccagccugggcgacagagugagacuccgucucaaaaaaaaaaagaagguuguacccacaguaua

SEQ ID NO: 34719 - RNA, 64 nt, hsa
cagccugggcgacagagugagacuccgucucaaaaaaaaaaagaagguuguacccacaguauac

SEQ ID NO: 34720 - RNA, 64 nt, hsa
cuccagccugggcaacacagggagacuccaucucaaaaaaaaaaaaaaaaaaaaaaagacauuc

SEQ ID NO: 34721 - RNA, 64 nt, hsa
uccagccugggcaacacagggagacuccaucucaaaaaaaaaaaaaaaaaaaaaaagacauuca

SEQ ID NO: 34722 - RNA, 64 nt, hsa
ccagccugggcaacacagggagacuccaucucaaaaaaaaaaaaaaaaaaaaaaagacauucaa

SEQ ID NO: 34723 - RNA, 64 nt, hsa
cagccugggcaacacagggagacuccaucucaaaaaaaaaaaaaaaaaaaaaaagacauucaac

SEQ ID NO: 34724 - RNA, 64 nt, hsa
agccugggcaacacagggagacuccaucucaaaaaaaaaaaaaaaaaaaaaaagacauucaacu

SEQ ID NO: 34725 - RNA, 64 nt, hsa
gccugggcaacacagggagacuccaucucaaaaaaaaaaaaaaaaaaaaaaagacauucaacuu

SEQ ID NO: 34726 - RNA, 64 nt, hsa
ccugggcaacacagggagacuccaucucaaaaaaaaaaaaaaaaaaaaaaagacauucaacuug

SEQ ID NO: 34727 - RNA, 64 nt, hsa
cugggcaacacagggagacuccaucucaaaaaaaaaaaaaaaaaaaaaaagacauucaacuuga

SEQ ID NO: 34728 - RNA, 64 nt, hsa
ugggcaacacagggagacuccaucucaaaaaaaaaaaaaaaaaaaaaaagacauucaacuugag

SEQ ID NO: 34729 - RNA, 64 nt, hsa
gggcaacacagggagacuccaucucaaaaaaaaaaaaaaaaaaaaaaagacauucaacuugagg

SEQ ID NO: 34730 - RNA, 64 nt, hsa
ggcaacacagggagacuccaucucaaaaaaaaaaaaaaaaaaaaaaagacauucaacuugaggc

SEQ ID NO: 34731 - RNA, 64 nt, hsa
gcaacacagggagacuccaucucaaaaaaaaaaaaaaaaaaaaaaagacauucaacuugaggcu

SEQ ID NO: 34732 - RNA, 64 nt, hsa
caacacagggagacuccaucucaaaaaaaaaaaaaaaaaaaaaaagacauucaacuugaggcuc

SEQ ID NO: 34733 - RNA, 64 nt, hsa
aacacagggagacuccaucucaaaaaaaaaaaaaaaaaaaaaaagacauucaacuugaggcucc

SEQ ID NO: 34734 - RNA, 64 nt, hsa
acacagggagacuccaucucaaaaaaaaaaaaaaaaaaaaaaagacauucaacuugaggcuccu

SEQ ID NO: 34735 - RNA, 64 nt, hsa
cacagggagacuccaucucaaaaaaaaaaaaaaaaaaaaaaagacauucaacuugaggcuccug

SEQ ID NO: 34736 - RNA, 64 nt, hsa
cuccagccugggcgauagagcuagacucugucucaaaaaaaaaacaaaaaacaaguaacucuuu

SEQ ID NO: 34737 - RNA, 64 nt, hsa
uccagccugggcgauagagcuagacucugucucaaaaaaaaaacaaaaaacaaguaacucuuua

SEQ ID NO: 34738 - RNA, 64 nt, hsa
ccagccugggcgauagagcuagacucugucucaaaaaaaaaacaaaaaacaaguaacucuuuau

SEQ ID NO: 34739 - RNA, 64 nt, hsa
cuccagccugggugacagagcgagacuccgucucaaaaaaaaaaaaaaauucggccaggugcgg

SEQ ID NO: 34740 - RNA, 64 nt, hsa
uccagccugggugacagagcgagacuccgucucaaaaaaaaaaaaaaauucggccaggugcggu

SEQ ID NO: 34741 - RNA, 64 nt, hsa
ccagccugggugacagagcgagacuccgucucaaaaaaaaaaaaaaauucggccaggugcggug

SEQ ID NO: 34742 - RNA, 63 nt, hsa
cagccugggugacagagcgagacuccgucucaaaaaaaaaaaaaaauucggccaggugcggug

SEQ ID NO: 34743 - RNA, 62 nt, hsa
agccugggugacagagcgagacuccgucucaaaaaaaaaaaaaaauucggccaggugcggug

SEQ ID NO: 34744 - RNA, 64 nt, hsa
auuguccaauucuacgugcucucuauaccaaaacaaaaaaaaaaagcuauccaccuuuccaugu

SEQ ID NO: 34745 - RNA, 64 nt, hsa
uuguccaauucuacgugcucucuauaccaaaacaaaaaaaaaaagcuauccaccuuuccaugug

SEQ ID NO: 34746 - RNA, 64 nt, hsa
uguccaauucuacgugcucucuauaccaaaacaaaaaaaaaaagcuauccaccuuuccaugugg

SEQ ID NO: 34747 - RNA, 64 nt, hsa
guccaauucuacgugcucucuauaccaaaacaaaaaaaaaaagcuauccaccuuuccauguggg

SEQ ID NO: 34748 - RNA, 64 nt, hsa
auaauuguggagaggagagaaugagagaguguggaaaaaaaaagaauaaugacccggcccccgc

SEQ ID NO: 34749 - RNA, 64 nt, hsa
uaauuguggagaggagagaaugagagaguguggaaaaaaaaagaauaaugacccggcccccgcc

SEQ ID NO: 34750 - RNA, 64 nt, hsa
ccaaauugaugggugggcuaguaauaaaauauuuaaaaaaaaacauucaaaaacauggccacau

SEQ ID NO: 34751 - RNA, 64 nt, hsa
caaauugaugggugggcuaguaauaaaauauuuaaaaaaaaacauucaaaaacauggccacauc

SEQ ID NO: 34752 - RNA, 64 nt, hsa
uugccuucccuucugugugaccgaccccuuggccaaaaaaaaacaaaaagcaaaaaacaaaaac

SEQ ID NO: 34753 - RNA, 64 nt, hsa
ugccuucccuucugugugaccgaccccuuggccaaaaaaaaacaaaaagcaaaaaacaaaaacc

SEQ ID NO: 34754 - RNA, 64 nt, hsa
uuggaaaagagaaaaacaauggaguuacuuauuuaaaaaaaaagaaagaaaguuaucucuuccc

SEQ ID NO: 34755 - RNA, 64 nt, hsa
uggaaaagagaaaaacaauggaguuacuuauuuaaaaaaaaagaaagaaaguuaucucuuccca

SEQ ID NO: 34756 - RNA, 64 nt, hsa
gaaguuuuguuuacugaugcagcacaagagauguaaaaaaaaaaaaaaaaaaaaaaaaaaaaac

SEQ ID NO: 34757 - RNA, 64 nt, hsa
aaguuuuguuuacugaugcagcacaagagauguaaaaaaaaaaaaaaaaaaaaaaaaaaaaaca

SEQ ID NO: 34758 - RNA, 64 nt, hsa
aguuuuguuuacugaugcagcacaagagauguaaaaaaaaaaaaaaaaaaaaaaaaaaaaacac

SEQ ID NO: 34759 - RNA, 64 nt, hsa
guuuuguuuacugaugcagcacaagagauguaaaaaaaaaaaaaaaaaaaaaaaaaaaaacaca

SEQ ID NO: 34760 - RNA, 64 nt, hsa
uuuuguuuacugaugcagcacaagagauguaaaaaaaaaaaaaaaaaaaaaaaaaaaaacacac

SEQ ID NO: 34761 - RNA, 64 nt, hsa
uuuguuuacugaugcagcacaagagauguaaaaaaaaaaaaaaaaaaaaaaaaaaaaacacaca

SEQ ID NO: 34762 - RNA, 64 nt, hsa
uuguuuacugaugcagcacaagagauguaaaaaaaaaaaaaaaaaaaaaaaaaaaaacacacac

SEQ ID NO: 34763 - RNA, 64 nt, hsa
uguuuacugaugcagcacaagagauguaaaaaaaaaaaaaaaaaaaaaaaaaaaaacacacaca

SEQ ID NO: 34764 - RNA, 64 nt, hsa
guuuacugaugcagcacaagagauguaaaaaaaaaaaaaaaaaaaaaaaaaaaaacacacacac

SEQ ID NO: 34765 - RNA, 64 nt, hsa
uuuacugaugcagcacaagagauguaaaaaaaaaaaaaaaaaaaaaaaaaaaaacacacacaca

SEQ ID NO: 34766 - RNA, 64 nt, hsa
uuacugaugcagcacaagagauguaaaaaaaaaaaaaaaaaaaaaaaaaaaaacacacacacag

SEQ ID NO: 34767 - RNA, 64 nt, hsa
uacugaugcagcacaagagauguaaaaaaaaaaaaaaaaaaaaaaaaaaaaacacacacacaga

SEQ ID NO: 34768 - RNA, 64 nt, hsa
acugaugcagcacaagagauguaaaaaaaaaaaaaaaaaaaaaaaaaaaaacacacacacagag

SEQ ID NO: 34769 - RNA, 64 nt, hsa
cugaugcagcacaagagauguaaaaaaaaaaaaaaaaaaaaaaaaaaaaacacacacacagagg

SEQ ID NO: 34770 - RNA, 64 nt, hsa
ugaugcagcacaagagauguaaaaaaaaaaaaaaaaaaaaaaaaaaaaacacacacacagagga

SEQ ID NO: 34771 - RNA, 64 nt, hsa
gaugcagcacaagagauguaaaaaaaaaaaaaaaaaaaaaaaaaaaaacacacacacagaggaa

SEQ ID NO: 34772 - RNA, 64 nt, hsa
augcagcacaagagauguaaaaaaaaaaaaaaaaaaaaaaaaaaaaacacacacacagaggaaa

SEQ ID NO: 34773 - RNA, 64 nt, hsa
ugcagcacaagagauguaaaaaaaaaaaaaaaaaaaaaaaaaaaaacacacacacagaggaaag

SEQ ID NO: 34774 - RNA, 64 nt, hsa
gcagcacaagagauguaaaaaaaaaaaaaaaaaaaaaaaaaaaaacacacacacagaggaaaga

SEQ ID NO: 34775 - RNA, 64 nt, hsa
cagcacaagagauguaaaaaaaaaaaaaaaaaaaaaaaaaaaaacacacacacagaggaaagac

SEQ ID NO: 34776 - RNA, 64 nt, hsa
agcacaagagauguaaaaaaaaaaaaaaaaaaaaaaaaaaaaacacacacacagaggaaagacg

SEQ ID NO: 34777 - RNA, 64 nt, hsa
gcacaagagauguaaaaaaaaaaaaaaaaaaaaaaaaaaaaacacacacacagaggaaagacgc

SEQ ID NO: 34778 - RNA, 64 nt, hsa
agaaggaaggaaggaaggaacccccccccccccgaaaaaaaaaucaaagcgggaagaaaaucag

SEQ ID NO: 34779 - RNA, 64 nt, hsa
gaaggaaggaaggaaggaacccccccccccccgaaaaaaaaaucaaagcgggaagaaaaucaga

SEQ ID NO: 34780 - RNA, 64 nt, hsa
gcuuugauaucugguucagacuaucaucaggaagaaaaaaaaaucccacaguaccugaaaugug

SEQ ID NO: 34781 - RNA, 64 nt, hsa
cuuugauaucugguucagacuaucaucaggaagaaaaaaaaaucccacaguaccugaaauguga

SEQ ID NO: 34782 - RNA, 64 nt, hsa
uugggagauuuggaugauuugagaagagugacuuaaaaaaaaugcuucugugcucuaagauaua

SEQ ID NO: 34783 - RNA, 64 nt, hsa
uaaucauuuccuggguuccacuuacucuugauuuaaaaaaaaaaaaacaacaaaagaguuugug

SEQ ID NO: 34784 - RNA, 64 nt, hsa
aaucauuuccuggguuccacuuacucuugauuuaaaaaaaaaaaaacaacaaaagaguuugugu

SEQ ID NO: 34785 - RNA, 64 nt, hsa
aucauuuccuggguuccacuuacucuugauuuaaaaaaaaaaaaacaacaaaagaguuugugug

SEQ ID NO: 34786 - RNA, 64 nt, hsa
ucauuuccuggguuccacuuacucuugauuuaaaaaaaaaaaaacaacaaaagaguuugugugu

SEQ ID NO: 34787 - RNA, 64 nt, hsa
cauuuccuggguuccacuuacucuugauuuaaaaaaaaaaaaacaacaaaagaguuugugugug

SEQ ID NO: 34788 - RNA, 64 nt, hsa
auuuccuggguuccacuuacucuugauuuaaaaaaaaaaaaacaacaaaagaguuugugugugg

SEQ ID NO: 34789 - RNA, 64 nt, hsa
aauuuuugaauuuuaaaacuaaucuauuuuauuuaaaaaaaaucaaguacuuuggaagugaaua

SEQ ID NO: 34790 - RNA, 64 nt, hsa
aagccagcuggcuuaugcugguucucagcuguuuaaaaaaaaaaaaaaaaaggaauagaaacag

SEQ ID NO: 34791 - RNA, 64 nt, hsa
agccagcuggcuuaugcugguucucagcuguuuaaaaaaaaaaaaaaaaaggaauagaaacagu

SEQ ID NO: 34792 - RNA, 64 nt, hsa
gccagcuggcuuaugcugguucucagcuguuuaaaaaaaaaaaaaaaaaggaauagaaacaguu

SEQ ID NO: 34793 - RNA, 64 nt, hsa
ccagcuggcuuaugcugguucucagcuguuuaaaaaaaaaaaaaaaaaggaauagaaacaguuu

SEQ ID NO: 34794 - RNA, 64 nt, hsa
cagcuggcuuaugcugguucucagcuguuuaaaaaaaaaaaaaaaaaggaauagaaacaguuuc

SEQ ID NO: 34795 - RNA, 64 nt, hsa
agcuggcuuaugcugguucucagcuguuuaaaaaaaaaaaaaaaaaggaauagaaacaguuuca

SEQ ID NO: 34796 - RNA, 64 nt, hsa
gcuggcuuaugcugguucucagcuguuuaaaaaaaaaaaaaaaaaggaauagaaacaguuucaa

SEQ ID NO: 34797 - RNA, 64 nt, hsa
cuggcuuaugcugguucucagcuguuuaaaaaaaaaaaaaaaaaggaauagaaacaguuucaac

SEQ ID NO: 34798 - RNA, 64 nt, hsa
uggcuuaugcugguucucagcuguuuaaaaaaaaaaaaaaaaaggaauagaaacaguuucaacc

SEQ ID NO: 34799 - RNA, 64 nt, hsa
ggcuuaugcugguucucagcuguuuaaaaaaaaaaaaaaaaaggaauagaaacaguuucaacca

SEQ ID NO: 34800 - RNA, 64 nt, hsa
ugaucugggaacuuuuugcuguacaaaucuguuuaaaaaaaaaaaaaaguaacucauugaauua

SEQ ID NO: 34801 - RNA, 64 nt, hsa
gaucugggaacuuuuugcuguacaaaucuguuuaaaaaaaaaaaaaaguaacucauugaauuaa

SEQ ID NO: 34802 - RNA, 64 nt, hsa
aucugggaacuuuuugcuguacaaaucuguuuaaaaaaaaaaaaaaguaacucauugaauuaac

SEQ ID NO: 34803 - RNA, 64 nt, hsa
ucugggaacuuuuugcuguacaaaucuguuuaaaaaaaaaaaaaaguaacucauugaauuaacu

SEQ ID NO: 34804 - RNA, 64 nt, hsa
cugggaacuuuuugcuguacaaaucuguuuaaaaaaaaaaaaaaguaacucauugaauuaacuu

SEQ ID NO: 34805 - RNA, 64 nt, hsa
ugggaacuuuuugcuguacaaaucuguuuaaaaaaaaaaaaaaguaacucauugaauuaacuug

SEQ ID NO: 34806 - RNA, 64 nt, hsa
gggaacuuuuugcuguacaaaucuguuuaaaaaaaaaaaaaaguaacucauugaauuaacuugc

SEQ ID NO: 34807 - RNA, 64 nt, hsa
ucuuggacucauguccucauugcuucacucaauuaaaaaaaaauuauucuccaguccccuccca

SEQ ID NO: 34808 - RNA, 64 nt, hsa
cuuggacucauguccucauugcuucacucaauuaaaaaaaaauuauucuccaguccccucccac

SEQ ID NO: 34809 - RNA, 64 nt, hsa
gguacacauuauaguccaaagugcuuagcgaaguaaaaaaaaaagcuuuuuaaaauuucuauug

SEQ ID NO: 34810 - RNA, 64 nt, hsa
guacacauuauaguccaaagugcuuagcgaaguaaaaaaaaaagcuuuuuaaaauuucuauugu

SEQ ID NO: 34811 - RNA, 64 nt, hsa
uacacauuauaguccaaagugcuuagcgaaguaaaaaaaaaagcuuuuuaaaauuucuauuguu

SEQ ID NO: 34812 - RNA, 64 nt, hsa
uugaaauaauugacuugucuaaaaggacaaagagaaaaaaaaaauaccucaugacugcauucuc

SEQ ID NO: 34813 - RNA, 64 nt, hsa
ugaaauaauugacuugucuaaaaggacaaagagaaaaaaaaaauaccucaugacugcauucucu

SEQ ID NO: 34814 - RNA, 64 nt, hsa
gaaauaauugacuugucuaaaaggacaaagagaaaaaaaaaauaccucaugacugcauucucuc

SEQ ID NO: 34815 - RNA, 64 nt, hsa
gaaaggauacuggagagagaaauuacccauuucuaaaaaaaaaccacacucugucguaucugug

SEQ ID NO: 34816 - RNA, 64 nt, hsa
aaaggauacuggagagagaaauuacccauuucuaaaaaaaaaccacacucugucguaucugugu

SEQ ID NO: 34817 - RNA, 64 nt, hsa
uaaacguggauuuuaaaaaaucaaucaauggugcaaaaaaaaacuuaaagcaaaauaguauugc

SEQ ID NO: 34818 - RNA, 64 nt, hsa
aaacguggauuuuaaaaaaucaaucaauggugcaaaaaaaaacuuaaagcaaaauaguauugcu

SEQ ID NO: 34819 - RNA, 64 nt, hsa
guaacccagcugcaauaccugucuguaauaugagaaaaaaaaaaugaaucuauuuaaucauuuc

SEQ ID NO: 34820 - RNA, 64 nt, hsa
uaacccagcugcaauaccugucuguaauaugagaaaaaaaaaaugaaucuauuuaaucauuucu

SEQ ID NO: 34821 - RNA, 64 nt, hsa
aacccagcugcaauaccugucuguaauaugagaaaaaaaaaaugaaucuauuuaaucauuucua

SEQ ID NO: 34822 - RNA, 64 nt, hsa
auuucaucauugucccgggccugcauugcacuggaaaaaaaaaucgccaccuguucuuacacca

SEQ ID NO: 34823 - RNA, 64 nt, hsa
uuucaucauugucccgggccugcauugcacuggaaaaaaaaaucgccaccuguucuuacaccag

SEQ ID NO: 34824 - RNA, 64 nt, hsa
ucgauaaaaguucaucuuuggacagaaagccuuuaaaaaaaaaaucacucccucuucccccucc

SEQ ID NO: 34825 - RNA, 64 nt, hsa
cgauaaaaguucaucuuuggacagaaagccuuuaaaaaaaaaaucacucccucuucccccuccu

SEQ ID NO: 34826 - RNA, 64 nt, hsa
gauaaaaguucaucuuuggacagaaagccuuuaaaaaaaaaaucacucccucuucccccuccuc

SEQ ID NO: 34827 - RNA, 64 nt, hsa
agggaguggcacuucugccuugaguccccaggggaaaaaaaaaaaagauauuuaugaaauaaau

SEQ ID NO: 34828 - RNA, 64 nt, hsa
gggaguggcacuucugccuugaguccccaggggaaaaaaaaaaaagauauuuaugaaauaaaug

SEQ ID NO: 34829 - RNA, 64 nt, hsa
ggaguggcacuucugccuugaguccccaggggaaaaaaaaaaaagauauuuaugaaauaaaugg

SEQ ID NO: 34830 - RNA, 64 nt, hsa
gaguggcacuucugccuugaguccccaggggaaaaaaaaaaaagauauuuaugaaauaaauggu

SEQ ID NO: 34831 - RNA, 64 nt, hsa
aguggcacuucugccuugaguccccaggggaaaaaaaaaaaagauauuuaugaaauaaauggua

SEQ ID NO: 34832 - RNA, 64 nt, hsa
acgaugcaagcccauuguguuuccgggcuuuuuuaaaaaaaaaauuguagcacugggcguggug

SEQ ID NO: 34833 - RNA, 64 nt, hsa
cgaugcaagcccauuguguuuccgggcuuuuuuaaaaaaaaaauuguagcacugggcguggugc

SEQ ID NO: 34834 - RNA, 64 nt, hsa
gaugcaagcccauuguguuuccgggcuuuuuuaaaaaaaaaauuguagcacugggcguggugca

SEQ ID NO: 34835 - RNA, 64 nt, hsa
agcugggaagaaucagaucagauauuuuccugacaaaaaaaaaugacccuacagagagcaucaa

SEQ ID NO: 34836 - RNA, 64 nt, hsa
gcugggaagaaucagaucagauauuuuccugacaaaaaaaaaugacccuacagagagcaucaaa

SEQ ID NO: 34837 - RNA, 64 nt, hsa
acaaagcaagacucugucucaaaaaaauaaaaauaaaaaaaaaaucuuaguuccauggaauuuu

SEQ ID NO: 34838 - RNA, 64 nt, hsa
caaagcaagacucugucucaaaaaaauaaaaauaaaaaaaaaaucuuaguuccauggaauuuua

SEQ ID NO: 34839 - RNA, 64 nt, hsa
aaagcaagacucugucucaaaaaaauaaaaauaaaaaaaaaaucuuaguuccauggaauuuuaa

SEQ ID NO: 34840 - RNA, 64 nt, hsa
agcugggagacacagcaagacuccgucucaaaagaaaaaaaaaaaaaagaacaacugccaaggc

SEQ ID NO: 34841 - RNA, 64 nt, hsa
gcugggagacacagcaagacuccgucucaaaagaaaaaaaaaaaaaagaacaacugccaaggcc

SEQ ID NO: 34842 - RNA, 64 nt, hsa
cugggagacacagcaagacuccgucucaaaagaaaaaaaaaaaaaagaacaacugccaaggccu

SEQ ID NO: 34843 - RNA, 64 nt, hsa
ugggagacacagcaagacuccgucucaaaagaaaaaaaaaaaaaagaacaacugccaaggccug

SEQ ID NO: 34844 - RNA, 64 nt, hsa
gggagacacagcaagacuccgucucaaaagaaaaaaaaaaaaaagaacaacugccaaggccugu

SEQ ID NO: 34845 - RNA, 64 nt, hsa
ggagacacagcaagacuccgucucaaaagaaaaaaaaaaaaaagaacaacugccaaggccuguc

SEQ ID NO: 34846 - RNA, 64 nt, hsa
gagacacagcaagacuccgucucaaaagaaaaaaaaaaaaaagaacaacugccaaggccugucu

SEQ ID NO: 34847 - RNA, 64 nt, hsa
cggugaaaccccaccucuacuaaaauuaaaaaagaaaaaaaauagccgggcgugguggcaggcg

SEQ ID NO: 34848 - RNA, 64 nt, hsa
cuccagccugggugacagagugagacuccaacucaaaaaaaaaaaaaaaaaagaucuuggggag

SEQ ID NO: 34849 - RNA, 64 nt, hsa
uccagccugggugacagagugagacuccaacucaaaaaaaaaaaaaaaaaagaucuuggggagg

SEQ ID NO: 34850 - RNA, 64 nt, hsa
ccagccugggugacagagugagacuccaacucaaaaaaaaaaaaaaaaaagaucuuggggaggc

SEQ ID NO: 34851 - RNA, 64 nt, hsa
cagccugggugacagagugagacuccaacucaaaaaaaaaaaaaaaaaagaucuuggggaggca

SEQ ID NO: 34852 - RNA, 64 nt, hsa
agccugggugacagagugagacuccaacucaaaaaaaaaaaaaaaaaagaucuuggggaggcag

SEQ ID NO: 34853 - RNA, 64 nt, hsa
gccugggugacagagugagacuccaacucaaaaaaaaaaaaaaaaaagaucuuggggaggcaga

SEQ ID NO: 34854 - RNA, 64 nt, hsa
ccugggugacagagugagacuccaacucaaaaaaaaaaaaaaaaaagaucuuggggaggcagac

SEQ ID NO: 34855 - RNA, 64 nt, hsa
cugggugacagagugagacuccaacucaaaaaaaaaaaaaaaaaagaucuuggggaggcagaca

SEQ ID NO: 34856 - RNA, 64 nt, hsa
ugggugacagagugagacuccaacucaaaaaaaaaaaaaaaaaagaucuuggggaggcagacag

SEQ ID NO: 34857 - RNA, 64 nt, hsa
gggugacagagugagacuccaacucaaaaaaaaaaaaaaaaaagaucuuggggaggcagacagc

SEQ ID NO: 34858 - RNA, 63 nt, hsa
ggugacagagugagacuccaacucaaaaaaaaaaaaaaaaaagaucuuggggaggcagacagc

SEQ ID NO: 34859 - RNA, 64 nt, hsa
aaaagcauuauacuguggguaaugaaaagggaggaaaaaaaaagaaggaaaaggaauuauagac

SEQ ID NO: 34860 - RNA, 64 nt, hsa
aaagcauuauacuguggguaaugaaaagggaggaaaaaaaaagaaggaaaaggaauuauagacc

SEQ ID NO: 34861 - RNA, 64 nt, hsa
aauuugucagcuggaacucagaaacaacaacuugaaaaaaaaauaauaauuagaacauauuugc

SEQ ID NO: 34862 - RNA, 64 nt, hsa
auuugucagcuggaacucagaaacaacaacuugaaaaaaaaauaauaauuagaacauauuugca

SEQ ID NO: 34863 - RNA, 64 nt, hsa
uaacauggugaaaccccaucucuacuaaaaauacaaaaaaaaauuagccgggggugguggcggg

SEQ ID NO: 34864 - RNA, 64 nt, hsa
aacauggugaaaccccaucucuacuaaaaauacaaaaaaaaauuagccgggggugguggcgggu

SEQ ID NO: 34865 - RNA, 64 nt, hsa
cugggcgacagagcaagacuccgucucaaaaaauaaaaaaaaaaaaaaaauaggugaaaauucc

SEQ ID NO: 34866 - RNA, 64 nt, hsa
ugggcgacagagcaagacuccgucucaaaaaauaaaaaaaaaaaaaaaauaggugaaaauuccu

SEQ ID NO: 34867 - RNA, 64 nt, hsa
gggcgacagagcaagacuccgucucaaaaaauaaaaaaaaaaaaaaaauaggugaaaauuccuu

SEQ ID NO: 34868 - RNA, 64 nt, hsa
ggcgacagagcaagacuccgucucaaaaaauaaaaaaaaaaaaaaaauaggugaaaauuccuua

SEQ ID NO: 34869 - RNA, 64 nt, hsa
gcgacagagcaagacuccgucucaaaaaauaaaaaaaaaaaaaaaauaggugaaaauuccuuau

SEQ ID NO: 34870 - RNA, 64 nt, hsa
cgacagagcaagacuccgucucaaaaaauaaaaaaaaaaaaaaaauaggugaaaauuccuuaua

SEQ ID NO: 34871 - RNA, 64 nt, hsa
gacagagcaagacuccgucucaaaaaauaaaaaaaaaaaaaaaauaggugaaaauuccuuauaa

SEQ ID NO: 34872 - RNA, 64 nt, hsa
acagagcaagacuccgucucaaaaaauaaaaaaaaaaaaaaaauaggugaaaauuccuuauaaa

SEQ ID NO: 34873 - RNA, 64 nt, hsa
cagagcaagacuccgucucaaaaaauaaaaaaaaaaaaaaaauaggugaaaauuccuuauaaau

SEQ ID NO: 34874 - RNA, 64 nt, hsa
aacacccaguuuccuugggaguugucauuaaaggaaaaaaaaaaaaaaaaaagccagugcccag

SEQ ID NO: 34875 - RNA, 64 nt, hsa
acacccaguuuccuugggaguugucauuaaaggaaaaaaaaaaaaaaaaaagccagugcccagg

SEQ ID NO: 34876 - RNA, 64 nt, hsa
cacccaguuuccuugggaguugucauuaaaggaaaaaaaaaaaaaaaaaagccagugcccaggg

SEQ ID NO: 34877 - RNA, 64 nt, hsa
acccaguuuccuugggaguugucauuaaaggaaaaaaaaaaaaaaaaaagccagugcccaggga

SEQ ID NO: 34878 - RNA, 64 nt, hsa
cccaguuuccuugggaguugucauuaaaggaaaaaaaaaaaaaaaaaagccagugcccagggau

SEQ ID NO: 34879 - RNA, 64 nt, hsa
ccaguuuccuugggaguugucauuaaaggaaaaaaaaaaaaaaaaaagccagugcccagggaug

SEQ ID NO: 34880 - RNA, 64 nt, hsa
caguuuccuugggaguugucauuaaaggaaaaaaaaaaaaaaaaaagccagugcccagggaugg

SEQ ID NO: 34881 - RNA, 64 nt, hsa
aguuuccuugggaguugucauuaaaggaaaaaaaaaaaaaaaaaagccagugcccagggauggg

SEQ ID NO: 34882 - RNA, 64 nt, hsa
guuuccuugggaguugucauuaaaggaaaaaaaaaaaaaaaaaagccagugcccagggaugggc

SEQ ID NO: 34883 - RNA, 64 nt, hsa
uuuccuugggaguugucauuaaaggaaaaaaaaaaaaaaaaaagccagugcccagggaugggca

SEQ ID NO: 34884 - RNA, 64 nt, hsa
uuccuugggaguugucauuaaaggaaaaaaaaaaaaaaaaaagccagugcccagggaugggcau

SEQ ID NO: 34885 - RNA, 64 nt, hsa
uauuguggcagaagcgagaaaacuuuguuuauugaaaaaaaaagaaaaagaaagcaagaaaaaa

SEQ ID NO: 34886 - RNA, 64 nt, hsa
auuguggcagaagcgagaaaacuuuguuuauugaaaaaaaaagaaaaagaaagcaagaaaaaaa

SEQ ID NO: 34887 - RNA, 64 nt, hsa
gaaaagauuccauuuuauacaagaagggagauucaaaaaaaaaauauaagguuggguuagcaau

SEQ ID NO: 34888 - RNA, 64 nt, hsa
aaaagauuccauuuuauacaagaagggagauucaaaaaaaaaauauaagguuggguuagcaaua

SEQ ID NO: 34889 - RNA, 64 nt, hsa
aaagauuccauuuuauacaagaagggagauucaaaaaaaaaauauaagguuggguuagcaauau

SEQ ID NO: 34890 - RNA, 64 nt, hsa
aggaaggacagaggguuuugauuuuaaaaagaagaaaaaaaaaccuuauuuuuucuuucuuggc

SEQ ID NO: 34891 - RNA, 64 nt, hsa
ggaaggacagaggguuuugauuuuaaaaagaagaaaaaaaaaccuuauuuuuucuuucuuggcc

SEQ ID NO: 34892 - RNA, 64 nt, hsa
uuuuucacucugugucuaauaauguuaaggugggaaaaaaaaaaguguggcauagcuaccugcc

SEQ ID NO: 34893 - RNA, 64 nt, hsa
uuuucacucugugucuaauaauguuaaggugggaaaaaaaaaaguguggcauagcuaccugccc

SEQ ID NO: 34894 - RNA, 64 nt, hsa
uuucacucugugucuaauaauguuaaggugggaaaaaaaaaaguguggcauagcuaccugccca

SEQ ID NO: 34895 - RNA, 64 nt, hsa
auuuuuguacagauuugcuuucucuuacaaaaagaaaaaaaaaauccuguuguauuaacauuua

SEQ ID NO: 34896 - RNA, 64 nt, hsa
uuuuuguacagauuugcuuucucuuacaaaaagaaaaaaaaaauccuguuguauuaacauuuaa

SEQ ID NO: 34897 - RNA, 64 nt, hsa
uuuuguacagauuugcuuucucuuacaaaaagaaaaaaaaaauccuguuguauuaacauuuaaa

SEQ ID NO: 34898 - RNA, 64 nt, hsa
ccucaggcuuugcgauuuaaggaggagcugccuuaaaaaaaaauaaaggccuuauuuugcaauu

SEQ ID NO: 34899 - RNA, 64 nt, hsa
cucaggcuuugcgauuuaaggaggagcugccuuaaaaaaaaauaaaggccuuauuuugcaauua

SEQ ID NO: 34900 - RNA, 64 nt, hsa
uauuuauuuuguaaggagagguuuuaauuaaaacaaaaaaaaauucuuuuuuuuuuuuuuuucc

SEQ ID NO: 34901 - RNA, 64 nt, hsa
auuuauuuuguaaggagagguuuuaauuaaaacaaaaaaaaauucuuuuuuuuuuuuuuuucca

SEQ ID NO: 34902 - RNA, 64 nt, hsa
gucacaggcauccauccagucguaucuuucagagaaaaaaaaaguuagauguagccaaggaaag

SEQ ID NO: 34903 - RNA, 64 nt, hsa
ucacaggcauccauccagucguaucuuucagagaaaaaaaaaguuagauguagccaaggaaagu

SEQ ID NO: 34904 - RNA, 64 nt, hsa
uguuuguacagaaauauacuggccuagcagaggcaaaaaaaaaaaaaaugaauuuuauuuuacu

SEQ ID NO: 34905 - RNA, 64 nt, hsa
guuuguacagaaauauacuggccuagcagaggcaaaaaaaaaaaaaaugaauuuuauuuuacuu

SEQ ID NO: 34906 - RNA, 64 nt, hsa
uuuguacagaaauauacuggccuagcagaggcaaaaaaaaaaaaaaugaauuuuauuuuacuug

SEQ ID NO: 34907 - RNA, 64 nt, hsa
uuguacagaaauauacuggccuagcagaggcaaaaaaaaaaaaaaugaauuuuauuuuacuugu

SEQ ID NO: 34908 - RNA, 64 nt, hsa
uguacagaaauauacuggccuagcagaggcaaaaaaaaaaaaaaugaauuuuauuuuacuuguc

SEQ ID NO: 34909 - RNA, 64 nt, hsa
guacagaaauauacuggccuagcagaggcaaaaaaaaaaaaaaugaauuuuauuuuacuuguca

SEQ ID NO: 34910 - RNA, 64 nt, hsa
uacagaaauauacuggccuagcagaggcaaaaaaaaaaaaaaugaauuuuauuuuacuugucac

SEQ ID NO: 34911 - RNA, 64 nt, hsa
cuccaaccugggugacagagugagacccugucucaaaaaaaaauaaaauaaggaccuuauugug

SEQ ID NO: 34912 - RNA, 64 nt, hsa
uccaaccugggugacagagugagacccugucucaaaaaaaaauaaaauaaggaccuuauugugu

SEQ ID NO: 34913 - RNA, 64 nt, hsa
ccaggucuaaaguuugaagaaaaagaaaaaucuuaaaaaaaaaaaaaaaaaaaaaaagaaaaaa

SEQ ID NO: 34914 - RNA, 64 nt, hsa
caggucuaaaguuugaagaaaaagaaaaaucuuaaaaaaaaaaaaaaaaaaaaaaagaaaaaaa

SEQ ID NO: 34915 - RNA, 64 nt, hsa
aggucuaaaguuugaagaaaaagaaaaaucuuaaaaaaaaaaaaaaaaaaaaaaagaaaaaaag

SEQ ID NO: 34916 - RNA, 64 nt, hsa
ggucuaaaguuugaagaaaaagaaaaaucuuaaaaaaaaaaaaaaaaaaaaaaagaaaaaaaga

SEQ ID NO: 34917 - RNA, 64 nt, hsa
gucuaaaguuugaagaaaaagaaaaaucuuaaaaaaaaaaaaaaaaaaaaaaagaaaaaaagaa

SEQ ID NO: 34918 - RNA, 64 nt, hsa
ucuaaaguuugaagaaaaagaaaaaucuuaaaaaaaaaaaaaaaaaaaaaaagaaaaaaagaaa

SEQ ID NO: 34919 - RNA, 64 nt, hsa
cuaaaguuugaagaaaaagaaaaaucuuaaaaaaaaaaaaaaaaaaaaaaagaaaaaaagaaaa

SEQ ID NO: 34920 - RNA, 64 nt, hsa
uaaaguuugaagaaaaagaaaaaucuuaaaaaaaaaaaaaaaaaaaaaaagaaaaaaagaaaaa

SEQ ID NO: 34921 - RNA, 64 nt, hsa
aaaguuugaagaaaaagaaaaaucuuaaaaaaaaaaaaaaaaaaaaaaagaaaaaaagaaaaac

SEQ ID NO: 34922 - RNA, 64 nt, hsa
aaguuugaagaaaaagaaaaaucuuaaaaaaaaaaaaaaaaaaaaaaagaaaaaaagaaaaaca

SEQ ID NO: 34923 - RNA, 64 nt, hsa
aguuugaagaaaaagaaaaaucuuaaaaaaaaaaaaaaaaaaaaaaagaaaaaaagaaaaacag

SEQ ID NO: 34924 - RNA, 64 nt, hsa
guuugaagaaaaagaaaaaucuuaaaaaaaaaaaaaaaaaaaaaaagaaaaaaagaaaaacagg

SEQ ID NO: 34925 - RNA, 64 nt, hsa
uuugaagaaaaagaaaaaucuuaaaaaaaaaaaaaaaaaaaaaaagaaaaaaagaaaaacagga

SEQ ID NO: 34926 - RNA, 64 nt, hsa
uugaagaaaaagaaaaaucuuaaaaaaaaaaaaaaaaaaaaaaagaaaaaaagaaaaacaggaa

SEQ ID NO: 34927 - RNA, 64 nt, hsa
ugaagaaaaagaaaaaucuuaaaaaaaaaaaaaaaaaaaaaaagaaaaaaagaaaaacaggaaa

SEQ ID NO: 34928 - RNA, 64 nt, hsa
gaagaaaaagaaaaaucuuaaaaaaaaaaaaaaaaaaaaaaagaaaaaaagaaaaacaggaaaa

SEQ ID NO: 34929 - RNA, 63 nt, hsa
ggcaagacucagucucaaaaaaaaaaaaaaggaaaaaaaaaagaaaaaaaaauguugaaccaa

SEQ ID NO: 34930 - RNA, 64 nt, hsa
gggcaagacucagucucaaaaaaaaaaaaaaggaaaaaaaaaagaaaaaaaaauguugaaccaa

SEQ ID NO: 34931 - RNA, 64 nt, hsa
agggcaagacucagucucaaaaaaaaaaaaaaggaaaaaaaaaagaaaaaaaaauguugaacca

SEQ ID NO: 34932 - RNA, 64 nt, hsa
ccugagcgacagggcaagacucagucucaaaaaaaaaaaaaaggaaaaaaaaaagaaaaaaaaa

SEQ ID NO: 34933 - RNA, 64 nt, hsa
gccugagcgacagggcaagacucagucucaaaaaaaaaaaaaaggaaaaaaaaaagaaaaaaaa

SEQ ID NO: 34934 - RNA, 64 nt, hsa
agccugagcgacagggcaagacucagucucaaaaaaaaaaaaaaggaaaaaaaaaagaaaaaaa

SEQ ID NO: 34935 - RNA, 64 nt, hsa
cagccugagcgacagggcaagacucagucucaaaaaaaaaaaaaaggaaaaaaaaaagaaaaaa

SEQ ID NO: 34936 - RNA, 64 nt, hsa
ccagccugagcgacagggcaagacucagucucaaaaaaaaaaaaaaggaaaaaaaaaagaaaaa

SEQ ID NO: 34937 - RNA, 64 nt, hsa
uccagccugagcgacagggcaagacucagucucaaaaaaaaaaaaaaggaaaaaaaaaagaaaa

SEQ ID NO: 34938 - RNA, 64 nt, hsa
uuccagccugagcgacagggcaagacucagucucaaaaaaaaaaaaaaggaaaaaaaaaagaaa

SEQ ID NO: 34939 - RNA, 64 nt, hsa
ugggugacagagccagacuccaucucaaagaaaaaaaaaaaauauuaagagguucugcugccag

SEQ ID NO: 34940 - RNA, 64 nt, hsa
cugggugacagagccagacuccaucucaaagaaaaaaaaaaaauauuaagagguucugcugcca

SEQ ID NO: 34941 - RNA, 64 nt, hsa
ccugggugacagagccagacuccaucucaaagaaaaaaaaaaaauauuaagagguucugcugcc

SEQ ID NO: 34942 - RNA, 64 nt, hsa
gccugggugacagagccagacuccaucucaaagaaaaaaaaaaaauauuaagagguucugcugc

SEQ ID NO: 34943 - RNA, 64 nt, hsa
agccugggugacagagccagacuccaucucaaagaaaaaaaaaaaauauuaagagguucugcug

SEQ ID NO: 34944 - RNA, 64 nt, hsa
cagcccaggugacagugugagacuccaucucaaaaaaaaaaauaagaggccgggugcgguggcu

SEQ ID NO: 34945 - RNA, 64 nt, hsa
ccagcccaggugacagugugagacuccaucucaaaaaaaaaaauaagaggccgggugcgguggc

SEQ ID NO: 34946 - RNA, 64 nt, hsa
uccagcccaggugacagugugagacuccaucucaaaaaaaaaaauaagaggccgggugcggugg

SEQ ID NO: 34947 - RNA, 64 nt, hsa
cuccagcccaggugacagugugagacuccaucucaaaaaaaaaaauaagaggccgggugcggug

SEQ ID NO: 34948 - RNA, 64 nt, hsa
uuauguguuuggauacaucugcuguguggaaaaaaaaaaaaacuacaaaaacccuaauuuugua

SEQ ID NO: 34949 - RNA, 64 nt, hsa
uuuauguguuuggauacaucugcuguguggaaaaaaaaaaaaacuacaaaaacccuaauuuugu

SEQ ID NO: 34950 - RNA, 64 nt, hsa
uuuuauguguuuggauacaucugcuguguggaaaaaaaaaaaaacuacaaaaacccuaauuuug

SEQ ID NO: 34951 - RNA, 64 nt, hsa
uuuuuauguguuuggauacaucugcuguguggaaaaaaaaaaaaacuacaaaaacccuaauuuu

SEQ ID NO: 34952 - RNA, 64 nt, hsa
auuuuuauguguuuggauacaucugcuguguggaaaaaaaaaaaaacuacaaaaacccuaauuu

SEQ ID NO: 34953 - RNA, 64 nt, hsa
gauuuuuauguguuuggauacaucugcuguguggaaaaaaaaaaaaacuacaaaaacccuaauu

SEQ ID NO: 34954 - RNA, 64 nt, hsa
aaucaaagucagacacacccaugguaaaaaaaaaaaaaaaaacaaucccaaggguacagaagag

SEQ ID NO: 34955 - RNA, 64 nt, hsa
aaaucaaagucagacacacccaugguaaaaaaaaaaaaaaaaacaaucccaaggguacagaaga

SEQ ID NO: 34956 - RNA, 64 nt, hsa
gaaaucaaagucagacacacccaugguaaaaaaaaaaaaaaaaacaaucccaaggguacagaag

SEQ ID NO: 34957 - RNA, 64 nt, hsa
ugaaaucaaagucagacacacccaugguaaaaaaaaaaaaaaaaacaaucccaaggguacagaa

SEQ ID NO: 34958 - RNA, 64 nt, hsa
uugaaaucaaagucagacacacccaugguaaaaaaaaaaaaaaaaacaaucccaaggguacaga

SEQ ID NO: 34959 - RNA, 64 nt, hsa
uuugaaaucaaagucagacacacccaugguaaaaaaaaaaaaaaaaacaaucccaaggguacag

SEQ ID NO: 34960 - RNA, 64 nt, hsa
uuuugaaaucaaagucagacacacccaugguaaaaaaaaaaaaaaaaacaaucccaaggguaca

SEQ ID NO: 34961 - RNA, 64 nt, hsa
uuuuugaaaucaaagucagacacacccaugguaaaaaaaaaaaaaaaaacaaucccaaggguac

SEQ ID NO: 34962 - RNA, 64 nt, hsa
auuuuugaaaucaaagucagacacacccaugguaaaaaaaaaaaaaaaaacaaucccaagggua

SEQ ID NO: 34963 - RNA, 64 nt, hsa
aauuuuugaaaucaaagucagacacacccaugguaaaaaaaaaaaaaaaaacaaucccaagggu

SEQ ID NO: 34964 - RNA, 64 nt, hsa
ggggaaagguuucaaauggggaaaaacacacaaaaaaaaaaaucacuaaaaauucccacaaauc

SEQ ID NO: 34965 - RNA, 64 nt, hsa
gggggaaagguuucaaauggggaaaaacacacaaaaaaaaaaaucacuaaaaauucccacaaau

SEQ ID NO: 34966 - RNA, 64 nt, hsa
ggggggaaagguuucaaauggggaaaaacacacaaaaaaaaaaaucacuaaaaauucccacaaa

SEQ ID NO: 34967 - RNA, 64 nt, hsa
gggggggaaagguuucaaauggggaaaaacacacaaaaaaaaaaaucacuaaaaauucccacaa

SEQ ID NO: 34968 - RNA, 64 nt, hsa
cccucugccccgcccucaaaaaaaaaaaaaaaaaaaaaaaaacaacagcaccuguccaggcuuc

SEQ ID NO: 34969 - RNA, 64 nt, hsa
ucccucugccccgcccucaaaaaaaaaaaaaaaaaaaaaaaaacaacagcaccuguccaggcuu

SEQ ID NO: 34970 - RNA, 64 nt, hsa
cucccucugccccgcccucaaaaaaaaaaaaaaaaaaaaaaaaacaacagcaccuguccaggcu

SEQ ID NO: 34971 - RNA, 64 nt, hsa
gcucccucugccccgcccucaaaaaaaaaaaaaaaaaaaaaaaaacaacagcaccuguccaggc

SEQ ID NO: 34972 - RNA, 64 nt, hsa
ugcucccucugccccgcccucaaaaaaaaaaaaaaaaaaaaaaaaacaacagcaccuguccagg

SEQ ID NO: 34973 - RNA, 64 nt, hsa
augcucccucugccccgcccucaaaaaaaaaaaaaaaaaaaaaaaaacaacagcaccuguccag

SEQ ID NO: 34974 - RNA, 64 nt, hsa
caugcucccucugccccgcccucaaaaaaaaaaaaaaaaaaaaaaaaacaacagcaccugucca

SEQ ID NO: 34975 - RNA, 64 nt, hsa
ucaugcucccucugccccgcccucaaaaaaaaaaaaaaaaaaaaaaaaacaacagcaccugucc

SEQ ID NO: 34976 - RNA, 64 nt, hsa
gucaugcucccucugccccgcccucaaaaaaaaaaaaaaaaaaaaaaaaacaacagcaccuguc

SEQ ID NO: 34977 - RNA, 64 nt, hsa
cgucaugcucccucugccccgcccucaaaaaaaaaaaaaaaaaaaaaaaaacaacagcaccugu

SEQ ID NO: 34978 - RNA, 64 nt, hsa
ccgucaugcucccucugccccgcccucaaaaaaaaaaaaaaaaaaaaaaaaacaacagcaccug

SEQ ID NO: 34979 - RNA, 64 nt, hsa
cccgucaugcucccucugccccgcccucaaaaaaaaaaaaaaaaaaaaaaaaacaacagcaccu

SEQ ID NO: 34980 - RNA, 64 nt, hsa
ccccgucaugcucccucugccccgcccucaaaaaaaaaaaaaaaaaaaaaaaaacaacagcacc

SEQ ID NO: 34981 - RNA, 64 nt, hsa
uccccgucaugcucccucugccccgcccucaaaaaaaaaaaaaaaaaaaaaaaaacaacagcac

SEQ ID NO: 34982 - RNA, 64 nt, hsa
cuccccgucaugcucccucugccccgcccucaaaaaaaaaaaaaaaaaaaaaaaaacaacagca

SEQ ID NO: 34983 - RNA, 64 nt, hsa
ucuccccgucaugcucccucugccccgcccucaaaaaaaaaaaaaaaaaaaaaaaaacaacagc

SEQ ID NO: 34984 - RNA, 64 nt, hsa
cucuccccgucaugcucccucugccccgcccucaaaaaaaaaaaaaaaaaaaaaaaaacaacag

SEQ ID NO: 34985 - RNA, 64 nt, hsa
acucuccccgucaugcucccucugccccgcccucaaaaaaaaaaaaaaaaaaaaaaaaacaaca

SEQ ID NO: 34986 - RNA, 64 nt, hsa
agaaguaauuuauuccuuuucggcagccgaaugaaaaaaaaauuuaaaaaaaugugcgagcuaa

SEQ ID NO: 34987 - RNA, 64 nt, hsa
aagaaguaauuuauuccuuuucggcagccgaaugaaaaaaaaauuuaaaaaaaugugcgagcua

SEQ ID NO: 34988 - RNA, 64 nt, hsa
aggggacaauugagauggcugaacuacugaauaaaaaaaaaacaacgcuguuuucuaguccugc

SEQ ID NO: 34989 - RNA, 64 nt, hsa
uaggggacaauugagauggcugaacuacugaauaaaaaaaaaacaacgcuguuuucuaguccug

SEQ ID NO: 34990 - RNA, 64 nt, hsa
uuaggggacaauugagauggcugaacuacugaauaaaaaaaaaacaacgcuguuuucuaguccu

SEQ ID NO: 34991 - RNA, 64 nt, hsa
aagaucuguuugugaaagccugauuuaaaaagaaaaaaaaaauuccuuaagccaaaugguguuc

SEQ ID NO: 34992 - RNA, 64 nt, hsa
caagaucuguuugugaaagccugauuuaaaaagaaaaaaaaaauuccuuaagccaaaugguguu

SEQ ID NO: 34993 - RNA, 64 nt, hsa
acaagaucuguuugugaaagccugauuuaaaaagaaaaaaaaaauuccuuaagccaaauggugu

SEQ ID NO: 34994 - RNA, 64 nt, hsa
ggcugggauggauaaccauauaauuuaaaaagaaaaaaaaaaucaaaauauaauauauuuuuuu

SEQ ID NO: 34995 - RNA, 64 nt, hsa
uggcugggauggauaaccauauaauuuaaaaagaaaaaaaaaaucaaaauauaauauauuuuuu

SEQ ID NO: 34996 - RNA, 64 nt, hsa
uuggcugggauggauaaccauauaauuuaaaaagaaaaaaaaaaucaaaauauaauauauuuuu

SEQ ID NO: 34997 - RNA, 64 nt, hsa
auacccuggagaauggcaaaaugauuuaaagagaaaaaaaaagauauuuuaaauuugaugcuca

SEQ ID NO: 34998 - RNA, 64 nt, hsa
uauacccuggagaauggcaaaaugauuuaaagagaaaaaaaaagauauuuuaaauuugaugcuc

SEQ ID NO: 34999 - RNA, 64 nt, hsa
gguccucacacaauuccuuacagagcacuuauuaaaaaaaaaucuuaagaguugaucuguuuuc

SEQ ID NO: 35000 - RNA, 64 nt, hsa
agguccucacacaauuccuuacagagcacuuauuaaaaaaaaaucuuaagaguugaucuguuuu

SEQ ID NO: 35001 - RNA, 64 nt, hsa
uguguuuuuuuaaauaaaaauuuucaaaaaguuaaaaaaaaagacauauaagguugauuaaagg

SEQ ID NO: 35002 - RNA, 64 nt, hsa
uuguguuuuuuuaaauaaaaauuuucaaaaaguuaaaaaaaaagacauauaagguugauuaaag

SEQ ID NO: 35003 - RNA, 64 nt, hsa
cuguccucagcccagcguaguuguaauugcuuuaaaaaaaaaguugaauucaucucuaacuuag

SEQ ID NO: 35004 - RNA, 64 nt, hsa
gcuguccucagcccagcguaguuguaauugcuuuaaaaaaaaaguugaauucaucucuaacuua

SEQ ID NO: 35005 - RNA, 64 nt, hsa
caucaaacaaggauuacagugaaugugaaaaaaaaaaaaaaagauaccugaauagacauuucua

SEQ ID NO: 35006 - RNA, 64 nt, hsa
acaucaaacaaggauuacagugaaugugaaaaaaaaaaaaaaagauaccugaauagacauuucu

SEQ ID NO: 35007 - RNA, 64 nt, hsa
gacaucaaacaaggauuacagugaaugugaaaaaaaaaaaaaaagauaccugaauagacauuuc

SEQ ID NO: 35008 - RNA, 64 nt, hsa
ugacaucaaacaaggauuacagugaaugugaaaaaaaaaaaaaaagauaccugaauagacauuu

SEQ ID NO: 35009 - RNA, 64 nt, hsa
uugacaucaaacaaggauuacagugaaugugaaaaaaaaaaaaaaagauaccugaauagacauu

SEQ ID NO: 35010 - RNA, 64 nt, hsa
auugacaucaaacaaggauuacagugaaugugaaaaaaaaaaaaaaagauaccugaauagacau

SEQ ID NO: 35011 - RNA, 64 nt, hsa
cauugacaucaaacaaggauuacagugaaugugaaaaaaaaaaaaaaagauaccugaauagaca

SEQ ID NO: 35012 - RNA, 64 nt, hsa
acauugacaucaaacaaggauuacagugaaugugaaaaaaaaaaaaaaagauaccugaauagac

SEQ ID NO: 35013 - RNA, 64 nt, hsa
cagagcgagacuccgucucaaaaaaaaaaaaaaaaaaaaaaauacaaaaauuagccgggcgugg

SEQ ID NO: 35014 - RNA, 64 nt, hsa
acagagcgagacuccgucucaaaaaaaaaaaaaaaaaaaaaaauacaaaaauuagccgggcgug

SEQ ID NO: 35015 - RNA, 64 nt, hsa
gacagagcgagacuccgucucaaaaaaaaaaaaaaaaaaaaaaauacaaaaauuagccgggcgu

SEQ ID NO: 35016 - RNA, 64 nt, hsa
cgacagagcgagacuccgucucaaaaaaaaaaaaaaaaaaaaaaauacaaaaauuagccgggcg

SEQ ID NO: 35017 - RNA, 64 nt, hsa
gcgacagagcgagacuccgucucaaaaaaaaaaaaaaaaaaaaaaauacaaaaauuagccgggc

SEQ ID NO: 35018 - RNA, 64 nt, hsa
ggcgacagagcgagacuccgucucaaaaaaaaaaaaaaaaaaaaaaauacaaaaauuagccggg

SEQ ID NO: 35019 - RNA, 64 nt, hsa
gggcgacagagcgagacuccgucucaaaaaaaaaaaaaaaaaaaaaaauacaaaaauuagccgg

SEQ ID NO: 35020 - RNA, 64 nt, hsa
ugggcgacagagcgagacuccgucucaaaaaaaaaaaaaaaaaaaaaaauacaaaaauuagccg

SEQ ID NO: 35021 - RNA, 64 nt, hsa
cugggcgacagagcgagacuccgucucaaaaaaaaaaaaaaaaaaaaaaauacaaaaauuagcc

SEQ ID NO: 35022 - RNA, 64 nt, hsa
ccugggcgacagagcgagacuccgucucaaaaaaaaaaaaaaaaaaaaaaauacaaaaauuagc

SEQ ID NO: 35023 - RNA, 64 nt, hsa
gccugggcgacagagcgagacuccgucucaaaaaaaaaaaaaaaaaaaaaaauacaaaaauuag

SEQ ID NO: 35024 - RNA, 64 nt, hsa
agccugggcgacagagcgagacuccgucucaaaaaaaaaaaaaaaaaaaaaaauacaaaaauua

SEQ ID NO: 35025 - RNA, 64 nt, hsa
cagccugggcgacagagcgagacuccgucucaaaaaaaaaaaaaaaaaaaaaaauacaaaaauu

SEQ ID NO: 35026 - RNA, 64 nt, hsa
ccagccugggcgacagagcgagacuccgucucaaaaaaaaaaaaaaaaaaaaaaauacaaaaau

SEQ ID NO: 35027 - RNA, 64 nt, hsa
uccagccugggcgacagagcgagacuccgucucaaaaaaaaaaaaaaaaaaaaaaauacaaaaa

SEQ ID NO: 35028 - RNA, 64 nt, hsa
cuccagccugggcgacagagcgagacuccgucucaaaaaaaaaaaaaaaaaaaaaaauacaaaa

SEQ ID NO: 35029 - RNA, 64 nt, hsa
ggcagggguacagagagugccugauuggaaaaaaaaaaaaaagagagagagagagaagaagaag

SEQ ID NO: 35030 - RNA, 64 nt, hsa
uggcagggguacagagagugccugauuggaaaaaaaaaaaaaagagagagagagagaagaagaa

SEQ ID NO: 35031 - RNA, 64 nt, hsa
guggcagggguacagagagugccugauuggaaaaaaaaaaaaaagagagagagagagaagaaga

SEQ ID NO: 35032 - RNA, 64 nt, hsa
gguggcagggguacagagagugccugauuggaaaaaaaaaaaaaagagagagagagagaagaag

SEQ ID NO: 35033 - RNA, 64 nt, hsa
ggguggcagggguacagagagugccugauuggaaaaaaaaaaaaaagagagagagagagaagaa

SEQ ID NO: 35034 - RNA, 64 nt, hsa
aggguggcagggguacagagagugccugauuggaaaaaaaaaaaaaagagagagagagagaaga

SEQ ID NO: 35035 - RNA, 64 nt, hsa
caggguggcagggguacagagagugccugauuggaaaaaaaaaaaaaagagagagagagagaag

SEQ ID NO: 35036 - RNA, 64 nt, hsa
caaaagaggaaaaaaaaaaucccuccuggaaaaaaaaaaaaacccuggaaaauagaaaaaaaaa

SEQ ID NO: 35037 - RNA, 64 nt, hsa
acaaaagaggaaaaaaaaaaucccuccuggaaaaaaaaaaaaacccuggaaaauagaaaaaaaa

SEQ ID NO: 35038 - RNA, 64 nt, hsa
aacaaaagaggaaaaaaaaaaucccuccuggaaaaaaaaaaaaacccuggaaaauagaaaaaaa

SEQ ID NO: 35039 - RNA, 64 nt, hsa
uaacaaaagaggaaaaaaaaaaucccuccuggaaaaaaaaaaaaacccuggaaaauagaaaaaa

SEQ ID NO: 35040 - RNA, 64 nt, hsa
auaacaaaagaggaaaaaaaaaaucccuccuggaaaaaaaaaaaaacccuggaaaauagaaaaa

SEQ ID NO: 35041 - RNA, 64 nt, hsa
aauaacaaaagaggaaaaaaaaaaucccuccuggaaaaaaaaaaaaacccuggaaaauagaaaa

SEQ ID NO: 35042 - RNA, 64 nt, hsa
gagcaagccuuuuugaaaaauaacaaaagaggaaaaaaaaaaucccuccuggaaaaaaaaaaaa

SEQ ID NO: 35043 - RNA, 64 nt, hsa
cgagcaagccuuuuugaaaaauaacaaaagaggaaaaaaaaaaucccuccuggaaaaaaaaaaa

SEQ ID NO: 35044 - RNA, 64 nt, hsa
gcgagcaagccuuuuugaaaaauaacaaaagaggaaaaaaaaaaucccuccuggaaaaaaaaaa

SEQ ID NO: 35045 - RNA, 64 nt, hsa
ugcaugauucuccaguauauuuguaaaaaauaaaaaaaaaaacuaaacccauuaaaaaguauuu

SEQ ID NO: 35046 - RNA, 64 nt, hsa
uugcaugauucuccaguauauuuguaaaaaauaaaaaaaaaaacuaaacccauuaaaaaguauu

SEQ ID NO: 35047 - RNA, 64 nt, hsa
auugcaugauucuccaguauauuuguaaaaaauaaaaaaaaaaacuaaacccauuaaaaaguau

SEQ ID NO: 35048 - RNA, 64 nt, hsa
cauugcaugauucuccaguauauuuguaaaaaauaaaaaaaaaaacuaaacccauuaaaaagua

SEQ ID NO: 35049 - RNA, 64 nt, hsa
gacagagugagacccugucuccgaaaaaaaaaaaaaaaaaaagaacggaaaaagaaaugcuuac

SEQ ID NO: 35050 - RNA, 64 nt, hsa
ugacagagugagacccugucuccgaaaaaaaaaaaaaaaaaaagaacggaaaaagaaaugcuua

SEQ ID NO: 35051 - RNA, 64 nt, hsa
gugacagagugagacccugucuccgaaaaaaaaaaaaaaaaaaagaacggaaaaagaaaugcuu

SEQ ID NO: 35052 - RNA, 64 nt, hsa
ggugacagagugagacccugucuccgaaaaaaaaaaaaaaaaaaagaacggaaaaagaaaugcu

SEQ ID NO: 35053 - RNA, 64 nt, hsa
gggugacagagugagacccugucuccgaaaaaaaaaaaaaaaaaaagaacggaaaaagaaaugc

SEQ ID NO: 35054 - RNA, 64 nt, hsa
ugggugacagagugagacccugucuccgaaaaaaaaaaaaaaaaaaagaacggaaaaagaaaug

SEQ ID NO: 35055 - RNA, 64 nt, hsa
cugggugacagagugagacccugucuccgaaaaaaaaaaaaaaaaaaagaacggaaaaagaaau

SEQ ID NO: 35056 - RNA, 64 nt, hsa
ccugggugacagagugagacccugucuccgaaaaaaaaaaaaaaaaaaagaacggaaaaagaaa

SEQ ID NO: 35057 - RNA, 64 nt, hsa
gccugggugacagagugagacccugucuccgaaaaaaaaaaaaaaaaaaagaacggaaaaagaa

SEQ ID NO: 35058 - RNA, 64 nt, hsa
agccugggugacagagugagacccugucuccgaaaaaaaaaaaaaaaaaaagaacggaaaaaga

SEQ ID NO: 35059 - RNA, 64 nt, hsa
cagccugggugacagagugagacccugucuccgaaaaaaaaaaaaaaaaaaagaacggaaaaag

SEQ ID NO: 35060 - RNA, 64 nt, hsa
ccagccugggugacagagugagacccugucuccgaaaaaaaaaaaaaaaaaaagaacggaaaaa

SEQ ID NO: 35061 - RNA, 64 nt, hsa
gccugggugacagagcgagacuccgucucaaaaaaaaaaaaagaaagcagauccucauggcuau

SEQ ID NO: 35062 - RNA, 64 nt, hsa
agccugggugacagagcgagacuccgucucaaaaaaaaaaaaagaaagcagauccucauggcua

SEQ ID NO: 35063 - RNA, 64 nt, hsa
cagccugggugacagagcgagacuccgucucaaaaaaaaaaaaagaaagcagauccucauggcu

SEQ ID NO: 35064 - RNA, 64 nt, hsa
ccagccugggugacagagcgagacuccgucucaaaaaaaaaaaaagaaagcagauccucauggc

SEQ ID NO: 35065 - RNA, 64 nt, hsa
uccagccugggugacagagcgagacuccgucucaaaaaaaaaaaaagaaagcagauccucaugg

SEQ ID NO: 35066 - RNA, 64 nt, hsa
cuccagccugggugacagagcgagacuccgucucaaaaaaaaaaaaagaaagcagauccucaug

SEQ ID NO: 35067 - RNA, 64 nt, hsa
gccugggcaacagagcgagacuccgucucaaaaaaaaaaaaagaaagaaagaaaaggaaaccca

SEQ ID NO: 35068 - RNA, 64 nt, hsa
agccugggcaacagagcgagacuccgucucaaaaaaaaaaaaagaaagaaagaaaaggaaaccc

SEQ ID NO: 35069 - RNA, 64 nt, hsa
cagccugggcaacagagcgagacuccgucucaaaaaaaaaaaaagaaagaaagaaaaggaaacc

SEQ ID NO: 35070 - RNA, 64 nt, hsa
ccagccugggcaacagagcgagacuccgucucaaaaaaaaaaaaagaaagaaagaaaaggaaac

SEQ ID NO: 35071 - RNA, 64 nt, hsa
cccagccugggcaacagagcgagacuccgucucaaaaaaaaaaaaagaaagaaagaaaaggaaa

SEQ ID NO: 35072 - RNA, 64 nt, hsa
ccccagccugggcaacagagcgagacuccgucucaaaaaaaaaaaaagaaagaaagaaaaggaa

SEQ ID NO: 35073 - RNA, 64 nt, hsa
cccuugaggaaacaacagcuuuaaaagaaaaagaaaaaaaaagucuuugguaaauggcaaauga

SEQ ID NO: 35074 - RNA, 64 nt, hsa
ucccuugaggaaacaacagcuuuaaaagaaaaagaaaaaaaaagucuuugguaaauggcaaaug

SEQ ID NO: 35075 - RNA, 64 nt, hsa
gaacuuccagaucaacaaaagugucuuucaaagaaaaaaaaaucaagaaggacacaagcgaaga

SEQ ID NO: 35076 - RNA, 64 nt, hsa
ggaacuuccagaucaacaaaagugucuuucaaagaaaaaaaaaucaagaaggacacaagcgaag

SEQ ID NO: 35077 - RNA, 64 nt, hsa
aacaaggaugguacuaccacaaucacccccugcaaaaaaaaagagaccaagaaacuuucaauga

SEQ ID NO: 35078 - RNA, 64 nt, hsa
gaacaaggaugguacuaccacaaucacccccugcaaaaaaaaagagaccaagaaacuuucaaug

SEQ ID NO: 35079 - RNA, 64 nt, hsa
gggcgacagagugagacuccaucucaaaaaaaaaaaaaaaaacuuaagauggacacagcugacu

SEQ ID NO: 35080 - RNA, 64 nt, hsa
ugggcgacagagugagacuccaucucaaaaaaaaaaaaaaaaacuuaagauggacacagcugac

SEQ ID NO: 35081 - RNA, 64 nt, hsa
cugggcgacagagugagacuccaucucaaaaaaaaaaaaaaaaacuuaagauggacacagcuga

SEQ ID NO: 35082 - RNA, 64 nt, hsa
ccugggcgacagagugagacuccaucucaaaaaaaaaaaaaaaaacuuaagauggacacagcug

SEQ ID NO: 35083 - RNA, 64 nt, hsa
gccugggcgacagagugagacuccaucucaaaaaaaaaaaaaaaaacuuaagauggacacagcu

SEQ ID NO: 35084 - RNA, 64 nt, hsa
agccugggcgacagagugagacuccaucucaaaaaaaaaaaaaaaaacuuaagauggacacagc

SEQ ID NO: 35085 - RNA, 64 nt, hsa
cagccugggcgacagagugagacuccaucucaaaaaaaaaaaaaaaaacuuaagauggacacag

SEQ ID NO: 35086 - RNA, 64 nt, hsa
ccagccugggcgacagagugagacuccaucucaaaaaaaaaaaaaaaaacuuaagauggacaca

SEQ ID NO: 35087 - RNA, 64 nt, hsa
uccagccugggcgacagagugagacuccaucucaaaaaaaaaaaaaaaaacuuaagauggacac

SEQ ID NO: 35088 - RNA, 64 nt, hsa
cuccagccugggcgacagagugagacuccaucucaaaaaaaaaaaaaaaaacuuaagauggaca

SEQ ID NO: 35089 - RNA, 64 nt, hsa
ccagccugggcgacagagcgagacuccaucuuuaaaaaaaaacaagacgggccggcacgguggc

SEQ ID NO: 35090 - RNA, 64 nt, hsa
uccagccugggcgacagagcgagacuccaucuuuaaaaaaaaacaagacgggccggcacggugg

SEQ ID NO: 35091 - RNA, 64 nt, hsa
guacaauuuggggccucaaauuugacucugccucaaaaaaaagaaauauauccuaugcagaguu

SEQ ID NO: 35092 - RNA, 64 nt, hsa
uuuagugucaaggcagauuaguuauuuagccaccaaaaaaaaguauuguguacaauuuggggcc

SEQ ID NO: 35093 - RNA, 64 nt, hsa
cgacagucugagacucugucucaaaaaaaaaaaaaaaaaaaagaaacuucaguuaacagccucc

SEQ ID NO: 35094 - RNA, 64 nt, hsa
gcgacagucugagacucugucucaaaaaaaaaaaaaaaaaaaagaaacuucaguuaacagccuc

SEQ ID NO: 35095 - RNA, 64 nt, hsa
ggcgacagucugagacucugucucaaaaaaaaaaaaaaaaaaaagaaacuucaguuaacagccu

SEQ ID NO: 35096 - RNA, 64 nt, hsa
gggcgacagucugagacucugucucaaaaaaaaaaaaaaaaaaaagaaacuucaguuaacagcc

SEQ ID NO: 35097 - RNA, 64 nt, hsa
ugggcgacagucugagacucugucucaaaaaaaaaaaaaaaaaaaagaaacuucaguuaacagc

SEQ ID NO: 35098 - RNA, 64 nt, hsa
cugggcgacagucugagacucugucucaaaaaaaaaaaaaaaaaaaagaaacuucaguuaacag

SEQ ID NO: 35099 - RNA, 64 nt, hsa
ccugggcgacagucugagacucugucucaaaaaaaaaaaaaaaaaaaagaaacuucaguuaaca

SEQ ID NO: 35100 - RNA, 64 nt, hsa
uccugggcgacagucugagacucugucucaaaaaaaaaaaaaaaaaaaagaaacuucaguuaac

SEQ ID NO: 35101 - RNA, 64 nt, hsa
auccugggcgacagucugagacucugucucaaaaaaaaaaaaaaaaaaaagaaacuucaguuaa

SEQ ID NO: 35102 - RNA, 64 nt, hsa
cauccugggcgacagucugagacucugucucaaaaaaaaaaaaaaaaaaaagaaacuucaguua

SEQ ID NO: 35103 - RNA, 64 nt, hsa
ccauccugggcgacagucugagacucugucucaaaaaaaaaaaaaaaaaaaagaaacuucaguu

SEQ ID NO: 35104 - RNA, 64 nt, hsa
uccauccugggcgacagucugagacucugucucaaaaaaaaaaaaaaaaaaaagaaacuucagu

SEQ ID NO: 35105 - RNA, 64 nt, hsa
cuccauccugggcgacagucugagacucugucucaaaaaaaaaaaaaaaaaaaagaaacuucag

SEQ ID NO: 35106 - RNA, 64 nt, hsa
ccucuuacuuucuguguaguuuuuaauuguuaaaaaaaaaaaguuuuaaacagaagcacaugac

SEQ ID NO: 35107 - RNA, 64 nt, hsa
accucuuacuuucuguguaguuuuuaauuguuaaaaaaaaaaaguuuuaaacagaagcacauga

SEQ ID NO: 35108 - RNA, 64 nt, hsa
aaccucuuacuuucuguguaguuuuuaauuguuaaaaaaaaaaaguuuuaaacagaagcacaug

SEQ ID NO: 35109 - RNA, 64 nt, hsa
caaccucuuacuuucuguguaguuuuuaauuguuaaaaaaaaaaaguuuuaaacagaagcacau

SEQ ID NO: 35110 - RNA, 64 nt, hsa
ucuucugacagccaaagaugaaaaacaaacagaaaaaaaaaaguaaagagucuauuuauggcug

SEQ ID NO: 35111 - RNA, 64 nt, hsa
cucuucugacagccaaagaugaaaaacaaacagaaaaaaaaaaguaaagagucuauuuauggcu

SEQ ID NO: 35112 - RNA, 64 nt, hsa
ucucuucugacagccaaagaugaaaaacaaacagaaaaaaaaaaguaaagagucuauuuauggc

SEQ ID NO: 35113 - RNA, 64 nt, hsa
aaguuaagaugcuacuguuuuaaaggaaaaaaaaaaaaaaaaguacugaucuucaauaugaaga

SEQ ID NO: 35114 - RNA, 64 nt, hsa
caaguuaagaugcuacuguuuuaaaggaaaaaaaaaaaaaaaaguacugaucuucaauaugaag

SEQ ID NO: 35115 - RNA, 64 nt, hsa
acaaguuaagaugcuacuguuuuaaaggaaaaaaaaaaaaaaaaguacugaucuucaauaugaa

SEQ ID NO: 35116 - RNA, 64 nt, hsa
cacaaguuaagaugcuacuguuuuaaaggaaaaaaaaaaaaaaaaguacugaucuucaauauga

SEQ ID NO: 35117 - RNA, 64 nt, hsa
ccacaaguuaagaugcuacuguuuuaaaggaaaaaaaaaaaaaaaaguacugaucuucaauaug

SEQ ID NO: 35118 - RNA, 64 nt, hsa
gccacaaguuaagaugcuacuguuuuaaaggaaaaaaaaaaaaaaaaguacugaucuucaauau

SEQ ID NO: 35119 - RNA, 64 nt, hsa
ugccacaaguuaagaugcuacuguuuuaaaggaaaaaaaaaaaaaaaaguacugaucuucaaua

SEQ ID NO: 35120 - RNA, 64 nt, hsa
gugccacaaguuaagaugcuacuguuuuaaaggaaaaaaaaaaaaaaaaguacugaucuucaau

SEQ ID NO: 35121 - RNA, 64 nt, hsa
ugugccacaaguuaagaugcuacuguuuuaaaggaaaaaaaaaaaaaaaaguacugaucuucaa

SEQ ID NO: 35122 - RNA, 64 nt, hsa
uaguagagcuuguucuuguauugugaccuuuuuuaaaaaaaaggaacugagguucagaaugauu

SEQ ID NO: 35123 - RNA, 64 nt, hsa
ggccucccccacuuucuuucuuucuuuaaaaaaaaaaaaaaauacgguggggguagggggcugg

SEQ ID NO: 35124 - RNA, 64 nt, hsa
uggccucccccacuuucuuucuuucuuuaaaaaaaaaaaaaaauacgguggggguagggggcug

SEQ ID NO: 35125 - RNA, 64 nt, hsa
cuggccucccccacuuucuuucuuucuuuaaaaaaaaaaaaaaauacgguggggguagggggcu

SEQ ID NO: 35126 - RNA, 64 nt, hsa
ccuggccucccccacuuucuuucuuucuuuaaaaaaaaaaaaaaauacgguggggguagggggc

SEQ ID NO: 35127 - RNA, 64 nt, hsa
cccuggccucccccacuuucuuucuuucuuuaaaaaaaaaaaaaaauacgguggggguaggggg

SEQ ID NO: 35128 - RNA, 64 nt, hsa
ccccuggccucccccacuuucuuucuuucuuuaaaaaaaaaaaaaaauacgguggggguagggg

SEQ ID NO: 35129 - RNA, 64 nt, hsa
cccccuggccucccccacuuucuuucuuucuuuaaaaaaaaaaaaaaauacgguggggguaggg

SEQ ID NO: 35130 - RNA, 64 nt, hsa
ccccccuggccucccccacuuucuuucuuucuuuaaaaaaaaaaaaaaauacgguggggguagg

SEQ ID NO: 35131 - RNA, 64 nt, hsa
aaaaaaaaaaagaaggaaaaauugaaaaaaauaaaaaaaaaaguuacagaaugcuguguaccag

SEQ ID NO: 35132 - RNA, 64 nt, hsa
aaaaaaaaaaaagaaggaaaaauugaaaaaaauaaaaaaaaaaguuacagaaugcuguguacca

SEQ ID NO: 35133 - RNA, 64 nt, hsa
uaaaaaaaaaaaagaaggaaaaauugaaaaaaauaaaaaaaaaaguuacagaaugcuguguacc

SEQ ID NO: 35134 - RNA, 64 nt, hsa
auucuguucgcaaagcacagacuagugcuuaaaaaaaaaaaagaaggaaaaauugaaaaaaaua

SEQ ID NO: 35135 - RNA, 64 nt, hsa
gauucuguucgcaaagcacagacuagugcuuaaaaaaaaaaaagaaggaaaaauugaaaaaaau

SEQ ID NO: 35136 - RNA, 64 nt, hsa
ugauucuguucgcaaagcacagacuagugcuuaaaaaaaaaaaagaaggaaaaauugaaaaaaa

SEQ ID NO: 35137 - RNA, 64 nt, hsa
uugauucuguucgcaaagcacagacuagugcuuaaaaaaaaaaaagaaggaaaaauugaaaaaa

SEQ ID NO: 35138 - RNA, 64 nt, hsa
cuugauucuguucgcaaagcacagacuagugcuuaaaaaaaaaaaagaaggaaaaauugaaaaa

SEQ ID NO: 35139 - RNA, 64 nt, hsa
gcauugaaaaaaaaaacaaaaacaaaaaauggaaaaaaaaaaccuuguauuuuguaaauauuuu

SEQ ID NO: 35140 - RNA, 64 nt, hsa
agcauugaaaaaaaaaacaaaaacaaaaaauggaaaaaaaaaaccuuguauuuuguaaauauuu

SEQ ID NO: 35141 - RNA, 64 nt, hsa
uagcauugaaaaaaaaaacaaaaacaaaaaauggaaaaaaaaaaccuuguauuuuguaaauauu

SEQ ID NO: 35142 - RNA, 64 nt, hsa
guugaaaauucugaauaacccuuuuagcauugaaaaaaaaaacaaaaacaaaaaauggaaaaaa

SEQ ID NO: 35143 - RNA, 64 nt, hsa
gguugaaaauucugaauaacccuuuuagcauugaaaaaaaaaacaaaaacaaaaaauggaaaaa

SEQ ID NO: 35144 - RNA, 64 nt, hsa
agguugaaaauucugaauaacccuuuuagcauugaaaaaaaaaacaaaaacaaaaaauggaaaa

SEQ ID NO: 35145 - RNA, 64 nt, hsa
uuugcaaguuaaaggguuugucauuguuucuuuaaaaaaaaauacaauaaugcaccauaucccu

SEQ ID NO: 35146 - RNA, 64 nt, hsa
guuugcaaguuaaaggguuugucauuguuucuuuaaaaaaaaauacaauaaugcaccauauccc

SEQ ID NO: 35147 - RNA, 64 nt, hsa
gugucugugguugcagucuuucccccaggaaaaaaaaaaaaagaaauucgcauguuuaauguga

SEQ ID NO: 35148 - RNA, 64 nt, hsa
ugugucugugguugcagucuuucccccaggaaaaaaaaaaaaagaaauucgcauguuuaaugug

SEQ ID NO: 35149 - RNA, 64 nt, hsa
uugugucugugguugcagucuuucccccaggaaaaaaaaaaaaagaaauucgcauguuuaaugu

SEQ ID NO: 35150 - RNA, 64 nt, hsa
uuugugucugugguugcagucuuucccccaggaaaaaaaaaaaaagaaauucgcauguuuaaug

SEQ ID NO: 35151 - RNA, 64 nt, hsa
guuugugucugugguugcagucuuucccccaggaaaaaaaaaaaaagaaauucgcauguuuaau

SEQ ID NO: 35152 - RNA, 64 nt, hsa
uguuugugucugugguugcagucuuucccccaggaaaaaaaaaaaaagaaauucgcauguuuaa

SEQ ID NO: 35153 - RNA, 64 nt, hsa
aguaaaaaaacaaaacaaaaaacaaaaaaaacaaaaaaaaaacccuauuuaaaugaaaggaguu

SEQ ID NO: 35154 - RNA, 64 nt, hsa
aaguaaaaaaacaaaacaaaaaacaaaaaaaacaaaaaaaaaacccuauuuaaaugaaaggagu

SEQ ID NO: 35155 - RNA, 64 nt, hsa
gaaguaaaaaaacaaaacaaaaaacaaaaaaaacaaaaaaaaaacccuauuuaaaugaaaggag

SEQ ID NO: 35156 - RNA, 64 nt, hsa
ucgaauagggaaguaaaaaaacaaaacaaaaaacaaaaaaaacaaaaaaaaaacccuauuuaaa

SEQ ID NO: 35157 - RNA, 64 nt, hsa
ucucccccaccccuuuuucuaaaaaacaaacaaaaaaaaaaacacacaaaacaaaaacagaaca

SEQ ID NO: 35158 - RNA, 64 nt, hsa
uucucccccaccccuuuuucuaaaaaacaaacaaaaaaaaaaacacacaaaacaaaaacagaac

SEQ ID NO: 35159 - RNA, 64 nt, hsa
cuucucccccaccccuuuuucuaaaaaacaaacaaaaaaaaaaacacacaaaacaaaaacagaa

SEQ ID NO: 35160 - RNA, 64 nt, hsa
ucuucucccccaccccuuuuucuaaaaaacaaacaaaaaaaaaaacacacaaaacaaaaacaga

SEQ ID NO: 35161 - RNA, 64 nt, hsa
acaaaucgucaggugccuggagcaaaaaggaaaaaaaaaaaagaaaggacauugaguuuuaaca

SEQ ID NO: 35162 - RNA, 64 nt, hsa
aacaaaucgucaggugccuggagcaaaaaggaaaaaaaaaaaagaaaggacauugaguuuuaac

SEQ ID NO: 35163 - RNA, 64 nt, hsa
gaacaaaucgucaggugccuggagcaaaaaggaaaaaaaaaaaagaaaggacauugaguuuuaa

SEQ ID NO: 35164 - RNA, 64 nt, hsa
agaacaaaucgucaggugccuggagcaaaaaggaaaaaaaaaaaagaaaggacauugaguuuua

SEQ ID NO: 35165 - RNA, 64 nt, hsa
cagaacaaaucgucaggugccuggagcaaaaaggaaaaaaaaaaaagaaaggacauugaguuuu

SEQ ID NO: 35166 - RNA, 64 nt, hsa
cccccaccccugaugcaguaaaacauugaaaaaaaaaaaaaaggagagguagaagacuguagcu

SEQ ID NO: 35167 - RNA, 64 nt, hsa
ucccccaccccugaugcaguaaaacauugaaaaaaaaaaaaaaggagagguagaagacuguagc

SEQ ID NO: 35168 - RNA, 64 nt, hsa
uucccccaccccugaugcaguaaaacauugaaaaaaaaaaaaaaggagagguagaagacuguag

SEQ ID NO: 35169 - RNA, 64 nt, hsa
uuucccccaccccugaugcaguaaaacauugaaaaaaaaaaaaaaggagagguagaagacugua

SEQ ID NO: 35170 - RNA, 64 nt, hsa
cuuucccccaccccugaugcaguaaaacauugaaaaaaaaaaaaaaggagagguagaagacugu

SEQ ID NO: 35171 - RNA, 64 nt, hsa
acuuucccccaccccugaugcaguaaaacauugaaaaaaaaaaaaaaggagagguagaagacug

SEQ ID NO: 35172 - RNA, 64 nt, hsa
aacuuucccccaccccugaugcaguaaaacauugaaaaaaaaaaaaaaggagagguagaagacu

SEQ ID NO: 35173 - RNA, 64 nt, hsa
ccaaaagugcauucaaccuuaccaaaaaaaaaaaaaaaaaaagaauaaauaaauaacuuuuuaa

SEQ ID NO: 35174 - RNA, 64 nt, hsa
accaaaagugcauucaaccuuaccaaaaaaaaaaaaaaaaaaagaauaaauaaauaacuuuuua

SEQ ID NO: 35175 - RNA, 64 nt, hsa
aaccaaaagugcauucaaccuuaccaaaaaaaaaaaaaaaaaaagaauaaauaaauaacuuuuu

SEQ ID NO: 35176 - RNA, 64 nt, hsa
aaaccaaaagugcauucaaccuuaccaaaaaaaaaaaaaaaaaaagaauaaauaaauaacuuuu

SEQ ID NO: 35177 - RNA, 64 nt, hsa
aaaaccaaaagugcauucaaccuuaccaaaaaaaaaaaaaaaaaaagaauaaauaaauaacuuu

SEQ ID NO: 35178 - RNA, 64 nt, hsa
aaaaaccaaaagugcauucaaccuuaccaaaaaaaaaaaaaaaaaaagaauaaauaaauaacuu

SEQ ID NO: 35179 - RNA, 64 nt, hsa
caaaaaccaaaagugcauucaaccuuaccaaaaaaaaaaaaaaaaaaagaauaaauaaauaacu

SEQ ID NO: 35180 - RNA, 64 nt, hsa
ccaaaaaccaaaagugcauucaaccuuaccaaaaaaaaaaaaaaaaaaagaauaaauaaauaac

SEQ ID NO: 35181 - RNA, 64 nt, hsa
accaaaaaccaaaagugcauucaaccuuaccaaaaaaaaaaaaaaaaaaagaauaaauaaauaa

SEQ ID NO: 35182 - RNA, 64 nt, hsa
gaccaaaaaccaaaagugcauucaaccuuaccaaaaaaaaaaaaaaaaaaagaauaaauaaaua

SEQ ID NO: 35183 - RNA, 64 nt, hsa
ugaccaaaaaccaaaagugcauucaaccuuaccaaaaaaaaaaaaaaaaaaagaauaaauaaau

SEQ ID NO: 35184 - RNA, 64 nt, hsa
augaccaaaaaccaaaagugcauucaaccuuaccaaaaaaaaaaaaaaaaaaagaauaaauaaa

SEQ ID NO: 35185 - RNA, 64 nt, hsa
ucaaaaguucuucuggaaacaaaccuuuguuaaaaaaaaaaaguauuaaauuguuuuaauagug

SEQ ID NO: 35186 - RNA, 64 nt, hsa
aucaaaaguucuucuggaaacaaaccuuuguuaaaaaaaaaaaguauuaaauuguuuuaauagu

SEQ ID NO: 35187 - RNA, 64 nt, hsa
caucaaaaguucuucuggaaacaaaccuuuguuaaaaaaaaaaaguauuaaauuguuuuaauag

SEQ ID NO: 35188 - RNA, 64 nt, hsa
acaucaaaaguucuucuggaaacaaaccuuuguuaaaaaaaaaaaguauuaaauuguuuuaaua

SEQ ID NO: 35189 - RNA, 64 nt, hsa
ugguugucagaacccugaaaguauuaguucuaaaaaaaaaaagauauauacuagaaguaauugu

SEQ ID NO: 35190 - RNA, 64 nt, hsa
gugguugucagaacccugaaaguauuaguucuaaaaaaaaaaagauauauacuagaaguaauug

SEQ ID NO: 35191 - RNA, 64 nt, hsa
ugugguugucagaacccugaaaguauuaguucuaaaaaaaaaaagauauauacuagaaguaauu

SEQ ID NO: 35192 - RNA, 64 nt, hsa
augugguugucagaacccugaaaguauuaguucuaaaaaaaaaaagauauauacuagaaguaau

SEQ ID NO: 35193 - RNA, 64 nt, hsa
caugccacgcauuguuuuuaaagcauugcguuaaaaaaaaaauuaacuaaaccaagaugcugug

SEQ ID NO: 35194 - RNA, 64 nt, hsa
ucaugccacgcauuguuuuuaaagcauugcguuaaaaaaaaaauuaacuaaaccaagaugcugu

SEQ ID NO: 35195 - RNA, 64 nt, hsa
aucaugccacgcauuguuuuuaaagcauugcguuaaaaaaaaaauuaacuaaaccaagaugcug

SEQ ID NO: 35196 - RNA, 64 nt, hsa
auuguaguugacuuuuuaaaaaaaaaaaaaauuuaaaaaaaaucuacaaauuguguuuugcuaa

SEQ ID NO: 35197 - RNA, 64 nt, hsa
uggaauauagcauuguaguugacuuuuuaaaaaaaaaaaaaauuuaaaaaaaaucuacaaauug

SEQ ID NO: 35198 - RNA, 64 nt, hsa
auggaauauagcauuguaguugacuuuuuaaaaaaaaaaaaaauuuaaaaaaaaucuacaaauu

SEQ ID NO: 35199 - RNA, 64 nt, hsa
gauggaauauagcauuguaguugacuuuuuaaaaaaaaaaaaaauuuaaaaaaaaucuacaaau

SEQ ID NO: 35200 - RNA, 64 nt, hsa
cgauggaauauagcauuguaguugacuuuuuaaaaaaaaaaaaaauuuaaaaaaaaucuacaaa

SEQ ID NO: 35201 - RNA, 64 nt, hsa
ccgauggaauauagcauuguaguugacuuuuuaaaaaaaaaaaaaauuuaaaaaaaaucuacaa

SEQ ID NO: 35202 - RNA, 64 nt, hsa
cccgauggaauauagcauuguaguugacuuuuuaaaaaaaaaaaaaauuuaaaaaaaaucuaca

SEQ ID NO: 35203 - RNA, 64 nt, hsa
ucccgauggaauauagcauuguaguugacuuuuuaaaaaaaaaaaaaauuuaaaaaaaaucuac

SEQ ID NO: 35204 - RNA, 64 nt, hsa
augaaaacauucacuugguauuucauuuguaagaaaaaaaaauggugcuuuuauaaagaacuuu

SEQ ID NO: 35205 - RNA, 64 nt, hsa
aaugaaaacauucacuugguauuucauuuguaagaaaaaaaaauggugcuuuuauaaagaacuu

SEQ ID NO: 35206 - RNA, 64 nt, hsa
gacagagcgagacuccgucucaaaaaaaaaaaaaaaaaaaaauguuuucaaaguuccauucugu

SEQ ID NO: 35207 - RNA, 64 nt, hsa
cgacagagcgagacuccgucucaaaaaaaaaaaaaaaaaaaaauguuuucaaaguuccauucug

SEQ ID NO: 35208 - RNA, 64 nt, hsa
gcgacagagcgagacuccgucucaaaaaaaaaaaaaaaaaaaaauguuuucaaaguuccauucu

SEQ ID NO: 35209 - RNA, 64 nt, hsa
ggcgacagagcgagacuccgucucaaaaaaaaaaaaaaaaaaaaauguuuucaaaguuccauuc

SEQ ID NO: 35210 - RNA, 64 nt, hsa
gggcgacagagcgagacuccgucucaaaaaaaaaaaaaaaaaaaaauguuuucaaaguuccauu

SEQ ID NO: 35211 - RNA, 64 nt, hsa
ugggcgacagagcgagacuccgucucaaaaaaaaaaaaaaaaaaaaauguuuucaaaguuccau

SEQ ID NO: 35212 - RNA, 64 nt, hsa
cugggcgacagagcgagacuccgucucaaaaaaaaaaaaaaaaaaaaauguuuucaaaguucca

SEQ ID NO: 35213 - RNA, 64 nt, hsa
ccugggcgacagagcgagacuccgucucaaaaaaaaaaaaaaaaaaaaauguuuucaaaguucc

SEQ ID NO: 35214 - RNA, 64 nt, hsa
gccugggcgacagagcgagacuccgucucaaaaaaaaaaaaaaaaaaaaauguuuucaaaguuc

SEQ ID NO: 35215 - RNA, 64 nt, hsa
agccugggcgacagagcgagacuccgucucaaaaaaaaaaaaaaaaaaaaauguuuucaaaguu

SEQ ID NO: 35216 - RNA, 64 nt, hsa
cagccugggcgacagagcgagacuccgucucaaaaaaaaaaaaaaaaaaaaauguuuucaaagu

SEQ ID NO: 35217 - RNA, 64 nt, hsa
ccagccugggcgacagagcgagacuccgucucaaaaaaaaaaaaaaaaaaaaauguuuucaaag

SEQ ID NO: 35218 - RNA, 64 nt, hsa
uccagccugggcgacagagcgagacuccgucucaaaaaaaaaaaaaaaaaaaaauguuuucaaa

SEQ ID NO: 35219 - RNA, 64 nt, hsa
cuccagccugggcgacagagcgagacuccgucucaaaaaaaaaaaaaaaaaaaaauguuuucaa

SEQ ID NO: 35220 - RNA, 64 nt, hsa
ggggcucccuguuuuuaagagacucuuuuaaaaaaaaaaaaaccuaauguuuuuaucuugaguc

SEQ ID NO: 35221 - RNA, 64 nt, hsa
aggggcucccuguuuuuaagagacucuuuuaaaaaaaaaaaaaccuaauguuuuuaucuugagu

SEQ ID NO: 35222 - RNA, 64 nt, hsa
caggggcucccuguuuuuaagagacucuuuuaaaaaaaaaaaaaccuaauguuuuuaucuugag

SEQ ID NO: 35223 - RNA, 64 nt, hsa
ucaggggcucccuguuuuuaagagacucuuuuaaaaaaaaaaaaaccuaauguuuuuaucuuga

SEQ ID NO: 35224 - RNA, 64 nt, hsa
uucaggggcucccuguuuuuaagagacucuuuuaaaaaaaaaaaaaccuaauguuuuuaucuug

SEQ ID NO: 35225 - RNA, 64 nt, hsa
guucaggggcucccuguuuuuaagagacucuuuuaaaaaaaaaaaaaccuaauguuuuuaucuu

SEQ ID NO: 35226 - RNA, 64 nt, hsa
ugaucuugaacagcuccuguacuugcucuuuguaaaaaaaaauaaaauuauuuugaauuauucu

SEQ ID NO: 35227 - RNA, 64 nt, hsa
augaucuugaacagcuccuguacuugcucuuuguaaaaaaaaauaaaauuauuuugaauuauuc

SEQ ID NO: 35228 - RNA, 64 nt, hsa
ggggaaaggacaauuuugaaauuccuuuucaaggaaaaaaaaggucuuuaugcuuugccaugag

SEQ ID NO: 35229 - RNA, 64 nt, hsa
acccaggucauugaaaugaaauuggccagucaaaaaaaaaaagacuucaaucauuuuuaaaauu

SEQ ID NO: 35230 - RNA, 64 nt, hsa
aacccaggucauugaaaugaaauuggccagucaaaaaaaaaaagacuucaaucauuuuuaaaau

SEQ ID NO: 35231 - RNA, 64 nt, hsa
caacccaggucauugaaaugaaauuggccagucaaaaaaaaaaagacuucaaucauuuuuaaaa

SEQ ID NO: 35232 - RNA, 64 nt, hsa
ccaacccaggucauugaaaugaaauuggccagucaaaaaaaaaaagacuucaaucauuuuuaaa

SEQ ID NO: 35233 - RNA, 64 nt, hsa
uucaugauauugucaaaacagugaggaaacauuaaaaaaaaagcccuaaagcacgccugguguc

SEQ ID NO: 35234 - RNA, 64 nt, hsa
uuucaugauauugucaaaacagugaggaaacauuaaaaaaaaagcccuaaagcacgccuggugu

SEQ ID NO: 35235 - RNA, 64 nt, hsa
aguaaguuauuuugcucucacuguuuuaacaaaaaaaaaaaacaacaacauaaaaauccuugca

SEQ ID NO: 35236 - RNA, 64 nt, hsa
caguaaguuauuuugcucucacuguuuuaacaaaaaaaaaaaacaacaacauaaaaauccuugc

SEQ ID NO: 35237 - RNA, 64 nt, hsa
ccaguaaguuauuuugcucucacuguuuuaacaaaaaaaaaaaacaacaacauaaaaauccuug

SEQ ID NO: 35238 - RNA, 64 nt, hsa
uccaguaaguuauuuugcucucacuguuuuaacaaaaaaaaaaaacaacaacauaaaaauccuu

SEQ ID NO: 35239 - RNA, 64 nt, hsa
uuccaguaaguuauuuugcucucacuguuuuaacaaaaaaaaaaaacaacaacauaaaaauccu

SEQ ID NO: 35240 - RNA, 64 nt, hsa
auccugggacauguacuccaagccuccgucacaaaaaaaaaaucaccagcugccauagacacgg

SEQ ID NO: 35241 - RNA, 64 nt, hsa
gauccugggacauguacuccaagccuccgucacaaaaaaaaaaucaccagcugccauagacacg

SEQ ID NO: 35242 - RNA, 64 nt, hsa
ugauccugggacauguacuccaagccuccgucacaaaaaaaaaaucaccagcugccauagacac

SEQ ID NO: 35243 - RNA, 64 nt, hsa
cuugcugaacuaaguuuuguguguauauauuuaaaaaaaaaaucaguguuuaaauaaagaccua

SEQ ID NO: 35244 - RNA, 64 nt, hsa
ccuugcugaacuaaguuuuguguguauauauuuaaaaaaaaaaucaguguuuaaauaaagaccu

SEQ ID NO: 35245 - RNA, 64 nt, hsa
gccuugcugaacuaaguuuuguguguauauauuuaaaaaaaaaaucaguguuuaaauaaagacc

SEQ ID NO: 35246 - RNA, 64 nt, hsa
gggugacagagcgagauuccgucucaaaaaaaaaaaaaaaaagcccaccugaaagccugucucu

SEQ ID NO: 35247 - RNA, 64 nt, hsa
ugggugacagagcgagauuccgucucaaaaaaaaaaaaaaaaagcccaccugaaagccugucuc

SEQ ID NO: 35248 - RNA, 64 nt, hsa
cugggugacagagcgagauuccgucucaaaaaaaaaaaaaaaaagcccaccugaaagccugucu

SEQ ID NO: 35249 - RNA, 64 nt, hsa
ccugggugacagagcgagauuccgucucaaaaaaaaaaaaaaaaagcccaccugaaagccuguc

SEQ ID NO: 35250 - RNA, 64 nt, hsa
gccugggugacagagcgagauuccgucucaaaaaaaaaaaaaaaaagcccaccugaaagccugu

SEQ ID NO: 35251 - RNA, 64 nt, hsa
agccugggugacagagcgagauuccgucucaaaaaaaaaaaaaaaaagcccaccugaaagccug

SEQ ID NO: 35252 - RNA, 64 nt, hsa
cagccugggugacagagcgagauuccgucucaaaaaaaaaaaaaaaaagcccaccugaaagccu

SEQ ID NO: 35253 - RNA, 64 nt, hsa
ccagccugggugacagagcgagauuccgucucaaaaaaaaaaaaaaaaagcccaccugaaagcc

SEQ ID NO: 35254 - RNA, 64 nt, hsa
uccagccugggugacagagcgagauuccgucucaaaaaaaaaaaaaaaaagcccaccugaaagc

SEQ ID NO: 35255 - RNA, 64 nt, hsa
cuccagccugggugacagagcgagauuccgucucaaaaaaaaaaaaaaaaagcccaccugaaag

SEQ ID NO: 35256 - RNA, 64 nt, hsa
uaaccacaguguaacuuacaguuuccuuuaaaaaaaaaaaaaguaaaccuggcagcuauagaau

SEQ ID NO: 35257 - RNA, 64 nt, hsa
uuaaccacaguguaacuuacaguuuccuuuaaaaaaaaaaaaaguaaaccuggcagcuauagaa

SEQ ID NO: 35258 - RNA, 64 nt, hsa
cuuaaccacaguguaacuuacaguuuccuuuaaaaaaaaaaaaaguaaaccuggcagcuauaga

SEQ ID NO: 35259 - RNA, 64 nt, hsa
ucuuaaccacaguguaacuuacaguuuccuuuaaaaaaaaaaaaaguaaaccuggcagcuauag

SEQ ID NO: 35260 - RNA, 64 nt, hsa
gucuuaaccacaguguaacuuacaguuuccuuuaaaaaaaaaaaaaguaaaccuggcagcuaua

SEQ ID NO: 35261 - RNA, 64 nt, hsa
agucuuaaccacaguguaacuuacaguuuccuuuaaaaaaaaaaaaaguaaaccuggcagcuau

SEQ ID NO: 35262 - RNA, 64 nt, hsa
gggugacagagcgagacucugucucaaaaaaaaaaaaaaaaagggagggcugucugcuuuuugu

SEQ ID NO: 35263 - RNA, 64 nt, hsa
ugggugacagagcgagacucugucucaaaaaaaaaaaaaaaaagggagggcugucugcuuuuug

SEQ ID NO: 35264 - RNA, 64 nt, hsa
cugggugacagagcgagacucugucucaaaaaaaaaaaaaaaaagggagggcugucugcuuuuu

SEQ ID NO: 35265 - RNA, 64 nt, hsa
ccugggugacagagcgagacucugucucaaaaaaaaaaaaaaaaagggagggcugucugcuuuu

SEQ ID NO: 35266 - RNA, 64 nt, hsa
gccugggugacagagcgagacucugucucaaaaaaaaaaaaaaaaagggagggcugucugcuuu

SEQ ID NO: 35267 - RNA, 64 nt, hsa
agccugggugacagagcgagacucugucucaaaaaaaaaaaaaaaaagggagggcugucugcuu

SEQ ID NO: 35268 - RNA, 64 nt, hsa
cagccugggugacagagcgagacucugucucaaaaaaaaaaaaaaaaagggagggcugucugcu

SEQ ID NO: 35269 - RNA, 64 nt, hsa
acagccugggugacagagcgagacucugucucaaaaaaaaaaaaaaaaagggagggcugucugc

SEQ ID NO: 35270 - RNA, 64 nt, hsa
uacagccugggugacagagcgagacucugucucaaaaaaaaaaaaaaaaagggagggcugucug

SEQ ID NO: 35271 - RNA, 64 nt, hsa
cuacagccugggugacagagcgagacucugucucaaaaaaaaaaaaaaaaagggagggcugucu

SEQ ID NO: 35272 - RNA, 64 nt, hsa
auuaaaagcuuggagauuacuguauuuggcauuaaaaaaaaaugucacuuaggucagcacuccc

SEQ ID NO: 35273 - RNA, 64 nt, hsa
cauuaaaagcuuggagauuacuguauuuggcauuaaaaaaaaaugucacuuaggucagcacucc

SEQ ID NO: 35274 - RNA, 64 nt, hsa
caaugcacuccagccugggcgacagagaaaaaaaaaaaaaaagaaggagcccuugaaucugaga

SEQ ID NO: 35275 - RNA, 64 nt, hsa
ccaaugcacuccagccugggcgacagagaaaaaaaaaaaaaaagaaggagcccuugaaucugag

SEQ ID NO: 35276 - RNA, 64 nt, hsa
gccaaugcacuccagccugggcgacagagaaaaaaaaaaaaaaagaaggagcccuugaaucuga

SEQ ID NO: 35277 - RNA, 64 nt, hsa
cgccaaugcacuccagccugggcgacagagaaaaaaaaaaaaaaagaaggagcccuugaaucug

SEQ ID NO: 35278 - RNA, 64 nt, hsa
gcgccaaugcacuccagccugggcgacagagaaaaaaaaaaaaaaagaaggagcccuugaaucu

SEQ ID NO: 35279 - RNA, 64 nt, hsa
cgcgccaaugcacuccagccugggcgacagagaaaaaaaaaaaaaaagaaggagcccuugaauc

SEQ ID NO: 35280 - RNA, 64 nt, hsa
ucgcgccaaugcacuccagccugggcgacagagaaaaaaaaaaaaaaagaaggagcccuugaau

SEQ ID NO: 35281 - RNA, 64 nt, hsa
aucgcgccaaugcacuccagccugggcgacagagaaaaaaaaaaaaaaagaaggagcccuugaa

SEQ ID NO: 35282 - RNA, 64 nt, hsa
ugcugaaauaaagcucaaucaacacacuaccuuaaaaaaaaaguggagcaguggcauuuccaug

SEQ ID NO: 35283 - RNA, 64 nt, hsa
uugcugaaauaaagcucaaucaacacacuaccuuaaaaaaaaaguggagcaguggcauuuccau

SEQ ID NO: 35284 - RNA, 64 nt, hsa
uggaugucuuguuucuaugugcaaaaaaaaaaaaaaaaaaaaguuuguuaaaaggcuacacgag

SEQ ID NO: 35285 - RNA, 64 nt, hsa
auggaugucuuguuucuaugugcaaaaaaaaaaaaaaaaaaaaguuuguuaaaaggcuacacga

SEQ ID NO: 35286 - RNA, 64 nt, hsa
cauggaugucuuguuucuaugugcaaaaaaaaaaaaaaaaaaaaguuuguuaaaaggcuacacg

SEQ ID NO: 35287 - RNA, 64 nt, hsa
acauggaugucuuguuucuaugugcaaaaaaaaaaaaaaaaaaaaguuuguuaaaaggcuacac

SEQ ID NO: 35288 - RNA, 64 nt, hsa
cacauggaugucuuguuucuaugugcaaaaaaaaaaaaaaaaaaaaguuuguuaaaaggcuaca

SEQ ID NO: 35289 - RNA, 64 nt, hsa
acacauggaugucuuguuucuaugugcaaaaaaaaaaaaaaaaaaaaguuuguuaaaaggcuac

SEQ ID NO: 35290 - RNA, 64 nt, hsa
uacacauggaugucuuguuucuaugugcaaaaaaaaaaaaaaaaaaaaguuuguuaaaaggcua

SEQ ID NO: 35291 - RNA, 64 nt, hsa
guacacauggaugucuuguuucuaugugcaaaaaaaaaaaaaaaaaaaaguuuguuaaaaggcu

SEQ ID NO: 35292 - RNA, 64 nt, hsa
uguacacauggaugucuuguuucuaugugcaaaaaaaaaaaaaaaaaaaaguuuguuaaaaggc

SEQ ID NO: 35293 - RNA, 64 nt, hsa
cuguacacauggaugucuuguuucuaugugcaaaaaaaaaaaaaaaaaaaaguuuguuaaaagg

SEQ ID NO: 35294 - RNA, 64 nt, hsa
acuguacacauggaugucuuguuucuaugugcaaaaaaaaaaaaaaaaaaaaguuuguuaaaag

SEQ ID NO: 35295 - RNA, 64 nt, hsa
uacuguacacauggaugucuuguuucuaugugcaaaaaaaaaaaaaaaaaaaaguuuguuaaaa

SEQ ID NO: 35296 - RNA, 64 nt, hsa
auacuguacacauggaugucuuguuucuaugugcaaaaaaaaaaaaaaaaaaaaguuuguuaaa

SEQ ID NO: 35297 - RNA, 64 nt, hsa
cccaauuuugucucauuugccaaaaaaaaaaaaaaaaaaaaagcaaacccccuaugguugauau

SEQ ID NO: 35298 - RNA, 64 nt, hsa
ucccaauuuugucucauuugccaaaaaaaaaaaaaaaaaaaaagcaaacccccuaugguugaua

SEQ ID NO: 35299 - RNA, 64 nt, hsa
gucccaauuuugucucauuugccaaaaaaaaaaaaaaaaaaaaagcaaacccccuaugguugau

SEQ ID NO: 35300 - RNA, 64 nt, hsa
agucccaauuuugucucauuugccaaaaaaaaaaaaaaaaaaaaagcaaacccccuaugguuga

SEQ ID NO: 35301 - RNA, 64 nt, hsa
gagucccaauuuugucucauuugccaaaaaaaaaaaaaaaaaaaaagcaaacccccuaugguug

SEQ ID NO: 35302 - RNA, 64 nt, hsa
agagucccaauuuugucucauuugccaaaaaaaaaaaaaaaaaaaaagcaaacccccuaugguu

SEQ ID NO: 35303 - RNA, 64 nt, hsa
uagagucccaauuuugucucauuugccaaaaaaaaaaaaaaaaaaaaagcaaacccccuauggu

SEQ ID NO: 35304 - RNA, 64 nt, hsa
uuagagucccaauuuugucucauuugccaaaaaaaaaaaaaaaaaaaaagcaaacccccuaugg

SEQ ID NO: 35305 - RNA, 64 nt, hsa
cuuagagucccaauuuugucucauuugccaaaaaaaaaaaaaaaaaaaaagcaaacccccuaug

SEQ ID NO: 35306 - RNA, 64 nt, hsa
acuuagagucccaauuuugucucauuugccaaaaaaaaaaaaaaaaaaaaagcaaacccccuau

SEQ ID NO: 35307 - RNA, 64 nt, hsa
uacuuagagucccaauuuugucucauuugccaaaaaaaaaaaaaaaaaaaaagcaaacccccua

SEQ ID NO: 35308 - RNA, 64 nt, hsa
auacuuagagucccaauuuugucucauuugccaaaaaaaaaaaaaaaaaaaaagcaaacccccu

SEQ ID NO: 35309 - RNA, 64 nt, hsa
aauacuuagagucccaauuuugucucauuugccaaaaaaaaaaaaaaaaaaaaagcaaaccccc

SEQ ID NO: 35310 - RNA, 64 nt, hsa
caauacuuagagucccaauuuugucucauuugccaaaaaaaaaaaaaaaaaaaaagcaaacccc

SEQ ID NO: 35311 - RNA, 64 nt, hsa
caauuuguugaaagggaacaagucauugaagagaaaaaaaaagcccaauacuuagagucccaau

SEQ ID NO: 35312 - RNA, 64 nt, hsa
gcaauuuguugaaagggaacaagucauugaagagaaaaaaaaagcccaauacuuagagucccaa

SEQ ID NO: 35313 - RNA, 64 nt, hsa
uauuuauaaaacuuaguuuaaaaaaaagacaaaaaaaaaaaagccaagccgugagccgaccaga

SEQ ID NO: 35314 - RNA, 64 nt, hsa
uuauuuauaaaacuuaguuuaaaaaaaagacaaaaaaaaaaaagccaagccgugagccgaccag

SEQ ID NO: 35315 - RNA, 64 nt, hsa
auuauuuauaaaacuuaguuuaaaaaaaagacaaaaaaaaaaaagccaagccgugagccgacca

SEQ ID NO: 35316 - RNA, 64 nt, hsa
cauuauuuauaaaacuuaguuuaaaaaaaagacaaaaaaaaaaaagccaagccgugagccgacc

SEQ ID NO: 35317 - RNA, 64 nt, hsa
acauuauuuauaaaacuuaguuuaaaaaaaagacaaaaaaaaaaaagccaagccgugagccgac

SEQ ID NO: 35318 - RNA, 64 nt, hsa
agaguuaucagacauuauuuauaaaacuuaguuuaaaaaaaagacaaaaaaaaaaaagccaagc

SEQ ID NO: 35319 - RNA, 64 nt, hsa
aacuuugcuaguuaaaaaaaaaagaaaaaaaaagaaaaaaaaucccuuucuuguaaacuuacgg

SEQ ID NO: 35320 - RNA, 64 nt, hsa
uauaauagaaacuuugcuaguuaaaaaaaaaagaaaaaaaaagaaaaaaaaucccuuucuugua

SEQ ID NO: 35321 - RNA, 64 nt, hsa
guauaauagaaacuuugcuaguuaaaaaaaaaagaaaaaaaaagaaaaaaaaucccuuucuugu

SEQ ID NO: 35322 - RNA, 64 nt, hsa
gggaagaaaguauaauagaaacuuugcuaguuaaaaaaaaaagaaaaaaaaagaaaaaaaaucc

SEQ ID NO: 35323 - RNA, 64 nt, hsa
agggaagaaaguauaauagaaacuuugcuaguuaaaaaaaaaagaaaaaaaaagaaaaaaaauc

SEQ ID NO: 35324 - RNA, 64 nt, hsa
aagggaagaaaguauaauagaaacuuugcuaguuaaaaaaaaaagaaaaaaaaagaaaaaaaau

SEQ ID NO: 35325 - RNA, 64 nt, hsa
agagcugcagaguauuuauaaaacugucuuuuagaaaaaaaacaagcaagaagaccauuugacc

SEQ ID NO: 35326 - RNA, 64 nt, hsa
uuauuuuuagaaaaugaggacauuuaauaauaauaaaaaaaaagggauuaauagcuuuugaccu

SEQ ID NO: 35327 - RNA, 64 nt, hsa
uauuuuuagaaaaugaggacauuuaauaauaauaaaaaaaaagggauuaauagcuuuugaccuc

SEQ ID NO: 35328 - RNA, 64 nt, hsa
uacaguauaaacuaccucacuugccuuucuugggaaaaaaaaaaugaauggacuuuaacaauug

SEQ ID NO: 35329 - RNA, 64 nt, hsa
acaguauaaacuaccucacuugccuuucuugggaaaaaaaaaaugaauggacuuuaacaauugu

SEQ ID NO: 35330 - RNA, 64 nt, hsa
caguauaaacuaccucacuugccuuucuugggaaaaaaaaaaugaauggacuuuaacaauuguu

SEQ ID NO: 35331 - RNA, 64 nt, hsa
uaugcuguuuuauaauaaauuagcaauauacuuuaaaaaaaauccaguuucuccuauaacauga

SEQ ID NO: 35332 - RNA, 64 nt, hsa
cuguacuuggcaugcgcaauaaagcagcacauguaaaaaaaaaauacacagugcaaggacuuua

SEQ ID NO: 35333 - RNA, 64 nt, hsa
uguacuuggcaugcgcaauaaagcagcacauguaaaaaaaaaauacacagugcaaggacuuuau

SEQ ID NO: 35334 - RNA, 64 nt, hsa
guacuuggcaugcgcaauaaagcagcacauguaaaaaaaaaauacacagugcaaggacuuuauu

SEQ ID NO: 35335 - RNA, 64 nt, hsa
augcacauggaggggauguaguugcauuuuugcuaaaaaaaaaaaaaaaccuuuaaaaauuguu

SEQ ID NO: 35336 - RNA, 64 nt, hsa
ugcacauggaggggauguaguugcauuuuugcuaaaaaaaaaaaaaaaccuuuaaaaauuguug

SEQ ID NO: 35337 - RNA, 64 nt, hsa
gcacauggaggggauguaguugcauuuuugcuaaaaaaaaaaaaaaaccuuuaaaaauuguugg

SEQ ID NO: 35338 - RNA, 64 nt, hsa
cacauggaggggauguaguugcauuuuugcuaaaaaaaaaaaaaaaccuuuaaaaauuguugga

SEQ ID NO: 35339 - RNA, 64 nt, hsa
acauggaggggauguaguugcauuuuugcuaaaaaaaaaaaaaaaccuuuaaaaauuguuggau

SEQ ID NO: 35340 - RNA, 64 nt, hsa
cauggaggggauguaguugcauuuuugcuaaaaaaaaaaaaaaaccuuuaaaaauuguuggaug

SEQ ID NO: 35341 - RNA, 64 nt, hsa
auggaggggauguaguugcauuuuugcuaaaaaaaaaaaaaaaccuuuaaaaauuguuggaugu

SEQ ID NO: 35342 - RNA, 64 nt, hsa
uggaggggauguaguugcauuuuugcuaaaaaaaaaaaaaaaccuuuaaaaauuguuggaugug

SEQ ID NO: 35343 - RNA, 64 nt, hsa
aggccaagaaaugaucauaccccuugccaaagguaaaaaaaaaaaaaaaaaaaugaguugaaaa

SEQ ID NO: 35344 - RNA, 64 nt, hsa
ggccaagaaaugaucauaccccuugccaaagguaaaaaaaaaaaaaaaaaaaugaguugaaaau

SEQ ID NO: 35345 - RNA, 64 nt, hsa
gccaagaaaugaucauaccccuugccaaagguaaaaaaaaaaaaaaaaaaaugaguugaaaauu

SEQ ID NO: 35346 - RNA, 64 nt, hsa
ccaagaaaugaucauaccccuugccaaagguaaaaaaaaaaaaaaaaaaaugaguugaaaauug

SEQ ID NO: 35347 - RNA, 64 nt, hsa
caagaaaugaucauaccccuugccaaagguaaaaaaaaaaaaaaaaaaaugaguugaaaauuga

SEQ ID NO: 35348 - RNA, 64 nt, hsa
aagaaaugaucauaccccuugccaaagguaaaaaaaaaaaaaaaaaaaugaguugaaaauugaa

SEQ ID NO: 35349 - RNA, 64 nt, hsa
agaaaugaucauaccccuugccaaagguaaaaaaaaaaaaaaaaaaaugaguugaaaauugaag

SEQ ID NO: 35350 - RNA, 64 nt, hsa
gaaaugaucauaccccuugccaaagguaaaaaaaaaaaaaaaaaaaugaguugaaaauugaagu

SEQ ID NO: 35351 - RNA, 64 nt, hsa
aaaugaucauaccccuugccaaagguaaaaaaaaaaaaaaaaaaaugaguugaaaauugaagug

SEQ ID NO: 35352 - RNA, 64 nt, hsa
aaugaucauaccccuugccaaagguaaaaaaaaaaaaaaaaaaaugaguugaaaauugaaguga

SEQ ID NO: 35353 - RNA, 64 nt, hsa
augaucauaccccuugccaaagguaaaaaaaaaaaaaaaaaaaugaguugaaaauugaagugac

SEQ ID NO: 35354 - RNA, 64 nt, hsa
ugaucauaccccuugccaaagguaaaaaaaaaaaaaaaaaaaugaguugaaaauugaagugacc

SEQ ID NO: 35355 - RNA, 64 nt, hsa
cauccuuacaauccugucccaugguauuuaacauaaaaaaaaauaaaacuguuaacagauucuu

SEQ ID NO: 35356 - RNA, 64 nt, hsa
auccuuacaauccugucccaugguauuuaacauaaaaaaaaauaaaacuguuaacagauucuug

SEQ ID NO: 35357 - RNA, 64 nt, hsa
gucauuauguucugagugugugguauguucccuuaaaaaaaaaugacacuuggaagaaaaaugu

SEQ ID NO: 35358 - RNA, 64 nt, hsa
ucauuauguucugagugugugguauguucccuuaaaaaaaaaugacacuuggaagaaaaaugua

SEQ ID NO: 35359 - RNA, 64 nt, hsa
aaaaugugaaguguccuuuuccuuuucacaauacaaaaaaaauuucaacagauugugugguuug

SEQ ID NO: 35360 - RNA, 64 nt, hsa
uaaaggugauugaauauaaguaaccaugacuuguaaaaaaaaaaaaagaaagcaguuacucuug

SEQ ID NO: 35361 - RNA, 64 nt, hsa
aaaggugauugaauauaaguaaccaugacuuguaaaaaaaaaaaaagaaagcaguuacucuugg

SEQ ID NO: 35362 - RNA, 64 nt, hsa
aaggugauugaauauaaguaaccaugacuuguaaaaaaaaaaaaagaaagcaguuacucuugga

SEQ ID NO: 35363 - RNA, 64 nt, hsa
aggugauugaauauaaguaaccaugacuuguaaaaaaaaaaaaagaaagcaguuacucuuggag

SEQ ID NO: 35364 - RNA, 64 nt, hsa
ggugauugaauauaaguaaccaugacuuguaaaaaaaaaaaaagaaagcaguuacucuuggagc

SEQ ID NO: 35365 - RNA, 64 nt, hsa
gugauugaauauaaguaaccaugacuuguaaaaaaaaaaaaagaaagcaguuacucuuggagcu

SEQ ID NO: 35366 - RNA, 64 nt, hsa
ggccuaggugacagagggaaacuccaucuccaggaaaaaaaaaaaaaaacccaauuuggauacc

SEQ ID NO: 35367 - RNA, 64 nt, hsa
gccuaggugacagagggaaacuccaucuccaggaaaaaaaaaaaaaaacccaauuuggauacca

SEQ ID NO: 35368 - RNA, 64 nt, hsa
ccuaggugacagagggaaacuccaucuccaggaaaaaaaaaaaaaaacccaauuuggauaccaa

SEQ ID NO: 35369 - RNA, 64 nt, hsa
cuaggugacagagggaaacuccaucuccaggaaaaaaaaaaaaaaacccaauuuggauaccaaa

SEQ ID NO: 35370 - RNA, 64 nt, hsa
uaggugacagagggaaacuccaucuccaggaaaaaaaaaaaaaaacccaauuuggauaccaaau

SEQ ID NO: 35371 - RNA, 64 nt, hsa
aggugacagagggaaacuccaucuccaggaaaaaaaaaaaaaaacccaauuuggauaccaaauu

SEQ ID NO: 35372 - RNA, 64 nt, hsa
ggugacagagggaaacuccaucuccaggaaaaaaaaaaaaaaacccaauuuggauaccaaauua

SEQ ID NO: 35373 - RNA, 64 nt, hsa
gugacagagggaaacuccaucuccaggaaaaaaaaaaaaaaacccaauuuggauaccaaauuaa

SEQ ID NO: 35374 - RNA, 64 nt, hsa
agccuggcaacagaacaagacucugucuaaaaagaaaaaaaaauuuuuuuguuuaagacagcau

SEQ ID NO: 35375 - RNA, 64 nt, hsa
gccuggcaacagaacaagacucugucuaaaaagaaaaaaaaauuuuuuuguuuaagacagcauc

SEQ ID NO: 35376 - RNA, 64 nt, hsa
uguugcccagccugggugucaauaauuauuuuuuaaaaaaaauuuuuaaaaagguuuuuugaga

SEQ ID NO: 35377 - RNA, 64 nt, hsa
aguuaaaaugauuuacauaggccgagcuguggacaaaaaaaaaagaagcagcagcuuguaguau

SEQ ID NO: 35378 - RNA, 64 nt, hsa
guuaaaaugauuuacauaggccgagcuguggacaaaaaaaaaagaagcagcagcuuguaguaug

SEQ ID NO: 35379 - RNA, 64 nt, hsa
uuaaaaugauuuacauaggccgagcuguggacaaaaaaaaaagaagcagcagcuuguaguaugc

SEQ ID NO: 35380 - RNA, 64 nt, hsa
gauuuguagugcauagguguguguuucaagaaggaaaaaaaaagacuucuguucaaaguuaacu

SEQ ID NO: 35381 - RNA, 64 nt, hsa
auuuguagugcauagguguguguuucaagaaggaaaaaaaaagacuucuguucaaaguuaacuu

SEQ ID NO: 35382 - RNA, 64 nt, hsa
agaaagggcauuuuuacuuuugaaccaaaaagagaaaaaaaaaucagaaguguugcaucuugag

SEQ ID NO: 35383 - RNA, 64 nt, hsa
gaaagggcauuuuuacuuuugaaccaaaaagagaaaaaaaaaucagaaguguugcaucuugagg

SEQ ID NO: 35384 - RNA, 64 nt, hsa
acacuaaagauuucacaauauucauugguauuguaaaaaaaaaauacuauuguauggauuuuug

SEQ ID NO: 35385 - RNA, 64 nt, hsa
cacuaaagauuucacaauauucauugguauuguaaaaaaaaaauacuauuguauggauuuuugu

SEQ ID NO: 35386 - RNA, 64 nt, hsa
acuaaagauuucacaauauucauugguauuguaaaaaaaaaauacuauuguauggauuuuugua

SEQ ID NO: 35387 - RNA, 64 nt, hsa
uccgaaaaucaugguaaagaauacugagacaaugaaaaaaaaucaacaaaauaugcuuucugga

SEQ ID NO: 35388 - RNA, 64 nt, hsa
cuuuuauuuuccuuggggugcugaaauugagcugaaaaaaaaaggcucuuugaauauaguuuua

SEQ ID NO: 35389 - RNA, 64 nt, hsa
uuuuauuuuccuuggggugcugaaauugagcugaaaaaaaaaggcucuuugaauauaguuuuaa

SEQ ID NO: 35390 - RNA, 64 nt, hsa
ugcuguauuuggguauuuuucuccucuaccuucuaaaaaaaaauaccauaagaagaaucagaau

SEQ ID NO: 35391 - RNA, 64 nt, hsa
gcuguauuuggguauuuuucuccucuaccuucuaaaaaaaaauaccauaagaagaaucagaaug

SEQ ID NO: 35392 - RNA, 64 nt, hsa
auucucuuaacaaauuuuaaaagguagugaucuuaaaaaaaaaucacuggauaacuaggaaaua

SEQ ID NO: 35393 - RNA, 64 nt, hsa
uucucuuaacaaauuuuaaaagguagugaucuuaaaaaaaaaucacuggauaacuaggaaauau

SEQ ID NO: 35394 - RNA, 64 nt, hsa
ugagagaaaaggaaaaaggaaucaaagguggaagaaaaaaaaagccaaauucuguuuacgguga

SEQ ID NO: 35395 - RNA, 64 nt, hsa
gagagaaaaggaaaaaggaaucaaagguggaagaaaaaaaaagccaaauucuguuuacggugaa

SEQ ID NO: 35396 - RNA, 64 nt, hsa
uagagcgauuucagcugauagaaaaacaaaaaugaaaaaaaaaacacaaaaaacaaaaaacaug

SEQ ID NO: 35397 - RNA, 64 nt, hsa
agagcgauuucagcugauagaaaaacaaaaaugaaaaaaaaaacacaaaaaacaaaaaacaugg

SEQ ID NO: 35398 - RNA, 64 nt, hsa
gagcgauuucagcugauagaaaaacaaaaaugaaaaaaaaaacacaaaaaacaaaaaacauggc

SEQ ID NO: 35399 - RNA, 64 nt, hsa
uuuuuacaacacuggugacagucauaugguuuugaaaaaaaaaagaaauuuugcuucuucccag

SEQ ID NO: 35400 - RNA, 64 nt, hsa
uuuuacaacacuggugacagucauaugguuuugaaaaaaaaaagaaauuuugcuucuucccagc

SEQ ID NO: 35401 - RNA, 64 nt, hsa
uuuacaacacuggugacagucauaugguuuugaaaaaaaaaagaaauuuugcuucuucccagcu

SEQ ID NO: 35402 - RNA, 64 nt, hsa
gugucaugucacuaaguuuaaugcugcuguuuuuaaaaaaaaaaaaaaguuuuuuuaaaaagcc

SEQ ID NO: 35403 - RNA, 64 nt, hsa
ugucaugucacuaaguuuaaugcugcuguuuuuaaaaaaaaaaaaaaguuuuuuuaaaaagcca

SEQ ID NO: 35404 - RNA, 64 nt, hsa
gucaugucacuaaguuuaaugcugcuguuuuuaaaaaaaaaaaaaaguuuuuuuaaaaagccaa

SEQ ID NO: 35405 - RNA, 64 nt, hsa
ucaugucacuaaguuuaaugcugcuguuuuuaaaaaaaaaaaaaaguuuuuuuaaaaagccaau

SEQ ID NO: 35406 - RNA, 64 nt, hsa
caugucacuaaguuuaaugcugcuguuuuuaaaaaaaaaaaaaaguuuuuuuaaaaagccaauc

SEQ ID NO: 35407 - RNA, 64 nt, hsa
augucacuaaguuuaaugcugcuguuuuuaaaaaaaaaaaaaaguuuuuuuaaaaagccaaucu

SEQ ID NO: 35408 - RNA, 64 nt, hsa
ugucacuaaguuuaaugcugcuguuuuuaaaaaaaaaaaaaaguuuuuuuaaaaagccaaucua

SEQ ID NO: 35409 - RNA, 64 nt, hsa
aggacuguaauugcauuucugugccuuucacuugaaaaaaaaaaaagaagaaaaaaaggcuuaa

SEQ ID NO: 35410 - RNA, 64 nt, hsa
ggacuguaauugcauuucugugccuuucacuugaaaaaaaaaaaagaagaaaaaaaggcuuaaa

SEQ ID NO: 35411 - RNA, 64 nt, hsa
gacuguaauugcauuucugugccuuucacuugaaaaaaaaaaaagaagaaaaaaaggcuuaaag

SEQ ID NO: 35412 - RNA, 64 nt, hsa
acuguaauugcauuucugugccuuucacuugaaaaaaaaaaaagaagaaaaaaaggcuuaaagg

SEQ ID NO: 35413 - RNA, 64 nt, hsa
cuguaauugcauuucugugccuuucacuugaaaaaaaaaaaagaagaaaaaaaggcuuaaaggc

SEQ ID NO: 35414 - RNA, 64 nt, hsa
aacccucuggaugcugaaaaaugccacuuucggcaaaaaaaaaaguaugcaagcuauuauuuaa

SEQ ID NO: 35415 - RNA, 64 nt, hsa
acccucuggaugcugaaaaaugccacuuucggcaaaaaaaaaaguaugcaagcuauuauuuaaa

SEQ ID NO: 35416 - RNA, 64 nt, hsa
cccucuggaugcugaaaaaugccacuuucggcaaaaaaaaaaguaugcaagcuauuauuuaaaa

SEQ ID NO: 35417 - RNA, 64 nt, hsa
cugaccuuucuauagcgugcugcauugguaaaugaaaaaaaauggggcaaacguuggaguccuu

SEQ ID NO: 35418 - RNA, 64 nt, hsa
ucuaaagaaucauugucuuucagagacucauaggaaaaaaaaacuaggaaaagugucaccgcau

SEQ ID NO: 35419 - RNA, 64 nt, hsa
cuaaagaaucauugucuuucagagacucauaggaaaaaaaaacuaggaaaagugucaccgcauu

SEQ ID NO: 35420 - RNA, 64 nt, hsa
caaagcaagcguaagauugaggcaugaaguucagaaaaaaaaguguuacaacacacagggaagu

SEQ ID NO: 35421 - RNA, 64 nt, hsa
uuugcagucuacauuuuaaagccaauuuauuuagaaaaaaaaauuugagcuuuaauucuuuaau

SEQ ID NO: 35422 - RNA, 64 nt, hsa
uugcagucuacauuuuaaagccaauuuauuuagaaaaaaaaauuugagcuuuaauucuuuaauu

SEQ ID NO: 35423 - RNA, 64 nt, hsa
uugccuugaauggaaccuacuaaaaagagagaugaaaaaaaaucagcgagguugauguagauaa

SEQ ID NO: 35424 - RNA, 64 nt, hsa
aaagcauauuucauguuugauuuagaugacauucaaaaaaaaucaugggacugaauauaccugg

SEQ ID NO: 35425 - RNA, 64 nt, hsa
gagaacucugcaaucuuuuaaauaagcuuccuucaaaaaaaaaagugcuuggaaaaccgccuua

SEQ ID NO: 35426 - RNA, 64 nt, hsa
agaacucugcaaucuuuuaaauaagcuuccuucaaaaaaaaaagugcuuggaaaaccgccuuag

SEQ ID NO: 35427 - RNA, 64 nt, hsa
gaacucugcaaucuuuuaaauaagcuuccuucaaaaaaaaaagugcuuggaaaaccgccuuagg

SEQ ID NO: 35428 - RNA, 64 nt, hsa
uugaaaaaaaaaaagcacugaaaaccaauuacugaaaaaaaauugacagcuaguguuuuuuacc

SEQ ID NO: 35429 - RNA, 64 nt, hsa
uuucuaauugcaucaccuucucaucagauugaaaaaaaaaaagcacugaaaaccaauuacugaa

SEQ ID NO: 35430 - RNA, 64 nt, hsa
cuuucuaauugcaucaccuucucaucagauugaaaaaaaaaaagcacugaaaaccaauuacuga

SEQ ID NO: 35431 - RNA, 64 nt, hsa
ccuuucuaauugcaucaccuucucaucagauugaaaaaaaaaaagcacugaaaaccaauuacug

SEQ ID NO: 35432 - RNA, 64 nt, hsa
uccuuucuaauugcaucaccuucucaucagauugaaaaaaaaaaagcacugaaaaccaauuacu

SEQ ID NO: 35433 - RNA, 64 nt, hsa
gagugagacuccgucucaaaaaauauauuuaaaaaaaaaaaaguacagaugugaugugcagaac

SEQ ID NO: 35434 - RNA, 64 nt, hsa
agagugagacuccgucucaaaaaauauauuuaaaaaaaaaaaaguacagaugugaugugcagaa

SEQ ID NO: 35435 - RNA, 64 nt, hsa
cagagugagacuccgucucaaaaaauauauuuaaaaaaaaaaaaguacagaugugaugugcaga

SEQ ID NO: 35436 - RNA, 64 nt, hsa
acagagugagacuccgucucaaaaaauauauuuaaaaaaaaaaaaguacagaugugaugugcag

SEQ ID NO: 35437 - RNA, 64 nt, hsa
aacagagugagacuccgucucaaaaaauauauuuaaaaaaaaaaaaguacagaugugaugugca

SEQ ID NO: 35438 - RNA, 64 nt, hsa
acuguuccucgaauaaucuccugacuaaggcaaaaaaaaaaagcuucuccuacgagaaucaguc

SEQ ID NO: 35439 - RNA, 64 nt, hsa
uacuguuccucgaauaaucuccugacuaaggcaaaaaaaaaaagcuucuccuacgagaaucagu

SEQ ID NO: 35440 - RNA, 64 nt, hsa
uuacuguuccucgaauaaucuccugacuaaggcaaaaaaaaaaagcuucuccuacgagaaucag

SEQ ID NO: 35441 - RNA, 64 nt, hsa
uuuacuguuccucgaauaaucuccugacuaaggcaaaaaaaaaaagcuucuccuacgagaauca

SEQ ID NO: 35442 - RNA, 64 nt, hsa
ugcauuucaagcaguguuggaaauucuuuuaugaaaaaaaaagaugcccagaaugcccauccug

SEQ ID NO: 35443 - RNA, 64 nt, hsa
uugcauuucaagcaguguuggaaauucuuuuaugaaaaaaaaagaugcccagaaugcccauccu

SEQ ID NO: 35444 - RNA, 64 nt, hsa
ccucccaauguuaccccuuccaucuuccaagaagaaaaaaaaugccugaauauucagaauagau

SEQ ID NO: 35445 - RNA, 64 nt, hsa
auuuuuuucccuugguuucuacuuaucuuuuaaaaaaaaaaaugaaaaaacacucaugagauaa

SEQ ID NO: 35446 - RNA, 64 nt, hsa
aauuuuuuucccuugguuucuacuuaucuuuuaaaaaaaaaaaugaaaaaacacucaugagaua

SEQ ID NO: 35447 - RNA, 64 nt, hsa
aaauuuuuuucccuugguuucuacuuaucuuuuaaaaaaaaaaaugaaaaaacacucaugagau

SEQ ID NO: 35448 - RNA, 64 nt, hsa
uaaauuuuuuucccuugguuucuacuuaucuuuuaaaaaaaaaaaugaaaaaacacucaugaga

SEQ ID NO: 35449 - RNA, 64 nt, hsa
guggacuugggcccuauucaggcaagauuaaaaaaaaaaaaagacuaugaccaaaauggcuuaa

SEQ ID NO: 35450 - RNA, 64 nt, hsa
aguggacuugggcccuauucaggcaagauuaaaaaaaaaaaaagacuaugaccaaaauggcuua

SEQ ID NO: 35451 - RNA, 64 nt, hsa
aaguggacuugggcccuauucaggcaagauuaaaaaaaaaaaaagacuaugaccaaaauggcuu

SEQ ID NO: 35452 - RNA, 64 nt, hsa
caaguggacuugggcccuauucaggcaagauuaaaaaaaaaaaaagacuaugaccaaaauggcu

SEQ ID NO: 35453 - RNA, 64 nt, hsa
acaaguggacuugggcccuauucaggcaagauuaaaaaaaaaaaaagacuaugaccaaaauggc

SEQ ID NO: 35454 - RNA, 64 nt, hsa
gacaaguggacuugggcccuauucaggcaagauuaaaaaaaaaaaaagacuaugaccaaaaugg

SEQ ID NO: 35455 - RNA, 64 nt, hsa
auaugucaaaagguaggaaaugcaaaaaagaaaaaaaaaaaaggugacagccgcaguuggugcu

SEQ ID NO: 35456 - RNA, 64 nt, hsa
uauaugucaaaagguaggaaaugcaaaaaagaaaaaaaaaaaaggugacagccgcaguuggugc

SEQ ID NO: 35457 - RNA, 64 nt, hsa
auauaugucaaaagguaggaaaugcaaaaaagaaaaaaaaaaaaggugacagccgcaguuggug

SEQ ID NO: 35458 - RNA, 64 nt, hsa
uauauaugucaaaagguaggaaaugcaaaaaagaaaaaaaaaaaaggugacagccgcaguuggu

SEQ ID NO: 35459 - RNA, 64 nt, hsa
auauauaugucaaaagguaggaaaugcaaaaaagaaaaaaaaaaaaggugacagccgcaguugg

SEQ ID NO: 35460 - RNA, 64 nt, hsa
acuaaguguguguuuuuuuaaaaaaaaaauggaaaaaaaaaagcuuuuaaacuggagagacuuc

SEQ ID NO: 35461 - RNA, 64 nt, hsa
uacuaaguguguguuuuuuuaaaaaaaaaauggaaaaaaaaaagcuuuuaaacuggagagacuu

SEQ ID NO: 35462 - RNA, 64 nt, hsa
cuacuaaguguguguuuuuuuaaaaaaaaaauggaaaaaaaaaagcuuuuaaacuggagagacu

SEQ ID NO: 35463 - RNA, 64 nt, hsa
cacugguggcacuacuaaguguguguuuuuuuaaaaaaaaaauggaaaaaaaaaagcuuuuaaa

SEQ ID NO: 35464 - RNA, 64 nt, hsa
acacugguggcacuacuaaguguguguuuuuuuaaaaaaaaaauggaaaaaaaaaagcuuuuaa

SEQ ID NO: 35465 - RNA, 64 nt, hsa
gacacugguggcacuacuaaguguguguuuuuuuaaaaaaaaaauggaaaaaaaaaagcuuuua

SEQ ID NO: 35466 - RNA, 64 nt, hsa
gcacaaauguuuuacauaauuuguaccaaaaaaaaaaaaaaaggaaaggaaagaaagggguggc

SEQ ID NO: 35467 - RNA, 64 nt, hsa
agcacaaauguuuuacauaauuuguaccaaaaaaaaaaaaaaaggaaaggaaagaaaggggugg

SEQ ID NO: 35468 - RNA, 64 nt, hsa
uagcacaaauguuuuacauaauuuguaccaaaaaaaaaaaaaaaggaaaggaaagaaaggggug

SEQ ID NO: 35469 - RNA, 64 nt, hsa
uuagcacaaauguuuuacauaauuuguaccaaaaaaaaaaaaaaaggaaaggaaagaaaggggu

SEQ ID NO: 35470 - RNA, 64 nt, hsa
cuuagcacaaauguuuuacauaauuuguaccaaaaaaaaaaaaaaaggaaaggaaagaaagggg

SEQ ID NO: 35471 - RNA, 64 nt, hsa
ucuuagcacaaauguuuuacauaauuuguaccaaaaaaaaaaaaaaaggaaaggaaagaaaggg

SEQ ID NO: 35472 - RNA, 64 nt, hsa
uucuuagcacaaauguuuuacauaauuuguaccaaaaaaaaaaaaaaaggaaaggaaagaaagg

SEQ ID NO: 35473 - RNA, 64 nt, hsa
guucuuagcacaaauguuuuacauaauuuguaccaaaaaaaaaaaaaaaggaaaggaaagaaag

SEQ ID NO: 35474 - RNA, 64 nt, hsa
aauaucuuggugauugcuucauuaucucuucaacaaaaaaaaccuuuaauuuugccauugaaac

SEQ ID NO: 35475 - RNA, 64 nt, hsa
uaagucucugaaagccaguggcuuuaugacuuuuaaaaaaaauuacaaaccaagaauuuuuuaa

SEQ ID NO: 35476 - RNA, 64 nt, hsa
gucccuaugacuuauacauaacuuuguaaaaagaaaaaaaaauuuuuucugaugcuuugaauau

SEQ ID NO: 35477 - RNA, 64 nt, hsa
ggucccuaugacuuauacauaacuuuguaaaaagaaaaaaaaauuuuuucugaugcuuugaaua

SEQ ID NO: 35478 - RNA, 64 nt, hsa
gaugauaugucugacccaaauuuaauccauaauaaaaaaaaaugggagauuguuuucaggaauu

SEQ ID NO: 35479 - RNA, 64 nt, hsa
agaugauaugucugacccaaauuuaauccauaauaaaaaaaaaugggagauuguuuucaggaau

SEQ ID NO: 35480 - RNA, 61 nt, hsa
ugaauguugugaaaguuuaagaaauugaaaaaaaaaaaagaaucagcacucaggucuuuuu

SEQ ID NO: 35481 - RNA, 60 nt, hsa
ugaauguugugaaaguuuaagaaauugaaaaaaaaaaaagaaucagcacucaggucuuuu

SEQ ID NO: 35482 - RNA, 59 nt, hsa
ugaauguugugaaaguuuaagaaauugaaaaaaaaaaaagaaucagcacucaggucuuu

SEQ ID NO: 35483 - RNA, 58 nt, hsa
ugaauguugugaaaguuuaagaaauugaaaaaaaaaaaagaaucagcacucaggucuu

SEQ ID NO: 35484 - RNA, 57 nt, hsa
ugaauguugugaaaguuuaagaaauugaaaaaaaaaaaagaaucagcacucaggucu

SEQ ID NO: 35485 - RNA, 64 nt, hsa
cauaaaauuaucauuugaaauauuuuuuuaugaaaaaaaaaacacuucucagugaaaaaacaag

SEQ ID NO: 35486 - RNA, 64 nt, hsa
ucauaaaauuaucauuugaaauauuuuuuuaugaaaaaaaaaacacuucucagugaaaaaacaa

SEQ ID NO: 35487 - RNA, 64 nt, hsa
aucauaaaauuaucauuugaaauauuuuuuuaugaaaaaaaaaacacuucucagugaaaaaaca

SEQ ID NO: 35488 - RNA, 64 nt, hsa
gauggaagacagauucugcuuuaaauuaaaaaaaaaaaaaaaucugaaucuuguuuucagauuu

SEQ ID NO: 35489 - RNA, 64 nt, hsa
ugauggaagacagauucugcuuuaaauuaaaaaaaaaaaaaaaucugaaucuuguuuucagauu

SEQ ID NO: 35490 - RNA, 64 nt, hsa
augauggaagacagauucugcuuuaaauuaaaaaaaaaaaaaaaucugaaucuuguuuucagau

SEQ ID NO: 35491 - RNA, 64 nt, hsa
caugauggaagacagauucugcuuuaaauuaaaaaaaaaaaaaaaucugaaucuuguuuucaga

SEQ ID NO: 35492 - RNA, 64 nt, hsa
ucaugauggaagacagauucugcuuuaaauuaaaaaaaaaaaaaaaucugaaucuuguuuucag

SEQ ID NO: 35493 - RNA, 64 nt, hsa
cucaugauggaagacagauucugcuuuaaauuaaaaaaaaaaaaaaaucugaaucuuguuuuca

SEQ ID NO: 35494 - RNA, 64 nt, hsa
ucucaugauggaagacagauucugcuuuaaauuaaaaaaaaaaaaaaaucugaaucuuguuuuc

SEQ ID NO: 35495 - RNA, 64 nt, hsa
uucucaugauggaagacagauucugcuuuaaauuaaaaaaaaaaaaaaaucugaaucuuguuuu

SEQ ID NO: 35496 - RNA, 64 nt, hsa
aauacacuauugaaaguuaucuuggauggggagaaaaaaaaauagugguuuuccuuguuugcaa

SEQ ID NO: 35497 - RNA, 64 nt, hsa
uaauacacuauugaaaguuaucuuggauggggagaaaaaaaaauagugguuuuccuuguuugca

SEQ ID NO: 35498 - RNA, 64 nt, hsa
auauggggguuaucuguacauccuggggcauuaaaaaaaaaaucaaugguggggaacuauaaag

SEQ ID NO: 35499 - RNA, 64 nt, hsa
aauauggggguuaucuguacauccuggggcauuaaaaaaaaaaucaaugguggggaacuauaaa

SEQ ID NO: 35500 - RNA, 64 nt, hsa
gaauauggggguuaucuguacauccuggggcauuaaaaaaaaaaucaaugguggggaacuauaa

SEQ ID NO: 35501 - RNA, 64 nt, hsa
ucacuguaguuugguuuuauuugaaaaccugacaaaaaaaaaguuccagguguggaauaugggg

SEQ ID NO: 35502 - RNA, 64 nt, hsa
gucacuguaguuugguuuuauuugaaaaccugacaaaaaaaaaguuccagguguggaauauggg

SEQ ID NO: 35503 - RNA, 64 nt, hsa
ugcuguaauauuuuuguaaaaaaaaaaaaaaaggaaaaaaaagaccagcuaaaauuuucgacuu

SEQ ID NO: 35504 - RNA, 64 nt, hsa
uugcuuauacugcuguaauauuuuuguaaaaaaaaaaaaaaaggaaaaaaaagaccagcuaaaa

SEQ ID NO: 35505 - RNA, 64 nt, hsa
uuugcuuauacugcuguaauauuuuuguaaaaaaaaaaaaaaaggaaaaaaaagaccagcuaaa

SEQ ID NO: 35506 - RNA, 64 nt, hsa
uuuugcuuauacugcuguaauauuuuuguaaaaaaaaaaaaaaaggaaaaaaaagaccagcuaa

SEQ ID NO: 35507 - RNA, 64 nt, hsa
auuuugcuuauacugcuguaauauuuuuguaaaaaaaaaaaaaaaggaaaaaaaagaccagcua

SEQ ID NO: 35508 - RNA, 64 nt, hsa
aauuuugcuuauacugcuguaauauuuuuguaaaaaaaaaaaaaaaggaaaaaaaagaccagcu

SEQ ID NO: 35509 - RNA, 64 nt, hsa
caauuuugcuuauacugcuguaauauuuuuguaaaaaaaaaaaaaaaggaaaaaaaagaccagc

SEQ ID NO: 35510 - RNA, 64 nt, hsa
ccaauuuugcuuauacugcuguaauauuuuuguaaaaaaaaaaaaaaaggaaaaaaaagaccag

SEQ ID NO: 35511 - RNA, 64 nt, hsa
uccaauuuugcuuauacugcuguaauauuuuuguaaaaaaaaaaaaaaaggaaaaaaaagacca

SEQ ID NO: 35512 - RNA, 64 nt, hsa
uccagccugggcgacugaauaaaacucugucucaaaaaaaaacaaaaacgguaagcuuuuauau

SEQ ID NO: 35513 - RNA, 64 nt, hsa
cuccagccugggcgacugaauaaaacucugucucaaaaaaaaacaaaaacgguaagcuuuuaua

SEQ ID NO: 35514 - RNA, 64 nt, hsa
gaaguauuguuuccuuuauuuaaaaaaaaaaaaaaaaaaaaagaaugcuagguaaucuucguag

SEQ ID NO: 35515 - RNA, 64 nt, hsa
ugaaguauuguuuccuuuauuuaaaaaaaaaaaaaaaaaaaaagaaugcuagguaaucuucgua

SEQ ID NO: 35516 - RNA, 64 nt, hsa
augaaguauuguuuccuuuauuuaaaaaaaaaaaaaaaaaaaaagaaugcuagguaaucuucgu

SEQ ID NO: 35517 - RNA, 64 nt, hsa
caugaaguauuguuuccuuuauuuaaaaaaaaaaaaaaaaaaaaagaaugcuagguaaucuucg

SEQ ID NO: 35518 - RNA, 64 nt, hsa
ccaugaaguauuguuuccuuuauuuaaaaaaaaaaaaaaaaaaaaagaaugcuagguaaucuuc

SEQ ID NO: 35519 - RNA, 64 nt, hsa
uccaugaaguauuguuuccuuuauuuaaaaaaaaaaaaaaaaaaaaagaaugcuagguaaucuu

SEQ ID NO: 35520 - RNA, 64 nt, hsa
uuccaugaaguauuguuuccuuuauuuaaaaaaaaaaaaaaaaaaaaagaaugcuagguaaucu

SEQ ID NO: 35521 - RNA, 64 nt, hsa
auuccaugaaguauuguuuccuuuauuuaaaaaaaaaaaaaaaaaaaaagaaugcuagguaauc

SEQ ID NO: 35522 - RNA, 64 nt, hsa
uauuccaugaaguauuguuuccuuuauuuaaaaaaaaaaaaaaaaaaaaagaaugcuagguaau

SEQ ID NO: 35523 - RNA, 64 nt, hsa
uuauuccaugaaguauuguuuccuuuauuuaaaaaaaaaaaaaaaaaaaaagaaugcuagguaa

SEQ ID NO: 35524 - RNA, 64 nt, hsa
auuauuccaugaaguauuguuuccuuuauuuaaaaaaaaaaaaaaaaaaaaagaaugcuaggua

SEQ ID NO: 35525 - RNA, 64 nt, hsa
aauuauuccaugaaguauuguuuccuuuauuuaaaaaaaaaaaaaaaaaaaaagaaugcuaggu

SEQ ID NO: 35526 - RNA, 64 nt, hsa
gaauuauuccaugaaguauuguuuccuuuauuuaaaaaaaaaaaaaaaaaaaaagaaugcuagg

SEQ ID NO: 35527 - RNA, 64 nt, hsa
ugaauuauuccaugaaguauuguuuccuuuauuuaaaaaaaaaaaaaaaaaaaaagaaugcuag

SEQ ID NO: 35528 - RNA, 64 nt, hsa
ugggcgacagagcgagacuccgccucaaaaaaaaaaaaaaaagaaaaaaagaaauguaccuguu

SEQ ID NO: 35529 - RNA, 64 nt, hsa
cugggcgacagagcgagacuccgccucaaaaaaaaaaaaaaaagaaaaaaagaaauguaccugu

SEQ ID NO: 35530 - RNA, 64 nt, hsa
ccugggcgacagagcgagacuccgccucaaaaaaaaaaaaaaaagaaaaaaagaaauguaccug

SEQ ID NO: 35531 - RNA, 64 nt, hsa
gccugggcgacagagcgagacuccgccucaaaaaaaaaaaaaaaagaaaaaaagaaauguaccu

SEQ ID NO: 35532 - RNA, 64 nt, hsa
agccugggcgacagagcgagacuccgccucaaaaaaaaaaaaaaaagaaaaaaagaaauguacc

SEQ ID NO: 35533 - RNA, 64 nt, hsa
cagccugggcgacagagcgagacuccgccucaaaaaaaaaaaaaaaagaaaaaaagaaauguac

SEQ ID NO: 35534 - RNA, 64 nt, hsa
ccagccugggcgacagagcgagacuccgccucaaaaaaaaaaaaaaaagaaaaaaagaaaugua

SEQ ID NO: 35535 - RNA, 64 nt, hsa
uccagccugggcgacagagcgagacuccgccucaaaaaaaaaaaaaaaagaaaaaaagaaaugu

SEQ ID NO: 35536 - RNA, 64 nt, hsa
cuccagccugggcgacagagcgagacuccgccucaaaaaaaaaaaaaaaagaaaaaaagaaaug

SEQ ID NO: 35537 - RNA, 64 nt, hsa
ccuggcuaacacggugaaaccccgucucuacuaaaaaaaaaaguacaaaaaauuagccgggcgu

SEQ ID NO: 35538 - RNA, 64 nt, hsa
uccuggcuaacacggugaaaccccgucucuacuaaaaaaaaaaguacaaaaaauuagccgggcg

SEQ ID NO: 35539 - RNA, 64 nt, hsa
auccuggcuaacacggugaaaccccgucucuacuaaaaaaaaaaguacaaaaaauuagccgggc

SEQ ID NO: 35540 - RNA, 64 nt, hsa
ucuccuccuccuccuccucuucccuugggggaaaaaaaaaaaugugcuaauaaaacuucccucc

SEQ ID NO: 35541 - RNA, 64 nt, hsa
uucuccuccuccuccuccucuucccuugggggaaaaaaaaaaaugugcuaauaaaacuucccuc

SEQ ID NO: 35542 - RNA, 64 nt, hsa
cuucuccuccuccuccuccucuucccuugggggaaaaaaaaaaaugugcuaauaaaacuucccu

SEQ ID NO: 35543 - RNA, 64 nt, hsa
ccuucuccuccuccuccuccucuucccuugggggaaaaaaaaaaaugugcuaauaaaacuuccc

SEQ ID NO: 35544 - RNA, 64 nt, hsa
aacauggugaaacccugucucuacuaaaaauacgaaaaaaaaaaaaagcugggcugugguggca

SEQ ID NO: 35545 - RNA, 64 nt, hsa
acauggugaaacccugucucuacuaaaaauacgaaaaaaaaaaaaagcugggcugugguggcag

SEQ ID NO: 35546 - RNA, 64 nt, hsa
cauggugaaacccugucucuacuaaaaauacgaaaaaaaaaaaaagcugggcugugguggcagg

SEQ ID NO: 35547 - RNA, 64 nt, hsa
auggugaaacccugucucuacuaaaaauacgaaaaaaaaaaaaagcugggcugugguggcaggc

SEQ ID NO: 35548 - RNA, 64 nt, hsa
uggugaaacccugucucuacuaaaaauacgaaaaaaaaaaaaagcugggcugugguggcaggcg

SEQ ID NO: 35549 - RNA, 64 nt, hsa
ggugaaacccugucucuacuaaaaauacgaaaaaaaaaaaaagcugggcugugguggcaggcgc

SEQ ID NO: 35550 - RNA, 64 nt, hsa
aggauuuuggguuuuguuuuguuuucauuuuuccaaaaaaaaaagaaaaaaaaauagaaaaaaa

SEQ ID NO: 35551 - RNA, 64 nt, hsa
ggauuuuggguuuuguuuuguuuucauuuuuccaaaaaaaaaagaaaaaaaaauagaaaaaaaa

SEQ ID NO: 35552 - RNA, 64 nt, hsa
gauuuuggguuuuguuuuguuuucauuuuuccaaaaaaaaaagaaaaaaaaauagaaaaaaaag

SEQ ID NO: 35553 - RNA, 64 nt, hsa
uuuuguuuuguuuucauuuuuccaaaaaaaaaagaaaaaaaaauagaaaaaaaaggaguaaaag

SEQ ID NO: 35554 - RNA, 64 nt, hsa
uuuguuuuguuuucauuuuuccaaaaaaaaaagaaaaaaaaauagaaaaaaaaggaguaaaagg

SEQ ID NO: 35555 - RNA, 64 nt, hsa
uucauuuuuccaaaaaaaaaagaaaaaaaaauagaaaaaaaaggaguaaaaggggcggguuugu

SEQ ID NO: 35556 - RNA, 64 nt, hsa
uggcgugaguuucauguaugaaaacauaaaauugaaaaaaaaaaaaaaaccuacacgagcaccg

SEQ ID NO: 35557 - RNA, 64 nt, hsa
ggcgugaguuucauguaugaaaacauaaaauugaaaaaaaaaaaaaaaccuacacgagcaccgu

SEQ ID NO: 35558 - RNA, 64 nt, hsa
gcgugaguuucauguaugaaaacauaaaauugaaaaaaaaaaaaaaaccuacacgagcaccgug

SEQ ID NO: 35559 - RNA, 64 nt, hsa
cgugaguuucauguaugaaaacauaaaauugaaaaaaaaaaaaaaaccuacacgagcaccguga

SEQ ID NO: 35560 - RNA, 64 nt, hsa
gugaguuucauguaugaaaacauaaaauugaaaaaaaaaaaaaaaccuacacgagcaccgugau

SEQ ID NO: 35561 - RNA, 64 nt, hsa
ugaguuucauguaugaaaacauaaaauugaaaaaaaaaaaaaaaccuacacgagcaccgugauu

SEQ ID NO: 35562 - RNA, 64 nt, hsa
gaguuucauguaugaaaacauaaaauugaaaaaaaaaaaaaaaccuacacgagcaccgugauuu

SEQ ID NO: 35563 - RNA, 64 nt, hsa
aguuucauguaugaaaacauaaaauugaaaaaaaaaaaaaaaccuacacgagcaccgugauuuc

SEQ ID NO: 35564 - RNA, 64 nt, hsa
uuaaauauuucuuucucuaacccaucagcacaauaaaaaaaagucacugguucaacaacagggu

SEQ ID NO: 35565 - RNA, 64 nt, hsa
auaaaaaaaagucacugguucaacaacaggguuuaaaaaaaaugucuucagcuuuaauucaaaa

SEQ ID NO: 35566 - RNA, 64 nt, hsa
aagagcauuaacuauuuaaaacaaggaaaagaggaaaaaaaaaacagaggcccgcccuacccca

SEQ ID NO: 35567 - RNA, 64 nt, hsa
agagcauuaacuauuuaaaacaaggaaaagaggaaaaaaaaaacagaggcccgcccuaccccac

SEQ ID NO: 35568 - RNA, 64 nt, hsa
gagcauuaacuauuuaaaacaaggaaaagaggaaaaaaaaaacagaggcccgcccuaccccacu

SEQ ID NO: 35569 - RNA, 64 nt, hsa
cuuaauguucaaaacgccucucuuuggucuggagaaaaaaaaaaaaaaaaaaaaacaacuaaaa

SEQ ID NO: 35570 - RNA, 64 nt, hsa
uuaauguucaaaacgccucucuuuggucuggagaaaaaaaaaaaaaaaaaaaaacaacuaaaaa

SEQ ID NO: 35571 - RNA, 64 nt, hsa
uaauguucaaaacgccucucuuuggucuggagaaaaaaaaaaaaaaaaaaaaacaacuaaaaau

SEQ ID NO: 35572 - RNA, 64 nt, hsa
aauguucaaaacgccucucuuuggucuggagaaaaaaaaaaaaaaaaaaaaacaacuaaaaauu

SEQ ID NO: 35573 - RNA, 64 nt, hsa
auguucaaaacgccucucuuuggucuggagaaaaaaaaaaaaaaaaaaaaacaacuaaaaauuu

SEQ ID NO: 35574 - RNA, 64 nt, hsa
uguucaaaacgccucucuuuggucuggagaaaaaaaaaaaaaaaaaaaaacaacuaaaaauuua

SEQ ID NO: 35575 - RNA, 64 nt, hsa
guucaaaacgccucucuuuggucuggagaaaaaaaaaaaaaaaaaaaaacaacuaaaaauuuau

SEQ ID NO: 35576 - RNA, 64 nt, hsa
uucaaaacgccucucuuuggucuggagaaaaaaaaaaaaaaaaaaaaacaacuaaaaauuuauu

SEQ ID NO: 35577 - RNA, 64 nt, hsa
ucaaaacgccucucuuuggucuggagaaaaaaaaaaaaaaaaaaaaacaacuaaaaauuuauuu

SEQ ID NO: 35578 - RNA, 64 nt, hsa
caaaacgccucucuuuggucuggagaaaaaaaaaaaaaaaaaaaaacaacuaaaaauuuauuua

SEQ ID NO: 35579 - RNA, 64 nt, hsa
aaaacgccucucuuuggucuggagaaaaaaaaaaaaaaaaaaaaacaacuaaaaauuuauuuaa

SEQ ID NO: 35580 - RNA, 64 nt, hsa
aaacgccucucuuuggucuggagaaaaaaaaaaaaaaaaaaaaacaacuaaaaauuuauuuaau

SEQ ID NO: 35581 - RNA, 64 nt, hsa
aacgccucucuuuggucuggagaaaaaaaaaaaaaaaaaaaaacaacuaaaaauuuauuuaaua

SEQ ID NO: 35582 - RNA, 64 nt, hsa
acgccucucuuuggucuggagaaaaaaaaaaaaaaaaaaaaacaacuaaaaauuuauuuaauaa

SEQ ID NO: 35583 - RNA, 64 nt, hsa
caccuguaccucuggacucuccuaucgggggauuaaaaaaaaaaguaaaaugacaaaaaaagau

SEQ ID NO: 35584 - RNA, 64 nt, hsa
accuguaccucuggacucuccuaucgggggauuaaaaaaaaaaguaaaaugacaaaaaaagaua

SEQ ID NO: 35585 - RNA, 64 nt, hsa
ccuguaccucuggacucuccuaucgggggauuaaaaaaaaaaguaaaaugacaaaaaaagauac

SEQ ID NO: 35586 - RNA, 64 nt, hsa
uuugugaggcucuuucuauaaauacauauuguuuaaaaaaaagcaagaaaaaaaggaaaacaaa

SEQ ID NO: 35587 - RNA, 64 nt, hsa
uccagccugggcaacagagcgagacccugucuccaaaaaaaaaaaaaagcaauguuuauauuau

SEQ ID NO: 35588 - RNA, 64 nt, hsa
ccagccugggcaacagagcgagacccugucuccaaaaaaaaaaaaaagcaauguuuauauuaua

SEQ ID NO: 35589 - RNA, 64 nt, hsa
cagccugggcaacagagcgagacccugucuccaaaaaaaaaaaaaagcaauguuuauauuauaa

SEQ ID NO: 35590 - RNA, 64 nt, hsa
agccugggcaacagagcgagacccugucuccaaaaaaaaaaaaaagcaauguuuauauuauaaa

SEQ ID NO: 35591 - RNA, 64 nt, hsa
gccugggcaacagagcgagacccugucuccaaaaaaaaaaaaaagcaauguuuauauuauaaaa

SEQ ID NO: 35592 - RNA, 64 nt, hsa
ccugggcaacagagcgagacccugucuccaaaaaaaaaaaaaagcaauguuuauauuauaaaag

SEQ ID NO: 35593 - RNA, 64 nt, hsa
cugggcaacagagcgagacccugucuccaaaaaaaaaaaaaagcaauguuuauauuauaaaaga

SEQ ID NO: 35594 - RNA, 64 nt, hsa
cauccuaaccucagaaacugaaauaaagccuuugaaaaaaaaaucuguaaaacaucaaccccca

SEQ ID NO: 35595 - RNA, 64 nt, hsa
auccuaaccucagaaacugaaauaaagccuuugaaaaaaaaaucuguaaaacaucaacccccaa

SEQ ID NO: 35596 - RNA, 64 nt, hsa
cggcuccggccauuuuguuuuauacaaaaaugggaaaaaaaaaaaagaaauuauauaaaguucc

SEQ ID NO: 35597 - RNA, 64 nt, hsa
ggcuccggccauuuuguuuuauacaaaaaugggaaaaaaaaaaaagaaauuauauaaaguuccu

SEQ ID NO: 35598 - RNA, 64 nt, hsa
gcuccggccauuuuguuuuauacaaaaaugggaaaaaaaaaaaagaaauuauauaaaguuccua

SEQ ID NO: 35599 - RNA, 64 nt, hsa
cuccggccauuuuguuuuauacaaaaaugggaaaaaaaaaaaagaaauuauauaaaguuccuag

SEQ ID NO: 35600 - RNA, 64 nt, hsa
uccggccauuuuguuuuauacaaaaaugggaaaaaaaaaaaagaaauuauauaaaguuccuaga

SEQ ID NO: 35601 - RNA, 64 nt, hsa
agccuggguaacauagcgagaccccaccucugccaaaaaaaaaaaaaauaggguauccaaauau

SEQ ID NO: 35602 - RNA, 64 nt, hsa
gccuggguaacauagcgagaccccaccucugccaaaaaaaaaaaaaauaggguauccaaauauc

SEQ ID NO: 35603 - RNA, 64 nt, hsa
ccuggguaacauagcgagaccccaccucugccaaaaaaaaaaaaaauaggguauccaaauaucu

SEQ ID NO: 35604 - RNA, 64 nt, hsa
cuggguaacauagcgagaccccaccucugccaaaaaaaaaaaaaauaggguauccaaauaucua

SEQ ID NO: 35605 - RNA, 64 nt, hsa
uggguaacauagcgagaccccaccucugccaaaaaaaaaaaaaauaggguauccaaauaucuag

SEQ ID NO: 35606 - RNA, 64 nt, hsa
ggguaacauagcgagaccccaccucugccaaaaaaaaaaaaaauaggguauccaaauaucuaga

SEQ ID NO: 35607 - RNA, 64 nt, hsa
gguaacauagcgagaccccaccucugccaaaaaaaaaaaaaauaggguauccaaauaucuagau

SEQ ID NO: 35608 - RNA, 64 nt, hsa
guggacaagaaaaaauaacaaaacaaaaaacaagaaaaaaaaaacacaaaaccccguaaaauca

SEQ ID NO: 35609 - RNA, 64 nt, hsa
uggacaagaaaaaauaacaaaacaaaaaacaagaaaaaaaaaacacaaaaccccguaaaaucac

SEQ ID NO: 35610 - RNA, 64 nt, hsa
ggacaagaaaaaauaacaaaacaaaaaacaagaaaaaaaaaacacaaaaccccguaaaaucaca

SEQ ID NO: 35611 - RNA, 64 nt, hsa
cccaaaccuggggagagagcuagacucuugucucaaaaaaaaaaaaaaaaaaaaaaaaaaagcu

SEQ ID NO: 35612 - RNA, 64 nt, hsa
ccaaaccuggggagagagcuagacucuugucucaaaaaaaaaaaaaaaaaaaaaaaaaaagcuc

SEQ ID NO: 35613 - RNA, 64 nt, hsa
caaaccuggggagagagcuagacucuugucucaaaaaaaaaaaaaaaaaaaaaaaaaaagcucc

SEQ ID NO: 35614 - RNA, 64 nt, hsa
aaaccuggggagagagcuagacucuugucucaaaaaaaaaaaaaaaaaaaaaaaaaaagcucca

SEQ ID NO: 35615 - RNA, 64 nt, hsa
aaccuggggagagagcuagacucuugucucaaaaaaaaaaaaaaaaaaaaaaaaaaagcuccaa

SEQ ID NO: 35616 - RNA, 64 nt, hsa
accuggggagagagcuagacucuugucucaaaaaaaaaaaaaaaaaaaaaaaaaaagcuccaaa

SEQ ID NO: 35617 - RNA, 64 nt, hsa
ccuggggagagagcuagacucuugucucaaaaaaaaaaaaaaaaaaaaaaaaaaagcuccaaag

SEQ ID NO: 35618 - RNA, 64 nt, hsa
cuggggagagagcuagacucuugucucaaaaaaaaaaaaaaaaaaaaaaaaaaagcuccaaagu

SEQ ID NO: 35619 - RNA, 64 nt, hsa
uggggagagagcuagacucuugucucaaaaaaaaaaaaaaaaaaaaaaaaaaagcuccaaaguc

SEQ ID NO: 35620 - RNA, 64 nt, hsa
ggggagagagcuagacucuugucucaaaaaaaaaaaaaaaaaaaaaaaaaaagcuccaaaguca

SEQ ID NO: 35621 - RNA, 64 nt, hsa
gggagagagcuagacucuugucucaaaaaaaaaaaaaaaaaaaaaaaaaaagcuccaaagucac

SEQ ID NO: 35622 - RNA, 64 nt, hsa
ggagagagcuagacucuugucucaaaaaaaaaaaaaaaaaaaaaaaaaaagcuccaaagucacc

SEQ ID NO: 35623 - RNA, 64 nt, hsa
gagagagcuagacucuugucucaaaaaaaaaaaaaaaaaaaaaaaaaaagcuccaaagucaccu

SEQ ID NO: 35624 - RNA, 64 nt, hsa
agagagcuagacucuugucucaaaaaaaaaaaaaaaaaaaaaaaaaaagcuccaaagucaccuc

SEQ ID NO: 35625 - RNA, 64 nt, hsa
gagagcuagacucuugucucaaaaaaaaaaaaaaaaaaaaaaaaaaagcuccaaagucaccucu

SEQ ID NO: 35626 - RNA, 64 nt, hsa
agagcuagacucuugucucaaaaaaaaaaaaaaaaaaaaaaaaaaagcuccaaagucaccucug

SEQ ID NO: 35627 - RNA, 64 nt, hsa
gagcuagacucuugucucaaaaaaaaaaaaaaaaaaaaaaaaaaagcuccaaagucaccucugu

SEQ ID NO: 35628 - RNA, 64 nt, hsa
agcuagacucuugucucaaaaaaaaaaaaaaaaaaaaaaaaaaagcuccaaagucaccucuguc

SEQ ID NO: 35629 - RNA, 64 nt, hsa
gcuagacucuugucucaaaaaaaaaaaaaaaaaaaaaaaaaaagcuccaaagucaccucuguca

SEQ ID NO: 35630 - RNA, 64 nt, hsa
cuagacucuugucucaaaaaaaaaaaaaaaaaaaaaaaaaaagcuccaaagucaccucugucaa

SEQ ID NO: 35631 - RNA, 64 nt, hsa
aauuguaacauuuuuagaaaaagaacaaaaaaagaaaaaaaaaagaaagaaacacagcaacugu

SEQ ID NO: 35632 - RNA, 64 nt, hsa
auuguaacauuuuuagaaaaagaacaaaaaaagaaaaaaaaaagaaagaaacacagcaacugua

SEQ ID NO: 35633 - RNA, 64 nt, hsa
uuguaacauuuuuagaaaaagaacaaaaaaagaaaaaaaaaagaaagaaacacagcaacuguag

SEQ ID NO: 35634 - RNA, 64 nt, hsa
gucuggccugggcgacagagcgagacuccgucucaaaaaaaaaaaacaaaaaaaaaccaugcau

SEQ ID NO: 35635 - RNA, 64 nt, hsa
ucuggccugggcgacagagcgagacuccgucucaaaaaaaaaaaacaaaaaaaaaccaugcaug

SEQ ID NO: 35636 - RNA, 64 nt, hsa
cuggccugggcgacagagcgagacuccgucucaaaaaaaaaaaacaaaaaaaaaccaugcaugg

SEQ ID NO: 35637 - RNA, 64 nt, hsa
uggccugggcgacagagcgagacuccgucucaaaaaaaaaaaacaaaaaaaaaccaugcauggu

SEQ ID NO: 35638 - RNA, 64 nt, hsa
ggccugggcgacagagcgagacuccgucucaaaaaaaaaaaacaaaaaaaaaccaugcauggug

SEQ ID NO: 35639 - RNA, 64 nt, hsa
gacagagcgagacuccgucucaaaaaaaaaaaacaaaaaaaaaccaugcauggugcaucagcag

SEQ ID NO: 35640 - RNA, 64 nt, hsa
acagagcgagacuccgucucaaaaaaaaaaaacaaaaaaaaaccaugcauggugcaucagcagc

SEQ ID NO: 35641 - RNA, 64 nt, hsa
ccagugugcaaaacauagcaagaccucaucucagaaaaaaaaaaaaagucauuugaaaacuucu

SEQ ID NO: 35642 - RNA, 64 nt, hsa
cagugugcaaaacauagcaagaccucaucucagaaaaaaaaaaaaagucauuugaaaacuucua

SEQ ID NO: 35643 - RNA, 64 nt, hsa
agugugcaaaacauagcaagaccucaucucagaaaaaaaaaaaaagucauuugaaaacuucuaa

SEQ ID NO: 35644 - RNA, 64 nt, hsa
gugugcaaaacauagcaagaccucaucucagaaaaaaaaaaaaagucauuugaaaacuucuaau

SEQ ID NO: 35645 - RNA, 64 nt, hsa
ugugcaaaacauagcaagaccucaucucagaaaaaaaaaaaaagucauuugaaaacuucuaaua

SEQ ID NO: 35646 - RNA, 64 nt, hsa
gugcaaaacauagcaagaccucaucucagaaaaaaaaaaaaagucauuugaaaacuucuaauac

SEQ ID NO: 35647 - RNA, 64 nt, hsa
guguguuuguucuuuuuauugaaucuauuuaaguaaaaaaaaaauugguucuuuauuaauuucu

SEQ ID NO: 35648 - RNA, 64 nt, hsa
uguguuuguucuuuuuauugaaucuauuuaaguaaaaaaaaaauugguucuuuauuaauuucug

SEQ ID NO: 35649 - RNA, 64 nt, hsa
guguuuguucuuuuuauugaaucuauuuaaguaaaaaaaaaauugguucuuuauuaauuucugu

SEQ ID NO: 35650 - RNA, 64 nt, hsa
aauauauauauauucauguuuauuuaagaaauggaaaaaaaaaucaaaaaucuuaaaaaaacaa

SEQ ID NO: 35651 - RNA, 64 nt, hsa
auauauauauauucauguuuauuuaagaaauggaaaaaaaaaucaaaaaucuuaaaaaaacaag

SEQ ID NO: 35652 - RNA, 64 nt, hsa
cagugaugaccucagccuagggacaccaaaaaagaaaaaaaaaaaaacccaaaccaaaaacgca

SEQ ID NO: 35653 - RNA, 64 nt, hsa
agugaugaccucagccuagggacaccaaaaaagaaaaaaaaaaaaacccaaaccaaaaacgcaa

SEQ ID NO: 35654 - RNA, 64 nt, hsa
gugaugaccucagccuagggacaccaaaaaagaaaaaaaaaaaaacccaaaccaaaaacgcaaa

SEQ ID NO: 35655 - RNA, 64 nt, hsa
ugaugaccucagccuagggacaccaaaaaagaaaaaaaaaaaaacccaaaccaaaaacgcaaac

SEQ ID NO: 35656 - RNA, 64 nt, hsa
gaugaccucagccuagggacaccaaaaaagaaaaaaaaaaaaacccaaaccaaaaacgcaaacc

SEQ ID NO: 35657 - RNA, 64 nt, hsa
augaccucagccuagggacaccaaaaaagaaaaaaaaaaaaacccaaaccaaaaacgcaaacca

SEQ ID NO: 35658 - RNA, 64 nt, hsa
gggcaacaggagauguggggacguguuaggagagaaaaaaaaaaaaacaaaaauauauaugggg

SEQ ID NO: 35659 - RNA, 64 nt, hsa
ggcaacaggagauguggggacguguuaggagagaaaaaaaaaaaaacaaaaauauauauggggg

SEQ ID NO: 35660 - RNA, 64 nt, hsa
gcaacaggagauguggggacguguuaggagagaaaaaaaaaaaaacaaaaauauauauggggga

SEQ ID NO: 35661 - RNA, 64 nt, hsa
caacaggagauguggggacguguuaggagagaaaaaaaaaaaaacaaaaauauauaugggggaa

SEQ ID NO: 35662 - RNA, 64 nt, hsa
aacaggagauguggggacguguuaggagagaaaaaaaaaaaaacaaaaauauauaugggggaaa

SEQ ID NO: 35663 - RNA, 64 nt, hsa
acaggagauguggggacguguuaggagagaaaaaaaaaaaaacaaaaauauauaugggggaaau

SEQ ID NO: 35664 - RNA, 64 nt, hsa
gaguuuuccuaucuuuguauguuaagagauuaagaaaaaaaaauucuauuuuuguuguaauguc

SEQ ID NO: 35665 - RNA, 64 nt, hsa
aguuuuccuaucuuuguauguuaagagauuaagaaaaaaaaauucuauuuuuguuguaaugucc

SEQ ID NO: 35666 - RNA, 64 nt, hsa
gagggcugaaggaaacguucacauuuuagaguuuaaaaaaaacaccucgacauuuaaaaaauca

SEQ ID NO: 35667 - RNA, 64 nt, hsa
ccuuaucucaaaaauaaacaaacuaauaaaaagcaaaaaaaaaaaaaaaagaaaagaaaaaaca

SEQ ID NO: 35668 - RNA, 64 nt, hsa
cuuaucucaaaaauaaacaaacuaauaaaaagcaaaaaaaaaaaaaaaagaaaagaaaaaacac

SEQ ID NO: 35669 - RNA, 64 nt, hsa
uuaucucaaaaauaaacaaacuaauaaaaagcaaaaaaaaaaaaaaaagaaaagaaaaaacacu

SEQ ID NO: 35670 - RNA, 64 nt, hsa
uaucucaaaaauaaacaaacuaauaaaaagcaaaaaaaaaaaaaaaagaaaagaaaaaacacug

SEQ ID NO: 35671 - RNA, 64 nt, hsa
aucucaaaaauaaacaaacuaauaaaaagcaaaaaaaaaaaaaaaagaaaagaaaaaacacugc

SEQ ID NO: 35672 - RNA, 64 nt, hsa
ucucaaaaauaaacaaacuaauaaaaagcaaaaaaaaaaaaaaaagaaaagaaaaaacacugca

SEQ ID NO: 35673 - RNA, 64 nt, hsa
cucaaaaauaaacaaacuaauaaaaagcaaaaaaaaaaaaaaaagaaaagaaaaaacacugcau

SEQ ID NO: 35674 - RNA, 64 nt, hsa
ucaaaaauaaacaaacuaauaaaaagcaaaaaaaaaaaaaaaagaaaagaaaaaacacugcauu

SEQ ID NO: 35675 - RNA, 64 nt, hsa
caaaaauaaacaaacuaauaaaaagcaaaaaaaaaaaaaaaagaaaagaaaaaacacugcauuu

SEQ ID NO: 35676 - RNA, 64 nt, hsa
ccagccugggugaaagagcuagauucucucucucaaaaaaaaaaaaaaaaaaaaggaaagaaag

SEQ ID NO: 35677 - RNA, 64 nt, hsa
cagccugggugaaagagcuagauucucucucucaaaaaaaaaaaaaaaaaaaaggaaagaaaga

SEQ ID NO: 35678 - RNA, 64 nt, hsa
agccugggugaaagagcuagauucucucucucaaaaaaaaaaaaaaaaaaaaggaaagaaagaa

SEQ ID NO: 35679 - RNA, 64 nt, hsa
gccugggugaaagagcuagauucucucucucaaaaaaaaaaaaaaaaaaaaggaaagaaagaaa

SEQ ID NO: 35680 - RNA, 64 nt, hsa
ccugggugaaagagcuagauucucucucucaaaaaaaaaaaaaaaaaaaaggaaagaaagaaag

SEQ ID NO: 35681 - RNA, 64 nt, hsa
cugggugaaagagcuagauucucucucucaaaaaaaaaaaaaaaaaaaaggaaagaaagaaaga

SEQ ID NO: 35682 - RNA, 64 nt, hsa
ugggugaaagagcuagauucucucucucaaaaaaaaaaaaaaaaaaaaggaaagaaagaaagaa

SEQ ID NO: 35683 - RNA, 64 nt, hsa
gggugaaagagcuagauucucucucucaaaaaaaaaaaaaaaaaaaaggaaagaaagaaagaaa

SEQ ID NO: 35684 - RNA, 64 nt, hsa
ggugaaagagcuagauucucucucucaaaaaaaaaaaaaaaaaaaaggaaagaaagaaagaaaa

SEQ ID NO: 35685 - RNA, 64 nt, hsa
gugaaagagcuagauucucucucucaaaaaaaaaaaaaaaaaaaaggaaagaaagaaagaaaag

SEQ ID NO: 35686 - RNA, 64 nt, hsa
ugaaagagcuagauucucucucucaaaaaaaaaaaaaaaaaaaaggaaagaaagaaagaaaaga

SEQ ID NO: 35687 - RNA, 64 nt, hsa
gaaagagcuagauucucucucucaaaaaaaaaaaaaaaaaaaaggaaagaaagaaagaaaagaa

SEQ ID NO: 35688 - RNA, 64 nt, hsa
aaagagcuagauucucucucucaaaaaaaaaaaaaaaaaaaaggaaagaaagaaagaaaagaaa

SEQ ID NO: 35689 - RNA, 64 nt, hsa
cacuccagccugggugacggugagacuuugucucaaaaaaaaaaaaaaaaacaauggaaggcag

SEQ ID NO: 35690 - RNA, 64 nt, hsa
acuccagccugggugacggugagacuuugucucaaaaaaaaaaaaaaaaacaauggaaggcaga

SEQ ID NO: 35691 - RNA, 64 nt, hsa
cuccagccugggugacggugagacuuugucucaaaaaaaaaaaaaaaaacaauggaaggcagac

SEQ ID NO: 35692 - RNA, 64 nt, hsa
uccagccugggugacggugagacuuugucucaaaaaaaaaaaaaaaaacaauggaaggcagaca

SEQ ID NO: 35693 - RNA, 64 nt, hsa
ccagccugggugacggugagacuuugucucaaaaaaaaaaaaaaaaacaauggaaggcagacag

SEQ ID NO: 35694 - RNA, 64 nt, hsa
cagccugggugacggugagacuuugucucaaaaaaaaaaaaaaaaacaauggaaggcagacagc

SEQ ID NO: 35695 - RNA, 64 nt, hsa
agccugggugacggugagacuuugucucaaaaaaaaaaaaaaaaacaauggaaggcagacagca

SEQ ID NO: 35696 - RNA, 64 nt, hsa
gccugggugacggugagacuuugucucaaaaaaaaaaaaaaaaacaauggaaggcagacagcaa

SEQ ID NO: 35697 - RNA, 64 nt, hsa
ccugggugacggugagacuuugucucaaaaaaaaaaaaaaaaacaauggaaggcagacagcaag

SEQ ID NO: 35698 - RNA, 64 nt, hsa
cugggugacggugagacuuugucucaaaaaaaaaaaaaaaaacaauggaaggcagacagcaagu

SEQ ID NO: 35699 - RNA, 64 nt, hsa
cagccugggcaacaagaguggcacuccaucucagaaaaaaaaaaaaaagauaauucauacugaa

SEQ ID NO: 35700 - RNA, 64 nt, hsa
agccugggcaacaagaguggcacuccaucucagaaaaaaaaaaaaaagauaauucauacugaaa

SEQ ID NO: 35701 - RNA, 64 nt, hsa
gccugggcaacaagaguggcacuccaucucagaaaaaaaaaaaaaagauaauucauacugaaaa

SEQ ID NO: 35702 - RNA, 64 nt, hsa
ccugggcaacaagaguggcacuccaucucagaaaaaaaaaaaaaagauaauucauacugaaaag

SEQ ID NO: 35703 - RNA, 64 nt, hsa
cugggcaacaagaguggcacuccaucucagaaaaaaaaaaaaaagauaauucauacugaaaaga

SEQ ID NO: 35704 - RNA, 64 nt, hsa
ugggcaacaagaguggcacuccaucucagaaaaaaaaaaaaaagauaauucauacugaaaagaa

SEQ ID NO: 35705 - RNA, 64 nt, hsa
gggcaacaagaguggcacuccaucucagaaaaaaaaaaaaaagauaauucauacugaaaagaaa

SEQ ID NO: 35706 - RNA, 64 nt, hsa
acuccaguuuggcaacagagugagacuccgucucaaaaaaaauuuauacuguacaaaaacccca

SEQ ID NO: 35707 - RNA, 64 nt, hsa
ccuuuguuuuacaaacaauccaauucuacacuuuaaaaaaaaauuuuuaaauguacaauuaaau

SEQ ID NO: 35708 - RNA, 64 nt, hsa
cuuuguuuuacaaacaauccaauucuacacuuuaaaaaaaaauuuuuaaauguacaauuaaauu

SEQ ID NO: 35709 - RNA, 64 nt, hsa
aaaugcuucaauaacuuaucuugguauugcuaauaaaaaaaaaaagcugugaaacauuagugca

SEQ ID NO: 35710 - RNA, 64 nt, hsa
aaugcuucaauaacuuaucuugguauugcuaauaaaaaaaaaaagcugugaaacauuagugcag

SEQ ID NO: 35711 - RNA, 64 nt, hsa
augcuucaauaacuuaucuugguauugcuaauaaaaaaaaaaagcugugaaacauuagugcagu

SEQ ID NO: 35712 - RNA, 64 nt, hsa
ugcuucaauaacuuaucuugguauugcuaauaaaaaaaaaaagcugugaaacauuagugcaguu

SEQ ID NO: 35713 - RNA, 64 nt, hsa
ugacagaugagguccucuguuuaccuccccccccaaaaaaaaaauucaguaggaauuccuucau

SEQ ID NO: 35714 - RNA, 64 nt, hsa
gacagaugagguccucuguuuaccuccccccccaaaaaaaaaauucaguaggaauuccuucaua

SEQ ID NO: 35715 - RNA, 64 nt, hsa
acagaugagguccucuguuuaccuccccccccaaaaaaaaaauucaguaggaauuccuucauag

SEQ ID NO: 35716 - RNA, 64 nt, hsa
uuuaauauuguauuuugguaauaaauuuuuuguuaaaaaaaacuuggcuccaaguucuauuaac

SEQ ID NO: 35717 - RNA, 64 nt, hsa
gauguagauagaaauuaauuuaaggucuuuucuuaaaaaaaaaauccaccucauuuucaguuaa

SEQ ID NO: 35718 - RNA, 64 nt, hsa
auguagauagaaauuaauuuaaggucuuuucuuaaaaaaaaaauccaccucauuuucaguuaac

SEQ ID NO: 35719 - RNA, 64 nt, hsa
uguagauagaaauuaauuuaaggucuuuucuuaaaaaaaaaauccaccucauuuucaguuaaca

SEQ ID NO: 35720 - RNA, 64 nt, hsa
ccugggugacagagugagauuccgucucaacaagaaaaaaaaaaaagaauauauauauauguau

SEQ ID NO: 35721 - RNA, 64 nt, hsa
cugggugacagagugagauuccgucucaacaagaaaaaaaaaaaagaauauauauauauguaug

SEQ ID NO: 35722 - RNA, 64 nt, hsa
ugggugacagagugagauuccgucucaacaagaaaaaaaaaaaagaauauauauauauguaugu

SEQ ID NO: 35723 - RNA, 64 nt, hsa
gggugacagagugagauuccgucucaacaagaaaaaaaaaaaagaauauauauauauguaugua

SEQ ID NO: 35724 - RNA, 64 nt, hsa
ggugacagagugagauuccgucucaacaagaaaaaaaaaaaagaauauauauauauguauguau

SEQ ID NO: 35725 - RNA, 64 nt, hsa
uguguguuuuaauuuucuuuauggaaaaauugacaaaaaaaaaauagagagagagguauuuaac

SEQ ID NO: 35726 - RNA, 64 nt, hsa
guguguuuuaauuuucuuuauggaaaaauugacaaaaaaaaaauagagagagagguauuuaacu

SEQ ID NO: 35727 - RNA, 64 nt, hsa
uguguuuuaauuuucuuuauggaaaaauugacaaaaaaaaaauagagagagagguauuuaacug

SEQ ID NO: 35728 - RNA, 64 nt, hsa
uuuggaaaauucuuacuugugaauguuaaaaaugaaaaaaaaaucauuuauuauauuuugccuc

SEQ ID NO: 35729 - RNA, 64 nt, hsa
uuggaaaauucuuacuugugaauguuaaaaaugaaaaaaaaaucauuuauuauauuuugccuca

SEQ ID NO: 35730 - RNA, 64 nt, hsa
ccagccugggaaacauagcaagaccccaucucuuaaaaaaaaagaaauauauagacauauaucu

SEQ ID NO: 35731 - RNA, 64 nt, hsa
cagccugggaaacauagcaagaccccaucucuuaaaaaaaaagaaauauauagacauauaucug

SEQ ID NO: 35732 - RNA, 64 nt, hsa
uccauuauugcuauaagaggaaauucauacuguuaaaaaaaaaaaaacccaguggauauaauca

SEQ ID NO: 35733 - RNA, 64 nt, hsa
ccauuauugcuauaagaggaaauucauacuguuaaaaaaaaaaaaacccaguggauauaaucag

SEQ ID NO: 35734 - RNA, 64 nt, hsa
cauuauugcuauaagaggaaauucauacuguuaaaaaaaaaaaaacccaguggauauaaucagu

SEQ ID NO: 35735 - RNA, 64 nt, hsa
auuauugcuauaagaggaaauucauacuguuaaaaaaaaaaaaacccaguggauauaaucagug

SEQ ID NO: 35736 - RNA, 64 nt, hsa
uuauugcuauaagaggaaauucauacuguuaaaaaaaaaaaaacccaguggauauaaucagugu

SEQ ID NO: 35737 - RNA, 64 nt, hsa
uauugcuauaagaggaaauucauacuguuaaaaaaaaaaaaacccaguggauauaaucagugua

SEQ ID NO: 35738 - RNA, 64 nt, hsa
ucuggccucacgugucucagauuuucuaagaaccaaaaaaaaaaaaggaaaaaaaacacaaaac

SEQ ID NO: 35739 - RNA, 64 nt, hsa
cuggccucacgugucucagauuuucuaagaaccaaaaaaaaaaaaggaaaaaaaacacaaaaca

SEQ ID NO: 35740 - RNA, 64 nt, hsa
uggccucacgugucucagauuuucuaagaaccaaaaaaaaaaaaggaaaaaaaacacaaaacaa

SEQ ID NO: 35741 - RNA, 64 nt, hsa
ggccucacgugucucagauuuucuaagaaccaaaaaaaaaaaaggaaaaaaaacacaaaacaac

SEQ ID NO: 35742 - RNA, 64 nt, hsa
gccucacgugucucagauuuucuaagaaccaaaaaaaaaaaaggaaaaaaaacacaaaacaaca

SEQ ID NO: 35743 - RNA, 64 nt, hsa
ucucagauuuucuaagaaccaaaaaaaaaaaaggaaaaaaaacacaaaacaacaaaaaccaaaa

SEQ ID NO: 35744 - RNA, 64 nt, hsa
aaaaaaggaaaaaaaacacaaaacaacaaaaaccaaaaaaaaaaaaaaucacaaaaacaaaaaa

SEQ ID NO: 35745 - RNA, 64 nt, hsa
aaaaaggaaaaaaaacacaaaacaacaaaaaccaaaaaaaaaaaaaaucacaaaaacaaaaaaa

SEQ ID NO: 35746 - RNA, 64 nt, hsa
aaaaggaaaaaaaacacaaaacaacaaaaaccaaaaaaaaaaaaaaucacaaaaacaaaaaaac

SEQ ID NO: 35747 - RNA, 64 nt, hsa
aaaggaaaaaaaacacaaaacaacaaaaaccaaaaaaaaaaaaaaucacaaaaacaaaaaaacu

SEQ ID NO: 35748 - RNA, 64 nt, hsa
aaggaaaaaaaacacaaaacaacaaaaaccaaaaaaaaaaaaaaucacaaaaacaaaaaaacua

SEQ ID NO: 35749 - RNA, 64 nt, hsa
aggaaaaaaaacacaaaacaacaaaaaccaaaaaaaaaaaaaaucacaaaaacaaaaaaacuau

SEQ ID NO: 35750 - RNA, 64 nt, hsa
ggaaaaaaaacacaaaacaacaaaaaccaaaaaaaaaaaaaaucacaaaaacaaaaaaacuaua

SEQ ID NO: 35751 - RNA, 64 nt, hsa
uuccagccugggcaacagagcgagacuccaucuuaaaaaaaaaaaaaaaaaaaagaaagaaaag

SEQ ID NO: 35752 - RNA, 64 nt, hsa
uccagccugggcaacagagcgagacuccaucuuaaaaaaaaaaaaaaaaaaaagaaagaaaaga

SEQ ID NO: 35753 - RNA, 64 nt, hsa
ccagccugggcaacagagcgagacuccaucuuaaaaaaaaaaaaaaaaaaaagaaagaaaagaa

SEQ ID NO: 35754 - RNA, 64 nt, hsa
cagccugggcaacagagcgagacuccaucuuaaaaaaaaaaaaaaaaaaaagaaagaaaagaaa

SEQ ID NO: 35755 - RNA, 64 nt, hsa
agccugggcaacagagcgagacuccaucuuaaaaaaaaaaaaaaaaaaaagaaagaaaagaaaa

SEQ ID NO: 35756 - RNA, 64 nt, hsa
gccugggcaacagagcgagacuccaucuuaaaaaaaaaaaaaaaaaaaagaaagaaaagaaaau

SEQ ID NO: 35757 - RNA, 64 nt, hsa
ccugggcaacagagcgagacuccaucuuaaaaaaaaaaaaaaaaaaaagaaagaaaagaaaaug

SEQ ID NO: 35758 - RNA, 64 nt, hsa
cugggcaacagagcgagacuccaucuuaaaaaaaaaaaaaaaaaaaagaaagaaaagaaaaugg

SEQ ID NO: 35759 - RNA, 64 nt, hsa
ugggcaacagagcgagacuccaucuuaaaaaaaaaaaaaaaaaaaagaaagaaaagaaaaugga

SEQ ID NO: 35760 - RNA, 64 nt, hsa
gggcaacagagcgagacuccaucuuaaaaaaaaaaaaaaaaaaaagaaagaaaagaaaauggag

SEQ ID NO: 35761 - RNA, 64 nt, hsa
ggcaacagagcgagacuccaucuuaaaaaaaaaaaaaaaaaaaagaaagaaaagaaaauggagu

SEQ ID NO: 35762 - RNA, 64 nt, hsa
gcaacagagcgagacuccaucuuaaaaaaaaaaaaaaaaaaaagaaagaaaagaaaauggaguu

SEQ ID NO: 35763 - RNA, 64 nt, hsa
caacagagcgagacuccaucuuaaaaaaaaaaaaaaaaaaaagaaagaaaagaaaauggaguuc

SEQ ID NO: 35764 - RNA, 64 nt, hsa
ccaggagcuguuuuacugucuacuuuucaggauuaaaaaaaaaaucaaaacuuaaaaaaaaaaa

SEQ ID NO: 35765 - RNA, 64 nt, hsa
caggagcuguuuuacugucuacuuuucaggauuaaaaaaaaaaucaaaacuuaaaaaaaaaaaa

SEQ ID NO: 35766 - RNA, 64 nt, hsa
aggagcuguuuuacugucuacuuuucaggauuaaaaaaaaaaucaaaacuuaaaaaaaaaaaag

SEQ ID NO: 35767 - RNA, 64 nt, hsa
cuacuuuucaggauuaaaaaaaaaaucaaaacuuaaaaaaaaaaaaguuuaaaaagcaaaaugg

SEQ ID NO: 35768 - RNA, 64 nt, hsa
uacuuuucaggauuaaaaaaaaaaucaaaacuuaaaaaaaaaaaaguuuaaaaagcaaaauggg

SEQ ID NO: 35769 - RNA, 64 nt, hsa
acuuuucaggauuaaaaaaaaaaucaaaacuuaaaaaaaaaaaaguuuaaaaagcaaaaugggg

SEQ ID NO: 35770 - RNA, 64 nt, hsa
cuuuucaggauuaaaaaaaaaaucaaaacuuaaaaaaaaaaaaguuuaaaaagcaaaaugggga

SEQ ID NO: 35771 - RNA, 64 nt, hsa
uuuucaggauuaaaaaaaaaaucaaaacuuaaaaaaaaaaaaguuuaaaaagcaaaauggggag

SEQ ID NO: 35772 - RNA, 64 nt, hsa
aacugaaauguuaaggaagaagauagauccaauuaaaaaaaauuaaaaccaauuuaaaaaaaaa

SEQ ID NO: 35773 - RNA, 64 nt, hsa
gauagauccaauuaaaaaaaauuaaaaccaauuuaaaaaaaaaaagaacacaggagauuccagu

SEQ ID NO: 35774 - RNA, 64 nt, hsa
auagauccaauuaaaaaaaauuaaaaccaauuuaaaaaaaaaaagaacacaggagauuccaguc

SEQ ID NO: 35775 - RNA, 64 nt, hsa
uagauccaauuaaaaaaaauuaaaaccaauuuaaaaaaaaaaagaacacaggagauuccagucu

SEQ ID NO: 35776 - RNA, 64 nt, hsa
agauccaauuaaaaaaaauuaaaaccaauuuaaaaaaaaaaagaacacaggagauuccagucua

SEQ ID NO: 35777 - RNA, 64 nt, hsa
gaaaacaaacuuggauuuuuuucuuuguccaaauaaaaaaaaaugauguaaagaaauaaugggg

SEQ ID NO: 35778 - RNA, 64 nt, hsa
aaaacaaacuuggauuuuuuucuuuguccaaauaaaaaaaaaugauguaaagaaauaauggggg

SEQ ID NO: 35779 - RNA, 64 nt, hsa
acagugaaaucagauaauaaugagaucuuuuguuaaaaaaaaaaaaugggaagggagugcggga

SEQ ID NO: 35780 - RNA, 64 nt, hsa
cagugaaaucagauaauaaugagaucuuuuguuaaaaaaaaaaaaugggaagggagugcgggag

SEQ ID NO: 35781 - RNA, 64 nt, hsa
agugaaaucagauaauaaugagaucuuuuguuaaaaaaaaaaaaugggaagggagugcgggaga

SEQ ID NO: 35782 - RNA, 64 nt, hsa
gugaaaucagauaauaaugagaucuuuuguuaaaaaaaaaaaaugggaagggagugcgggagag

SEQ ID NO: 35783 - RNA, 64 nt, hsa
ugaaaucagauaauaaugagaucuuuuguuaaaaaaaaaaaaugggaagggagugcgggagaga

SEQ ID NO: 35784 - RNA, 64 nt, hsa
uccagccagggcaacagagugagacccugucuccaaaaaaaaaaauuaaauaaauaccuuucuu

SEQ ID NO: 35785 - RNA, 64 nt, hsa
ccagccagggcaacagagugagacccugucuccaaaaaaaaaaauuaaauaaauaccuuucuuu

SEQ ID NO: 35786 - RNA, 64 nt, hsa
cagccagggcaacagagugagacccugucuccaaaaaaaaaaauuaaauaaauaccuuucuuug

SEQ ID NO: 35787 - RNA, 64 nt, hsa
agccagggcaacagagugagacccugucuccaaaaaaaaaaauuaaauaaauaccuuucuuugu

SEQ ID NO: 35788 - RNA, 64 nt, hsa
acacagcgagaucucuuggggguaaaacaaaaagaaaaaaaaaaguucauacuucuccaauaaa

SEQ ID NO: 35789 - RNA, 64 nt, hsa
cacagcgagaucucuuggggguaaaacaaaaagaaaaaaaaaaguucauacuucuccaauaaau

SEQ ID NO: 35790 - RNA, 64 nt, hsa
acagcgagaucucuuggggguaaaacaaaaagaaaaaaaaaaguucauacuucuccaauaaaua

SEQ ID NO: 35791 - RNA, 64 nt, hsa
cgcuuaaugccuucaaaguuuugguuuuuuuaagaaaaaaaaauauauauauauuuggguuuug

SEQ ID NO: 35792 - RNA, 64 nt, hsa
gcuuaaugccuucaaaguuuugguuuuuuuaagaaaaaaaaauauauauauauuuggguuuugg

SEQ ID NO: 35793 - RNA, 64 nt, hsa
cucagaauacagacaaguagaaagauucucgcuuaaaaaaaauguauuuauuuuauggcaaguu

SEQ ID NO: 35794 - RNA, 64 nt, hsa
uggaaucauauaguauguaaccuguuuugagcuuaaaaaaaaaguauacaugacuuuaaugagg

SEQ ID NO: 35795 - RNA, 64 nt, hsa
ggaaucauauaguauguaaccuguuuugagcuuaaaaaaaaaguauacaugacuuuaaugagga

SEQ ID NO: 35796 - RNA, 64 nt, hsa
aaguauucaagaucaucuugauugaccaaagaccaaaaaaaaaaaaaagaccugugguuccaga

SEQ ID NO: 35797 - RNA, 64 nt, hsa
aguauucaagaucaucuugauugaccaaagaccaaaaaaaaaaaaaagaccugugguuccagaa

SEQ ID NO: 35798 - RNA, 64 nt, hsa
guauucaagaucaucuugauugaccaaagaccaaaaaaaaaaaaaagaccugugguuccagaaa

SEQ ID NO: 35799 - RNA, 64 nt, hsa
uauucaagaucaucuugauugaccaaagaccaaaaaaaaaaaaaagaccugugguuccagaaag

SEQ ID NO: 35800 - RNA, 64 nt, hsa
auucaagaucaucuugauugaccaaagaccaaaaaaaaaaaaaagaccugugguuccagaaagc

SEQ ID NO: 35801 - RNA, 64 nt, hsa
uucaagaucaucuugauugaccaaagaccaaaaaaaaaaaaaagaccugugguuccagaaagcu

SEQ ID NO: 35802 - RNA, 64 nt, hsa
ucaagaucaucuugauugaccaaagaccaaaaaaaaaaaaaagaccugugguuccagaaagcuc

SEQ ID NO: 35803 - RNA, 64 nt, hsa
cuccagucugggugacacagcaagacuccaucucaaaaaaaaaaaaagaaaaagaaaugaaugg

SEQ ID NO: 35804 - RNA, 64 nt, hsa
uccagucugggugacacagcaagacuccaucucaaaaaaaaaaaaagaaaaagaaaugaauggg

SEQ ID NO: 35805 - RNA, 64 nt, hsa
ccagucugggugacacagcaagacuccaucucaaaaaaaaaaaaagaaaaagaaaugaaugggu

SEQ ID NO: 35806 - RNA, 64 nt, hsa
cagucugggugacacagcaagacuccaucucaaaaaaaaaaaaagaaaaagaaaugaauggguu

SEQ ID NO: 35807 - RNA, 64 nt, hsa
agucugggugacacagcaagacuccaucucaaaaaaaaaaaaagaaaaagaaaugaauggguuc

SEQ ID NO: 35808 - RNA, 64 nt, hsa
gucugggugacacagcaagacuccaucucaaaaaaaaaaaaagaaaaagaaaugaauggguuca

SEQ ID NO: 35809 - RNA, 64 nt, hsa
agccugggcaacauaguaagacccugucucuauuaaaaaaaaaaaaucaacccuucuuccccac

SEQ ID NO: 35810 - RNA, 64 nt, hsa
gccugggcaacauaguaagacccugucucuauuaaaaaaaaaaaaucaacccuucuuccccacc

SEQ ID NO: 35811 - RNA, 64 nt, hsa
ccugggcaacauaguaagacccugucucuauuaaaaaaaaaaaaucaacccuucuuccccacca

SEQ ID NO: 35812 - RNA, 64 nt, hsa
cugggcaacauaguaagacccugucucuauuaaaaaaaaaaaaucaacccuucuuccccaccaa

SEQ ID NO: 35813 - RNA, 64 nt, hsa
ugggcaacauaguaagacccugucucuauuaaaaaaaaaaaaucaacccuucuuccccaccaaa

SEQ ID NO: 35814 - RNA, 64 nt, hsa
uaguuggugacuggguguucauuuuagcucuaagaaaaaaaaucaguguuucgugaagguguug

SEQ ID NO: 35815 - RNA, 64 nt, hsa
ugggcucugucucuuucuacccugcguuaagcggaaaaaaaaaauucugacaguguuuuucuuc

SEQ ID NO: 35816 - RNA, 64 nt, hsa
gggcucugucucuuucuacccugcguuaagcggaaaaaaaaaauucugacaguguuuuucuucc

SEQ ID NO: 35817 - RNA, 64 nt, hsa
ggcucugucucuuucuacccugcguuaagcggaaaaaaaaaauucugacaguguuuuucuuccu

SEQ ID NO: 35818 - RNA, 64 nt, hsa
ggcaacauaguaagaccucaucucuacuaaaaauaaaaaaaaacagccagguguguuaguccac

SEQ ID NO: 35819 - RNA, 64 nt, hsa
gcaacauaguaagaccucaucucuacuaaaaauaaaaaaaaacagccagguguguuaguccaca

SEQ ID NO: 35820 - RNA, 64 nt, hsa
cucucauagaaaauauaaagaaucccucaaguugaaaaaaaaaucaauuuaaaggggagaaaac

SEQ ID NO: 35821 - RNA, 64 nt, hsa
ucucauagaaaauauaaagaaucccucaaguugaaaaaaaaaucaauuuaaaggggagaaaacu

SEQ ID NO: 35822 - RNA, 64 nt, hsa
agccuggcgacagagggagacuccaucucaaauuaaaaaaaaaaaaaaaaaagaaagaaaaaga

SEQ ID NO: 35823 - RNA, 64 nt, hsa
gccuggcgacagagggagacuccaucucaaauuaaaaaaaaaaaaaaaaaagaaagaaaaagag

SEQ ID NO: 35824 - RNA, 64 nt, hsa
ccuggcgacagagggagacuccaucucaaauuaaaaaaaaaaaaaaaaaagaaagaaaaagaga

SEQ ID NO: 35825 - RNA, 64 nt, hsa
cuggcgacagagggagacuccaucucaaauuaaaaaaaaaaaaaaaaaagaaagaaaaagagaa

SEQ ID NO: 35826 - RNA, 64 nt, hsa
uggcgacagagggagacuccaucucaaauuaaaaaaaaaaaaaaaaaagaaagaaaaagagaaa

SEQ ID NO: 35827 - RNA, 64 nt, hsa
ggcgacagagggagacuccaucucaaauuaaaaaaaaaaaaaaaaaagaaagaaaaagagaaaa

SEQ ID NO: 35828 - RNA, 64 nt, hsa
gcgacagagggagacuccaucucaaauuaaaaaaaaaaaaaaaaaagaaagaaaaagagaaaaa

SEQ ID NO: 35829 - RNA, 64 nt, hsa
cgacagagggagacuccaucucaaauuaaaaaaaaaaaaaaaaaagaaagaaaaagagaaaaaa

SEQ ID NO: 35830 - RNA, 64 nt, hsa
gacagagggagacuccaucucaaauuaaaaaaaaaaaaaaaaaagaaagaaaaagagaaaaaag

SEQ ID NO: 35831 - RNA, 64 nt, hsa
acagagggagacuccaucucaaauuaaaaaaaaaaaaaaaaaagaaagaaaaagagaaaaaaga

SEQ ID NO: 35832 - RNA, 64 nt, hsa
cagagggagacuccaucucaaauuaaaaaaaaaaaaaaaaaagaaagaaaaagagaaaaaagaa

SEQ ID NO: 35833 - RNA, 64 nt, hsa
cuccagccugggcgacagagcgagacuccaucucaaaaaaaaaaaaaaaaaaaccacauaggcu

SEQ ID NO: 35834 - RNA, 64 nt, hsa
uccagccugggcgacagagcgagacuccaucucaaaaaaaaaaaaaaaaaaaccacauaggcuc

SEQ ID NO: 35835 - RNA, 64 nt, hsa
ccagccugggcgacagagcgagacuccaucucaaaaaaaaaaaaaaaaaaaccacauaggcuca

SEQ ID NO: 35836 - RNA, 64 nt, hsa
cagccugggcgacagagcgagacuccaucucaaaaaaaaaaaaaaaaaaaccacauaggcucag

SEQ ID NO: 35837 - RNA, 64 nt, hsa
agccugggcgacagagcgagacuccaucucaaaaaaaaaaaaaaaaaaaccacauaggcucagu

SEQ ID NO: 35838 - RNA, 64 nt, hsa
gccugggcgacagagcgagacuccaucucaaaaaaaaaaaaaaaaaaaccacauaggcucaguc

SEQ ID NO: 35839 - RNA, 64 nt, hsa
ccugggcgacagagcgagacuccaucucaaaaaaaaaaaaaaaaaaaccacauaggcucagucu

SEQ ID NO: 35840 - RNA, 64 nt, hsa
cugggcgacagagcgagacuccaucucaaaaaaaaaaaaaaaaaaaccacauaggcucagucuu

SEQ ID NO: 35841 - RNA, 64 nt, hsa
ugggcgacagagcgagacuccaucucaaaaaaaaaaaaaaaaaaaccacauaggcucagucuuu

SEQ ID NO: 35842 - RNA, 64 nt, hsa
gggcgacagagcgagacuccaucucaaaaaaaaaaaaaaaaaaaccacauaggcucagucuuuu

SEQ ID NO: 35843 - RNA, 64 nt, hsa
ggcgacagagcgagacuccaucucaaaaaaaaaaaaaaaaaaaccacauaggcucagucuuuuc

SEQ ID NO: 35844 - RNA, 64 nt, hsa
gcgacagagcgagacuccaucucaaaaaaaaaaaaaaaaaaaccacauaggcucagucuuuuca

SEQ ID NO: 35845 - RNA, 64 nt, hsa
agccuggccaacauggugaaaccccgccucuacuaaaaaaaaaaauacaaaaaauuaggcgugg

SEQ ID NO: 35846 - RNA, 64 nt, hsa
gccuggccaacauggugaaaccccgccucuacuaaaaaaaaaaauacaaaaaauuaggcguggu

SEQ ID NO: 35847 - RNA, 64 nt, hsa
ccuggccaacauggugaaaccccgccucuacuaaaaaaaaaaauacaaaaaauuaggcguggug

SEQ ID NO: 35848 - RNA, 64 nt, hsa
cuggccaacauggugaaaccccgccucuacuaaaaaaaaaaauacaaaaaauuaggcguggugg

SEQ ID NO: 35849 - RNA, 64 nt, hsa
ccugggcgacagagcaagacucugucucaagaagaaaaaaaaaauacauauacacauaaauaua

SEQ ID NO: 35850 - RNA, 64 nt, hsa
cugggcgacagagcaagacucugucucaagaagaaaaaaaaaauacauauacacauaaauauau

SEQ ID NO: 35851 - RNA, 64 nt, hsa
ugggcgacagagcaagacucugucucaagaagaaaaaaaaaauacauauacacauaaauauaua

SEQ ID NO: 35852 - RNA, 64 nt, hsa
gugcacaugguacccuaaaacuuaaaguauaauuaaaaaaaaaaauuagagguuuuucuucggg

SEQ ID NO: 35853 - RNA, 64 nt, hsa
ugcacaugguacccuaaaacuuaaaguauaauuaaaaaaaaaaauuagagguuuuucuucgggu

SEQ ID NO: 35854 - RNA, 64 nt, hsa
gcacaugguacccuaaaacuuaaaguauaauuaaaaaaaaaaauuagagguuuuucuucgggug

SEQ ID NO: 35855 - RNA, 64 nt, hsa
cacaugguacccuaaaacuuaaaguauaauuaaaaaaaaaaauuagagguuuuucuucgggugc

SEQ ID NO: 35856 - RNA, 64 nt, hsa
ccagccagguugacagaaugagacccugucucuuaaaaaaaaaaaaaaaaauccuggugaugcu

SEQ ID NO: 35857 - RNA, 64 nt, hsa
cagccagguugacagaaugagacccugucucuuaaaaaaaaaaaaaaaaauccuggugaugcuu

SEQ ID NO: 35858 - RNA, 64 nt, hsa
agccagguugacagaaugagacccugucucuuaaaaaaaaaaaaaaaaauccuggugaugcuuu

SEQ ID NO: 35859 - RNA, 64 nt, hsa
gccagguugacagaaugagacccugucucuuaaaaaaaaaaaaaaaaauccuggugaugcuuuu

SEQ ID NO: 35860 - RNA, 64 nt, hsa
ccagguugacagaaugagacccugucucuuaaaaaaaaaaaaaaaaauccuggugaugcuuuuc

SEQ ID NO: 35861 - RNA, 64 nt, hsa
cagguugacagaaugagacccugucucuuaaaaaaaaaaaaaaaaauccuggugaugcuuuucu

SEQ ID NO: 35862 - RNA, 64 nt, hsa
agguugacagaaugagacccugucucuuaaaaaaaaaaaaaaaaauccuggugaugcuuuucug

SEQ ID NO: 35863 - RNA, 64 nt, hsa
gguugacagaaugagacccugucucuuaaaaaaaaaaaaaaaaauccuggugaugcuuuucugg

SEQ ID NO: 35864 - RNA, 64 nt, hsa
guugacagaaugagacccugucucuuaaaaaaaaaaaaaaaaauccuggugaugcuuuucugga

SEQ ID NO: 35865 - RNA, 64 nt, hsa
uugacagaaugagacccugucucuuaaaaaaaaaaaaaaaaauccuggugaugcuuuucuggau

SEQ ID NO: 35866 - RNA, 64 nt, hsa
auacacuaacauuaacaauagcugaugagcuaagaaaaaaaaaaagucugugcauaguuuuagu

SEQ ID NO: 35867 - RNA, 64 nt, hsa
uacacuaacauuaacaauagcugaugagcuaagaaaaaaaaaaagucugugcauaguuuuagug

SEQ ID NO: 35868 - RNA, 64 nt, hsa
acacuaacauuaacaauagcugaugagcuaagaaaaaaaaaaagucugugcauaguuuuaguga

SEQ ID NO: 35869 - RNA, 64 nt, hsa
cacuaacauuaacaauagcugaugagcuaagaaaaaaaaaaagucugugcauaguuuuagugau

SEQ ID NO: 35870 - RNA, 64 nt, hsa
auuuuggaaccaaaacaguaucuuuuuuuaagcuaaaaaaaaaguuuuaaauggugucuuucua

SEQ ID NO: 35871 - RNA, 64 nt, hsa
uuuuggaaccaaaacaguaucuuuuuuuaagcuaaaaaaaaaguuuuaaauggugucuuucuau

SEQ ID NO: 35872 - RNA, 64 nt, hsa
cggggaauauauacaagacuuuauuuagucaaguaaaaaaaaaucacuaauguuuaacugaaga

SEQ ID NO: 35873 - RNA, 64 nt, hsa
ggggaauauauacaagacuuuauuuagucaaguaaaaaaaaaucacuaauguuuaacugaagaa

SEQ ID NO: 35874 - RNA, 64 nt, hsa
uuuauuccucuuuaauuuuuacaagcacuuuuuaaaaaaaaauuuuacuuuaaguucugggugu

SEQ ID NO: 35875 - RNA, 64 nt, hsa
uuuuauuccucuuuaauuuuuacaagcacuuuuuaaaaaaaaauuuuacuuuaaguucugggug

SEQ ID NO: 35876 - RNA, 64 nt, hsa
uuaauguuacgauguuuuuaaaagacaaaaaaaaaaaaaaaaccucaaaaguuuuuuuaaagug

SEQ ID NO: 35877 - RNA, 64 nt, hsa
guuaauguuacgauguuuuuaaaagacaaaaaaaaaaaaaaaaccucaaaaguuuuuuuaaagu

SEQ ID NO: 35878 - RNA, 64 nt, hsa
uguuaauguuacgauguuuuuaaaagacaaaaaaaaaaaaaaaaccucaaaaguuuuuuuaaag

SEQ ID NO: 35879 - RNA, 64 nt, hsa
guguuaauguuacgauguuuuuaaaagacaaaaaaaaaaaaaaaaccucaaaaguuuuuuuaaa

SEQ ID NO: 35880 - RNA, 64 nt, hsa
uguguuaauguuacgauguuuuuaaaagacaaaaaaaaaaaaaaaaccucaaaaguuuuuuuaa

SEQ ID NO: 35881 - RNA, 64 nt, hsa
auguguuaauguuacgauguuuuuaaaagacaaaaaaaaaaaaaaaaccucaaaaguuuuuuua

SEQ ID NO: 35882 - RNA, 64 nt, hsa
cauguguuaauguuacgauguuuuuaaaagacaaaaaaaaaaaaaaaaccucaaaaguuuuuuu

SEQ ID NO: 35883 - RNA, 64 nt, hsa
ccauguguuaauguuacgauguuuuuaaaagacaaaaaaaaaaaaaaaaccucaaaaguuuuuu

SEQ ID NO: 35884 - RNA, 64 nt, hsa
gccauguguuaauguuacgauguuuuuaaaagacaaaaaaaaaaaaaaaaccucaaaaguuuuu

SEQ ID NO: 35885 - RNA, 64 nt, hsa
ucuuccuccuguuuaguuuuuuaguuuuuccuuaaaaaaaaacaacacaucgauggacuuugcu

SEQ ID NO: 35886 - RNA, 64 nt, hsa
uucuuccuccuguuuaguuuuuuaguuuuuccuuaaaaaaaaacaacacaucgauggacuuugc

SEQ ID NO: 35887 - RNA, 64 nt, hsa
agccuguggguuucuuucuagcuugggggauuaaaaaaaaaauucuccacuuuuuuuuuucuug

SEQ ID NO: 35888 - RNA, 64 nt, hsa
aagccuguggguuucuuucuagcuugggggauuaaaaaaaaaauucuccacuuuuuuuuuucuu

SEQ ID NO: 35889 - RNA, 64 nt, hsa
gaagccuguggguuucuuucuagcuugggggauuaaaaaaaaaauucuccacuuuuuuuuuucu

SEQ ID NO: 35890 - RNA, 64 nt, hsa
gauauuaaaaaaaaaaaaagacaaaaguguuuuuaaaaaaaagcaacacccacaccugugucug

SEQ ID NO: 35891 - RNA, 64 nt, hsa
cuagcuugucuuuuaagaaaggggauauuaaaaaaaaaaaaagacaaaaguguuuuuaaaaaaa

SEQ ID NO: 35892 - RNA, 64 nt, hsa
acuagcuugucuuuuaagaaaggggauauuaaaaaaaaaaaaagacaaaaguguuuuuaaaaaa

SEQ ID NO: 35893 - RNA, 64 nt, hsa
uacuagcuugucuuuuaagaaaggggauauuaaaaaaaaaaaaagacaaaaguguuuuuaaaaa

SEQ ID NO: 35894 - RNA, 64 nt, hsa
auacuagcuugucuuuuaagaaaggggauauuaaaaaaaaaaaaagacaaaaguguuuuuaaaa

SEQ ID NO: 35895 - RNA, 64 nt, hsa
uauacuagcuugucuuuuaagaaaggggauauuaaaaaaaaaaaaagacaaaaguguuuuuaaa

SEQ ID NO: 35896 - RNA, 64 nt, hsa
guauacuagcuugucuuuuaagaaaggggauauuaaaaaaaaaaaaagacaaaaguguuuuuaa

SEQ ID NO: 35897 - RNA, 64 nt, hsa
uaaaagucgauuuauuuuuguacaaaauaauaaaaaaaaaaacccaccacaaacguagaaucca

SEQ ID NO: 35898 - RNA, 64 nt, hsa
cuaaaagucgauuuauuuuuguacaaaauaauaaaaaaaaaaacccaccacaaacguagaaucc

SEQ ID NO: 35899 - RNA, 64 nt, hsa
ccuaaaagucgauuuauuuuuguacaaaauaauaaaaaaaaaaacccaccacaaacguagaauc

SEQ ID NO: 35900 - RNA, 64 nt, hsa
uccuaaaagucgauuuauuuuuguacaaaauaauaaaaaaaaaaacccaccacaaacguagaau

SEQ ID NO: 35901 - RNA, 64 nt, hsa
aacuucuaugaaaaguugaaaagacaaaaaaaaaaaaaaaaagcgagcgagagagagagcgaga

SEQ ID NO: 35902 - RNA, 64 nt, hsa
caacuucuaugaaaaguugaaaagacaaaaaaaaaaaaaaaaagcgagcgagagagagagcgag

SEQ ID NO: 35903 - RNA, 64 nt, hsa
ccaacuucuaugaaaaguugaaaagacaaaaaaaaaaaaaaaaagcgagcgagagagagagcga

SEQ ID NO: 35904 - RNA, 64 nt, hsa
accaacuucuaugaaaaguugaaaagacaaaaaaaaaaaaaaaaagcgagcgagagagagagcg

SEQ ID NO: 35905 - RNA, 64 nt, hsa
aaccaacuucuaugaaaaguugaaaagacaaaaaaaaaaaaaaaaagcgagcgagagagagagc

SEQ ID NO: 35906 - RNA, 64 nt, hsa
caaccaacuucuaugaaaaguugaaaagacaaaaaaaaaaaaaaaaagcgagcgagagagagag

SEQ ID NO: 35907 - RNA, 64 nt, hsa
acaaccaacuucuaugaaaaguugaaaagacaaaaaaaaaaaaaaaaagcgagcgagagagaga

SEQ ID NO: 35908 - RNA, 64 nt, hsa
uacaaccaacuucuaugaaaaguugaaaagacaaaaaaaaaaaaaaaaagcgagcgagagagag

SEQ ID NO: 35909 - RNA, 64 nt, hsa
uuacaaccaacuucuaugaaaaguugaaaagacaaaaaaaaaaaaaaaaagcgagcgagagaga

SEQ ID NO: 35910 - RNA, 64 nt, hsa
guuacaaccaacuucuaugaaaaguugaaaagacaaaaaaaaaaaaaaaaagcgagcgagagag

SEQ ID NO: 35911 - RNA, 64 nt, hsa
aaaaaaaagguuuuacaaaaugaaaggaaggaaaaaaaaaaaggcaaccaaccacauuagaagu

SEQ ID NO: 35912 - RNA, 64 nt, hsa
aaaaaaaaagguuuuacaaaaugaaaggaaggaaaaaaaaaaaggcaaccaaccacauuagaag

SEQ ID NO: 35913 - RNA, 64 nt, hsa
aaaaaaaaaagguuuuacaaaaugaaaggaaggaaaaaaaaaaaggcaaccaaccacauuagaa

SEQ ID NO: 35914 - RNA, 64 nt, hsa
gaaaaaaaaaagguuuuacaaaaugaaaggaaggaaaaaaaaaaaggcaaccaaccacauuaga

SEQ ID NO: 35915 - RNA, 64 nt, hsa
uccaaugucacaaaagcaauaaaacaaacuagaaaaaaaaaagguuuuacaaaaugaaaggaag

SEQ ID NO: 35916 - RNA, 64 nt, hsa
uuccaaugucacaaaagcaauaaaacaaacuagaaaaaaaaaagguuuuacaaaaugaaaggaa

SEQ ID NO: 35917 - RNA, 64 nt, hsa
auuccaaugucacaaaagcaauaaaacaaacuagaaaaaaaaaagguuuuacaaaaugaaagga

SEQ ID NO: 35918 - RNA, 64 nt, hsa
cagaaacccgagaaagagagagacagagagagagaaaaaaaaucacccaccacccccccaaaaa

SEQ ID NO: 35919 - RNA, 64 nt, hsa
cgggcaaaaaaaaaaguaaaaagaaaagaaaaaaaaaaaaaagaaacaaaccaccucuacauau

SEQ ID NO: 35920 - RNA, 64 nt, hsa
gcgggcaaaaaaaaaaguaaaaagaaaagaaaaaaaaaaaaaagaaacaaaccaccucuacaua

SEQ ID NO: 35921 - RNA, 64 nt, hsa
ggcgggcaaaaaaaaaaguaaaaagaaaagaaaaaaaaaaaaaagaaacaaaccaccucuacau

SEQ ID NO: 35922 - RNA, 64 nt, hsa
gggcgggcaaaaaaaaaaguaaaaagaaaagaaaaaaaaaaaaaagaaacaaaccaccucuaca

SEQ ID NO: 35923 - RNA, 64 nt, hsa
ggggcgggcaaaaaaaaaaguaaaaagaaaagaaaaaaaaaaaaaagaaacaaaccaccucuac

SEQ ID NO: 35924 - RNA, 64 nt, hsa
aggggcgggcaaaaaaaaaaguaaaaagaaaagaaaaaaaaaaaaaagaaacaaaccaccucua

SEQ ID NO: 35925 - RNA, 64 nt, hsa
caggggcgggcaaaaaaaaaaguaaaaagaaaagaaaaaaaaaaaaaagaaacaaaccaccucu

SEQ ID NO: 35926 - RNA, 64 nt, hsa
ccuccccgccaagagcucugccaggggcgggcaaaaaaaaaaguaaaaagaaaagaaaaaaaaa

SEQ ID NO: 35927 - RNA, 64 nt, hsa
cccuccccgccaagagcucugccaggggcgggcaaaaaaaaaaguaaaaagaaaagaaaaaaaa

SEQ ID NO: 35928 - RNA, 64 nt, hsa
ucccuccccgccaagagcucugccaggggcgggcaaaaaaaaaaguaaaaagaaaagaaaaaaa

SEQ ID NO: 35929 - RNA, 64 nt, hsa
gagugagacuuagucucaaaaaaaaaaaaaaagaaaaaaaaaucagggauauaguucauauccc

SEQ ID NO: 35930 - RNA, 64 nt, hsa
agagugagacuuagucucaaaaaaaaaaaaaaagaaaaaaaaaucagggauauaguucauaucc

SEQ ID NO: 35931 - RNA, 64 nt, hsa
ugggggacaagagugagacuuagucucaaaaaaaaaaaaaaagaaaaaaaaaucagggauauag

SEQ ID NO: 35932 - RNA, 64 nt, hsa
cugggggacaagagugagacuuagucucaaaaaaaaaaaaaaagaaaaaaaaaucagggauaua

SEQ ID NO: 35933 - RNA, 64 nt, hsa
ccugggggacaagagugagacuuagucucaaaaaaaaaaaaaaagaaaaaaaaaucagggauau

SEQ ID NO: 35934 - RNA, 64 nt, hsa
gccugggggacaagagugagacuuagucucaaaaaaaaaaaaaaagaaaaaaaaaucagggaua

SEQ ID NO: 35935 - RNA, 64 nt, hsa
agccugggggacaagagugagacuuagucucaaaaaaaaaaaaaaagaaaaaaaaaucagggau

SEQ ID NO: 35936 - RNA, 64 nt, hsa
cagccugggggacaagagugagacuuagucucaaaaaaaaaaaaaaagaaaaaaaaaucaggga

SEQ ID NO: 35937 - RNA, 64 nt, hsa
ccagccugggggacaagagugagacuuagucucaaaaaaaaaaaaaaagaaaaaaaaaucaggg

SEQ ID NO: 35938 - RNA, 64 nt, hsa
uccagccugggggacaagagugagacuuagucucaaaaaaaaaaaaaaagaaaaaaaaaucagg

SEQ ID NO: 35939 - RNA, 64 nt, hsa
aacauggugaaaccccgucucuacuaaaaauacaaaaaaaaaugagccgggcaugguagcaggu

SEQ ID NO: 35940 - RNA, 64 nt, hsa
caacauggugaaaccccgucucuacuaaaaauacaaaaaaaaaugagccgggcaugguagcagg

SEQ ID NO: 35941 - RNA, 64 nt, hsa
cugggugacagaaugaaauccuggcacaaaaaaaaaaaaaaaguagccaggcaugguggcggga

SEQ ID NO: 35942 - RNA, 64 nt, hsa
ccugggugacagaaugaaauccuggcacaaaaaaaaaaaaaaaguagccaggcaugguggcggg

SEQ ID NO: 35943 - RNA, 64 nt, hsa
gccugggugacagaaugaaauccuggcacaaaaaaaaaaaaaaaguagccaggcaugguggcgg

SEQ ID NO: 35944 - RNA, 64 nt, hsa
agccugggugacagaaugaaauccuggcacaaaaaaaaaaaaaaaguagccaggcaugguggcg

SEQ ID NO: 35945 - RNA, 64 nt, hsa
cagccugggugacagaaugaaauccuggcacaaaaaaaaaaaaaaaguagccaggcaugguggc

SEQ ID NO: 35946 - RNA, 64 nt, hsa
ccagccugggugacagaaugaaauccuggcacaaaaaaaaaaaaaaaguagccaggcauggugg

SEQ ID NO: 35947 - RNA, 64 nt, hsa
uccagccugggugacagaaugaaauccuggcacaaaaaaaaaaaaaaaguagccaggcauggug

SEQ ID NO: 35948 - RNA, 64 nt, hsa
uuccagccugggugacagaaugaaauccuggcacaaaaaaaaaaaaaaaguagccaggcauggu

SEQ ID NO: 35949 - RNA, 64 nt, hsa
aggagauugaaacugaaaacaaaaugagaacaacaaaaaaaauuguauggcaguuuuuacuuuu

SEQ ID NO: 35950 - RNA, 64 nt, hsa
ccucuuguuuuuaaaauaaacuuuuaaaaaggaaaaaaaaaagucacucuugcuauuucuuuuu

SEQ ID NO: 35951 - RNA, 64 nt, hsa
cccucuuguuuuuaaaauaaacuuuuaaaaaggaaaaaaaaaagucacucuugcuauuucuuuu

SEQ ID NO: 35952 - RNA, 64 nt, hsa
gcccucuuguuuuuaaaauaaacuuuuaaaaaggaaaaaaaaaagucacucuugcuauuucuuu

SEQ ID NO: 35953 - RNA, 64 nt, hsa
gaagauagcgagaucuaaaucucugccaaaaaaaaaaaaaaacuuaaaaauuaaaaacacaaag

SEQ ID NO: 35954 - RNA, 64 nt, hsa
agaagauagcgagaucuaaaucucugccaaaaaaaaaaaaaaacuuaaaaauuaaaaacacaaa

SEQ ID NO: 35955 - RNA, 64 nt, hsa
gagaagauagcgagaucuaaaucucugccaaaaaaaaaaaaaaacuuaaaaauuaaaaacacaa

SEQ ID NO: 35956 - RNA, 64 nt, hsa
agagaagauagcgagaucuaaaucucugccaaaaaaaaaaaaaaacuuaaaaauuaaaaacaca

SEQ ID NO: 35957 - RNA, 64 nt, hsa
cagagaagauagcgagaucuaaaucucugccaaaaaaaaaaaaaaacuuaaaaauuaaaaacac

SEQ ID NO: 35958 - RNA, 64 nt, hsa
ccagagaagauagcgagaucuaaaucucugccaaaaaaaaaaaaaaacuuaaaaauuaaaaaca

SEQ ID NO: 35959 - RNA, 64 nt, hsa
gccagagaagauagcgagaucuaaaucucugccaaaaaaaaaaaaaaacuuaaaaauuaaaaac

SEQ ID NO: 35960 - RNA, 64 nt, hsa
agccagagaagauagcgagaucuaaaucucugccaaaaaaaaaaaaaaacuuaaaaauuaaaaa

SEQ ID NO: 35961 - RNA, 64 nt, hsa
acccaagcacccaaugaugcaaaaaacaaaaacaaaaaaaaaccaccaaauccccaaauucauu

SEQ ID NO: 35962 - RNA, 64 nt, hsa
aacccaagcacccaaugaugcaaaaaacaaaaacaaaaaaaaaccaccaaauccccaaauucau

SEQ ID NO: 35963 - RNA, 64 nt, hsa
ggcaacaaagcaagacccugucucuugaaaaaaaaaaaaaaauuaaaaaacacguguagcugug

SEQ ID NO: 35964 - RNA, 64 nt, hsa
gggcaacaaagcaagacccugucucuugaaaaaaaaaaaaaaauuaaaaaacacguguagcugu

SEQ ID NO: 35965 - RNA, 64 nt, hsa
ugggcaacaaagcaagacccugucucuugaaaaaaaaaaaaaaauuaaaaaacacguguagcug

SEQ ID NO: 35966 - RNA, 64 nt, hsa
cugggcaacaaagcaagacccugucucuugaaaaaaaaaaaaaaauuaaaaaacacguguagcu

SEQ ID NO: 35967 - RNA, 64 nt, hsa
ccugggcaacaaagcaagacccugucucuugaaaaaaaaaaaaaaauuaaaaaacacguguagc

SEQ ID NO: 35968 - RNA, 64 nt, hsa
gccugggcaacaaagcaagacccugucucuugaaaaaaaaaaaaaaauuaaaaaacacguguag

SEQ ID NO: 35969 - RNA, 64 nt, hsa
agccugggcaacaaagcaagacccugucucuugaaaaaaaaaaaaaaauuaaaaaacacgugua

SEQ ID NO: 35970 - RNA, 64 nt, hsa
cagccugggcaacaaagcaagacccugucucuugaaaaaaaaaaaaaaauuaaaaaacacgugu

SEQ ID NO: 35971 - RNA, 64 nt, hsa
aaaaaaaaaaagacaaaacaaaagacaaaaaaaaaaaaaaaacccaacaagaacacuucgcguu

SEQ ID NO: 35972 - RNA, 64 nt, hsa
aaaaaaaaaaaagacaaaacaaaagacaaaaaaaaaaaaaaaacccaacaagaacacuucgcgu

SEQ ID NO: 35973 - RNA, 64 nt, hsa
aaaaaaaaaaaaagacaaaacaaaagacaaaaaaaaaaaaaaaacccaacaagaacacuucgcg

SEQ ID NO: 35974 - RNA, 64 nt, hsa
aaaaaaaaaaaaaagacaaaacaaaagacaaaaaaaaaaaaaaaacccaacaagaacacuucgc

SEQ ID NO: 35975 - RNA, 64 nt, hsa
aaaaaaaaaaaaaaagacaaaacaaaagacaaaaaaaaaaaaaaaacccaacaagaacacuucg

SEQ ID NO: 35976 - RNA, 64 nt, hsa
aaaaaaaaaaaaaaaagacaaaacaaaagacaaaaaaaaaaaaaaaacccaacaagaacacuuc

SEQ ID NO: 35977 - RNA, 64 nt, hsa
aaaaaaaaaaaaaaaaagacaaaacaaaagacaaaaaaaaaaaaaaaacccaacaagaacacuu

SEQ ID NO: 35978 - RNA, 64 nt, hsa
aaaaaaaaaaaaaaaaaagacaaaacaaaagacaaaaaaaaaaaaaaaacccaacaagaacacu

SEQ ID NO: 35979 - RNA, 64 nt, hsa
aaaaaaaaaaaaaaaaaaagacaaaacaaaagacaaaaaaaaaaaaaaaacccaacaagaacac

SEQ ID NO: 35980 - RNA, 64 nt, hsa
uuggaggugauaaaaaacuguaaaaaaaaaaaaaaaaaaaaagacaaaacaaaagacaaaaaaa

SEQ ID NO: 35981 - RNA, 64 nt, hsa
guuggaggugauaaaaaacuguaaaaaaaaaaaaaaaaaaaaagacaaaacaaaagacaaaaaa

SEQ ID NO: 35982 - RNA, 64 nt, hsa
uguuggaggugauaaaaaacuguaaaaaaaaaaaaaaaaaaaaagacaaaacaaaagacaaaaa

SEQ ID NO: 35983 - RNA, 64 nt, hsa
auguuggaggugauaaaaaacuguaaaaaaaaaaaaaaaaaaaaagacaaaacaaaagacaaaa

SEQ ID NO: 35984 - RNA, 64 nt, hsa
cauguuggaggugauaaaaaacuguaaaaaaaaaaaaaaaaaaaaagacaaaacaaaagacaaa

SEQ ID NO: 35985 - RNA, 64 nt, hsa
ccauguuggaggugauaaaaaacuguaaaaaaaaaaaaaaaaaaaaagacaaaacaaaagacaa

SEQ ID NO: 35986 - RNA, 64 nt, hsa
uccauguuggaggugauaaaaaacuguaaaaaaaaaaaaaaaaaaaaagacaaaacaaaagaca

SEQ ID NO: 35987 - RNA, 64 nt, hsa
guccauguuggaggugauaaaaaacuguaaaaaaaaaaaaaaaaaaaaagacaaaacaaaagac

SEQ ID NO: 35988 - RNA, 64 nt, hsa
aguccauguuggaggugauaaaaaacuguaaaaaaaaaaaaaaaaaaaaagacaaaacaaaaga

SEQ ID NO: 35989 - RNA, 64 nt, hsa
gaguccauguuggaggugauaaaaaacuguaaaaaaaaaaaaaaaaaaaaagacaaaacaaaag

SEQ ID NO: 35990 - RNA, 64 nt, hsa
agaguccauguuggaggugauaaaaaacuguaaaaaaaaaaaaaaaaaaaaagacaaaacaaaa

SEQ ID NO: 35991 - RNA, 64 nt, hsa
cagaguccauguuggaggugauaaaaaacuguaaaaaaaaaaaaaaaaaaaaagacaaaacaaa

SEQ ID NO: 35992 - RNA, 64 nt, hsa
acagaguccauguuggaggugauaaaaaacuguaaaaaaaaaaaaaaaaaaaaagacaaaacaa

SEQ ID NO: 35993 - RNA, 64 nt, hsa
gacagaguccauguuggaggugauaaaaaacuguaaaaaaaaaaaaaaaaaaaaagacaaaaca

SEQ ID NO: 35994 - RNA, 64 nt, hsa
cacacagaagagauuuaaaaaaaaaaaaggaaaaaaaaaaaagacauaaacuggcaccaguuaa

SEQ ID NO: 35995 - RNA, 64 nt, hsa
acacacagaagagauuuaaaaaaaaaaaaggaaaaaaaaaaaagacauaaacuggcaccaguua

SEQ ID NO: 35996 - RNA, 64 nt, hsa
aacacacagaagagauuuaaaaaaaaaaaaggaaaaaaaaaaaagacauaaacuggcaccaguu

SEQ ID NO: 35997 - RNA, 64 nt, hsa
aaacacacagaagagauuuaaaaaaaaaaaaggaaaaaaaaaaaagacauaaacuggcaccagu

SEQ ID NO: 35998 - RNA, 64 nt, hsa
aaaacacacagaagagauuuaaaaaaaaaaaaggaaaaaaaaaaaagacauaaacuggcaccag

SEQ ID NO: 35999 - RNA, 64 nt, hsa
acaaaaaaagaaaacacacagaagagauuuaaaaaaaaaaaaggaaaaaaaaaaaagacauaaa

SEQ ID NO: 36000 - RNA, 64 nt, hsa
aacaaaaaaagaaaacacacagaagagauuuaaaaaaaaaaaaggaaaaaaaaaaaagacauaa

SEQ ID NO: 36001 - RNA, 64 nt, hsa
caacaaaaaaagaaaacacacagaagagauuuaaaaaaaaaaaaggaaaaaaaaaaaagacaua

SEQ ID NO: 36002 - RNA, 64 nt, hsa
gcaacaaaaaaagaaaacacacagaagagauuuaaaaaaaaaaaaggaaaaaaaaaaaagacau

SEQ ID NO: 36003 - RNA, 64 nt, hsa
agcaacaaaaaaagaaaacacacagaagagauuuaaaaaaaaaaaaggaaaaaaaaaaaagaca

SEQ ID NO: 36004 - RNA, 64 nt, hsa
caaaaaagcgacaaaaaaacacaaacagaagaggaaaaaaaagcaacaaaaaaagaaaacacac

SEQ ID NO: 36005 - RNA, 64 nt, hsa
gacauugcaucgcccuaguuuucuuucuuuaaaaaaaaaaaauuccaacagaagccacaggccg

SEQ ID NO: 36006 - RNA, 64 nt, hsa
ggacauugcaucgcccuaguuuucuuucuuuaaaaaaaaaaaauuccaacagaagccacaggcc

SEQ ID NO: 36007 - RNA, 64 nt, hsa
uggacauugcaucgcccuaguuuucuuucuuuaaaaaaaaaaaauuccaacagaagccacaggc

SEQ ID NO: 36008 - RNA, 64 nt, hsa
cuggacauugcaucgcccuaguuuucuuucuuuaaaaaaaaaaaauuccaacagaagccacagg

SEQ ID NO: 36009 - RNA, 64 nt, hsa
ucuggacauugcaucgcccuaguuuucuuucuuuaaaaaaaaaaaauuccaacagaagccacag

SEQ ID NO: 36010 - RNA, 64 nt, hsa
acuugaaaaaaaaaaacacaaaaaaagacaaaaaaaaaaaaagaaaauauuuuggcagguuaug

SEQ ID NO: 36011 - RNA, 64 nt, hsa
aacuugaaaaaaaaaaacacaaaaaaagacaaaaaaaaaaaaagaaaauauuuuggcagguuau

SEQ ID NO: 36012 - RNA, 64 nt, hsa
gaacuugaaaaaaaaaaacacaaaaaaagacaaaaaaaaaaaaagaaaauauuuuggcagguua

SEQ ID NO: 36013 - RNA, 64 nt, hsa
ugaacuugaaaaaaaaaaacacaaaaaaagacaaaaaaaaaaaaagaaaauauuuuggcagguu

SEQ ID NO: 36014 - RNA, 64 nt, hsa
uugaacuugaaaaaaaaaaacacaaaaaaagacaaaaaaaaaaaaagaaaauauuuuggcaggu

SEQ ID NO: 36015 - RNA, 64 nt, hsa
cuugaacuugaaaaaaaaaaacacaaaaaaagacaaaaaaaaaaaaagaaaauauuuuggcagg

SEQ ID NO: 36016 - RNA, 64 nt, hsa
ggagaauuuuuacuggggauucuugaacuugaaaaaaaaaaacacaaaaaaagacaaaaaaaaa

SEQ ID NO: 36017 - RNA, 64 nt, hsa
uggagaauuuuuacuggggauucuugaacuugaaaaaaaaaaacacaaaaaaagacaaaaaaaa

SEQ ID NO: 36018 - RNA, 64 nt, hsa
guggagaauuuuuacuggggauucuugaacuugaaaaaaaaaaacacaaaaaaagacaaaaaaa

SEQ ID NO: 36019 - RNA, 64 nt, hsa
cguggagaauuuuuacuggggauucuugaacuugaaaaaaaaaaacacaaaaaaagacaaaaaa

SEQ ID NO: 36020 - RNA, 64 nt, hsa
gcaggcaguggggcuggaagcagaaacaaaaugaaaaaaaaaggggggugggaggggaagaaaa

SEQ ID NO: 36021 - RNA, 64 nt, hsa
agcaggcaguggggcuggaagcagaaacaaaaugaaaaaaaaaggggggugggaggggaagaaa

SEQ ID NO: 36022 - RNA, 64 nt, hsa
cugggcgacagagccagacccugucucaaaaaaaaaaaaaaaguacaugaaaggauucacucug

SEQ ID NO: 36023 - RNA, 64 nt, hsa
ccugggcgacagagccagacccugucucaaaaaaaaaaaaaaaguacaugaaaggauucacucu

SEQ ID NO: 36024 - RNA, 64 nt, hsa
gccugggcgacagagccagacccugucucaaaaaaaaaaaaaaaguacaugaaaggauucacuc

SEQ ID NO: 36025 - RNA, 64 nt, hsa
agccugggcgacagagccagacccugucucaaaaaaaaaaaaaaaguacaugaaaggauucacu

SEQ ID NO: 36026 - RNA, 64 nt, hsa
cagccugggcgacagagccagacccugucucaaaaaaaaaaaaaaaguacaugaaaggauucac

SEQ ID NO: 36027 - RNA, 64 nt, hsa
ccagccugggcgacagagccagacccugucucaaaaaaaaaaaaaaaguacaugaaaggauuca

SEQ ID NO: 36028 - RNA, 64 nt, hsa
cccagccugggcgacagagccagacccugucucaaaaaaaaaaaaaaaguacaugaaaggauuc

SEQ ID NO: 36029 - RNA, 64 nt, hsa
ccccagccugggcgacagagccagacccugucucaaaaaaaaaaaaaaaguacaugaaaggauu

SEQ ID NO: 36030 - RNA, 64 nt, hsa
ggcaacagagugagacuccaucucaaaaaaaauaaaaaaaaagaaaaagaaauaaacucuauga

SEQ ID NO: 36031 - RNA, 64 nt, hsa
uggcaacagagugagacuccaucucaaaaaaaauaaaaaaaaagaaaaagaaauaaacucuaug

SEQ ID NO: 36032 - RNA, 64 nt, hsa
acuccagccuggcaacagagugagacuccaucucaaaaaaaauaaaaaaaaagaaaaagaaaua

SEQ ID NO: 36033 - RNA, 64 nt, hsa
guucuucucguuuuccuuuuuuuuuuuuuuuuuaaaaaaaaacuauuuaauuuuuuaauuuauu

SEQ ID NO: 36034 - RNA, 64 nt, hsa
gguucuucucguuuuccuuuuuuuuuuuuuuuuuaaaaaaaaacuauuuaauuuuuuaauuuau

SEQ ID NO: 36035 - RNA, 64 nt, hsa
gagcaggucucuggaagccauuuguuaaaaaaaaaaaaaaaaguuuuaaaaauaccuuuuaauu

SEQ ID NO: 36036 - RNA, 64 nt, hsa
cgagcaggucucuggaagccauuuguuaaaaaaaaaaaaaaaaguuuuaaaaauaccuuuuaau

SEQ ID NO: 36037 - RNA, 64 nt, hsa
ucgagcaggucucuggaagccauuuguuaaaaaaaaaaaaaaaaguuuuaaaaauaccuuuuaa

SEQ ID NO: 36038 - RNA, 64 nt, hsa
cucgagcaggucucuggaagccauuuguuaaaaaaaaaaaaaaaaguuuuaaaaauaccuuuua

SEQ ID NO: 36039 - RNA, 64 nt, hsa
acucgagcaggucucuggaagccauuuguuaaaaaaaaaaaaaaaaguuuuaaaaauaccuuuu

SEQ ID NO: 36040 - RNA, 64 nt, hsa
aacucgagcaggucucuggaagccauuuguuaaaaaaaaaaaaaaaaguuuuaaaaauaccuuu

SEQ ID NO: 36041 - RNA, 64 nt, hsa
aaacucgagcaggucucuggaagccauuuguuaaaaaaaaaaaaaaaaguuuuaaaaauaccuu

SEQ ID NO: 36042 - RNA, 64 nt, hsa
gaaacucgagcaggucucuggaagccauuuguuaaaaaaaaaaaaaaaaguuuuaaaaauaccu

SEQ ID NO: 36043 - RNA, 64 nt, hsa
ugaaacucgagcaggucucuggaagccauuuguuaaaaaaaaaaaaaaaaguuuuaaaaauacc

SEQ ID NO: 36044 - RNA, 64 nt, hsa
gccaaccugggucacauagcaagacucuguuucaaaaaaaaagggggggcgggggacggguggg

SEQ ID NO: 36045 - RNA, 64 nt, hsa
cgccaaccugggucacauagcaagacucuguuucaaaaaaaaagggggggcgggggacgggugg

SEQ ID NO: 36046 - RNA, 64 nt, hsa
ccugugagauagauguuuauggcaagaaaaaggaaaaaaaaauggaaaucugaccuauuguaua

SEQ ID NO: 36047 - RNA, 64 nt, hsa
gccugugagauagauguuuauggcaagaaaaaggaaaaaaaaauggaaaucugaccuauuguau

SEQ ID NO: 36048 - RNA, 64 nt, hsa
aaaaaaaaaagacaaaaaaaaaaaaaaagaaaagaaaaaaaaucucaucacuugaagccaccgg

SEQ ID NO: 36049 - RNA, 64 nt, hsa
acgaaauggaaaagaaaaaaaaaagacaaaaaaaaaaaaaaagaaaagaaaaaaaaucucauca

SEQ ID NO: 36050 - RNA, 64 nt, hsa
aacgaaauggaaaagaaaaaaaaaagacaaaaaaaaaaaaaaagaaaagaaaaaaaaucucauc

SEQ ID NO: 36051 - RNA, 64 nt, hsa
caacgaaauggaaaagaaaaaaaaaagacaaaaaaaaaaaaaaagaaaagaaaaaaaaucucau

SEQ ID NO: 36052 - RNA, 64 nt, hsa
ucaacgaaauggaaaagaaaaaaaaaagacaaaaaaaaaaaaaaagaaaagaaaaaaaaucuca

SEQ ID NO: 36053 - RNA, 64 nt, hsa
uucaacgaaauggaaaagaaaaaaaaaagacaaaaaaaaaaaaaaagaaaagaaaaaaaaucuc

SEQ ID NO: 36054 - RNA, 64 nt, hsa
uuucaacgaaauggaaaagaaaaaaaaaagacaaaaaaaaaaaaaaagaaaagaaaaaaaaucu

SEQ ID NO: 36055 - RNA, 64 nt, hsa
auuucaacgaaauggaaaagaaaaaaaaaagacaaaaaaaaaaaaaaagaaaagaaaaaaaauc

SEQ ID NO: 36056 - RNA, 64 nt, hsa
uauuucaacgaaauggaaaagaaaaaaaaaagacaaaaaaaaaaaaaaagaaaagaaaaaaaau

SEQ ID NO: 36057 - RNA, 64 nt, hsa
auugcuguaaauauuucaacgaaauggaaaagaaaaaaaaaagacaaaaaaaaaaaaaaagaaa

SEQ ID NO: 36058 - RNA, 64 nt, hsa
cauugcuguaaauauuucaacgaaauggaaaagaaaaaaaaaagacaaaaaaaaaaaaaaagaa

SEQ ID NO: 36059 - RNA, 64 nt, hsa
ccauugcuguaaauauuucaacgaaauggaaaagaaaaaaaaaagacaaaaaaaaaaaaaaaga

SEQ ID NO: 36060 - RNA, 64 nt, hsa
ugugggcaacagagugagaaccaucucuacccaaaaaaaaaauuaaaaauuagccaagcauggu

SEQ ID NO: 36061 - RNA, 64 nt, hsa
gugugggcaacagagugagaaccaucucuacccaaaaaaaaaauuaaaaauuagccaagcaugg

SEQ ID NO: 36062 - RNA, 64 nt, hsa
agugugggcaacagagugagaaccaucucuacccaaaaaaaaaauuaaaaauuagccaagcaug

SEQ ID NO: 36063 - RNA, 64 nt, hsa
caaccuggacaacauagcaagaccccaucucuuaaaaaaaaaggaaagaaaacuugaugugauu

SEQ ID NO: 36064 - RNA, 64 nt, hsa
ccaaccuggacaacauagcaagaccccaucucuuaaaaaaaaaggaaagaaaacuugaugugau

SEQ ID NO: 36065 - RNA, 64 nt, hsa
cagccuggguaacagagcgagacuccaucucaaaaaaaaaaacaaaacaaaaccaaguucccac

SEQ ID NO: 36066 - RNA, 64 nt, hsa
ccagccuggguaacagagcgagacuccaucucaaaaaaaaaaacaaaacaaaaccaaguuccca

SEQ ID NO: 36067 - RNA, 64 nt, hsa
uccagccuggguaacagagcgagacuccaucucaaaaaaaaaaacaaaacaaaaccaaguuccc

SEQ ID NO: 36068 - RNA, 64 nt, hsa
cuccagccuggguaacagagcgagacuccaucucaaaaaaaaaaacaaaacaaaaccaaguucc

SEQ ID NO: 36069 - RNA, 64 nt, hsa
ugggcaacauagcaagacccccaccaucucugaaaaaaaaaauuagccaggcaugguggugugc

SEQ ID NO: 36070 - RNA, 64 nt, hsa
cugggcaacauagcaagacccccaccaucucugaaaaaaaaaauuagccaggcaugguggugug

SEQ ID NO: 36071 - RNA, 64 nt, hsa
ccugggcaacauagcaagacccccaccaucucugaaaaaaaaaauuagccaggcaugguggugu

SEQ ID NO: 36072 - RNA, 64 nt, hsa
cuuguguugguuuuuuaaagaaaugggaagaagaaaaaaaaauucuccgccccuuuccucgauc

SEQ ID NO: 36073 - RNA, 64 nt, hsa
ucuuguguugguuuuuuaaagaaaugggaagaagaaaaaaaaauucuccgccccuuuccucgau

SEQ ID NO: 36074 - RNA, 64 nt, hsa
agaagauuaaaucagaauaguuguucuuuguuaaaaaaaaaauuagauucuuaaaguguggcaa

SEQ ID NO: 36075 - RNA, 64 nt, hsa
gagaagauuaaaucagaauaguuguucuuuguuaaaaaaaaaauuagauucuuaaaguguggca

SEQ ID NO: 36076 - RNA, 64 nt, hsa
ugagaagauuaaaucagaauaguuguucuuuguuaaaaaaaaaauuagauucuuaaaguguggc

SEQ ID NO: 36077 - RNA, 64 nt, hsa
gucuauuugaaaagguuaaaaaaaagaacaaaaaaaaaaaaagaacuuguacuguauuuccuaa

SEQ ID NO: 36078 - RNA, 64 nt, hsa
agucuauuugaaaagguuaaaaaaaagaacaaaaaaaaaaaaagaacuuguacuguauuuccua

SEQ ID NO: 36079 - RNA, 64 nt, hsa
aagucuauuugaaaagguuaaaaaaaagaacaaaaaaaaaaaaagaacuuguacuguauuuccu

SEQ ID NO: 36080 - RNA, 64 nt, hsa
uaagucuauuugaaaagguuaaaaaaaagaacaaaaaaaaaaaaagaacuuguacuguauuucc

SEQ ID NO: 36081 - RNA, 64 nt, hsa
uuaagucuauuugaaaagguuaaaaaaaagaacaaaaaaaaaaaaagaacuuguacuguauuuc

SEQ ID NO: 36082 - RNA, 64 nt, hsa
guuaagucuauuugaaaagguuaaaaaaaagaacaaaaaaaaaaaaagaacuuguacuguauuu

SEQ ID NO: 36083 - RNA, 64 nt, hsa
agugcucaaaggguuaagucuauuugaaaagguuaaaaaaaagaacaaaaaaaaaaaaagaacu

SEQ ID NO: 36084 - RNA, 64 nt, hsa
uguauauauuguauagauuucagacucucuuaugaaaaaaaaugugauugugguuaaaugaccu

SEQ ID NO: 36085 - RNA, 64 nt, hsa
caaaaaauuagcaacagagcgcgauuccgucucaaaaaaaaaguaacuuuuuaaaacuuucuau

SEQ ID NO: 36086 - RNA, 64 nt, hsa
acaaaaaauuagcaacagagcgcgauuccgucucaaaaaaaaaguaacuuuuuaaaacuuucua

SEQ ID NO: 36087 - RNA, 64 nt, hsa
ucacuguuuccuaagcaucagauaaucuaugcuaaaaaaaaaugaauauagaaaagcugcuucu

SEQ ID NO: 36088 - RNA, 64 nt, hsa
cucacuguuuccuaagcaucagauaaucuaugcuaaaaaaaaaugaauauagaaaagcugcuuc

SEQ ID NO: 36089 - RNA, 64 nt, hsa
ccagccugggugacagagugagacccugucucaaaaaaaaaauuuguuuuuugaauggguuuuu

SEQ ID NO: 36090 - RNA, 64 nt, hsa
uccagccugggugacagagugagacccugucucaaaaaaaaaauuuguuuuuugaauggguuuu

SEQ ID NO: 36091 - RNA, 64 nt, hsa
cuccagccugggugacagagugagacccugucucaaaaaaaaaauuuguuuuuugaauggguuu

SEQ ID NO: 36092 - RNA, 64 nt, hsa
uucaguauuucuaucaagaaagagaugcuacaaaaaaaaaaagaaaaaaccuuuauguauacag

SEQ ID NO: 36093 - RNA, 64 nt, hsa
auucaguauuucuaucaagaaagagaugcuacaaaaaaaaaaagaaaaaaccuuuauguauaca

SEQ ID NO: 36094 - RNA, 64 nt, hsa
cauucaguauuucuaucaagaaagagaugcuacaaaaaaaaaaagaaaaaaccuuuauguauac

SEQ ID NO: 36095 - RNA, 64 nt, hsa
ucauucaguauuucuaucaagaaagagaugcuacaaaaaaaaaaagaaaaaaccuuuauguaua

SEQ ID NO: 36096 - RNA, 64 nt, hsa
ccauagcuguucaucaccaugccuagcucauuuaaaaaaaaauuuuuuuagagauggggucuca

SEQ ID NO: 36097 - RNA, 64 nt, hsa
accauagcuguucaucaccaugccuagcucauuuaaaaaaaaauuuuuuuagagauggggucuc

SEQ ID NO: 36098 - RNA, 64 nt, hsa
aaccaagaaaaaaaaucaaucagaauaaacucaaaaaaaaaagguagggggagcaaaaccauca

SEQ ID NO: 36099 - RNA, 64 nt, hsa
aaaccaagaaaaaaaaucaaucagaauaaacucaaaaaaaaaagguagggggagcaaaaccauc

SEQ ID NO: 36100 - RNA, 64 nt, hsa
gaaaccaagaaaaaaaaucaaucagaauaaacucaaaaaaaaaagguagggggagcaaaaccau

SEQ ID NO: 36101 - RNA, 64 nt, hsa
cuguccccagagggugguuuauccagaaaccaagaaaaaaaaucaaucagaauaaacucaaaaa

SEQ ID NO: 36102 - RNA, 64 nt, hsa
gagaaagcaagacccuauaucaaugaaaaaaaaaaaaaaaaagaccagcuuugcagccagaagc

SEQ ID NO: 36103 - RNA, 64 nt, hsa
ugagaaagcaagacccuauaucaaugaaaaaaaaaaaaaaaaagaccagcuuugcagccagaag

SEQ ID NO: 36104 - RNA, 64 nt, hsa
gugagaaagcaagacccuauaucaaugaaaaaaaaaaaaaaaaagaccagcuuugcagccagaa

SEQ ID NO: 36105 - RNA, 64 nt, hsa
ggugagaaagcaagacccuauaucaaugaaaaaaaaaaaaaaaaagaccagcuuugcagccaga

SEQ ID NO: 36106 - RNA, 64 nt, hsa
gggugagaaagcaagacccuauaucaaugaaaaaaaaaaaaaaaaagaccagcuuugcagccag

SEQ ID NO: 36107 - RNA, 64 nt, hsa
ugggugagaaagcaagacccuauaucaaugaaaaaaaaaaaaaaaaagaccagcuuugcagcca

SEQ ID NO: 36108 - RNA, 64 nt, hsa
cugggugagaaagcaagacccuauaucaaugaaaaaaaaaaaaaaaaagaccagcuuugcagcc

SEQ ID NO: 36109 - RNA, 64 nt, hsa
ccugggugagaaagcaagacccuauaucaaugaaaaaaaaaaaaaaaaagaccagcuuugcagc

SEQ ID NO: 36110 - RNA, 64 nt, hsa
gccugggugagaaagcaagacccuauaucaaugaaaaaaaaaaaaaaaaagaccagcuuugcag

SEQ ID NO: 36111 - RNA, 64 nt, hsa
agccugggugagaaagcaagacccuauaucaaugaaaaaaaaaaaaaaaaagaccagcuuugca

SEQ ID NO: 36112 - RNA, 64 nt, hsa
agccugggugacagagcgagacccugucucaaaaaaaaaaaagaauuuggagaugguucugccc

SEQ ID NO: 36113 - RNA, 64 nt, hsa
cagccugggugacagagcgagacccugucucaaaaaaaaaaaagaauuuggagaugguucugcc

SEQ ID NO: 36114 - RNA, 64 nt, hsa
ccagccugggugacagagcgagacccugucucaaaaaaaaaaaagaauuuggagaugguucugc

SEQ ID NO: 36115 - RNA, 64 nt, hsa
uccagccugggugacagagcgagacccugucucaaaaaaaaaaaagaauuuggagaugguucug

SEQ ID NO: 36116 - RNA, 64 nt, hsa
cuccagccugggugacagagcgagacccugucucaaaaaaaaaaaagaauuuggagaugguucu

SEQ ID NO: 36117 - RNA, 64 nt, hsa
ggaccaggucaugcagcugaaagucuacguuaaaaaaaaaaaguuugggccaggcacaguggcu

SEQ ID NO: 36118 - RNA, 64 nt, hsa
gggaccaggucaugcagcugaaagucuacguuaaaaaaaaaaaguuugggccaggcacaguggc

SEQ ID NO: 36119 - RNA, 64 nt, hsa
ugggaccaggucaugcagcugaaagucuacguuaaaaaaaaaaaguuugggccaggcacagugg

SEQ ID NO: 36120 - RNA, 64 nt, hsa
cugggaccaggucaugcagcugaaagucuacguuaaaaaaaaaaaguuugggccaggcacagug

SEQ ID NO: 36121 - RNA, 62 nt, hsa
acaaacaaaaaaaaaccaaaaacaaaccaaaaaaaaaaaaaacccacaaaaucaaacaaacc

SEQ ID NO: 36122 - RNA, 63 nt, hsa
aacaaacaaaaaaaaaccaaaaacaaaccaaaaaaaaaaaaaacccacaaaaucaaacaaacc

SEQ ID NO: 36123 - RNA, 64 nt, hsa
aaacaaacaaaaaaaaaccaaaaacaaaccaaaaaaaaaaaaaacccacaaaaucaaacaaacc

SEQ ID NO: 36124 - RNA, 64 nt, hsa
aaaacaaacaaaaaaaaaccaaaaacaaaccaaaaaaaaaaaaaacccacaaaaucaaacaaac

SEQ ID NO: 36125 - RNA, 64 nt, hsa
aaaaacaaacaaaaaaaaaccaaaaacaaaccaaaaaaaaaaaaaacccacaaaaucaaacaaa

SEQ ID NO: 36126 - RNA, 64 nt, hsa
gaaaaacaaacaaaaaaaaaccaaaaacaaaccaaaaaaaaaaaaaacccacaaaaucaaacaa

SEQ ID NO: 36127 - RNA, 64 nt, hsa
ugaaaaacaaacaaaaaaaaaccaaaaacaaaccaaaaaaaaaaaaaacccacaaaaucaaaca

SEQ ID NO: 36128 - RNA, 64 nt, hsa
cugccccaaaggaaccagaggugaaaaacaaacaaaaaaaaaccaaaaacaaaccaaaaaaaaa

SEQ ID NO: 36129 - RNA, 64 nt, hsa
gcugccccaaaggaaccagaggugaaaaacaaacaaaaaaaaaccaaaaacaaaccaaaaaaaa

SEQ ID NO: 36130 - RNA, 64 nt, hsa
ggaaagaccaaaaaaacaaccaaccaaaaaaaaaaaaaaaaaggaaagaaacuaaccaacaaaa

SEQ ID NO: 36131 - RNA, 64 nt, hsa
aggaaagaccaaaaaaacaaccaaccaaaaaaaaaaaaaaaaaggaaagaaacuaaccaacaaa

SEQ ID NO: 36132 - RNA, 64 nt, hsa
gaggaaagaccaaaaaaacaaccaaccaaaaaaaaaaaaaaaaaggaaagaaacuaaccaacaa

SEQ ID NO: 36133 - RNA, 64 nt, hsa
ggaggaaagaccaaaaaaacaaccaaccaaaaaaaaaaaaaaaaaggaaagaaacuaaccaaca

SEQ ID NO: 36134 - RNA, 64 nt, hsa
gggaggaaagaccaaaaaaacaaccaaccaaaaaaaaaaaaaaaaaggaaagaaacuaaccaac

SEQ ID NO: 36135 - RNA, 64 nt, hsa
agggaggaaagaccaaaaaaacaaccaaccaaaaaaaaaaaaaaaaaggaaagaaacuaaccaa

SEQ ID NO: 36136 - RNA, 64 nt, hsa
aagggaggaaagaccaaaaaaacaaccaaccaaaaaaaaaaaaaaaaaggaaagaaacuaacca

SEQ ID NO: 36137 - RNA, 64 nt, hsa
caagggaggaaagaccaaaaaaacaaccaaccaaaaaaaaaaaaaaaaaggaaagaaacuaacc

SEQ ID NO: 36138 - RNA, 64 nt, hsa
acaagggaggaaagaccaaaaaaacaaccaaccaaaaaaaaaaaaaaaaaggaaagaaacuaac

SEQ ID NO: 36139 - RNA, 64 nt, hsa
gacaagggaggaaagaccaaaaaaacaaccaaccaaaaaaaaaaaaaaaaaggaaagaaacuaa

SEQ ID NO: 36140 - RNA, 64 nt, hsa
gcaacacagugagaccucaucuccacuaaaaauaaaaaaaaauuggcuggaugugguggggcau

SEQ ID NO: 36141 - RNA, 64 nt, hsa
ggcaacacagugagaccucaucuccacuaaaaauaaaaaaaaauuggcuggaugugguggggca

SEQ ID NO: 36142 - RNA, 64 nt, hsa
gaugugagccaccacacacaccaucugauuaaaaaaaaaaaauacugauuccuuguagcaaccc

SEQ ID NO: 36143 - RNA, 64 nt, hsa
agaugugagccaccacacacaccaucugauuaaaaaaaaaaaauacugauuccuuguagcaacc

SEQ ID NO: 36144 - RNA, 64 nt, hsa
cagaugugagccaccacacacaccaucugauuaaaaaaaaaaaauacugauuccuuguagcaac

SEQ ID NO: 36145 - RNA, 64 nt, hsa
acagaugugagccaccacacacaccaucugauuaaaaaaaaaaaauacugauuccuuguagcaa

SEQ ID NO: 36146 - RNA, 64 nt, hsa
uacagaugugagccaccacacacaccaucugauuaaaaaaaaaaaauacugauuccuuguagca

SEQ ID NO: 36147 - RNA, 64 nt, hsa
gggcuguuuguaguuuuuugccuuuuagacaagaaaaaaaaaucuuuccacucuuuaguuuuug

SEQ ID NO: 36148 - RNA, 64 nt, hsa
ugggcuguuuguaguuuuuugccuuuuagacaagaaaaaaaaaucuuuccacucuuuaguuuuu

SEQ ID NO: 36149 - RNA, 64 nt, hsa
cagccugggcagcagagcaacacucugucucaaaaaaaaaaagaaaagaaaagaaaaagccaga

SEQ ID NO: 36150 - RNA, 64 nt, hsa
ccagccugggcagcagagcaacacucugucucaaaaaaaaaaagaaaagaaaagaaaaagccag

SEQ ID NO: 36151 - RNA, 64 nt, hsa
uccagccugggcagcagagcaacacucugucucaaaaaaaaaaagaaaagaaaagaaaaagcca

SEQ ID NO: 36152 - RNA, 64 nt, hsa
cuccagccugggcagcagagcaacacucugucucaaaaaaaaaaagaaaagaaaagaaaaagcc

SEQ ID NO: 36153 - RNA, 64 nt, hsa
aggcaacagagacucugucucaaaaaaaaaaaaaaaaaaaaagaaacucccaggagacagcagc

SEQ ID NO: 36154 - RNA, 64 nt, hsa
uaggcaacagagacucugucucaaaaaaaaaaaaaaaaaaaaagaaacucccaggagacagcag

SEQ ID NO: 36155 - RNA, 64 nt, hsa
cuaggcaacagagacucugucucaaaaaaaaaaaaaaaaaaaaagaaacucccaggagacagca

SEQ ID NO: 36156 - RNA, 64 nt, hsa
ccuaggcaacagagacucugucucaaaaaaaaaaaaaaaaaaaaagaaacucccaggagacagc

SEQ ID NO: 36157 - RNA, 64 nt, hsa
gccuaggcaacagagacucugucucaaaaaaaaaaaaaaaaaaaaagaaacucccaggagacag

SEQ ID NO: 36158 - RNA, 64 nt, hsa
agccuaggcaacagagacucugucucaaaaaaaaaaaaaaaaaaaaagaaacucccaggagaca

SEQ ID NO: 36159 - RNA, 64 nt, hsa
cagccuaggcaacagagacucugucucaaaaaaaaaaaaaaaaaaaaagaaacucccaggagac

SEQ ID NO: 36160 - RNA, 64 nt, hsa
ccagccuaggcaacagagacucugucucaaaaaaaaaaaaaaaaaaaaagaaacucccaggaga

SEQ ID NO: 36161 - RNA, 64 nt, hsa
uccagccuaggcaacagagacucugucucaaaaaaaaaaaaaaaaaaaaagaaacucccaggag

SEQ ID NO: 36162 - RNA, 64 nt, hsa
cuccagccuaggcaacagagacucugucucaaaaaaaaaaaaaaaaaaaaagaaacucccagga

SEQ ID NO: 36163 - RNA, 64 nt, hsa
acuccagccuaggcaacagagacucugucucaaaaaaaaaaaaaaaaaaaaagaaacucccagg

SEQ ID NO: 36164 - RNA, 64 nt, hsa
cacuccagccuaggcaacagagacucugucucaaaaaaaaaaaaaaaaaaaaagaaacucccag

SEQ ID NO: 36165 - RNA, 64 nt, hsa
gcacuccagccuaggcaacagagacucugucucaaaaaaaaaaaaaaaaaaaaagaaacuccca

SEQ ID NO: 36166 - RNA, 64 nt, hsa
ugcacuccagccuaggcaacagagacucugucucaaaaaaaaaaaaaaaaaaaaagaaacuccc

SEQ ID NO: 36167 - RNA, 64 nt, hsa
aguccaagugguucccauuugaacauuuaaaaaaaaaaaaaaggcugggcaugguggcucacgc

SEQ ID NO: 36168 - RNA, 64 nt, hsa
aaguccaagugguucccauuugaacauuuaaaaaaaaaaaaaaggcugggcaugguggcucacg

SEQ ID NO: 36169 - RNA, 64 nt, hsa
caaguccaagugguucccauuugaacauuuaaaaaaaaaaaaaaggcugggcaugguggcucac

SEQ ID NO: 36170 - RNA, 64 nt, hsa
ccaaguccaagugguucccauuugaacauuuaaaaaaaaaaaaaaggcugggcaugguggcuca

SEQ ID NO: 36171 - RNA, 64 nt, hsa
accaaguccaagugguucccauuugaacauuuaaaaaaaaaaaaaaggcugggcaugguggcuc

SEQ ID NO: 36172 - RNA, 64 nt, hsa
gaccaaguccaagugguucccauuugaacauuuaaaaaaaaaaaaaaggcugggcaugguggcu

SEQ ID NO: 36173 - RNA, 64 nt, hsa
ggaccaaguccaagugguucccauuugaacauuuaaaaaaaaaaaaaaggcugggcaugguggc

SEQ ID NO: 36174 - RNA, 64 nt, hsa
uccagaacuuuccauuugcagugugcaacagaaaaaaaaaaaugaaguaaugugacucaaggcc

SEQ ID NO: 36175 - RNA, 64 nt, hsa
uuccagaacuuuccauuugcagugugcaacagaaaaaaaaaaaugaaguaaugugacucaaggc

SEQ ID NO: 36176 - RNA, 64 nt, hsa
cuuccagaacuuuccauuugcagugugcaacagaaaaaaaaaaaugaaguaaugugacucaagg

SEQ ID NO: 36177 - RNA, 64 nt, hsa
ucuuccagaacuuuccauuugcagugugcaacagaaaaaaaaaaaugaaguaaugugacucaag

SEQ ID NO: 36178 - RNA, 64 nt, hsa
gcuuauuuuaggauuacccacucaucagaaaaaaaaaaaaaagccuuuguguccccugauuugg

SEQ ID NO: 36179 - RNA, 64 nt, hsa
ugcuuauuuuaggauuacccacucaucagaaaaaaaaaaaaaagccuuuguguccccugauuug

SEQ ID NO: 36180 - RNA, 64 nt, hsa
cugcuuauuuuaggauuacccacucaucagaaaaaaaaaaaaaagccuuuguguccccugauuu

SEQ ID NO: 36181 - RNA, 64 nt, hsa
ccugcuuauuuuaggauuacccacucaucagaaaaaaaaaaaaaagccuuuguguccccugauu

SEQ ID NO: 36182 - RNA, 64 nt, hsa
uccugcuuauuuuaggauuacccacucaucagaaaaaaaaaaaaaagccuuuguguccccugau

SEQ ID NO: 36183 - RNA, 64 nt, hsa
uuccugcuuauuuuaggauuacccacucaucagaaaaaaaaaaaaaagccuuuguguccccuga

SEQ ID NO: 36184 - RNA, 64 nt, hsa
uuuccugcuuauuuuaggauuacccacucaucagaaaaaaaaaaaaaagccuuuguguccccug

SEQ ID NO: 36185 - RNA, 64 nt, hsa
gggcgacagugagaaucugucucaaaaaaaaaaaaaaaaaaaggauaucaaagcuggauggugg

SEQ ID NO: 36186 - RNA, 64 nt, hsa
ugggcgacagugagaaucugucucaaaaaaaaaaaaaaaaaaaggauaucaaagcuggauggug

SEQ ID NO: 36187 - RNA, 64 nt, hsa
cugggcgacagugagaaucugucucaaaaaaaaaaaaaaaaaaaggauaucaaagcuggauggu

SEQ ID NO: 36188 - RNA, 64 nt, hsa
ccugggcgacagugagaaucugucucaaaaaaaaaaaaaaaaaaaggauaucaaagcuggaugg

SEQ ID NO: 36189 - RNA, 64 nt, hsa
gccugggcgacagugagaaucugucucaaaaaaaaaaaaaaaaaaaggauaucaaagcuggaug

SEQ ID NO: 36190 - RNA, 64 nt, hsa
ggccugggcgacagugagaaucugucucaaaaaaaaaaaaaaaaaaaggauaucaaagcuggau

SEQ ID NO: 36191 - RNA, 64 nt, hsa
cggccugggcgacagugagaaucugucucaaaaaaaaaaaaaaaaaaaggauaucaaagcugga

SEQ ID NO: 36192 - RNA, 64 nt, hsa
ccggccugggcgacagugagaaucugucucaaaaaaaaaaaaaaaaaaaggauaucaaagcugg

SEQ ID NO: 36193 - RNA, 64 nt, hsa
uccggccugggcgacagugagaaucugucucaaaaaaaaaaaaaaaaaaaggauaucaaagcug

SEQ ID NO: 36194 - RNA, 64 nt, hsa
cuccggccugggcgacagugagaaucugucucaaaaaaaaaaaaaaaaaaaggauaucaaagcu

SEQ ID NO: 36195 - RNA, 64 nt, hsa
acuccggccugggcgacagugagaaucugucucaaaaaaaaaaaaaaaaaaaggauaucaaagc

SEQ ID NO: 36196 - RNA, 64 nt, hsa
cacuccggccugggcgacagugagaaucugucucaaaaaaaaaaaaaaaaaaaggauaucaaag

SEQ ID NO: 36197 - RNA, 64 nt, hsa
gccaccaugaccaacguguuucuuaauuuaaaaaaaaaaaaauagaccaggugcucuggcucau

SEQ ID NO: 36198 - RNA, 64 nt, hsa
agccaccaugaccaacguguuucuuaauuuaaaaaaaaaaaaauagaccaggugcucuggcuca

SEQ ID NO: 36199 - RNA, 64 nt, hsa
gagccaccaugaccaacguguuucuuaauuuaaaaaaaaaaaaauagaccaggugcucuggcuc

SEQ ID NO: 36200 - RNA, 64 nt, hsa
ugagccaccaugaccaacguguuucuuaauuuaaaaaaaaaaaaauagaccaggugcucuggcu

SEQ ID NO: 36201 - RNA, 64 nt, hsa
augagccaccaugaccaacguguuucuuaauuuaaaaaaaaaaaaauagaccaggugcucuggc

SEQ ID NO: 36202 - RNA, 64 nt, hsa
caugagccaccaugaccaacguguuucuuaauuuaaaaaaaaaaaaauagaccaggugcucugg

SEQ ID NO: 36203 - RNA, 64 nt, hsa
agcgagacuccaucucaaaaaaaaaaaaaaaaaaaaaaaaaagaaagugaugcacagaguggca

SEQ ID NO: 36204 - RNA, 64 nt, hsa
gagcgagacuccaucucaaaaaaaaaaaaaaaaaaaaaaaaaagaaagugaugcacagaguggc

SEQ ID NO: 36205 - RNA, 64 nt, hsa
agagcgagacuccaucucaaaaaaaaaaaaaaaaaaaaaaaaaagaaagugaugcacagagugg

SEQ ID NO: 36206 - RNA, 64 nt, hsa
cagagcgagacuccaucucaaaaaaaaaaaaaaaaaaaaaaaaaagaaagugaugcacagagug

SEQ ID NO: 36207 - RNA, 64 nt, hsa
acagagcgagacuccaucucaaaaaaaaaaaaaaaaaaaaaaaaaagaaagugaugcacagagu

SEQ ID NO: 36208 - RNA, 64 nt, hsa
gacagagcgagacuccaucucaaaaaaaaaaaaaaaaaaaaaaaaaagaaagugaugcacagag

SEQ ID NO: 36209 - RNA, 64 nt, hsa
ugacagagcgagacuccaucucaaaaaaaaaaaaaaaaaaaaaaaaaagaaagugaugcacaga

SEQ ID NO: 36210 - RNA, 64 nt, hsa
gugacagagcgagacuccaucucaaaaaaaaaaaaaaaaaaaaaaaaaagaaagugaugcacag

SEQ ID NO: 36211 - RNA, 64 nt, hsa
ggugacagagcgagacuccaucucaaaaaaaaaaaaaaaaaaaaaaaaaagaaagugaugcaca

SEQ ID NO: 36212 - RNA, 64 nt, hsa
gggugacagagcgagacuccaucucaaaaaaaaaaaaaaaaaaaaaaaaaagaaagugaugcac

SEQ ID NO: 36213 - RNA, 64 nt, hsa
ugggugacagagcgagacuccaucucaaaaaaaaaaaaaaaaaaaaaaaaaagaaagugaugca

SEQ ID NO: 36214 - RNA, 64 nt, hsa
cugggugacagagcgagacuccaucucaaaaaaaaaaaaaaaaaaaaaaaaaagaaagugaugc

SEQ ID NO: 36215 - RNA, 64 nt, hsa
ccugggugacagagcgagacuccaucucaaaaaaaaaaaaaaaaaaaaaaaaaagaaagugaug

SEQ ID NO: 36216 - RNA, 64 nt, hsa
gccugggugacagagcgagacuccaucucaaaaaaaaaaaaaaaaaaaaaaaaaagaaagugau

SEQ ID NO: 36217 - RNA, 64 nt, hsa
agccugggugacagagcgagacuccaucucaaaaaaaaaaaaaaaaaaaaaaaaaagaaaguga

SEQ ID NO: 36218 - RNA, 64 nt, hsa
cagccugggugacagagcgagacuccaucucaaaaaaaaaaaaaaaaaaaaaaaaaagaaagug

SEQ ID NO: 36219 - RNA, 64 nt, hsa
ccagccugggugacagagcgagacuccaucucaaaaaaaaaaaaaaaaaaaaaaaaaagaaagu

SEQ ID NO: 36220 - RNA, 64 nt, hsa
uccagccugggugacagagcgagacuccaucucaaaaaaaaaaaaaaaaaaaaaaaaaagaaag

SEQ ID NO: 36221 - RNA, 64 nt, hsa
cuccagccugggugacagagcgagacuccaucucaaaaaaaaaaaaaaaaaaaaaaaaaagaaa

SEQ ID NO: 36222 - RNA, 64 nt, hsa
ggcaaaaagagcaaaacuccaucuuaaaggaaaaaaaaaaaaugcaaugacuguggcaaacucc

SEQ ID NO: 36223 - RNA, 64 nt, hsa
gggcaaaaagagcaaaacuccaucuuaaaggaaaaaaaaaaaaugcaaugacuguggcaaacuc

SEQ ID NO: 36224 - RNA, 64 nt, hsa
ugggcaaaaagagcaaaacuccaucuuaaaggaaaaaaaaaaaaugcaaugacuguggcaaacu

SEQ ID NO: 36225 - RNA, 64 nt, hsa
cugggcaaaaagagcaaaacuccaucuuaaaggaaaaaaaaaaaaugcaaugacuguggcaaac

SEQ ID NO: 36226 - RNA, 64 nt, hsa
ccugggcaaaaagagcaaaacuccaucuuaaaggaaaaaaaaaaaaugcaaugacuguggcaaa

SEQ ID NO: 36227 - RNA, 64 nt, hsa
caggagugaaacuccaucuccaaaaaaaaaaaaaaaaaaaaaguaaccuuacaaaggagugcgg

SEQ ID NO: 36228 - RNA, 64 nt, hsa
acaggagugaaacuccaucuccaaaaaaaaaaaaaaaaaaaaaguaaccuuacaaaggagugcg

SEQ ID NO: 36229 - RNA, 64 nt, hsa
aacaggagugaaacuccaucuccaaaaaaaaaaaaaaaaaaaaaguaaccuuacaaaggagugc

SEQ ID NO: 36230 - RNA, 64 nt, hsa
caacaggagugaaacuccaucuccaaaaaaaaaaaaaaaaaaaaaguaaccuuacaaaggagug

SEQ ID NO: 36231 - RNA, 64 nt, hsa
gcaacaggagugaaacuccaucuccaaaaaaaaaaaaaaaaaaaaaguaaccuuacaaaggagu

SEQ ID NO: 36232 - RNA, 64 nt, hsa
ggcaacaggagugaaacuccaucuccaaaaaaaaaaaaaaaaaaaaaguaaccuuacaaaggag

SEQ ID NO: 36233 - RNA, 64 nt, hsa
gggcaacaggagugaaacuccaucuccaaaaaaaaaaaaaaaaaaaaaguaaccuuacaaagga

SEQ ID NO: 36234 - RNA, 64 nt, hsa
ugggcaacaggagugaaacuccaucuccaaaaaaaaaaaaaaaaaaaaaguaaccuuacaaagg

SEQ ID NO: 36235 - RNA, 64 nt, hsa
cugggcaacaggagugaaacuccaucuccaaaaaaaaaaaaaaaaaaaaaguaaccuuacaaag

SEQ ID NO: 36236 - RNA, 64 nt, hsa
ccugggcaacaggagugaaacuccaucuccaaaaaaaaaaaaaaaaaaaaaguaaccuuacaaa

SEQ ID NO: 36237 - RNA, 64 nt, hsa
gccugggcaacaggagugaaacuccaucuccaaaaaaaaaaaaaaaaaaaaaguaaccuuacaa

SEQ ID NO: 36238 - RNA, 64 nt, hsa
agccugggcaacaggagugaaacuccaucuccaaaaaaaaaaaaaaaaaaaaaguaaccuuaca

SEQ ID NO: 36239 - RNA, 64 nt, hsa
cagccugggcaacaggagugaaacuccaucuccaaaaaaaaaaaaaaaaaaaaaguaaccuuac

SEQ ID NO: 36240 - RNA, 64 nt, hsa
ccagccugggcaacaggagugaaacuccaucuccaaaaaaaaaaaaaaaaaaaaaguaaccuua

SEQ ID NO: 36241 - RNA, 64 nt, hsa
ccaagauggugaaacccugucucuacuaaaaauaaaaaaaaauuagccaggcaugguggcgggc

SEQ ID NO: 36242 - RNA, 64 nt, hsa
gccaagauggugaaacccugucucuacuaaaaauaaaaaaaaauuagccaggcaugguggcggg

SEQ ID NO: 36243 - RNA, 64 nt, hsa
ccagccuggguggccgagcgagacucccucucaaaaaaaaaaguuacauuuacacuacacuaca

SEQ ID NO: 36244 - RNA, 64 nt, hsa
uccagccuggguggccgagcgagacucccucucaaaaaaaaaaguuacauuuacacuacacuac

SEQ ID NO: 36245 - RNA, 64 nt, hsa
cuccagccuggguggccgagcgagacucccucucaaaaaaaaaaguuacauuuacacuacacua

SEQ ID NO: 36246 - RNA, 64 nt, hsa
cuggcuaacguggagaaaccccgucucuacuaaaaaaaaaaauuacaaaaaauuagccgggcau

SEQ ID NO: 36247 - RNA, 64 nt, hsa
ccuggcuaacguggagaaaccccgucucuacuaaaaaaaaaaauuacaaaaaauuagccgggca

SEQ ID NO: 36248 - RNA, 64 nt, hsa
uccuggcuaacguggagaaaccccgucucuacuaaaaaaaaaaauuacaaaaaauuagccgggc

SEQ ID NO: 36249 - RNA, 64 nt, hsa
auccuggcuaacguggagaaaccccgucucuacuaaaaaaaaaaauuacaaaaaauuagccggg

SEQ ID NO: 36250 - RNA, 64 nt, hsa
guucuuguuuccaaacaacaacaaaacaaaacaaaaaaaaaaccggauagaauaaugaccaaaa

SEQ ID NO: 36251 - RNA, 64 nt, hsa
aguucuuguuuccaaacaacaacaaaacaaaacaaaaaaaaaaccggauagaauaaugaccaaa

SEQ ID NO: 36252 - RNA, 64 nt, hsa
aaguucuuguuuccaaacaacaacaaaacaaaacaaaaaaaaaaccggauagaauaaugaccaa

SEQ ID NO: 36253 - RNA, 64 nt, hsa
uccuuuacuuucuuaacaaauuugcuuucacuuaaaaaaaaaccuuuaaguucaaggaagaaca

SEQ ID NO: 36254 - RNA, 64 nt, hsa
uuccuuuacuuucuuaacaaauuugcuuucacuuaaaaaaaaaccuuuaaguucaaggaagaac

SEQ ID NO: 36255 - RNA, 64 nt, hsa
uccagccugggugacagagcgagacuccauuucaaaaaaaaagacugaaacaagcuugugcuaa

SEQ ID NO: 36256 - RNA, 64 nt, hsa
cuccagccugggugacagagcgagacuccauuucaaaaaaaaagacugaaacaagcuugugcua

SEQ ID NO: 36257 - RNA, 64 nt, hsa
uuaagaaaaacaacaacaacaaaaaaagacaaugaaaaaaaaaacgucaugugagugaagagau

SEQ ID NO: 36258 - RNA, 64 nt, hsa
uaagaaaaacaacaacaacaaaaaaagacaaugaaaaaaaaaacgucaugugagugaagagaug

SEQ ID NO: 36259 - RNA, 64 nt, hsa
aagaaaaacaacaacaacaaaaaaagacaaugaaaaaaaaaacgucaugugagugaagagaugu

SEQ ID NO: 36260 - RNA, 64 nt, hsa
ccuuggaccaaauggaaauaaggcuuucugaugcaaaaaaaaaaaaaaaaaaaaaaaaaaaaag

SEQ ID NO: 36261 - RNA, 64 nt, hsa
cuuggaccaaauggaaauaaggcuuucugaugcaaaaaaaaaaaaaaaaaaaaaaaaaaaaaga

SEQ ID NO: 36262 - RNA, 64 nt, hsa
uuggaccaaauggaaauaaggcuuucugaugcaaaaaaaaaaaaaaaaaaaaaaaaaaaaagaa

SEQ ID NO: 36263 - RNA, 64 nt, hsa
uggaccaaauggaaauaaggcuuucugaugcaaaaaaaaaaaaaaaaaaaaaaaaaaaaagaau

SEQ ID NO: 36264 - RNA, 64 nt, hsa
ggaccaaauggaaauaaggcuuucugaugcaaaaaaaaaaaaaaaaaaaaaaaaaaaaagaaua

SEQ ID NO: 36265 - RNA, 64 nt, hsa
gaccaaauggaaauaaggcuuucugaugcaaaaaaaaaaaaaaaaaaaaaaaaaaaaagaauaa

SEQ ID NO: 36266 - RNA, 64 nt, hsa
accaaauggaaauaaggcuuucugaugcaaaaaaaaaaaaaaaaaaaaaaaaaaaaagaauaag

SEQ ID NO: 36267 - RNA, 64 nt, hsa
ccaaauggaaauaaggcuuucugaugcaaaaaaaaaaaaaaaaaaaaaaaaaaaaagaauaaga

SEQ ID NO: 36268 - RNA, 64 nt, hsa
caaauggaaauaaggcuuucugaugcaaaaaaaaaaaaaaaaaaaaaaaaaaaaagaauaagag

SEQ ID NO: 36269 - RNA, 64 nt, hsa
aaauggaaauaaggcuuucugaugcaaaaaaaaaaaaaaaaaaaaaaaaaaaaagaauaagagg

SEQ ID NO: 36270 - RNA, 64 nt, hsa
aauggaaauaaggcuuucugaugcaaaaaaaaaaaaaaaaaaaaaaaaaaaaagaauaagaggu

SEQ ID NO: 36271 - RNA, 64 nt, hsa
auggaaauaaggcuuucugaugcaaaaaaaaaaaaaaaaaaaaaaaaaaaaagaauaagaggug

SEQ ID NO: 36272 - RNA, 64 nt, hsa
uggaaauaaggcuuucugaugcaaaaaaaaaaaaaaaaaaaaaaaaaaaaagaauaagagguga

SEQ ID NO: 36273 - RNA, 64 nt, hsa
ggaaauaaggcuuucugaugcaaaaaaaaaaaaaaaaaaaaaaaaaaaaagaauaagaggugau

SEQ ID NO: 36274 - RNA, 64 nt, hsa
gaaauaaggcuuucugaugcaaaaaaaaaaaaaaaaaaaaaaaaaaaaagaauaagaggugaua

SEQ ID NO: 36275 - RNA, 64 nt, hsa
aaauaaggcuuucugaugcaaaaaaaaaaaaaaaaaaaaaaaaaaaaagaauaagaggugauau

SEQ ID NO: 36276 - RNA, 64 nt, hsa
aauaaggcuuucugaugcaaaaaaaaaaaaaaaaaaaaaaaaaaaaagaauaagaggugauauu

SEQ ID NO: 36277 - RNA, 64 nt, hsa
auaaggcuuucugaugcaaaaaaaaaaaaaaaaaaaaaaaaaaaaagaauaagaggugauauua

SEQ ID NO: 36278 - RNA, 64 nt, hsa
uaaggcuuucugaugcaaaaaaaaaaaaaaaaaaaaaaaaaaaaagaauaagaggugauauuac

SEQ ID NO: 36279 - RNA, 64 nt, hsa
aaggcuuucugaugcaaaaaaaaaaaaaaaaaaaaaaaaaaaaagaauaagaggugauauuaca

SEQ ID NO: 36280 - RNA, 64 nt, hsa
aggcuuucugaugcaaaaaaaaaaaaaaaaaaaaaaaaaaaaagaauaagaggugauauuacac

SEQ ID NO: 36281 - RNA, 64 nt, hsa
ggcuuucugaugcaaaaaaaaaaaaaaaaaaaaaaaaaaaaagaauaagaggugauauuacacc

SEQ ID NO: 36282 - RNA, 64 nt, hsa
caaccuugggcaacauagcaagaccccauuucuuaaaaaaaaaaaaaaaaaauuuaaacuuagc

SEQ ID NO: 36283 - RNA, 64 nt, hsa
aaccuugggcaacauagcaagaccccauuucuuaaaaaaaaaaaaaaaaaauuuaaacuuagcu

SEQ ID NO: 36284 - RNA, 64 nt, hsa
accuugggcaacauagcaagaccccauuucuuaaaaaaaaaaaaaaaaaauuuaaacuuagcug

SEQ ID NO: 36285 - RNA, 64 nt, hsa
ccuugggcaacauagcaagaccccauuucuuaaaaaaaaaaaaaaaaaauuuaaacuuagcugg

SEQ ID NO: 36286 - RNA, 64 nt, hsa
cuugggcaacauagcaagaccccauuucuuaaaaaaaaaaaaaaaaaauuuaaacuuagcuggg

SEQ ID NO: 36287 - RNA, 64 nt, hsa
uugggcaacauagcaagaccccauuucuuaaaaaaaaaaaaaaaaaauuuaaacuuagcugggu

SEQ ID NO: 36288 - RNA, 64 nt, hsa
ugggcaacauagcaagaccccauuucuuaaaaaaaaaaaaaaaaaauuuaaacuuagcugggua

SEQ ID NO: 36289 - RNA, 64 nt, hsa
gggcaacauagcaagaccccauuucuuaaaaaaaaaaaaaaaaaauuuaaacuuagcuggguau

SEQ ID NO: 36290 - RNA, 64 nt, hsa
ggcaacauagcaagaccccauuucuuaaaaaaaaaaaaaaaaaauuuaaacuuagcuggguaug

SEQ ID NO: 36291 - RNA, 64 nt, hsa
gcaacauagcaagaccccauuucuuaaaaaaaaaaaaaaaaaauuuaaacuuagcuggguaugg

SEQ ID NO: 36292 - RNA, 64 nt, hsa
caacauagcaagaccccauuucuuaaaaaaaaaaaaaaaaaauuuaaacuuagcuggguauggu

SEQ ID NO: 36293 - RNA, 64 nt, hsa
cugggcaauaaaguaacucuugacucaaaaaaauaaaaaaaauuguagugguagccauguguua

SEQ ID NO: 36294 - RNA, 64 nt, hsa
gauacuguagugauucaaauaaguuuucuauuugaaaaaaaaaaucacuugauuguauccuugc

SEQ ID NO: 36295 - RNA, 64 nt, hsa
auacuguagugauucaaauaaguuuucuauuugaaaaaaaaaaucacuugauuguauccuugcc

SEQ ID NO: 36296 - RNA, 64 nt, hsa
uacuguagugauucaaauaaguuuucuauuugaaaaaaaaaaucacuugauuguauccuugccc

SEQ ID NO: 36297 - RNA, 64 nt, hsa
gcuuaguucaaacauaaggaaacaguguuugauuaaaaaaaacacaucuaguaagacguaaggg

SEQ ID NO: 36298 - RNA, 64 nt, hsa
ggauuggacguugugacucuugccuuuuaagaagaaaaaaaagauaggacaaaguauuugaagc

SEQ ID NO: 36299 - RNA, 64 nt, hsa
uauuauucaagcugcaagucaucaaaagacccagaaaaaaaaaagucuguagguuauuuucucu

SEQ ID NO: 36300 - RNA, 64 nt, hsa
auuauucaagcugcaagucaucaaaagacccagaaaaaaaaaagucuguagguuauuuucucua

SEQ ID NO: 36301 - RNA, 64 nt, hsa
uuauucaagcugcaagucaucaaaagacccagaaaaaaaaaagucuguagguuauuuucucuac

SEQ ID NO: 36302 - RNA, 64 nt, hsa
cuuuauuucugucauucaaaugggugauauccugaaaaaaaaaaaaaaaaaaaaacugggacag

SEQ ID NO: 36303 - RNA, 64 nt, hsa
uuuauuucugucauucaaaugggugauauccugaaaaaaaaaaaaaaaaaaaaacugggacagc

SEQ ID NO: 36304 - RNA, 64 nt, hsa
uuauuucugucauucaaaugggugauauccugaaaaaaaaaaaaaaaaaaaaacugggacagcu

SEQ ID NO: 36305 - RNA, 64 nt, hsa
uauuucugucauucaaaugggugauauccugaaaaaaaaaaaaaaaaaaaaacugggacagcuu

SEQ ID NO: 36306 - RNA, 64 nt, hsa
auuucugucauucaaaugggugauauccugaaaaaaaaaaaaaaaaaaaaacugggacagcuuu

SEQ ID NO: 36307 - RNA, 64 nt, hsa
uuucugucauucaaaugggugauauccugaaaaaaaaaaaaaaaaaaaaacugggacagcuuuc

SEQ ID NO: 36308 - RNA, 64 nt, hsa
uucugucauucaaaugggugauauccugaaaaaaaaaaaaaaaaaaaaacugggacagcuuucc

SEQ ID NO: 36309 - RNA, 64 nt, hsa
ucugucauucaaaugggugauauccugaaaaaaaaaaaaaaaaaaaaacugggacagcuuuccc

SEQ ID NO: 36310 - RNA, 64 nt, hsa
cugucauucaaaugggugauauccugaaaaaaaaaaaaaaaaaaaaacugggacagcuuucccc

SEQ ID NO: 36311 - RNA, 64 nt, hsa
ugucauucaaaugggugauauccugaaaaaaaaaaaaaaaaaaaaacugggacagcuuuccccu

SEQ ID NO: 36312 - RNA, 64 nt, hsa
gucauucaaaugggugauauccugaaaaaaaaaaaaaaaaaaaaacugggacagcuuuccccuc

SEQ ID NO: 36313 - RNA, 64 nt, hsa
ucauucaaaugggugauauccugaaaaaaaaaaaaaaaaaaaaacugggacagcuuuccccuca

SEQ ID NO: 36314 - RNA, 64 nt, hsa
cauucaaaugggugauauccugaaaaaaaaaaaaaaaaaaaaacugggacagcuuuccccucau

SEQ ID NO: 36315 - RNA, 64 nt, hsa
auucaaaugggugauauccugaaaaaaaaaaaaaaaaaaaaacugggacagcuuuccccucauu

SEQ ID NO: 36316 - RNA, 64 nt, hsa
uuucuggggcuccucacauagcuacccaaaagagaaaaaaaauuaagacaagccuggcaacaca

SEQ ID NO: 36317 - RNA, 64 nt, hsa
uguacuugucuuacagaaauuucugaacuuuaguaaaaaaaaauaaaguuaaacuuuuaaaacu

SEQ ID NO: 36318 - RNA, 64 nt, hsa
guacuugucuuacagaaauuucugaacuuuaguaaaaaaaaauaaaguuaaacuuuuaaaacuc

SEQ ID NO: 36319 - RNA, 64 nt, hsa
uuccagccugggcaacagagcgagacuccaucucaaaaaaaaggagacuucaugugcccccaau

SEQ ID NO: 36320 - RNA, 64 nt, hsa
aaauguucauuaauaaaguuguuggacgggaagcaaaaaaaaaaaguuguuuaagauaaauucc

SEQ ID NO: 36321 - RNA, 64 nt, hsa
aauguucauuaauaaaguuguuggacgggaagcaaaaaaaaaaaguuguuuaagauaaauuccc

SEQ ID NO: 36322 - RNA, 64 nt, hsa
auguucauuaauaaaguuguuggacgggaagcaaaaaaaaaaaguuguuuaagauaaauuccca

SEQ ID NO: 36323 - RNA, 64 nt, hsa
uguucauuaauaaaguuguuggacgggaagcaaaaaaaaaaaguuguuuaagauaaauucccag

SEQ ID NO: 36324 - RNA, 64 nt, hsa
uuccagccugggugacagagugagacucccccucaaaaaaaaaaaaaaaaaaaaaaaaaacaga

SEQ ID NO: 36325 - RNA, 64 nt, hsa
uccagccugggugacagagugagacucccccucaaaaaaaaaaaaaaaaaaaaaaaaaacagaa

SEQ ID NO: 36326 - RNA, 64 nt, hsa
ccagccugggugacagagugagacucccccucaaaaaaaaaaaaaaaaaaaaaaaaaacagaaa

SEQ ID NO: 36327 - RNA, 64 nt, hsa
cagccugggugacagagugagacucccccucaaaaaaaaaaaaaaaaaaaaaaaaaacagaaag

SEQ ID NO: 36328 - RNA, 64 nt, hsa
agccugggugacagagugagacucccccucaaaaaaaaaaaaaaaaaaaaaaaaaacagaaaga

SEQ ID NO: 36329 - RNA, 64 nt, hsa
gccugggugacagagugagacucccccucaaaaaaaaaaaaaaaaaaaaaaaaaacagaaagaa

SEQ ID NO: 36330 - RNA, 64 nt, hsa
ccugggugacagagugagacucccccucaaaaaaaaaaaaaaaaaaaaaaaaaacagaaagaaa

SEQ ID NO: 36331 - RNA, 64 nt, hsa
cugggugacagagugagacucccccucaaaaaaaaaaaaaaaaaaaaaaaaaacagaaagaaag

SEQ ID NO: 36332 - RNA, 64 nt, hsa
ugggugacagagugagacucccccucaaaaaaaaaaaaaaaaaaaaaaaaaacagaaagaaaga

SEQ ID NO: 36333 - RNA, 64 nt, hsa
gggugacagagugagacucccccucaaaaaaaaaaaaaaaaaaaaaaaaaacagaaagaaagaa

SEQ ID NO: 36334 - RNA, 64 nt, hsa
ggugacagagugagacucccccucaaaaaaaaaaaaaaaaaaaaaaaaaacagaaagaaagaaa

SEQ ID NO: 36335 - RNA, 64 nt, hsa
gugacagagugagacucccccucaaaaaaaaaaaaaaaaaaaaaaaaaacagaaagaaagaaaa

SEQ ID NO: 36336 - RNA, 64 nt, hsa
ugacagagugagacucccccucaaaaaaaaaaaaaaaaaaaaaaaaaacagaaagaaagaaaaa

SEQ ID NO: 36337 - RNA, 64 nt, hsa
gacagagugagacucccccucaaaaaaaaaaaaaaaaaaaaaaaaaacagaaagaaagaaaaag

SEQ ID NO: 36338 - RNA, 64 nt, hsa
acagagugagacucccccucaaaaaaaaaaaaaaaaaaaaaaaaaacagaaagaaagaaaaaga

SEQ ID NO: 36339 - RNA, 64 nt, hsa
cagagugagacucccccucaaaaaaaaaaaaaaaaaaaaaaaaaacagaaagaaagaaaaagaa

SEQ ID NO: 36340 - RNA, 64 nt, hsa
agagugagacucccccucaaaaaaaaaaaaaaaaaaaaaaaaaacagaaagaaagaaaaagaaa

SEQ ID NO: 36341 - RNA, 64 nt, hsa
gagugagacucccccucaaaaaaaaaaaaaaaaaaaaaaaaaacagaaagaaagaaaaagaaaa

SEQ ID NO: 36342 - RNA, 64 nt, hsa
agugagacucccccucaaaaaaaaaaaaaaaaaaaaaaaaaacagaaagaaagaaaaagaaaac

SEQ ID NO: 36343 - RNA, 64 nt, hsa
cuccagccugggcaacagagcaaaacucugucucaaaaaaaaaaaaaaaaaggcaaaauuaaag

SEQ ID NO: 36344 - RNA, 64 nt, hsa
uccagccugggcaacagagcaaaacucugucucaaaaaaaaaaaaaaaaaggcaaaauuaaaga

SEQ ID NO: 36345 - RNA, 64 nt, hsa
ccagccugggcaacagagcaaaacucugucucaaaaaaaaaaaaaaaaaggcaaaauuaaagaa

SEQ ID NO: 36346 - RNA, 64 nt, hsa
cagccugggcaacagagcaaaacucugucucaaaaaaaaaaaaaaaaaggcaaaauuaaagaau

SEQ ID NO: 36347 - RNA, 64 nt, hsa
agccugggcaacagagcaaaacucugucucaaaaaaaaaaaaaaaaaggcaaaauuaaagaauu

SEQ ID NO: 36348 - RNA, 64 nt, hsa
gccugggcaacagagcaaaacucugucucaaaaaaaaaaaaaaaaaggcaaaauuaaagaauuu

SEQ ID NO: 36349 - RNA, 64 nt, hsa
ccugggcaacagagcaaaacucugucucaaaaaaaaaaaaaaaaaggcaaaauuaaagaauuuc

SEQ ID NO: 36350 - RNA, 64 nt, hsa
cugggcaacagagcaaaacucugucucaaaaaaaaaaaaaaaaaggcaaaauuaaagaauuuca

SEQ ID NO: 36351 - RNA, 64 nt, hsa
ugggcaacagagcaaaacucugucucaaaaaaaaaaaaaaaaaggcaaaauuaaagaauuucaa

SEQ ID NO: 36352 - RNA, 64 nt, hsa
gggcaacagagcaaaacucugucucaaaaaaaaaaaaaaaaaggcaaaauuaaagaauuucaag

SEQ ID NO: 36353 - RNA, 64 nt, hsa
ccaaaugguuguuuuaucauugguuugguuuaccaaaaaaaaggcagggaaaaaaaaaaaaaac

SEQ ID NO: 36354 - RNA, 64 nt, hsa
aucauugguuugguuuaccaaaaaaaaggcagggaaaaaaaaaaaaaacaaccguaugagcgca

SEQ ID NO: 36355 - RNA, 64 nt, hsa
ucauugguuugguuuaccaaaaaaaaggcagggaaaaaaaaaaaaaacaaccguaugagcgcau

SEQ ID NO: 36356 - RNA, 64 nt, hsa
cauugguuugguuuaccaaaaaaaaggcagggaaaaaaaaaaaaaacaaccguaugagcgcauu

SEQ ID NO: 36357 - RNA, 64 nt, hsa
auugguuugguuuaccaaaaaaaaggcagggaaaaaaaaaaaaaacaaccguaugagcgcauug

SEQ ID NO: 36358 - RNA, 64 nt, hsa
uugguuugguuuaccaaaaaaaaggcagggaaaaaaaaaaaaaacaaccguaugagcgcauugg

SEQ ID NO: 36359 - RNA, 64 nt, hsa
ugguuugguuuaccaaaaaaaaggcagggaaaaaaaaaaaaaacaaccguaugagcgcauuggc

SEQ ID NO: 36360 - RNA, 64 nt, hsa
gguuugguuuaccaaaaaaaaggcagggaaaaaaaaaaaaaacaaccguaugagcgcauuggcu

SEQ ID NO: 36361 - RNA, 64 nt, hsa
ucaagaacaauucacaguaugagaagaaaaauggaaaaaaaaaacuuuauuuaaaaaagaaaaa

SEQ ID NO: 36362 - RNA, 64 nt, hsa
caagaacaauucacaguaugagaagaaaaauggaaaaaaaaaacuuuauuuaaaaaagaaaaaa

SEQ ID NO: 36363 - RNA, 64 nt, hsa
aagaacaauucacaguaugagaagaaaaauggaaaaaaaaaacuuuauuuaaaaaagaaaaaag

SEQ ID NO: 36364 - RNA, 64 nt, hsa
acucuguacccucaacauauaucccuugugcgauaaaaaaaaaaaaaaaaaaaaaaagagaauc

SEQ ID NO: 36365 - RNA, 64 nt, hsa
cucuguacccucaacauauaucccuugugcgauaaaaaaaaaaaaaaaaaaaaaaagagaaucg

SEQ ID NO: 36366 - RNA, 64 nt, hsa
ucuguacccucaacauauaucccuugugcgauaaaaaaaaaaaaaaaaaaaaaaagagaaucgu

SEQ ID NO: 36367 - RNA, 64 nt, hsa
cuguacccucaacauauaucccuugugcgauaaaaaaaaaaaaaaaaaaaaaaagagaaucgua

SEQ ID NO: 36368 - RNA, 64 nt, hsa
uguacccucaacauauaucccuugugcgauaaaaaaaaaaaaaaaaaaaaaaagagaaucguac

SEQ ID NO: 36369 - RNA, 64 nt, hsa
guacccucaacauauaucccuugugcgauaaaaaaaaaaaaaaaaaaaaaaagagaaucguacg

SEQ ID NO: 36370 - RNA, 64 nt, hsa
uacccucaacauauaucccuugugcgauaaaaaaaaaaaaaaaaaaaaaaagagaaucguacgu

SEQ ID NO: 36371 - RNA, 64 nt, hsa
acccucaacauauaucccuugugcgauaaaaaaaaaaaaaaaaaaaaaaagagaaucguacguc

SEQ ID NO: 36372 - RNA, 64 nt, hsa
cccucaacauauaucccuugugcgauaaaaaaaaaaaaaaaaaaaaaaagagaaucguacgucg

SEQ ID NO: 36373 - RNA, 64 nt, hsa
ccucaacauauaucccuugugcgauaaaaaaaaaaaaaaaaaaaaaaagagaaucguacgucga

SEQ ID NO: 36374 - RNA, 64 nt, hsa
cucaacauauaucccuugugcgauaaaaaaaaaaaaaaaaaaaaaaagagaaucguacgucgac

SEQ ID NO: 36375 - RNA, 64 nt, hsa
ucaacauauaucccuugugcgauaaaaaaaaaaaaaaaaaaaaaaagagaaucguacgucgacu

SEQ ID NO: 36376 - RNA, 64 nt, hsa
caacauauaucccuugugcgauaaaaaaaaaaaaaaaaaaaaaaagagaaucguacgucgacuu

SEQ ID NO: 36377 - RNA, 64 nt, hsa
aacauauaucccuugugcgauaaaaaaaaaaaaaaaaaaaaaaagagaaucguacgucgacuuu

SEQ ID NO: 36378 - RNA, 64 nt, hsa
acauauaucccuugugcgauaaaaaaaaaaaaaaaaaaaaaaagagaaucguacgucgacuuuc

SEQ ID NO: 36379 - RNA, 64 nt, hsa
cauauaucccuugugcgauaaaaaaaaaaaaaaaaaaaaaaagagaaucguacgucgacuuucg

SEQ ID NO: 36380 - RNA, 64 nt, hsa
aaagaaaaauuuaugcacugauuuaaaacaaaccaaaaaaaaagaaaaaaacaaaaaaaaaaau

SEQ ID NO: 36381 - RNA, 64 nt, hsa
aagaaaaauuuaugcacugauuuaaaacaaaccaaaaaaaaagaaaaaaacaaaaaaaaaaauc

SEQ ID NO: 36382 - RNA, 64 nt, hsa
ugauuuaaaacaaaccaaaaaaaaagaaaaaaacaaaaaaaaaaaucccuccuuucuagcugaa

SEQ ID NO: 36383 - RNA, 64 nt, hsa
gauuuaaaacaaaccaaaaaaaaagaaaaaaacaaaaaaaaaaaucccuccuuucuagcugaac

SEQ ID NO: 36384 - RNA, 64 nt, hsa
auuuaaaacaaaccaaaaaaaaagaaaaaaacaaaaaaaaaaaucccuccuuucuagcugaaca

SEQ ID NO: 36385 - RNA, 64 nt, hsa
uuuaaaacaaaccaaaaaaaaagaaaaaaacaaaaaaaaaaaucccuccuuucuagcugaacaa

SEQ ID NO: 36386 - RNA, 64 nt, hsa
ugccuucaagaaacaaugaccugauucugucuuuaaaaaaaaaaaucucagaauucuuuuuuug

SEQ ID NO: 36387 - RNA, 64 nt, hsa
gccuucaagaaacaaugaccugauucugucuuuaaaaaaaaaaaucucagaauucuuuuuuugu

SEQ ID NO: 36388 - RNA, 64 nt, hsa
ccuucaagaaacaaugaccugauucugucuuuaaaaaaaaaaaucucagaauucuuuuuuuguu

SEQ ID NO: 36389 - RNA, 64 nt, hsa
cuucaagaaacaaugaccugauucugucuuuaaaaaaaaaaaucucagaauucuuuuuuuguuu

SEQ ID NO: 36390 - RNA, 64 nt, hsa
gcaacauggcaaaaucccaucucuacaaaacaucaaaaaaaaaaaaaauuagucgggcauggug

SEQ ID NO: 36391 - RNA, 64 nt, hsa
caacauggcaaaaucccaucucuacaaaacaucaaaaaaaaaaaaaauuagucgggcauggugg

SEQ ID NO: 36392 - RNA, 64 nt, hsa
aacauggcaaaaucccaucucuacaaaacaucaaaaaaaaaaaaaauuagucgggcaugguggu

SEQ ID NO: 36393 - RNA, 64 nt, hsa
acauggcaaaaucccaucucuacaaaacaucaaaaaaaaaaaaaauuagucgggcaugguggug

SEQ ID NO: 36394 - RNA, 64 nt, hsa
cauggcaaaaucccaucucuacaaaacaucaaaaaaaaaaaaaauuagucgggcaugguggugc

SEQ ID NO: 36395 - RNA, 64 nt, hsa
auggcaaaaucccaucucuacaaaacaucaaaaaaaaaaaaaauuagucgggcaugguggugca

SEQ ID NO: 36396 - RNA, 64 nt, hsa
uggcaaaaucccaucucuacaaaacaucaaaaaaaaaaaaaauuagucgggcaugguggugcac

SEQ ID NO: 36397 - RNA, 64 nt, hsa
gcagugauaguugacuuuggauacaagguuuggcaaaaaaaaaaauauuaacaaaauauucugu

SEQ ID NO: 36398 - RNA, 64 nt, hsa
cagugauaguugacuuuggauacaagguuuggcaaaaaaaaaaauauuaacaaaauauucugua

SEQ ID NO: 36399 - RNA, 64 nt, hsa
agugauaguugacuuuggauacaagguuuggcaaaaaaaaaaauauuaacaaaauauucuguaa

SEQ ID NO: 36400 - RNA, 64 nt, hsa
gugauaguugacuuuggauacaagguuuggcaaaaaaaaaaauauuaacaaaauauucuguaag

SEQ ID NO: 36401 - RNA, 64 nt, hsa
uggggggaaagaauagauauggggaaauaaacuuaaaaaaaaaucaggaauuuaaaaaaacgag

SEQ ID NO: 36402 - RNA, 64 nt, hsa
ggggggaaagaauagauauggggaaauaaacuuaaaaaaaaaucaggaauuuaaaaaaacgagc

SEQ ID NO: 36403 - RNA, 64 nt, hsa
uaucuuucuugacuuuaaaaaaauuauuaaaaacaaaaaaaaaauaaauuuuuuugcaauccuu

SEQ ID NO: 36404 - RNA, 64 nt, hsa
aucuuucuugacuuuaaaaaaauuauuaaaaacaaaaaaaaaauaaauuuuuuugcaauccuuu

SEQ ID NO: 36405 - RNA, 64 nt, hsa
ucuuucuugacuuuaaaaaaauuauuaaaaacaaaaaaaaaauaaauuuuuuugcaauccuuuc

SEQ ID NO: 36406 - RNA, 64 nt, hsa
cauccuggcuggucugucuuuucuccauuuguuuaaaaaaaaaacaaaaacaaaaaacaacacu

SEQ ID NO: 36407 - RNA, 64 nt, hsa
auccuggcuggucugucuuuucuccauuuguuuaaaaaaaaaacaaaaacaaaaaacaacacuu

SEQ ID NO: 36408 - RNA, 64 nt, hsa
uccuggcuggucugucuuuucuccauuuguuuaaaaaaaaaacaaaaacaaaaaacaacacuuu

SEQ ID NO: 36409 - RNA, 64 nt, hsa
uuuugauaccuugggaauuucuaugcagggcuuuaaaaaaaaauaagugauucaauuuuaaaaa

SEQ ID NO: 36410 - RNA, 64 nt, hsa
uuugauaccuugggaauuucuaugcagggcuuuaaaaaaaaauaagugauucaauuuuaaaaau

SEQ ID NO: 36411 - RNA, 64 nt, hsa
cuccagccugggugacagagcgaggcuccgucucaaaaaaaaaaaaaaaaaauuguuuuagcgc

SEQ ID NO: 36412 - RNA, 64 nt, hsa
uccagccugggugacagagcgaggcuccgucucaaaaaaaaaaaaaaaaaauuguuuuagcgcu

SEQ ID NO: 36413 - RNA, 64 nt, hsa
ccagccugggugacagagcgaggcuccgucucaaaaaaaaaaaaaaaaaauuguuuuagcgcug

SEQ ID NO: 36414 - RNA, 64 nt, hsa
cagccugggugacagagcgaggcuccgucucaaaaaaaaaaaaaaaaaauuguuuuagcgcugg

SEQ ID NO: 36415 - RNA, 64 nt, hsa
agccugggugacagagcgaggcuccgucucaaaaaaaaaaaaaaaaaauuguuuuagcgcuggg

SEQ ID NO: 36416 - RNA, 64 nt, hsa
gccugggugacagagcgaggcuccgucucaaaaaaaaaaaaaaaaaauuguuuuagcgcugggu

SEQ ID NO: 36417 - RNA, 64 nt, hsa
ccugggugacagagcgaggcuccgucucaaaaaaaaaaaaaaaaaauuguuuuagcgcuggguu

SEQ ID NO: 36418 - RNA, 64 nt, hsa
cugggugacagagcgaggcuccgucucaaaaaaaaaaaaaaaaaauuguuuuagcgcuggguuu

SEQ ID NO: 36419 - RNA, 64 nt, hsa
ugggugacagagcgaggcuccgucucaaaaaaaaaaaaaaaaaauuguuuuagcgcuggguuuc

SEQ ID NO: 36420 - RNA, 64 nt, hsa
gggugacagagcgaggcuccgucucaaaaaaaaaaaaaaaaaauuguuuuagcgcuggguuucc

SEQ ID NO: 36421 - RNA, 64 nt, hsa
ggugacagagcgaggcuccgucucaaaaaaaaaaaaaaaaaauuguuuuagcgcuggguuuccc

SEQ ID NO: 36422 - RNA, 64 nt, hsa
cacuugaauuuccuagaacagaagcacuguuuuuaaaaaaaaaaaaaaaaaaagaagaaagaaa

SEQ ID NO: 36423 - RNA, 64 nt, hsa
acuugaauuuccuagaacagaagcacuguuuuuaaaaaaaaaaaaaaaaaaagaagaaagaaag

SEQ ID NO: 36424 - RNA, 64 nt, hsa
cuugaauuuccuagaacagaagcacuguuuuuaaaaaaaaaaaaaaaaaaagaagaaagaaaga

SEQ ID NO: 36425 - RNA, 64 nt, hsa
uugaauuuccuagaacagaagcacuguuuuuaaaaaaaaaaaaaaaaaaagaagaaagaaagaa

SEQ ID NO: 36426 - RNA, 64 nt, hsa
ugaauuuccuagaacagaagcacuguuuuuaaaaaaaaaaaaaaaaaaagaagaaagaaagaaa

SEQ ID NO: 36427 - RNA, 64 nt, hsa
gaauuuccuagaacagaagcacuguuuuuaaaaaaaaaaaaaaaaaaagaagaaagaaagaaaa

SEQ ID NO: 36428 - RNA, 64 nt, hsa
aauuuccuagaacagaagcacuguuuuuaaaaaaaaaaaaaaaaaaagaagaaagaaagaaaaa

SEQ ID NO: 36429 - RNA, 64 nt, hsa
auuuccuagaacagaagcacuguuuuuaaaaaaaaaaaaaaaaaaagaagaaagaaagaaaaaa

SEQ ID NO: 36430 - RNA, 64 nt, hsa
uuuccuagaacagaagcacuguuuuuaaaaaaaaaaaaaaaaaaagaagaaagaaagaaaaaaa

SEQ ID NO: 36431 - RNA, 64 nt, hsa
uuccuagaacagaagcacuguuuuuaaaaaaaaaaaaaaaaaaagaagaaagaaagaaaaaaaa

SEQ ID NO: 36432 - RNA, 64 nt, hsa
uccuagaacagaagcacuguuuuuaaaaaaaaaaaaaaaaaaagaagaaagaaagaaaaaaaaa

SEQ ID NO: 36433 - RNA, 64 nt, hsa
ccuagaacagaagcacuguuuuuaaaaaaaaaaaaaaaaaaagaagaaagaaagaaaaaaaaaa

SEQ ID NO: 36434 - RNA, 64 nt, hsa
cguugcuuguggauuuauaguaguucagucauaaaaaaaaaauuauaauaggcugauuuucuuu

SEQ ID NO: 36435 - RNA, 64 nt, hsa
ccguugcuuguggauuuauaguaguucagucauaaaaaaaaaauuauaauaggcugauuuucuu

SEQ ID NO: 36436 - RNA, 64 nt, hsa
accguugcuuguggauuuauaguaguucagucauaaaaaaaaaauuauaauaggcugauuuucu

SEQ ID NO: 36437 - RNA, 64 nt, hsa
uggguuuuugugaugaucaauggacuuuaaugaaaaaaaaaauaaaaacaaccaaaaaaauuga

SEQ ID NO: 36438 - RNA, 64 nt, hsa
cuggguuuuugugaugaucaauggacuuuaaugaaaaaaaaaauaaaaacaaccaaaaaaauug

SEQ ID NO: 36439 - RNA, 64 nt, hsa
ccuggguuuuugugaugaucaauggacuuuaaugaaaaaaaaaauaaaaacaaccaaaaaaauu

SEQ ID NO: 36440 - RNA, 64 nt, hsa
caucccaaagaaauaaacaagugugacaaaaaaaaaaaaaaacaaaccuaaaugcuacuguucc

SEQ ID NO: 36441 - RNA, 64 nt, hsa
acaucccaaagaaauaaacaagugugacaaaaaaaaaaaaaaacaaaccuaaaugcuacuguuc

SEQ ID NO: 36442 - RNA, 64 nt, hsa
aacaucccaaagaaauaaacaagugugacaaaaaaaaaaaaaaacaaaccuaaaugcuacuguu

SEQ ID NO: 36443 - RNA, 64 nt, hsa
caacaucccaaagaaauaaacaagugugacaaaaaaaaaaaaaaacaaaccuaaaugcuacugu

SEQ ID NO: 36444 - RNA, 64 nt, hsa
gcaacaucccaaagaaauaaacaagugugacaaaaaaaaaaaaaaacaaaccuaaaugcuacug

SEQ ID NO: 36445 - RNA, 64 nt, hsa
agcaacaucccaaagaaauaaacaagugugacaaaaaaaaaaaaaaacaaaccuaaaugcuacu

SEQ ID NO: 36446 - RNA, 64 nt, hsa
cagcaacaucccaaagaaauaaacaagugugacaaaaaaaaaaaaaaacaaaccuaaaugcuac

SEQ ID NO: 36447 - RNA, 64 nt, hsa
acagcaacaucccaaagaaauaaacaagugugacaaaaaaaaaaaaaaacaaaccuaaaugcua

SEQ ID NO: 36448 - RNA, 64 nt, hsa
cuauauugaaagaauacuuuucuggcaaaaaaaaaaaaaaaagaaagaaaggaaaacaaaaagc

SEQ ID NO: 36449 - RNA, 64 nt, hsa
ucuauauugaaagaauacuuuucuggcaaaaaaaaaaaaaaaagaaagaaaggaaaacaaaaag

SEQ ID NO: 36450 - RNA, 64 nt, hsa
uucuauauugaaagaauacuuuucuggcaaaaaaaaaaaaaaaagaaagaaaggaaaacaaaaa

SEQ ID NO: 36451 - RNA, 64 nt, hsa
uuucuauauugaaagaauacuuuucuggcaaaaaaaaaaaaaaaagaaagaaaggaaaacaaaa

SEQ ID NO: 36452 - RNA, 64 nt, hsa
uuuucuauauugaaagaauacuuuucuggcaaaaaaaaaaaaaaaagaaagaaaggaaaacaaa

SEQ ID NO: 36453 - RNA, 64 nt, hsa
auuuucuauauugaaagaauacuuuucuggcaaaaaaaaaaaaaaaagaaagaaaggaaaacaa

SEQ ID NO: 36454 - RNA, 64 nt, hsa
gauuuucuauauugaaagaauacuuuucuggcaaaaaaaaaaaaaaaagaaagaaaggaaaaca

SEQ ID NO: 36455 - RNA, 64 nt, hsa
ggauuuucuauauugaaagaauacuuuucuggcaaaaaaaaaaaaaaaagaaagaaaggaaaac

SEQ ID NO: 36456 - RNA, 64 nt, hsa
aggauuuucuauauugaaagaauacuuuucuggcaaaaaaaaaaaaaaaagaaagaaaggaaaa

SEQ ID NO: 36457 - RNA, 64 nt, hsa
ccauuuuucacuuugguauuaauaaaauguaaaaaaaaaaaacuggcugaauggcugaaugaga

SEQ ID NO: 36458 - RNA, 64 nt, hsa
gccauuuuucacuuugguauuaauaaaauguaaaaaaaaaaaacuggcugaauggcugaaugag

SEQ ID NO: 36459 - RNA, 64 nt, hsa
ggccauuuuucacuuugguauuaauaaaauguaaaaaaaaaaaacuggcugaauggcugaauga

SEQ ID NO: 36460 - RNA, 64 nt, hsa
aggccauuuuucacuuugguauuaauaaaauguaaaaaaaaaaaacuggcugaauggcugaaug

SEQ ID NO: 36461 - RNA, 64 nt, hsa
caggccauuuuucacuuugguauuaauaaaauguaaaaaaaaaaaacuggcugaauggcugaau

SEQ ID NO: 36462 - RNA, 64 nt, hsa
gccugggcaacaagagcaaaacuccaucucaaaaaaaaaaaagaauaugugcagcucuggcuau

SEQ ID NO: 36463 - RNA, 64 nt, hsa
agccugggcaacaagagcaaaacuccaucucaaaaaaaaaaaagaauaugugcagcucuggcua

SEQ ID NO: 36464 - RNA, 64 nt, hsa
cagccugggcaacaagagcaaaacuccaucucaaaaaaaaaaaagaauaugugcagcucuggcu

SEQ ID NO: 36465 - RNA, 64 nt, hsa
ccagccugggcaacaagagcaaaacuccaucucaaaaaaaaaaaagaauaugugcagcucuggc

SEQ ID NO: 36466 - RNA, 64 nt, hsa
uccagccugggcaacaagagcaaaacuccaucucaaaaaaaaaaaagaauaugugcagcucugg

SEQ ID NO: 36467 - RNA, 64 nt, hsa
aaccaaaagucuugguuuuuaaaugugcuuagacaaaaaaaaucaggaaagguacccuaaucgu

SEQ ID NO: 36468 - RNA, 64 nt, hsa
ccugggugauggagcgaagaaccugucucuuaaaaaaaaaaauuuuuuuuuaauuaaaaaaacc

SEQ ID NO: 36469 - RNA, 64 nt, hsa
uccugggugauggagcgaagaaccugucucuuaaaaaaaaaaauuuuuuuuuaauuaaaaaaac

SEQ ID NO: 36470 - RNA, 64 nt, hsa
auccugggugauggagcgaagaaccugucucuuaaaaaaaaaaauuuuuuuuuaauuaaaaaaa

SEQ ID NO: 36471 - RNA, 64 nt, hsa
cauccugggugauggagcgaagaaccugucucuuaaaaaaaaaaauuuuuuuuuaauuaaaaaa

SEQ ID NO: 36472 - RNA, 64 nt, hsa
cuuuaaaaauacagagaauuucuuccuuuuuuuaaaaaaaaauaagaaaaugcuaaauauuuau

SEQ ID NO: 36473 - RNA, 64 nt, hsa
acuuuaaaaauacagagaauuucuuccuuuuuuuaaaaaaaaauaagaaaaugcuaaauauuua

SEQ ID NO: 36474 - RNA, 64 nt, hsa
uguaagggucuguuguaaaugaccaagaaaaagaaaaaaaaagcauucccaaucuugacacggu

SEQ ID NO: 36475 - RNA, 64 nt, hsa
auguaagggucuguuguaaaugaccaagaaaaagaaaaaaaaagcauucccaaucuugacacgg

SEQ ID NO: 36476 - RNA, 64 nt, hsa
gaaccagaggguuguacuauuguuuaaaaacaggaaaaaaaauaauguaagggucuguuguaaa

SEQ ID NO: 36477 - RNA, 64 nt, hsa
ugcuguuguugcagggaagucuuacuuaaaaaaaaaaaaaaauuuugugagugacucgguguaa

SEQ ID NO: 36478 - RNA, 64 nt, hsa
uugcuguuguugcagggaagucuuacuuaaaaaaaaaaaaaaauuuugugagugacucggugua

SEQ ID NO: 36479 - RNA, 64 nt, hsa
auugcuguuguugcagggaagucuuacuuaaaaaaaaaaaaaaauuuugugagugacucggugu

SEQ ID NO: 36480 - RNA, 64 nt, hsa
cauugcuguuguugcagggaagucuuacuuaaaaaaaaaaaaaaauuuugugagugacucggug

SEQ ID NO: 36481 - RNA, 64 nt, hsa
ccauugcuguuguugcagggaagucuuacuuaaaaaaaaaaaaaaauuuugugagugacucggu

SEQ ID NO: 36482 - RNA, 64 nt, hsa
uccauugcuguuguugcagggaagucuuacuuaaaaaaaaaaaaaaauuuugugagugacucgg

SEQ ID NO: 36483 - RNA, 64 nt, hsa
cuccauugcuguuguugcagggaagucuuacuuaaaaaaaaaaaaaaauuuugugagugacucg

SEQ ID NO: 36484 - RNA, 64 nt, hsa
ccuccauugcuguuguugcagggaagucuuacuuaaaaaaaaaaaaaaauuuugugagugacuc

SEQ ID NO: 36485 - RNA, 64 nt, hsa
auauaaggaggaaaacgggaaagaauauaaaguuaaaaaaaagccuccgguuuccacuacugug

SEQ ID NO: 36486 - RNA, 64 nt, hsa
gugaaaacuaggagaacagagaugagauuugacaaaaaaaaauugaauuaaaaauaacacaguc

SEQ ID NO: 36487 - RNA, 64 nt, hsa
ugugaaaacuaggagaacagagaugagauuugacaaaaaaaaauugaauuaaaaauaacacagu

SEQ ID NO: 36488 - RNA, 64 nt, hsa
ucaucacacuggaaauuguacuauauguaaaaaaaaaaaaaaguauaguuuuauauuugaaaug

SEQ ID NO: 36489 - RNA, 64 nt, hsa
gucaucacacuggaaauuguacuauauguaaaaaaaaaaaaaaguauaguuuuauauuugaaau

SEQ ID NO: 36490 - RNA, 64 nt, hsa
ugucaucacacuggaaauuguacuauauguaaaaaaaaaaaaaaguauaguuuuauauuugaaa

SEQ ID NO: 36491 - RNA, 64 nt, hsa
augucaucacacuggaaauuguacuauauguaaaaaaaaaaaaaaguauaguuuuauauuugaa

SEQ ID NO: 36492 - RNA, 64 nt, hsa
aaugucaucacacuggaaauuguacuauauguaaaaaaaaaaaaaaguauaguuuuauauuuga

SEQ ID NO: 36493 - RNA, 64 nt, hsa
aaaugucaucacacuggaaauuguacuauauguaaaaaaaaaaaaaaguauaguuuuauauuug

SEQ ID NO: 36494 - RNA, 64 nt, hsa
gaaaugucaucacacuggaaauuguacuauauguaaaaaaaaaaaaaaguauaguuuuauauuu

SEQ ID NO: 36495 - RNA, 64 nt, hsa
cccuuccuaaaaucuggggggucggggggaaagaaaaaaaaagccuuaguggccugguuguuca

SEQ ID NO: 36496 - RNA, 64 nt, hsa
ucccuuccuaaaaucuggggggucggggggaaagaaaaaaaaagccuuaguggccugguuguuc

SEQ ID NO: 36497 - RNA, 64 nt, hsa
ugaaggcagcugagcuuucagagcuggguucaaaaaaaaaaauuccagugucuguauacaggag

SEQ ID NO: 36498 - RNA, 64 nt, hsa
augaaggcagcugagcuuucagagcuggguucaaaaaaaaaaauuccagugucuguauacagga

SEQ ID NO: 36499 - RNA, 64 nt, hsa
caugaaggcagcugagcuuucagagcuggguucaaaaaaaaaaauuccagugucuguauacagg

SEQ ID NO: 36500 - RNA, 64 nt, hsa
ccaugaaggcagcugagcuuucagagcuggguucaaaaaaaaaaauuccagugucuguauacag

SEQ ID NO: 36501 - RNA, 64 nt, hsa
cugggcgacagugagacccugucucaccaaagaaaaaaaaaaggugagauuaaucuucacuaua

SEQ ID NO: 36502 - RNA, 64 nt, hsa
ccugggcgacagugagacccugucucaccaaagaaaaaaaaaaggugagauuaaucuucacuau

SEQ ID NO: 36503 - RNA, 64 nt, hsa
gccugggcgacagugagacccugucucaccaaagaaaaaaaaaaggugagauuaaucuucacua

SEQ ID NO: 36504 - RNA, 64 nt, hsa
auuacgguauuuuuguuuguaaguuaaaaagaaaaaaaaaaagaaaaaguuccgggcauuuugc

SEQ ID NO: 36505 - RNA, 64 nt, hsa
uauuacgguauuuuuguuuguaaguuaaaaagaaaaaaaaaaagaaaaaguuccgggcauuuug

SEQ ID NO: 36506 - RNA, 64 nt, hsa
uuauuacgguauuuuuguuuguaaguuaaaaagaaaaaaaaaaagaaaaaguuccgggcauuuu

SEQ ID NO: 36507 - RNA, 64 nt, hsa
auuauuacgguauuuuuguuuguaaguuaaaaagaaaaaaaaaaagaaaaaguuccgggcauuu

SEQ ID NO: 36508 - RNA, 64 nt, hsa
cuuuuaaguacuaauuuucuuuuuaucaaguagaaaaaaaaauguauuugcccuaaauccuuaa

SEQ ID NO: 36509 - RNA, 64 nt, hsa
ccuuuuaaguacuaauuuucuuuuuaucaaguagaaaaaaaaauguauuugcccuaaauccuua

SEQ ID NO: 36510 - RNA, 64 nt, hsa
aggugugacuucagggagaaacaaacuugcaaaaaaaaaaaaucucaggccauguugggguaac

SEQ ID NO: 36511 - RNA, 64 nt, hsa
aaggugugacuucagggagaaacaaacuugcaaaaaaaaaaaaucucaggccauguugggguaa

SEQ ID NO: 36512 - RNA, 64 nt, hsa
uaaggugugacuucagggagaaacaaacuugcaaaaaaaaaaaaucucaggccauguuggggua

SEQ ID NO: 36513 - RNA, 64 nt, hsa
uuaaggugugacuucagggagaaacaaacuugcaaaaaaaaaaaaucucaggccauguuggggu

SEQ ID NO: 36514 - RNA, 64 nt, hsa
uuuaaggugugacuucagggagaaacaaacuugcaaaaaaaaaaaaucucaggccauguugggg

SEQ ID NO: 36515 - RNA, 64 nt, hsa
auauuuauauugcaguauccuuuaaaagcaaaaaaaaaaaaaugcauuuauauuacaguuuucc

SEQ ID NO: 36516 - RNA, 64 nt, hsa
uauauuuauauugcaguauccuuuaaaagcaaaaaaaaaaaaaugcauuuauauuacaguuuuc

SEQ ID NO: 36517 - RNA, 64 nt, hsa
auauauuuauauugcaguauccuuuaaaagcaaaaaaaaaaaaaugcauuuauauuacaguuuu

SEQ ID NO: 36518 - RNA, 64 nt, hsa
aauauauuuauauugcaguauccuuuaaaagcaaaaaaaaaaaaaugcauuuauauuacaguuu

SEQ ID NO: 36519 - RNA, 64 nt, hsa
uaauauauuuauauugcaguauccuuuaaaagcaaaaaaaaaaaaaugcauuuauauuacaguu

SEQ ID NO: 36520 - RNA, 64 nt, hsa
uuaauauauuuauauugcaguauccuuuaaaagcaaaaaaaaaaaaaugcauuuauauuacagu

SEQ ID NO: 36521 - RNA, 64 nt, hsa
aaaaaaaagaaaaagaaaaacgauuuaaaaaaaaaaaaaaaagcaaccaaccccaacaacaaaa

SEQ ID NO: 36522 - RNA, 64 nt, hsa
aaaaaaaaagaaaaagaaaaacgauuuaaaaaaaaaaaaaaaagcaaccaaccccaacaacaaa

SEQ ID NO: 36523 - RNA, 64 nt, hsa
aaaaaaaaaagaaaaagaaaaacgauuuaaaaaaaaaaaaaaaagcaaccaaccccaacaacaa

SEQ ID NO: 36524 - RNA, 64 nt, hsa
aaaaaaaaaaagaaaaagaaaaacgauuuaaaaaaaaaaaaaaaagcaaccaaccccaacaaca

SEQ ID NO: 36525 - RNA, 64 nt, hsa
aaaaaaaaaaaagaaaaagaaaaacgauuuaaaaaaaaaaaaaaaagcaaccaaccccaacaac

SEQ ID NO: 36526 - RNA, 64 nt, hsa
aaaaaaaaaaaaagaaaaagaaaaacgauuuaaaaaaaaaaaaaaaagcaaccaaccccaacaa

SEQ ID NO: 36527 - RNA, 64 nt, hsa
uaaaaaaaaaaaaagaaaaagaaaaacgauuuaaaaaaaaaaaaaaaagcaaccaaccccaaca

SEQ ID NO: 36528 - RNA, 64 nt, hsa
uuaaaaaaaaaaaaagaaaaagaaaaacgauuuaaaaaaaaaaaaaaaagcaaccaaccccaac

SEQ ID NO: 36529 - RNA, 64 nt, hsa
auuaaaaaaaaaaaaagaaaaagaaaaacgauuuaaaaaaaaaaaaaaaagcaaccaaccccaa

SEQ ID NO: 36530 - RNA, 64 nt, hsa
uuuuauauuuguauuaacuuuaacuuauuaaaaaaaaaaaaagaaaaagaaaaacgauuuaaaa

SEQ ID NO: 36531 - RNA, 64 nt, hsa
uuuuuauauuuguauuaacuuuaacuuauuaaaaaaaaaaaaagaaaaagaaaaacgauuuaaa

SEQ ID NO: 36532 - RNA, 64 nt, hsa
cuuuuuauauuuguauuaacuuuaacuuauuaaaaaaaaaaaaagaaaaagaaaaacgauuuaa

SEQ ID NO: 36533 - RNA, 64 nt, hsa
ccuuuuuauauuuguauuaacuuuaacuuauuaaaaaaaaaaaaagaaaaagaaaaacgauuua

SEQ ID NO: 36534 - RNA, 64 nt, hsa
cccuuuuuauauuuguauuaacuuuaacuuauuaaaaaaaaaaaaagaaaaagaaaaacgauuu

SEQ ID NO: 36535 - RNA, 64 nt, hsa
ccccuuuuuauauuuguauuaacuuuaacuuauuaaaaaaaaaaaaagaaaaagaaaaacgauu

SEQ ID NO: 36536 - RNA, 64 nt, hsa
agguaguauugacaacuguuccugcuucuacuaaaaaaaaaagagcacaaaagaaaaacuaaau

SEQ ID NO: 36537 - RNA, 64 nt, hsa
aagguaguauugacaacuguuccugcuucuacuaaaaaaaaaagagcacaaaagaaaaacuaaa

SEQ ID NO: 36538 - RNA, 64 nt, hsa
gaagguaguauugacaacuguuccugcuucuacuaaaaaaaaaagagcacaaaagaaaaacuaa

SEQ ID NO: 36539 - RNA, 64 nt, hsa
ugugcuguuaauagugugaaauugucauguuaaaaaaaaaaacaggaaccaaaugugaccuugu

SEQ ID NO: 36540 - RNA, 64 nt, hsa
gugugcuguuaauagugugaaauugucauguuaaaaaaaaaaacaggaaccaaaugugaccuug

SEQ ID NO: 36541 - RNA, 64 nt, hsa
cgugugcuguuaauagugugaaauugucauguuaaaaaaaaaaacaggaaccaaaugugaccuu

SEQ ID NO: 36542 - RNA, 64 nt, hsa
ccgugugcuguuaauagugugaaauugucauguuaaaaaaaaaaacaggaaccaaaugugaccu

SEQ ID NO: 36543 - RNA, 64 nt, hsa
uauugucagaccauugccugauuuuaauauaauaaaaaaaaagugugcguuaauauuuaacagg

SEQ ID NO: 36544 - RNA, 64 nt, hsa
uuauugucagaccauugccugauuuuaauauaauaaaaaaaaagugugcguuaauauuuaacag

SEQ ID NO: 36545 - RNA, 64 nt, hsa
ugcuaugcugcuuugcaaaaaguugaaaaaauaaaaaaaaaaugcauaccaaaacaaauacaga

SEQ ID NO: 36546 - RNA, 64 nt, hsa
uugcuaugcugcuuugcaaaaaguugaaaaaauaaaaaaaaaaugcauaccaaaacaaauacag

SEQ ID NO: 36547 - RNA, 64 nt, hsa
guugcuaugcugcuuugcaaaaaguugaaaaaauaaaaaaaaaaugcauaccaaaacaaauaca

SEQ ID NO: 36548 - RNA, 64 nt, hsa
uuuucuacauaauaugacauggauacuugacccaaaaaaaaauguuuagugcuaaugagcagaa

SEQ ID NO: 36549 - RNA, 64 nt, hsa
auuuucuacauaauaugacauggauacuugacccaaaaaaaaauguuuagugcuaaugagcaga

SEQ ID NO: 36550 - RNA, 64 nt, hsa
cacccugggcgacagagcaagauucuaucaaaaaaaaaaaaaggcaguggcaaguaaguuauag

SEQ ID NO: 36551 - RNA, 64 nt, hsa
ccacccugggcgacagagcaagauucuaucaaaaaaaaaaaaaggcaguggcaaguaaguuaua

SEQ ID NO: 36552 - RNA, 64 nt, hsa
uccacccugggcgacagagcaagauucuaucaaaaaaaaaaaaaggcaguggcaaguaaguuau

SEQ ID NO: 36553 - RNA, 64 nt, hsa
cuccacccugggcgacagagcaagauucuaucaaaaaaaaaaaaaggcaguggcaaguaaguua

SEQ ID NO: 36554 - RNA, 64 nt, hsa
acuccacccugggcgacagagcaagauucuaucaaaaaaaaaaaaaggcaguggcaaguaaguu

SEQ ID NO: 36555 - RNA, 64 nt, hsa
cacuccacccugggcgacagagcaagauucuaucaaaaaaaaaaaaaggcaguggcaaguaagu

SEQ ID NO: 36556 - RNA, 64 nt, hsa
cuugacuacgauaucaucgacaugacuucucucaaaaaaaaagaaugcuucauaguuguauuuu

SEQ ID NO: 36557 - RNA, 64 nt, hsa
ccuugacuacgauaucaucgacaugacuucucucaaaaaaaaagaaugcuucauaguuguauuu

SEQ ID NO: 36558 - RNA, 64 nt, hsa
auccuacaagcugugcaggcaaaaccuagcaggaaaaaaaaacaacgcauaaagaaaaauggcc

SEQ ID NO: 36559 - RNA, 64 nt, hsa
gauccuacaagcugugcaggcaaaaccuagcaggaaaaaaaaacaacgcauaaagaaaaauggc

SEQ ID NO: 36560 - RNA, 64 nt, hsa
cuggcuaacauggugaaaccccgucucuacuaaaaaaaaaaauacaaaaaauuagccgggcguu

SEQ ID NO: 36561 - RNA, 64 nt, hsa
ccuggcuaacauggugaaaccccgucucuacuaaaaaaaaaaauacaaaaaauuagccgggcgu

SEQ ID NO: 36562 - RNA, 64 nt, hsa
uccuggcuaacauggugaaaccccgucucuacuaaaaaaaaaaauacaaaaaauuagccgggcg

SEQ ID NO: 36563 - RNA, 64 nt, hsa
guccuggcuaacauggugaaaccccgucucuacuaaaaaaaaaaauacaaaaaauuagccgggc

SEQ ID NO: 36564 - RNA, 64 nt, hsa
caggaguauuuuuguauuagaagaggccuauuaaaaaaaaaaguuguuuucugaacuagaagag

SEQ ID NO: 36565 - RNA, 64 nt, hsa
gcaggaguauuuuuguauuagaagaggccuauuaaaaaaaaaaguuguuuucugaacuagaaga

SEQ ID NO: 36566 - RNA, 64 nt, hsa
ggcaggaguauuuuuguauuagaagaggccuauuaaaaaaaaaaguuguuuucugaacuagaag

SEQ ID NO: 36567 - RNA, 64 nt, hsa
guuucuuuguugagcugugucuugaaggcaaaagaaaaaaaauuucuacaguagucuuucuugu

SEQ ID NO: 36568 - RNA, 64 nt, hsa
aagagagcuugcaaaaaaaaaaagaaaaaagaaaaaaaaaaaccacguuucuuuguugagcugu

SEQ ID NO: 36569 - RNA, 64 nt, hsa
uaagagagcuugcaaaaaaaaaaagaaaaaagaaaaaaaaaaaccacguuucuuuguugagcug

SEQ ID NO: 36570 - RNA, 64 nt, hsa
cuaagagagcuugcaaaaaaaaaaagaaaaaagaaaaaaaaaaaccacguuucuuuguugagcu

SEQ ID NO: 36571 - RNA, 64 nt, hsa
gcuaagagagcuugcaaaaaaaaaaagaaaaaagaaaaaaaaaaaccacguuucuuuguugagc

SEQ ID NO: 36572 - RNA, 64 nt, hsa
uggucugaaugcacaagcuaagagagcuugcaaaaaaaaaaagaaaaaagaaaaaaaaaaacca

SEQ ID NO: 36573 - RNA, 64 nt, hsa
cuggucugaaugcacaagcuaagagagcuugcaaaaaaaaaaagaaaaaagaaaaaaaaaaacc

SEQ ID NO: 36574 - RNA, 64 nt, hsa
ucuggucugaaugcacaagcuaagagagcuugcaaaaaaaaaaagaaaaaagaaaaaaaaaaac

SEQ ID NO: 36575 - RNA, 64 nt, hsa
gucuggucugaaugcacaagcuaagagagcuugcaaaaaaaaaaagaaaaaagaaaaaaaaaaa

SEQ ID NO: 36576 - RNA, 64 nt, hsa
uggcagauugaaaaggaucucauuccaugggaaaaaaaaaaauccugucuuguucauaaauuga

SEQ ID NO: 36577 - RNA, 64 nt, hsa
auggcagauugaaaaggaucucauuccaugggaaaaaaaaaaauccugucuuguucauaaauug

SEQ ID NO: 36578 - RNA, 64 nt, hsa
uauggcagauugaaaaggaucucauuccaugggaaaaaaaaaaauccugucuuguucauaaauu

SEQ ID NO: 36579 - RNA, 64 nt, hsa
uuauggcagauugaaaaggaucucauuccaugggaaaaaaaaaaauccugucuuguucauaaau

SEQ ID NO: 36580 - RNA, 64 nt, hsa
agcaaguguacccuuuauaggaacccucaaauuaaaaaaaaaugucuuuuaauggaugagaggg

SEQ ID NO: 36581 - RNA, 64 nt, hsa
aagcaaguguacccuuuauaggaacccucaaauuaaaaaaaaaugucuuuuaauggaugagagg

SEQ ID NO: 36582 - RNA, 64 nt, hsa
gacaacaggugcuagaauuaaggugugggaaaaaaaaaaaaacagccaggaaggacaagaucuc

SEQ ID NO: 36583 - RNA, 64 nt, hsa
ugacaacaggugcuagaauuaaggugugggaaaaaaaaaaaaacagccaggaaggacaagaucu

SEQ ID NO: 36584 - RNA, 64 nt, hsa
cugacaacaggugcuagaauuaaggugugggaaaaaaaaaaaaacagccaggaaggacaagauc

SEQ ID NO: 36585 - RNA, 64 nt, hsa
ucugacaacaggugcuagaauuaaggugugggaaaaaaaaaaaaacagccaggaaggacaagau

SEQ ID NO: 36586 - RNA, 64 nt, hsa
gucugacaacaggugcuagaauuaaggugugggaaaaaaaaaaaaacagccaggaaggacaaga

SEQ ID NO: 36587 - RNA, 64 nt, hsa
ggucugacaacaggugcuagaauuaaggugugggaaaaaaaaaaaaacagccaggaaggacaag

SEQ ID NO: 36588 - RNA, 64 nt, hsa
cuccucaggaauauucucgauuuaauaagcuaaaaaaaaaaaguucuguguuugugcccacagu

SEQ ID NO: 36589 - RNA, 64 nt, hsa
ccuccucaggaauauucucgauuuaauaagcuaaaaaaaaaaaguucuguguuugugcccacag

SEQ ID NO: 36590 - RNA, 64 nt, hsa
gccuccucaggaauauucucgauuuaauaagcuaaaaaaaaaaaguucuguguuugugcccaca

SEQ ID NO: 36591 - RNA, 64 nt, hsa
ugccuccucaggaauauucucgauuuaauaagcuaaaaaaaaaaaguucuguguuugugcccac

SEQ ID NO: 36592 - RNA, 64 nt, hsa
cagccugggugacagagcgagacccugucuuaaaaaaaaaaacaaaacaaaaccagcaucuguu

SEQ ID NO: 36593 - RNA, 64 nt, hsa
ccagccugggugacagagcgagacccugucuuaaaaaaaaaaacaaaacaaaaccagcaucugu

SEQ ID NO: 36594 - RNA, 64 nt, hsa
uccagccugggugacagagcgagacccugucuuaaaaaaaaaaacaaaacaaaaccagcaucug

SEQ ID NO: 36595 - RNA, 64 nt, hsa
cuccagccugggugacagagcgagacccugucuuaaaaaaaaaaacaaaacaaaaccagcaucu

SEQ ID NO: 36596 - RNA, 64 nt, hsa
uuugcugcacucacuuuuuuauacucugacaaaaaaaaaaaaucagaaauaaagcugguuccca

SEQ ID NO: 36597 - RNA, 64 nt, hsa
uuuugcugcacucacuuuuuuauacucugacaaaaaaaaaaaaucagaaauaaagcugguuccc

SEQ ID NO: 36598 - RNA, 64 nt, hsa
guuuugcugcacucacuuuuuuauacucugacaaaaaaaaaaaaucagaaauaaagcugguucc

SEQ ID NO: 36599 - RNA, 64 nt, hsa
uguuuugcugcacucacuuuuuuauacucugacaaaaaaaaaaaaucagaaauaaagcugguuc

SEQ ID NO: 36600 - RNA, 64 nt, hsa
uuguuuugcugcacucacuuuuuuauacucugacaaaaaaaaaaaaucagaaauaaagcugguu

SEQ ID NO: 36601 - RNA, 64 nt, hsa
agugacaauaaaacaugagauauaaaucaagcuuaaaaaaaaaaagcagcaccugugggccaua

SEQ ID NO: 36602 - RNA, 64 nt, hsa
gugacaauaaaacaugagauauaaaucaagcuuaaaaaaaaaaagcagcaccugugggccauac

SEQ ID NO: 36603 - RNA, 64 nt, hsa
ugacaauaaaacaugagauauaaaucaagcuuaaaaaaaaaaagcagcaccugugggccauacu

SEQ ID NO: 36604 - RNA, 64 nt, hsa
gacaauaaaacaugagauauaaaucaagcuuaaaaaaaaaaagcagcaccugugggccauacua

SEQ ID NO: 36605 - RNA, 64 nt, hsa
ucacaagccaguggaagggauuccugauuuuacuaaaaaaaaaaaaaaaaaagagagggcgggg

SEQ ID NO: 36606 - RNA, 64 nt, hsa
cacaagccaguggaagggauuccugauuuuacuaaaaaaaaaaaaaaaaaagagagggcgggga

SEQ ID NO: 36607 - RNA, 64 nt, hsa
acaagccaguggaagggauuccugauuuuacuaaaaaaaaaaaaaaaaaagagagggcggggac

SEQ ID NO: 36608 - RNA, 64 nt, hsa
caagccaguggaagggauuccugauuuuacuaaaaaaaaaaaaaaaaaagagagggcggggaca

SEQ ID NO: 36609 - RNA, 64 nt, hsa
aagccaguggaagggauuccugauuuuacuaaaaaaaaaaaaaaaaaagagagggcggggacaa

SEQ ID NO: 36610 - RNA, 64 nt, hsa
agccaguggaagggauuccugauuuuacuaaaaaaaaaaaaaaaaaagagagggcggggacaaa

SEQ ID NO: 36611 - RNA, 64 nt, hsa
gccaguggaagggauuccugauuuuacuaaaaaaaaaaaaaaaaaagagagggcggggacaaau

SEQ ID NO: 36612 - RNA, 64 nt, hsa
ccaguggaagggauuccugauuuuacuaaaaaaaaaaaaaaaaaagagagggcggggacaaaua

SEQ ID NO: 36613 - RNA, 64 nt, hsa
caguggaagggauuccugauuuuacuaaaaaaaaaaaaaaaaaagagagggcggggacaaauau

SEQ ID NO: 36614 - RNA, 64 nt, hsa
aguggaagggauuccugauuuuacuaaaaaaaaaaaaaaaaaagagagggcggggacaaauauc

SEQ ID NO: 36615 - RNA, 64 nt, hsa
guggaagggauuccugauuuuacuaaaaaaaaaaaaaaaaaagagagggcggggacaaauauca

SEQ ID NO: 36616 - RNA, 64 nt, hsa
uauuuaauaccaccaacaaauauagggguuaaggaaaaaaaacgugagcuacauguguaagaag

SEQ ID NO: 36617 - RNA, 64 nt, hsa
uauauauguccuauucauucacaauggauuauacaaaaaaaaguguauugcaagugaaauaaua

SEQ ID NO: 36618 - RNA, 64 nt, hsa
aacauggugaaagcccgucucuaccgaaaaauacaaaaaaaaauagcuggguguggugguacgu

SEQ ID NO: 36619 - RNA, 64 nt, hsa
acauggugaaagcccgucucuaccgaaaaauacaaaaaaaaauagcuggguguggugguacgug

SEQ ID NO: 36620 - RNA, 64 nt, hsa
uagcuauagaaauccaauuaagacucacuuggguaaaaaaaaauaaaaaaauaaacaaaauaaa

SEQ ID NO: 36621 - RNA, 64 nt, hsa
agcuauagaaauccaauuaagacucacuuggguaaaaaaaaauaaaaaaauaaacaaaauaaac

SEQ ID NO: 36622 - RNA, 64 nt, hsa
cuccagccugggugacaaagugagacuccaucucaaaaaaaaaaaaaaaaaaaauugugagaaa

SEQ ID NO: 36623 - RNA, 64 nt, hsa
uccagccugggugacaaagugagacuccaucucaaaaaaaaaaaaaaaaaaaauugugagaaac

SEQ ID NO: 36624 - RNA, 64 nt, hsa
ccagccugggugacaaagugagacuccaucucaaaaaaaaaaaaaaaaaaaauugugagaaaca

SEQ ID NO: 36625 - RNA, 64 nt, hsa
cagccugggugacaaagugagacuccaucucaaaaaaaaaaaaaaaaaaaauugugagaaacag

SEQ ID NO: 36626 - RNA, 64 nt, hsa
agccugggugacaaagugagacuccaucucaaaaaaaaaaaaaaaaaaaauugugagaaacaga

SEQ ID NO: 36627 - RNA, 64 nt, hsa
gccugggugacaaagugagacuccaucucaaaaaaaaaaaaaaaaaaaauugugagaaacagaa

SEQ ID NO: 36628 - RNA, 64 nt, hsa
ccugggugacaaagugagacuccaucucaaaaaaaaaaaaaaaaaaaauugugagaaacagaaa

SEQ ID NO: 36629 - RNA, 64 nt, hsa
cugggugacaaagugagacuccaucucaaaaaaaaaaaaaaaaaaaauugugagaaacagaaau

SEQ ID NO: 36630 - RNA, 64 nt, hsa
ugggugacaaagugagacuccaucucaaaaaaaaaaaaaaaaaaaauugugagaaacagaaaua

SEQ ID NO: 36631 - RNA, 64 nt, hsa
gggugacaaagugagacuccaucucaaaaaaaaaaaaaaaaaaaauugugagaaacagaaauac

SEQ ID NO: 36632 - RNA, 64 nt, hsa
ggugacaaagugagacuccaucucaaaaaaaaaaaaaaaaaaaauugugagaaacagaaauacu

SEQ ID NO: 36633 - RNA, 64 nt, hsa
gugacaaagugagacuccaucucaaaaaaaaaaaaaaaaaaaauugugagaaacagaaauacuu

SEQ ID NO: 36634 - RNA, 64 nt, hsa
ugacaaagugagacuccaucucaaaaaaaaaaaaaaaaaaaauugugagaaacagaaauacuua

SEQ ID NO: 36635 - RNA, 64 nt, hsa
cacuccagcugugugacagaaugagaccaucuccaaaaaaaaaaaaaaguagauuucagauaau

SEQ ID NO: 36636 - RNA, 64 nt, hsa
acuccagcugugugacagaaugagaccaucuccaaaaaaaaaaaaaaguagauuucagauaauu

SEQ ID NO: 36637 - RNA, 64 nt, hsa
cuccagcugugugacagaaugagaccaucuccaaaaaaaaaaaaaaguagauuucagauaauuu

SEQ ID NO: 36638 - RNA, 64 nt, hsa
uccagcugugugacagaaugagaccaucuccaaaaaaaaaaaaaaguagauuucagauaauuua

SEQ ID NO: 36639 - RNA, 64 nt, hsa
ccagcugugugacagaaugagaccaucuccaaaaaaaaaaaaaaguagauuucagauaauuuac

SEQ ID NO: 36640 - RNA, 64 nt, hsa
cagcugugugacagaaugagaccaucuccaaaaaaaaaaaaaaguagauuucagauaauuuacu

SEQ ID NO: 36641 - RNA, 64 nt, hsa
agcugugugacagaaugagaccaucuccaaaaaaaaaaaaaaguagauuucagauaauuuacug

SEQ ID NO: 36642 - RNA, 64 nt, hsa
caaggguagauguaguugcuuaguagcauuuuggaaaaaaaagaaaaaaagguuugguuugguu

SEQ ID NO: 36643 - RNA, 64 nt, hsa
cugggauuacaggcgugagccacugagcccggccaaaaaaaaauguauuuauuaaaaaaaaauu

SEQ ID NO: 36644 - RNA, 64 nt, hsa
ugggauuacaggcgugagccacugagcccggccaaaaaaaaauguauuuauuaaaaaaaaauuu

SEQ ID NO: 36645 - RNA, 64 nt, hsa
ccacugagcccggccaaaaaaaaauguauuuauuaaaaaaaaauuuuuuuaacccgccgaauaa

SEQ ID NO: 36646 - RNA, 64 nt, hsa
cacugagcccggccaaaaaaaaauguauuuauuaaaaaaaaauuuuuuuaacccgccgaauaau

SEQ ID NO: 36647 - RNA, 64 nt, hsa
uccagccugggcaacaagagcgaaacuccgucucaaaaaaaaaaaaaaaaaaaaagaaagaaaa

SEQ ID NO: 36648 - RNA, 64 nt, hsa
ccagccugggcaacaagagcgaaacuccgucucaaaaaaaaaaaaaaaaaaaaagaaagaaaag

SEQ ID NO: 36649 - RNA, 64 nt, hsa
cagccugggcaacaagagcgaaacuccgucucaaaaaaaaaaaaaaaaaaaaagaaagaaaaga

SEQ ID NO: 36650 - RNA, 64 nt, hsa
agccugggcaacaagagcgaaacuccgucucaaaaaaaaaaaaaaaaaaaaagaaagaaaagag

SEQ ID NO: 36651 - RNA, 64 nt, hsa
gccugggcaacaagagcgaaacuccgucucaaaaaaaaaaaaaaaaaaaaagaaagaaaagagu

SEQ ID NO: 36652 - RNA, 64 nt, hsa
ccugggcaacaagagcgaaacuccgucucaaaaaaaaaaaaaaaaaaaaagaaagaaaagagua

SEQ ID NO: 36653 - RNA, 64 nt, hsa
cugggcaacaagagcgaaacuccgucucaaaaaaaaaaaaaaaaaaaaagaaagaaaagaguaa

SEQ ID NO: 36654 - RNA, 64 nt, hsa
ugggcaacaagagcgaaacuccgucucaaaaaaaaaaaaaaaaaaaaagaaagaaaagaguaac

SEQ ID NO: 36655 - RNA, 64 nt, hsa
gggcaacaagagcgaaacuccgucucaaaaaaaaaaaaaaaaaaaaagaaagaaaagaguaaca

SEQ ID NO: 36656 - RNA, 64 nt, hsa
ggcaacaagagcgaaacuccgucucaaaaaaaaaaaaaaaaaaaaagaaagaaaagaguaacag

SEQ ID NO: 36657 - RNA, 64 nt, hsa
gcaacaagagcgaaacuccgucucaaaaaaaaaaaaaaaaaaaaagaaagaaaagaguaacaga

SEQ ID NO: 36658 - RNA, 64 nt, hsa
caacaagagcgaaacuccgucucaaaaaaaaaaaaaaaaaaaaagaaagaaaagaguaacagaa

SEQ ID NO: 36659 - RNA, 64 nt, hsa
aacaagagcgaaacuccgucucaaaaaaaaaaaaaaaaaaaaagaaagaaaagaguaacagaaa

SEQ ID NO: 36660 - RNA, 64 nt, hsa
acaagagcgaaacuccgucucaaaaaaaaaaaaaaaaaaaaagaaagaaaagaguaacagaaag

SEQ ID NO: 36661 - RNA, 64 nt, hsa
gaugaugaaugcacaacauaaugaugguuaaauuaaaaaaaaaaaagagcacgguaauaaaauu

SEQ ID NO: 36662 - RNA, 64 nt, hsa
augaugaaugcacaacauaaugaugguuaaauuaaaaaaaaaaaagagcacgguaauaaaauuu

SEQ ID NO: 36663 - RNA, 64 nt, hsa
ugaugaaugcacaacauaaugaugguuaaauuaaaaaaaaaaaagagcacgguaauaaaauuuc

SEQ ID NO: 36664 - RNA, 64 nt, hsa
gaugaaugcacaacauaaugaugguuaaauuaaaaaaaaaaaagagcacgguaauaaaauuucc

SEQ ID NO: 36665 - RNA, 64 nt, hsa
augaaugcacaacauaaugaugguuaaauuaaaaaaaaaaaagagcacgguaauaaaauuucca

SEQ ID NO: 36666 - RNA, 64 nt, hsa
uuucaaauccucccuacuuccaagaaaaauaauuaaaaaaaaaacuucauucuaaaccaaaaca

SEQ ID NO: 36667 - RNA, 64 nt, hsa
uucaaauccucccuacuuccaagaaaaauaauuaaaaaaaaaacuucauucuaaaccaaaacag

SEQ ID NO: 36668 - RNA, 64 nt, hsa
ucaaauccucccuacuuccaagaaaaauaauuaaaaaaaaaacuucauucuaaaccaaaacaga

SEQ ID NO: 36669 - RNA, 64 nt, hsa
cauguuuucuaagaaccauuuuguucacugauacaaaaaaaaaaaaaggaauucaugaugcugu

SEQ ID NO: 36670 - RNA, 64 nt, hsa
auguuuucuaagaaccauuuuguucacugauacaaaaaaaaaaaaaggaauucaugaugcugua

SEQ ID NO: 36671 - RNA, 64 nt, hsa
uguuuucuaagaaccauuuuguucacugauacaaaaaaaaaaaaaggaauucaugaugcuguac

SEQ ID NO: 36672 - RNA, 64 nt, hsa
guuuucuaagaaccauuuuguucacugauacaaaaaaaaaaaaaggaauucaugaugcuguaca

SEQ ID NO: 36673 - RNA, 64 nt, hsa
uuuucuaagaaccauuuuguucacugauacaaaaaaaaaaaaaggaauucaugaugcuguacag

SEQ ID NO: 36674 - RNA, 64 nt, hsa
uuucuaagaaccauuuuguucacugauacaaaaaaaaaaaaaggaauucaugaugcuguacaga

SEQ ID NO: 36675 - RNA, 64 nt, hsa
gguuugucaguacucgucaaagccaaguccaauuaaaaaaaaaagucuuugcccuccaauuugu

SEQ ID NO: 36676 - RNA, 64 nt, hsa
guuugucaguacucgucaaagccaaguccaauuaaaaaaaaaagucuuugcccuccaauuugug

SEQ ID NO: 36677 - RNA, 64 nt, hsa
uuugucaguacucgucaaagccaaguccaauuaaaaaaaaaagucuuugcccuccaauuugugu

SEQ ID NO: 36678 - RNA, 64 nt, hsa
aucauuuaugaauaacaaucugaagucuuuucauaaaaaaaauuaauaaacuuuaguuguacau

SEQ ID NO: 36679 - RNA, 64 nt, hsa
aaaagcugaauguuacuaauauuuuucauaucuaaaaaaaaauucuuagcaaugaaauugcugu

SEQ ID NO: 36680 - RNA, 64 nt, hsa
aaaaagcugaauguuacuaauauuuuucauaucuaaaaaaaaauucuuagcaaugaaauugcug

SEQ ID NO: 36681 - RNA, 64 nt, hsa
ugauuacaauugagggaaguuugauagauccuuuaaaaaaaaggcagauuuccauuuuuuguau

SEQ ID NO: 36682 - RNA, 64 nt, hsa
auaugcuuacauuuuucacuuuugcuaaaaagaaaaaaaaaagguguuuauuuuuaacucuugg

SEQ ID NO: 36683 - RNA, 64 nt, hsa
uauaugcuuacauuuuucacuuuugcuaaaaagaaaaaaaaaagguguuuauuuuuaacucuug

SEQ ID NO: 36684 - RNA, 64 nt, hsa
auauaugcuuacauuuuucacuuuugcuaaaaagaaaaaaaaaagguguuuauuuuuaacucuu

SEQ ID NO: 36685 - RNA, 64 nt, hsa
guuaaacaacucuuuaaaggauaauuauccaauaaaaaaaaaccuagugcugauucacagcuua

SEQ ID NO: 36686 - RNA, 64 nt, hsa
uguuaaacaacucuuuaaaggauaauuauccaauaaaaaaaaaccuagugcugauucacagcuu

SEQ ID NO: 36687 - RNA, 64 nt, hsa
aucagaauaaagguuauucuaacuguggggagaaaaaaaaaauuguaucaaguuccacagguag

SEQ ID NO: 36688 - RNA, 64 nt, hsa
gaucagaauaaagguuauucuaacuguggggagaaaaaaaaaauuguaucaaguuccacaggua

SEQ ID NO: 36689 - RNA, 64 nt, hsa
ggaucagaauaaagguuauucuaacuguggggagaaaaaaaaaauuguaucaaguuccacaggu

SEQ ID NO: 36690 - RNA, 64 nt, hsa
aaugaguauuacugaaacuuaaagaucaguggaaaaaaaaaacauuuaaaaauguuguaggaga

SEQ ID NO: 36691 - RNA, 64 nt, hsa
aaaugaguauuacugaaacuuaaagaucaguggaaaaaaaaaacauuuaaaaauguuguaggag

SEQ ID NO: 36692 - RNA, 64 nt, hsa
uaaaugaguauuacugaaacuuaaagaucaguggaaaaaaaaaacauuuaaaaauguuguagga

SEQ ID NO: 36693 - RNA, 64 nt, hsa
cuagucugggcaacagagugagaccuucucucaaaaaaaaaacccaaaauuguagaauuacuuc

SEQ ID NO: 36694 - RNA, 64 nt, hsa
ucuagucugggcaacagagugagaccuucucucaaaaaaaaaacccaaaauuguagaauuacuu

SEQ ID NO: 36695 - RNA, 64 nt, hsa
uucuagucugggcaacagagugagaccuucucucaaaaaaaaaacccaaaauuguagaauuacu

SEQ ID NO: 36696 - RNA, 64 nt, hsa
uagugagacgucgucucuacaaaaaaaaaaagaaaaaaaaaauuagccaggcaugcgaaacgcu

SEQ ID NO: 36697 - RNA, 64 nt, hsa
auagugagacgucgucucuacaaaaaaaaaaagaaaaaaaaaauuagccaggcaugcgaaacgc

SEQ ID NO: 36698 - RNA, 64 nt, hsa
cauagugagacgucgucucuacaaaaaaaaaaagaaaaaaaaaauuagccaggcaugcgaaacg

SEQ ID NO: 36699 - RNA, 64 nt, hsa
augaagcaacauagugagacgucgucucuacaaaaaaaaaaagaaaaaaaaaauuagccaggca

SEQ ID NO: 36700 - RNA, 64 nt, hsa
aaugaagcaacauagugagacgucgucucuacaaaaaaaaaaagaaaaaaaaaauuagccaggc

SEQ ID NO: 36701 - RNA, 64 nt, hsa
aaaugaagcaacauagugagacgucgucucuacaaaaaaaaaaagaaaaaaaaaauuagccagg

SEQ ID NO: 36702 - RNA, 64 nt, hsa
uaaaugaagcaacauagugagacgucgucucuacaaaaaaaaaaagaaaaaaaaaauuagccag

SEQ ID NO: 36703 - RNA, 64 nt, hsa
gaggaggagaaagcucucuauaccaaagacugaaaaaaaaaauccugucuguuuuuguauuuau

SEQ ID NO: 36704 - RNA, 64 nt, hsa
agaggaggagaaagcucucuauaccaaagacugaaaaaaaaaauccugucuguuuuuguauuua

SEQ ID NO: 36705 - RNA, 64 nt, hsa
aagaggaggagaaagcucucuauaccaaagacugaaaaaaaaaauccugucuguuuuuguauuu

SEQ ID NO: 36706 - RNA, 64 nt, hsa
uauaauuaaagaaaauugccaaaauauauuaaaaaaaaaaaagagaaaauacugaaaccacaga

SEQ ID NO: 36707 - RNA, 64 nt, hsa
uuauaauuaaagaaaauugccaaaauauauuaaaaaaaaaaaagagaaaauacugaaaccacag

SEQ ID NO: 36708 - RNA, 64 nt, hsa
uuuauaauuaaagaaaauugccaaaauauauuaaaaaaaaaaaagagaaaauacugaaaccaca

SEQ ID NO: 36709 - RNA, 64 nt, hsa
auuuauaauuaaagaaaauugccaaaauauauuaaaaaaaaaaaagagaaaauacugaaaccac

SEQ ID NO: 36710 - RNA, 64 nt, hsa
uauuuauaauuaaagaaaauugccaaaauauauuaaaaaaaaaaaagagaaaauacugaaacca

SEQ ID NO: 36711 - RNA, 64 nt, hsa
uacaggcaugcaccaccaagcuuggcuaauuuaaaaaaaaaauuauauagauagggacuugcua

SEQ ID NO: 36712 - RNA, 64 nt, hsa
cuacaggcaugcaccaccaagcuuggcuaauuuaaaaaaaaaauuauauagauagggacuugcu

SEQ ID NO: 36713 - RNA, 64 nt, hsa
acuacaggcaugcaccaccaagcuuggcuaauuuaaaaaaaaaauuauauagauagggacuugc

SEQ ID NO: 36714 - RNA, 64 nt, hsa
acaaauauugucauccgcuugcugugcuguggggaaaaaaaaguagaggaaaaagugugugguu

SEQ ID NO: 36715 - RNA, 64 nt, hsa
aggauuuuauauuaagccuucuugcucucaaaaaaaaaaaaagguuuuaacuauuccauuucca

SEQ ID NO: 36716 - RNA, 64 nt, hsa
caggauuuuauauuaagccuucuugcucucaaaaaaaaaaaaagguuuuaacuauuccauuucc

SEQ ID NO: 36717 - RNA, 64 nt, hsa
ccaggauuuuauauuaagccuucuugcucucaaaaaaaaaaaaagguuuuaacuauuccauuuc

SEQ ID NO: 36718 - RNA, 64 nt, hsa
cccaggauuuuauauuaagccuucuugcucucaaaaaaaaaaaaagguuuuaacuauuccauuu

SEQ ID NO: 36719 - RNA, 64 nt, hsa
ccccaggauuuuauauuaagccuucuugcucucaaaaaaaaaaaaagguuuuaacuauuccauu

SEQ ID NO: 36720 - RNA, 64 nt, hsa
gccccaggauuuuauauuaagccuucuugcucucaaaaaaaaaaaaagguuuuaacuauuccau

SEQ ID NO: 36721 - RNA, 64 nt, hsa
aagcauuaggcugaaagaguuuauuuugguggucaaaaaaaauaugcuuccacucauguaacua

SEQ ID NO: 36722 - RNA, 64 nt, hsa
gauuuuuuaaaaauaauauuguuaaucaguaaaaaaaaaaaauauuuuugaucuaaacauaggu

SEQ ID NO: 36723 - RNA, 64 nt, hsa
agauuuuuuaaaaauaauauuguuaaucaguaaaaaaaaaaaauauuuuugaucuaaacauagg

SEQ ID NO: 36724 - RNA, 64 nt, hsa
aagauuuuuuaaaaauaauauuguuaaucaguaaaaaaaaaaaauauuuuugaucuaaacauag

SEQ ID NO: 36725 - RNA, 64 nt, hsa
gaagauuuuuuaaaaauaauauuguuaaucaguaaaaaaaaaaaauauuuuugaucuaaacaua

SEQ ID NO: 36726 - RNA, 64 nt, hsa
cgaagauuuuuuaaaaauaauauuguuaaucaguaaaaaaaaaaaauauuuuugaucuaaacau

SEQ ID NO: 36727 - RNA, 64 nt, hsa
uucauaaggggaauuuuuuuuaaaaaacaacaaaaaaaaaaacauacaaagauggguuucugaa

SEQ ID NO: 36728 - RNA, 64 nt, hsa
guucauaaggggaauuuuuuuuaaaaaacaacaaaaaaaaaaacauacaaagauggguuucuga

SEQ ID NO: 36729 - RNA, 64 nt, hsa
aguucauaaggggaauuuuuuuuaaaaaacaacaaaaaaaaaaacauacaaagauggguuucug

SEQ ID NO: 36730 - RNA, 64 nt, hsa
caguucauaaggggaauuuuuuuuaaaaaacaacaaaaaaaaaaacauacaaagauggguuucu

SEQ ID NO: 36731 - RNA, 64 nt, hsa
caacagagugagacucugucucaaaaaaaaaaaaaaaaaaaauggaacgcagggcaagaacucg

SEQ ID NO: 36732 - RNA, 64 nt, hsa
gcaacagagugagacucugucucaaaaaaaaaaaaaaaaaaaauggaacgcagggcaagaacuc

SEQ ID NO: 36733 - RNA, 64 nt, hsa
ggcaacagagugagacucugucucaaaaaaaaaaaaaaaaaaaauggaacgcagggcaagaacu

SEQ ID NO: 36734 - RNA, 64 nt, hsa
gggcaacagagugagacucugucucaaaaaaaaaaaaaaaaaaaauggaacgcagggcaagaac

SEQ ID NO: 36735 - RNA, 64 nt, hsa
ugggcaacagagugagacucugucucaaaaaaaaaaaaaaaaaaaauggaacgcagggcaagaa

SEQ ID NO: 36736 - RNA, 64 nt, hsa
cugggcaacagagugagacucugucucaaaaaaaaaaaaaaaaaaaauggaacgcagggcaaga

SEQ ID NO: 36737 - RNA, 64 nt, hsa
ccugggcaacagagugagacucugucucaaaaaaaaaaaaaaaaaaaauggaacgcagggcaag

SEQ ID NO: 36738 - RNA, 64 nt, hsa
gccugggcaacagagugagacucugucucaaaaaaaaaaaaaaaaaaaauggaacgcagggcaa

SEQ ID NO: 36739 - RNA, 64 nt, hsa
agccugggcaacagagugagacucugucucaaaaaaaaaaaaaaaaaaaauggaacgcagggca

SEQ ID NO: 36740 - RNA, 64 nt, hsa
cagccugggcaacagagugagacucugucucaaaaaaaaaaaaaaaaaaaauggaacgcagggc

SEQ ID NO: 36741 - RNA, 64 nt, hsa
ccagccugggcaacagagugagacucugucucaaaaaaaaaaaaaaaaaaaauggaacgcaggg

SEQ ID NO: 36742 - RNA, 64 nt, hsa
uccagccugggcaacagagugagacucugucucaaaaaaaaaaaaaaaaaaaauggaacgcagg

SEQ ID NO: 36743 - RNA, 64 nt, hsa
cuccagccugggcaacagagugagacucugucucaaaaaaaaaaaaaaaaaaaauggaacgcag

SEQ ID NO: 36744 - RNA, 64 nt, hsa
cauguaggaaagagaggauaaacaaagaaaaaagaaaaaaaaauaagcucauacccaaauucac

SEQ ID NO: 36745 - RNA, 64 nt, hsa
auguaggaaagagaggauaaacaaagaaaaaagaaaaaaaaauaagcucauacccaaauucaca

SEQ ID NO: 36746 - RNA, 64 nt, hsa
gaccgagccccagcaagggcuccuccaggauugcaaaaaaaaaaggaagagaaaagaugaaccu

SEQ ID NO: 36747 - RNA, 64 nt, hsa
accgagccccagcaagggcuccuccaggauugcaaaaaaaaaaggaagagaaaagaugaaccuu

SEQ ID NO: 36748 - RNA, 64 nt, hsa
ccgagccccagcaagggcuccuccaggauugcaaaaaaaaaaggaagagaaaagaugaaccuuu

SEQ ID NO: 36749 - RNA, 64 nt, hsa
aaaaucuucaaguuacauuuaacccauaagguuuaaaaaaaaggaaaaaaaacgguugugguuc

SEQ ID NO: 36750 - RNA, 64 nt, hsa
aguuacauuuaacccauaagguuuaaaaaaaaggaaaaaaaacgguugugguucccuuucuucc

SEQ ID NO: 36751 - RNA, 64 nt, hsa
aacagacucaugacaaaggauucaagauuguuugaaaaaaaaaaaaggggagcagggaggcaga

SEQ ID NO: 36752 - RNA, 64 nt, hsa
acagacucaugacaaaggauucaagauuguuugaaaaaaaaaaaaggggagcagggaggcagaa

SEQ ID NO: 36753 - RNA, 64 nt, hsa
cagacucaugacaaaggauucaagauuguuugaaaaaaaaaaaaggggagcagggaggcagaaa

SEQ ID NO: 36754 - RNA, 64 nt, hsa
agacucaugacaaaggauucaagauuguuugaaaaaaaaaaaaggggagcagggaggcagaaag

SEQ ID NO: 36755 - RNA, 64 nt, hsa
gacucaugacaaaggauucaagauuguuugaaaaaaaaaaaaggggagcagggaggcagaaagu

SEQ ID NO: 36756 - RNA, 64 nt, hsa
acuccagccuggucgacagagugaacucugucucaaaaaaaaaaaaaaaagaaaagaaagaaga

SEQ ID NO: 36757 - RNA, 64 nt, hsa
cuccagccuggucgacagagugaacucugucucaaaaaaaaaaaaaaaagaaaagaaagaagaa

SEQ ID NO: 36758 - RNA, 64 nt, hsa
uccagccuggucgacagagugaacucugucucaaaaaaaaaaaaaaaagaaaagaaagaagaag

SEQ ID NO: 36759 - RNA, 64 nt, hsa
ccagccuggucgacagagugaacucugucucaaaaaaaaaaaaaaaagaaaagaaagaagaagc

SEQ ID NO: 36760 - RNA, 64 nt, hsa
cagccuggucgacagagugaacucugucucaaaaaaaaaaaaaaaagaaaagaaagaagaagcc

SEQ ID NO: 36761 - RNA, 64 nt, hsa
agccuggucgacagagugaacucugucucaaaaaaaaaaaaaaaagaaaagaaagaagaagcca

SEQ ID NO: 36762 - RNA, 64 nt, hsa
gccuggucgacagagugaacucugucucaaaaaaaaaaaaaaaagaaaagaaagaagaagccau

SEQ ID NO: 36763 - RNA, 64 nt, hsa
ccuggucgacagagugaacucugucucaaaaaaaaaaaaaaaagaaaagaaagaagaagccauu

SEQ ID NO: 36764 - RNA, 64 nt, hsa
cuggucgacagagugaacucugucucaaaaaaaaaaaaaaaagaaaagaaagaagaagccauuc

SEQ ID NO: 36765 - RNA, 64 nt, hsa
ucagaauguuuguuauguaaauuuuaccucaacuaaaaaaaaaaaugcccagguacugcuugug

SEQ ID NO: 36766 - RNA, 64 nt, hsa
cagaauguuuguuauguaaauuuuaccucaacuaaaaaaaaaaaugcccagguacugcuugugc

SEQ ID NO: 36767 - RNA, 64 nt, hsa
agaauguuuguuauguaaauuuuaccucaacuaaaaaaaaaaaugcccagguacugcuugugca

SEQ ID NO: 36768 - RNA, 64 nt, hsa
gaauguuuguuauguaaauuuuaccucaacuaaaaaaaaaaaugcccagguacugcuugugcag

SEQ ID NO: 36769 - RNA, 64 nt, hsa
gagaaccagcgaaaucccccaugucaucagucuuaaaaaaaaaauuuuacaaauccacguauuu

SEQ ID NO: 36770 - RNA, 64 nt, hsa
agaaccagcgaaaucccccaugucaucagucuuaaaaaaaaaauuuuacaaauccacguauuug

SEQ ID NO: 36771 - RNA, 64 nt, hsa
gaaccagcgaaaucccccaugucaucagucuuaaaaaaaaaauuuuacaaauccacguauuugu

SEQ ID NO: 36772 - RNA, 64 nt, hsa
ucuacuccaggacugguuuuguuuuuauauauauaaaaaaaaaaagugaaaacaccaaugugug

SEQ ID NO: 36773 - RNA, 64 nt, hsa
cuacuccaggacugguuuuguuuuuauauauauaaaaaaaaaaagugaaaacaccaauguguga

SEQ ID NO: 36774 - RNA, 64 nt, hsa
uacuccaggacugguuuuguuuuuauauauauaaaaaaaaaaagugaaaacaccaaugugugaa

SEQ ID NO: 36775 - RNA, 64 nt, hsa
acuccaggacugguuuuguuuuuauauauauaaaaaaaaaaagugaaaacaccaaugugugaaa

SEQ ID NO: 36776 - RNA, 61 nt, hsa
guccuggggaggccaaauaagccgccacugcaaaaaaaaacagggucagaaaauuacuugg

SEQ ID NO: 36777 - RNA, 62 nt, hsa
guccuggggaggccaaauaagccgccacugcaaaaaaaaacagggucagaaaauuacuuggg

SEQ ID NO: 36778 - RNA, 64 nt, hsa
uaggaaacagagcugccaauugaaacagaagaagaaaaaaaaaaaaagcagcagacaacacacu

SEQ ID NO: 36779 - RNA, 64 nt, hsa
aggaaacagagcugccaauugaaacagaagaagaaaaaaaaaaaaagcagcagacaacacacug

SEQ ID NO: 36780 - RNA, 64 nt, hsa
ggaaacagagcugccaauugaaacagaagaagaaaaaaaaaaaaagcagcagacaacacacugu

SEQ ID NO: 36781 - RNA, 64 nt, hsa
gaaacagagcugccaauugaaacagaagaagaaaaaaaaaaaaagcagcagacaacacacugua

SEQ ID NO: 36782 - RNA, 64 nt, hsa
aaacagagcugccaauugaaacagaagaagaaaaaaaaaaaaagcagcagacaacacacuguag

SEQ ID NO: 36783 - RNA, 64 nt, hsa
aacagagcugccaauugaaacagaagaagaaaaaaaaaaaaagcagcagacaacacacuguaga

SEQ ID NO: 36784 - RNA, 64 nt, hsa
cuccagucugggugucagaaugagaccccaucucaaaaaaaaaaaaaaaaaaaaaaaagaagaa

SEQ ID NO: 36785 - RNA, 64 nt, hsa
uccagucugggugucagaaugagaccccaucucaaaaaaaaaaaaaaaaaaaaaaaagaagaag

SEQ ID NO: 36786 - RNA, 64 nt, hsa
ccagucugggugucagaaugagaccccaucucaaaaaaaaaaaaaaaaaaaaaaaagaagaaga

SEQ ID NO: 36787 - RNA, 64 nt, hsa
cagucugggugucagaaugagaccccaucucaaaaaaaaaaaaaaaaaaaaaaaagaagaagaa

SEQ ID NO: 36788 - RNA, 64 nt, hsa
agucugggugucagaaugagaccccaucucaaaaaaaaaaaaaaaaaaaaaaaagaagaagaau

SEQ ID NO: 36789 - RNA, 64 nt, hsa
gucugggugucagaaugagaccccaucucaaaaaaaaaaaaaaaaaaaaaaaagaagaagaaua

SEQ ID NO: 36790 - RNA, 64 nt, hsa
ucugggugucagaaugagaccccaucucaaaaaaaaaaaaaaaaaaaaaaaagaagaagaauac

SEQ ID NO: 36791 - RNA, 64 nt, hsa
cugggugucagaaugagaccccaucucaaaaaaaaaaaaaaaaaaaaaaaagaagaagaauaca

SEQ ID NO: 36792 - RNA, 64 nt, hsa
ugggugucagaaugagaccccaucucaaaaaaaaaaaaaaaaaaaaaaaagaagaagaauacag

SEQ ID NO: 36793 - RNA, 64 nt, hsa
gggugucagaaugagaccccaucucaaaaaaaaaaaaaaaaaaaaaaaagaagaagaauacagu

SEQ ID NO: 36794 - RNA, 64 nt, hsa
ggugucagaaugagaccccaucucaaaaaaaaaaaaaaaaaaaaaaaagaagaagaauacaguc

SEQ ID NO: 36795 - RNA, 64 nt, hsa
gugucagaaugagaccccaucucaaaaaaaaaaaaaaaaaaaaaaaagaagaagaauacaguca

SEQ ID NO: 36796 - RNA, 64 nt, hsa
ugucagaaugagaccccaucucaaaaaaaaaaaaaaaaaaaaaaaagaagaagaauacagucau

SEQ ID NO: 36797 - RNA, 64 nt, hsa
gucagaaugagaccccaucucaaaaaaaaaaaaaaaaaaaaaaaagaagaagaauacagucaug

SEQ ID NO: 36798 - RNA, 64 nt, hsa
ucagaaugagaccccaucucaaaaaaaaaaaaaaaaaaaaaaaagaagaagaauacagucaugu

SEQ ID NO: 36799 - RNA, 64 nt, hsa
cagaaugagaccccaucucaaaaaaaaaaaaaaaaaaaaaaaagaagaagaauacagucaugua

SEQ ID NO: 36800 - RNA, 64 nt, hsa
agaaugagaccccaucucaaaaaaaaaaaaaaaaaaaaaaaagaagaagaauacagucauguau

SEQ ID NO: 36801 - RNA, 64 nt, hsa
cuccagccugggugacagagcgagacuccaucucaaaaaaaaaaaaaaaaagaauauauugacg

SEQ ID NO: 36802 - RNA, 64 nt, hsa
uccagccugggugacagagcgagacuccaucucaaaaaaaaaaaaaaaaagaauauauugacgg

SEQ ID NO: 36803 - RNA, 64 nt, hsa
ccagccugggugacagagcgagacuccaucucaaaaaaaaaaaaaaaaagaauauauugacgga

SEQ ID NO: 36804 - RNA, 64 nt, hsa
cagccugggugacagagcgagacuccaucucaaaaaaaaaaaaaaaaagaauauauugacggaa

SEQ ID NO: 36805 - RNA, 64 nt, hsa
agccugggugacagagcgagacuccaucucaaaaaaaaaaaaaaaaagaauauauugacggaag

SEQ ID NO: 36806 - RNA, 64 nt, hsa
gccugggugacagagcgagacuccaucucaaaaaaaaaaaaaaaaagaauauauugacggaaga

SEQ ID NO: 36807 - RNA, 64 nt, hsa
ccugggugacagagcgagacuccaucucaaaaaaaaaaaaaaaaagaauauauugacggaagaa

SEQ ID NO: 36808 - RNA, 64 nt, hsa
cugggugacagagcgagacuccaucucaaaaaaaaaaaaaaaaagaauauauugacggaagaau

SEQ ID NO: 36809 - RNA, 64 nt, hsa
ugggugacagagcgagacuccaucucaaaaaaaaaaaaaaaaagaauauauugacggaagaaua

SEQ ID NO: 36810 - RNA, 64 nt, hsa
gggugacagagcgagacuccaucucaaaaaaaaaaaaaaaaagaauauauugacggaagaauag

SEQ ID NO: 36811 - RNA, 64 nt, hsa
uuuuuuccuuuuuuuccaaaacacuuuauacuuuaaaaaaaaaaaaaaaaagcaauuccuggug

SEQ ID NO: 36812 - RNA, 64 nt, hsa
uuuuuccuuuuuuuccaaaacacuuuauacuuuaaaaaaaaaaaaaaaaagcaauuccuggugg

SEQ ID NO: 36813 - RNA, 64 nt, hsa
uuuuccuuuuuuuccaaaacacuuuauacuuuaaaaaaaaaaaaaaaaagcaauuccugguggc

SEQ ID NO: 36814 - RNA, 64 nt, hsa
uuuccuuuuuuuccaaaacacuuuauacuuuaaaaaaaaaaaaaaaaagcaauuccugguggcu

SEQ ID NO: 36815 - RNA, 64 nt, hsa
uuccuuuuuuuccaaaacacuuuauacuuuaaaaaaaaaaaaaaaaagcaauuccugguggcug

SEQ ID NO: 36816 - RNA, 64 nt, hsa
uccuuuuuuuccaaaacacuuuauacuuuaaaaaaaaaaaaaaaaagcaauuccugguggcugu

SEQ ID NO: 36817 - RNA, 64 nt, hsa
ccuuuuuuuccaaaacacuuuauacuuuaaaaaaaaaaaaaaaaagcaauuccugguggcugug

SEQ ID NO: 36818 - RNA, 64 nt, hsa
cuuuuuuuccaaaacacuuuauacuuuaaaaaaaaaaaaaaaaagcaauuccugguggcugugu

SEQ ID NO: 36819 - RNA, 64 nt, hsa
uuuuuuuccaaaacacuuuauacuuuaaaaaaaaaaaaaaaaagcaauuccugguggcugugug

SEQ ID NO: 36820 - RNA, 64 nt, hsa
uuuuuuccaaaacacuuuauacuuuaaaaaaaaaaaaaaaaagcaauuccugguggcugugugc

SEQ ID NO: 36821 - RNA, 64 nt, hsa
cuccagccugggcaacauagcaaaauccugucucaaaaaaaaaguuaaaaaauauugcccggcu

SEQ ID NO: 36822 - RNA, 64 nt, hsa
uccagccugggcaacauagcaaaauccugucucaaaaaaaaaguuaaaaaauauugcccggcuc

SEQ ID NO: 36823 - RNA, 64 nt, hsa
cuccagccugggcgacaguaccagacuccaucucaaaaaaaaaaaaaccagacugaauuaauuu

SEQ ID NO: 36824 - RNA, 64 nt, hsa
uccagccugggcgacaguaccagacuccaucucaaaaaaaaaaaaaccagacugaauuaauuuu

SEQ ID NO: 36825 - RNA, 64 nt, hsa
ccagccugggcgacaguaccagacuccaucucaaaaaaaaaaaaaccagacugaauuaauuuua

SEQ ID NO: 36826 - RNA, 64 nt, hsa
cagccugggcgacaguaccagacuccaucucaaaaaaaaaaaaaccagacugaauuaauuuuaa

SEQ ID NO: 36827 - RNA, 64 nt, hsa
agccugggcgacaguaccagacuccaucucaaaaaaaaaaaaaccagacugaauuaauuuuaac

SEQ ID NO: 36828 - RNA, 64 nt, hsa
gccugggcgacaguaccagacuccaucucaaaaaaaaaaaaaccagacugaauuaauuuuaacu

SEQ ID NO: 36829 - RNA, 64 nt, hsa
acaugacaaagccccaucucuacaaaaaaauuacaaaaaaaaaaaaaacaggugugguggcaug

SEQ ID NO: 36830 - RNA, 64 nt, hsa
caugacaaagccccaucucuacaaaaaaauuacaaaaaaaaaaaaaacaggugugguggcaugc

SEQ ID NO: 36831 - RNA, 64 nt, hsa
augacaaagccccaucucuacaaaaaaauuacaaaaaaaaaaaaaacaggugugguggcaugca

SEQ ID NO: 36832 - RNA, 64 nt, hsa
ugacaaagccccaucucuacaaaaaaauuacaaaaaaaaaaaaaacaggugugguggcaugcac

SEQ ID NO: 36833 - RNA, 64 nt, hsa
gacaaagccccaucucuacaaaaaaauuacaaaaaaaaaaaaaacaggugugguggcaugcacc

SEQ ID NO: 36834 - RNA, 64 nt, hsa
acaaagccccaucucuacaaaaaaauuacaaaaaaaaaaaaaacaggugugguggcaugcaccu

SEQ ID NO: 36835 - RNA, 64 nt, hsa
caaagccccaucucuacaaaaaaauuacaaaaaaaaaaaaaacaggugugguggcaugcaccug

SEQ ID NO: 36836 - RNA, 64 nt, hsa
uacccugucuguuggucagacucaaaugagaguuaaaaaaaaaaaaaaaaaucuguaugccuga

SEQ ID NO: 36837 - RNA, 64 nt, hsa
acccugucuguuggucagacucaaaugagaguuaaaaaaaaaaaaaaaaaucuguaugccugag

SEQ ID NO: 36838 - RNA, 64 nt, hsa
cccugucuguuggucagacucaaaugagaguuaaaaaaaaaaaaaaaaaucuguaugccugagu

SEQ ID NO: 36839 - RNA, 64 nt, hsa
ccugucuguuggucagacucaaaugagaguuaaaaaaaaaaaaaaaaaucuguaugccugagua

SEQ ID NO: 36840 - RNA, 64 nt, hsa
cugucuguuggucagacucaaaugagaguuaaaaaaaaaaaaaaaaaucuguaugccugaguac

SEQ ID NO: 36841 - RNA, 64 nt, hsa
ugucuguuggucagacucaaaugagaguuaaaaaaaaaaaaaaaaaucuguaugccugaguacc

SEQ ID NO: 36842 - RNA, 64 nt, hsa
gucuguuggucagacucaaaugagaguuaaaaaaaaaaaaaaaaaucuguaugccugaguacca

SEQ ID NO: 36843 - RNA, 64 nt, hsa
ucuguuggucagacucaaaugagaguuaaaaaaaaaaaaaaaaaucuguaugccugaguaccau

SEQ ID NO: 36844 - RNA, 64 nt, hsa
cuguuggucagacucaaaugagaguuaaaaaaaaaaaaaaaaaucuguaugccugaguaccauc

SEQ ID NO: 36845 - RNA, 64 nt, hsa
uguuggucagacucaaaugagaguuaaaaaaaaaaaaaaaaaucuguaugccugaguaccaucc

SEQ ID NO: 36846 - RNA, 64 nt, hsa
ggugcaaagauguucauucuuuuaaaaaauguuuaaaaaaaaaaaaaaacugccuuucuucccc

SEQ ID NO: 36847 - RNA, 64 nt, hsa
gugcaaagauguucauucuuuuaaaaaauguuuaaaaaaaaaaaaaaacugccuuucuuccccu

SEQ ID NO: 36848 - RNA, 64 nt, hsa
ugcaaagauguucauucuuuuaaaaaauguuuaaaaaaaaaaaaaaacugccuuucuuccccuc

SEQ ID NO: 36849 - RNA, 64 nt, hsa
gcaaagauguucauucuuuuaaaaaauguuuaaaaaaaaaaaaaaacugccuuucuuccccuca

SEQ ID NO: 36850 - RNA, 64 nt, hsa
caaagauguucauucuuuuaaaaaauguuuaaaaaaaaaaaaaaacugccuuucuuccccucaa

SEQ ID NO: 36851 - RNA, 64 nt, hsa
aaagauguucauucuuuuaaaaaauguuuaaaaaaaaaaaaaaacugccuuucuuccccucaag

SEQ ID NO: 36852 - RNA, 64 nt, hsa
aagauguucauucuuuuaaaaaauguuuaaaaaaaaaaaaaaacugccuuucuuccccucaagu

SEQ ID NO: 36853 - RNA, 64 nt, hsa
agauguucauucuuuuaaaaaauguuuaaaaaaaaaaaaaaacugccuuucuuccccucaaguc

SEQ ID NO: 36854 - RNA, 64 nt, hsa
ugugaaucagugagauguuaguagaauaagccuuaaaaaaaaaaaaaucgguugggugcagugg

SEQ ID NO: 36855 - RNA, 64 nt, hsa
gugaaucagugagauguuaguagaauaagccuuaaaaaaaaaaaaaucgguugggugcaguggc

SEQ ID NO: 36856 - RNA, 64 nt, hsa
ugaaucagugagauguuaguagaauaagccuuaaaaaaaaaaaaaucgguugggugcaguggca

SEQ ID NO: 36857 - RNA, 64 nt, hsa
gaaucagugagauguuaguagaauaagccuuaaaaaaaaaaaaaucgguugggugcaguggcac

SEQ ID NO: 36858 - RNA, 64 nt, hsa
aaucagugagauguuaguagaauaagccuuaaaaaaaaaaaaaucgguugggugcaguggcaca

SEQ ID NO: 36859 - RNA, 64 nt, hsa
aucagugagauguuaguagaauaagccuuaaaaaaaaaaaaaucgguugggugcaguggcacac

SEQ ID NO: 36860 - RNA, 64 nt, hsa
uccagccugggcaacaugagugaaagucugacucaaaaaaaaaaaauuuaaaaaacaaaauaau

SEQ ID NO: 36861 - RNA, 64 nt, hsa
ccagccugggcaacaugagugaaagucugacucaaaaaaaaaaaauuuaaaaaacaaaauaauc

SEQ ID NO: 36862 - RNA, 64 nt, hsa
cagccugggcaacaugagugaaagucugacucaaaaaaaaaaaauuuaaaaaacaaaauaaucu

SEQ ID NO: 36863 - RNA, 64 nt, hsa
agccugggcaacaugagugaaagucugacucaaaaaaaaaaaauuuaaaaaacaaaauaaucua

SEQ ID NO: 36864 - RNA, 64 nt, hsa
gccugggcaacaugagugaaagucugacucaaaaaaaaaaaauuuaaaaaacaaaauaaucuag

SEQ ID NO: 36865 - RNA, 64 nt, hsa
acagaacgagacucugucuuaaaaacaaacaaacaaaaaaaaaaucuguuagauaagcuaucaa

SEQ ID NO: 36866 - RNA, 64 nt, hsa
cagaacgagacucugucuuaaaaacaaacaaacaaaaaaaaaaucuguuagauaagcuaucaaa

SEQ ID NO: 36867 - RNA, 64 nt, hsa
agaacgagacucugucuuaaaaacaaacaaacaaaaaaaaaaucuguuagauaagcuaucaaaa

SEQ ID NO: 36868 - RNA, 64 nt, hsa
gacagaguuagauuccacccucucccaccccggcaaaaaaaaaaaaaaaagaugcaaucaaagg

SEQ ID NO: 36869 - RNA, 64 nt, hsa
acagaguuagauuccacccucucccaccccggcaaaaaaaaaaaaaaaagaugcaaucaaaggg

SEQ ID NO: 36870 - RNA, 64 nt, hsa
cagaguuagauuccacccucucccaccccggcaaaaaaaaaaaaaaaagaugcaaucaaagggg

SEQ ID NO: 36871 - RNA, 64 nt, hsa
agaguuagauuccacccucucccaccccggcaaaaaaaaaaaaaaaagaugcaaucaaaggggc

SEQ ID NO: 36872 - RNA, 64 nt, hsa
gaguuagauuccacccucucccaccccggcaaaaaaaaaaaaaaaagaugcaaucaaaggggcu

SEQ ID NO: 36873 - RNA, 64 nt, hsa
aguuagauuccacccucucccaccccggcaaaaaaaaaaaaaaaagaugcaaucaaaggggcug

SEQ ID NO: 36874 - RNA, 64 nt, hsa
guuagauuccacccucucccaccccggcaaaaaaaaaaaaaaaagaugcaaucaaaggggcugu

SEQ ID NO: 36875 - RNA, 64 nt, hsa
uuagauuccacccucucccaccccggcaaaaaaaaaaaaaaaagaugcaaucaaaggggcuguu

SEQ ID NO: 36876 - RNA, 64 nt, hsa
uagauuccacccucucccaccccggcaaaaaaaaaaaaaaaagaugcaaucaaaggggcuguug

SEQ ID NO: 36877 - RNA, 64 nt, hsa
ccagccugggcaccaaugugagaaccugucuuggaaaaaaaaaaaaagaaacauguuuuaguag

SEQ ID NO: 36878 - RNA, 64 nt, hsa
cagccugggcaccaaugugagaaccugucuuggaaaaaaaaaaaaagaaacauguuuuaguaga

SEQ ID NO: 36879 - RNA, 64 nt, hsa
agccugggcaccaaugugagaaccugucuuggaaaaaaaaaaaaagaaacauguuuuaguagaa

SEQ ID NO: 36880 - RNA, 64 nt, hsa
gccugggcaccaaugugagaaccugucuuggaaaaaaaaaaaaagaaacauguuuuaguagaag

SEQ ID NO: 36881 - RNA, 64 nt, hsa
ccugggcaccaaugugagaaccugucuuggaaaaaaaaaaaaagaaacauguuuuaguagaagu

SEQ ID NO: 36882 - RNA, 64 nt, hsa
cugggcaccaaugugagaaccugucuuggaaaaaaaaaaaaagaaacauguuuuaguagaaguu

SEQ ID NO: 36883 - RNA, 64 nt, hsa
uccagccugggcaacaagagcaaaauucugccucaaaaaaaaaaauaguaauaauacaaaaauu

SEQ ID NO: 36884 - RNA, 64 nt, hsa
ccagccugggcaacaagagcaaaauucugccucaaaaaaaaaaauaguaauaauacaaaaauua

SEQ ID NO: 36885 - RNA, 64 nt, hsa
cagccugggcaacaagagcaaaauucugccucaaaaaaaaaaauaguaauaauacaaaaauuag

SEQ ID NO: 36886 - RNA, 64 nt, hsa
agccugggcaacaagagcaaaauucugccucaaaaaaaaaaauaguaauaauacaaaaauuagc

SEQ ID NO: 36887 - RNA, 64 nt, hsa
cucaagcuuggaugacagagcaagacuccguuucaaaaaaaaaaaaccuccucucuuccuucac

SEQ ID NO: 36888 - RNA, 64 nt, hsa
ucaagcuuggaugacagagcaagacuccguuucaaaaaaaaaaaaccuccucucuuccuucaca

SEQ ID NO: 36889 - RNA, 64 nt, hsa
caagcuuggaugacagagcaagacuccguuucaaaaaaaaaaaaccuccucucuuccuucacac

SEQ ID NO: 36890 - RNA, 64 nt, hsa
aagcuuggaugacagagcaagacuccguuucaaaaaaaaaaaaccuccucucuuccuucacacc

SEQ ID NO: 36891 - RNA, 64 nt, hsa
agcuuggaugacagagcaagacuccguuucaaaaaaaaaaaaccuccucucuuccuucacaccu

SEQ ID NO: 36892 - RNA, 64 nt, hsa
aaggaaguagaaacaaaauacaauuuuuuugguaaaaaaaaauuacuguuuauuaaaguacaac

SEQ ID NO: 36893 - RNA, 64 nt, hsa
caaggaaguagaaacaaaauacaauuuuuuugguaaaaaaaaauuacuguuuauuaaaguacaa

SEQ ID NO: 36894 - RNA, 64 nt, hsa
gggggacaaaagugagacaucgucucaaaaaaaaaaaaaaaagcuggguaugguggcgcaugcc

SEQ ID NO: 36895 - RNA, 64 nt, hsa
ugggggacaaaagugagacaucgucucaaaaaaaaaaaaaaaagcuggguaugguggcgcaugc

SEQ ID NO: 36896 - RNA, 64 nt, hsa
cugggggacaaaagugagacaucgucucaaaaaaaaaaaaaaaagcuggguaugguggcgcaug

SEQ ID NO: 36897 - RNA, 64 nt, hsa
ccugggggacaaaagugagacaucgucucaaaaaaaaaaaaaaaagcuggguaugguggcgcau

SEQ ID NO: 36898 - RNA, 64 nt, hsa
gccugggggacaaaagugagacaucgucucaaaaaaaaaaaaaaaagcuggguaugguggcgca

SEQ ID NO: 36899 - RNA, 64 nt, hsa
agccugggggacaaaagugagacaucgucucaaaaaaaaaaaaaaaagcuggguaugguggcgc

SEQ ID NO: 36900 - RNA, 64 nt, hsa
cagccugggggacaaaagugagacaucgucucaaaaaaaaaaaaaaaagcuggguaugguggcg

SEQ ID NO: 36901 - RNA, 64 nt, hsa
ccagccugggggacaaaagugagacaucgucucaaaaaaaaaaaaaaaagcuggguaugguggc

SEQ ID NO: 36902 - RNA, 64 nt, hsa
uccagccugggggacaaaagugagacaucgucucaaaaaaaaaaaaaaaagcuggguauggugg

SEQ ID NO: 36903 - RNA, 64 nt, hsa
cagucaaugcauugcuuaaggucucuuauuuacaaaaaaaaaccuuaaacauagucgcugucau

SEQ ID NO: 36904 - RNA, 64 nt, hsa
gcagucaaugcauugcuuaaggucucuuauuuacaaaaaaaaaccuuaaacauagucgcuguca

SEQ ID NO: 36905 - RNA, 64 nt, hsa
augccacugacaaugagaucucccuuuaaaaaaaaaaaaaaacuucuacuuuuccucuuaaagg

SEQ ID NO: 36906 - RNA, 64 nt, hsa
aaugccacugacaaugagaucucccuuuaaaaaaaaaaaaaaacuucuacuuuuccucuuaaag

SEQ ID NO: 36907 - RNA, 64 nt, hsa
aaaugccacugacaaugagaucucccuuuaaaaaaaaaaaaaaacuucuacuuuuccucuuaaa

SEQ ID NO: 36908 - RNA, 64 nt, hsa
aaaaugccacugacaaugagaucucccuuuaaaaaaaaaaaaaaacuucuacuuuuccucuuaa

SEQ ID NO: 36909 - RNA, 64 nt, hsa
uaaaaugccacugacaaugagaucucccuuuaaaaaaaaaaaaaaacuucuacuuuuccucuua

SEQ ID NO: 36910 - RNA, 64 nt, hsa
uuaaaaugccacugacaaugagaucucccuuuaaaaaaaaaaaaaaacuucuacuuuuccucuu

SEQ ID NO: 36911 - RNA, 64 nt, hsa
cuuaaaaugccacugacaaugagaucucccuuuaaaaaaaaaaaaaaacuucuacuuuuccucu

SEQ ID NO: 36912 - RNA, 64 nt, hsa
ucuuaaaaugccacugacaaugagaucucccuuuaaaaaaaaaaaaaaacuucuacuuuuccuc

SEQ ID NO: 36913 - RNA, 64 nt, hsa
ucugagccaccuuccuuaaaggaaauguuaaaaaaaaaaaaacaaaaaaacaaaaaaacaacug

SEQ ID NO: 36914 - RNA, 64 nt, hsa
aucugagccaccuuccuuaaaggaaauguuaaaaaaaaaaaaacaaaaaaacaaaaaaacaacu

SEQ ID NO: 36915 - RNA, 64 nt, hsa
aaucugagccaccuuccuuaaaggaaauguuaaaaaaaaaaaaacaaaaaaacaaaaaaacaac

SEQ ID NO: 36916 - RNA, 64 nt, hsa
caaucugagccaccuuccuuaaaggaaauguuaaaaaaaaaaaaacaaaaaaacaaaaaaacaa

SEQ ID NO: 36917 - RNA, 64 nt, hsa
gcaaucugagccaccuuccuuaaaggaaauguuaaaaaaaaaaaaacaaaaaaacaaaaaaaca

SEQ ID NO: 36918 - RNA, 64 nt, hsa
agcaaucugagccaccuuccuuaaaggaaauguuaaaaaaaaaaaaacaaaaaaacaaaaaaac

SEQ ID NO: 36919 - RNA, 64 nt, hsa
ugggaaauugcucugcauuugacuuaauuaaaaaaaaaaaaagacuccacauugccaaguuuuu

SEQ ID NO: 36920 - RNA, 64 nt, hsa
gugggaaauugcucugcauuugacuuaauuaaaaaaaaaaaaagacuccacauugccaaguuuu

SEQ ID NO: 36921 - RNA, 64 nt, hsa
ugugggaaauugcucugcauuugacuuaauuaaaaaaaaaaaaagacuccacauugccaaguuu

SEQ ID NO: 36922 - RNA, 64 nt, hsa
gugugggaaauugcucugcauuugacuuaauuaaaaaaaaaaaaagacuccacauugccaaguu

SEQ ID NO: 36923 - RNA, 64 nt, hsa
agugugggaaauugcucugcauuugacuuaauuaaaaaaaaaaaaagacuccacauugccaagu

SEQ ID NO: 36924 - RNA, 64 nt, hsa
uagugugggaaauugcucugcauuugacuuaauuaaaaaaaaaaaaagacuccacauugccaag

SEQ ID NO: 36925 - RNA, 64 nt, hsa
uuuuuucuuuuuuuuuuuaaacugugguaaaaaaaaaaaaaauaaugcauuuccaugucuguau

SEQ ID NO: 36926 - RNA, 64 nt, hsa
uuuuuuucuuuuuuuuuuuaaacugugguaaaaaaaaaaaaaauaaugcauuuccaugucugua

SEQ ID NO: 36927 - RNA, 64 nt, hsa
auuuuuuucuuuuuuuuuuuaaacugugguaaaaaaaaaaaaaauaaugcauuuccaugucugu

SEQ ID NO: 36928 - RNA, 64 nt, hsa
cauuuuuuucuuuuuuuuuuuaaacugugguaaaaaaaaaaaaaauaaugcauuuccaugucug

SEQ ID NO: 36929 - RNA, 64 nt, hsa
gcauuuuuuucuuuuuuuuuuuaaacugugguaaaaaaaaaaaaaauaaugcauuuccaugucu

SEQ ID NO: 36930 - RNA, 64 nt, hsa
ugcauuuuuuucuuuuuuuuuuuaaacugugguaaaaaaaaaaaaaauaaugcauuuccauguc

SEQ ID NO: 36931 - RNA, 64 nt, hsa
gugcauuuuuuucuuuuuuuuuuuaaacugugguaaaaaaaaaaaaaauaaugcauuuccaugu

SEQ ID NO: 36932 - RNA, 64 nt, hsa
agcaagaugaagaggaaaaacaaacaaacaaacaaaaaaaaacacaaaaaaagaaagaauacuu

SEQ ID NO: 36933 - RNA, 64 nt, hsa
uagcaagaugaagaggaaaaacaaacaaacaaacaaaaaaaaacacaaaaaaagaaagaauacu

SEQ ID NO: 36934 - RNA, 64 nt, hsa
gggaaaauauaaacgagggaagaaaacaaacuuuaaaaaaaagcgagagggauaaaaaauuaaa

SEQ ID NO: 36935 - RNA, 64 nt, hsa
caaaaaaagagaaaaaacauaacaaguaaauuuuaaaaaaaagaacaaaauauaagaggaacaa

SEQ ID NO: 36936 - RNA, 64 nt, hsa
gcugggagaccuuccaaaagcaaaaacaaaaaacaaaaaaaacaaaaaaacaaaaaacaaaaaa

SEQ ID NO: 36937 - RNA, 64 nt, hsa
cuuuuuauuacuuuguaauuuaaaaaacugaaaaaaaaaaaacugaagaacuuuggggggaauu

SEQ ID NO: 36938 - RNA, 64 nt, hsa
gcuuuuuauuacuuuguaauuuaaaaaacugaaaaaaaaaaaacugaagaacuuuggggggaau

SEQ ID NO: 36939 - RNA, 64 nt, hsa
agcuuuuuauuacuuuguaauuuaaaaaacugaaaaaaaaaaaacugaagaacuuuggggggaa

SEQ ID NO: 36940 - RNA, 64 nt, hsa
aagcuuuuuauuacuuuguaauuuaaaaaacugaaaaaaaaaaaacugaagaacuuugggggga

SEQ ID NO: 36941 - RNA, 64 nt, hsa
aaagcuuuuuauuacuuuguaauuuaaaaaacugaaaaaaaaaaaacugaagaacuuugggggg

SEQ ID NO: 36942 - RNA, 64 nt, hsa
ucuucacuguauuuucuuuaaaaaaaaaaaaaaaaaaaaaaaggcaaaaauaaaccacucaaaa

SEQ ID NO: 36943 - RNA, 64 nt, hsa
gucuucacuguauuuucuuuaaaaaaaaaaaaaaaaaaaaaaaggcaaaaauaaaccacucaaa

SEQ ID NO: 36944 - RNA, 64 nt, hsa
ugucuucacuguauuuucuuuaaaaaaaaaaaaaaaaaaaaaaaggcaaaaauaaaccacucaa

SEQ ID NO: 36945 - RNA, 64 nt, hsa
gugucuucacuguauuuucuuuaaaaaaaaaaaaaaaaaaaaaaaggcaaaaauaaaccacuca

SEQ ID NO: 36946 - RNA, 64 nt, hsa
agugucuucacuguauuuucuuuaaaaaaaaaaaaaaaaaaaaaaaggcaaaaauaaaccacuc

SEQ ID NO: 36947 - RNA, 64 nt, hsa
uagugucuucacuguauuuucuuuaaaaaaaaaaaaaaaaaaaaaaaggcaaaaauaaaccacu

SEQ ID NO: 36948 - RNA, 64 nt, hsa
cuagugucuucacuguauuuucuuuaaaaaaaaaaaaaaaaaaaaaaaggcaaaaauaaaccac

SEQ ID NO: 36949 - RNA, 64 nt, hsa
ucuagugucuucacuguauuuucuuuaaaaaaaaaaaaaaaaaaaaaaaggcaaaaauaaacca

SEQ ID NO: 36950 - RNA, 64 nt, hsa
uucuagugucuucacuguauuuucuuuaaaaaaaaaaaaaaaaaaaaaaaggcaaaaauaaacc

SEQ ID NO: 36951 - RNA, 64 nt, hsa
cuucuagugucuucacuguauuuucuuuaaaaaaaaaaaaaaaaaaaaaaaggcaaaaauaaac

SEQ ID NO: 36952 - RNA, 64 nt, hsa
ccuucuagugucuucacuguauuuucuuuaaaaaaaaaaaaaaaaaaaaaaaggcaaaaauaaa

SEQ ID NO: 36953 - RNA, 64 nt, hsa
cccuucuagugucuucacuguauuuucuuuaaaaaaaaaaaaaaaaaaaaaaaggcaaaaauaa

SEQ ID NO: 36954 - RNA, 64 nt, hsa
ucccuucuagugucuucacuguauuuucuuuaaaaaaaaaaaaaaaaaaaaaaaggcaaaaaua

SEQ ID NO: 36955 - RNA, 64 nt, hsa
cucccuucuagugucuucacuguauuuucuuuaaaaaaaaaaaaaaaaaaaaaaaggcaaaaau

SEQ ID NO: 36956 - RNA, 64 nt, hsa
ucucccuucuagugucuucacuguauuuucuuuaaaaaaaaaaaaaaaaaaaaaaaggcaaaaa

SEQ ID NO: 36957 - RNA, 64 nt, hsa
uucucccuucuagugucuucacuguauuuucuuuaaaaaaaaaaaaaaaaaaaaaaaggcaaaa

SEQ ID NO: 36958 - RNA, 64 nt, hsa
aaugauccagucuggaauaacauuuuguaaaaaaaaaaaaaauauauauauauauauauagcug

SEQ ID NO: 36959 - RNA, 64 nt, hsa
aaaugauccagucuggaauaacauuuuguaaaaaaaaaaaaaauauauauauauauauauagcu

SEQ ID NO: 36960 - RNA, 64 nt, hsa
aaaaugauccagucuggaauaacauuuuguaaaaaaaaaaaaaauauauauauauauauauagc

SEQ ID NO: 36961 - RNA, 64 nt, hsa
caaaaugauccagucuggaauaacauuuuguaaaaaaaaaaaaaauauauauauauauauauag

SEQ ID NO: 36962 - RNA, 64 nt, hsa
ccaaaaugauccagucuggaauaacauuuuguaaaaaaaaaaaaaauauauauauauauauaua

SEQ ID NO: 36963 - RNA, 64 nt, hsa
accaaaaugauccagucuggaauaacauuuuguaaaaaaaaaaaaaauauauauauauauauau

SEQ ID NO: 36964 - RNA, 64 nt, hsa
caccaaaaugauccagucuggaauaacauuuuguaaaaaaaaaaaaaauauauauauauauaua

SEQ ID NO: 36965 - RNA, 64 nt, hsa
uaggugacagagugagacuccgucucaaaaaaaaaaaaaaaacuuuuuuaaaauguuaaaauua

SEQ ID NO: 36966 - RNA, 64 nt, hsa
cuaggugacagagugagacuccgucucaaaaaaaaaaaaaaaacuuuuuuaaaauguuaaaauu

SEQ ID NO: 36967 - RNA, 64 nt, hsa
ccuaggugacagagugagacuccgucucaaaaaaaaaaaaaaaacuuuuuuaaaauguuaaaau

SEQ ID NO: 36968 - RNA, 64 nt, hsa
gccuaggugacagagugagacuccgucucaaaaaaaaaaaaaaaacuuuuuuaaaauguuaaaa

SEQ ID NO: 36969 - RNA, 64 nt, hsa
agccuaggugacagagugagacuccgucucaaaaaaaaaaaaaaaacuuuuuuaaaauguuaaa

SEQ ID NO: 36970 - RNA, 64 nt, hsa
cagccuaggugacagagugagacuccgucucaaaaaaaaaaaaaaaacuuuuuuaaaauguuaa

SEQ ID NO: 36971 - RNA, 64 nt, hsa
ccagccuaggugacagagugagacuccgucucaaaaaaaaaaaaaaaacuuuuuuaaaauguua

SEQ ID NO: 36972 - RNA, 64 nt, hsa
uccagccuaggugacagagugagacuccgucucaaaaaaaaaaaaaaaacuuuuuuaaaauguu

SEQ ID NO: 36973 - RNA, 64 nt, hsa
cuccagccuaggugacagagugagacuccgucucaaaaaaaaaaaaaaaacuuuuuuaaaaugu

SEQ ID NO: 36974 - RNA, 64 nt, hsa
cuugggugacaaaguaagacccugucuuaaaaaaaaaaaaaaggaauuuggaaaacugcaauga

SEQ ID NO: 36975 - RNA, 64 nt, hsa
gcuugggugacaaaguaagacccugucuuaaaaaaaaaaaaaaggaauuuggaaaacugcaaug

SEQ ID NO: 36976 - RNA, 64 nt, hsa
agcuugggugacaaaguaagacccugucuuaaaaaaaaaaaaaaggaauuuggaaaacugcaau

SEQ ID NO: 36977 - RNA, 64 nt, hsa
cagcuugggugacaaaguaagacccugucuuaaaaaaaaaaaaaaggaauuuggaaaacugcaa

SEQ ID NO: 36978 - RNA, 64 nt, hsa
ccagcuugggugacaaaguaagacccugucuuaaaaaaaaaaaaaaggaauuuggaaaacugca

SEQ ID NO: 36979 - RNA, 64 nt, hsa
uccagcuugggugacaaaguaagacccugucuuaaaaaaaaaaaaaaggaauuuggaaaacugc

SEQ ID NO: 36980 - RNA, 64 nt, hsa
cuccagcuugggugacaaaguaagacccugucuuaaaaaaaaaaaaaaggaauuuggaaaacug

SEQ ID NO: 36981 - RNA, 64 nt, hsa
agaaacauauuuuuucaggaaaaacaaacuuuaaaaaaaaaagaggagaaauaaaaccuuuucu

SEQ ID NO: 36982 - RNA, 64 nt, hsa
gagaaacauauuuuuucaggaaaaacaaacuuuaaaaaaaaaagaggagaaauaaaaccuuuuc

SEQ ID NO: 36983 - RNA, 64 nt, hsa
agagaaacauauuuuuucaggaaaaacaaacuuuaaaaaaaaaagaggagaaauaaaaccuuuu

SEQ ID NO: 36984 - RNA, 64 nt, hsa
cacccaagaccacagaaaagagaaaggaaaggccaaaaaaaagaggaaaagaaaaauguacaaa

SEQ ID NO: 36985 - RNA, 64 nt, hsa
uauuggcuuuuucagagucauuuaugagcagaaaaaaaaaaaguaaaacuuugcuaauauuaac

SEQ ID NO: 36986 - RNA, 64 nt, hsa
guauuggcuuuuucagagucauuuaugagcagaaaaaaaaaaaguaaaacuuugcuaauauuaa

SEQ ID NO: 36987 - RNA, 64 nt, hsa
cguauuggcuuuuucagagucauuuaugagcagaaaaaaaaaaaguaaaacuuugcuaauauua

SEQ ID NO: 36988 - RNA, 64 nt, hsa
gcguauuggcuuuuucagagucauuuaugagcagaaaaaaaaaaaguaaaacuuugcuaauauu

SEQ ID NO: 36989 - RNA, 64 nt, hsa
cucaaaaaaaaaaaaaaaaaaaaaaaaaaaaaaaaaaaaaaagauacauuggucuuuaaaccca

SEQ ID NO: 36990 - RNA, 64 nt, hsa
ucucaaaaaaaaaaaaaaaaaaaaaaaaaaaaaaaaaaaaaaagauacauuggucuuuaaaccc

SEQ ID NO: 36991 - RNA, 64 nt, hsa
gucucaaaaaaaaaaaaaaaaaaaaaaaaaaaaaaaaaaaaaaagauacauuggucuuuaaacc

SEQ ID NO: 36992 - RNA, 64 nt, hsa
ugucucaaaaaaaaaaaaaaaaaaaaaaaaaaaaaaaaaaaaaaagauacauuggucuuuaaac

SEQ ID NO: 36993 - RNA, 64 nt, hsa
cugucucaaaaaaaaaaaaaaaaaaaaaaaaaaaaaaaaaaaaaaagauacauuggucuuuaaa

SEQ ID NO: 36994 - RNA, 64 nt, hsa
ucugucucaaaaaaaaaaaaaaaaaaaaaaaaaaaaaaaaaaaaaaagauacauuggucuuuaa

SEQ ID NO: 36995 - RNA, 64 nt, hsa
cucugucucaaaaaaaaaaaaaaaaaaaaaaaaaaaaaaaaaaaaaaagauacauuggucuuua

SEQ ID NO: 36996 - RNA, 64 nt, hsa
acucugucucaaaaaaaaaaaaaaaaaaaaaaaaaaaaaaaaaaaaaaagauacauuggucuuu

SEQ ID NO: 36997 - RNA, 64 nt, hsa
aacucugucucaaaaaaaaaaaaaaaaaaaaaaaaaaaaaaaaaaaaaaagauacauuggucuu

SEQ ID NO: 36998 - RNA, 64 nt, hsa
aaacucugucucaaaaaaaaaaaaaaaaaaaaaaaaaaaaaaaaaaaaaaagauacauuggucu

SEQ ID NO: 36999 - RNA, 64 nt, hsa
gaaacucugucucaaaaaaaaaaaaaaaaaaaaaaaaaaaaaaaaaaaaaaagauacauugguc

SEQ ID NO: 37000 - RNA, 64 nt, hsa
cgaaacucugucucaaaaaaaaaaaaaaaaaaaaaaaaaaaaaaaaaaaaaaagauacauuggu

SEQ ID NO: 37001 - RNA, 64 nt, hsa
gcgaaacucugucucaaaaaaaaaaaaaaaaaaaaaaaaaaaaaaaaaaaaaaagauacauugg

SEQ ID NO: 37002 - RNA, 64 nt, hsa
agcgaaacucugucucaaaaaaaaaaaaaaaaaaaaaaaaaaaaaaaaaaaaaaagauacauug

SEQ ID NO: 37003 - RNA, 64 nt, hsa
gagcgaaacucugucucaaaaaaaaaaaaaaaaaaaaaaaaaaaaaaaaaaaaaaagauacauu

SEQ ID NO: 37004 - RNA, 64 nt, hsa
agagcgaaacucugucucaaaaaaaaaaaaaaaaaaaaaaaaaaaaaaaaaaaaaaagauacau

SEQ ID NO: 37005 - RNA, 64 nt, hsa
gagagcgaaacucugucucaaaaaaaaaaaaaaaaaaaaaaaaaaaaaaaaaaaaaaagauaca

SEQ ID NO: 37006 - RNA, 64 nt, hsa
cgagagcgaaacucugucucaaaaaaaaaaaaaaaaaaaaaaaaaaaaaaaaaaaaaaagauac

SEQ ID NO: 37007 - RNA, 64 nt, hsa
acgagagcgaaacucugucucaaaaaaaaaaaaaaaaaaaaaaaaaaaaaaaaaaaaaaagaua

SEQ ID NO: 37008 - RNA, 64 nt, hsa
aacgagagcgaaacucugucucaaaaaaaaaaaaaaaaaaaaaaaaaaaaaaaaaaaaaaagau

SEQ ID NO: 37009 - RNA, 64 nt, hsa
caacgagagcgaaacucugucucaaaaaaaaaaaaaaaaaaaaaaaaaaaaaaaaaaaaaaaga

SEQ ID NO: 37010 - RNA, 64 nt, hsa
gcaacgagagcgaaacucugucucaaaaaaaaaaaaaaaaaaaaaaaaaaaaaaaaaaaaaaag

SEQ ID NO: 37011 - RNA, 64 nt, hsa
ggcaacgagagcgaaacucugucucaaaaaaaaaaaaaaaaaaaaaaaaaaaaaaaaaaaaaaa

SEQ ID NO: 37012 - RNA, 64 nt, hsa
gggcaacgagagcgaaacucugucucaaaaaaaaaaaaaaaaaaaaaaaaaaaaaaaaaaaaaa

SEQ ID NO: 37013 - RNA, 64 nt, hsa
ugggcaacgagagcgaaacucugucucaaaaaaaaaaaaaaaaaaaaaaaaaaaaaaaaaaaaa

SEQ ID NO: 37014 - RNA, 64 nt, hsa
cugggcaacgagagcgaaacucugucucaaaaaaaaaaaaaaaaaaaaaaaaaaaaaaaaaaaa

SEQ ID NO: 37015 - RNA, 64 nt, hsa
ccugggcaacgagagcgaaacucugucucaaaaaaaaaaaaaaaaaaaaaaaaaaaaaaaaaaa

SEQ ID NO: 37016 - RNA, 64 nt, hsa
gccugggcaacgagagcgaaacucugucucaaaaaaaaaaaaaaaaaaaaaaaaaaaaaaaaaa

SEQ ID NO: 37017 - RNA, 64 nt, hsa
agccugggcaacgagagcgaaacucugucucaaaaaaaaaaaaaaaaaaaaaaaaaaaaaaaaa

SEQ ID NO: 37018 - RNA, 64 nt, hsa
uagccugggcaacgagagcgaaacucugucucaaaaaaaaaaaaaaaaaaaaaaaaaaaaaaaa

SEQ ID NO: 37019 - RNA, 64 nt, hsa
cuagccugggcaacgagagcgaaacucugucucaaaaaaaaaaaaaaaaaaaaaaaaaaaaaaa

SEQ ID NO: 37020 - RNA, 64 nt, hsa
ucuagccugggcaacgagagcgaaacucugucucaaaaaaaaaaaaaaaaaaaaaaaaaaaaaa

SEQ ID NO: 37021 - RNA, 64 nt, hsa
gacauacaacaccuguacuuuagaguuuuaagggaaaaaaaaucagaagugcugguuagauagu

SEQ ID NO: 37022 - RNA, 64 nt, hsa
aaacagagggagacuccaucgccccccccaacaaaaaaaaaaguuucccauacacuggccugcc

SEQ ID NO: 37023 - RNA, 64 nt, hsa
caaacagagggagacuccaucgccccccccaacaaaaaaaaaaguuucccauacacuggccugc

SEQ ID NO: 37024 - RNA, 64 nt, hsa
gcaaacagagggagacuccaucgccccccccaacaaaaaaaaaaguuucccauacacuggccug

SEQ ID NO: 37025 - RNA, 64 nt, hsa
uucuauuucaaacguuaauuuugcuucucuuucuaaaaaaaaaaaaaaaaaagaaagagaagaa

SEQ ID NO: 37026 - RNA, 64 nt, hsa
ucuauuucaaacguuaauuuugcuucucuuucuaaaaaaaaaaaaaaaaaagaaagagaagaaa

SEQ ID NO: 37027 - RNA, 64 nt, hsa
cuauuucaaacguuaauuuugcuucucuuucuaaaaaaaaaaaaaaaaaagaaagagaagaaag

SEQ ID NO: 37028 - RNA, 64 nt, hsa
uauuucaaacguuaauuuugcuucucuuucuaaaaaaaaaaaaaaaaaagaaagagaagaaaga

SEQ ID NO: 37029 - RNA, 64 nt, hsa
auuucaaacguuaauuuugcuucucuuucuaaaaaaaaaaaaaaaaaagaaagagaagaaagaa

SEQ ID NO: 37030 - RNA, 64 nt, hsa
uuucaaacguuaauuuugcuucucuuucuaaaaaaaaaaaaaaaaaagaaagagaagaaagaag

SEQ ID NO: 37031 - RNA, 64 nt, hsa
uucaaacguuaauuuugcuucucuuucuaaaaaaaaaaaaaaaaaagaaagagaagaaagaagu

SEQ ID NO: 37032 - RNA, 64 nt, hsa
ucaaacguuaauuuugcuucucuuucuaaaaaaaaaaaaaaaaaagaaagagaagaaagaagug

SEQ ID NO: 37033 - RNA, 64 nt, hsa
caaacguuaauuuugcuucucuuucuaaaaaaaaaaaaaaaaaagaaagagaagaaagaaguga

SEQ ID NO: 37034 - RNA, 64 nt, hsa
aaacguuaauuuugcuucucuuucuaaaaaaaaaaaaaaaaaagaaagagaagaaagaagugau

SEQ ID NO: 37035 - RNA, 64 nt, hsa
aacguuaauuuugcuucucuuucuaaaaaaaaaaaaaaaaaagaaagagaagaaagaagugauu

SEQ ID NO: 37036 - RNA, 64 nt, hsa
uggcugaauggaaagaaacguaaaaagcugugccaaaaaaaaagcaaaaugcugugauaaacca

SEQ ID NO: 37037 - RNA, 64 nt, hsa
ggcugaauggaaagaaacguaaaaagcugugccaaaaaaaaagcaaaaugcugugauaaaccaa

SEQ ID NO: 37038 - RNA, 64 nt, hsa
uaagaaggcagggcaggggggcuuuuuacaggagaaaaaaaaaugacuuauaagagaaagagcc

SEQ ID NO: 37039 - RNA, 64 nt, hsa
aagaaggcagggcaggggggcuuuuuacaggagaaaaaaaaaugacuuauaagagaaagagccu

SEQ ID NO: 37040 - RNA, 64 nt, hsa
gacuuauaagagaaagagccuggaguauuuuuggaaaaaaaaauaauauuuuuauguuaaaaca

SEQ ID NO: 37041 - RNA, 64 nt, hsa
acuuauaagagaaagagccuggaguauuuuuggaaaaaaaaauaauauuuuuauguuaaaacaa

SEQ ID NO: 37042 - RNA, 64 nt, hsa
uuuuuuaaccuuuuguuccgccauuuaaaaaaagaaaaaaaaaaagcuuauguuucuugucaaa

SEQ ID NO: 37043 - RNA, 64 nt, hsa
uuuuuaaccuuuuguuccgccauuuaaaaaaagaaaaaaaaaaagcuuauguuucuugucaaau

SEQ ID NO: 37044 - RNA, 64 nt, hsa
uuuuaaccuuuuguuccgccauuuaaaaaaagaaaaaaaaaaagcuuauguuucuugucaaaug

SEQ ID NO: 37045 - RNA, 64 nt, hsa
uuuaaccuuuuguuccgccauuuaaaaaaagaaaaaaaaaaagcuuauguuucuugucaaaugc

SEQ ID NO: 37046 - RNA, 64 nt, hsa
ccgccaccuguacucacccucacgcucuuugaagaaaaaaaaaaaaaucaccuuguguguugua

SEQ ID NO: 37047 - RNA, 64 nt, hsa
cgccaccuguacucacccucacgcucuuugaagaaaaaaaaaaaaaucaccuuguguguuguag

SEQ ID NO: 37048 - RNA, 64 nt, hsa
gccaccuguacucacccucacgcucuuugaagaaaaaaaaaaaaaucaccuuguguguuguagc

SEQ ID NO: 37049 - RNA, 64 nt, hsa
ccaccuguacucacccucacgcucuuugaagaaaaaaaaaaaaaucaccuuguguguuguagcu

SEQ ID NO: 37050 - RNA, 64 nt, hsa
caccuguacucacccucacgcucuuugaagaaaaaaaaaaaaaucaccuuguguguuguagcuc

SEQ ID NO: 37051 - RNA, 64 nt, hsa
accuguacucacccucacgcucuuugaagaaaaaaaaaaaaaucaccuuguguguuguagcuca

SEQ ID NO: 37052 - RNA, 64 nt, hsa
uauuugugcaaagcuauuaauauacacauuuuguaaaaaaaaaaaaaaaacacguauaucuaua

SEQ ID NO: 37053 - RNA, 64 nt, hsa
auuugugcaaagcuauuaauauacacauuuuguaaaaaaaaaaaaaaaacacguauaucuauac

SEQ ID NO: 37054 - RNA, 64 nt, hsa
uuugugcaaagcuauuaauauacacauuuuguaaaaaaaaaaaaaaaacacguauaucuauaca

SEQ ID NO: 37055 - RNA, 64 nt, hsa
uugugcaaagcuauuaauauacacauuuuguaaaaaaaaaaaaaaaacacguauaucuauacau

SEQ ID NO: 37056 - RNA, 64 nt, hsa
ugugcaaagcuauuaauauacacauuuuguaaaaaaaaaaaaaaaacacguauaucuauacaua

SEQ ID NO: 37057 - RNA, 64 nt, hsa
gugcaaagcuauuaauauacacauuuuguaaaaaaaaaaaaaaaacacguauaucuauacauau

SEQ ID NO: 37058 - RNA, 64 nt, hsa
ugcaaagcuauuaauauacacauuuuguaaaaaaaaaaaaaaaacacguauaucuauacauaua

SEQ ID NO: 37059 - RNA, 64 nt, hsa
gcaaagcuauuaauauacacauuuuguaaaaaaaaaaaaaaaacacguauaucuauacauauau

SEQ ID NO: 37060 - RNA, 64 nt, hsa
caaagcuauuaauauacacauuuuguaaaaaaaaaaaaaaaacacguauaucuauacauauaua

SEQ ID NO: 37061 - RNA, 64 nt, hsa
gggucauggggguggguuuccuggcaccuacaugaaaaaaaagacaaguuauaugggugaugaa

SEQ ID NO: 37062 - RNA, 64 nt, hsa
gugguuugaauucuggcuacauguuuuaaguaagaaaaaaaaagacguauuuuugcuuacucag

SEQ ID NO: 37063 - RNA, 64 nt, hsa
ugguuugaauucuggcuacauguuuuaaguaagaaaaaaaaagacguauuuuugcuuacucaga

SEQ ID NO: 37064 - RNA, 64 nt, hsa
uacaaaauacuagaguaucuagaagggugaaaacaaaaaaaaauaaaaagaaacacagacgccc

SEQ ID NO: 37065 - RNA, 64 nt, hsa
acaaaauacuagaguaucuagaagggugaaaacaaaaaaaaauaaaaagaaacacagacgccca

SEQ ID NO: 37066 - RNA, 64 nt, hsa
ugccauuccaccauagaagagcaauccuuuuaggaaaaaaaaaaucaugcuauuaauuaaucaa

SEQ ID NO: 37067 - RNA, 64 nt, hsa
gccauuccaccauagaagagcaauccuuuuaggaaaaaaaaaaucaugcuauuaauuaaucaaa

SEQ ID NO: 37068 - RNA, 64 nt, hsa
ccauuccaccauagaagagcaauccuuuuaggaaaaaaaaaaucaugcuauuaauuaaucaaau

SEQ ID NO: 37069 - RNA, 64 nt, hsa
uugaaauuacuugaauuuucuugucuuaaaacugaaaaaaaaauguaguuacacguuaaaaucu

SEQ ID NO: 37070 - RNA, 64 nt, hsa
ugaaauuacuugaauuuucuugucuuaaaacugaaaaaaaaauguaguuacacguuaaaaucug

SEQ ID NO: 37071 - RNA, 64 nt, hsa
aaucugauugcuguuguuuuguuuguuuggaaagaaaaaaaaugucuggcuucuucuacuauuu

SEQ ID NO: 37072 - RNA, 64 nt, hsa
aaaaauggugacaguuucauugugaaccccucucaaaaaaaauguaucagaaaaguuugauuac

SEQ ID NO: 37073 - RNA, 64 nt, hsa
uauuguuuacaaauauauuucaugcaagaaacagaaaaaaaaaaaaacccuuugauucugguuc

SEQ ID NO: 37074 - RNA, 64 nt, hsa
auuguuuacaaauauauuucaugcaagaaacagaaaaaaaaaaaaacccuuugauucugguuca

SEQ ID NO: 37075 - RNA, 64 nt, hsa
uuguuuacaaauauauuucaugcaagaaacagaaaaaaaaaaaaacccuuugauucugguucau

SEQ ID NO: 37076 - RNA, 64 nt, hsa
uguuuacaaauauauuucaugcaagaaacagaaaaaaaaaaaaacccuuugauucugguucauc

SEQ ID NO: 37077 - RNA, 64 nt, hsa
guuuacaaauauauuucaugcaagaaacagaaaaaaaaaaaaacccuuugauucugguucaucu

SEQ ID NO: 37078 - RNA, 64 nt, hsa
uuuacaaauauauuucaugcaagaaacagaaaaaaaaaaaaacccuuugauucugguucaucuc

SEQ ID NO: 37079 - RNA, 64 nt, hsa
uuauucucacccgaaguauucacacaaucuuuuuaaaaaaaauuugaaauggcauuuuguauug

SEQ ID NO: 37080 - RNA, 64 nt, hsa
agauauuaaaauuuggugcuuauaagagagaguuaaaaaaaaauaggauugcuucaauuaaaau

SEQ ID NO: 37081 - RNA, 64 nt, hsa
gauauuaaaauuuggugcuuauaagagagaguuaaaaaaaaauaggauugcuucaauuaaaauu

SEQ ID NO: 37082 - RNA, 64 nt, hsa
cagugcaacaaaugccagcauugccauucgggggaaaaaaaaaaaaaaaaaaaaaagaugagaa

SEQ ID NO: 37083 - RNA, 64 nt, hsa
agugcaacaaaugccagcauugccauucgggggaaaaaaaaaaaaaaaaaaaaaagaugagaag

SEQ ID NO: 37084 - RNA, 64 nt, hsa
gugcaacaaaugccagcauugccauucgggggaaaaaaaaaaaaaaaaaaaaaagaugagaaga

SEQ ID NO: 37085 - RNA, 64 nt, hsa
ugcaacaaaugccagcauugccauucgggggaaaaaaaaaaaaaaaaaaaaaagaugagaagaa

SEQ ID NO: 37086 - RNA, 64 nt, hsa
gcaacaaaugccagcauugccauucgggggaaaaaaaaaaaaaaaaaaaaaagaugagaagaac

SEQ ID NO: 37087 - RNA, 64 nt, hsa
caacaaaugccagcauugccauucgggggaaaaaaaaaaaaaaaaaaaaaagaugagaagaaca

SEQ ID NO: 37088 - RNA, 64 nt, hsa
aacaaaugccagcauugccauucgggggaaaaaaaaaaaaaaaaaaaaaagaugagaagaacac

SEQ ID NO: 37089 - RNA, 64 nt, hsa
acaaaugccagcauugccauucgggggaaaaaaaaaaaaaaaaaaaaaagaugagaagaacacu

SEQ ID NO: 37090 - RNA, 64 nt, hsa
caaaugccagcauugccauucgggggaaaaaaaaaaaaaaaaaaaaaagaugagaagaacacuu

SEQ ID NO: 37091 - RNA, 64 nt, hsa
aaaugccagcauugccauucgggggaaaaaaaaaaaaaaaaaaaaaagaugagaagaacacuug

SEQ ID NO: 37092 - RNA, 64 nt, hsa
aaugccagcauugccauucgggggaaaaaaaaaaaaaaaaaaaaaagaugagaagaacacuugu

SEQ ID NO: 37093 - RNA, 64 nt, hsa
augccagcauugccauucgggggaaaaaaaaaaaaaaaaaaaaaagaugagaagaacacuuguu

SEQ ID NO: 37094 - RNA, 64 nt, hsa
ugccagcauugccauucgggggaaaaaaaaaaaaaaaaaaaaaagaugagaagaacacuuguuc

SEQ ID NO: 37095 - RNA, 64 nt, hsa
gccagcauugccauucgggggaaaaaaaaaaaaaaaaaaaaaagaugagaagaacacuuguuca

SEQ ID NO: 37096 - RNA, 64 nt, hsa
ccagcauugccauucgggggaaaaaaaaaaaaaaaaaaaaaagaugagaagaacacuuguucau

SEQ ID NO: 37097 - RNA, 64 nt, hsa
uggaauuagaauaagcauuuccuugaaaauguuuaaaaaaaaaaagucagcaguaaaauguaug

SEQ ID NO: 37098 - RNA, 64 nt, hsa
ggaauuagaauaagcauuuccuugaaaauguuuaaaaaaaaaaagucagcaguaaaauguaugg

SEQ ID NO: 37099 - RNA, 64 nt, hsa
gaauuagaauaagcauuuccuugaaaauguuuaaaaaaaaaaagucagcaguaaaauguauggc

SEQ ID NO: 37100 - RNA, 64 nt, hsa
aauuagaauaagcauuuccuugaaaauguuuaaaaaaaaaaagucagcaguaaaauguauggca

SEQ ID NO: 37101 - RNA, 64 nt, hsa
cuugcaauaaaguuggugggaccaggaaguagagaaaaaaaaaguaaaauguggucaauucuug

SEQ ID NO: 37102 - RNA, 64 nt, hsa
uugcaauaaaguuggugggaccaggaaguagagaaaaaaaaaguaaaauguggucaauucuugc

SEQ ID NO: 37103 - RNA, 64 nt, hsa
gugcuuuaaaguagauaguauacuuuacauuuauaaaaaaaaaucaaauuuuguucuuuauuuu

SEQ ID NO: 37104 - RNA, 64 nt, hsa
ugcuuuaaaguagauaguauacuuuacauuuauaaaaaaaaaucaaauuuuguucuuuauuuug

SEQ ID NO: 37105 - RNA, 64 nt, hsa
uuguggacaaauaaauuuguaaaguccgaggauuaaaaaaaaaaaaagguuaaaccgguuucuc

SEQ ID NO: 37106 - RNA, 64 nt, hsa
uguggacaaauaaauuuguaaaguccgaggauuaaaaaaaaaaaaagguuaaaccgguuucucu

SEQ ID NO: 37107 - RNA, 64 nt, hsa
guggacaaauaaauuuguaaaguccgaggauuaaaaaaaaaaaaagguuaaaccgguuucucua

SEQ ID NO: 37108 - RNA, 64 nt, hsa
uggacaaauaaauuuguaaaguccgaggauuaaaaaaaaaaaaagguuaaaccgguuucucuac

SEQ ID NO: 37109 - RNA, 64 nt, hsa
ggacaaauaaauuuguaaaguccgaggauuaaaaaaaaaaaaagguuaaaccgguuucucuacu

SEQ ID NO: 37110 - RNA, 64 nt, hsa
gacaaauaaauuuguaaaguccgaggauuaaaaaaaaaaaaagguuaaaccgguuucucuacug

SEQ ID NO: 37111 - RNA, 64 nt, hsa
ggauguuaauugagagcccuggguccugccacagaaaaaaaaaaaaaaaagcccucucugcaau

SEQ ID NO: 37112 - RNA, 64 nt, hsa
gauguuaauugagagcccuggguccugccacagaaaaaaaaaaaaaaaagcccucucugcaauc

SEQ ID NO: 37113 - RNA, 64 nt, hsa
auguuaauugagagcccuggguccugccacagaaaaaaaaaaaaaaaagcccucucugcaaucu

SEQ ID NO: 37114 - RNA, 64 nt, hsa
uguuaauugagagcccuggguccugccacagaaaaaaaaaaaaaaaagcccucucugcaaucuc

SEQ ID NO: 37115 - RNA, 64 nt, hsa
guuaauugagagcccuggguccugccacagaaaaaaaaaaaaaaaagcccucucugcaaucucg

SEQ ID NO: 37116 - RNA, 64 nt, hsa
uuaauugagagcccuggguccugccacagaaaaaaaaaaaaaaaagcccucucugcaaucucgc

SEQ ID NO: 37117 - RNA, 64 nt, hsa
uaauugagagcccuggguccugccacagaaaaaaaaaaaaaaaagcccucucugcaaucucgcu

SEQ ID NO: 37118 - RNA, 64 nt, hsa
aauugagagcccuggguccugccacagaaaaaaaaaaaaaaaagcccucucugcaaucucgcuu

SEQ ID NO: 37119 - RNA, 64 nt, hsa
auugagagcccuggguccugccacagaaaaaaaaaaaaaaaagcccucucugcaaucucgcuuc

SEQ ID NO: 37120 - RNA, 64 nt, hsa
uacuccagccugggcaacagcgagacuccaucucaaaaaaaaaggaaauguguaucaagaacau

SEQ ID NO: 37121 - RNA, 64 nt, hsa
acuccagccugggcaacagcgagacuccaucucaaaaaaaaaggaaauguguaucaagaacaug

SEQ ID NO: 37122 - RNA, 64 nt, hsa
agcucugcuaguaagggauucgucuccccaaaugaaaaaaaaaaguaaucucagaauguuggcc

SEQ ID NO: 37123 - RNA, 64 nt, hsa
gcucugcuaguaagggauucgucuccccaaaugaaaaaaaaaaguaaucucagaauguuggccg

SEQ ID NO: 37124 - RNA, 64 nt, hsa
cucugcuaguaagggauucgucuccccaaaugaaaaaaaaaaguaaucucagaauguuggccga

SEQ ID NO: 37125 - RNA, 64 nt, hsa
cucccagccaucguaaucacauuucuguaccuggaaaaaaaauguaucuuauuuuugauaaugg

SEQ ID NO: 37126 - RNA, 64 nt, hsa
cuugugcacagagaaaaaugcauuaaaaaugacuaaaaaaaauaaaaaauuaaaaaauggauaa

SEQ ID NO: 37127 - RNA, 64 nt, hsa
acccuuccacacacacacacacacacacacacacaaaaaaaaaucccuuccuugugggauucuu

SEQ ID NO: 37128 - RNA, 64 nt, hsa
cccuuccacacacacacacacacacacacacacaaaaaaaaaucccuuccuugugggauucuug

SEQ ID NO: 37129 - RNA, 64 nt, hsa
cuguugccauuuguguaaauacuagucuuuuuggaaaaaaaauaauguaaagauguuuuguaua

SEQ ID NO: 37130 - RNA, 64 nt, hsa
cuuguugcuuuuuucuuagaaaaaaaugagaacuaaaaaaaaaaaauuaaccacauggagaaau

SEQ ID NO: 37131 - RNA, 64 nt, hsa
uuguugcuuuuuucuuagaaaaaaaugagaacuaaaaaaaaaaaauuaaccacauggagaaaug

SEQ ID NO: 37132 - RNA, 64 nt, hsa
uguugcuuuuuucuuagaaaaaaaugagaacuaaaaaaaaaaaauuaaccacauggagaaaugg

SEQ ID NO: 37133 - RNA, 64 nt, hsa
guugcuuuuuucuuagaaaaaaaugagaacuaaaaaaaaaaaauuaaccacauggagaaauggg

SEQ ID NO: 37134 - RNA, 64 nt, hsa
uugcuuuuuucuuagaaaaaaaugagaacuaaaaaaaaaaaauuaaccacauggagaaaugggu

SEQ ID NO: 37135 - RNA, 64 nt, hsa
uuucucuuagagauuuucauuuuaguguaucuuuaaaaaaaaaucuuguguuaacuugccucca

SEQ ID NO: 37136 - RNA, 64 nt, hsa
uucucuuagagauuuucauuuuaguguaucuuuaaaaaaaaaucuuguguuaacuugccuccau

SEQ ID NO: 37137 - RNA, 64 nt, hsa
cuuuaauuaccauguuaaaggaggaaagagcuagaaaaaaaaaccucaaaaaaguuaaucauug

SEQ ID NO: 37138 - RNA, 64 nt, hsa
uuuaauuaccauguuaaaggaggaaagagcuagaaaaaaaaaccucaaaaaaguuaaucauugg

SEQ ID NO: 37139 - RNA, 64 nt, hsa
uaccugggccaggccaggaaagagacuauuuaagaaaaaaaaaaucaauuccuagccuggaucc

SEQ ID NO: 37140 - RNA, 64 nt, hsa
accugggccaggccaggaaagagacuauuuaagaaaaaaaaaaucaauuccuagccuggauccc

SEQ ID NO: 37141 - RNA, 64 nt, hsa
ccugggccaggccaggaaagagacuauuuaagaaaaaaaaaaucaauuccuagccuggauccca

SEQ ID NO: 37142 - RNA, 64 nt, hsa
acugcugcuaaagugauuuuuuuuuuauuugaccaaaaaaaaaaaggcccaagaagaagaaaau

SEQ ID NO: 37143 - RNA, 64 nt, hsa
cugcugcuaaagugauuuuuuuuuuauuugaccaaaaaaaaaaaggcccaagaagaagaaaaug

SEQ ID NO: 37144 - RNA, 64 nt, hsa
ugcugcuaaagugauuuuuuuuuuauuugaccaaaaaaaaaaaggcccaagaagaagaaaauga

SEQ ID NO: 37145 - RNA, 64 nt, hsa
gcugcuaaagugauuuuuuuuuuauuugaccaaaaaaaaaaaggcccaagaagaagaaaaugaa

SEQ ID NO: 37146 - RNA, 64 nt, hsa
gggcugcauuugugcccaggucaggagcaaauugaaaaaaaaaauaaaguaauacaaaaaaauc

SEQ ID NO: 37147 - RNA, 64 nt, hsa
ggcugcauuugugcccaggucaggagcaaauugaaaaaaaaaauaaaguaauacaaaaaaauca

SEQ ID NO: 37148 - RNA, 64 nt, hsa
gcugcauuugugcccaggucaggagcaaauugaaaaaaaaaauaaaguaauacaaaaaaaucaa

SEQ ID NO: 37149 - RNA, 64 nt, hsa
cugcugaauuugugccccuggauuggaagcaaauaaaaaaaaaaaacaacacauaaacuaaacc

SEQ ID NO: 37150 - RNA, 64 nt, hsa
ugcugaauuugugccccuggauuggaagcaaauaaaaaaaaaaaacaacacauaaacuaaacca

SEQ ID NO: 37151 - RNA, 64 nt, hsa
gcugaauuugugccccuggauuggaagcaaauaaaaaaaaaaaacaacacauaaacuaaaccaa

SEQ ID NO: 37152 - RNA, 63 nt, hsa
cugaauuugugccccuggauuggaagcaaauaaaaaaaaaaaacaacacauaaacuaaaccaa

SEQ ID NO: 37153 - RNA, 62 nt, hsa
ugaauuugugccccuggauuggaagcaaauaaaaaaaaaaaacaacacauaaacuaaaccaa

SEQ ID NO: 37154 - RNA, 64 nt, hsa
augcacaguaaauaugugaauuuuuccuagauguaaaaaaaaaaaucuuucauauaaagaccuu

SEQ ID NO: 37155 - RNA, 64 nt, hsa
ugcacaguaaauaugugaauuuuuccuagauguaaaaaaaaaaaucuuucauauaaagaccuua

SEQ ID NO: 37156 - RNA, 64 nt, hsa
gcacaguaaauaugugaauuuuuccuagauguaaaaaaaaaaaucuuucauauaaagaccuuaa

SEQ ID NO: 37157 - RNA, 64 nt, hsa
cacaguaaauaugugaauuuuuccuagauguaaaaaaaaaaaucuuucauauaaagaccuuaaa

SEQ ID NO: 37158 - RNA, 64 nt, hsa
uccaguagaaaauguuaggauaugugugcuauauaaaaaaaaaaaaagacuuguuaaguuuuaa

SEQ ID NO: 37159 - RNA, 64 nt, hsa
ccaguagaaaauguuaggauaugugugcuauauaaaaaaaaaaaaagacuuguuaaguuuuaaa

SEQ ID NO: 37160 - RNA, 64 nt, hsa
caguagaaaauguuaggauaugugugcuauauaaaaaaaaaaaaagacuuguuaaguuuuaaaa

SEQ ID NO: 37161 - RNA, 64 nt, hsa
aguagaaaauguuaggauaugugugcuauauaaaaaaaaaaaaagacuuguuaaguuuuaaaau

SEQ ID NO: 37162 - RNA, 64 nt, hsa
guagaaaauguuaggauaugugugcuauauaaaaaaaaaaaaagacuuguuaaguuuuaaaaua

SEQ ID NO: 37163 - RNA, 64 nt, hsa
uagaaaauguuaggauaugugugcuauauaaaaaaaaaaaaagacuuguuaaguuuuaaaauaa

SEQ ID NO: 37164 - RNA, 64 nt, hsa
acaguuuccuucuggaguuccaaaugcaauauagaaaaaaaaacccugugacucuggauuuuau

SEQ ID NO: 37165 - RNA, 64 nt, hsa
caguuuccuucuggaguuccaaaugcaauauagaaaaaaaaacccugugacucuggauuuuauu

SEQ ID NO: 37166 - RNA, 64 nt, hsa
agacuccuaccuugagaucuuagucuagguaaagaaaaaaaaaaaaaggucaugaaacacaaau

SEQ ID NO: 37167 - RNA, 64 nt, hsa
gacuccuaccuugagaucuuagucuagguaaagaaaaaaaaaaaaaggucaugaaacacaaaug

SEQ ID NO: 37168 - RNA, 64 nt, hsa
acuccuaccuugagaucuuagucuagguaaagaaaaaaaaaaaaaggucaugaaacacaaaugu

SEQ ID NO: 37169 - RNA, 64 nt, hsa
cuccuaccuugagaucuuagucuagguaaagaaaaaaaaaaaaaggucaugaaacacaaauguc

SEQ ID NO: 37170 - RNA, 64 nt, hsa
uccuaccuugagaucuuagucuagguaaagaaaaaaaaaaaaaggucaugaaacacaaaugucc

SEQ ID NO: 37171 - RNA, 64 nt, hsa
ccuaccuugagaucuuagucuagguaaagaaaaaaaaaaaaaggucaugaaacacaaauguccu

SEQ ID NO: 37172 - RNA, 64 nt, hsa
auucacaaguuuuuuuuugaagugaauucuuuugaaaaaaaaaugcaaaacuagaaaacuuuau

SEQ ID NO: 37173 - RNA, 64 nt, hsa
uucacaaguuuuuuuuugaagugaauucuuuugaaaaaaaaaugcaaaacuagaaaacuuuauu

SEQ ID NO: 37174 - RNA, 64 nt, hsa
augguuuucuuuaugucuuggcugcuugaaaauuaaaaaaaaaaaagguuuguucaauauugcc

SEQ ID NO: 37175 - RNA, 64 nt, hsa
ugguuuucuuuaugucuuggcugcuugaaaauuaaaaaaaaaaaagguuuguucaauauugccg

SEQ ID NO: 37176 - RNA, 64 nt, hsa
gguuuucuuuaugucuuggcugcuugaaaauuaaaaaaaaaaaagguuuguucaauauugccgu

SEQ ID NO: 37177 - RNA, 64 nt, hsa
guuuucuuuaugucuuggcugcuugaaaauuaaaaaaaaaaaagguuuguucaauauugccguu

SEQ ID NO: 37178 - RNA, 64 nt, hsa
uuuucuuuaugucuuggcugcuugaaaauuaaaaaaaaaaaagguuuguucaauauugccguua

SEQ ID NO: 37179 - RNA, 64 nt, hsa
auuuugaccuguugacuuuuuaggaaguaggacuaaaaaaaaaaaucucaaguggcauucuuug

SEQ ID NO: 37180 - RNA, 64 nt, hsa
uuuugaccuguugacuuuuuaggaaguaggacuaaaaaaaaaaaucucaaguggcauucuuugu

SEQ ID NO: 37181 - RNA, 64 nt, hsa
uuugaccuguugacuuuuuaggaaguaggacuaaaaaaaaaaaucucaaguggcauucuuuguc

SEQ ID NO: 37182 - RNA, 64 nt, hsa
uugaccuguugacuuuuuaggaaguaggacuaaaaaaaaaaaucucaaguggcauucuuuguca

SEQ ID NO: 37183 - RNA, 64 nt, hsa
uuuagagcaaucccacaugcuuuucacaaacauuaaaaaaaaaaaccuuucagggucuuucaug

SEQ ID NO: 37184 - RNA, 64 nt, hsa
uuagagcaaucccacaugcuuuucacaaacauuaaaaaaaaaaaccuuucagggucuuucauga

SEQ ID NO: 37185 - RNA, 64 nt, hsa
uagagcaaucccacaugcuuuucacaaacauuaaaaaaaaaaaccuuucagggucuuucaugaa

SEQ ID NO: 37186 - RNA, 64 nt, hsa
agagcaaucccacaugcuuuucacaaacauuaaaaaaaaaaaccuuucagggucuuucaugaag

SEQ ID NO: 37187 - RNA, 64 nt, hsa
uccuuuuguccacuuauauaguuauuuucucuuuaaaaaaaaauuuuuuuuaauguauuagaga

SEQ ID NO: 37188 - RNA, 64 nt, hsa
ccuuuuguccacuuauauaguuauuuucucuuuaaaaaaaaauuuuuuuuaauguauuagagau

SEQ ID NO: 37189 - RNA, 64 nt, hsa
agauacuaacaacuuaaacuuacuacuuuaggagaaaaaaaaaaacauucaauuucggacacug

SEQ ID NO: 37190 - RNA, 64 nt, hsa
gauacuaacaacuuaaacuuacuacuuuaggagaaaaaaaaaaacauucaauuucggacacuga

SEQ ID NO: 37191 - RNA, 64 nt, hsa
auacuaacaacuuaaacuuacuacuuuaggagaaaaaaaaaaacauucaauuucggacacugag

SEQ ID NO: 37192 - RNA, 64 nt, hsa
uacuaacaacuuaaacuuacuacuuuaggagaaaaaaaaaaacauucaauuucggacacugagu

SEQ ID NO: 37193 - RNA, 64 nt, hsa
uucagucuuuuccuguuuuuguuaacuuuggguuaaaaaaaaaaaaagucugauugguuuuaau

SEQ ID NO: 37194 - RNA, 64 nt, hsa
ucagucuuuuccuguuuuuguuaacuuuggguuaaaaaaaaaaaaagucugauugguuuuaauu

SEQ ID NO: 37195 - RNA, 64 nt, hsa
cagucuuuuccuguuuuuguuaacuuuggguuaaaaaaaaaaaaagucugauugguuuuaauug

SEQ ID NO: 37196 - RNA, 64 nt, hsa
agucuuuuccuguuuuuguuaacuuuggguuaaaaaaaaaaaaagucugauugguuuuaauuga

SEQ ID NO: 37197 - RNA, 64 nt, hsa
gucuuuuccuguuuuuguuaacuuuggguuaaaaaaaaaaaaagucugauugguuuuaauugaa

SEQ ID NO: 37198 - RNA, 64 nt, hsa
ucuuuuccuguuuuuguuaacuuuggguuaaaaaaaaaaaaagucugauugguuuuaauugaag

SEQ ID NO: 37199 - RNA, 64 nt, hsa
ccauuuagagauaaugggcuuuguuagcacuuucaaaaaaaaaaaaagcaaaccauacuugucc

SEQ ID NO: 37200 - RNA, 64 nt, hsa
cauuuagagauaaugggcuuuguuagcacuuucaaaaaaaaaaaaagcaaaccauacuugucca

SEQ ID NO: 37201 - RNA, 64 nt, hsa
auuuagagauaaugggcuuuguuagcacuuucaaaaaaaaaaaaagcaaaccauacuuguccac

SEQ ID NO: 37202 - RNA, 64 nt, hsa
uuuagagauaaugggcuuuguuagcacuuucaaaaaaaaaaaaagcaaaccauacuuguccacu

SEQ ID NO: 37203 - RNA, 64 nt, hsa
uuagagauaaugggcuuuguuagcacuuucaaaaaaaaaaaaagcaaaccauacuuguccacug

SEQ ID NO: 37204 - RNA, 64 nt, hsa
uagagauaaugggcuuuguuagcacuuucaaaaaaaaaaaaagcaaaccauacuuguccacugu

SEQ ID NO: 37205 - RNA, 64 nt, hsa
aaggcagccugggacauuuaaaaaaauaaaaaugaaaaaaaaacccagaacccauuucucaggg

SEQ ID NO: 37206 - RNA, 64 nt, hsa
aggcagccugggacauuuaaaaaaauaaaaaugaaaaaaaaacccagaacccauuucucagggc

SEQ ID NO: 37207 - RNA, 64 nt, hsa
auguuuuucacuugcauugucauuagauguccagaaaaaaaaaagaugucaaaauguuuuucua

SEQ ID NO: 37208 - RNA, 64 nt, hsa
uguuuuucacuugcauugucauuagauguccagaaaaaaaaaagaugucaaaauguuuuucuaa

SEQ ID NO: 37209 - RNA, 64 nt, hsa
guuuuucacuugcauugucauuagauguccagaaaaaaaaaagaugucaaaauguuuuucuaaa

SEQ ID NO: 37210 - RNA, 64 nt, hsa
auuaaggacuacagaauugggcccuuagaaugugaaaaaaaaaaguaauuaaaaagacacuuuu

SEQ ID NO: 37211 - RNA, 64 nt, hsa
uuaaggacuacagaauugggcccuuagaaugugaaaaaaaaaaguaauuaaaaagacacuuuua

SEQ ID NO: 37212 - RNA, 64 nt, hsa
uaaggacuacagaauugggcccuuagaaugugaaaaaaaaaaguaauuaaaaagacacuuuuac

SEQ ID NO: 37213 - RNA, 64 nt, hsa
uucuuuauccaugagcaccaggcuuugcucacuuaaaaaaaaauuaagccacauuaaggaguga

SEQ ID NO: 37214 - RNA, 64 nt, hsa
ucuuuauccaugagcaccaggcuuugcucacuuaaaaaaaaauuaagccacauuaaggagugag

SEQ ID NO: 37215 - RNA, 64 nt, hsa
cuuccaaaucuaacuuugcacaaguaacccauguaaaaaaaaauguacauuuuucaaaaguugu

SEQ ID NO: 37216 - RNA, 64 nt, hsa
uuccaaaucuaacuuugcacaaguaacccauguaaaaaaaaauguacauuuuucaaaaguugua

SEQ ID NO: 37217 - RNA, 64 nt, hsa
ccucccaaccaggcuaauaaccuaacacauguuuaaaaaaaaucugccuaagccggguguggug

SEQ ID NO: 37218 - RNA, 64 nt, hsa
gccugggugacagagugagauccugucucugaagaaaaaaaaaaccugccuggcaagguccuuc

SEQ ID NO: 37219 - RNA, 64 nt, hsa
ccugggugacagagugagauccugucucugaagaaaaaaaaaaccugccuggcaagguccuucc

SEQ ID NO: 37220 - RNA, 64 nt, hsa
cugggugacagagugagauccugucucugaagaaaaaaaaaaccugccuggcaagguccuuccc

SEQ ID NO: 37221 - RNA, 64 nt, hsa
acaccuccaccagggggaaggcuggcacaaggagaaaaaaaaagcaagcaucagcgaauaguau

SEQ ID NO: 37222 - RNA, 64 nt, hsa
caccuccaccagggggaaggcuggcacaaggagaaaaaaaaagcaagcaucagcgaauaguaua

SEQ ID NO: 37223 - RNA, 64 nt, hsa
gauugaauuccauuagcauuugcuaccaaguaggaaaaaaaauguacauggcaguguuuuaguu

SEQ ID NO: 37224 - RNA, 64 nt, hsa
cuccagccugggcaacagagcaagacucugucucaaaaaaaaaaaaaaaagaaauaagaaaaug

SEQ ID NO: 37225 - RNA, 64 nt, hsa
uccagccugggcaacagagcaagacucugucucaaaaaaaaaaaaaaaagaaauaagaaaaugg

SEQ ID NO: 37226 - RNA, 64 nt, hsa
ccagccugggcaacagagcaagacucugucucaaaaaaaaaaaaaaaagaaauaagaaaauggg

SEQ ID NO: 37227 - RNA, 64 nt, hsa
cagccugggcaacagagcaagacucugucucaaaaaaaaaaaaaaaagaaauaagaaaauggga

SEQ ID NO: 37228 - RNA, 64 nt, hsa
agccugggcaacagagcaagacucugucucaaaaaaaaaaaaaaaagaaauaagaaaaugggaa

SEQ ID NO: 37229 - RNA, 64 nt, hsa
gccugggcaacagagcaagacucugucucaaaaaaaaaaaaaaaagaaauaagaaaaugggaag

SEQ ID NO: 37230 - RNA, 64 nt, hsa
ccugggcaacagagcaagacucugucucaaaaaaaaaaaaaaaagaaauaagaaaaugggaagc

SEQ ID NO: 37231 - RNA, 64 nt, hsa
cugggcaacagagcaagacucugucucaaaaaaaaaaaaaaaagaaauaagaaaaugggaagca

SEQ ID NO: 37232 - RNA, 64 nt, hsa
ugggcaacagagcaagacucugucucaaaaaaaaaaaaaaaagaaauaagaaaaugggaagcaa

SEQ ID NO: 37233 - RNA, 64 nt, hsa
uggcuuuugaaucgauuauuucaugcuuuuuuuuaaaaaaaaaaaaaaacaaaauaacaaucug

SEQ ID NO: 37234 - RNA, 64 nt, hsa
ggcuuuugaaucgauuauuucaugcuuuuuuuuaaaaaaaaaaaaaaacaaaauaacaaucuga

SEQ ID NO: 37235 - RNA, 64 nt, hsa
gcuuuugaaucgauuauuucaugcuuuuuuuuaaaaaaaaaaaaaaacaaaauaacaaucugaa

SEQ ID NO: 37236 - RNA, 64 nt, hsa
cuuuugaaucgauuauuucaugcuuuuuuuuaaaaaaaaaaaaaaacaaaauaacaaucugaag

SEQ ID NO: 37237 - RNA, 64 nt, hsa
uuuugaaucgauuauuucaugcuuuuuuuuaaaaaaaaaaaaaaacaaaauaacaaucugaaga

SEQ ID NO: 37238 - RNA, 64 nt, hsa
uuugaaucgauuauuucaugcuuuuuuuuaaaaaaaaaaaaaaacaaaauaacaaucugaagag

SEQ ID NO: 37239 - RNA, 64 nt, hsa
uugaaucgauuauuucaugcuuuuuuuuaaaaaaaaaaaaaaacaaaauaacaaucugaagagg

SEQ ID NO: 37240 - RNA, 64 nt, hsa
ugaaucgauuauuucaugcuuuuuuuuaaaaaaaaaaaaaaacaaaauaacaaucugaagaggc

SEQ ID NO: 37241 - RNA, 64 nt, hsa
guaaauuaucaagcuucaaaaagcuuuuuuuuuuaaaaaaaaacaugcauauucuaaaaaugac

SEQ ID NO: 37242 - RNA, 64 nt, hsa
uaaauuaucaagcuucaaaaagcuuuuuuuuuuaaaaaaaaacaugcauauucuaaaaaugacu

SEQ ID NO: 37243 - RNA, 64 nt, hsa
ccaugauuuuauuauaauuuugacacuagacaagaaaaaaaaauauuauuugucuuuccugccc

SEQ ID NO: 37244 - RNA, 64 nt, hsa
caugauuuuauuauaauuuugacacuagacaagaaaaaaaaauauuauuugucuuuccugcccc

SEQ ID NO: 37245 - RNA, 64 nt, hsa
agucugcucaaaguuuucaacauaaagaauaaagaaaaaaaaaugccaaagugcuuuucaaucu

SEQ ID NO: 37246 - RNA, 64 nt, hsa
gucugcucaaaguuuucaacauaaagaauaaagaaaaaaaaaugccaaagugcuuuucaaucua

SEQ ID NO: 37247 - RNA, 64 nt, hsa
ccaugcaggggcaaucagaucagcaucuucaugcaaaaaaaaaaaaaaaguugagugcucugca

SEQ ID NO: 37248 - RNA, 64 nt, hsa
caugcaggggcaaucagaucagcaucuucaugcaaaaaaaaaaaaaaaguugagugcucugcag

SEQ ID NO: 37249 - RNA, 64 nt, hsa
augcaggggcaaucagaucagcaucuucaugcaaaaaaaaaaaaaaaguugagugcucugcagg

SEQ ID NO: 37250 - RNA, 64 nt, hsa
ugcaggggcaaucagaucagcaucuucaugcaaaaaaaaaaaaaaaguugagugcucugcaggc

SEQ ID NO: 37251 - RNA, 64 nt, hsa
gcaggggcaaucagaucagcaucuucaugcaaaaaaaaaaaaaaaguugagugcucugcaggcc

SEQ ID NO: 37252 - RNA, 64 nt, hsa
caggggcaaucagaucagcaucuucaugcaaaaaaaaaaaaaaaguugagugcucugcaggccu

SEQ ID NO: 37253 - RNA, 64 nt, hsa
aggggcaaucagaucagcaucuucaugcaaaaaaaaaaaaaaaguugagugcucugcaggccug

SEQ ID NO: 37254 - RNA, 64 nt, hsa
ggggcaaucagaucagcaucuucaugcaaaaaaaaaaaaaaaguugagugcucugcaggccugu

SEQ ID NO: 37255 - RNA, 64 nt, hsa
cuaacuuaaagaauagaccaaaauuucuguguauaaaaaaaaaugaaaggcuccuuacauccug

SEQ ID NO: 37256 - RNA, 64 nt, hsa
uaacuuaaagaauagaccaaaauuucuguguauaaaaaaaaaugaaaggcuccuuacauccugg

SEQ ID NO: 37257 - RNA, 64 nt, hsa
cuccaaccuguguaacagagugaggccucaucucaaaaaaaaaaaaaggccacaaaacucaaca

SEQ ID NO: 37258 - RNA, 64 nt, hsa
uccaaccuguguaacagagugaggccucaucucaaaaaaaaaaaaaggccacaaaacucaacaa

SEQ ID NO: 37259 - RNA, 64 nt, hsa
ccaaccuguguaacagagugaggccucaucucaaaaaaaaaaaaaggccacaaaacucaacaau

SEQ ID NO: 37260 - RNA, 64 nt, hsa
caaccuguguaacagagugaggccucaucucaaaaaaaaaaaaaggccacaaaacucaacaaua

SEQ ID NO: 37261 - RNA, 64 nt, hsa
aaccuguguaacagagugaggccucaucucaaaaaaaaaaaaaggccacaaaacucaacaauaa

SEQ ID NO: 37262 - RNA, 64 nt, hsa
accuguguaacagagugaggccucaucucaaaaaaaaaaaaaggccacaaaacucaacaauaaa

SEQ ID NO: 37263 - RNA, 64 nt, hsa
aacuugguuguaccucagggguauuauggugaacaaaaaaaaaaccagucucaaauggucacau

SEQ ID NO: 37264 - RNA, 64 nt, hsa
acuugguuguaccucagggguauuauggugaacaaaaaaaaaaccagucucaaauggucacaua

SEQ ID NO: 37265 - RNA, 64 nt, hsa
cuugguuguaccucagggguauuauggugaacaaaaaaaaaaccagucucaaauggucacauac

SEQ ID NO: 37266 - RNA, 64 nt, hsa
agccugggccacauagcaagacccugucuccaaaaaaaaaaagaaauaaaagacgaagaauagg

SEQ ID NO: 37267 - RNA, 64 nt, hsa
cagccugggccacauagcaagacccugucuccaaaaaaaaaaagaaauaaaagacgaagaauag

SEQ ID NO: 37268 - RNA, 64 nt, hsa
ccagccugggccacauagcaagacccugucuccaaaaaaaaaaagaaauaaaagacgaagaaua

SEQ ID NO: 37269 - RNA, 64 nt, hsa
uccagccugggccacauagcaagacccugucuccaaaaaaaaaaagaaauaaaagacgaagaau

SEQ ID NO: 37270 - RNA, 64 nt, hsa
aaaaacaccaaaucauuugaaaucacuguccauuaaaaaaaaucaccaguggaacuaaacaguu

SEQ ID NO: 37271 - RNA, 64 nt, hsa
cacagagcaagacuccgucucaaaacauaaaaauaaaaaaaauacaaauagcugacccgggugg

SEQ ID NO: 37272 - RNA, 64 nt, hsa
ccugggcagcauagcgagaccccaucucuauauaaaaaaaaagauguuaaaacagugaaauuac

SEQ ID NO: 37273 - RNA, 64 nt, hsa
accugggcagcauagcgagaccccaucucuauauaaaaaaaaagauguuaaaacagugaaauua

SEQ ID NO: 37274 - RNA, 64 nt, hsa
ugacagagugagacccuguccaaaaaaaaaaaaaaaaaaaaagaaggcaauggcuuugugcuuu

SEQ ID NO: 37275 - RNA, 64 nt, hsa
gugacagagugagacccuguccaaaaaaaaaaaaaaaaaaaaagaaggcaauggcuuugugcuu

SEQ ID NO: 37276 - RNA, 64 nt, hsa
ggugacagagugagacccuguccaaaaaaaaaaaaaaaaaaaaagaaggcaauggcuuugugcu

SEQ ID NO: 37277 - RNA, 64 nt, hsa
gggugacagagugagacccuguccaaaaaaaaaaaaaaaaaaaaagaaggcaauggcuuugugc

SEQ ID NO: 37278 - RNA, 64 nt, hsa
ugggugacagagugagacccuguccaaaaaaaaaaaaaaaaaaaaagaaggcaauggcuuugug

SEQ ID NO: 37279 - RNA, 64 nt, hsa
cugggugacagagugagacccuguccaaaaaaaaaaaaaaaaaaaaagaaggcaauggcuuugu

SEQ ID NO: 37280 - RNA, 64 nt, hsa
ccugggugacagagugagacccuguccaaaaaaaaaaaaaaaaaaaaagaaggcaauggcuuug

SEQ ID NO: 37281 - RNA, 64 nt, hsa
gccugggugacagagugagacccuguccaaaaaaaaaaaaaaaaaaaaagaaggcaauggcuuu

SEQ ID NO: 37282 - RNA, 64 nt, hsa
agccugggugacagagugagacccuguccaaaaaaaaaaaaaaaaaaaaagaaggcaauggcuu

SEQ ID NO: 37283 - RNA, 64 nt, hsa
cagccugggugacagagugagacccuguccaaaaaaaaaaaaaaaaaaaaagaaggcaauggcu

SEQ ID NO: 37284 - RNA, 64 nt, hsa
ccagccugggugacagagugagacccuguccaaaaaaaaaaaaaaaaaaaaagaaggcaauggc

SEQ ID NO: 37285 - RNA, 64 nt, hsa
uccagccugggugacagagugagacccuguccaaaaaaaaaaaaaaaaaaaaagaaggcaaugg

SEQ ID NO: 37286 - RNA, 64 nt, hsa
uuccagccugggugacagagugagacccuguccaaaaaaaaaaaaaaaaaaaaagaaggcaaug

SEQ ID NO: 37287 - RNA, 64 nt, hsa
auuccagccugggugacagagugagacccuguccaaaaaaaaaaaaaaaaaaaaagaaggcaau

SEQ ID NO: 37288 - RNA, 64 nt, hsa
ggggacaacaucugaaggguauguugcaugcauuaaaaaaaaucaucucacaugcauuuuauag

SEQ ID NO: 37289 - RNA, 64 nt, hsa
gaaaaaagaaaaaaaaugagaaaaaaguaagaaaaaaaaaaauccuguccuaggcuuuuacucu

SEQ ID NO: 37290 - RNA, 64 nt, hsa
agaaaaaagaaaaaaaaugagaaaaaaguaagaaaaaaaaaaauccuguccuaggcuuuuacuc

SEQ ID NO: 37291 - RNA, 64 nt, hsa
gagaaaaaagaaaaaaaaugagaaaaaaguaagaaaaaaaaaaauccuguccuaggcuuuuacu

SEQ ID NO: 37292 - RNA, 64 nt, hsa
agagaaaaaagaaaaaaaaugagaaaaaaguaagaaaaaaaaaaauccuguccuaggcuuuuac

SEQ ID NO: 37293 - RNA, 64 nt, hsa
aauauacuugcuaucuauaaaaaagagaaaaaagaaaaaaaaugagaaaaaaguaagaaaaaaa

SEQ ID NO: 37294 - RNA, 64 nt, hsa
auauucacaaagagaaaacaaaaggaacuuuuaaaaaaaaaaucacuucacuuauauuaagcaa

SEQ ID NO: 37295 - RNA, 64 nt, hsa
uauauucacaaagagaaaacaaaaggaacuuuuaaaaaaaaaaucacuucacuuauauuaagca

SEQ ID NO: 37296 - RNA, 64 nt, hsa
auauauucacaaagagaaaacaaaaggaacuuuuaaaaaaaaaaucacuucacuuauauuaagc

SEQ ID NO: 37297 - RNA, 64 nt, hsa
aaguugcugucacuguuuuuuucccagguguuaaaaaaaaaauccauuuuacacagcaccacag

SEQ ID NO: 37298 - RNA, 64 nt, hsa
caaguugcugucacuguuuuuuucccagguguuaaaaaaaaaauccauuuuacacagcaccaca

SEQ ID NO: 37299 - RNA, 64 nt, hsa
ccaaguugcugucacuguuuuuuucccagguguuaaaaaaaaaauccauuuuacacagcaccac

SEQ ID NO: 37300 - RNA, 64 nt, hsa
agacuagugcagcauuucagcauauguaaaaaaaaaaaaaaagggaauugacaugucacauauc

SEQ ID NO: 37301 - RNA, 64 nt, hsa
aagacuagugcagcauuucagcauauguaaaaaaaaaaaaaaagggaauugacaugucacauau

SEQ ID NO: 37302 - RNA, 64 nt, hsa
aaagacuagugcagcauuucagcauauguaaaaaaaaaaaaaaagggaauugacaugucacaua

SEQ ID NO: 37303 - RNA, 64 nt, hsa
caaagacuagugcagcauuucagcauauguaaaaaaaaaaaaaaagggaauugacaugucacau

SEQ ID NO: 37304 - RNA, 64 nt, hsa
ccaaagacuagugcagcauuucagcauauguaaaaaaaaaaaaaaagggaauugacaugucaca

SEQ ID NO: 37305 - RNA, 64 nt, hsa
accaaagacuagugcagcauuucagcauauguaaaaaaaaaaaaaaagggaauugacaugucac

SEQ ID NO: 37306 - RNA, 64 nt, hsa
aaccaaagacuagugcagcauuucagcauauguaaaaaaaaaaaaaaagggaauugacauguca

SEQ ID NO: 37307 - RNA, 64 nt, hsa
aaaccaaagacuagugcagcauuucagcauauguaaaaaaaaaaaaaaagggaauugacauguc

SEQ ID NO: 37308 - RNA, 64 nt, hsa
agcuaccaugauucaaaaaaauuaaaaauuaaaaaaaaaaaaucugccacuuauccaaguccac

SEQ ID NO: 37309 - RNA, 64 nt, hsa
cagcuaccaugauucaaaaaaauuaaaaauuaaaaaaaaaaaaucugccacuuauccaagucca

SEQ ID NO: 37310 - RNA, 64 nt, hsa
gcagcuaccaugauucaaaaaaauuaaaaauuaaaaaaaaaaaaucugccacuuauccaagucc

SEQ ID NO: 37311 - RNA, 64 nt, hsa
ugcagcuaccaugauucaaaaaaauuaaaaauuaaaaaaaaaaaaucugccacuuauccaaguc

SEQ ID NO: 37312 - RNA, 64 nt, hsa
augcagcuaccaugauucaaaaaaauuaaaaauuaaaaaaaaaaaaucugccacuuauccaagu

SEQ ID NO: 37313 - RNA, 64 nt, hsa
guguggcuaaauaaccaaacauuuguguaaaaaaaaaaaaaagccaagauuucauuguuuguug

SEQ ID NO: 37314 - RNA, 64 nt, hsa
aguguggcuaaauaaccaaacauuuguguaaaaaaaaaaaaaagccaagauuucauuguuuguu

SEQ ID NO: 37315 - RNA, 64 nt, hsa
uaguguggcuaaauaaccaaacauuuguguaaaaaaaaaaaaaagccaagauuucauuguuugu

SEQ ID NO: 37316 - RNA, 64 nt, hsa
cuaguguggcuaaauaaccaaacauuuguguaaaaaaaaaaaaaagccaagauuucauuguuug

SEQ ID NO: 37317 - RNA, 64 nt, hsa
acuaguguggcuaaauaaccaaacauuuguguaaaaaaaaaaaaaagccaagauuucauuguuu

SEQ ID NO: 37318 - RNA, 64 nt, hsa
cacuaguguggcuaaauaaccaaacauuuguguaaaaaaaaaaaaaagccaagauuucauuguu

SEQ ID NO: 37319 - RNA, 64 nt, hsa
ucacuaguguggcuaaauaaccaaacauuuguguaaaaaaaaaaaaaagccaagauuucauugu

SEQ ID NO: 37320 - RNA, 64 nt, hsa
auagucguauuuugccaccguaaacauaaaaaaaaaaaaaaagauuuccaaaaugccguuuuca

SEQ ID NO: 37321 - RNA, 64 nt, hsa
cauagucguauuuugccaccguaaacauaaaaaaaaaaaaaaagauuuccaaaaugccguuuuc

SEQ ID NO: 37322 - RNA, 64 nt, hsa
ucauagucguauuuugccaccguaaacauaaaaaaaaaaaaaaagauuuccaaaaugccguuuu

SEQ ID NO: 37323 - RNA, 64 nt, hsa
uucauagucguauuuugccaccguaaacauaaaaaaaaaaaaaaagauuuccaaaaugccguuu

SEQ ID NO: 37324 - RNA, 64 nt, hsa
uuucauagucguauuuugccaccguaaacauaaaaaaaaaaaaaaagauuuccaaaaugccguu

SEQ ID NO: 37325 - RNA, 64 nt, hsa
uuuucauagucguauuuugccaccguaaacauaaaaaaaaaaaaaaagauuuccaaaaugccgu

SEQ ID NO: 37326 - RNA, 64 nt, hsa
cuuuucauagucguauuuugccaccguaaacauaaaaaaaaaaaaaaagauuuccaaaaugccg

SEQ ID NO: 37327 - RNA, 64 nt, hsa
ucuuuucauagucguauuuugccaccguaaacauaaaaaaaaaaaaaaagauuuccaaaaugcc

SEQ ID NO: 37328 - RNA, 64 nt, hsa
acaauuugagggaggcagaagucugcaguugaagaaaaaaaauaagucuguuugucauauuuaa

SEQ ID NO: 37329 - RNA, 64 nt, hsa
ggguagaagaccaugucuacuaauuacaaaaaaaaaaaaaaaccaugcauugcugcuuuuccua

SEQ ID NO: 37330 - RNA, 64 nt, hsa
uggguagaagaccaugucuacuaauuacaaaaaaaaaaaaaaaccaugcauugcugcuuuuccu

SEQ ID NO: 37331 - RNA, 64 nt, hsa
auggguagaagaccaugucuacuaauuacaaaaaaaaaaaaaaaccaugcauugcugcuuuucc

SEQ ID NO: 37332 - RNA, 64 nt, hsa
uauggguagaagaccaugucuacuaauuacaaaaaaaaaaaaaaaccaugcauugcugcuuuuc

SEQ ID NO: 37333 - RNA, 64 nt, hsa
uuauggguagaagaccaugucuacuaauuacaaaaaaaaaaaaaaaccaugcauugcugcuuuu

SEQ ID NO: 37334 - RNA, 64 nt, hsa
cuuauggguagaagaccaugucuacuaauuacaaaaaaaaaaaaaaaccaugcauugcugcuuu

SEQ ID NO: 37335 - RNA, 64 nt, hsa
gcuuauggguagaagaccaugucuacuaauuacaaaaaaaaaaaaaaaccaugcauugcugcuu

SEQ ID NO: 37336 - RNA, 64 nt, hsa
agcuuauggguagaagaccaugucuacuaauuacaaaaaaaaaaaaaaaccaugcauugcugcu

SEQ ID NO: 37337 - RNA, 64 nt, hsa
gacagagugagacucugucucaagaaggaaaaaaaaaaaaaagaauguacucauacagauuuuu

SEQ ID NO: 37338 - RNA, 64 nt, hsa
ugacagagugagacucugucucaagaaggaaaaaaaaaaaaaagaauguacucauacagauuuu

SEQ ID NO: 37339 - RNA, 64 nt, hsa
gugacagagugagacucugucucaagaaggaaaaaaaaaaaaaagaauguacucauacagauuu

SEQ ID NO: 37340 - RNA, 64 nt, hsa
ggugacagagugagacucugucucaagaaggaaaaaaaaaaaaaagaauguacucauacagauu

SEQ ID NO: 37341 - RNA, 64 nt, hsa
gggugacagagugagacucugucucaagaaggaaaaaaaaaaaaaagaauguacucauacagau

SEQ ID NO: 37342 - RNA, 64 nt, hsa
ugggugacagagugagacucugucucaagaaggaaaaaaaaaaaaaagaauguacucauacaga

SEQ ID NO: 37343 - RNA, 64 nt, hsa
cugggugacagagugagacucugucucaagaaggaaaaaaaaaaaaaagaauguacucauacag

SEQ ID NO: 37344 - RNA, 64 nt, hsa
ucuuaagaaugguugccaaaaacaacagccaaaaaaaaaaaaccuauuuuauuauccaaaugcu

SEQ ID NO: 37345 - RNA, 64 nt, hsa
gucuuaagaaugguugccaaaaacaacagccaaaaaaaaaaaaccuauuuuauuauccaaaugc

SEQ ID NO: 37346 - RNA, 64 nt, hsa
ugucuuaagaaugguugccaaaaacaacagccaaaaaaaaaaaaccuauuuuauuauccaaaug

SEQ ID NO: 37347 - RNA, 64 nt, hsa
uugucuuaagaaugguugccaaaaacaacagccaaaaaaaaaaaaccuauuuuauuauccaaau

SEQ ID NO: 37348 - RNA, 64 nt, hsa
cuugucuuaagaaugguugccaaaaacaacagccaaaaaaaaaaaaccuauuuuauuauccaaa

SEQ ID NO: 37349 - RNA, 64 nt, hsa
uuggaacauuuguuucuuuucuuuuuuaaggagaaaaaaaaaugaguaaaaggagcuccacacu

SEQ ID NO: 37350 - RNA, 64 nt, hsa
cuuggaacauuuguuucuuuucuuuuuuaaggagaaaaaaaaaugaguaaaaggagcuccacac

SEQ ID NO: 37351 - RNA, 64 nt, hsa
cuguggggggaaaaaauucucaguugucaaaaaaaaaaaaaacugaucugcuuagaauguggcc

SEQ ID NO: 37352 - RNA, 64 nt, hsa
gcuguggggggaaaaaauucucaguugucaaaaaaaaaaaaaacugaucugcuuagaauguggc

SEQ ID NO: 37353 - RNA, 64 nt, hsa
agcuguggggggaaaaaauucucaguugucaaaaaaaaaaaaaacugaucugcuuagaaugugg

SEQ ID NO: 37354 - RNA, 64 nt, hsa
cagcuguggggggaaaaaauucucaguugucaaaaaaaaaaaaaacugaucugcuuagaaugug

SEQ ID NO: 37355 - RNA, 64 nt, hsa
acagcuguggggggaaaaaauucucaguugucaaaaaaaaaaaaaacugaucugcuuagaaugu

SEQ ID NO: 37356 - RNA, 64 nt, hsa
aacagcuguggggggaaaaaauucucaguugucaaaaaaaaaaaaaacugaucugcuuagaaug

SEQ ID NO: 37357 - RNA, 64 nt, hsa
gaacagcuguggggggaaaaaauucucaguugucaaaaaaaaaaaaaacugaucugcuuagaau

SEQ ID NO: 37358 - RNA, 64 nt, hsa
aaaaaaaacaaaaacaaaaaaaccuuaaaugucaaaaaaaaauaauauuuucaccauccagacg

SEQ ID NO: 37359 - RNA, 64 nt, hsa
aaaaaaaaacaaaaacaaaaaaaccuuaaaugucaaaaaaaaauaauauuuucaccauccagac

SEQ ID NO: 37360 - RNA, 64 nt, hsa
cugggaaaugugguaaaacuccgacucuauuuaaaaaaaaaacaaaaacaaaaaaaccuuaaau

SEQ ID NO: 37361 - RNA, 64 nt, hsa
ccugggaaaugugguaaaacuccgacucuauuuaaaaaaaaaacaaaaacaaaaaaaccuuaaa

SEQ ID NO: 37362 - RNA, 64 nt, hsa
gccugggaaaugugguaaaacuccgacucuauuuaaaaaaaaaacaaaaacaaaaaaaccuuaa

SEQ ID NO: 37363 - RNA, 64 nt, hsa
uguaagaggugucaacaaacugggaaauaaaauaaaaaaaaauaauaauaaaugugucauuguu

SEQ ID NO: 37364 - RNA, 64 nt, hsa
auguaagaggugucaacaaacugggaaauaaaauaaaaaaaaauaauaauaaaugugucauugu

SEQ ID NO: 37365 - RNA, 64 nt, hsa
agcaguuaaguugucucuaaaugaacuagcaaaaaaaaaaaauguaguuuuuguuuguaaggaa

SEQ ID NO: 37366 - RNA, 64 nt, hsa
cagcaguuaaguugucucuaaaugaacuagcaaaaaaaaaaaauguaguuuuuguuuguaagga

SEQ ID NO: 37367 - RNA, 64 nt, hsa
acagcaguuaaguugucucuaaaugaacuagcaaaaaaaaaaaauguaguuuuuguuuguaagg

SEQ ID NO: 37368 - RNA, 64 nt, hsa
aacagcaguuaaguugucucuaaaugaacuagcaaaaaaaaaaaauguaguuuuuguuuguaag

SEQ ID NO: 37369 - RNA, 64 nt, hsa
aaacagcaguuaaguugucucuaaaugaacuagcaaaaaaaaaaaauguaguuuuuguuuguaa

SEQ ID NO: 37370 - RNA, 64 nt, hsa
acagcuuaagaauuccaaaaaaaaaaaaaaaaaaaaaaaaaagaaaacuggguuugggcuuugc

SEQ ID NO: 37371 - RNA, 64 nt, hsa
aacagcuuaagaauuccaaaaaaaaaaaaaaaaaaaaaaaaaagaaaacuggguuugggcuuug

SEQ ID NO: 37372 - RNA, 64 nt, hsa
aaacagcuuaagaauuccaaaaaaaaaaaaaaaaaaaaaaaaaagaaaacuggguuugggcuuu

SEQ ID NO: 37373 - RNA, 64 nt, hsa
gaaacagcuuaagaauuccaaaaaaaaaaaaaaaaaaaaaaaaaagaaaacuggguuugggcuu

SEQ ID NO: 37374 - RNA, 64 nt, hsa
ugaaacagcuuaagaauuccaaaaaaaaaaaaaaaaaaaaaaaaaagaaaacuggguuugggcu

SEQ ID NO: 37375 - RNA, 64 nt, hsa
gugaaacagcuuaagaauuccaaaaaaaaaaaaaaaaaaaaaaaaaagaaaacuggguuugggc

SEQ ID NO: 37376 - RNA, 64 nt, hsa
agugaaacagcuuaagaauuccaaaaaaaaaaaaaaaaaaaaaaaaaagaaaacuggguuuggg

SEQ ID NO: 37377 - RNA, 64 nt, hsa
uagugaaacagcuuaagaauuccaaaaaaaaaaaaaaaaaaaaaaaaaagaaaacuggguuugg

SEQ ID NO: 37378 - RNA, 64 nt, hsa
guagugaaacagcuuaagaauuccaaaaaaaaaaaaaaaaaaaaaaaaaagaaaacuggguuug

SEQ ID NO: 37379 - RNA, 64 nt, hsa
gguagugaaacagcuuaagaauuccaaaaaaaaaaaaaaaaaaaaaaaaaagaaaacuggguuu

SEQ ID NO: 37380 - RNA, 64 nt, hsa
agguagugaaacagcuuaagaauuccaaaaaaaaaaaaaaaaaaaaaaaaaagaaaacuggguu

SEQ ID NO: 37381 - RNA, 64 nt, hsa
cagguagugaaacagcuuaagaauuccaaaaaaaaaaaaaaaaaaaaaaaaaagaaaacugggu

SEQ ID NO: 37382 - RNA, 64 nt, hsa
acagguagugaaacagcuuaagaauuccaaaaaaaaaaaaaaaaaaaaaaaaaagaaaacuggg

SEQ ID NO: 37383 - RNA, 64 nt, hsa
aacagguagugaaacagcuuaagaauuccaaaaaaaaaaaaaaaaaaaaaaaaaagaaaacugg

SEQ ID NO: 37384 - RNA, 64 nt, hsa
caacagguagugaaacagcuuaagaauuccaaaaaaaaaaaaaaaaaaaaaaaaaagaaaacug

SEQ ID NO: 37385 - RNA, 64 nt, hsa
acaacagguagugaaacagcuuaagaauuccaaaaaaaaaaaaaaaaaaaaaaaaaagaaaacu

SEQ ID NO: 37386 - RNA, 64 nt, hsa
uacaacagguagugaaacagcuuaagaauuccaaaaaaaaaaaaaaaaaaaaaaaaaagaaaac

SEQ ID NO: 37387 - RNA, 64 nt, hsa
auacaacagguagugaaacagcuuaagaauuccaaaaaaaaaaaaaaaaaaaaaaaaaagaaaa

SEQ ID NO: 37388 - RNA, 64 nt, hsa
gauacaacagguagugaaacagcuuaagaauuccaaaaaaaaaaaaaaaaaaaaaaaaaagaaa

SEQ ID NO: 37389 - RNA, 64 nt, hsa
cuggcaacagagcgagacuccaucucaaaaaaaaaaaaaaaaguaagaaagaaaaggacucccu

SEQ ID NO: 37390 - RNA, 64 nt, hsa
ccuggcaacagagcgagacuccaucucaaaaaaaaaaaaaaaaguaagaaagaaaaggacuccc

SEQ ID NO: 37391 - RNA, 64 nt, hsa
gccuggcaacagagcgagacuccaucucaaaaaaaaaaaaaaaaguaagaaagaaaaggacucc

SEQ ID NO: 37392 - RNA, 64 nt, hsa
agccuggcaacagagcgagacuccaucucaaaaaaaaaaaaaaaaguaagaaagaaaaggacuc

SEQ ID NO: 37393 - RNA, 64 nt, hsa
cagccuggcaacagagcgagacuccaucucaaaaaaaaaaaaaaaaguaagaaagaaaaggacu

SEQ ID NO: 37394 - RNA, 64 nt, hsa
ccagccuggcaacagagcgagacuccaucucaaaaaaaaaaaaaaaaguaagaaagaaaaggac

SEQ ID NO: 37395 - RNA, 64 nt, hsa
uccagccuggcaacagagcgagacuccaucucaaaaaaaaaaaaaaaaguaagaaagaaaagga

SEQ ID NO: 37396 - RNA, 64 nt, hsa
cuccagccuggcaacagagcgagacuccaucucaaaaaaaaaaaaaaaaguaagaaagaaaagg

SEQ ID NO: 37397 - RNA, 64 nt, hsa
acuccagccuggcaacagagcgagacuccaucucaaaaaaaaaaaaaaaaguaagaaagaaaag

SEQ ID NO: 37398 - RNA, 64 nt, hsa
cuccagccugagugauagagugagacucugucucaaaaaaaaguaucucuaaauacaggauuau

SEQ ID NO: 37399 - RNA, 64 nt, hsa
uuuacucuauugcuuaugcuuuaaaaaaaggaaaaaaaaaaacuacuaaccacugcaagcucuu

SEQ ID NO: 37400 - RNA, 64 nt, hsa
auuuacucuauugcuuaugcuuuaaaaaaaggaaaaaaaaaaacuacuaaccacugcaagcucu

SEQ ID NO: 37401 - RNA, 64 nt, hsa
cauuuacucuauugcuuaugcuuuaaaaaaaggaaaaaaaaaaacuacuaaccacugcaagcuc

SEQ ID NO: 37402 - RNA, 64 nt, hsa
gcauuuacucuauugcuuaugcuuuaaaaaaaggaaaaaaaaaaacuacuaaccacugcaagcu

SEQ ID NO: 37403 - RNA, 64 nt, hsa
ucagaauuguuaacugaaacaaauauuugcuugaaaaaaaaaguucaugaaguaccaaugcaag

SEQ ID NO: 37404 - RNA, 64 nt, hsa
gucagaauuguuaacugaaacaaauauuugcuugaaaaaaaaaguucaugaaguaccaaugcaa

SEQ ID NO: 37405 - RNA, 64 nt, hsa
guggaggauuacauuuaaaaaagcaaaaagugaaaaaaaaaagcucuggacaccuuuaauaagc

SEQ ID NO: 37406 - RNA, 64 nt, hsa
uguggaggauuacauuuaaaaaagcaaaaagugaaaaaaaaaagcucuggacaccuuuaauaag

SEQ ID NO: 37407 - RNA, 64 nt, hsa
uuguggaggauuacauuuaaaaaagcaaaaagugaaaaaaaaaagcucuggacaccuuuaauaa

SEQ ID NO: 37408 - RNA, 64 nt, hsa
ccuuaacucuguauuaaaaaaaauguuuuuguuuaaaaaaaacuguucccauaggugcagcaaa

SEQ ID NO: 37409 - RNA, 64 nt, hsa
gugaaauauaagccugcggccuuaacucuguauuaaaaaaaauguuuuuguuuaaaaaaaacug

SEQ ID NO: 37410 - RNA, 64 nt, hsa
ccucaaguuacuuuccuucauuuucuuaaaaaagaaaaaaaauuauuaaauguuucucacauau

SEQ ID NO: 37411 - RNA, 64 nt, hsa
uuguauaaaaauuuaaauugaauuaaaagaaggaaaaaaaaagcccaaacuuaaccucugagaa

SEQ ID NO: 37412 - RNA, 64 nt, hsa
uuuguauaaaaauuuaaauugaauuaaaagaaggaaaaaaaaagcccaaacuuaaccucugaga

SEQ ID NO: 37413 - RNA, 64 nt, hsa
uguuuaguuuuguuuacccaagguugaauugaaaaaaaaaaacagucaauauggauuuagaaaa

SEQ ID NO: 37414 - RNA, 64 nt, hsa
auguuuaguuuuguuuacccaagguugaauugaaaaaaaaaaacagucaauauggauuuagaaa

SEQ ID NO: 37415 - RNA, 64 nt, hsa
aauguuuaguuuuguuuacccaagguugaauugaaaaaaaaaaacagucaauauggauuuagaa

SEQ ID NO: 37416 - RNA, 64 nt, hsa
gaauguuuaguuuuguuuacccaagguugaauugaaaaaaaaaaacagucaauauggauuuaga

SEQ ID NO: 37417 - RNA, 64 nt, hsa
uaaaaaacacaugaagaaaauuuaccaaaaaaaaaaaaaaaagcagaagaauaauguaguuuag

SEQ ID NO: 37418 - RNA, 64 nt, hsa
cuaaaaaacacaugaagaaaauuuaccaaaaaaaaaaaaaaaagcagaagaauaauguaguuua

SEQ ID NO: 37419 - RNA, 64 nt, hsa
ucuaaaaaacacaugaagaaaauuuaccaaaaaaaaaaaaaaaagcagaagaauaauguaguuu

SEQ ID NO: 37420 - RNA, 64 nt, hsa
gucuaaaaaacacaugaagaaaauuuaccaaaaaaaaaaaaaaaagcagaagaauaauguaguu

SEQ ID NO: 37421 - RNA, 64 nt, hsa
ugucuaaaaaacacaugaagaaaauuuaccaaaaaaaaaaaaaaaagcagaagaauaauguagu

SEQ ID NO: 37422 - RNA, 64 nt, hsa
uugucuaaaaaacacaugaagaaaauuuaccaaaaaaaaaaaaaaaagcagaagaauaauguag

SEQ ID NO: 37423 - RNA, 64 nt, hsa
uuugucuaaaaaacacaugaagaaaauuuaccaaaaaaaaaaaaaaaagcagaagaauaaugua

SEQ ID NO: 37424 - RNA, 64 nt, hsa
uuuugucuaaaaaacacaugaagaaaauuuaccaaaaaaaaaaaaaaaagcagaagaauaaugu

SEQ ID NO: 37425 - RNA, 64 nt, hsa
cuuuugucuaaaaaacacaugaagaaaauuuaccaaaaaaaaaaaaaaaagcagaagaauaaug

SEQ ID NO: 37426 - RNA, 64 nt, hsa
uacauauacagcacuuaaaauguuugugugggaaaaaaaaaacucauuggcagauccaagaaug

SEQ ID NO: 37427 - RNA, 64 nt, hsa
uuacauauacagcacuuaaaauguuugugugggaaaaaaaaaacucauuggcagauccaagaau

SEQ ID NO: 37428 - RNA, 64 nt, hsa
uuuacauauacagcacuuaaaauguuugugugggaaaaaaaaaacucauuggcagauccaagaa

SEQ ID NO: 37429 - RNA, 64 nt, hsa
gaccucauuaguuguuaauuuuuuaguuggauaaaaaaaaaacucgcugacauaaucucccuag

SEQ ID NO: 37430 - RNA, 64 nt, hsa
ugaccucauuaguuguuaauuuuuuaguuggauaaaaaaaaaacucgcugacauaaucucccua

SEQ ID NO: 37431 - RNA, 64 nt, hsa
uugaccucauuaguuguuaauuuuuuaguuggauaaaaaaaaaacucgcugacauaaucucccu

SEQ ID NO: 37432 - RNA, 64 nt, hsa
auguaucccauagaagcugauguuuaacauaugaaaaaaaaaguauugucuauaaaauguuucu

SEQ ID NO: 37433 - RNA, 64 nt, hsa
aauguaucccauagaagcugauguuuaacauaugaaaaaaaaaguauugucuauaaaauguuuc

SEQ ID NO: 37434 - RNA, 64 nt, hsa
aacugcuauuuucgcuuauuucuggaauguaaaaaaaaaaaauguauaaaaagaauuaguguau

SEQ ID NO: 37435 - RNA, 64 nt, hsa
aaacugcuauuuucgcuuauuucuggaauguaaaaaaaaaaaauguauaaaaagaauuagugua

SEQ ID NO: 37436 - RNA, 64 nt, hsa
aaaacugcuauuuucgcuuauuucuggaauguaaaaaaaaaaaauguauaaaaagaauuagugu

SEQ ID NO: 37437 - RNA, 64 nt, hsa
uaaaacugcuauuuucgcuuauuucuggaauguaaaaaaaaaaaauguauaaaaagaauuagug

SEQ ID NO: 37438 - RNA, 64 nt, hsa
uuaaaacugcuauuuucgcuuauuucuggaauguaaaaaaaaaaaauguauaaaaagaauuagu

SEQ ID NO: 37439 - RNA, 64 nt, hsa
aggcuuuuaaauuaguacaacuguuacuauuuaaaaaaaaaauacccuaaguacucuguuuacu

SEQ ID NO: 37440 - RNA, 64 nt, hsa
aaggcuuuuaaauuaguacaacuguuacuauuuaaaaaaaaaauacccuaaguacucuguuuac

SEQ ID NO: 37441 - RNA, 64 nt, hsa
aaaggcuuuuaaauuaguacaacuguuacuauuuaaaaaaaaaauacccuaaguacucuguuua

SEQ ID NO: 37442 - RNA, 64 nt, hsa
gagguagaaacaaaccaacgaccaaaaaaaaaaaaaaaaaaaucugcucagauacucagccagu

SEQ ID NO: 37443 - RNA, 64 nt, hsa
ggagguagaaacaaaccaacgaccaaaaaaaaaaaaaaaaaaaucugcucagauacucagccag

SEQ ID NO: 37444 - RNA, 64 nt, hsa
uggagguagaaacaaaccaacgaccaaaaaaaaaaaaaaaaaaaucugcucagauacucagcca

SEQ ID NO: 37445 - RNA, 64 nt, hsa
uuggagguagaaacaaaccaacgaccaaaaaaaaaaaaaaaaaaaucugcucagauacucagcc

SEQ ID NO: 37446 - RNA, 64 nt, hsa
cuuggagguagaaacaaaccaacgaccaaaaaaaaaaaaaaaaaaaucugcucagauacucagc

SEQ ID NO: 37447 - RNA, 64 nt, hsa
gcuuggagguagaaacaaaccaacgaccaaaaaaaaaaaaaaaaaaaucugcucagauacucag

SEQ ID NO: 37448 - RNA, 64 nt, hsa
ugcuuggagguagaaacaaaccaacgaccaaaaaaaaaaaaaaaaaaaucugcucagauacuca

SEQ ID NO: 37449 - RNA, 64 nt, hsa
augcuuggagguagaaacaaaccaacgaccaaaaaaaaaaaaaaaaaaaucugcucagauacuc

SEQ ID NO: 37450 - RNA, 64 nt, hsa
uaugcuuggagguagaaacaaaccaacgaccaaaaaaaaaaaaaaaaaaaucugcucagauacu

SEQ ID NO: 37451 - RNA, 64 nt, hsa
auaugcuuggagguagaaacaaaccaacgaccaaaaaaaaaaaaaaaaaaaucugcucagauac

SEQ ID NO: 37452 - RNA, 64 nt, hsa
cauaugcuuggagguagaaacaaaccaacgaccaaaaaaaaaaaaaaaaaaaucugcucagaua

SEQ ID NO: 37453 - RNA, 64 nt, hsa
ccauaugcuuggagguagaaacaaaccaacgaccaaaaaaaaaaaaaaaaaaaucugcucagau

SEQ ID NO: 37454 - RNA, 64 nt, hsa
ucuccucuccucucccccgauguacccucaaaaaaaaaaaaaugcuaaccaguucuuccauuaa

SEQ ID NO: 37455 - RNA, 64 nt, hsa
cucuccucuccucucccccgauguacccucaaaaaaaaaaaaaugcuaaccaguucuuccauua

SEQ ID NO: 37456 - RNA, 64 nt, hsa
ccucuccucuccucucccccgauguacccucaaaaaaaaaaaaaugcuaaccaguucuuccauu

SEQ ID NO: 37457 - RNA, 64 nt, hsa
uccucuccucuccucucccccgauguacccucaaaaaaaaaaaaaugcuaaccaguucuuccau

SEQ ID NO: 37458 - RNA, 64 nt, hsa
cuccucuccucuccucucccccgauguacccucaaaaaaaaaaaaaugcuaaccaguucuucca

SEQ ID NO: 37459 - RNA, 64 nt, hsa
ucuccucuccucuccucucccccgauguacccucaaaaaaaaaaaaaugcuaaccaguucuucc

SEQ ID NO: 37460 - RNA, 64 nt, hsa
cagaauggauugcuaguguuggugaguaaaaacaaaaaaaaacaaaugacaaagaaugugauag

SEQ ID NO: 37461 - RNA, 64 nt, hsa
acagaauggauugcuaguguuggugaguaaaaacaaaaaaaaacaaaugacaaagaaugugaua

SEQ ID NO: 37462 - RNA, 64 nt, hsa
uuucuaucguucucucuuugcauggauuucuuugaaaaaaaauaaauugcucaaauaaaaaugu

SEQ ID NO: 37463 - RNA, 64 nt, hsa
ugguagcauauagauuguccuuuugcaaagaaagaaaaaaaaccaucaaguugugccaaauuau

SEQ ID NO: 37464 - RNA, 64 nt, hsa
acauuuaugguuuggaaccaucaccccaagguaaaaaaaaaauaaaagguauucccagguaugu

SEQ ID NO: 37465 - RNA, 64 nt, hsa
cacauuuaugguuuggaaccaucaccccaagguaaaaaaaaaauaaaagguauucccagguaug

SEQ ID NO: 37466 - RNA, 64 nt, hsa
ucacauuuaugguuuggaaccaucaccccaagguaaaaaaaaaauaaaagguauucccagguau

SEQ ID NO: 37467 - RNA, 64 nt, hsa
cagcuaggcaaaagccauacuuuucacaauuaaaaaaaaaaacuauucugacuagagucagguu

SEQ ID NO: 37468 - RNA, 64 nt, hsa
ucagcuaggcaaaagccauacuuuucacaauuaaaaaaaaaaacuauucugacuagagucaggu

SEQ ID NO: 37469 - RNA, 64 nt, hsa
uucagcuaggcaaaagccauacuuuucacaauuaaaaaaaaaaacuauucugacuagagucagg

SEQ ID NO: 37470 - RNA, 64 nt, hsa
guucagcuaggcaaaagccauacuuuucacaauuaaaaaaaaaaacuauucugacuagagucag

SEQ ID NO: 37471 - RNA, 64 nt, hsa
ggagugaagugcaauauuauaaauauuauagauuaaaaaaaaaauagccgugcacucuugaccc

SEQ ID NO: 37472 - RNA, 64 nt, hsa
gagugaagugcaauauuauaaauauuauagauuaaaaaaaaaauagccgugcacucuugacccc

SEQ ID NO: 37473 - RNA, 64 nt, hsa
agugaagugcaauauuauaaauauuauagauuaaaaaaaaaauagccgugcacucuugaccccg

SEQ ID NO: 37474 - RNA, 64 nt, hsa
auuuagauacuucucccugagguggggauaaaagaaaaaaaaaaacaacuucuuuuuuucuucc

SEQ ID NO: 37475 - RNA, 64 nt, hsa
uuuagauacuucucccugagguggggauaaaagaaaaaaaaaaacaacuucuuuuuuucuuccg

SEQ ID NO: 37476 - RNA, 64 nt, hsa
uuagauacuucucccugagguggggauaaaagaaaaaaaaaaacaacuucuuuuuuucuuccgc

SEQ ID NO: 37477 - RNA, 64 nt, hsa
uagauacuucucccugagguggggauaaaagaaaaaaaaaaacaacuucuuuuuuucuuccgca

SEQ ID NO: 37478 - RNA, 64 nt, hsa
cucauucauccauuuuucuuaaaagcuggaaauuaaaaaaaaaaaagagagagagaggcuuuaa

SEQ ID NO: 37479 - RNA, 64 nt, hsa
ucauucauccauuuuucuuaaaagcuggaaauuaaaaaaaaaaaagagagagagaggcuuuaau

SEQ ID NO: 37480 - RNA, 64 nt, hsa
cauucauccauuuuucuuaaaagcuggaaauuaaaaaaaaaaaagagagagagaggcuuuaaua

SEQ ID NO: 37481 - RNA, 64 nt, hsa
auucauccauuuuucuuaaaagcuggaaauuaaaaaaaaaaaagaggagagaggcuuucggugg

SEQ ID NO: 37482 - RNA, 64 nt, hsa
uucauccauuuuucuuaaaagcuggaaauuaaaaaaaaaaaagaggagagaggcuuucggugga

SEQ ID NO: 37483 - RNA, 64 nt, hsa
aggagagaggcuuucgguggacacguuugacauuaaaaaaaaaaaaaaaaaaaaaaaaaaacug

SEQ ID NO: 37484 - RNA, 64 nt, hsa
ggagagaggcuuucgguggacacguuugacauuaaaaaaaaaaaaaaaaaaaaaaaaaaacugg

SEQ ID NO: 37485 - RNA, 64 nt, hsa
gagagaggcuuucgguggacacguuugacauuaaaaaaaaaaaaaaaaaaaaaaaaaaacuggu

SEQ ID NO: 37486 - RNA, 64 nt, hsa
agagaggcuuucgguggacacguuugacauuaaaaaaaaaaaaaaaaaaaaaaaaaaacuggug

SEQ ID NO: 37487 - RNA, 64 nt, hsa
gagaggcuuucgguggacacguuugacauuaaaaaaaaaaaaaaaaaaaaaaaaaaacuggugc

SEQ ID NO: 37488 - RNA, 64 nt, hsa
agaggcuuucgguggacacguuugacauuaaaaaaaaaaaaaaaaaaaaaaaaaaacuggugcc

SEQ ID NO: 37489 - RNA, 64 nt, hsa
gaggcuuucgguggacacguuugacauuaaaaaaaaaaaaaaaaaaaaaaaaaaacuggugccu

SEQ ID NO: 37490 - RNA, 64 nt, hsa
aggcuuucgguggacacguuugacauuaaaaaaaaaaaaaaaaaaaaaaaaaaacuggugccua

SEQ ID NO: 37491 - RNA, 64 nt, hsa
ggcuuucgguggacacguuugacauuaaaaaaaaaaaaaaaaaaaaaaaaaaacuggugccuaa

SEQ ID NO: 37492 - RNA, 64 nt, hsa
gcuuucgguggacacguuugacauuaaaaaaaaaaaaaaaaaaaaaaaaaaacuggugccuaau

SEQ ID NO: 37493 - RNA, 64 nt, hsa
cuuucgguggacacguuugacauuaaaaaaaaaaaaaaaaaaaaaaaaaaacuggugccuaauu

SEQ ID NO: 37494 - RNA, 64 nt, hsa
uuucgguggacacguuugacauuaaaaaaaaaaaaaaaaaaaaaaaaaaacuggugccuaauuu

SEQ ID NO: 37495 - RNA, 64 nt, hsa
uucgguggacacguuugacauuaaaaaaaaaaaaaaaaaaaaaaaaaaacuggugccuaauuua

SEQ ID NO: 37496 - RNA, 64 nt, hsa
ucgguggacacguuugacauuaaaaaaaaaaaaaaaaaaaaaaaaaaacuggugccuaauuuau

SEQ ID NO: 37497 - RNA, 64 nt, hsa
cgguggacacguuugacauuaaaaaaaaaaaaaaaaaaaaaaaaaaacuggugccuaauuuauu

SEQ ID NO: 37498 - RNA, 64 nt, hsa
gguggacacguuugacauuaaaaaaaaaaaaaaaaaaaaaaaaaaacuggugccuaauuuauua

SEQ ID NO: 37499 - RNA, 64 nt, hsa
guggacacguuugacauuaaaaaaaaaaaaaaaaaaaaaaaaaaacuggugccuaauuuauuaa

SEQ ID NO: 37500 - RNA, 64 nt, hsa
uggacacguuugacauuaaaaaaaaaaaaaaaaaaaaaaaaaaacuggugccuaauuuauuaaa

SEQ ID NO: 37501 - RNA, 64 nt, hsa
ggacacguuugacauuaaaaaaaaaaaaaaaaaaaaaaaaaaacuggugccuaauuuauuaaag

SEQ ID NO: 37502 - RNA, 64 nt, hsa
gacacguuugacauuaaaaaaaaaaaaaaaaaaaaaaaaaaacuggugccuaauuuauuaaaga

SEQ ID NO: 37503 - RNA, 64 nt, hsa
cccucuguuauugucggcaggcggugagggguagaaaaaaaacaaacaaacaaacagaaaaaaa

SEQ ID NO: 37504 - RNA, 64 nt, hsa
gugagggguagaaaaaaaacaaacaaacaaacagaaaaaaaaaccaaaaaaaaccacccugagu

SEQ ID NO: 37505 - RNA, 64 nt, hsa
ugagggguagaaaaaaaacaaacaaacaaacagaaaaaaaaaccaaaaaaaaccacccugaguu

SEQ ID NO: 37506 - RNA, 64 nt, hsa
aaaaaaaacaaacaaacaaacagaaaaaaaaaccaaaaaaaaccacccugaguuucucugguga

SEQ ID NO: 37507 - RNA, 64 nt, hsa
cuccagccuggacgacagagcaagacccuguauuaaaaaaaaaauucauccugcacagggaaau

SEQ ID NO: 37508 - RNA, 64 nt, hsa
uccagccuggacgacagagcaagacccuguauuaaaaaaaaaauucauccugcacagggaaaug

SEQ ID NO: 37509 - RNA, 64 nt, hsa
ccagccuggacgacagagcaagacccuguauuaaaaaaaaaauucauccugcacagggaaaugg

SEQ ID NO: 37510 - RNA, 64 nt, hsa
cuccagccugggugacagagugagacccuguuccaaaaaaaaaaaaaaacccaaaaaaccucaa

SEQ ID NO: 37511 - RNA, 64 nt, hsa
uccagccugggugacagagugagacccuguuccaaaaaaaaaaaaaaacccaaaaaaccucaau

SEQ ID NO: 37512 - RNA, 64 nt, hsa
ccagccugggugacagagugagacccuguuccaaaaaaaaaaaaaaacccaaaaaaccucaaug

SEQ ID NO: 37513 - RNA, 64 nt, hsa
cagccugggugacagagugagacccuguuccaaaaaaaaaaaaaaacccaaaaaaccucaaugg

SEQ ID NO: 37514 - RNA, 64 nt, hsa
agccugggugacagagugagacccuguuccaaaaaaaaaaaaaaacccaaaaaaccucaauggc

SEQ ID NO: 37515 - RNA, 64 nt, hsa
gccugggugacagagugagacccuguuccaaaaaaaaaaaaaaacccaaaaaaccucaauggcu

SEQ ID NO: 37516 - RNA, 64 nt, hsa
ccugggugacagagugagacccuguuccaaaaaaaaaaaaaaacccaaaaaaccucaauggcuu

SEQ ID NO: 37517 - RNA, 64 nt, hsa
cugggugacagagugagacccuguuccaaaaaaaaaaaaaaacccaaaaaaccucaauggcuuu

SEQ ID NO: 37518 - RNA, 64 nt, hsa
gccugggcagcauagcgagaccccaucucuauauaaaaaaaaagauguuaaaacagugaaauua

SEQ ID NO: 37519 - RNA, 64 nt, hsa; identical to SEQ ID NO: 37272

SEQ ID NO: 37520 - RNA, 64 nt, hsa
auccuuuucauccuuugugccucgguuauuaaggaaaaaaaaauguccaacauacaguuuuuaa

SEQ ID NO: 37521 - RNA, 64 nt, hsa
uccuuuucauccuuugugccucgguuauuaaggaaaaaaaaauguccaacauacaguuuuuaaa

SEQ ID NO: 37522 - RNA, 64 nt, hsa
acucaucucuguaaaaaauaaaaauaaaacauuaaaaaaaaacaugagcuuugaagugcacagg

SEQ ID NO: 37523 - RNA, 64 nt, hsa
aacucaucucuguaaaaaauaaaaauaaaacauuaaaaaaaaacaugagcuuugaagugcacag

SEQ ID NO: 37524 - RNA, 64 nt, hsa
gcugagcgugggccuugggugugucucaugggggaaaaaaaacugugaaaaaccucagaguagc

SEQ ID NO: 37525 - RNA, 64 nt, hsa
uauuucugcauauguugaauacuuuuuacaauuaaaaaaaaagaucuguuuugaaggcaaaauu

SEQ ID NO: 37526 - RNA, 64 nt, hsa
uuauuucugcauauguugaauacuuuuuacaauuaaaaaaaaagaucuguuuugaaggcaaaau

SEQ ID NO: 37527 - RNA, 61 nt, hsa
gaugauuuagcaauaauaaaauggcagucauaacagggacuguuugucaguauugcuguca

SEQ ID NO: 37528 - RNA, 61 nt, hsa
uuguaaauuuuuaguuuuaaugaaagcaugcaacagggaucucacacccauguuacuugcc

SEQ ID NO: 37529 - RNA, 61 nt, hsa
ugcaugcaugauaaugcguggcagagacugcaacagggauuguguguucagagaucauaug

SEQ ID NO: 37530 - RNA, 61 nt, hsa
caucccagguguguguaagagagagagagagaacagggaggauacagaaguauugcagccc

SEQ ID NO: 37531 - RNA, 61 nt, hsa
uuauuucccuuaaguguuucacuggggagagaacagggagugcuccuccagcuucccaaag

SEQ ID NO: 37532 - RNA, 61 nt, hsa
cagaguuuggaggccaguuuuccacagccuaaacagggaggagcugcagaauggggcucug

SEQ ID NO: 37533 - RNA, 61 nt, hsa
ccucagcagggcuuacuaagcacuaccccuuaacagggaugacuccgcacugccccucaac

SEQ ID NO: 37534 - RNA, 61 nt, hsa
ccuuaacagggaugacuccgcacugccccucaacagggaugacucagcagagaugacucag

SEQ ID NO: 37535 - RNA, 61 nt, hsa
ccucagcagggaugacucagcaccgccucucaacagggaugacucagcagggaugacucag

SEQ ID NO: 37536 - RNA, 61 nt, hsa
ccucagcaaggaugacucagcacugccgcucaacagggaugacucagggauggcuuaguac

SEQ ID NO: 37537 - RNA, 61 nt, hsa
augacucagggauggcuuaguacugccccucaacagggaugacucagcagggaugacucag

SEQ ID NO: 37538 - RNA, 61 nt, hsa
ccucagcagggaugacucagcacugccccucaacagggaugacucagcagggaugacucag

SEQ ID NO: 37539 - RNA, 61 nt, hsa
ccucagcagggaugacucagcaccgccccucaacagggaugacucagcacugccccucaac

SEQ ID NO: 37540 - RNA, 61 nt, hsa
ccucaacagggaugacucagcacugccccucaacagggaugacucagcagggaugacucag

SEQ ID NO: 37541 - RNA, 61 nt, hsa
acucagcagggaugacucagcaccaccccucaacagggaugacucagcagggaugacucag

SEQ ID NO: 37542 - RNA, 61 nt, hsa
acucagcagggaugacucagcacugccccucaacagggaugacugcagggaugacucagca

SEQ ID NO: 37543 - RNA, 61 nt, hsa
gcucagcagggaugacucagcauugccccucaacagggaugacucagcagacucagcaggg

SEQ ID NO: 37544 - RNA, 61 nt, hsa
acacguccuccagcccaagacugccuaauuuaacagggauuucugcauucuggaacaagcc

SEQ ID NO: 37545 - RNA, 61 nt, hsa
acgcuuaaacauagccuuuaaaguuuacaacaacagggacagggcaaaagaggggaguaaa

SEQ ID NO: 37546 - RNA, 64 nt, hsa
augguauguagcauguagugcacaagcugauuuuaagugauauucagauggccuuuuaaauuua

SEQ ID NO: 37547 - RNA, 64 nt, hsa
auuauuauguauuuaaaauuuaauuaauuauagcaagugauaugaacugugauaaugcagaagg

SEQ ID NO: 37548 - RNA, 64 nt, hsa
aauuucuacuuuguaaaaauagggaaauuauuugaagugauauauuugguuaaacauuucuaaa

SEQ ID NO: 37549 - RNA, 64 nt, hsa
uaauaaauaugaguguccuuuauuugccuaguagaagugauaaauuguguuauauaugauaauu

SEQ ID NO: 37550 - RNA, 64 nt, hsa
uaaauuccuccauugugagauaaggacagugucaaagugauaaagcuuaacacuugaccuaaac

SEQ ID NO: 37551 - RNA, 64 nt, hsa
uggacuggauaagugcuaccuuaaaggguauacuaagugauacaguacuuugaaucuaguuguu

SEQ ID NO: 37552 - RNA, 64 nt, hsa
gggguacauaugugaacacuccagccuucagcguaagugauaguccaaauuuucuuuaagcagc

SEQ ID NO: 37553 - RNA, 64 nt, hsa
agacuacaacaacuauaggauggcuuuuguuaggaagugauauucuguugaauaucagaugguu

SEQ ID NO: 37554 - RNA, 64 nt, hsa
guuuucaguaugcuaaaaagucagagugauacaaaagugauauuuaaaaauauacacacaugua

SEQ ID NO: 37555 - RNA, 64 nt, hsa
auuuaaauuacuaucauuuaugauugcaguaauaaagugauaagcauucaagcaacucuguauu

SEQ ID NO: 37556 - RNA, 64 nt, hsa
aaacauuaguauuuuagguuucuauaaacacuauaagugauaguuucccccauccuuucauuga

SEQ ID NO: 37557 - RNA, 64 nt, hsa
gcugaauucuguuuuuaccaguuucaaaaccuucaagugauauguggaaaaaagugaaugagac

SEQ ID NO: 37558 - RNA, 64 nt, hsa
cccuuauuguccuggguggaccaauccaaaggcuaagugauagugacucaucaauguugggucc

SEQ ID NO: 37559 - RNA, 64 nt, hsa
guccuaggucccuggguggacccaucaggaccccaagugauagugacccaguggucuuuuagau

SEQ ID NO: 37560 - RNA, 64 nt, hsa
aagcgcagaaggcacagccuuacugaccagcacgcccacugacuggcaucugccggcuuugugc

SEQ ID NO: 37561 - RNA, 64 nt, hsa
auggcacugaauauccccuuggcagcagagaaaacccacugaaagaucguagaguggcacaugc

SEQ ID NO: 37562 - RNA, 64 nt, hsa
ucuuuccaguuagagaagaggaguggugauaaagcccacugaccuucacacauucuaaaaauug

SEQ ID NO: 37563 - RNA, 64 nt, hsa
uugcuaaucaaucacagcacuauuuccuauuaagcccacugauuucuucacaauccuucucaaa

SEQ ID NO: 37564 - RNA, 64 nt, hsa
gucagggaaaccuaaacugaggucagcacuugggcccacugacagugacugacugggggagaag

SEQ ID NO: 37565 - RNA, 64 nt, hsa
aaagauguuuuuagaaccagaagaaaccucgguucccacugauccuucugggccacguugugcg

SEQ ID NO: 37566 - RNA, 64 nt, hsa
agagaaggaggaggaagcccauagacccccaagccccacugaggccccuacugaggccagcccc

SEQ ID NO: 37567 - RNA, 64 nt, hsa
gauccugggcaugaugggccgagccaccucggaucccacugauuggccagccgagcgagaacca

SEQ ID NO: 37568 - RNA, 64 nt, hsa
agguggcagccacccucuaggagacaaaacuacccccacugacaaggcuuuaggagacccuaaa

SEQ ID NO: 37569 - RNA, 64 nt, hsa
accauugcuacauuguagguugugaucauuuugccccacugaagcccauguaucugaccuuacg

SEQ ID NO: 37570 - RNA, 64 nt, hsa
caagacugucauugccccuccgaugcugaggccacccacugacccaacugauccugcuccagca

SEQ ID NO: 37571 - RNA, 64 nt, hsa
cccaacugauccugcuccagcagcacaccucagccccacugacacccaguguccuuccaucuuc

SEQ ID NO: 37572 - RNA, 64 nt, hsa
aauauagcccacugaccaggaauuauuuaaccaacccacugaaaacuuguguguugagcagcuc

SEQ ID NO: 37573 - RNA, 64 nt, hsa
uccaguaccaugcuguuuuguggcaugaauauagcccacugaccaggaauuauuuaaccaaccc

SEQ ID NO: 37574 - RNA, 64 nt, hsa
auacugcagccccaucccauggggccccugaagacccacugaggaauuccguagggucuuguuc

SEQ ID NO: 37575 - RNA, 64 nt, hsa
auugaugcagauggaaggaggaagggagacugggcccacugauuuccagccccaccaugugugc

SEQ ID NO: 37576 - RNA, 64 nt, hsa
gcccccucccuguuucuuaucaccagcccaucagcccacugacucccauaugguagaaaaggua

SEQ ID NO: 37577 - RNA, 64 nt, hsa
cuggcuuuccuuaggucaggcaagcagacagcuccccacugaagaggucuguacagugacaacc

SEQ ID NO: 37578 - RNA, 64 nt, hsa
gguccucucuugcuagacacacuccauagauccccccacugagcuguggaugggcaaaccccgg

SEQ ID NO: 37579 - RNA, 64 nt, hsa
gcaaaccccgguggaaucccacccuccccaacaccccacugagcccugggcccccuccucccuu

SEQ ID NO: 37580 - RNA, 64 nt, hsa
cuugggagugaggugugggaguagccaccagccucccacugacuaggcauguuaggaauuagac

SEQ ID NO: 37581 - RNA, 64 nt, hsa
agcacccaaacacauggcacuuggaagaaaaagacccacugaaucugagaaaguacuuucuggu

SEQ ID NO: 37582 - RNA, 64 nt, hsa
agagacccgagggcugcuuugggggaggggggaacucgagaauguauggauuuaccugaaaaca

SEQ ID NO: 37583 - RNA, 64 nt, hsa
gucaaggccaagucugcagggaccuguugaaagccucgagaaugucuuggcugcccaagacucu

SEQ ID NO: 37584 - RNA, 64 nt, hsa
ggugccacagggaaagcuguagaaggcaagaagacucgagaaucccccagaguuauuuuucucc

SEQ ID NO: 37585 - RNA, 64 nt, hsa
agaaaugccugugaagaccuuggcagcgacguggcucgagaagcauucaucauuacuguggaca

SEQ ID NO: 37586 - RNA, 64 nt, hsa
gaaaacaaaugggagcauagcagugugugagguucucgagaacugucuugucucuguguguuua

SEQ ID NO: 37587 - RNA, 64 nt, hsa
uccucauuugcauuccaagaagagcauguccucccucgagaaacagugccgccggugugaugag

SEQ ID NO: 37588 - RNA, 64 nt, hsa
aaagaaagauccucugcugaccccuggagcagcucucgagaacuaccuguugguauuguccaca

SEQ ID NO: 37589 - RNA, 64 nt, hsa
gagagaaaaaucugcuauuuuucuaaguaagagucucgagaagcagaguuuuugucuugucauu

SEQ ID NO: 37590 - RNA, 64 nt, hsa
acccuucucuguuggucugccuucugcugaaagacucgagaaccaaccagggaagcuguccugg

SEQ ID NO: 37591 - RNA, 64 nt, hsa
uuuggaaggaaugccaggucucgcacagcuuggccucgagaaggugagaggaaggcaaaggcca

SEQ ID NO: 37592 - RNA, 64 nt, hsa
auaaauuuuaauaguuauaaauauaauacuauaacucgagaaaaggcauuucuagagaacagau

SEQ ID NO: 37593 - RNA, 64 nt, hsa
guugguagauuacaacucuuuuuauuugaaguugcucgagaaguuagacaugcuuuagaauuau

SEQ ID NO: 37594 - RNA, 64 nt, hsa
ccaaaguccuaacuuccugugccuuuccuaucaccucgagaaguaauuaucaguugguuuggau

SEQ ID NO: 37595 - RNA, 64 nt, hsa
ccaagacagaacucaagaaagccacuggggaaaacucgagaagaaagggaguauacuaguaggu

SEQ ID NO: 37596 - RNA, 64 nt, hsa
uccuggucccugguuggccucagacaagcacggccucgagaaaagagccaagcgcaucgggagc

SEQ ID NO: 37597 - RNA, 64 nt, hsa
aagacaacaguaugcugcuauagccgucugcuaccucgagaagccauggccugccugccuuuug

SEQ ID NO: 37598 - RNA, 64 nt, hsa
cagccccagagcaccccgcccgacucccauuaaccucgagaaccuuuuuuuuuuuaaccaaaac

SEQ ID NO: 37599 - RNA, 64 nt, hsa
agccacugaccuuggcucaccuuagaggaauuuccucgagaacaacagagauaagaaaagaacc

SEQ ID NO: 37600 - RNA, 64 nt, hsa
gcaccauuuuauuugguuugucccacuaaaaugacucgagaaguguuuagacaaacuccccuua

SEQ ID NO: 37601 - RNA, 64 nt, hsa
gaugcaaucagacaaguguuuuggaaagagcacccucgagaaggguggaugacagggcagagca

SEQ ID NO: 37602 - RNA, 64 nt, hsa
ccagaugccugagccuuuguccaaagugaggucacucgagaauucauggacacggcccccaguc

SEQ ID NO: 37603 - RNA, 64 nt, hsa
gaaucccuuugcuuaggcccaaccuggucgauagcucgagaaagaauuuuuuccaaggaaaugu

SEQ ID NO: 37604 - RNA, 64 nt, hsa
cacuuuuaaaccuaaagagccuuauuauuauuagcucgagaaauaccacaugccagucuuccca

SEQ ID NO: 37605 - RNA, 64 nt, hsa
caccccagcgcagccuggcgccgcgggacugaagcucgagaagggccugaccuaaaggucaggu

SEQ ID NO: 37606 - RNA, 64 nt, hsa
uagguucaaaaccuaauucccccagauuaguauacucgagaauucaaagggacauuuaaggugg

SEQ ID NO: 37607 - RNA, 64 nt, hsa
aauuacugacccaagccaaacagaaacaauaacccucgagaaaauaggucaacaaucuguugug

SEQ ID NO: 37608 - RNA, 64 nt, hsa
aaagugaaaaucacuaccgccuugugcuagugcccucgagaagaguuauugcucuagaaaguug

SEQ ID NO: 37609 - RNA, 64 nt, hsa
cacugcacuccagcuugggugacagagacccugucucgagaaauuaaaaaaaaaaaaaacuuau

SEQ ID NO: 37610 - RNA, 64 nt, hsa
aggagacgggcugggcggcgacccccacagggcucucgagaacagauucuccccuccaguaugg

SEQ ID NO: 37611 - RNA, 64 nt, hsa
aaaucauauuguaguauucaauaguuaauaaaaacucgagaaauguguuguuucugaugugaaa

SEQ ID NO: 37612 - RNA, 64 nt, hsa
aaaaauuagcaaaccgaaguuucuucaaugaccccucgagaacuuugggaccaguuuccuauag

SEQ ID NO: 37613 - RNA, 64 nt, hsa
gaucaaggcucuggcauucagagaacccuugcaacucgagaagcuguuuuuauuucguuuuugu

SEQ ID NO: 37614 - RNA, 64 nt, hsa
agugggggccagccugaggacccccgccuaccaccucgagaacuggaagccaaccucuaaccuc

SEQ ID NO: 37615 - RNA, 64 nt, hsa
uguaagccacuagucuguggcauuguuauagcagcucgagaagacuaaggcagaugggcuucca

SEQ ID NO: 37616 - RNA, 64 nt, hsa
cugaaggaacgucguaaggaagcugaacggauugcucgagaaagagaggaacucagaaggcaac

SEQ ID NO: 37617 - RNA, 64 nt, hsa
ucaugcaagcgcucuaauuccuauaaauacgaaacucgagaagauucaaucacuguauagaaug

SEQ ID NO: 37618 - RNA, 64 nt, hsa
cagaugccaugguaugggccacaggacacacuugcucgagaaccaaagugcauuugggugacau

SEQ ID NO: 37619 - RNA, 64 nt, hsa
cgagcaugguggcacaugccuguagucccaccuacucgagaagcugagauagggucaccugagc

SEQ ID NO: 37620 - RNA, 64 nt, hsa
aaggacucuaggucaaaugucaauaaauaugaaccucgagaaaguucugaaggccaugacaccu

SEQ ID NO: 37621 - RNA, 64 nt, hsa
gauauauguguuccuuuuagagagcugucuagaacucgagaaucauggcaccacagacgugaaa

SEQ ID NO: 37622 - RNA, 64 nt, hsa
cauggcgcucccuucaacagcaagccugacuguucucgagaacucugcaaucuuuuaaauaagc

SEQ ID NO: 37623 - RNA, 64 nt, hsa
agagcuggccgcgccaaauaaugucucugugagacucgagaacuuucauuuuuuuccaggcugg

SEQ ID NO: 37624 - RNA, 64 nt, hsa
acuccuccauauucuuucaacccacaugagucuccucgagaagugaggagaggcaguuuggagc

SEQ ID NO: 37625 - RNA, 64 nt, hsa
uucacgcccuccaucucacagucaagauaaaggccucgagaauaaagagccagcccccuuccau

SEQ ID NO: 37626 - RNA, 64 nt, hsa
ccucuucagagccugcacucgcuaaggaaggggacucgagaaugggggggcagcuugcugaccc

SEQ ID NO: 37627 - RNA, 64 nt, hsa
augaaaauuguguuacuauaaugccuuauuuuaccucgagaauuguuaccuuaaauuaguacag

SEQ ID NO: 37628 - RNA, 64 nt, hsa
caugguucacagaaaaggauccugggcucagaaucucgagaaccgccugcuccuaacaauucag

SEQ ID NO: 37629 - RNA, 64 nt, hsa
cuuuggggagaugggcgauaaguguugagguaggcucgagaacugcuccccaaaucagugagaa

SEQ ID NO: 37630 - RNA, 64 nt, hsa
accauuuggggucugaggagaaacaggcuggggccucgagaaggagucacucagacaagccaua

SEQ ID NO: 37631 - RNA, 64 nt, hsa
guggugccaugaaggaaagaaaccuuggccuggucucgagaagcuucccaugcuucaggaaguu

SEQ ID NO: 37632 - RNA, 60 nt, hsa
gcggcccagggugggccagaccagcagcccaggaagcagcacacgcggccguggggaggc

SEQ ID NO: 37633 - RNA, 60 nt, hsa
gagacgaggauacccagcgaaagggacgggaggaagcauccgaaaccuaggauucguccu

SEQ ID NO: 37634 - RNA, 60 nt, hsa
gcugcuccucuguccugcuagccuuccuccaggaagcacacugggugcagauaaucagga

SEQ ID NO: 37635 - RNA, 60 nt, hsa
gaaugcuaccauuuuuuuuccaaaguagaaaggaagcacuucugagccagugaccacuga

SEQ ID NO: 37636 - RNA, 60 nt, hsa
aaaccaguguagccuugcccggauucugggaggaagcagguugaggggcuccuggaaagg

SEQ ID NO: 37637 - RNA, 60 nt, hsa
cagcgaccugccugucaugcccacccccugaggaagcauggggacccuaacacccuggug

SEQ ID NO: 37638 - RNA, 60 nt, hsa
gcacaauuuaauauauucaagaguggggggaggaagcagaggucuucagggcucuuuuuu

SEQ ID NO: 37639 - RNA, 60 nt, hsa
uuccucuuuuuauagugguggcuggcaagaaggaagcaguucuccacguucucaccuaag

SEQ ID NO: 37640 - RNA, 60 nt, hsa
cugcaaaggggacccccaggugggaggggcaggaagcagccggagugagcccuucgcccc

SEQ ID NO: 37641 - RNA, 60 nt, hsa
agccccaggagcugugccacccaaauccagaggaagcaaggaggagggaggugggguagg

SEQ ID NO: 37642 - RNA, 60 nt, hsa
uacuugaguuuggagucagaaagcaagaccaggaagcaaauagcagcucaggaaauccca

SEQ ID NO: 37643 - RNA, 60 nt, hsa
ucuucauaaauuagugcuguuuacuuucagaggaagcagagaaguugcuguuauguuuuu

SEQ ID NO: 37644 - RNA, 60 nt, hsa
ucacuacugguaauuaaggggaaggauaugaggaagcaguuuaaauagcccuguucucau

SEQ ID NO: 37645 - RNA, 60 nt, hsa
ugucugggguauucacuuggcuccucagcaaggaagcaaacgccuuggaggagaagcaca

SEQ ID NO: 37646 - RNA, 60 nt, hsa
ugcguugcuaccuugcuucugugagaauucaggaagcaggugagaggagucaagccaaua

SEQ ID NO: 37647 - RNA, 60 nt, hsa
uauccuuugaccaucugcacuuuauuuggaaggaagcaggggcuguccacccugaaaaag

SEQ ID NO: 37648 - RNA, 60 nt, hsa
guauuacagugccacguuggaaaacgcuacaggaagcaugaccuauccacaucuuuccaa

SEQ ID NO: 37649 - RNA, 60 nt, hsa
uuggcauagaagaauguaaagaaucauuaaaggaagcagggccuaggagacacgugaaac

SEQ ID NO: 37650 - RNA, 60 nt, hsa
caaucucuuuuuuuccuugcucacauuaaaaggaagcauggaguucuaaugcucccauaa

SEQ ID NO: 37651 - RNA, 60 nt, hsa
ccucucacaucuccuccugcccaagauguaaggaagcauuguaaggauuucuucccaucg

SEQ ID NO: 37652 - RNA, 60 nt, hsa
cucuguauccagaacacacuuggcagauggaggaagcaucugaguuugagaccauggcug

SEQ ID NO: 37653 - RNA, 60 nt, hsa
cagccugggcagccaucacaccacgaggacaggaagcaccagcacguuucacaccucccc

SEQ ID NO: 37654 - RNA, 60 nt, hsa
aggaaaauggaagaccuaaggcagacaggaaggaagcacaaaagacaagcauugggucag

SEQ ID NO: 37655 - RNA, 60 nt, hsa
guuggggcccaaaagacagucugaagaggaaggaagcagcaguaucugcguagcccacag

SEQ ID NO: 37656 - RNA, 60 nt, hsa
cuggccccauccucuccucacuguaaugugaggaagcaccucugugucagggcucaccug

SEQ ID NO: 37657 - RNA, 60 nt, hsa
uuuguuggaaaaacaugaauucauaaauucaggaagcacaauauauaccaaacauauauu

SEQ ID NO: 37658 - RNA, 60 nt, hsa
aaaccaugugcuuauuagaugguuccacucaggaagcaaggaagcuaaaacucaaguuaa

SEQ ID NO: 37659 - RNA, 60 nt, hsa
cagccaaggagaagaauggcccaaggaacuaggaagcagccaugggagaggggaaggguu

SEQ ID NO: 37660 - RNA, 60 nt, hsa
guugcucaacacaucaccucggacaaauucaggaagcauuucuuuagcccacaaguccag

SEQ ID NO: 37661 - RNA, 60 nt, hsa
ccgcuuuggggagcgccucgcuucacggacaggaagcacagcagguuuauccagaugaac

SEQ ID NO: 37662 - RNA, 60 nt, hsa
gcccaccuggcugaccugugcacuuggcugaggaagcagagaccgagcgcuggucauuuu

SEQ ID NO: 37663 - RNA, 60 nt, hsa
uaaaguuguacuaggcaaacacacugauguaggaagcacgaggaaaggaagacguuuuga

SEQ ID NO: 37664 - RNA, 60 nt, hsa
ugcacccaaggggccucuccaugccuucuuaggaagcagcuaugaauccauuguccuugu

SEQ ID NO: 37665 - RNA, 60 nt, hsa
uuccuaaaggucuccucaguccccagaggaaggaagcacugcagagauuaagagcagaaa

SEQ ID NO: 37666 - RNA, 60 nt, hsa
ugaaguaguuugaugauuuguuuggcauauaggaagcacgcuggugcuaaguauuuuuua

SEQ ID NO: 37667 - RNA, 60 nt, hsa
aaagcugccagccgagauagccaaggccaaaggaagcacaugccucucucaggccaaacu

SEQ ID NO: 37668 - RNA, 60 nt, hsa
uucucuagacuuggaagcugagauucagagaggaagcaucccuugugcaagaucacauag

SEQ ID NO: 37669 - RNA, 60 nt, hsa
aacuucaaacaauauagaauuaaauguaaaaggaagcacuccuguguacagaugcgauca

SEQ ID NO: 37670 - RNA, 60 nt, hsa
agccaaacuccuuggucaccugcuccaagaaggaagcaguagcugagcaccugcccucac

SEQ ID NO: 37671 - RNA, 60 nt, hsa
gaggcugagacacacgaaucccuugagcccaggaagcagagguugcagugagccucgauu

SEQ ID NO: 37672 - RNA, 60 nt, hsa
ggucuccuuucuuucucacuucugucuugaaggaagcauuucuaaaauguauccccuuuc

SEQ ID NO: 37673 - RNA, 50 nt, hsa
ccccacugaauguuucauaaaggaagcacuguuggagcuacugcaaaugc

SEQ ID NO: 37674 - RNA, 60 nt, hsa
ucaggcugacagggagggcaaagagugaaaaggaagcaucucuuucuuguuauccaacau

SEQ ID NO: 37675 - RNA, 60 nt, hsa
ucaaaaagcacaaagagcuggggcagaggcaggaagcaggggcccuccuggcagcuccuc

SEQ ID NO: 37676 - RNA, 60 nt, hsa
ugcccgccagcccugcucuuguuguggagaaggaagcagaugugaucacaucaccccguc

SEQ ID NO: 37677 - RNA, 60 nt, hsa
cugaacacaugaaucuuuuuuggucaguguaggaagcacagccagauccuauaggaauga

SEQ ID NO: 37678 - RNA, 60 nt, hsa
uccuucccccucagagaaccaaauagccugaggaagcaggagaguuccugguuauggcag

SEQ ID NO: 37679 - RNA, 60 nt, hsa
ugaagaucauuaagaauguggagaaguacaaggaagcagcucgacuugagaucaacgugc

SEQ ID NO: 37680 - RNA, 60 nt, hsa
gaggaucacucucaaaugagauuaaaaacaaggaagcagagaauggucagagaaugggau

SEQ ID NO: 37681 - RNA, 60 nt, hsa
acaagccacaauaaaaagcauaacuucuaaaggaagcagaauagcuccucuggccagcau

SEQ ID NO: 37682 - RNA, 60 nt, hsa
uguguuuugcaacauauuaagaguaugugaaggaagcagggaugucgcaggaauccgcug

SEQ ID NO: 37683 - RNA, 60 nt, hsa
ucuuugaggugaggguggggugccccagcuaggaagcaagaucgcugugcuaggucugac

SEQ ID NO: 37684 - RNA, 60 nt, hsa
gagugccuccuuaguggugcuugcagucacaggaagcagcagcaguaaggacaaggggcc

SEQ ID NO: 37685 - RNA, 60 nt, hsa
caaauccccaagucgacucaagaggcugccaggaagcagagaugcagaccccaaggagac

SEQ ID NO: 37686 - RNA, 60 nt, hsa
gauucuccuaauuuuuaacacuaaaauucaaggaagcaguggaggaaagaaugcauuacu

SEQ ID NO: 37687 - RNA, 60 nt, hsa
ccagaugagcccugccucugggagcccccuaggaagcaccagccuggaccuaccaccugc

SEQ ID NO: 37688 - RNA, 60 nt, hsa
ucugggacgugguucaaguucaagacuugaaggaagcaaagacgcccugcaugguuacaa

SEQ ID NO: 37689 - RNA, 60 nt, hsa
uauaucacuaagcuguggcuggaauugauuaggaagcauuugguagaaggacugaacaac

SEQ ID NO: 37690 - RNA, 60 nt, hsa
ggaugcuagccccagagaugccagcccuucaggaagcagguguccuuuccccucucugcc

SEQ ID NO: 37691 - RNA, 60 nt, hsa
uggguuugccaaacgccuaauuaccaggccaggaagcaugccaacaaagccacacgggug

SEQ ID NO: 37692 - RNA, 60 nt, hsa
ggucucugggucggucagugacauguagguaggaagcacugaaaauaguguucccagagc

SEQ ID NO: 37693 - RNA, 60 nt, hsa
gaggcugaggcacaauaauuguuugaacccaggaagcagagguugcagugagcugagauc

SEQ ID NO: 37694 - RNA, 60 nt, hsa
ugaugagauaucaaguuuugaauauuauucaggaagcacuuuggagaaugugggaguccu

SEQ ID NO: 37695 - RNA, 60 nt, hsa
ugcaauugcacaaauacaagccaagcuagaaggaagcaccuaugaaagcaacaacuuugu

SEQ ID NO: 37696 - RNA, 60 nt, hsa
ugucauauuuuuuucacccugccuuuccacaggaagcacucacaggcaccacacacguau

SEQ ID NO: 37697 - RNA, 60 nt, hsa
guuuauauuuugugcuuauucauacaagacaggaagcacggucuuaggcggauggaggcc

SEQ ID NO: 37698 - RNA, 60 nt, hsa
ggauguauucagccuacguugcccuggaaaaggaagcaggagaugucucccugugggaaa

SEQ ID NO: 37699 - RNA, 60 nt, hsa
gggaaguguuuauuguuccuuuuccuacaaaggaagcagucucuggaggccagaaagaaa

SEQ ID NO: 37700 - RNA, 60 nt, hsa
agaaaacccacugccuagaggccaucuuaaaggaagcaauggauggaucccuuucauccc

SEQ ID NO: 37701 - RNA, 60 nt, hsa
gguguuggaggaggguuuaagcauuaagauaggaagcaggaaauuugauugcucuaaauu

SEQ ID NO: 37702 - RNA, 60 nt, hsa
uagcccuaguaguuuuuuagguuggaccagaggaagcagguuaaaugagaccuguccucu

SEQ ID NO: 37703 - RNA, 60 nt, hsa
caucugugcuucagucauagauguuaauagaggaagcaguuuuccugcugcagauuccug

SEQ ID NO: 37704 - RNA, 60 nt, hsa
aaagauuugcaguuugacagcccagcagggaggaagcaucacacagcguuaggagccguu

SEQ ID NO: 37705 - RNA, 60 nt, hsa
ucuguagaaucuuacugguauugaauguaaaggaagcaaggccuguauugcagucuucau

SEQ ID NO: 37706 - RNA, 60 nt, hsa
gaagcaagauuucuauauuuguuuuuuuaaaggaagcagucauucuuucuacuaaaucca

SEQ ID NO: 37707 - RNA, 60 nt, hsa
auauggcucagagcagagccggaucucccaaggaagcacaaauaguuuuugucgcuaacu

SEQ ID NO: 37708 - RNA, 60 nt, hsa
acaugcuuuuuguagcauucaaaccauagcaggaagcaacuuugcuuaaaauuguauacc

SEQ ID NO: 37709 - RNA, 60 nt, hsa
uuaaacauuuuuaguugcuguguaaauguuaggaagcaaaguagcuuugaauuuucucug

SEQ ID NO: 37710 - RNA, 60 nt, hsa
aacuauaaauuuuucaaggucuuaaauaaaaggaagcaaaaacaaaauuauugaaaaauu

SEQ ID NO: 37711 - RNA, 60 nt, hsa
augacaggauaaacucugacgcaccaagaaaggaagcaaaugaaaaaguuuaaagacugu

SEQ ID NO: 37712 - RNA, 60 nt, hsa
gaggcugaggcaggaggaucgcuugaacccaggaagcagagguugcagugagcugagauc

SEQ ID NO: 37713 - RNA, 60 nt, hsa
uaauagcccguuucgucucugacccaacagaggaagcacagaucaaaucaccuuggagug

SEQ ID NO: 37714 - RNA, 60 nt, hsa
ugaagccucuaacaaaugaucuaguucagaaggaagcaaaaucccuuaaucuaugugcac

SEQ ID NO: 37715 - RNA, 60 nt, hsa
aacaaaugucuuaaagggaaucauuuuuguaggaagcauuuuuuauaauuuucuaagucg

SEQ ID NO: 37716 - RNA, 60 nt, hsa
ggugaucagcagagagauugaacuuugaggaggaagcagaaucuuugcaagaaagucaga

SEQ ID NO: 37717 - RNA, 60 nt, hsa
ccaacccugccuugaagcaauucaauaaagaggaagcaaacagccaggcucccugagggc

SEQ ID NO: 37718 - RNA, 60 nt, hsa
cuuuggaggcaugguggaugaaaggcgcaaaggaagcaagagguuaaagauaauggccca

SEQ ID NO: 37719 - RNA, 60 nt, hsa
caaaaguuaaacguucuaaaaagaggcgaaaggaagcaagcaguucagaagagccaagga

SEQ ID NO: 37720 - RNA, 60 nt, hsa
auaugaacggugagcauuguggcugucagcaggaagcaacgaagggaaaugucuuuccuu

SEQ ID NO: 37721 - RNA, 60 nt, hsa
gcgugugugcagggagacuggguaggaaagaggaagcaaauagaagagagagguugaaaa

SEQ ID NO: 37722 - RNA, 60 nt, hsa
ggggagggagcacucugggacugugagacaaggaagcagggccagcagugagacuaugag

SEQ ID NO: 37723 - RNA, 60 nt, hsa
ucuuucauuaggaacauuuugcuggugaugaggaagcauuuagcugaauaaguuuaaagc

SEQ ID NO: 37724 - RNA, 60 nt, hsa
gccaaguuacuuucucauauacagcauuuuaggaagcaugauuuuuuuuuucuaucaucu

SEQ ID NO: 37725 - RNA, 60 nt, hsa
aacuuccuucugcuucuaccagauggcccaaggaagcacaucguccuguuuuauugcuuu

SEQ ID NO: 37726 - RNA, 60 nt, hsa
uuaauuggcucauggcucugcaggcuuuacaggaagcaugguacuggcaucugcuugguu

SEQ ID NO: 37727 - RNA, 60 nt, hsa
ggaucacugacaaaaaacacugcaccaguaaggaagcaacuaaauuuuguuuuguucuuu

SEQ ID NO: 37728 - RNA, 60 nt, hsa
gacuuuaguaaauuugucaauauagaugguaggaagcagaaugccauuuuauuaaaacac

SEQ ID NO: 37729 - RNA, 60 nt, hsa
aucugccaauagacccaggacgaguaagagaggaagcaucaaccuuuuaaaaauuuccuu

SEQ ID NO: 37730 - RNA, 60 nt, hsa
gaggcugaggcacaagaaucgcuugaauccaggaagcaagcggagguugcagugaguuga

SEQ ID NO: 37731 - RNA, 60 nt, hsa
ccugacaaagcuguuugcucuuggguugggaggaagcaaaugcaagcugggcugggucua

SEQ ID NO: 37732 - RNA, 60 nt, hsa
uucuuucuaucaacugcugauaucaucuucaggaagcaaguccauaacaugacauaucug

SEQ ID NO: 37733 - RNA, 60 nt, hsa
uuccuuagcagggaggaggaagaggagaggaggaagcaaagaaucacaaggaaccucugg

SEQ ID NO: 37734 - RNA, 60 nt, hsa
gcuuuauugcagcgauuaauaacaggcaaaaggaagcaggguugguuucccuucuuuuug

SEQ ID NO: 37735 - RNA, 60 nt, hsa
gaggcugaggcaggagaauugcuugaacccaggaagcagagguugcaguaagcugagauc

SEQ ID NO: 37736 - RNA, 60 nt, hsa
acugaauccuugcagcgacuuccggaauuuaggaagcauucccucuucuacaggggucug

SEQ ID NO: 37737 - RNA, 60 nt, hsa
ccucugagaucaugugaguccuccauggcaaggaagcaguuccagggagagucagguucc

SEQ ID NO: 37738 - RNA, 60 nt, hsa
ugcacuuucggggaaggaggacucacagugaggaagcaaaaacugugcacagaaguggau

SEQ ID NO: 37739 - RNA, 60 nt, hsa
auuaaaaugcauuuuuuauucuuaagugguaggaagcaacauccaaaaaugcuuaauaaa

SEQ ID NO: 37740 - RNA, 60 nt, hsa
gguucucuugccguagaacaaaaacaguuuaggaagcauaauuacgaacauuuaggaacc

SEQ ID NO: 37741 - RNA, 60 nt, hsa
aacuucaauguaccauuuuacugagugcuaaggaagcauaucaauuccaauauuuuauaa

SEQ ID NO: 37742 - RNA, 60 nt, hsa
uaugagcaaauguauugcuucuuuuagaggaggaagcauacaaccucuuuugugugaauu

SEQ ID NO: 37743 - RNA, 60 nt, hsa
gcaaggaauuuaucuucaggugaagaagagaggaagcaggaucccacugagcaccucuug

SEQ ID NO: 37744 - RNA, 60 nt, hsa
caacuggguauauaucacuaacagcuuuguaggaagcacuuuuaauguuuucucucucac

SEQ ID NO: 37745 - RNA, 60 nt, hsa
aggggcaucccggcccauaccccuccagacaggaagcauggguuugcccacagaccuguc

SEQ ID NO: 37746 - RNA, 60 nt, hsa
cugaccgcgggugucacgggcauuucucaaaggaagcaggggauucagugagugugaagg

SEQ ID NO: 37747 - RNA, 60 nt, hsa
auugguggagcggcucccuauuuauacaauaggaagcaugggugcuuagaaaguuuauuu

SEQ ID NO: 37748 - RNA, 60 nt, hsa
gaugucaaaaugaagauaguaaaacaagggaggaagcaguggauggaccaggauuaauuc

SEQ ID NO: 37749 - RNA, 60 nt, hsa
uacaaaggcaugacucuggcggugguccuaaggaagcaugagcagaaaauucauaaaaau

SEQ ID NO: 37750 - RNA, 60 nt, hsa
ucccuaaguauucuacaauggaaagaauggaggaagcacuucaaguagccaucaacaaca

SEQ ID NO: 37751 - RNA, 60 nt, hsa
uguguaacugaaggcaugagacaucuguacaggaagcaucccagcgcccacaugggcaug

SEQ ID NO: 37752 - RNA, 60 nt, hsa
acagugugccuguaaaaugggcauuccccaaggaagcagagucaagguauaaacuuucgu

SEQ ID NO: 37753 - RNA, 51 nt, hsa
ugagcucuccuccuguuuaaaaggaagcauccacacccccaacuccuggac

SEQ ID NO: 37754 - RNA, 60 nt, hsa
acacaguguuauaacucaagcacuagcuucaggaagcauguuguguuguuaagaagcuuu

SEQ ID NO: 37755 - RNA, 60 nt, hsa
gaaagggaacggugaaguacuaagcgcuagaggaagcagccaagucgguuaguggaagca

SEQ ID NO: 37756 - RNA, 60 nt, hsa
accuagaaguuuguuuugcuuuuaauuuaaaggaagcaguaaccacaaagcuuccgcuca

SEQ ID NO: 37757 - RNA, 60 nt, hsa
aaaauguauaugaaugcuccuaauauggucaggaagcaaggaagcgaaggauauauuaug

SEQ ID NO: 37758 - RNA, 60 nt, hsa
cuaagaguaaagcaacucaaguuauaggaaaggaagcagauaccuugcaaagcaacuagu

SEQ ID NO: 37759 - RNA, 60 nt, hsa
cauuaucuucauucugcaagggaaagggaaaggaagcagggcaguggugggugucugaaa

SEQ ID NO: 37760 - RNA, 60 nt, hsa
aagcuguagcuggagaagcccauggccacgaggaagcagcaauuaauuagaucaacacuu

SEQ ID NO: 37761 - RNA, 60 nt, hsa
cacgagcugacccagcagaauucucuguguaggaagcaucggacuuuguccauugaauau

SEQ ID NO: 37762 - RNA, 60 nt, hsa
aguauuucccauuuaucgcagaccuuuuuuaggaagcaagcuuaauggcugauaauuuua

SEQ ID NO: 37763 - RNA, 60 nt, hsa
cuauguuguaaaugaucaacuacaauauucaggaagcacauuuauucagauucucaguaa

SEQ ID NO: 37764 - RNA, 60 nt, hsa
ggagcugguucacuguaacuagcaggccacaggaagcaaagccuuggugccugugagcuc

SEQ ID NO: 37765 - RNA, 60 nt, hsa
caaaguucauugguucaguggugugaagaaaggaagcacaauuggcagguuaucacuuuc

SEQ ID NO: 37766 - RNA, 54 nt, hsa
ucgaccgcuucgauaauuaaaccaaggaagcaaucuguaacugcuuuucggaac

SEQ ID NO: 37767 - RNA, 60 nt, hsa
uuagaacuaccaucuucauauacaggagaaaggaagcauuuaaauuuuuauagugauuau

SEQ ID NO: 37768 - RNA, 60 nt, hsa
ucugugccagauugcccggucugacccugcaggaagcaaagaggugagcuuaaagaacaa

SEQ ID NO: 37769 - RNA, 60 nt, hsa
augaccugugguaagcaaccugggcaucuuaggaagcagucccuggagaaggcauguucc

SEQ ID NO: 37770 - RNA, 60 nt, hsa
uuaccuccugaccugaggguggagaguggcaggaagcaagcauguuugcugugcacuuag

SEQ ID NO: 37771 - RNA, 60 nt, hsa
gucagacuccuagagggccuccagacuaauaggaagcauuucuguaaccaaccugccacc

SEQ ID NO: 37772 - RNA, 60 nt, hsa
uugauuugcauucuggaaagcucucccaggaggaagcauuccccaccccaccuugccucu

SEQ ID NO: 37773 - RNA, 60 nt, hsa
uuuggggaaggaggccguaggccggcccggaggaagcaauuccacuugguuugacaacuu

SEQ ID NO: 37774 - RNA, 60 nt, hsa
gagcuggagcugguuggacuaaugagacugaggaagcagcuuuuccuacgaucugcauua

SEQ ID NO: 37775 - RNA, 60 nt, hsa
uuccuggccaugacagugugauucccccagaggaagcagaaggaaguuaaagguugucuu

SEQ ID NO: 37776 - RNA, 60 nt, hsa
ucuuauacuagugggacaaaagggagaaaaaggaagcaagauaaauggguauguaggaug

SEQ ID NO: 37777 - RNA, 60 nt, hsa
cagagcccuuuccgcauguggaagagugggaggaagcagagggagggacugggcagggac

SEQ ID NO: 37778 - RNA, 60 nt, hsa
auuucucaaugcuaacuaaucaagagaaguaggaagcauaucaaacguuuaacuuuauuu

SEQ ID NO: 37779 - RNA, 60 nt, hsa
aaaaugugaaagacugggugcuagacaagaaggaagcagguaaagggauaguugcuuugu

SEQ ID NO: 37780 - RNA, 60 nt, hsa
agaaauuggugggaaaauagguagaaaccaaggaagcagacacaacaugcauuuauggag

SEQ ID NO: 37781 - RNA, 60 nt, hsa
cuuugggggaccuggaagaaaugucuccaaaggaagcaaggcauguuuuaguugagugcu

SEQ ID NO: 37782 - RNA, 60 nt, hsa
agcucacuguuuuuccuugaguucuccuacaggaagcagaugagaacugcccagucuuca

SEQ ID NO: 37783 - RNA, 60 nt, hsa
caccaaggucugaaaaaugacuuccaggaaaggaagcaugguauauaacaggaaaagaaa

SEQ ID NO: 37784 - RNA, 60 nt, hsa
aauuagaguuauuagagcaagagagagcuuaggaagcaugagggcaacuauagugaggcc

SEQ ID NO: 37785 - RNA, 60 nt, hsa
uuagugguguggcacugggagcugcuccuaaggaagcagggagcaaaucccaccuuuacc

SEQ ID NO: 37786 - RNA, 60 nt, hsa
cacaaacucucaauaucuaaaauaagugcaaggaagcagucucuuuggucaguaacaagu

SEQ ID NO: 37787 - RNA, 60 nt, hsa
gaccuuggcauguggcuggccacaccaagcaggaagcacaaacucccccaagcugacuca

SEQ ID NO: 37788 - RNA, 60 nt, hsa
aaacuuauaaauauuucuccagcaaauuugaggaagcaugauauauuugaauuaacacca

SEQ ID NO: 37789 - RNA, 60 nt, hsa
uuccucaguaaccuccaucuaaaaucuccaaggaagcaauaaauuccuuuuaugagaucu

SEQ ID NO: 37790 - RNA, 60 nt, hsa
cugugcuguugguucccaaaacuagaaagaaggaagcagggagcggugccccaagcaugg

SEQ ID NO: 37791 - RNA, 60 nt, hsa
cuguggggcugggcaccguguccuccucugaggaagcaguuggggcccucuugccagccu

SEQ ID NO: 37792 - RNA, 60 nt, hsa
accuaggggacugccucugugccucuccccaggaagcauccagggcagaggaagccacau

SEQ ID NO: 37793 - RNA, 60 nt, hsa
uuuggagcuagaguugcuuccuggugagagaggaagcaacucuccuucugguugucugcc

SEQ ID NO: 37794 - RNA, 60 nt, hsa
ucccuaccuugcaugguaauauaaaggacuaggaagcagucauacuuccaggaaaugcuu

SEQ ID NO: 37795 - RNA, 60 nt, hsa
uaauaaucuuuugcuugguuauacuaggcuaggaagcaauaucaaagcccuuaaauucuc

SEQ ID NO: 37796 - RNA, 60 nt, hsa
aaagccgcuuccugucauuaagcaucucagaggaagcagcccucccucgauggccucuag

SEQ ID NO: 37797 - RNA, 60 nt, hsa
ggagaacaagccucaacuaacaaacccuucaggaagcauauaccggggaauguguagccu

SEQ ID NO: 37798 - RNA, 60 nt, hsa
acuaucucagugguauuuugcauuggaaaaaggaagcacuguguagcagugaauugucug

SEQ ID NO: 37799 - RNA, 60 nt, hsa
cagaacaaccacuacagccccucugucagcaggaagcaguuaaagaagacugaccuucgu

SEQ ID NO: 37800 - RNA, 60 nt, hsa
gccaccuuuugauugauugggcuuccucauaggaagcacugagggugugucuuuguacuu

SEQ ID NO: 37801 - RNA, 60 nt, hsa
uaaaacgagaacucuuauauuggcuuuuuaaggaagcagucuuaacaaaggcucuuuuca

SEQ ID NO: 37802 - RNA, 60 nt, hsa
ggaaagggagaggggaagggcaggggacucaggaagcaggggguccccauccccagcugg

SEQ ID NO: 37803 - RNA, 60 nt, hsa
guauaauaaucaagaaauuaguuuauuaaaaggaagcagaagcauugaccauuuuuuccc

SEQ ID NO: 37804 - RNA, 60 nt, hsa
gcauccacugcgggugacuggaggccgggcaggaagcaagucaucagagccgcucagcuc

SEQ ID NO: 37805 - RNA, 60 nt, hsa
uguugggucagccugaaacugccaaccaguaggaagcauggacucuccugagugagaaga

SEQ ID NO: 37806 - RNA, 60 nt, hsa
cuguuuguucaggcagagagcuauauuuggaggaagcauuacagaacgaaagagaucuuu

SEQ ID NO: 37807 - RNA, 60 nt, hsa
aguagaagauaaacuuuuuauucauaaaccaggaagcaauguucuuuauagugauucucu

SEQ ID NO: 37808 - RNA, 60 nt, hsa
uuaucgaggcacauacuucaccaccgucacaggaagcacuugccaagcuuggucaucuau

SEQ ID NO: 37809 - RNA, 60 nt, hsa
uuuuuaaacggcuuuuuguaacuucgcugcaggaagcagguuuguuucuuuuucuuuucu

SEQ ID NO: 37810 - RNA, 60 nt, hsa
gacacaucugugucaucacgcacugaagacaggaagcaguucacugagucagcugguucc

SEQ ID NO: 37811 - RNA, 60 nt, hsa
guggcagcccuggggcccuuucccuucuggaggaagcacaagccucagggaaggggaagc

SEQ ID NO: 37812 - RNA, 60 nt, hsa
uguacaauaucuaaaaagaaagugacaugaaggaagcaaucuacaacuuccuuccgcuua

SEQ ID NO: 37813 - RNA, 60 nt, hsa
ugucacagggccaacuugagggcccagagcaggaagcauucagagagcagcuuuaaacuc

SEQ ID NO: 37814 - RNA, 60 nt, hsa
gccaagaggcugaucaagcgucauuuauugaggaagcaucuuagaaaaugccucugaaug

SEQ ID NO: 37815 - RNA, 60 nt, hsa
uauuuugauauguaucuauucaugauugaaaggaagcagucuuggccaggcacgguggcu

SEQ ID NO: 37816 - RNA, 60 nt, hsa
gugaaagggaaguaggaccagagaaguggaaggaagcaaaauggaggugaugagaaaggu

SEQ ID NO: 37817 - RNA, 60 nt, hsa
ccgugaaugccagacuuuaagauugcccggaggaagcaaacucuucguauaaaaaaagca

SEQ ID NO: 37818 - RNA, 60 nt, hsa
uuauaacauuuggauauuacugaaaauguaaggaagcaggaaaaauuaacuacuuucauu

SEQ ID NO: 37819 - RNA, 60 nt, hsa
guucagcacacuccugggcauggcggaagcaggaagcagacuccagagggccucccuguu

SEQ ID NO: 37820 - RNA, 60 nt, hsa
aaacucaaugaaaugacaugccuuuuuagcaggaagcaaaguugguuucuguuuuuuguu

SEQ ID NO: 37821 - RNA, 60 nt, hsa
acucacuaaguauggaaaacugauucugggaggaagcagaaaugucccuagauaacagca

SEQ ID NO: 37822 - RNA, 60 nt, hsa
uaauacaagcaacauuaacaucuucagaaaaggaagcaggcaugguccuggaaaauuggg

SEQ ID NO: 37823 - RNA, 60 nt, hsa
gcauuuauccaaauucugcucacagacaugaggaagcaggcuguagauuuaagggcacuc

SEQ ID NO: 37824 - RNA, 60 nt, hsa
auauaagacguauacggcaccuucuugaaaaggaagcauuugaacuuguuccucccuaua

SEQ ID NO: 37825 - RNA, 60 nt, hsa
aggucuucaguugagcucucagccuuaggaaggaagcacguggaggagggacggaggagg

SEQ ID NO: 37826 - RNA, 60 nt, hsa
augagugggggccaccaggcucagcgcaagaggaagcagagggaauucacaggacccccu

SEQ ID NO: 37827 - RNA, 60 nt, hsa
ccaagcagauagcucccucugaggaaccaaaggaagcaaguuuccacgauuucugaagag

SEQ ID NO: 37828 - RNA, 60 nt, hsa
ucuccguggaggacccugggcccucaccgcaggaagcaguuuggguuuugaaagguuauu

SEQ ID NO: 37829 - RNA, 60 nt, hsa
cagcccccuguauucucaugauuuucucucaggaagcacacacugugaauggcagacuuu

SEQ ID NO: 37830 - RNA, 60 nt, hsa
ccugacuaacuuggcauuugcaggucaagcaggaagcaguugacaagacacauccucagu

SEQ ID NO: 37831 - RNA, 60 nt, hsa
agccugaugacuugccccaagggccacccgaggaagcaguauuaucugcgguggggggag

SEQ ID NO: 37832 - RNA, 60 nt, hsa
aaggaggcagggaagaaagggggccugcaaaggaagcaguagagugacuuaaacaucuug

SEQ ID NO: 37833 - RNA, 60 nt, hsa
uaauuaaucgaaaugaauuuaucugaauauaggaagcauaugccuacuuguaauuucuaa

SEQ ID NO: 37834 - RNA, 60 nt, hsa
cuauuuucuaaauuuauuuaaaugcuuagcaggaagcauaaggaaaagccaucggccucc

SEQ ID NO: 37835 - RNA, 60 nt, hsa
gcaugggacagguuccccacaagccuuagaaggaagcauggcccugacuucagaauucca

SEQ ID NO: 37836 - RNA, 60 nt, hsa
uuuacccucagauuuggagaugguaaccaaaggaagcagcugggacagguggagaaggaa

SEQ ID NO: 37837 - RNA, 60 nt, hsa
uuugugauguuaauacaggcuucuuguuuuaggaagcaucaccuauacucugaagccuuu

SEQ ID NO: 37838 - RNA, 60 nt, hsa
ucccauuucucucuuguuugagagagaaugaggaagcaaagagugagaaagaauaggggc

SEQ ID NO: 37839 - RNA, 60 nt, hsa
auaaucuucuaaaggcuauacaauugaaugaggaagcacuaacaaaagcaguaguucagu

SEQ ID NO: 37840 - RNA, 60 nt, hsa
uaaguauuauaccucaugaauucccguccaaggaagcagaguuguuaaagaguacuggaa

SEQ ID NO: 37841 - RNA, 60 nt, hsa
augugcuuuguaaaaagauuucaaguuauuaggaagcauacucuguuuuuuaaucaugua

SEQ ID NO: 37842 - RNA, 60 nt, hsa
cuagugauuuugcuauaaaauuauuuuugaaggaagcagacacagcaguauuuaccugua

SEQ ID NO: 37843 - RNA, 60 nt, hsa
cguuuuugccugguguuuuggcagcaaagcaggaagcaauuuugugugggucauuguucu

SEQ ID NO: 37844 - RNA, 60 nt, hsa
agcgguguuacaggugaggaguguaauccuaggaagcaucaggugaaaagcaggagacca

SEQ ID NO: 37845 - RNA, 60 nt, hsa
uaggcugagacaggagaauugcuugaacccaggaagcagagguugcaaugagcugagauu

SEQ ID NO: 37846 - RNA, 60 nt, hsa
ggggcagaaugggccugcagcuuccugcagaggaagcaggacuggguagcagagccggga

SEQ ID NO: 37847 - RNA, 60 nt, hsa
cucccaaacaggaaacccuggugaagguucaggaagcacggagauucucuccaacaaagg

SEQ ID NO: 37848 - RNA, 60 nt, hsa
uugugauucagcaccugcugucugagcgggaggaagcacugaaacaacacaaaacccuau

SEQ ID NO: 37849 - RNA, 60 nt, hsa
aucuuugaaaaguccugcgcugcggaggacaggaagcacccccucaauagccagcaccca

SEQ ID NO: 37850 - RNA, 60 nt, hsa
cccuauuugaaauguguuauaauacaaacaaggaagcacauuguguacaaaauacuuaug

SEQ ID NO: 37851 - RNA, 60 nt, hsa
gagcgucuggaaacucucugcucugacccgaggaagcacccuccugacgccgccuuccuc

SEQ ID NO: 37852 - RNA, 60 nt, hsa
gugcagcucucuaaaugggaauucucagguaggaagcaacagcuucagaaagagcucaaa

SEQ ID NO: 37853 - RNA, 60 nt, hsa
acauggaaaaagaggacuuucuugcacauuaggaagcagaauauccuccaguguagcaca

SEQ ID NO: 37854 - RNA, 60 nt, hsa
ccaaaggcgggguggcgguggaccaaaggaaggaagcaagcaucuccgcaucgcauccuc

SEQ ID NO: 37855 - RNA, 60 nt, hsa
ggccacuccccagugcucccgugcagggagaggaagcacccaguuugagaguguacccag

SEQ ID NO: 37856 - RNA, 60 nt, hsa
gcccuucuuuuuaggaaacccuaaaggagaaggaagcagaauauaacccucuggagagcu

SEQ ID NO: 37857 - RNA, 60 nt, hsa
cuuacugcuuaauguauaaacucucaccacaggaagcaucgcuguuuccaauaaauauug

SEQ ID NO: 37858 - RNA, 60 nt, hsa
ugcgcucauucuuauuacaggagugagcaaaggaagcauuuaccccgaugguuaccuaga

SEQ ID NO: 37859 - RNA, 60 nt, hsa
gucaccuuacugguuuucccuuguucaggaaggaagcagcuguuuccuugccaacagguc

SEQ ID NO: 37860 - RNA, 60 nt, hsa
guguaauuuuaggaauuaugcugguucaucaggaagcagagggggaguuuuaaaagucaa

SEQ ID NO: 37861 - RNA, 60 nt, hsa
cuguacuugaagucuaaaagcagaaaauaaaggaagcaaguuuucuuccaugauuuuaaa

SEQ ID NO: 37862 - RNA, 60 nt, hsa
gguuguaaaauagacuccauggagacucuuaggaagcaguagauucccgggggcugugcc

SEQ ID NO: 37863 - RNA, 60 nt, hsa
uaggagcauuuaaucuguauuuuacaaguuaggaagcagaggaucagagaugggaaagga

SEQ ID NO: 37864 - RNA, 60 nt, hsa
gugcuaccaaaggggauacacaagcccuuuaggaagcaguaccucucgccuggaggaucu

SEQ ID NO: 37865 - RNA, 60 nt, hsa
gugcgugguauaaucuccauuucaaaaccaaggaagcagccucagaguggucgagugaca

SEQ ID NO: 37866 - RNA, 60 nt, hsa
gaucaguguuaagcauuuuccuccaugggaaggaagcaugggauauagaaaagcgaaggg

SEQ ID NO: 37867 - RNA, 60 nt, hsa
accuaaggaugaaagcaaaggagggccuugaggaagcagcccccaggccuggcagccacg

SEQ ID NO: 37868 - RNA, 60 nt, hsa
aaaagucccaaaagcagcagaaggugaagcaggaagcacuugguuuucuccuuccugaua

SEQ ID NO: 37869 - RNA, 60 nt, hsa
agucaguaucgagccugaccaccgcaagccaggaagcaggugaagugcccagcgcuggag

SEQ ID NO: 37870 - RNA, 60 nt, hsa
gauguuguuuccuuacuacugccucaccucaggaagcacauaaugucuacuugucucuuu

SEQ ID NO: 37871 - RNA, 60 nt, hsa
ccuuccauuccucagcugaaagaacaucucaggaagcacuggacacagugauucugcaga

SEQ ID NO: 37872 - RNA, 60 nt, hsa
agcugggcuuggccagggagucugggaacaaggaagcagauuuuccugauucuggcucua

SEQ ID NO: 37873 - RNA, 60 nt, hsa
ucuagcccaccuccaucaauucccuaugugaggaagcaaaaccccagggaagccaaaggg

SEQ ID NO: 37874 - RNA, 60 nt, hsa
aagcuagcugcaguguucaggacguccgggaggaagcaagcaugugggggacagaacagu

SEQ ID NO: 37875 - RNA, 60 nt, hsa
gaaaguguuucuuggguuuggaauguucagaggaagcaguauuguacagaacacgguauu

SEQ ID NO: 37876 - RNA, 60 nt, hsa
auaagggacgcuaccuugcuuuucuggcacaggaagcacaugauaaagcaugcucagaug

SEQ ID NO: 37877 - RNA, 60 nt, hsa
cacuggcaaaugccugaauggucugucugaaggaagcaacagagaaguggggaauccagu

SEQ ID NO: 37878 - RNA, 60 nt, hsa
aggaaggaagcucugaggaugguugcagugaggaagcaugggucuuuaaggacuucucuc

SEQ ID NO: 37879 - RNA, 60 nt, hsa
ccccagcuuucuccaggcuggggugggagaaggaagcaggacagagcugcaagugccugg

SEQ ID NO: 37880 - RNA, 60 nt, hsa
ggccgccaccgcucuggaccacaggcggggaggaagcaugcucaagcagcccagcgggcg

SEQ ID NO: 37881 - RNA, 60 nt, hsa
cgggcuaacgggaggcugggcacagaggucaggaagcagggguggggggugcaggugggc

SEQ ID NO: 37882 - RNA, 60 nt, hsa
aaguuguuaauuaucucuaaaauuggaauuaggaagcauaucaccaauacugauuaacau

SEQ ID NO: 37883 - RNA, 60 nt, hsa
cacucuccuccaaaagagccuccaucuguaaggaagcaggucuccgcgagggguuucuuu

SEQ ID NO: 37884 - RNA, 60 nt, hsa
aucuuaccugucucuucuccaugagggagaaggaagcagcuagcuaugucccuagcugca

SEQ ID NO: 37885 - RNA, 60 nt, hsa
uuccuauuuucuaauauaaaacucuuuuccaggaagcaugcuuaagcaucuuguuacaga

SEQ ID NO: 37886 - RNA, 60 nt, hsa
acauauauacagauuguuggcauuugcaaaaggaagcaucaauaguggacccagaggcag

SEQ ID NO: 37887 - RNA, 60 nt, hsa
aaaggcaguuaugaagccaauucauuuugaaggaagcacaauuuccaccuuauuuuuuga

SEQ ID NO: 37888 - RNA, 60 nt, hsa
aauuucacacaguaaauuuugaaucucauaaggaagcauauuugaaccuagucaauuuaa

SEQ ID NO: 37889 - RNA, 60 nt, hsa
uuuuuuuuuucuuugaagacuuucuaaauuaggaagcagaaaaacaaaucucuaggagau

SEQ ID NO: 37890 - RNA, 60 nt, hsa
aaaccaaacucagugaaguacucaucuugcaggaagcaaaccuccuuguuuacaucuuca

SEQ ID NO: 37891 - RNA, 60 nt, hsa
gccugaggcggaugcagcccgcgacgccagaggaagcacgugcacuaacuggguuuaaau

SEQ ID NO: 37892 - RNA, 60 nt, hsa
cacucagagaggguccaagggugauggagaaggaagcauggccugggagcuuggaaggga

SEQ ID NO: 37893 - RNA, 60 nt, hsa
uaagcacaccaacagaacugaguuccagaaaggaagcaguuucuggugcuuugcauaugu

SEQ ID NO: 37894 - RNA, 60 nt, hsa
gaaaaccauggagauuauuuuuauuggaggaggaagcaucauucaugaaccgaucuuuuu

SEQ ID NO: 37895 - RNA, 60 nt, hsa
uacaaaugaaacuuaugcaggaugugugagaggaagcaguuaauuguuucugaauaucuc

SEQ ID NO: 37896 - RNA, 60 nt, hsa
cuccggagguaucuguucuguugaccuguaaggaagcagucgauccuagagugucagaac

SEQ ID NO: 37897 - RNA, 60 nt, hsa
gcaguuauauucugcaucaagccuuagaagaggaagcaaaggcagauucagggaccaaaa

SEQ ID NO: 37898 - RNA, 60 nt, hsa
ccuguuuagacuuugguggaagaugaaucaaggaagcagggcccugucuuaugggucacg

SEQ ID NO: 37899 - RNA, 60 nt, hsa
guaagcgguauuagccucacuuaacagaugaggaagcaagauuccagaaaguaccagaag

SEQ ID NO: 37900 - RNA, 60 nt, hsa
gaucuaagaaggcuauaggccuuuguuuguaggaagcagugucauuacauucaagcuuca

SEQ ID NO: 37901 - RNA, 60 nt, hsa
cugggaaggccgcaagaggcauagagggagaggaagcacacugcagggcugcuguggccc

SEQ ID NO: 37902 - RNA, 60 nt, hsa
ugugccuuaaaaaucaagacacuaguucagaggaagcacauaauguccagaucuauggcg

SEQ ID NO: 37903 - RNA, 60 nt, hsa
uuacccauggaacaauaugcuuaggauuacaggaagcaguccuuacuuacacuucuuguc

SEQ ID NO: 37904 - RNA, 60 nt, hsa
gguacuaaauccuuauuggaaccaagacaaaggaagcaaaauuggucucuuuagagacca

SEQ ID NO: 37905 - RNA, 60 nt, hsa
ggcuaaaucaacacucuaaucaguauagugaggaagcagcaggugaucugccuuacuuca

SEQ ID NO: 37906 - RNA, 60 nt, hsa
auccugcucacagucaccgcaggugcaggcaggaagcagcccugggggacuggacgcugc

SEQ ID NO: 37907 - RNA, 60 nt, hsa
uuauggaagaaugguuuaugaacuucccauaggaagcaccugagagauaguaaacugcag

SEQ ID NO: 37908 - RNA, 60 nt, hsa
uugaaguacucaggauagugccuggcauguaggaagcaccuggaaaauauucgcugugau

SEQ ID NO: 37909 - RNA, 60 nt, hsa
acagauguccucuuaagaaaaugaugcaucaggaagcaacgugauggaggacuuggggga

SEQ ID NO: 37910 - RNA, 60 nt, hsa
cuucagggugggggggaaggggacaugggcaggaagcaccgagggaguugggcccuagcu

SEQ ID NO: 37911 - RNA, 60 nt, hsa
cuacucuccucggcccccuccaucgggcugaggaagcacagcagcaucuucaaacaugua

SEQ ID NO: 37912 - RNA, 60 nt, hsa
ugauaacacuggagugguaacaagaggagcaggaagcaaggccagcccugguucuccauc

SEQ ID NO: 37913 - RNA, 60 nt, hsa
uccgagggccaguuucaggucuggaaggggaggaagcaggggaaggugaccugaggaggc

SEQ ID NO: 37914 - RNA, 60 nt, hsa
gcccuuacccaccuuccugugagugaagagaggaagcagccccagggaccaauuuuccca

SEQ ID NO: 37915 - RNA, 60 nt, hsa
cggagcuggguuggccccuucuuugggcucaggaagcagccuuagcacacgggccucucc

SEQ ID NO: 37916 - RNA, 60 nt, hsa
uucagcuccguaagguggcggcaccugaggaggaagcagccaggaguggcuggggaagaa

SEQ ID NO: 37917 - RNA, 60 nt, hsa
acagagggcuagagaaagcaucuucugcagaggaagcacuuaugggaacagucugugaga

SEQ ID NO: 37918 - RNA, 60 nt, hsa
uuacugcaagagaauggaagucuuaauagaaggaagcaggagugauuaguucggguuaaa

SEQ ID NO: 37919 - RNA, 60 nt, hsa
uuucuguggugagggagaaccucuccaaagaggaagcaggcauaugagugcgcacgccuu

SEQ ID NO: 37920 - RNA, 60 nt, hsa
aagaugagaaaguccucaagugaggggaggaggaagcagauagaugguccagcaggcuug

SEQ ID NO: 37921 - RNA, 60 nt, hsa
aucugagcagcagcauccaggcugaccucaaggaagcauagccacaaaacagaauagcac

SEQ ID NO: 37922 - RNA, 60 nt, hsa
gcuaaaauaauggcuucacucuuauauuugaggaagcaacugaacaggagucaaugauuu

SEQ ID NO: 37923 - RNA, 60 nt, hsa
uaaaaccugaugggacaauaacgccuuuggaggaagcacucaaccaguacucugucaucg

SEQ ID NO: 37924 - RNA, 60 nt, hsa
auuauauuuuauagaauuuguuugaaauugaggaagcaguuaaauugugcgcuguauuuu

SEQ ID NO: 37925 - RNA, 60 nt, hsa
uguuaaacaaaugauuuccacaaacagaucaggaagcacuagguuggcagagacacuuug

SEQ ID NO: 37926 - RNA, 60 nt, hsa
cuaggaacaccuuauaaguugaauaaauuaaggaagcauuuucccauugaaaguguguuc

SEQ ID NO: 37927 - RNA, 60 nt, hsa
cccacccggcaagcccgccccaucccagacaggaagcagagucccacagaccgcuccucc

SEQ ID NO: 37928 - RNA, 60 nt, hsa
aggugcaguugccccaaccucagacuuaccaggaagcagauacauaugaguguggaagcc

SEQ ID NO: 37929 - RNA, 60 nt, hsa
aggugcaguucccccaaccucagacuuaccaggaagcagauacauaugaguguggaagcc

SEQ ID NO: 37930 - RNA, 60 nt, hsa
cguuuccccaaaacaauguccccugucagcaggaagcaguuaaaucugucuucauccuua

SEQ ID NO: 37931 - RNA, 60 nt, hsa
uuuucccaaacugaucuuuucauuuaggugaggaagcaaaagcaucuaugugagaccauu

SEQ ID NO: 37932 - RNA, 60 nt, hsa
cuaauauacauaauuccauuaagugguugaaggaagcaaauaauggaauugucaauuggu

SEQ ID NO: 37933 - RNA, 60 nt, hsa
aaacagaaccuuuucuuaauccauguuggaaggaagcaacagugaacucuaccuguucug

SEQ ID NO: 37934 - RNA, 60 nt, hsa
aucacuguccugauucugaaccucuguuucaggaagcauucuccccuguguaaacaacuc

SEQ ID NO: 37935 - RNA, 60 nt, hsa
uaagguguugaaagagugcaggggguugggaggaagcauguaagagagggaacauuuccu

SEQ ID NO: 37936 - RNA, 60 nt, hsa
gugguauugaccggcacucaguggguggagaggaagcauauguggaaggagcauuuccuu

SEQ ID NO: 37937 - RNA, 60 nt, hsa
gcaaccuguggccugcacuuguggccucgaaggaagcacaaacccuccauccacuuccca

SEQ ID NO: 37938 - RNA, 60 nt, hsa
uuuauaucaagaauaaggaaauauaaacagaggaagcagcuuguuucuaaacaaauagug

SEQ ID NO: 37939 - RNA, 60 nt, hsa
aaacaugaauccugugauauugggcucuucaggaagcauaaagcaauugugaaauacagu

SEQ ID NO: 37940 - RNA, 60 nt, hsa
guaaguaucaaccauuucuugaucaagauaaggaagcaacacugauacugagagagaggu

SEQ ID NO: 37941 - RNA, 60 nt, hsa
cucuccagcucugcaguuuucacuguauucaggaagcauaaaguaguaugaaagguuuga

SEQ ID NO: 37942 - RNA, 60 nt, hsa
uugcugcuaagucagaucagauuugcuaacaggaagcauucuuuacaugacaguaucuug

SEQ ID NO: 37943 - RNA, 60 nt, hsa
uuuaaauauaaaugauauguugaaaacuuaaggaagcaaaugcuacauauaugcaauaua

SEQ ID NO: 37944 - RNA, 60 nt, hsa
ucaugaaacacuagaauguacccucagagcaggaagcacaccugugccauuucugggacu

SEQ ID NO: 37945 - RNA, 60 nt, hsa
gaaauuuuucauucccauaucuaccuaagaaggaagcaguaaauccauaauuuaccuuuu

SEQ ID NO: 37946 - RNA, 60 nt, hsa
cccguaugguauuuuguuagauuguucaacaggaagcacaugauugagaacaucuuggga

SEQ ID NO: 37947 - RNA, 60 nt, hsa
ucuuacuuauaaaguaggaaaagagaaccgaggaagcacgugaaacuuacuaauucuauu

SEQ ID NO: 37948 - RNA, 60 nt, hsa
cucaggcagcagaaguugcaggaagaacaaaggaagcaggaaaaugcucuuaaacccaaa

SEQ ID NO: 37949 - RNA, 60 nt, hsa
cacacaaaaugcccaaggcacucacuggggaggaagcaaggaagcaaacagucugagaaa

SEQ ID NO: 37950 - RNA, 60 nt, hsa
augcccaaggcacucacuggggaggaagcaaggaagcaaacagucugagaaaaugaugca

SEQ ID NO: 37951 - RNA, 60 nt, hsa
uggugugguuggugaacagugcaugccaggaggaagcagucccuccucaccagcucucca

SEQ ID NO: 37952 - RNA, 60 nt, hsa
ccgucacaugucucaaggguccagcguucgaggaagcacuguuguagaugacagagcuuu

SEQ ID NO: 37953 - RNA, 60 nt, hsa
ggcacacacgccuucaugccagugcaugccaggaagcacguucacuagacuaaaacacgg

SEQ ID NO: 37954 - RNA, 60 nt, hsa
caggcagacacaugcuguuggccucaagcaaggaagcagagcacuguguaaccagcaguc

SEQ ID NO: 37955 - RNA, 60 nt, hsa
ugacuucaagaugccucuucuaccucuuccaggaagcacaggccaggggaucugggugug

SEQ ID NO: 37956 - RNA, 60 nt, hsa
ggucucucuucuauccccagaaacuuucagaggaagcagcucauagaaacauacaaaagc

SEQ ID NO: 37957 - RNA, 60 nt, hsa
agggauauuccccaaccuguccuuccugacaggaagcauagggcacugcagauggggaag

SEQ ID NO: 37958 - RNA, 60 nt, hsa
ggagggauguuccaguggaugagggccaccaggaagcacagguccaaggcuggucccaca

SEQ ID NO: 37959 - RNA, 60 nt, hsa
aaagacucaaugagcuguuauguuguaaacaggaagcauuucacauccaaacgagaaaau

SEQ ID NO: 37960 - RNA, 60 nt, hsa
augcuggagccuguguaacagcuccuugggaggaagcagaauaaagcaauuuuccuugaa

SEQ ID NO: 37961 - RNA, 54 nt, hsa
aaaccaugaaacgcuacuaacuacaggaagcaaacuaagcccccgcuguaauga

SEQ ID NO: 37962 - RNA, 60 nt, hsa
auuuguauauuuuuaaauagcgauuuguauaggaagcaaguuauuuuuuuaaaaaauaga

SEQ ID NO: 37963 - RNA, 60 nt, hsa
acacuguuuggcuucacuaauuuagaagucaggaagcaauagaaaguuggagaugaggaa

SEQ ID NO: 37964 - RNA, 60 nt, hsa
gcuuaccaagcauauuaggaaauaccucuuaggaagcauuagcggucucaggccaauuac

SEQ ID NO: 37965 - RNA, 60 nt, hsa
aagcacauuuacugaaauguaaaacacaacaggaagcaaagcaaucucccuuuguuuuuc

SEQ ID NO: 37966 - RNA, 60 nt, hsa
guggucaccucccagaagaggcacggcacaaggaagcauugaauuccuaaagcugcuuag

SEQ ID NO: 37967 - RNA, 60 nt, hsa
cauccuaucgccacaaugccaugucgcaauaggaagcaggggccggccaucgcuaccuuc

SEQ ID NO: 37968 - RNA, 60 nt, hsa
agugcauuuuuguaaauguguacauauuaaaggaagcacucuguauauuugauugaauaa

SEQ ID NO: 37969 - RNA, 60 nt, hsa
uaaagggauaggcucauggcccuucacaagaggaagcacacuggguaacaaugaacagug

SEQ ID NO: 37970 - RNA, 60 nt, hsa
cuugccugguaucauugagcccacacauggaggaagcagaacucaucaguucuuggcguu

SEQ ID NO: 37971 - RNA, 60 nt, hsa
uaguguugugugauuuaaaauggacucagcaggaagcauauugucuggggauuguuggga

SEQ ID NO: 37972 - RNA, 60 nt, hsa
augacuggcuuucucuuguggauggacuauaggaagcacuuucugaauuauguaaugauu

SEQ ID NO: 37973 - RNA, 60 nt, hsa
cacuucccaaaccgcagacuacaucuuuagaggaagcacaacugugccuuuuucugaaaa

SEQ ID NO: 37974 - RNA, 60 nt, hsa
ggguuggcaggggcuccaucucaguggaccaggaagcaagaggggaagcgggaucccagc

SEQ ID NO: 37975 - RNA, 60 nt, hsa
cccaucccaucacacaugauccaccguaccaggaagcagaaauauuucuacaaagggggc

SEQ ID NO: 37976 - RNA, 60 nt, hsa
ucuggugcagauucaagcuccuccucuuagaggaagcagcuccuuccucccacaggagcc

SEQ ID NO: 37977 - RNA, 60 nt, hsa
ugggggccuccacccagcagcagaccaaccaggaagcagcuugaacuggauggagacuuu

SEQ ID NO: 37978 - RNA, 60 nt, hsa
gaagaggaacacaaaggaagccacccaggaaggaagcacagagcugggggcucuggaaac

SEQ ID NO: 37979 - RNA, 60 nt, hsa
ggagcuaauggaagugacagucauguucaaaggaagcauuucuagaaaaaaggagauaau

SEQ ID NO: 37980 - RNA, 60 nt, hsa
uaccacgggcuuucguuaucuugacauagaaggaagcaaugccacggcuccaggguuuca

SEQ ID NO: 37981 - RNA, 60 nt, hsa
gcugcucugcugacuaucuuuuaggaauucaggaagcaaaucacauagugacaaguccuu

SEQ ID NO: 37982 - RNA, 60 nt, hsa
uucauuaacuugacagaguacgugucuuaaaggaagcaucaagaauucaauauuugcauu

SEQ ID NO: 37983 - RNA, 60 nt, hsa
cauuuggagaugugaagauacacugcuuuaaggaagcaggguagagcuggaggauaagag

SEQ ID NO: 37984 - RNA, 60 nt, hsa
uccuuccagacccaccagcuggaaaagugaaggaagcauguccacugacaaacgggaaac

SEQ ID NO: 37985 - RNA, 60 nt, hsa
uaccaaauuuucuuagauuuggucaucaucaggaagcauuuguaaaaauaaaaaucucca

SEQ ID NO: 37986 - RNA, 60 nt, hsa
cuggccuuucccgaggccugugagugccucaggaagcagcugggcccucugggaaggcug

SEQ ID NO: 37987 - RNA, 60 nt, hsa
aacaccucagcugggcucuugggagaccuuaggaagcaggagaggcaacaccucuggcua

SEQ ID NO: 37988 - RNA, 60 nt, hsa
ucagcgcagagaaguugagaggacccaugaaggaagcaaggacacggggcaggcaccugg

SEQ ID NO: 37989 - RNA, 60 nt, hsa
gacuucaaggggaaguaugagacuucucugaggaagcagacccuucacaagcaaaaucag

SEQ ID NO: 37990 - RNA, 60 nt, hsa
ugggcuaggaccucaaccccagggauucccaggaagcagaacucuccagaagaaggguuu

SEQ ID NO: 37991 - RNA, 60 nt, hsa
cguccagaucuguguguguagcaugugcugaggaagcacgugcugggcugugccucagac

SEQ ID NO: 37992 - RNA, 60 nt, hsa
augaagaggaguacacagaacacauaauucaggaagcagcuuuccccaugucucgacuca

SEQ ID NO: 37993 - RNA, 60 nt, hsa
uucugggaaccuauggagaaagggaauccaaggaagcagccaaggcugcucgcagcuucc

SEQ ID NO: 37994 - RNA, 60 nt, hsa
uuggccauauauuugcucaauaaagauugaaggaagcauggucauaguugcccuggguuc

SEQ ID NO: 37995 - RNA, 52 nt, hsa
uucguguucauuccccuugaggaggaagcagagcagagugcgagauccugac

SEQ ID NO: 37996 - RNA, 60 nt, hsa
ggguggcaauaccucuuaggaacuuagggcaggaagcaauacuucagcauugaaugugug

SEQ ID NO: 37997 - RNA, 60 nt, hsa
uaaucaucucuauugcuuggugucauuuauaggaagcacugccaguuaaagagcauuaga

SEQ ID NO: 37998 - RNA, 60 nt, hsa
acccaagaugggcaucuuuuguauuaagaaaggaagcauuguaaaauaauucugaguuuu

SEQ ID NO: 37999 - RNA, 60 nt, hsa
gcccgucagacauaagcucucacagcgcuaaggaagcaggcccaggcuggcaggcaucuc

SEQ ID NO: 38000 - RNA, 60 nt, hsa
gcagggauugucagcccaccugaggcugggaggaagcaggaccaggccuaggaucucccc

SEQ ID NO: 38001 - RNA, 60 nt, hsa
aaaauccaaaaaguuuuuuuaaaaaagcaaaggaagcauacuugugaacuaccuugcuag

SEQ ID NO: 38002 - RNA, 60 nt, hsa
aacaauaaaggagaaugguaccgaugcaggaggaagcaagcgugucuuccccugcagcac

SEQ ID NO: 38003 - RNA, 60 nt, hsa
caaaaaaagcagaacccacuggaguagaaaaggaagcauguagcauauacucaguaguga

SEQ ID NO: 38004 - RNA, 60 nt, hsa
ccuugucuauggagccccgccuugugagccaggaagcagcgucucaucaggacagaaggu

SEQ ID NO: 38005 - RNA, 60 nt, hsa
cuacaucagacucuagaaaaaagggcugagaggaagcaagacguaaagaauuuucauccc

SEQ ID NO: 38006 - RNA, 60 nt, hsa
ugcagaaucaaucugagggaggggauaaagaggaagcaauaaaaaaaaaacauccgacag

SEQ ID NO: 38007 - RNA, 60 nt, hsa
cgcagaccugcagcgggcaaagagcucccgaggaagcacagcuugggucagguucuugcc

SEQ ID NO: 38008 - RNA, 60 nt, hsa
uaugaagauauucagauacucuucuaugccaggaagcacaaagacuuuguugagauuugc

SEQ ID NO: 38009 - RNA, 60 nt, hsa
gggucacugucccuuccagcugccccagacaggaagcagagucaccacgcagcagugucc

SEQ ID NO: 38010 - RNA, 60 nt, hsa
gcagggaagggggaagaaaacccucccauuaggaagcaugcuuuugcaguuaaauggcga

SEQ ID NO: 38011 - RNA, 60 nt, hsa
aggccgaggcaggggcugggcagaggggagaggaagcacaagaagugggagugggagagg

SEQ ID NO: 38012 - RNA, 60 nt, hsa
uuccuuuacccuccacacacuucuuccaaaaggaagcacccguugaguccuuuugagggu

SEQ ID NO: 38013 - RNA, 60 nt, hsa
uugagcauggccagacuauucccuaggacaaggaagcagagggaaaugggaggucuaagg

SEQ ID NO: 38014 - RNA, 60 nt, hsa
cuccccucuugcuguguguacuggacacgcaggaagcaugcugucuugcugccucugcaa

SEQ ID NO: 38015 - RNA, 60 nt, hsa
agggaaaauauagaccuaugauaaauaaccaggaagcauugcuuuuggacaaggaaggac

SEQ ID NO: 38016 - RNA, 60 nt, hsa
ccagcagggcugggggcuccggagagcagcaggaagcacucccagccaccagugccuguc

SEQ ID NO: 38017 - RNA, 60 nt, hsa
uuagguuggggcggaccuuuggauauauaaaggaagcaguuuuaguaucagaaaagauuu

SEQ ID NO: 38018 - RNA, 60 nt, hsa
uucaggcugggguagcaggucaguccaggcaggaagcagcaccugccccccgcgccagcc

SEQ ID NO: 38019 - RNA, 60 nt, hsa
agagagccuucuagaaugacagacugugcgaggaagcaggggcagggguuuccagcccgg

SEQ ID NO: 38020 - RNA, 60 nt, hsa
ggucccuguccucugucuuugaggcugguuaggaagcaagaguccugaucuuucaugcug

SEQ ID NO: 38021 - RNA, 60 nt, hsa
gccgggaagccgaagaguccacaggcccagaggaagcagaagcccccgaguccuuuccgg

SEQ ID NO: 38022 - RNA, 60 nt, hsa
ccaaagcuccccaccccagccugguggcagaggaagcagguggcaccaacucaccaaagg

SEQ ID NO: 38023 - RNA, 60 nt, hsa
uccauuuucuauuaccuggaaagggccauaaggaagcaggcagggcuuagguagcuuggu

SEQ ID NO: 38024 - RNA, 60 nt, hsa
caagggacaggaagcugauagaaagugaacaggaagcaaacaggaagugagcaaggggcc

SEQ ID NO: 38025 - RNA, 60 nt, hsa
auacaaagguauccauggagguagcaccacaggaagcaggcaucacacuugaggcuuggg

SEQ ID NO: 38026 - RNA, 60 nt, hsa
uuugucuuacucucauuuccguaauagaagaggaagcacauguuaacuugucccguuuau

SEQ ID NO: 38027 - RNA, 60 nt, hsa
gaagccaaggcugggucugacaucccugccaggaagcagguuggacagaaaccacuugcu

SEQ ID NO: 38028 - RNA, 60 nt, hsa
gagaaaaggcaugguuucuuaauugagggaaggaagcagauucggagggguggagauaaa

SEQ ID NO: 38029 - RNA, 60 nt, hsa
gaggugccuucagcuggugggccgagaggcaggaagcagccuuccuuggagcaguucuuc

SEQ ID NO: 38030 - RNA, 60 nt, hsa
gugucauauuuagucagaggccccacccccaggaagcauggauggggaugaaggcacagg

SEQ ID NO: 38031 - RNA, 60 nt, hsa
gugugugugugugucagguuuaauuuggggaggaagcaaaggguuuuguuuuggagguca

SEQ ID NO: 38032 - RNA, 60 nt, hsa
aauaccccaagaccccagagggcaguccuuaggaagcacuuacaccaccugggaaccccu

SEQ ID NO: 38033 - RNA, 60 nt, hsa
cacaaagcaguuuuucccccuaggggugggaggaagcaaaagacucuguaccuauuuugu

SEQ ID NO: 38034 - RNA, 60 nt, hsa
uguuucucaugaaaaguuugauuaaaauucaggaagcagcaaaaccuucaaaacaagaca

SEQ ID NO: 38035 - RNA, 60 nt, hsa
augccacuugggaaugaauuguccuuuucuaggaagcacgggggagugagacaggcuggg

SEQ ID NO: 38036 - RNA, 60 nt, hsa
cugcugcuccccaccccuaccgauggucccaggaagcagggagaguuggggaaggcaaga

SEQ ID NO: 38037 - RNA, 60 nt, hsa
acauguaugaacuuaacauggaaaauguuaaggaagcaaaugguuguaacuuuguaagua

SEQ ID NO: 38038 - RNA, 60 nt, hsa
cagccuuggugcagcaagaacauucaacucaggaagcauuugacucguuguacuucagag

SEQ ID NO: 38039 - RNA, 60 nt, hsa
uggcauguuuuauaauuaacugaauaaagaaggaagcauuauuauauauuauugugggga

SEQ ID NO: 38040 - RNA, 60 nt, hsa
ucaucuucauaagaaugagaaaggcucaaaaggaagcacuuuuagaaaucuucucugacc

SEQ ID NO: 38041 - RNA, 60 nt, hsa
ccuuagugccugcaccucaccacgauauugaggaagcacaggacauccaaggguacucuc

SEQ ID NO: 38042 - RNA, 60 nt, hsa
caccuuuuaucuuaguaggcucaaauguucaggaagcacagggauggaaaccucuuccug

SEQ ID NO: 38043 - RNA, 60 nt, hsa
ccauggucuuguuccucucguuuuggcuuuaggaagcaugucuuuaacagcaccgcucgu

SEQ ID NO: 38044 - RNA, 60 nt, hsa
ugcauaaaccauguccccaggaaauuugaaaggaagcaggugcugaauggaauuuuuuuc

SEQ ID NO: 38045 - RNA, 60 nt, hsa
uuucaauguaguugggguagauuaugauuuaggaagcaaaaguaagaagcagcauuuuau

SEQ ID NO: 38046 - RNA, 60 nt, hsa
auauacagaauguuuuuucuuacuuuuauaaggaagcagcugucuaaaaugcaguggggu

SEQ ID NO: 38047 - RNA, 60 nt, hsa
gaaacucuggaaugaacaguaucacauucuaggaagcaauggcaggugacaucacuauua

SEQ ID NO: 38048 - RNA, 60 nt, hsa
agauggcagaaucuaaaucaaguauuuugaaggaagcacccaucuucacuuggugcugcc

SEQ ID NO: 38049 - RNA, 60 nt, hsa
gauguuguaacucaauagaaguguuuuggaaggaagcauggugugugagacagugucugu

SEQ ID NO: 38050 - RNA, 60 nt, hsa
cuuaagauuuggaauaaagucacagaauuaaggaagcaccucaauuuaguucaaacaaga

SEQ ID NO: 38051 - RNA, 60 nt, hsa
cccauucagccucaaggggaaauccaggguaggaagcagcagcucugcuggacugggcuc

SEQ ID NO: 38052 - RNA, 60 nt, hsa
gaucacagccccccuaccuuuugcccuaggaggaagcaauaaugguguauacccucauuc

SEQ ID NO: 38053 - RNA, 60 nt, hsa
gaggcugacauaggagaauugcuugaauauaggaagcagagguugcagugagccgagguu

SEQ ID NO: 38054 - RNA, 60 nt, hsa
cccugagcaaggcaaccgaucgccaggaccaggaagcaucacccaggagauuuggcgccc

SEQ ID NO: 38055 - RNA, 60 nt, hsa
cccaugucccacccacguccuacggcacucaggaagcacuuggugaggacgagcccucac

SEQ ID NO: 38056 - RNA, 60 nt, hsa
uugccaagucccuuuuuaggcuuuuuaauuaggaagcauuucgaaccugcgcaacagacc

SEQ ID NO: 38057 - RNA, 60 nt, hsa
gaagagaccugcaacugugagaguccagacaggaagcagagaaggcguccuugcggaaag

SEQ ID NO: 38058 - RNA, 60 nt, hsa
ccaccaggccugcccuaaaagagcuccugaaggaagcacuaaacauggaaaggaacaacu

SEQ ID NO: 38059 - RNA, 60 nt, hsa
ugugacucccauggggaggaacagacuggcaggaagcacaccgggguuaacacugguuga

SEQ ID NO: 38060 - RNA, 60 nt, hsa
guccuuaaaagcuuucuccuggccgauaggaggaagcauauaucaaggagguucuuuccc

SEQ ID NO: 38061 - RNA, 60 nt, hsa
caauugacuuaaaaaauacaaauaacauuuaggaagcaaauagauuaaacacaaaaauaa

SEQ ID NO: 38062 - RNA, 60 nt, hsa
aaaaguuuaaaaagcaaaauggggagggggaggaagcagugacuuuuuuuugguaauuau

SEQ ID NO: 38063 - RNA, 60 nt, hsa
gaauaaaugacauggcaccuccuagcaggaaggaagcaggguugaaacccugaaguguua

SEQ ID NO: 38064 - RNA, 60 nt, hsa
agccuggggaaggaaaaagcaggaaacugaaggaagcaggggcugaggaacacuuagagg

SEQ ID NO: 38065 - RNA, 60 nt, hsa
uucuguggcuguagacugaucacagagucaaggaagcaguggcaauucuagauaucugag

SEQ ID NO: 38066 - RNA, 60 nt, hsa
agaacacccacugccuagaggccaucuuaaaggaagcaggggcuggaugccuuucauccc

SEQ ID NO: 38067 - RNA, 60 nt, hsa
gccccaagccacggggcaucccccucucccaggaagcagggagggggccgggagguuuuc

SEQ ID NO: 38068 - RNA, 60 nt, hsa
uguguaucauuuaccuccugaaccugcucaaggaagcagaccucugcuucuccccauuug

SEQ ID NO: 38069 - RNA, 60 nt, hsa
gagauggagguuuuggucuuauugggugugaggaagcaacgugugugugugcgcacgccc

SEQ ID NO: 38070 - RNA, 60 nt, hsa
cccgcggaguggggggcccccuccgccacaaggaagcacaaccagcucgcccucccccua

SEQ ID NO: 38071 - RNA, 60 nt, hsa
caccaaacuggaagcuguuuuugcagccugaggaagcaucaauaaauauuugagaaauga

SEQ ID NO: 38072 - RNA, 60 nt, hsa
gaggcugaggcaagugaaucacuugaacccaggaagcagagguugcagugagcagagauc

SEQ ID NO: 38073 - RNA, 60 nt, hsa
auggggaauaucagagucagcugcugcuugaggaagcagaacacacagcuggaggcuugg

SEQ ID NO: 38074 - RNA, 60 nt, hsa
acuacaggaagaagguggcugagauaagaaaggaagcacagaagucgcaggcagccucuc

SEQ ID NO: 38075 - RNA, 60 nt, hsa
caggaaugaggaguuguugaacccacugcuaggaagcaaggaugcaacaagaugaugcug

SEQ ID NO: 38076 - RNA, 60 nt, hsa
gaguuuauuuucuauugugcaauaucuuaaaggaagcaaccaccuuugggaaaguguauc

SEQ ID NO: 38077 - RNA, 60 nt, hsa
uugaaggaguuaacagacagguggccccccaggaagcagagagcgccagauuuguggugg

SEQ ID NO: 38078 - RNA, 60 nt, hsa
agaugccuuccuuugggcuggcucgagggaaggaagcagaaguucaaggugaucgugcca

SEQ ID NO: 38079 - RNA, 60 nt, hsa
cuaaaugccauauacucacacugaaacaugaggaagcagguagaucccagaacagacaaa

SEQ ID NO: 38080 - RNA, 60 nt, hsa
uuugggguuucagucccagggcuuagccggaggaagcacauuuugaaccugcaacuucag

SEQ ID NO: 38081 - RNA, 60 nt, hsa
agcucaucgcaccaauauugcagacuuggaaggaagcauaagcuucccauuucacaaagg

SEQ ID NO: 38082 - RNA, 60 nt, hsa
gaaucgaaacgacagugcuggaggagacucaggaagcagaggcgucccugccgcugcccu

SEQ ID NO: 38083 - RNA, 60 nt, hsa
gcccuaguuacugcauggggaaagagauccaggaagcaugagugcuggauauuuuacuac

SEQ ID NO: 38084 - RNA, 60 nt, hsa
aguaacucaugguaccuuggccaaguuggaaggaagcaguuuguuaaugaggcacaguaa

SEQ ID NO: 38085 - RNA, 60 nt, hsa
gacccugaagucagagcaggccagccaagcaggaagcacacuguuuacuuuuugcaugaa

SEQ ID NO: 38086 - RNA, 60 nt, hsa
uggcucuuccauugccacugagcaaugcccaggaagcaggcacauugccaaggacugggg

SEQ ID NO: 38087 - RNA, 60 nt, hsa
ggccgggaccagccaggagcugggagccacaggaagcaaaagucagccuuuucuucaagg

SEQ ID NO: 38088 - RNA, 60 nt, hsa
aggcucucgaagcucauaaaauucaacgugaggaagcaagugacaaggacgcccgaagca

SEQ ID NO: 38089 - RNA, 60 nt, hsa
aguuuuucagugaaggaaaaggccugagauaggaagcagugcccucgcuucaugaggugg

SEQ ID NO: 38090 - RNA, 60 nt, hsa
cccacccaggagggagggggcuauagcuacaggaagcaccccaugccaaagcuagggugg

SEQ ID NO: 38091 - RNA, 60 nt, hsa
ucaguauuuucuccacuucauuuuuaagaaaggaagcaacagauagauguugcucuuuca

SEQ ID NO: 38092 - RNA, 60 nt, hsa
caccuaacggccugcccuguuagcuuuccaaggaagcagaagacgggaggggaggcauug

SEQ ID NO: 38093 - RNA, 60 nt, hsa
aaccccuuugugcccccuuuguguuccucaaggaagcaguaccuuugaagagaucucugc

SEQ ID NO: 38094 - RNA, 60 nt, hsa
cucagcugccucaucguggcugggaagggaaggaagcaagccggcagaaauagcuaugga

SEQ ID NO: 38095 - RNA, 60 nt, hsa
acauuuauucagauauggcucuaauguauuaggaagcacuaaauggccuaaaaaagcuac

SEQ ID NO: 38096 - RNA, 60 nt, hsa
cuagggggagccugggugcagcagagacagaggaagcagagccaggugccgagcgcgacc

SEQ ID NO: 38097 - RNA, 60 nt, hsa
uguuuacauauucaaaguggugcacuuugaaggaagcacaugugcaccuuuccuuuacac

SEQ ID NO: 38098 - RNA, 60 nt, hsa
uaauugucgagaagccaagggugaggaggcaggaagcaccuccgguuggaggcacccagg

SEQ ID NO: 38099 - RNA, 60 nt, hsa
cuucuguuucacagggaggcugauggaaaaaggaagcaagcuggacccauccucccugcu

SEQ ID NO: 38100 - RNA, 60 nt, hsa
guaggaugggagaaugauuuggcccacacaaggaagcaacuuuauucuauauagcuuuaa

SEQ ID NO: 38101 - RNA, 60 nt, hsa
ccaggaaggcuccucucccacagguuucagaggaagcacagcccugcuugaauucaaacu

SEQ ID NO: 38102 - RNA, 60 nt, hsa
uuaaauccuuagggcaugguucaagucuguaggaagcaaaucuauacuuuuuuauauggg

SEQ ID NO: 38103 - RNA, 60 nt, hsa
augcauuuuagcaaguggacuuguugaaacaggaagcaagggccuucaguguagcccauu

SEQ ID NO: 38104 - RNA, 60 nt, hsa
ugaggcccagcaagaagggcuuggguucugaggaagcagauguuucaugcugugaggccu

SEQ ID NO: 38105 - RNA, 60 nt, hsa
uugugccuguaucucgcugggggacuucacaggaagcaggauuugggcauuccugaagcu

SEQ ID NO: 38106 - RNA, 60 nt, hsa
aagaggcagaucagcugaagcaggaccugcaggaagcacgcgaggcggagcgaagagcca

SEQ ID NO: 38107 - RNA, 60 nt, hsa
ccucugccccacugccagccugagugggcaaggaagcagguggaucccccagaaggaacc

SEQ ID NO: 38108 - RNA, 60 nt, hsa
ugucggccaggauugccacuccuguuucagaggaagcaggccgagagacuugcaccuugg

SEQ ID NO: 38109 - RNA, 60 nt, hsa
ugaguuaugcaguucccaguguccaguuaaaggaagcacacaugcuagucaugugagaca

SEQ ID NO: 38110 - RNA, 60 nt, hsa
cucugagcugaguugguuuuaugaaaagcuaggaagcaaccuuucgccugugcagcgguc

SEQ ID NO: 38111 - RNA, 60 nt, hsa
gaguccccuacuggcugcagaggacgaagcaggaagcaugccguggaucccacaugcacu

SEQ ID NO: 38112 - RNA, 60 nt, hsa
gcuaaauguaagccaguugggcuguguuaaaggaagcaguguuuuugguucgauucugcc

SEQ ID NO: 38113 - RNA, 60 nt, hsa
agagccaagcuaaugugguagugaaaaucgaggaagcaccucucagccccucagagaaug

SEQ ID NO: 38114 - RNA, 60 nt, hsa
aggccugccccauguauuuaacaguaauacaggaagcauggcaggcaccaugcaaaccaa

SEQ ID NO: 38115 - RNA, 60 nt, hsa
agauuagcaugaaagcaguuuagcauugggaggaagcacagaucucuagagcuguccugu

SEQ ID NO: 38116 - RNA, 60 nt, hsa
gcuccagagcaggaugggacuuccccaggcaggaagcacuugauggagagcugcccagcu

SEQ ID NO: 38117 - RNA, 60 nt, hsa
ugcucuugggggauuagguaucauuuggggaggaagcauguguucugugagguuguucgg

SEQ ID NO: 38118 - RNA, 60 nt, hsa
uaucagguccagaggguggaaggcccuggcaggaagcaggaggaggaggagagggggguc

SEQ ID NO: 38119 - RNA, 60 nt, hsa
acaauuuuagcaaaacaguccaggccaaagaggaagcauuucauguucaauaagaaaccc

SEQ ID NO: 38120 - RNA, 60 nt, hsa
gagaagagauaauuacaaucaggcuaccaaaggaagcacuaacuuuggugcuuucaaguu

SEQ ID NO: 38121 - RNA, 60 nt, hsa
aaaugaccaaauuauaccaaagaacuuaagaggaagcacuuucagaacuauucacuugcc

SEQ ID NO: 38122 - RNA, 60 nt, hsa
uacagagccuagaggcucacagccuccuggaggaagcagccuccacuuuggaucaggaaa

SEQ ID NO: 38123 - RNA, 60 nt, hsa
cccaaaucuaccugaucauaauaauuuaccaggaagcagaggagagcuacuuguuuaaaa

SEQ ID NO: 38124 - RNA, 60 nt, hsa
aaaaaccuguacacaguguuuauugugguuaggaagcaauuucccaauguaccuauaaga

SEQ ID NO: 38125 - RNA, 60 nt, hsa
caguaacaucuggagccuggagauauccucaggaagcacaucuguagugcacucccagca

SEQ ID NO: 38126 - RNA, 60 nt, hsa
aagagggccuggggcacgauguggucagccaggaagcauaggaugccauuucuuuuauag

SEQ ID NO: 38127 - RNA, 60 nt, hsa
cccccagcacagucccaggagaugacaggaaggaagcaccagggcaaggcggacgcucac

SEQ ID NO: 38128 - RNA, 60 nt, hsa
uggauuggcucacgguucugcaggcugcacaggaagcauggcagcaucugcuucugggga

SEQ ID NO: 38129 - RNA, 60 nt, hsa
gguugaucuugaucuacaauuguugggaaaaggaagcaaugcagacacgagaaggagggc

SEQ ID NO: 38130 - RNA, 60 nt, hsa
acccuuccuucgauaccaaacacuaacaagaggaagcagaauaugagaagccauauuuuu

SEQ ID NO: 38131 - RNA, 60 nt, hsa
accgcuucuucauguagauguauauuauuuaggaagcaauggaauucccuucugggaggu

SEQ ID NO: 38132 - RNA, 60 nt, hsa
cauacaugugcagaaauguauucaaaugaaaggaagcauaccuuuaucaagaugcuauua

SEQ ID NO: 38133 - RNA, 60 nt, hsa
uguucugggaguuguuauaaacacaccccaaggaagcaauauuuaauaaaacuaggucaa

SEQ ID NO: 38134 - RNA, 60 nt, hsa
ggauuucucacuucaauuauagaucauaauaggaagcaaaaagaaaaaaaugaaaagcaa

SEQ ID NO: 38135 - RNA, 60 nt, hsa
aagaaagcacauuuuaccauugcuguugggaggaagcagaggcagaugggaaagcagaga

SEQ ID NO: 38136 - RNA, 60 nt, hsa
gaccuguuuauacauugaaggaagaaaagaaggaagcaguugccuuccggagggggcucu

SEQ ID NO: 38137 - RNA, 60 nt, hsa
ggagacaaggauaaguuauagagcaguuggaggaagcauccaaagauugcaacccagggc

SEQ ID NO: 38138 - RNA, 60 nt, hsa
ccucagccauggcaaguccaucuggaguccaggaagcaggcaacuggccugacccaugag

SEQ ID NO: 38139 - RNA, 60 nt, hsa
acguccugagccgguuuaagucuguggaaaaggaagcacgggagaaauccacguaaccuu

SEQ ID NO: 38140 - RNA, 64 nt, hsa
gccccuuuucugucaccagccaaccacauagccuugggaccagccucucugggggaccagaagu

SEQ ID NO: 38141 - RNA, 64 nt, hsa
gcagaguuccugauuccaagucaccugugcuuucugggaccaaagaaugggcaccugcuggagu

SEQ ID NO: 38142 - RNA, 64 nt, hsa
auggauggauaaauagauugggaccaucagaccaugggaccaucagaccaugaccacuguagga

SEQ ID NO: 38143 - RNA, 64 nt, hsa
cuuccauaaauguuggauggauggauaaauagauugggaccaucagaccaugggaccaucagac

SEQ ID NO: 38144 - RNA, 64 nt, hsa
gcugggauuacaggcgugagccaccacgcccaacugggaccaggguuuucuguuuuuugaugga

SEQ ID NO: 38145 - RNA, 64 nt, hsa
caagcgauucuccugccucagccuccugaguagcugggaccacaggcgacugccaccacaccca

SEQ ID NO: 38146 - RNA, 64 nt, hsa
cugccuggacuguccccuguccccgcaucuccccugggaccagcuggagggccacaugcacaca

SEQ ID NO: 38147 - RNA, 64 nt, hsa
gacaagguggggaacaauccuugccagagugggcugggaccagacuuuguucucuuccucaccu

SEQ ID NO: 38148 - RNA, 64 nt, hsa
acagugaggaggcuguccaccuugcuuggcucacugggaccaggaaagccugucuuugguuagg

SEQ ID NO: 38149 - RNA, 64 nt, hsa
uguucucaugguuggcucugacuuucagcuguguugggaccacuggcugaucacaucaccucuc

SEQ ID NO: 38150 - RNA, 64 nt, hsa
gagcaugggacuguucuuuuacaagacaggacccugggaccacagagggcaggaacuugcacaa

SEQ ID NO: 38151 - RNA, 64 nt, hsa
ugccccaugcugcccgcuucucacccuaugugggugggaccacagacucacauccugaccuugc

SEQ ID NO: 38152 - RNA, 64 nt, hsa
agaauguggcaacguaguugugcucgccagaacgugggaccaaauuggccucagguguugaguc

SEQ ID NO: 38153 - RNA, 64 nt, hsa
ggcuuggucuggauucccagaagcauagcuuagaugggaccacagugggcaauuuugaccuguc

SEQ ID NO: 38154 - RNA, 64 nt, hsa
auucggcucccuucagcaaauuucagggguuuucugggaccaguucucccccaacaggaaacuu

SEQ ID NO: 38155 - RNA, 64 nt, hsa
gucccaauuuguguguauucugaaacuuucucuuugggaccaaauucauucucaauggcccuga

SEQ ID NO: 38156 - RNA, 64 nt, hsa
cagucugccucuuccuccuacuucugcuguagccugggaccagaccuggccaaggucagccagc

SEQ ID NO: 38157 - RNA, 64 nt, hsa
cacaaacagcagaggccuucccuggaggaggcuuugggaccaccccuggggggacuucccaaag

SEQ ID NO: 38158 - RNA, 64 nt, hsa
aaccucaccuccuggggcuuccgagcuacagggcugggaccaggucaugcagcugaaagucuac

SEQ ID NO: 38159 - RNA, 64 nt, hsa
cuugcaagacagccugacugugccuuccagggccugggaccauuggcugggaccccucauuaac

SEQ ID NO: 38160 - RNA, 64 nt, hsa
ggagcccccucugccucuugaguaccagaccucaugggaccagaccccuugggaccacauggca

SEQ ID NO: 38161 - RNA, 64 nt, hsa
ucuugaguaccagaccucaugggaccagaccccuugggaccacauggcacaaugggaccucugu

SEQ ID NO: 38162 - RNA, 64 nt, hsa
cugaaauaagcugcgugugguggcucacaccuguaaucccaacacuuugggacguugaaauggg

SEQ ID NO: 38163 - RNA, 64 nt, hsa
ggaaacuaggccaggcgugguggcucacgccuguaaucccaacacuuugggaggccgaggcggg

SEQ ID NO: 38164 - RNA, 64 nt, hsa
cugagguagagauuccaggcccuggcauaagcugaaucccaaauuugaguuugggaagaaccag

SEQ ID NO: 38165 - RNA, 64 nt, hsa
ccccuucucuccuccucugccucacuucuuuaguaaucccaacccuauaaaaaugaaccuaaug

SEQ ID NO: 38166 - RNA, 64 nt, hsa
acggaagccggcuggggugguggcucacgccuguaaucccaacacuuugggaggccaaggcagg

SEQ ID NO: 38167 - RNA, 64 nt, hsa
uuauguguuagcaaguauaaucggcuaacuccuaaaucccaaugaauaguccuaggcuggacag

SEQ ID NO: 38168 - RNA, 64 nt, hsa
gcuuagcaggaugggcgcaguggcucacgccacuaaucccaacauuuuaggaggccuaggcagg

SEQ ID NO: 38169 - RNA, 64 nt, hsa
uuaaaaaaggcugggugugguggcucacacccauaaucccaacacuuuggcucagcagauugcu

SEQ ID NO: 38170 - RNA, 64 nt, hsa
agagcccuggcuggugaugugcuggcugggggugaaucccaaugagggucccucucagagcggg

SEQ ID NO: 38171 - RNA, 64 nt, hsa
agagcccuggauggugaugcgcuggcugggggugaaucccaaugagggucccucucagaaaggg

SEQ ID NO: 38172 - RNA, 64 nt, hsa
cuaacauuggccaggcacgguggcucacgccuguaaucccaacacuuuaggagaccaaggcggg

SEQ ID NO: 38173 - RNA, 64 nt, hsa
auuuuucaagcugggccuaguggcgcacaccugcaaucccaacacuuugggaggccaagagagg

SEQ ID NO: 38174 - RNA, 64 nt, hsa
ugaaagccuucaccugaugccucugcagcuacacaaucccaagacagagcuagagcaagggucu

SEQ ID NO: 38175 - RNA, 64 nt, hsa
uuaaaaaauagaugaucaagaucuaaaggaaauuaaucccaaccaacaaacuuaaaaguuuauc

SEQ ID NO: 38176 - RNA, 64 nt, hsa
agaacaaaacuccaucucaaaaaauaaaaaucccaaucccaagucgaaaucaccucuuguuuua

SEQ ID NO: 38177 - RNA, 64 nt, hsa
gcaacaagaacaaaacuccaucucaaaaaauaaaaaucccaaucccaagucgaaaucaccucuu

SEQ ID NO: 38178 - RNA, 64 nt, hsa
cugcauugccgaguucuuauuuucaccuuuucauaaucccaacuacaauaacaagaauuuuauu

SEQ ID NO: 38179 - RNA, 64 nt, hsa
ugggccuaaggauccauggaagucaggagcauuaaaucccaaaccaaaucaacuccagauauau

SEQ ID NO: 38180 - RNA, 64 nt, hsa
gaagaaaaggccgggcaugguggcucaugccuguaaucccaacacuuugggaggcuaaggcagc

SEQ ID NO: 38181 - RNA, 64 nt, hsa
acuguccuggccaguugcaguggcucacgccuauaaucccaacacuucgggaggccaaggugag

SEQ ID NO: 38182 - RNA, 64 nt, hsa
ccaaauccccagggaaucccaaauuugaaaauccaaucccaaguccccaggaaacccaaucaug

SEQ ID NO: 38183 - RNA, 64 nt, hsa
gacccccaaaucauggaaucccaaauccccagggaaucccaaauuugaaaauccaaucccaagu

SEQ ID NO: 38184 - RNA, 64 nt, hsa
caaugccguaacuccuaggacccccaaaucauggaaucccaaauccccagggaaucccaaauuu

SEQ ID NO: 38185 - RNA, 64 nt, hsa
gaaguaaggacugaaggagaaggggagaauagcuaauagcuauaguauauguauauguuaaaaa

SEQ ID NO: 38186 - RNA, 64 nt, hsa
ggagccagaaguaaggacugaaggagaaggggagaauagcuaauagcuauaguauauguauaug

SEQ ID NO: 38187 - RNA, 64 nt, hsa
gauguaguuuugcagagacaaaaauccaugagugaauagcuauccuaaguccauauuuugaugc

SEQ ID NO: 38188 - RNA, 64 nt, hsa
cuuacccaugaaugugcacuaccuacauuuuuuaaauagcuagguuuuuacugauuauuuucau

SEQ ID NO: 38189 - RNA, 64 nt, hsa
gucuaauaaaaaaaucuggacaaucaaaccuuaaaauagcuacacucugcccucuguaauguag

SEQ ID NO: 38190 - RNA, 64 nt, hsa
uuuuucaagcaauccuuuaguuuuaguuuucuggaauagcuaguauuggguuuucuaguuuuuu

SEQ ID NO: 38191 - RNA, 64 nt, hsa
gauggaaauggugauuuuuacauguguccuggaaagauauuaaaguaauucaaaucuuccccaa

SEQ ID NO: 38192 - RNA, 64 nt, hsa
uuuuccuuuccaagcauuguaaauuguauaccaaagauauuaguuauuacuucuguguguacaa

SEQ ID NO: 38193 - RNA, 64 nt, hsa
caacuccuaagggguccucugggauuaguuaugcagauauuaaaucacccgaagacacuaacuu

SEQ ID NO: 38194 - RNA, 64 nt, hsa
gccaggauuuaggaauauuuucagaacagauuuuagauauuauuucuauccauauauugaaaag

SEQ ID NO: 38195 - RNA, 64 nt, hsa
uauccuuccuagaaaaugguaauugagauuacucagauauuaauuaaauacaauaucauauaua

SEQ ID NO: 38196 - RNA, 64 nt, hsa
agcuaaucuauaccauaauauuuucauauucacaagauauuaaauuaccaauuuucaaauuauu

SEQ ID NO: 38197 - RNA, 64 nt, hsa
auauagucauuagccaccuaaacauuuuaauuccagauauuauuuaauuccauauaauaacuga

SEQ ID NO: 38198 - RNA, 64 nt, hsa
aucacuaaaaugauuugugagaaacuggcacuucagauauuauauccuuuagcuauagguucuu

SEQ ID NO: 38199 - RNA, 64 nt, hsa
auggaguucuuauuauagaauaaccugguuaaacagauauuaaagcugcuuuuggguaaaacag

SEQ ID NO: 38200 - RNA, 64 nt, hsa
ugcaaguaauagcaagagaguauuguauaaaagaagauauuacuaagcuaguccucugcaaggg

SEQ ID NO: 38201 - RNA, 64 nt, hsa
aggagggaagauauuagugauuagacagcagggaagauauuagugguaaagagugaaugauagu

SEQ ID NO: 38202 - RNA, 64 nt, hsa
aggaaggaagacauuagugauuagacaggagggaagauauuagugauuagacagcagggaagau

SEQ ID NO: 38203 - RNA, 64 nt, hsa
auugcauuaguugguugcaugaacuucgaagggcagauauuacugcacaaacugccaucucgcu

SEQ ID NO: 38204 - RNA, 64 nt, hsa
uccuuucccucacuuucuccagugcucaacuguuagauauuaaucuuggcaaacugcuuaaucu

SEQ ID NO: 38205 - RNA, 64 nt, hsa
uagaggaugaggaaagcauguauucagcuuuaguagauauuaccaguuuuccuaagugauugua

SEQ ID NO: 38206 - RNA, 64 nt, hsa
aacuuucucuaugaacucuguuuucuuucuaaugagauauuaaaccauguaaagaacauaaaua

SEQ ID NO: 38207 - RNA, 64 nt, hsa
ggugcuacaaauaauccagacuaccaggucugguagauauuaaagcuggguacuaagaaauguu

SEQ ID NO: 38208 - RNA, 64 nt, hsa
auucauuugaaagucugauggcuuuuacaauaaaagauauuaagaauuguuauccuuaacuuac

SEQ ID NO: 38209 - RNA, 64 nt, hsa
ucaaaccgauccagaauaccgaagguauggacaggacagaaaagcgagucgcaggaggaaggga

SEQ ID NO: 38210 - RNA, 64 nt, hsa
uaccacaccaaggcuggaggcuggucugucauaagacagaaagaaagacgcugggcccaauuuu

SEQ ID NO: 38211 - RNA, 64 nt, hsa
guccagggccguuguguagauauuugacuucacugacagaaaagaaaccagggaguuuguagag

SEQ ID NO: 38212 - RNA, 64 nt, hsa
augccccucucgggccuuuguggcugagaagugggacagaaagaugauuaagguaauguguccu

SEQ ID NO: 38213 - RNA, 64 nt, hsa
uuaacaauacuccaaucacaguuaaauuaauuuagacagaaaagcaaauagcaauugacuugaa

SEQ ID NO: 38214 - RNA, 64 nt, hsa
ccuauaucuaggagucucuugaugagcauuggucgacagaaagaagucucuucuaaaaauuguu

SEQ ID NO: 38215 - RNA, 64 nt, hsa
agaguauccaauaaaggagacaguuuagagucaggacagaaaagcuuccauaauugaacuagau

SEQ ID NO: 38216 - RNA, 64 nt, hsa
acagacgugacguccugccagaaagagaaugaaugacagaaaaaaaaaagagagacaaacucua

SEQ ID NO: 38217 - RNA, 64 nt, hsa
gguuacuauggguuugccauuaauuucugagugggacagaaauuauaauugugcuuuuucgugu

SEQ ID NO: 38218 - RNA, 64 nt, hsa
auacuauuggaauauaguauguagggugaaaguugacagaaaucuguacuucuucaggaaaucc

SEQ ID NO: 38219 - RNA, 64 nt, hsa
caugcugcuaguaucagaggggcaguagagcuuggacagaaagaaaagaaacuugguguuaggu

SEQ ID NO: 38220 - RNA, 64 nt, hsa
acuguugcauggauccuguguuugcaacuggggagacagaaacugugguugauagccagucacu

SEQ ID NO: 38221 - RNA, 64 nt, hsa
auacaggguugguucucauuucgugccgaaaugagacagaaauucagugacgaaggugcguugu

SEQ ID NO: 38222 - RNA, 64 nt, hsa
acagcaguuucaaaaaugacaaagucaguuuggagacagaaaaagacaaaagguccagucucau

SEQ ID NO: 38223 - RNA, 64 nt, hsa
gcaucgucaaaagauuuuugcuuggaauaagcaugacagaaagauuuaaccuaaguguuagaca

SEQ ID NO: 38224 - RNA, 64 nt, hsa
auuuguuacagcaauccuaggaagcuaauacucugacagaaaaaaaucuuggauaauaugcaug

SEQ ID NO: 38225 - RNA, 64 nt, hsa
uucuaaagaugucuuaacauuuauagugaggauugacagaaauuaagcaguguuaagaauacca

SEQ ID NO: 38226 - RNA, 64 nt, hsa
aguauuuccccauggaaaggagaaagugguuugggacagaaagaaauggaaugucuucagucau

SEQ ID NO: 38227 - RNA, 64 nt, hsa
gaagcauacauuccugucagacaacuaguugucugacagaaauguuaggcuucauguauguuac

SEQ ID NO: 38228 - RNA, 64 nt, hsa
gccauuuuaaauuuaacuuugacauccagcuauagacagaaauaauaagccacccuggguguaa

SEQ ID NO: 38229 - RNA, 64 nt, hsa
uauguucugauauccuccuacaguaguuuaaauugacagaaaaauuugaauguuuucuucuuaa

SEQ ID NO: 38230 - RNA, 64 nt, hsa
auauaccugaacuguagugguuugaucggauggagacagaaaacccgauuuuuauucucauaaa

SEQ ID NO: 38231 - RNA, 64 nt, hsa
aauaauugaaagaaucgauaaaaguucaucuuuggacagaaagccuuuaaaaaaaaaaucacuc

SEQ ID NO: 38232 - RNA, 64 nt, hsa
gugaaaacaugucaagugucacauuagugucacagacagaaagcacacaccuaugcaauauggc

SEQ ID NO: 38233 - RNA, 64 nt, hsa
ggcccugacuccugcggggguauggggaagcugugacagaaacgaugggugcugugguccucug

SEQ ID NO: 38234 - RNA, 64 nt, hsa
ggguaggguaaaaggcaugugcugcaacacugaagacagaaagaagaagccucuggacacugcc

SEQ ID NO: 38235 - RNA, 64 nt, hsa
cuuaaacaccccacugucaacauuagaucaaugagacagaaaguuaacaaggauauccaggaau

SEQ ID NO: 38236 - RNA, 64 nt, hsa
aauaaauguaauccagcauauaaacagaaccaaagacagaaaccacaugauuaucucaauagau

SEQ ID NO: 38237 - RNA, 64 nt, hsa
cuaccugacucauuccagcacuacagaaguguguuuuacucauuugaggaacagcacaucagcu

SEQ ID NO: 38238 - RNA, 64 nt, hsa
cugccugacuuaggccagcccuacagaagugcuguuuacucauuggaggaacaguaccuuggcu

SEQ ID NO: 38239 - RNA, 64 nt, hsa
cuuguaaaaauugucagugcuugaagcuguuuccuuuacucacauugaagggacuucguugguu

SEQ ID NO: 38240 - RNA, 64 nt, hsa
cucguaaaaacugucagugcuugaaacuguuuccuuuacucauguugaagggacuuuguuggcu

SEQ ID NO: 38241 - RNA, 64 nt, hsa
ccacucagaugagaauuuauguuuaacuucucuuuuuacucaucagcugcaagcaaaaucuugu

SEQ ID NO: 38242 - RNA, 64 nt, hsa
uuagguaaagacauacucauuaaguguuauuuauuuuacucaagaacuggaaaccaacuaaaug

SEQ ID NO: 38243 - RNA, 64 nt, hsa
uagcuuauaaauuuacuuauuauucuuuuacucauuuacucagucauuucuuuacaagaaaaug

SEQ ID NO: 38244 - RNA, 64 nt, hsa
uuaaccuguagcuuauaaauuuacuuauuauucuuuuacucauuuacucagucauuucuuuaca

SEQ ID NO: 38245 - RNA, 64 nt, hsa
auuaccacucugauuauaguucugaguucuuugauuuacucaugcugcaugacaaaauguuuac

SEQ ID NO: 38246 - RNA, 64 nt, hsa
acuuaucuuucucacugagguucauucacuggaauuuacucacgcaaucucaguagaguacaac

SEQ ID NO: 38247 - RNA, 64 nt, hsa
cuucucuuaauugcuuuucauguaaucaugauaauuuacucagguagcacuccagucacaaaca

SEQ ID NO: 38248 - RNA, 64 nt, hsa
aagacgacuuuggcaucugaauuguuuuaauaucuuuacucaaaaaaacaaaaaaacaaaaacc

SEQ ID NO: 38249 - RNA, 64 nt, hsa
augaguugcuguuccuggaguaucuaacuuucaguuuacucaaaaacuuuuggguaaauaaaaa

SEQ ID NO: 38250 - RNA, 64 nt, hsa
ucaguucuguaagaaaugagugguauuugauguauuuacucaaaacacaauuugcacuguacac

SEQ ID NO: 38251 - RNA, 64 nt, hsa
aauauuuguaucauuuccuuuuuagauuuuuuauuuuacucauuuuacuuaaaagagaucuccu

SEQ ID NO: 38252 - RNA, 64 nt, hsa
ugaacaaaugaaaguguucauccagauuucauacuuuacucauuuaacaaauuaucuuuaguua

SEQ ID NO: 38253 - RNA, 64 nt, hsa
uuuaauaauacuuccaaauugcccuccuguacuauuuacucaguauuuuucuugagguugaucu

SEQ ID NO: 38254 - RNA, 64 nt, hsa
agaggcagcaaagccgggugcgaugagcucagccuuuacucauucacauacaccaucacacuuu

SEQ ID NO: 38255 - RNA, 64 nt, hsa
aggggcauuugacauccccuccugguucucaccaggaaaacauccaaagcuuuggaggaaacag

SEQ ID NO: 38256 - RNA, 64 nt, hsa
cuuccccagccccugggccuggucacuacacaguggaaaacagacaagcggccccuuccccaaa

SEQ ID NO: 38257 - RNA, 64 nt, hsa
gauauuuuauuuuuaaacuuuuuuuuuuuuuccuggaaaacauccugugcagaaaaggguauau

SEQ ID NO: 38258 - RNA, 64 nt, hsa
gcagaccuagauaagaaaagcagagaacuacuuuggaaaacaguuuaucugcuguaauugaaca

SEQ ID NO: 38259 - RNA, 64 nt, hsa
gugugcaugaaccaaaggaaauaacauugaagaaggaaaacaauauguagaaaguauuuuagaa

SEQ ID NO: 38260 - RNA, 64 nt, hsa
caucugaauaauuauggaaguugggacauguuaaggaaaacaaauauguucaucaccaacaauc

SEQ ID NO: 38261 - RNA, 64 nt, hsa
gcuuucauuccgugugcuuccugucacagguaauggaaaacauaaguagaauaggugaccucuu

SEQ ID NO: 38262 - RNA, 64 nt, hsa
guugucauuuugcacuuucaaaacuuauuuucuuggaaaacaauauuuauagggcuuaaagccc

SEQ ID NO: 38263 - RNA, 64 nt, hsa
aguacacaauuuauaaaguaaaaagauuuuauaaggaaaacaaauauaauaaccagugcuguga

SEQ ID NO: 38264 - RNA, 64 nt, hsa
auauaggcuuccaacaccaaauaaccuaacugcuggaaaacaagggaaauuuaaaucuccaaau

SEQ ID NO: 38265 - RNA, 64 nt, hsa
uacauuauuugcugauaccaacuuuugguaggaaggaaaacagggaaggugauugcugcuauuc

SEQ ID NO: 38266 - RNA, 64 nt, hsa
uuucauuucccaguuaaaugauauuuaacaccugggaaaacaggacagcucagauugucgaguu

SEQ ID NO: 38267 - RNA, 64 nt, hsa
uaauaccagauaccuuaucuuacaauauugauugggaaaacauuugcugccauuacagagguau

SEQ ID NO: 38268 - RNA, 64 nt, hsa
aaccacuuaaacgaagaguucccuugaaacuuugggaaaacauguuaaugacaauauuccagau

SEQ ID NO: 38269 - RNA, 64 nt, hsa
uaggacaggaaaugaaacauuaggagcucugcuuggaaaacaguucacuacuuagggauuuuug

SEQ ID NO: 38270 - RNA, 64 nt, hsa
uuguaaauucucuggugcaagauaaaaggucuugggaaaacaaaacaaaacaaaacaaaccucc

SEQ ID NO: 38271 - RNA, 64 nt, hsa
aagauuagaagcugaaaaccuaaguccuuuauguggaaaacagaacaucauuagaacaaaggac

SEQ ID NO: 38272 - RNA, 64 nt, hsa
caucuauaaauuguccguguucauacauuugaggggaaaacaccauaagguuucguuucuguau

SEQ ID NO: 38273 - RNA, 64 nt, hsa
guuacugauucacugcauggcucccacaggagugggaaaacacugccaucuuaguuuggauucu

SEQ ID NO: 38274 - RNA, 64 nt, hsa
uagaaauauuucaugucaaggaggaaaacauuagggaaaacaaaaaugauauaaagccauauga

SEQ ID NO: 38275 - RNA, 64 nt, hsa
cuguuuaaccauuagaaauauuucaugucaaggaggaaaacauuagggaaaacaaaaaugauau

SEQ ID NO: 38276 - RNA, 64 nt, hsa
auaaaaucuuacaauacagaacaacuguuaagauggaaaacagugccaaaccuccacagcucau

SEQ ID NO: 38277 - RNA, 64 nt, hsa
gcacauggaaacccaugagcuaggauucuaccgaggaaaacaucuagugggauuagcaagguga

SEQ ID NO: 38278 - RNA, 64 nt, hsa
uaauuuuaguuauguaacaaccugacaugauggaggaaaacaaccuuuaaagggauugugucua

SEQ ID NO: 38279 - RNA, 64 nt, hsa
guugcuggucagucuuaguguuuuacaguauuugggaaaacaacuguuacaguuuuauugcucu

SEQ ID NO: 38280 - RNA, 64 nt, hsa
auaggaauuugcuuccuaagucuacuuuugaagaggaaaacaggaacguaccauauauuuugcu

SEQ ID NO: 38281 - RNA, 64 nt, hsa
acuugauuuuugacagauacggcaagcucuauggggaaaacaauauguacuaccuuauacccuu

SEQ ID NO: 38282 - RNA, 64 nt, hsa
aggguuggagugugccagugcacagguagacuaaggaaaacauuauagaggagugaagagaaca

SEQ ID NO: 38283 - RNA, 64 nt, hsa
caagaugucuaauuuuuuuuuaaguaggaccaaaggaaaacaagauuuagauagucugacuuug

SEQ ID NO: 38284 - RNA, 64 nt, hsa
uuucaaacacagguuuugcggaauuuuaaaugcuggaaaacauaaaugaaaugccuaaauauau

SEQ ID NO: 38285 - RNA, 62 nt, hsa
gcagcuguagcauacccuaagauguuuugggaggaaaacaauugaauuacauugugcaaugc

SEQ ID NO: 38286 - RNA, 64 nt, hsa
acacuguaacugaagagucacuggacacagaaauggaaaacaggagucgauuuuccgucuuuug

SEQ ID NO: 38287 - RNA, 64 nt, hsa
guuuuucccuaaauguuucccuacuagucuuuuuggaaaacauguuuguuuuaauuucaucuuc

SEQ ID NO: 38288 - RNA, 64 nt, hsa
gucaaguuauuauugcuguuacucuggaugauauggaaaacacugccauauuuuaaaucaacua

SEQ ID NO: 38289 - RNA, 64 nt, hsa
uaacuuauuggagcacaucaguuucuuggguaauggaaaacauuaccuagaguugccaguggca

SEQ ID NO: 38290 - RNA, 64 nt, hsa
aggaagcaggcuguagauuuaagggcacucaaggggaaaacaaauguaguuuccacagugugag

SEQ ID NO: 38291 - RNA, 64 nt, hsa
agccuucuggcugauuguuccgaugugcccggcuggaaaacaugucuuuagggcugucugcaug

SEQ ID NO: 38292 - RNA, 64 nt, hsa
uuugucaaaaugcagagaauggaaaacagugaacggaaaacacagaguaaacccuagugucaac

SEQ ID NO: 38293 - RNA, 64 nt, hsa
guaggguacuguaauuugucaaaaugcagagaauggaaaacagugaacggaaaacacagaguaa

SEQ ID NO: 38294 - RNA, 64 nt, hsa
gacuccaguuaaaaaaaauuuuaaugaagaaaguggaaaacaaggaagucaaagcaaggaaacu

SEQ ID NO: 38295 - RNA, 64 nt, hsa
ccuucaaacuagggccaagcccagcacugcuugaggaaaacaagcauucacaacuuguuuuugg

SEQ ID NO: 38296 - RNA, 64 nt, hsa
aauauguaacuauucuaauccaguggaaucuuacggaaaacacagagaaaaccccuuuuaucau

SEQ ID NO: 38297 - RNA, 64 nt, hsa
uccagcuuaaugcagugugaacaauagaugguuaggaaaacaaaacugcuuagaagccccuuuc

SEQ ID NO: 38298 - RNA, 64 nt, hsa
acuuauuuuacuuucgauuuuuuuuuuccauaaaggaaaacaucacuuccugaauuacugaccc

SEQ ID NO: 38299 - RNA, 64 nt, hsa
auaagccauuaaacuuagcauuaucuucaucaugggaaaacacuuauuuuacuuucgauuuuuu

SEQ ID NO: 38300 - RNA, 64 nt, hsa
cuauauuuguacuguacccuagggguucuggaagggaaaacauggaaucaggauucuauagacu

SEQ ID NO: 38301 - RNA, 64 nt, hsa
accaucaaaccuuuccuccugacuuaccaaaccaggaaaacagcaggagaggguggcucaggac

SEQ ID NO: 38302 - RNA, 64 nt, hsa
ugaaagccauaaugacggugacuugugucgugggggaaaacauaaggucauuuucucccucuac

SEQ ID NO: 38303 - RNA, 64 nt, hsa
aguauguuguuaguuuugaaagacauucacucaaggaaaacaccaucucaacuuugcccgcuca

SEQ ID NO: 38304 - RNA, 64 nt, hsa
aauacauauuguuuaaaaaaaagcaagaaaaaaaggaaaacaaaggaaaauauccccaaaguug

SEQ ID NO: 38305 - RNA, 64 nt, hsa
guguccuaacaguccccgggcuagagaggacuaaggaaaacagagagaguguuacgcaggagca

SEQ ID NO: 38306 - RNA, 64 nt, hsa
uaccugaaagugagggggagaauggaaccaacuuggaaaacacucugcaggauauuauccagga

SEQ ID NO: 38307 - RNA, 64 nt, hsa
aauaaaaggauggaggaagaucuacgaagcaaauggaaaacaaacaaaaaaagaggcagggguu

SEQ ID NO: 38308 - RNA, 64 nt, hsa
augcaucagacaaaagccauuuguuaccaaacugggaaaacagaggcuuuucuuaacuauuuca

SEQ ID NO: 38309 - RNA, 64 nt, hsa
cuuuucuggcaaaaaaaaaaaaaaaagaaagaaaggaaaacaaaaagcacuuuuuucuuaaugg

SEQ ID NO: 38310 - RNA, 64 nt, hsa
ucuuagcuucuccauugucuaaaucaggaaaacaggaaaacacagcuuucuagcagcugcaaaa

SEQ ID NO: 38311 - RNA, 64 nt, hsa
auuucucuucuuagcuucuccauugucuaaaucaggaaaacaggaaaacacagcuuucuagcag

SEQ ID NO: 38312 - RNA, 64 nt, hsa
augguggaaggcaggacacguaucucugucugacggaaaacagaccucggggcuggcguaaacc

SEQ ID NO: 38313 - RNA, 64 nt, hsa
agguuggggugcccuuguuuggguuuguuuugguggaaaacaucacaaaccuggcacaccauuu

SEQ ID NO: 38314 - RNA, 64 nt, hsa
gcuggguuucuuccaaccaucucgucauuuaaagggaaaacaaaaucugagucuccagccagga

SEQ ID NO: 38315 - RNA, 64 nt, hsa
ccagguaaguaugugaugagcaaugaggaggaguggaaaacaaaacccagaaagugcggcagga

SEQ ID NO: 38316 - RNA, 64 nt, hsa
gccugggcaaucagaugggcugccuuuguccaagggaaaacagacucccuucgggaaacauccu

SEQ ID NO: 38317 - RNA, 64 nt, hsa
gucuuaagugaaccacuguguauauaaauauguuggaaaacagcuguauacauuuuugggcaac

SEQ ID NO: 38318 - RNA, 64 nt, hsa
ccuccuaauuauuuuuuucaaugagugcugaaugggaaaacauuuauaucuuacuauaaaaggu

SEQ ID NO: 38319 - RNA, 64 nt, hsa
gaaaaagagugccagucuuuggucaucucuaaacaaggcuuaucaccaauggagacagaaaacu

SEQ ID NO: 38320 - RNA, 64 nt, hsa
guuugcaaguaacugaauccauugcgacauugugaaggcuuaaaugaguuuagaugggaaauag

SEQ ID NO: 38321 - RNA, 64 nt, hsa
ugaauuucucacauuuaugguccauaaaaacuucaaggcuuauccauacuuuugauguuucaau

SEQ ID NO: 38322 - RNA, 64 nt, hsa
uuuuggucaucccuaauaaagugucugcuaauucaaggcuuauacauuauauuuauagaauaua

SEQ ID NO: 38323 - RNA, 64 nt, hsa
guuaaauaauguagaaguaaaaaaauuuuuuuuaaaggcuuaauuugggaggggggacuuauuu

SEQ ID NO: 38324 - RNA, 64 nt, hsa
uuuuucuuuuuuaaauaaacagguuugcuuuggaaaggcuuaaugauggaauguuagcaucuuc

SEQ ID NO: 38325 - RNA, 64 nt, hsa
uggcucacaccuguaaaagaaaaaagaaucaaauugaauauaucuuuuaagaauucaaaacuag

SEQ ID NO: 38326 - RNA, 64 nt, hsa
acaauauaauggcaauagguagagauacaacaaaugaauauaacacuauaacacuucauauuuu

SEQ ID NO: 38327 - RNA, 64 nt, hsa
uaaggaccgauuugagcacuaacuauagguacucugaauauauauuucccuugauuauucacca

SEQ ID NO: 38328 - RNA, 64 nt, hsa
ugugacuacccaaauugcuaauuauucuuucuuuugaauauauuuuacauuucuaugagccuaa

SEQ ID NO: 38329 - RNA, 64 nt, hsa
acauaauuuaaaugaauuugauuuaaauguuuccugaauauauauacagauagauagaugagua

SEQ ID NO: 38330 - RNA, 64 nt, hsa
uuauagcacauauuaguuagugcuaauauucuacugaauauaauuuaagcaaugggcuaagguc

SEQ ID NO: 38331 - RNA, 64 nt, hsa
uugaaucuacaaauaucuuuauauguauauaauuugaauauauacauguauguauauacagaug

SEQ ID NO: 38332 - RNA, 64 nt, hsa
uguguggauauauauacacacacacacagaaagaugaauauauauauauauauaucuguauaga

SEQ ID NO: 38333 - RNA, 64 nt, hsa
uuucaggcuacaagugacaagacagauucugcuuugaauauagcuacagaaauaaaggauggac

SEQ ID NO: 38334 - RNA, 64 nt, hsa
auucaggcuacaagugaugagaaagauucuguuuugaauauagccagaggaaaaaaggauggag

SEQ ID NO: 38335 - RNA, 64 nt, hsa
gauaauuggaaaaaauugaauauauuguaggauuugaauauacagccuacuuuuaugucaccuc

SEQ ID NO: 38336 - RNA, 64 nt, hsa
gcaaauuguuguucaaaagauaauuggaaaaaauugaauauauuguaggauuugaauauacagc

SEQ ID NO: 38337 - RNA, 64 nt, hsa
uuuauuuuacauaguuuugugacuuaauuacacaugaauauaaaaucuauaauucuauaugaau

SEQ ID NO: 38338 - RNA, 64 nt, hsa
aauuacacaugaauauaaaaucuauaauucuauaugaauauauagagauauagaaacaucugaa

SEQ ID NO: 38339 - RNA, 64 nt, hsa
uuuucaaaauaauuagcuauauuuuuauauaauaugaauauauacauaaaaauuguuucuauaa

SEQ ID NO: 38340 - RNA, 64 nt, hsa
auuagucauauuuuuguaaauaugacagaauuugugaauauauuuuuaaagcaaaaaacuucaa

SEQ ID NO: 38341 - RNA, 64 nt, hsa
cacuguuugcuuuuauaaaauaacuuugauuacaugaauauaauaaauuaugugcauauaaaug

SEQ ID NO: 38342 - RNA, 64 nt, hsa
acacuuuggcaugaacauuacugcagguuuuugaugaauauaaugaauguauggaauucaauug

SEQ ID NO: 38343 - RNA, 64 nt, hsa
ccauacccaguggcagagguguucuuuaaagacuugaauauaugaauguguguguguaguuacu

SEQ ID NO: 38344 - RNA, 64 nt, hsa
uacuguaucaaugucuauuuuuuuguuuuugcuaugaauauaauuacaguauuuuaauauuuag

SEQ ID NO: 38345 - RNA, 64 nt, hsa
auuaauauuuuagaaaauauuccuuuuguaauacugaauauaaacauagagcuagaaucauauu

SEQ ID NO: 38346 - RNA, 64 nt, hsa
cacuuaacacauugaaacuauuauuuuuuagauuugaauauaaauguauuuuuuaaacacuugu

SEQ ID NO: 38347 - RNA, 64 nt, hsa
uaacuugugaaguugcuauuuauuuuucccugagugaauauaacuguuauuuggucuuuaacag

SEQ ID NO: 38348 - RNA, 64 nt, hsa
gccagcuucaguuaagacaagaccuaucaguaaaugaauauauguuuugauuuaacacaucuuu

SEQ ID NO: 38349 - RNA, 64 nt, hsa
auuuuuauacuuuuuauaauguuuacguuuguccugaauauauauauauauauauauauauaua

SEQ ID NO: 38350 - RNA, 64 nt, hsa
gauaagcuauuucuuuccaaaaucuauaaaucuuugaauauagucccacagaauacuuauguuc

SEQ ID NO: 38351 - RNA, 64 nt, hsa
uucuuaacccaagugacgaaaacauuguccccaaugaauauacucauuagaauuaccauuuguu

SEQ ID NO: 38352 - RNA, 64 nt, hsa
gucuggaucaguaaaauuauacugugugugagugugaauauaaauguguguauguguguuucug

SEQ ID NO: 38353 - RNA, 64 nt, hsa
accauuauuaaccugauguggucugcuuaaaaaaugaauauaucaguauuuagaaauaaauugc

SEQ ID NO: 38354 - RNA, 64 nt, hsa
aggacaaagcaaaaacaaacaaaaagcaagccugugaauauaauuuaauuugaaacugcuccug

SEQ ID NO: 38355 - RNA, 64 nt, hsa
uuuuuaguugucuagaacauuuagagaaagaguaugaauauauuaaauccacaaacacacuaua

SEQ ID NO: 38356 - RNA, 64 nt, hsa
cacaagacaauaaucugaauaagacaauaugugaugaauauaagaaagggcaaaaaauucauuu

SEQ ID NO: 38357 - RNA, 64 nt, hsa
aaauggcuuagacacaaaaacaccucagcagaaaugaauauaccuagcacucagaucuucgugu

SEQ ID NO: 38358 - RNA, 64 nt, hsa
guuucuuuuuauuaccaaguacuauuucauuguaugaauauaucacaguuuauccauucuacua

SEQ ID NO: 38359 - RNA, 64 nt, hsa
cccuacuauagcaguuuuuauauuugucaauuuaugaauauaaugaaugagaguucugguaccu

SEQ ID NO: 38360 - RNA, 64 nt, hsa
uaguaagcaucuacuucaggccaacaagguuauaugaauauauaguguauagaagcgauuuaag

SEQ ID NO: 38361 - RNA, 64 nt, hsa
uguauuggauuguugucuugauuuggucuaaauuugaauauauaugaguuacuugaauauaaca

SEQ ID NO: 38362 - RNA, 64 nt, hsa
gauuuggucuaaauuugaauauauaugaguuacuugaauauaacaaaaaugaauuuuguuugau

SEQ ID NO: 38363 - RNA, 64 nt, hsa
augaaaaguauuuuucuuguauauuauuaaguaaugaauauauaagaacuguacucuucucagc

SEQ ID NO: 38364 - RNA, 64 nt, hsa
gauagcuaaauuaaaccaaacccuauugaagaauugaauauaugcuacuucaagaaacuaaauu

SEQ ID NO: 38365 - RNA, 64 nt, hsa
gaaaggauauauguggcaauauuaaccugguacaugaauauauggggauaacauuuuaauuuga

SEQ ID NO: 38366 - RNA, 64 nt, hsa
uaugucuguaaaaauguuagaguacuugucaucuugaauauagccuccccaagagagaacaggg

SEQ ID NO: 38367 - RNA, 64 nt, hsa
cuuauuuaaucuucacaccaaaacuguauucuuaugaauauacgcuaaaagauuaaguaaaaug

SEQ ID NO: 38368 - RNA, 64 nt, hsa
cucaguucuguauaggcaaugcuguguuauuacuugaauauagaauauauaguuuacaaaauga

SEQ ID NO: 38369 - RNA, 64 nt, hsa
aagagcaauaguuugccccuuuuggaaugaucucugaauauauaaaacacacacacaaagagca

SEQ ID NO: 38370 - RNA, 64 nt, hsa
aagagcaauaguuugccccuuuuggaacgaccccugaauauauaaaacacacacacaccccgcg

SEQ ID NO: 38371 - RNA, 64 nt, hsa
uacccuuucuaaacacuguccuuuuugaaaguuuugaauauauccacauucuauugaaaccuug

SEQ ID NO: 38372 - RNA, 64 nt, hsa
uguugguuuaugcgugcugcagcagugggcauaaugaauauaauuuacccaguggacaaaggug

SEQ ID NO: 38373 - RNA, 64 nt, hsa
auauacauauauauauauauguauauuuaaaaagugaauauaauuugaggcacagaagaauauu

SEQ ID NO: 38374 - RNA, 64 nt, hsa
caacauggugaaagcucaucucuaugaaaaaauuugaauauacauauauauauauauguauauu

SEQ ID NO: 38375 - RNA, 64 nt, hsa
uuuaaauucuaaacaauacaguggaugacccuuuugaauauaccuaaugauuuccuuaaaaaag

SEQ ID NO: 38376 - RNA, 64 nt, hsa
gcaccuucuauccugaauaacuagcauggaaaagugaauauaugugugagcagauauggcuaua

SEQ ID NO: 38377 - RNA, 64 nt, hsa
ucuguaaucauaccuacauuaaaaucauuuucuaugaauauauaauauauacuucacauuuuua

SEQ ID NO: 38378 - RNA, 64 nt, hsa
uaguucuuauauuuguuaacugauuucggugucuugaauauauuuuuuuaaauuauguguauga

SEQ ID NO: 38379 - RNA, 64 nt, hsa
guaccuuagaaaaaguuucacgcagauccuugguugaauauaguugagggagcguaguauugac

SEQ ID NO: 38380 - RNA, 64 nt, hsa
guaccuuagaaaaaguuacacgcaguuccgugguugaauauauuugagaugguaccuuagaaaa

SEQ ID NO: 38381 - RNA, 64 nt, hsa
aucaugaaaggacucacacuggagagaagcccuaugaauauaagcaaugugggaaagccuucag

SEQ ID NO: 38382 - RNA, 64 nt, hsa
uagcuauucaggaggcugacauaggagaauugcuugaauauaggaagcagagguugcagugagc

SEQ ID NO: 38383 - RNA, 64 nt, hsa
uacagagaucaaauucacacucaauaguauguucugaauauauguucaagagagagucucuaaa

SEQ ID NO: 38384 - RNA, 64 nt, hsa
ucugcccuguguuauccaguuaugagauaaaaaaugaauauaagagugcuugucauuauaaaag

SEQ ID NO: 38385 - RNA, 59 nt, hsa
cuaaggucuggccuugccccuuugcucugccccugaagucuaucugcaggauggucuuc

SEQ ID NO: 38386 - RNA, 59 nt, hsa
gucugcuaaaacagccaucuucaagacagccccugaaaagagaccaguucagguccugc

SEQ ID NO: 38387 - RNA, 59 nt, hsa
uuagagaauaaaccaggccuguuucuuuuccccugaaaucccugccucuggcuuccuaa

SEQ ID NO: 38388 - RNA, 59 nt, hsa
cccagggcugauauauauuggaaauaucaccccugaagccaucgcuggcccccaccucc

SEQ ID NO: 38389 - RNA, 59 nt, hsa
caggggccagggagggggcgacuugccugccccugaagcccuuguucccauuggcccca

SEQ ID NO: 38390 - RNA, 59 nt, hsa
ggggggaggggaggagcacccccucagccccccugaaccugaccaaaagccauggcugu

SEQ ID NO: 38391 - RNA, 59 nt, hsa
gcgccuccagggccccgcccacucucccaccccugaagcugcacucccacccaccuagc

SEQ ID NO: 38392 - RNA, 59 nt, hsa
uuccuuggggcggggggagggcaccucagccccugaagacaagcagcacugcaguggca

SEQ ID NO: 38393 - RNA, 59 nt, hsa
uuaaacucacauccauauuacaccuuuccccccugaaauguauagaauccauuugucau

SEQ ID NO: 38394 - RNA, 59 nt, hsa
cgguuccccggccacgacucugggcacuuccccugaagcuccucuccggagcuugacuu

SEQ ID NO: 38395 - RNA, 59 nt, hsa
aaaaacuccuuaacuuacuguugcuuacaccccugaaagucuguuuuuaagcaaauggg

SEQ ID NO: 38396 - RNA, 59 nt, hsa
acccuuuuaaaagagaccuauguugaaaaccccugaaaauucacugaagaaaaaucauu

SEQ ID NO: 38397 - RNA, 59 nt, hsa
gauuuuagaaaucauauaucucuucuaacccccugaaauccugaguuuaaguggcuuga

SEQ ID NO: 38398 - RNA, 59 nt, hsa
uccugcucuuucuccuuuuugcuuucuuaccccugaaagagggaaggacaagucaccuc

SEQ ID NO: 38399 - RNA, 59 nt, hsa
ucaucaguccuuccuuccuaaucucuaauccccugaagccuaacacaguuccuaaugug

SEQ ID NO: 38400 - RNA, 59 nt, hsa
gguagggcugugguuuacuccugucuaaaccccugaagccuaacacaguuccuggcaca

SEQ ID NO: 38401 - RNA, 59 nt, hsa
acagaaguuauaccuuacuccuuuccuuuccccugaacaaaccugcuaaucccacuaau

SEQ ID NO: 38402 - RNA, 59 nt, hsa
gagggaggaaauaugucccuugcacaccaccccugaagcacauggcaguaggaaacagc

SEQ ID NO: 38403 - RNA, 64 nt, hsa
gggccucauucugccaaagcuggaccaaggcuaaccuuucuaagcucccuaacuugggccagaa

SEQ ID NO: 38404 - RNA, 64 nt, hsa
acggucguauuuuccucccuacccgccaagucauccuuucuacugcuuuugaggcccucccuca

SEQ ID NO: 38405 - RNA, 64 nt, hsa
acugguugcccggacacucaacagccuccaccucccuuucuacccucacagcuccuggggccuu

SEQ ID NO: 38406 - RNA, 64 nt, hsa
ccuuccuggccuggggaaggaggcggggagggcuccuuucuaccuccagugcccugagccucca

SEQ ID NO: 38407 - RNA, 64 nt, hsa
cccagugaaguuagguggguuaauuacugccauuccuuucuaaguguguuuuauggcauccugc

SEQ ID NO: 38408 - RNA, 64 nt, hsa
agcggggaaggaaaggaaugagggaggaaauauuccuuucuagcauucauuuugcuuagaucac

SEQ ID NO: 38409 - RNA, 64 nt, hsa
cuuuuguccagccucuuuuucuucugcuguuccaccuuucuaaacauacaauaaagucauggga

SEQ ID NO: 38410 - RNA, 64 nt, hsa
cccacugugcuauaguugcggguggaacagucaaccuuucuaguaguuuaugauauugcccucu

SEQ ID NO: 38411 - RNA, 64 nt, hsa
cuccuuauuagucucccuguuuuuuauuuuuauuccuuucuacacuacaaccaaauugcuccaa

SEQ ID NO: 38412 - RNA, 64 nt, hsa
cauuuauaugcaaaugacugucagauucauaucuccuuucuagaucuucccuaauugauguauc

SEQ ID NO: 38413 - RNA, 64 nt, hsa
ggccaaacucccacucucugccccccuuuaauccccuuucuacagugaguccacuacccucacu

SEQ ID NO: 38414 - RNA, 64 nt, hsa
uuccucccuuaacuucugugacuaauuuuuauuuccuuucuagauuugcccaauuaauacuagg

SEQ ID NO: 38415 - RNA, 64 nt, hsa
uguuuugcgcauugucaugggauucuuaagugaaccuuucuaaauguggucuuguucacaugcu

SEQ ID NO: 38416 - RNA, 64 nt, hsa
caugaguucauacuuucuacguggcauuuuucucccuuucuaaaaugaaagcugaugaaucuua

SEQ ID NO: 38417 - RNA, 64 nt, hsa
cuagaaacaaauguaauaaauauuuuuaaaaucuccuuucuacugguuauguaaauaaaucaaa

SEQ ID NO: 38418 - RNA, 64 nt, hsa
gcauaaacuucucuggugugaaaggauaaauaugccuuucuaaaguuguauaucaaaauuguau

SEQ ID NO: 38419 - RNA, 64 nt, hsa
gaauaucccaaguaguucuucuacgcauagcucaccuuucuaaacccaguuaagcauggaagag

SEQ ID NO: 38420 - RNA, 64 nt, hsa
uuuuacugggauuccugaucaaguaagccucuucccuuucuaauaaaauauacaccuuauaccc

SEQ ID NO: 38421 - RNA, 64 nt, hsa
uucccggagccagcgagcauaugcugcaugaggaccuuucuaucuuacauuauggcugggaauc

SEQ ID NO: 38422 - RNA, 64 nt, hsa
aucuagacuaaaagccaaaauauaauuauugcugccuuucuaaaaacccaaaauguaguucucu

SEQ ID NO: 38423 - RNA, 64 nt, hsa
gcauaucuuauuuaaauguuuuuuuccuuuugguccuuucuacuuaucuauuuugugaauucua

SEQ ID NO: 38424 - RNA, 64 nt, hsa
aggcaucauugaggaugauuaaggagaauagccuccuuucuagcauaccaaccucgauacucuu

SEQ ID NO: 38425 - RNA, 64 nt, hsa
uuuauuuugagaagcucugauuuugcuucuucccccuuucuaaaaguuugaggaauauuucaag

SEQ ID NO: 38426 - RNA, 64 nt, hsa
ucuucuuauuuugguuucagguugaagucucuucccuuucuacccaguacucgagcccagggcu

SEQ ID NO: 38427 - RNA, 64 nt, hsa
cuugccuuuccaccuccagggcaugaacccugccccuuucuauccaugcuguguccaggaggug

SEQ ID NO: 38428 - RNA, 64 nt, hsa
ccucuguguguaaaauugccuuuguguucuccugccuuucuauguuuugaaacuguaucccaca

SEQ ID NO: 38429 - RNA, 64 nt, hsa
uucaccucccugccuccucuccuuucuacccaccccuuucuauccuaaacacauccauaaaaaa

SEQ ID NO: 38430 - RNA, 64 nt, hsa
uuguacauaauacauucaccucccugccuccucuccuuucuacccaccccuuucuauccuaaac

SEQ ID NO: 38431 - RNA, 64 nt, hsa
gugucucucccucccgaguccccagauggagaccccuuucuacaggaugaccccuugauauuug

SEQ ID NO: 38432 - RNA, 64 nt, hsa
uggaauuccaggaaagaacuucaggugucuggacccuuucuaucuagauaauauuuuuagauuc

SEQ ID NO: 38433 - RNA, 64 nt, hsa
augauauaggaaugaaccaauacgcuuuuauuacccuuucuaacucugauuuuauaaucagacu

SEQ ID NO: 38434 - RNA, 64 nt, hsa
gagcaagagaagcugaaauauauuucugcaagaaccuuucuauauuaugugccaauuaccacac

SEQ ID NO: 38435 - RNA, 64 nt, hsa
uagauauaggaaugaaccaauacgcuuuuauuacccuuucuaacucugauuuuauaaucagacu

SEQ ID NO: 38436 - RNA, 64 nt, hsa
gaacaagagaagcugaaauauauuucugcaagaaccuuucuauauuaugugccaauuaccacac

SEQ ID NO: 38437 - RNA, 62 nt, hsa
aggcccucagguugaauccagagcuguagagguuacaguagcaucaccagccuugggggucc

SEQ ID NO: 38438 - RNA, 62 nt, hsa
uggugccauagacacagguuuauaguuuuaacuuacaguauuguuugaaauuuaccuguuuu

SEQ ID NO: 38439 - RNA, 62 nt, hsa
agaaaauacguuugaaagcuuuaucuuauuauuuacaguauuuuuauauuucuuacauuauc

SEQ ID NO: 38440 - RNA, 62 nt, hsa
gggaaaaggcuucaguaaagcagaggcuagaauuacaguauuuauacauagcaacuuuucau

SEQ ID NO: 38441 - RNA, 62 nt, hsa
gaauguugacccauuugaguacgcuaaaaggcuuacaguaucagacacgaucaugguuuuag

SEQ ID NO: 38442 - RNA, 62 nt, hsa
aacuugcaaguaauuuuuuguaaaagauugaauuacaguaaacccaucuuuccuuaacgaaa

SEQ ID NO: 38443 - RNA, 62 nt, hsa
cuccaucaacugaaguaaaugaugucugaguguuacaguaaaggugaccaagucucuuucuu

SEQ ID NO: 38444 - RNA, 62 nt, hsa
uuauucacauuguagaacagcaaaugacauuuuuacaguauuuuuuuguaaagcaaacuauu

SEQ ID NO: 38445 - RNA, 62 nt, hsa
ccugccaccccuucccagucaucccuuuacucuuacaguagcaaauaagaccccugucuaau

SEQ ID NO: 38446 - RNA, 62 nt, hsa
ccuaccaucccuucucagucaacccuuuacccuuacaguagcaagcauagaccccugucuaa

SEQ ID NO: 38447 - RNA, 62 nt, hsa
auuucccuuuggacuucauguauauuguacaguuacaguaaaauucaaccuuuauuuucuaa

SEQ ID NO: 38448 - RNA, 62 nt, hsa
aaaaaccaacauagcaucauuaaucaggaauauuacaguaaugaggauuuuuucuuucuuuu

SEQ ID NO: 38449 - RNA, 62 nt, hsa
auuuaaauggugggucuauaaauuuguucuuguuacaguaacuguaaagucggaguuuuagu

SEQ ID NO: 38450 - RNA, 62 nt, hsa
uaaauuuagugcacucugucuuaaaaauacguuuacaguauuggguacauacaaggguaaaa

SEQ ID NO: 38451 - RNA, 62 nt, hsa
acucugagucugauuacgaaaaguacucuauguuacaguaaagcuaccacucuggcugcuag

SEQ ID NO: 38452 - RNA, 62 nt, hsa
uuuuuauuuugauauuugucuuuuuuuaaauuuuacaguagucauugaaaguuauguuucuu

SEQ ID NO: 38453 - RNA, 64 nt, hsa
aaugaagaagcaugaaaguaauaaugugggauuacuagaaaaccugacuaauggugucacugcu

SEQ ID NO: 38454 - RNA, 64 nt, hsa
agaaccagaaauaaauaaggauggugauagagagcuagaaaauuuuauggcuaucgaagaaaug

SEQ ID NO: 38455 - RNA, 64 nt, hsa
ccgggacacccucaacauucgccaagcauacaaccuagaaaauguuuaaucacaucauuacguu

SEQ ID NO: 38456 - RNA, 64 nt, hsa
aaaugaaacauuccaccuggcuacacgaaaauuucuagaaaaagaaguuuuuaagagugacuau

SEQ ID NO: 38457 - RNA, 64 nt, hsa
uugaauggauuaaaaauugcauuguguuacagagcuagaaaauuuuauguaugaaaaacgauaa

SEQ ID NO: 38458 - RNA, 64 nt, hsa
auugugacuucuaguucuuuucuagaggaugcugcuagaaaaugguuuugcuuuguauuuuaua

SEQ ID NO: 38459 - RNA, 64 nt, hsa
agggccagguuuauuuucuccuuuuuugagauuucuagaaaaaaugcugcuugcacauguuggu

SEQ ID NO: 38460 - RNA, 64 nt, hsa
agugugcaguguguaaauacuuuaaauuauuaugcuagaaaaauaaaguuacauaccuugcugu

SEQ ID NO: 38461 - RNA, 64 nt, hsa
uagaguuugaaaaacuaauugagccugugccuggcuagaaaacaagcguuuauuugaaugugaa

SEQ ID NO: 38462 - RNA, 64 nt, hsa
cugccaaaucguuauagagagcaauuugucuggacuagaaaaucugaguuuuacaccauacugu

SEQ ID NO: 38463 - RNA, 64 nt, hsa
cuuuugauacaacuagguuauucauaauguauaccuagaaaagugaaauugaaaauaccaaaag

SEQ ID NO: 38464 - RNA, 64 nt, hsa
aaagugcacauacgcaacuguguucucuguuuuccuagaaaaccaaaaucaaacugagauuuca

SEQ ID NO: 38465 - RNA, 64 nt, hsa
aaguuuaaaauugccugcggaaugugugcaguaucuagaaaaaugaaccguaguuuuuguuuuu

SEQ ID NO: 38466 - RNA, 64 nt, hsa
caagagcuccuccugaucacuauuacauauuuuucuagaaaaucuaaaguucagaagagaaugu

SEQ ID NO: 38467 - RNA, 64 nt, hsa
gaaccggaaaaugggagacaggauuuucuaaaagcuagaaaaaaaugaagugauugcaaugcca

SEQ ID NO: 38468 - RNA, 64 nt, hsa
cuaggccuuguccaagaagaacuugcuacacagccuagaaaacaagauggaaagauauauaaau

SEQ ID NO: 38469 - RNA, 64 nt, hsa
uaggccuuacuuugugauuauacguuaucuccggcuagaaaaaaauaaugguaguaaagaaacu

SEQ ID NO: 38470 - RNA, 64 nt, hsa
agauuaaaaacauucauuugaacacaguaguccccuagaaaaacaacucuacaaaaauuuugca

SEQ ID NO: 38471 - RNA, 64 nt, hsa
aaauggcacaucaucauaauccauuuucucuuugcuagaaaaucagcccauagagugcauuccc

SEQ ID NO: 38472 - RNA, 64 nt, hsa
aagugaaaaucauucugcuuuugaaucuuaaaagcuagaaaaaccauaauguaauauucuuuuu

SEQ ID NO: 38473 - RNA, 64 nt, hsa
caaauaaaacugcuucucucuuacacugcuugaacuagaaaaucagcuuuuuaauguagguuac

SEQ ID NO: 38474 - RNA, 64 nt, hsa
aaccacuacuguuacauuuuauuaauuuaaaaagcuagaaaauucauguaguuacuuuuuuuac

SEQ ID NO: 38475 - RNA, 64 nt, hsa
ccaauucacuauuuuauuuuuuaaugaauuaaaacuagaaaacaaauugaugcaaacccuggaa

SEQ ID NO: 38476 - RNA, 64 nt, hsa
aaguccacugguuaguguacuaguccaucauagccuagaaaaugaucccuaucugcagaucaag

SEQ ID NO: 38477 - RNA, 64 nt, hsa
uuauuuugcucgugcuuagcuaaauaugucaucucuagaaaagaugugguuuguuuuggcacug

SEQ ID NO: 38478 - RNA, 64 nt, hsa
aucucaaguuaccaaauuuuuuguaauccuuuuacuagaaaaaucuuuuuugaagaguuuuucu

SEQ ID NO: 38479 - RNA, 64 nt, hsa
uggauuacucaggcagggccauccagccccaccacuagaaaagcucuucagaaucuugucccuc

SEQ ID NO: 38480 - RNA, 64 nt, hsa
gauaaaugcccaucuuagcuaaaaccucaaauugcuagaaaauucacagggaagaaaacauuuc

SEQ ID NO: 38481 - RNA, 64 nt, hsa
ugcuggacaccacuuuuaaaaagcaaucacugugcuagaaaaguauauuggcuuuguuaggauu

SEQ ID NO: 38482 - RNA, 64 nt, hsa
uuaacauuauuuuaaaaugccaaauauguucuuucuagaaaaauauuuauuuuuguuuuuguug

SEQ ID NO: 38483 - RNA, 64 nt, hsa
cucauuucaagaguguuuccuucucaaacuucugcuagaaaaugcugacucacuuuuauauaca

SEQ ID NO: 38484 - RNA, 64 nt, hsa
auuacucuuuuaauuaaaacuagauuauuucaaucuagaaaagccuuguugagcagccuccuua

SEQ ID NO: 38485 - RNA, 64 nt, hsa
caaagauuacuauaaacaccuguaugcacacaaacuagaaaaccuagaaaaaauuaauaaauuc

SEQ ID NO: 38486 - RNA, 64 nt, hsa
cuauaaacaccuguaugcacacaaacuagaaaaccuagaaaaaauuaauaaauuccuugaaaga

SEQ ID NO: 38487 - RNA, 64 nt, hsa
cuguagacugaauucagcaccagugaaaggcuuugagaaggacgugggcagcaaaacgacacug

SEQ ID NO: 38488 - RNA, 64 nt, hsa
gccagcaccaccuacacaggagucuucagacccagagaaggacggugccaagggccccaggggc

SEQ ID NO: 38489 - RNA, 64 nt, hsa
ccagggucauucagacacauucagauacugcacugagaaggagcuggcaucucucagugugcuc

SEQ ID NO: 38490 - RNA, 64 nt, hsa
gugcaugugccuaugugggugacccuguggaagugagaaggagucacugugaugcuuagcuguc

SEQ ID NO: 38491 - RNA, 64 nt, hsa
uagccaggacugcagagacacuccagugcagagggagaaggacuuguaauuuucaaagcagggc

SEQ ID NO: 38492 - RNA, 64 nt, hsa
aaccucccucuauggggauggcuauuuuauuuuugagaaggaaaaaaaaagucauguauauaua

SEQ ID NO: 38493 - RNA, 64 nt, hsa
agaacugcccagccucagcugaaaacccgaaucugagaaggaauugcgucauguaagggaagcu

SEQ ID NO: 38494 - RNA, 64 nt, hsa
caucgccuccaucagccagacgagguccucacaggagaaggacagcucuuccccacccugggau

SEQ ID NO: 38495 - RNA, 64 nt, hsa
ucaagaggaggaggacaucuuggauguaagggaugagaaggauggcggggcuagggaagcagag

SEQ ID NO: 38496 - RNA, 64 nt, hsa
cucagaugaaagagaggguacaacuaaagggaaugagaaggaggacgcugcaggaacaaguggg

SEQ ID NO: 38497 - RNA, 64 nt, hsa
gagaucaugccaccgcacuucagccugggugacagagaaggacuccgucucaaaaaaaaaagaa

SEQ ID NO: 38498 - RNA, 64 nt, hsa
ucaucagcccucaauuugugauccggaauuuuaugagaaggauuagaaaucagcaccugcguuu

SEQ ID NO: 38499 - RNA, 64 nt, hsa
ugaaagaggcagaucccaguucaaaagcagccaugagaaggaaggauucaccaccuccaggaaa

SEQ ID NO: 38500 - RNA, 64 nt, hsa
ucggaaaaaaccagccuugaaggcuacaagugaugagaaggauucuuuuucgaauauaaccaga

SEQ ID NO: 38501 - RNA, 64 nt, hsa
ucggaaaaaaccauccuuggaggccacaagugaugagaaggauucuuuuucgaauauaaccaga

SEQ ID NO: 38502 - RNA, 64 nt, hsa
gcugccuggccguggcuucucuuuggcucccaaagagaaggacaguguugggaguaucugccgu

SEQ ID NO: 38503 - RNA, 64 nt, hsa
gaguaucugccguggcuucucuuuggcucccaaagagaaggacaguguugggaguaucugccgg

SEQ ID NO: 38504 - RNA, 64 nt, hsa
guuaaaauguacuuguuaaacagguaauuuuaaagagaaggaacaauuguuuuuaguaaguuuu

SEQ ID NO: 38505 - RNA, 64 nt, hsa
caaugaauugauucuucaaauuaaaaguucuugagagaaggagaggaagauacagcagacauag

SEQ ID NO: 38506 - RNA, 64 nt, hsa
uaggauuugcugagaguuugaauguggaguguaagagaaggaagaguuaaugaugacauuaagg

SEQ ID NO: 38507 - RNA, 64 nt, hsa
gcucucugggaaaugggaaaucagccaaaggacugagaaggaguuaccuuaaggucagagaaaa

SEQ ID NO: 38508 - RNA, 64 nt, hsa
gauggcagaacccccaagcgaaugcccuauugaggagaaggacaucacuguauuuggaauucug

SEQ ID NO: 38509 - RNA, 64 nt, hsa
ucugcgagggacggugugugacaugucaugccuggagaaggaacaaggcuauuugaaaacagaa

SEQ ID NO: 38510 - RNA, 64 nt, hsa
agaaacaccccagcacagcaagcucagccuuuuagagaaggauauuuccaaacugcaaacuuug

SEQ ID NO: 38511 - RNA, 64 nt, hsa
ucaaucagccugguuuuggggaugcuaugaaagagagaaggaaaaucaugccgcucaguuccug

SEQ ID NO: 38512 - RNA, 64 nt, hsa
ugaaggcuucuuuccccacugcaggacccacuuugagaaggaccgaggaggaggauuuggguug

SEQ ID NO: 38513 - RNA, 64 nt, hsa
acgguguggggaaguggaagagaagcuggcgggggagaaggaggcuaaccugcacugaguacuu

SEQ ID NO: 38514 - RNA, 64 nt, hsa
ggaauggaggaguuguuuggggagggaaaggagagagaaggaaaggagugagguauuucccguc

SEQ ID NO: 38515 - RNA, 64 nt, hsa
uaauuaaauaaaaugcugcugcuuugacaguaaagagaaggaaguauucugauuagcuguaucu

SEQ ID NO: 38516 - RNA, 64 nt, hsa
gaagagaucaggaagagaaggagcagagcugauggagaaggaaggcuccaucuccagugggaac

SEQ ID NO: 38517 - RNA, 64 nt, hsa
gcagagaagaaagaacggaagaagagaucaggaagagaaggagcagagcugauggagaaggaag

SEQ ID NO: 38518 - RNA, 64 nt, hsa
ugaggaguuagggaagcagcauacuugaauauuagagaaggagaggagcugugggucaggaauc

SEQ ID NO: 38519 - RNA, 64 nt, hsa
uagaaccuagcgcaauuguaaagugaaauucaaggagaaggaaugaggaguuagggaagcagca

SEQ ID NO: 38520 - RNA, 64 nt, hsa
agaagcuaaaaagcuaaaguaccagucaucuagagagaaggaaauuaauguuucuuaauaaucc

SEQ ID NO: 38521 - RNA, 64 nt, hsa
aagugauucagggauuccuaugaauagaaaugcugagaaggaacgcauuuuauugcagaagcua

SEQ ID NO: 38522 - RNA, 64 nt, hsa
guuccagaaccgccgaaugaagcaaaagaaacgugagaaggagggucucuugcccaucucuccg

SEQ ID NO: 38523 - RNA, 64 nt, hsa
caccaacuucacuaccaagcagcucacggaacuggagaaggaguuccacuucaacaaguaccug

SEQ ID NO: 38524 - RNA, 64 nt, hsa
ggacaacauggagcaaaagagacagggagagguggagaaggaaaaaacccuacaaaacaaaaac

SEQ ID NO: 38525 - RNA, 64 nt, hsa
ucgucuaaagaggcagcugagugagagacacagagagaaggagaaagagggagggagagagaga

SEQ ID NO: 38526 - RNA, 64 nt, hsa
cucagcaagccaaccugggaaucagagagagaaggagaaggaggggagccuguccguucagagc

SEQ ID NO: 38527 - RNA, 64 nt, hsa
agagaacucagcaagccaaccugggaaucagagagagaaggagaaggaggggagccuguccguu

SEQ ID NO: 38528 - RNA, 64 nt, hsa
agaaagaaagaaaagaagaagaaaagagaagaaggagaaggagaugaaggaggaggaggaggag

SEQ ID NO: 38529 - RNA, 64 nt, hsa
gaagaaggagaaggagaugaaggaggaggaggaggagaaggagaagaagaagaagaagaagacc

SEQ ID NO: 38530 - RNA, 64 nt, hsa
gacauuuaaaaagcacagucuuugaccuguccaggagaaggauuuacuccaaaauuauacugga

SEQ ID NO: 38531 - RNA, 64 nt, hsa
caaaacccuucuuuuuaaaaggaaaaaggauggagagaaggauggaaagccuggacuuaaaccu

SEQ ID NO: 38532 - RNA, 64 nt, hsa
gacuauuuauacaaaugggggcggcuggaaagaggagaaggagagggaguacaaagacagggaa

SEQ ID NO: 38533 - RNA, 64 nt, hsa
cccuccccacccaccaaaugccucugccuugauggagaaggaaaaggcuggcaagguggguucc

SEQ ID NO: 38534 - RNA, 64 nt, hsa
agaacaccaaggagguuccuggcuccuguucucagagaaggaggaugguaagguauccaggauu

SEQ ID NO: 38535 - RNA, 64 nt, hsa
uauugugcaagaacccaacuuuuacucaggagcugagaaggaagaagccucaaaccacccauuu

SEQ ID NO: 38536 - RNA, 64 nt, hsa
agagagagagagagaaagagaacaauauuugggagagaaggauggggaagcauugcaaggaaau

SEQ ID NO: 38537 - RNA, 64 nt, hsa
acgacucuuuaaaaagaucuaugucuugaaaauagagaaggaacacaggucuggccagggacgu

SEQ ID NO: 38538 - RNA, 64 nt, hsa
aaccuggcaccaguauaacuauaaagcacuagcugagaaggaacugauacuuacauuucaugga

SEQ ID NO: 38539 - RNA, 64 nt, hsa
uguccugagaacagcuuuagucauggaauacugggagaaggaauaacuuucacaaaauaaacuu

SEQ ID NO: 38540 - RNA, 64 nt, hsa
uuuaugggagaagggcaaagacuucaugggaagagagaaggaaggcccuggguagaaacgcuug

SEQ ID NO: 38541 - RNA, 64 nt, hsa
cuuuggggaacugagcucagaggcaggugcuucagagaaggaaacaaaaugagggguggcaggg

SEQ ID NO: 38542 - RNA, 64 nt, hsa
ggaugcccagcugcugacugugcagaagcuagaggagaaggagcgagccuugcagggcagccuc

SEQ ID NO: 38543 - RNA, 64 nt, hsa
ggagcgagccuugcagggcagccucggggguguggagaaggagcugacgcugcgcagccaagcc

SEQ ID NO: 38544 - RNA, 64 nt, hsa
gcccaggccagccugcuggacaagcagagaccaugagaaggagaguucaggggucccaaaccag

SEQ ID NO: 38545 - RNA, 64 nt, hsa
cggaagugaaaggacuugucugaaaucacauggugagaaggaggaugaagggaggagagagcuu

SEQ ID NO: 38546 - RNA, 64 nt, hsa
ugcgucauuguaacaugaagggauaaaaaugaaggagaaggaggguuugggaugggugucuaag

SEQ ID NO: 38547 - RNA, 64 nt, hsa
aguuucuugcuuucuucagcacaucuuauaguaugagaaggaagguuugggcauguugggaagg

SEQ ID NO: 38548 - RNA, 64 nt, hsa
cuccccuucugaaucagcugggaugacuggcuuugagaaggaagggaagauggaacaggcucag

SEQ ID NO: 38549 - RNA, 64 nt, hsa
aggccuuggacaacugcauggagcugcacucuaggagaaggaggggaaccagauguuagaucag

SEQ ID NO: 38550 - RNA, 64 nt, hsa
gagggaaagaggcagagaaggaaagagacaggcagagaaggagagaggcagagagggagagagg

SEQ ID NO: 38551 - RNA, 64 nt, hsa
cagaggggaagagaggcagagagggaaagaggcagagaaggaaagagacaggcagagaaggaga

SEQ ID NO: 38552 - RNA, 64 nt, hsa
uccaaccaugaggaugggugcaucggggaagggugagaaggagagccugccugcucagggaucc

SEQ ID NO: 38553 - RNA, 64 nt, hsa
guggcuggacuuugacauguggcuguuugaauaagagaaggacaaagggaggagaaagcacaug

SEQ ID NO: 38554 - RNA, 64 nt, hsa
guuuucuuuguucucagacuaauggaugguuccagagaaggaaaugaaaggugcuggguggggc

SEQ ID NO: 38555 - RNA, 64 nt, hsa
aagaugccaggucccaggaacucaggcuucaggugagaaggagcgguguguccaggcaccgcug

SEQ ID NO: 38556 - RNA, 64 nt, hsa
augggagccguuuugaugagaaaaaugggcuggagagaaggagaaggauuaggaaaaaacaaag

SEQ ID NO: 38557 - RNA, 64 nt, hsa
gccguuuugaugagaaaaaugggcuggagagaaggagaaggauuaggaaaaaacaaagaaggca

SEQ ID NO: 38558 - RNA, 64 nt, hsa
gggcacuuggcaaccacuaugugaagggugauuggagaaggacaagacuguggaauggggaaua

SEQ ID NO: 38559 - RNA, 64 nt, hsa
uugauguggagauguaaacacauguaggguuggugagaaggaaagaugagaacaaaagcaacau

SEQ ID NO: 38560 - RNA, 64 nt, hsa
agauuuugcccagcacauggagcuguaauccagagagaaggaaacguagaaauuuauuauuaaa

SEQ ID NO: 38561 - RNA, 64 nt, hsa
acccgcucagcaacauagaagagggaaggaaagagagaaggaaagagagagagaaagaaagucu

SEQ ID NO: 38562 - RNA, 64 nt, hsa
ggagaaaaaccgauucaaaucaacuuguacauggaaacagcaagcauuauggucaaacagcaaa

SEQ ID NO: 38563 - RNA, 64 nt, hsa
caacuuguacauggaaacagcaagcauuauggucaaacagcaaaggccauaaccuuuugggauu

SEQ ID NO: 38564 - RNA, 64 nt, hsa
aacaauagauuccauuaauauagacucaagaucaaaacagcauaccugcuaagcuaagauagau

SEQ ID NO: 38565 - RNA, 64 nt, hsa
aaaaaaaaaaaaaaaacaaaaaacaacaccaaaaaaacagcagugauauauauauauauauaua

SEQ ID NO: 38566 - RNA, 64 nt, hsa
auaaaugcaauaauaugcauguuaacaacauuaaaaacagcaaacagcaaucuaaguacagaaa

SEQ ID NO: 38567 - RNA, 64 nt, hsa
caauaauaugcauguuaacaacauuaaaaacagcaaacagcaaucuaaguacagaaaagcuuuu

SEQ ID NO: 38568 - RNA, 64 nt, hsa
uucugcaauucaacacauccacagguucgagcccaaacagcagaacuuuuugccaaaaugacag

SEQ ID NO: 38569 - RNA, 64 nt, hsa
gaucagaaacaugauuuguucauuucugagucacaaacagcaggauaccucacagguaagccau

SEQ ID NO: 38570 - RNA, 64 nt, hsa
uaaccguaaccucacacauuaacuuuauucaaacaaacagcacuuacaggaaauguaaaguaga

SEQ ID NO: 38571 - RNA, 64 nt, hsa
uccauaacuuugcuauuacgaauagugcugcgauaaacagcacuauuaugaauagugcugcgau

SEQ ID NO: 38572 - RNA, 64 nt, hsa
cuuguagaacaucagagaaggcacauugacuagcaaacagcacuuuaggaaaagucaccguagc

SEQ ID NO: 38573 - RNA, 64 nt, hsa
auuucacuguagaugauaugcuaggaucaaaguuaaacagcauucuucacugcaggacaucuca

SEQ ID NO: 38574 - RNA, 64 nt, hsa
gaaaccaauuucuacuucauacugauguuuuuggaaacagcaauuaaaguuuuucuuccaugag

SEQ ID NO: 38575 - RNA, 64 nt, hsa
uuugcagauucucugggauuuuaaggaacugagaaaacagcaaaguugacuaaauuuuauauuu

SEQ ID NO: 38576 - RNA, 64 nt, hsa
gauuuuugcuacaguuuagacacugugguuuacaaaacagcaugcacucaacuugggacuuuau

SEQ ID NO: 38577 - RNA, 64 nt, hsa
gucucagauguucuaauucucuuuguaugcuuggaaacagcauagauauguugcugugguuuuc

SEQ ID NO: 38578 - RNA, 64 nt, hsa
gcaggcucugcuguuucuagugacccugagauguaaacagcaagugggggcugaggcagaggca

SEQ ID NO: 38579 - RNA, 64 nt, hsa
acccccucucagccacugucuucagucuccacagaaacagcaucaagugugcggagacaggcgg

SEQ ID NO: 38580 - RNA, 64 nt, hsa
guccugcagucguauaguauagcagugcaggaacaaacagcacuugccagcaaagucugugugu

SEQ ID NO: 38581 - RNA, 64 nt, hsa
uuguuguugcuguuagaaaauuuguggcuggugaaaacagcacuccuuuggcuggagcacaugu

SEQ ID NO: 38582 - RNA, 64 nt, hsa
cuguggaguuuguucagugguacgguguccaagcaaacagcagaaugcaacuuucuaaacagcc

SEQ ID NO: 38583 - RNA, 64 nt, hsa
acagcagaaugcaacuuucuaaacagccccaagcaaacagcagaauucaacuuuuuaaacaaua

SEQ ID NO: 38584 - RNA, 64 nt, hsa
acaaagaaaaacagauacuaaaagucucuucugaaaacagcaauccagguaagacuuauaacag

SEQ ID NO: 38585 - RNA, 64 nt, hsa
ccucacaccacuguuacuugguguacaugagcaaaaacagcaaguggugaaauucuuaaucaag

SEQ ID NO: 38586 - RNA, 64 nt, hsa
uauucagaauuacauuuuaucguuuucacauugaaaacagcaaauguugacuuaguaauuuuua

SEQ ID NO: 38587 - RNA, 64 nt, hsa
guuuagcauuugugccgccuccuuuugcuacucaaaacagcaaugcuuggcggcagccuuccau

SEQ ID NO: 38588 - RNA, 64 nt, hsa
cuuucuuacugcuacuuucauguugcuuucuagaaaacagcauuucauuccaaaauaacuagga

SEQ ID NO: 38589 - RNA, 64 nt, hsa
gauugcguagauguugccuggugcaaagugccccaaacagcaauagaaaggcauauguauaacc

SEQ ID NO: 38590 - RNA, 64 nt, hsa
cuuuuuuccauucccauuuuuguccucauaaucaaaacagcauaacaugacaucaucaccagua

SEQ ID NO: 38591 - RNA, 64 nt, hsa
auggacuguuuacuauccaaaaguucaagagagaaaacagcacuugaggucucaucaauuaaag

SEQ ID NO: 38592 - RNA, 64 nt, hsa
cagagcucagaggucacacuguaucaaagaucucaaacagcaaagucagcauuugcuguauaga

SEQ ID NO: 38593 - RNA, 64 nt, hsa
augaaggagggagggagcacauuccuggcagagaaaacagcacgugcaaaggccccgagacugg

SEQ ID NO: 38594 - RNA, 64 nt, hsa
guuuuagauacuuuuguucuuucuugcucuuaaggauuuuaaaaaccuguuaaucuuuuuauuu

SEQ ID NO: 38595 - RNA, 64 nt, hsa
uuauuugucccacuuuuacuaaacaguggcagcagauuuuaaguuaaagaauauggaauauagu

SEQ ID NO: 38596 - RNA, 64 nt, hsa
gguacucuucucuguuugcccagaaucagcucuggauuuuaagcccagacuucaguggacccag

SEQ ID NO: 38597 - RNA, 64 nt, hsa
uuaaaccaaaaucuuuauaagacacaauucuauugauuuuaaagcuucugcuuuccaggcucug

SEQ ID NO: 38598 - RNA, 64 nt, hsa
uuuuaucugcuauaccaguuauuugagaaaguaugauuuuaauguaaaucauuuaaaaaggaca

SEQ ID NO: 38599 - RNA, 64 nt, hsa
aguauuucuaucuuugauaucuaaguguuuugaggauuuuaaaacugaauuuuaucugcuauac

SEQ ID NO: 38600 - RNA, 64 nt, hsa
ucaaucuggaagaaugacuguaucagucaauggggauuuuaacagacugccuugguacugccga

SEQ ID NO: 38601 - RNA, 64 nt, hsa
aaauccaguuuuaagaggagccacuuaucaaagagauuuuaacaguaguaagaaggcaaagaau

SEQ ID NO: 38602 - RNA, 64 nt, hsa
uuuguuuaugaaauguuacauguagaaaaauacugauuuuaaauauuuuccauauuaacaauuu

SEQ ID NO: 38603 - RNA, 64 nt, hsa
uuacucuuaaaaaaaaaaaaaaaagacuaagguggauuuuaaaaauuggaaacugacauaaugu

SEQ ID NO: 38604 - RNA, 64 nt, hsa
guguguuagagcuuaugcauuuguuuuuaugagagauuuuaauaaauuuaauuauuugcuuguc

SEQ ID NO: 38605 - RNA, 64 nt, hsa
ucugaauaguaaauuaaacaguuguuaucaaaaugauuuuaaagacuauuucuuuuucugggua

SEQ ID NO: 38606 - RNA, 64 nt, hsa
aaugucuuguucacauauguguacuuucauauuugauuuuaaaauguacauuauaaccuguaug

SEQ ID NO: 38607 - RNA, 64 nt, hsa
ucauuguugauauaccugaauuuacuuuguaagagauuuuaacuucacuucaugcugaugaugu

SEQ ID NO: 38608 - RNA, 64 nt, hsa
uucuuauuguuaucaccuauguacaauggaaagggauuuuaagcacaaaccugcugcucaucua

SEQ ID NO: 38609 - RNA, 64 nt, hsa
uuucuugugacuauucuaagaaugaaugcaaucagauuuuaaaaguaacuaaauauacuucagc

SEQ ID NO: 38610 - RNA, 64 nt, hsa
acaaaaugacuaauugaaaaaaguugaaacaaaugauuuuaaaagcuugcaguaaaaaauaaac

SEQ ID NO: 38611 - RNA, 64 nt, hsa
gaaaucuuaaugcagaaauuauauagucuccucagauuuuaauauuuuuauuucuuuccuggca

SEQ ID NO: 38612 - RNA, 64 nt, hsa
auguuuauuaguaaacaugaaauggggaauaagugauuuuaaguacaucccauacauuuaaaua

SEQ ID NO: 38613 - RNA, 64 nt, hsa
cagguuuuagaaaugaucuuagaucuaauauagugauuuuaagcaucccgucaaaggcagaauc

SEQ ID NO: 38614 - RNA, 64 nt, hsa
caacaaaaugcccuggcagagauaacuugggaaagauuuuaauauaaaacuugacauuggauau

SEQ ID NO: 38615 - RNA, 64 nt, hsa
aacuaguuaccaaaugaauugugccaccauaacugauuuuaauuuugcauuauuuaugauuuua

SEQ ID NO: 38616 - RNA, 64 nt, hsa
ccaccauaacugauuuuaauuuugcauuauuuaugauuuuaaaauauuuguugcccagguguua

SEQ ID NO: 38617 - RNA, 64 nt, hsa
uugaagucauaggacauuuuuauuuuauggaauagauuuuaaucuauuuacuacuauuaaggua

SEQ ID NO: 38618 - RNA, 64 nt, hsa
uuuuauucugaaggacuuuaaggaagggauacaugauuuuaaaaaagccuguaagaggugaaau

SEQ ID NO: 38619 - RNA, 64 nt, hsa
aaauuuugauacuuucuauuacuagaucuaauuugauuuuaagcucuaaguuucacuuuuccau

SEQ ID NO: 38620 - RNA, 64 nt, hsa
ugggauuacaggugugagucaccacaucuggucggauuuuaacuauucuaauagguauguagug

SEQ ID NO: 38621 - RNA, 64 nt, hsa
gccuuuuguuuuuguuuuuugguuggcaguaaccgauuuuaaugacuagcuuuuaaaaauacag

SEQ ID NO: 38622 - RNA, 64 nt, hsa
ggaccucuuuauagucuaggauggcagagcagaagauuuuaauaugcuuuuauuaagugaugua

SEQ ID NO: 38623 - RNA, 64 nt, hsa
aagcuuccuccaucaauuggcagaaccuaaagaagauuuuaaggggcaaaaguaauuacaauaa

SEQ ID NO: 38624 - RNA, 64 nt, hsa
cuggaggauuuuagucuuucuuacacauaugugugauuuuaaacgaauauucucagaccacagg

SEQ ID NO: 38625 - RNA, 64 nt, hsa
guaguaucuccuucugacaagcauucccuauugggauuuuaaagcuaugugcacagaauauuag

SEQ ID NO: 38626 - RNA, 64 nt, hsa
uuacuuuuguguuugggggaaaauacgagggauugauuuuaaauaaaaaacauuccaucuuuca

SEQ ID NO: 38627 - RNA, 64 nt, hsa
uuaaaaaggauucuuuauacauaugugcugaauugauuuuaagaaaguugcaugauccuguagg

SEQ ID NO: 38628 - RNA, 64 nt, hsa
aaugcuaacuuuauaguauuucuaauuguucaaggauuuuaaaauucuauuucagggaguauau

SEQ ID NO: 38629 - RNA, 64 nt, hsa
uauauugaaagaaauaggccagcagagacuuagggauuuuaaauuggcuugcuuuuuagcuguu

SEQ ID NO: 38630 - RNA, 64 nt, hsa
uuaagauugcagaaugauagugauuauucaauuagauuuuaaguaaggauugugauauuagagg

SEQ ID NO: 38631 - RNA, 64 nt, hsa
uuacuagcgaggucaguguuaggcuugcaauagggauuuuaaaauacacuaacuaguuccuuag

SEQ ID NO: 38632 - RNA, 64 nt, hsa
aucagaagugaugauuaucauaugauaccucagugauuuuaaaagccauagaagaaacuugacu

SEQ ID NO: 38633 - RNA, 64 nt, hsa
caaaaucuauuuagguucucuguguaugaauccugauuuuaacugcuaggauucagcuaaauuu

SEQ ID NO: 38634 - RNA, 64 nt, hsa
acguuuacuccuuucuagaugaaaaccaagcacagauuuuaaaacuucuaagauuauucuccuc

SEQ ID NO: 38635 - RNA, 64 nt, hsa
uauuucuuuuaaaaguauguuuuggaaaaucaaugauuuuaaugcauagcaguauguuugaaaa

SEQ ID NO: 38636 - RNA, 64 nt, hsa
uugggcauuccaaaauacagccuuugguucaguagauuuuaaugcuuuaaauagacugacgucg

SEQ ID NO: 38637 - RNA, 62 nt, hsa
cccucaagcuccuuaagugaauugccguaacugauuuuaaaggguuuagauuuuaagaaugg

SEQ ID NO: 38638 - RNA, 64 nt, hsa
aagugaauugccguaacugauuuuaaaggguuuagauuuuaagaauggugcucuuucaugccua

SEQ ID NO: 38639 - RNA, 64 nt, hsa
cggaggcaaucccggaaaccucuuuuauaagugugauuuuaaaaauguggauuaaacucucgau

SEQ ID NO: 38640 - RNA, 64 nt, hsa
gcauuaauauuauuagcaugaaauuuuuacuucagauuuuaagcucaugaauaaagauauaucu

SEQ ID NO: 38641 - RNA, 64 nt, hsa
cuuuucuacugaaucuauauuuccauuuguaagugauuuuaaguuaacauaugaaggcagggaa

SEQ ID NO: 38642 - RNA, 64 nt, hsa
uacauuuauuuaucuguuguacagauuugauuaugauuuuaauguuugaaagauugcacuuguu

SEQ ID NO: 38643 - RNA, 64 nt, hsa
cauaucugauuaacauuuuuaauaacuuagaggagauuuuaacuuuauuuaaaaauagguaaaa

SEQ ID NO: 38644 - RNA, 64 nt, hsa
ucugauuuuucagaauauuugcaauaagagucuggauuuuaaaaaacacaugcauacacacaau

SEQ ID NO: 38645 - RNA, 64 nt, hsa
ggggaacuuuuuugcccaugugucuuuuaagugugauuuuaaaaaaaugagugguucaguucau

SEQ ID NO: 38646 - RNA, 64 nt, hsa
cuggacagucagaaccacaggucugcuguuaagggauuuuaaauugugcauuuuuaacccuaca

SEQ ID NO: 38647 - RNA, 64 nt, hsa
uugagauuaaugugcuuaaaaguccuacgugacugauuuuaaacauugugauaaaauuaauuuu

SEQ ID NO: 38648 - RNA, 64 nt, hsa
uuugcagcuacauuugaaagugauagaauaaagagauuuuaaugaguuaucacuuuuucagcug

SEQ ID NO: 38649 - RNA, 64 nt, hsa
ccuuaugauguacuuuguaaaaaaauugauugaagauuuuaaauaaacaggaaauuagaagugu

SEQ ID NO: 38650 - RNA, 64 nt, hsa
uaaaaaccaggaaauuucuacaaucauggagacagauuuuaauuugcaugcucuccuuuauuua

SEQ ID NO: 38651 - RNA, 64 nt, hsa
uuaagggaagaguuauuuaauauaaauagucucugauuuuaaguucuguuuaauguucauucuc

SEQ ID NO: 38652 - RNA, 64 nt, hsa
cuccaauauuaccaggcccaacucagucuucagugauuuuaaacagcauugacaucaucuguaa

SEQ ID NO: 38653 - RNA, 64 nt, hsa
uuuagguuauuuauacaaagggaauaaauaggcugauuuuaauuugguaaguugaucuuuuuau

SEQ ID NO: 38654 - RNA, 64 nt, hsa
augagaaaaggaaauuacaauaauaaaguuuuaugauuuuaaauaagucauauguuuguauccu

SEQ ID NO: 38655 - RNA, 64 nt, hsa
auagaugauccacugaaaucuuuuccagcucuaagauuuuaaauuguccuuuuagauuagacuu

SEQ ID NO: 38656 - RNA, 64 nt, hsa
gccacuuauugaugacagaauuucuggauaguaggauuuuaauaggcgagcaaauaaaauucaa

SEQ ID NO: 38657 - RNA, 64 nt, hsa
gccaaagucaauaauugggacaaaugguaaagaugauuuuaaaaucuguuguauuuaggucccu

SEQ ID NO: 38658 - RNA, 64 nt, hsa
ugaaccaaaaucuucccaggaauaguacuuaauagauuuuaauguuaauuuauauucauuguag

SEQ ID NO: 38659 - RNA, 64 nt, hsa
uuccaaaggcucuacuuucaaagguuaagaaugagauuuuaaaauuggauuuuugccuggacuu

SEQ ID NO: 38660 - RNA, 64 nt, hsa
gagaauaaagcgcuagcaagauacaucacuuacugauuuuaaaaauacagaaagauuuugagua

SEQ ID NO: 38661 - RNA, 64 nt, hsa
auuaaauaugcacaauauuccauagcucacugaggauuuuaaaauuauaagcauaggauuuuau

SEQ ID NO: 38662 - RNA, 64 nt, hsa
ggucaagauuauuuuuagagguuauuuuauuggggauuuuaagaacuaauaacaucuugaguua

SEQ ID NO: 38663 - RNA, 64 nt, hsa
uugaaugguuuaacaaaagauuuguuuuuguagagauuuuaaagggggagaauucuagaaauaa

SEQ ID NO: 38664 - RNA, 64 nt, hsa
uuacaugcuacuaaauuuuuauaauaauugaaaagauuuuaacaaguauaaaaaauucucauag

SEQ ID NO: 38665 - RNA, 64 nt, hsa
aucuuuuucaugaaugauuuuaaagaaaaauuuggauuuuaaagguauuaaaauauuuuuguuu

SEQ ID NO: 38666 - RNA, 64 nt, hsa
uguuaauucugacuugagaaucuuuuucaugaaugauuuuaaagaaaaauuuggauuuuaaagg

SEQ ID NO: 38667 - RNA, 64 nt, hsa
uacguuuuugugcaaaaauaaaugaauggcaauagauuuuaaaaaaucuuauuauguacuucug

SEQ ID NO: 38668 - RNA, 64 nt, hsa
ccacccagcaguagguuuuguuaacaacaaacuggauuuuaaaaguucugccauguuaaguggc

SEQ ID NO: 38669 - RNA, 64 nt, hsa
guuaaaaagaaaauuauugcauuugaucuggauggauuuuaaaagaauauaauguucaauauua

SEQ ID NO: 38670 - RNA, 64 nt, hsa
gagguugucuaaaagucuuuuuaauuaauagaaagauuuuaauauccaagaguagucaaauuaa

SEQ ID NO: 38671 - RNA, 64 nt, hsa
acccaggguccuacagauagauauggugugcccagauuuuaaaaauaccuucaaaaauaaaaaa

SEQ ID NO: 38672 - RNA, 64 nt, hsa
ugugccaaacuuuccaggguuuuguagucaccuagauuuuaagcugauagcauagugcuucagc

SEQ ID NO: 38673 - RNA, 64 nt, hsa
uuguacauacuacuuuauaaaaauucucaccuuugauuuuaaaucccaguaccuaguuauaucu

SEQ ID NO: 38674 - RNA, 64 nt, hsa
aaucaaaagacaguuuuaggaagucuuauuuauugauuuuaaaaguuuuacauguaggagugug

SEQ ID NO: 38675 - RNA, 64 nt, hsa
auagaacacuucagacacaggaaaaauaaacguggauuuuaaaaaaucaaucaauggugcaaaa

SEQ ID NO: 38676 - RNA, 64 nt, hsa
auucccaugagaaauguugaauuuaugaagaauagauuuuaaggcuuugaaaaugguuaauuuc

SEQ ID NO: 38677 - RNA, 64 nt, hsa
cugcucccaggggccuagguagcugccaguccgugauuuuaauugcugucuugaaguuaacaag

SEQ ID NO: 38678 - RNA, 64 nt, hsa
aucuagcaauucacaaaaaugcccuagaaauauagauuuuaaucaccauuacauaaugacaaac

SEQ ID NO: 38679 - RNA, 64 nt, hsa
ucaccauuucagacagacuucugacuuagauacugauuuuaaugccaguaucugcucuaaauau

SEQ ID NO: 38680 - RNA, 64 nt, hsa
gcauuguaaaaguuccauuccaacugccaguguagauuuuaaaaguguuaaauagugacucccu

SEQ ID NO: 38681 - RNA, 64 nt, hsa
gggggacaaggucaguauuuaccaaaguguaucugauuuuaaaaauuccuuuagucuguaaaac

SEQ ID NO: 38682 - RNA, 64 nt, hsa
cuccuuagagcucugaaggggucuccuaguuccagauuuuaauuuggggaacagaucuggguuc

SEQ ID NO: 38683 - RNA, 64 nt, hsa
ggguauuuuaagugaugucauuugagcaggacuggauuuuaagccgaagggcaauaucuacgug

SEQ ID NO: 38684 - RNA, 64 nt, hsa
uuaaaaaaacgagcaauuugaagagaaucuuuuggauuuuaagcaguccgaaauaauagcaauu

SEQ ID NO: 38685 - RNA, 64 nt, hsa
aacaguaucaaaagaagaaucggaagaugcuugugauuuuaauauuauuugucaucaucauugu

SEQ ID NO: 38686 - RNA, 64 nt, hsa
ugagagucacugcagguguucuuucaucccaucugauuuuaacccaugguugagacguuccaag

SEQ ID NO: 38687 - RNA, 64 nt, hsa
ggcaccgcagugccagagaagaugcuugagguuagauuuuaaggaguggggaauugugaagccc

SEQ ID NO: 38688 - RNA, 64 nt, hsa
uuguccacguuguuucacaucugguuagggggcagauuuuaaaauguaguuuuguaauguuaca

SEQ ID NO: 38689 - RNA, 64 nt, hsa
uuuugaucuaaacauagguucugcauaucuguuagauuuuaaaaaugacugguguuuugucuuc

SEQ ID NO: 38690 - RNA, 64 nt, hsa
caaaaaacaaagcuaaccauauggcacuaauuuugauuuuaacauuaguguaacaaauaagguc

SEQ ID NO: 38691 - RNA, 64 nt, hsa
agcuuguccugucaacuaugaaauauggugacuagauuuuaauucauaaccguaaaguuuuuua

SEQ ID NO: 38692 - RNA, 64 nt, hsa
caaggacaucagagugaagugucaguugucagaugauuuuaaaaguuaugucuucagagaaaaa

SEQ ID NO: 38693 - RNA, 64 nt, hsa
uuaggcgcacauggaaaugagagcccggcgcauggauuuuaauguuuuucuaacaacuguggag

SEQ ID NO: 38694 - RNA, 64 nt, hsa
aaagaaaauauuuucaauauauauaccuggaacagauuuuaauaauuaucagaguaauaccauu

SEQ ID NO: 38695 - RNA, 64 nt, hsa
agcccugaacaacagcauuugacaguguccuuuagauuuuaauuuuuucaauggauugcuuuaa

SEQ ID NO: 38696 - RNA, 64 nt, hsa
cacguuaaaaucugcaaaugguuuuuacaccucugauuuuaacaugaacuuauacuaauguuug

SEQ ID NO: 38697 - RNA, 64 nt, hsa
auggaaacacauugcucuacccugcuacuuaguugauuuuaaagugaauuuacagugaugagaa

SEQ ID NO: 38698 - RNA, 64 nt, hsa
ucugaaaccagguagaaggaagccuagauuguaagauuuuaaacauuuguaauaguucuauaaa

SEQ ID NO: 38699 - RNA, 64 nt, hsa
ccaauaugugauuuuuuuucccauuuagaauggugauuuuaaaugugugagugcauguacuauc

SEQ ID NO: 38700 - RNA, 64 nt, hsa
uuaaacucugaauuuaucuuugauaacagggauugauuuuaaaauguacauguauuaaauuaca

SEQ ID NO: 38701 - RNA, 64 nt, hsa
uuguuuuucuuugaaguuuuauacacuggauuuguuaggggaaugaaauuuucucaucuaaaau

SEQ ID NO: 38702 - RNA, 64 nt, hsa
guguguauguauguguguggugugugugcuugguuuaggggaaguauguguggguacaugugag

SEQ ID NO: 38703 - RNA, 64 nt, hsa
cccugggaucaaguaggaaaaugggcagaacugcuuaggggaaugaaauugccauuuuucgggu

SEQ ID NO: 38704 - RNA, 64 nt, hsa
cccacacaggucuccgugcgugaaccaggucugcuuaggggaccugcgugcaggugaggagaga

SEQ ID NO: 38705 - RNA, 64 nt, hsa
agcugcauuuaaaucaagucccaaauucauugacuuaggggaguucaguauuuaaugaaacccu

SEQ ID NO: 38706 - RNA, 64 nt, hsa
cuuuccaguuuccaagucuuuuccuagcaguaauuuaggggagacagaggaguuucauguaaag

SEQ ID NO: 38707 - RNA, 64 nt, hsa
uggaagcuucagggccuugcugcuggggucauuuuuaggggaaaaaggaggauaugauggucac

SEQ ID NO: 38708 - RNA, 64 nt, hsa
ucaaucucccaucugugaaauaaggacuccaccuuuaggggacccuccauguuugcuggguauu

SEQ ID NO: 38709 - RNA, 64 nt, hsa
ggcguaagaugaaguggcccuccacaaaggcugguuaggggacaguucuuucucuaacauaguu

SEQ ID NO: 38710 - RNA, 64 nt, hsa
caucucuaaaaaauaaaauauaagaaaauaaaacuuaggggauauacagauuuaaauauucaaa

SEQ ID NO: 38711 - RNA, 64 nt, hsa
ugauuuuauuuuuacaacuaacauccauuccccuucauuuaaacaccuuuuguguuuuacuuca

SEQ ID NO: 38712 - RNA, 64 nt, hsa
guauuuuuucaugaacauuuugauacaaauuucaucauuuaaugauucaccaauuucuugcauu

SEQ ID NO: 38713 - RNA, 64 nt, hsa
auguuucacucaugucugucauuuuauaagcauaucauuuaaaaagcuucuaaaaagcuauuuc

SEQ ID NO: 38714 - RNA, 64 nt, hsa
agaugaaaauauauuucccuguaagcugaauuacucauuuaaaaauuuuaacuucuauauggga

SEQ ID NO: 38715 - RNA, 64 nt, hsa
ggugagacagagacaaaugaaccccccucuaaagucauuuaacuaauagccagcacaucccuuc

SEQ ID NO: 38716 - RNA, 64 nt, hsa
agacaaccaaaggaaaauggggaggcuugggauuucauuuaaauaaucuaagccaagaugauaa

SEQ ID NO: 38717 - RNA, 64 nt, hsa
ugaaugcuuacuaugugccagguacuacauccugucauuuaaucuuaaccuagucugggagaug

SEQ ID NO: 38718 - RNA, 64 nt, hsa
cuuuauaaagaauuugagguuaagauaaaaggacucauuuaagcucacauggucaguagguggc

SEQ ID NO: 38719 - RNA, 64 nt, hsa
ucaaauugcucuaucugggcugauagacauuucgucauuuaaguaagggaucgaagacauuuca

SEQ ID NO: 38720 - RNA, 64 nt, hsa
uauccaauuuacagauaguaugauauacauuucaucauuuaaguaagggaucgaaaacauuuca

SEQ ID NO: 38721 - RNA, 64 nt, hsa
agcacgucagcaagagccucuuugucucacuccaucauuuaaaaccaguauauucaguaguuga

SEQ ID NO: 38722 - RNA, 64 nt, hsa
aagauuugugaagacaucagauaggaauuuugacucauuuaaacuuugaugcuuaguuauguug

SEQ ID NO: 38723 - RNA, 64 nt, hsa
uauuuuuaccguaacuauuucguuuaaauuuguuucauuuaaguuuccuacacgcuaacuucgu

SEQ ID NO: 38724 - RNA, 64 nt, hsa
uuuuuucuggccuuuacaacagaauggaagagaaucauuuaagaguuccuguaacaguuaugca

SEQ ID NO: 38725 - RNA, 64 nt, hsa
cugcuggccauggaagccucuuaacaacacacugucauuuaaggcugugcuugugcuuuauaca

SEQ ID NO: 38726 - RNA, 64 nt, hsa
ccugcacuuuauguaagaauguaaaccuggagucucauuuaagaaugaucagcaauacguuuag

SEQ ID NO: 38727 - RNA, 64 nt, hsa
ucaucaaugaaaaacccauauguaauaaucgaauucauuuaacaugaaucuugaguacguggac

SEQ ID NO: 38728 - RNA, 64 nt, hsa
uuugaaggugccauucuuaugagccaaaaguuugucauuuaaaaguucauuuugagggaauaac

SEQ ID NO: 38729 - RNA, 64 nt, hsa
cuacaguacaugcugaagcgugccguuucagcccucauuuaauucaauuuguaaguagcgcagc

SEQ ID NO: 38730 - RNA, 64 nt, hsa
ccucccuccaccccaggacgccacucauuucaucucauuuaagggaaaaauauauaucuaucua

SEQ ID NO: 38731 - RNA, 64 nt, hsa
uagucugccaucuuuaaaaaaaaauacaguauuuucauuuaaauucucugauggagggacaaca

SEQ ID NO: 38732 - RNA, 64 nt, hsa
aguuauucucuuuuucaucuggggauuuaccuguucauuuaaucugccuguuuugaucuguuuu

SEQ ID NO: 38733 - RNA, 64 nt, hsa
cauuaauaaugguguacuuuaaaaaauauauguuucauuuaaucuucacaaaagaucuguagag

SEQ ID NO: 38734 - RNA, 64 nt, hsa
uuggaucacuuacauccaauauauguauauuuugucauuuaaaucagaacaaccacuugaaauu

SEQ ID NO: 38735 - RNA, 64 nt, hsa
cauuuugucacucaguuauuuaacuguguuuagcucauuuaaaucaaaauguguacuuuaaucu

SEQ ID NO: 38736 - RNA, 64 nt, hsa
augaauauuugaucuucuugagauuuucauacuaucauuuaaccaccaggaagcugaagugugu

SEQ ID NO: 38737 - RNA, 64 nt, hsa
cuugcugcguucuguuugcugagguugggcuuauucauuuaacacauaccaaccauuauccaga

SEQ ID NO: 38738 - RNA, 64 nt, hsa
uaagaguuuaaaaguuuagcuuauugaguaguugucauuuaaaauauaauugcgaauaucagaa

SEQ ID NO: 38739 - RNA, 64 nt, hsa
uaggaaaugaaaguagcgucuuuuaaauugcuauucauuuaauauaccuguuuucccaucuuuu

SEQ ID NO: 38740 - RNA, 64 nt, hsa
uauuuacaguaucagccuuugauuauagaugugaucauuuaaaauuugauaaugacuuuaguga

SEQ ID NO: 38741 - RNA, 64 nt, hsa
uacaguuuuucuuuugaucgugcacuuauagucuucauuuaauuccucauagaaucccagucac

SEQ ID NO: 38742 - RNA, 64 nt, hsa
aauacaucuacccacuccauuauuuuuuaaaacuucauuuaauaguuuaaacaagauugguuuu

SEQ ID NO: 38743 - RNA, 64 nt, hsa
cagaauuauuguuacucauauuuuaaucaguaagucauuuaagcuaugacagaguaggaauuga

SEQ ID NO: 38744 - RNA, 64 nt, hsa
uuuuguuucagucauuuaaaauuuaaauuuucagucauuuaaaauuuuaaaaauuuaaaauuuc

SEQ ID NO: 38745 - RNA, 64 nt, hsa
aauuuugaauaauaauguuuaaauuuuguuucagucauuuaaaauuuaaauuuucagucauuua

SEQ ID NO: 38746 - RNA, 64 nt, hsa
uggacugaaaagcaaauuuauucuuucgaagauuucauuuaaaucucuguacuaugcauuuuug

SEQ ID NO: 38747 - RNA, 64 nt, hsa
uauagacuugcugaguuuggcauagauagugcacucauuuaaucugugccucucaaaacuucag

SEQ ID NO: 38748 - RNA, 64 nt, hsa
aguuaaaaucauaacuuaauuucauuaacuuuuaucauuuaacucucucauguuuguuguaacc

SEQ ID NO: 38749 - RNA, 64 nt, hsa
aaaaagcaaauagcauugacacauuuaaagcuuuucauuuaaaguaguggauguuuuugaagua

SEQ ID NO: 38750 - RNA, 64 nt, hsa
auacagucauuuaugccuaaagccuggugauuauucauuuaaaugaagaucacauuucauauca

SEQ ID NO: 38751 - RNA, 64 nt, hsa
uuccaauugaauuaaaguguggccucguuuuuagucauuuaaaauuguuuucuaaguaauugcu

SEQ ID NO: 38752 - RNA, 64 nt, hsa
caacuugcacaauguugaacauagccuuuaagcaucauuuaaauuuuaaaggaauggaguuuuu

SEQ ID NO: 38753 - RNA, 64 nt, hsa
gcuuauuuucuuuuaaugugcaaugauggcuggaucauuuaaaguucuuuuuagaaaauaacau

SEQ ID NO: 38754 - RNA, 64 nt, hsa
agggaaguggaacuuugguaaaugacuguuugccucauuuaauaguauacaggcucagcccaua

SEQ ID NO: 38755 - RNA, 64 nt, hsa
gccuucuuaauggagauauucaguuuucuuuuuuucauuuaaacaaagaaaaaaaauguaucua

SEQ ID NO: 38756 - RNA, 64 nt, hsa
gcaaagacaggaucauacacaugacuuauaccucucauuuaaauauuuuauaguauaaaguauu

SEQ ID NO: 38757 - RNA, 64 nt, hsa
auaauuuuaauaaaagugaaccagaacaaaucacucauuuaaaaaguaauucagaagaacagug

SEQ ID NO: 38758 - RNA, 64 nt, hsa
caaaaccaaaaaaaccaaggugcaucauuaauauucauuuaauucaaauaccaaauaguuuaca

SEQ ID NO: 38759 - RNA, 64 nt, hsa
uuuuuccauauucugauuuuuaacagaaaagcacucauuuaauagauguagggaaacuagauau

SEQ ID NO: 38760 - RNA, 64 nt, hsa
acuuuuauaaugcauuuuacucccaguauuauguucauuuaauaaauuauuuuuucacuacaac

SEQ ID NO: 38761 - RNA, 64 nt, hsa
uauucuagacuuacaaaaggcuuaaaaagaacaaucauuuaaucaguaccauucuguaucuuau

SEQ ID NO: 38762 - RNA, 64 nt, hsa
aaauuaagauauguauuuguaaguuauugguggcucauuuaaacuguaucauacaguaaugcca

SEQ ID NO: 38763 - RNA, 64 nt, hsa
uucaaauuuagcauuauuuugacacuuuuaauuuucauuuaacaauggauuagaaaaauauuuu

SEQ ID NO: 38764 - RNA, 64 nt, hsa
gauucugagauuaaaaaaaauuuuuaaagagugaucauuuaaauaauuucuaaaagggucuuuu

SEQ ID NO: 38765 - RNA, 64 nt, hsa
acuagucucagggcuuguguaauauucugggaggucauuuaaaugccagaaauggucaagcaau

SEQ ID NO: 38766 - RNA, 64 nt, hsa
agcauuuuuaaaaacgaauuguaguuguuuuucuucauuuaaaauggaucuguuggagguuaug

SEQ ID NO: 38767 - RNA, 64 nt, hsa
ucauauauauuuucuguauuaagcucauuuggcuucauuuaagcuguauacuuagucauauauc

SEQ ID NO: 38768 - RNA, 64 nt, hsa
ccaggucccacgcuggauauuuucacaccuuaccucauuuaauacaacaagcaaggagguagac

SEQ ID NO: 38769 - RNA, 64 nt, hsa
cucugugcuaggcacagacuuucuagggauuauuucauuuaauucucauggcaaccaccaugca

SEQ ID NO: 38770 - RNA, 64 nt, hsa
ccaagucccugucucuuucagacacagacaagcuucauuuaaauuauuucaucugaucauuauc

SEQ ID NO: 38771 - RNA, 64 nt, hsa
uaggaaauuuaaagcugcauggucugucuuguuuucauuuaauuauugugaauaccuagaaucu

SEQ ID NO: 38772 - RNA, 64 nt, hsa
gaugggagccuuuaucugucauuagaaaucuuucucauuuaagaacuuaugaauaugcugaaga

SEQ ID NO: 38773 - RNA, 64 nt, hsa
gugucuuacuuguacuguaucacauuccauacccucauuuaauucuuaauaaaacuguucacuu

SEQ ID NO: 38774 - RNA, 64 nt, hsa
uuuguauuggggauauguuuuacauaaauagaacucauuuaaaaguaugguucaaguacugcuc

SEQ ID NO: 38775 - RNA, 64 nt, hsa
ggacuaucaagagugaccuuugaagcaagcuaaaucauuuaaauguuuaaauugaaaaugggcc

SEQ ID NO: 38776 - RNA, 64 nt, hsa
uccccaggggaaaaugaagguuaggauuuaacagucauuuaaaaaaaaaauuuguuuugacgga

SEQ ID NO: 38777 - RNA, 64 nt, hsa
aaaaaaaauuuguuuugacggaugauuggauuauucauuuaaaaugauuagaaggcaaguuucu

SEQ ID NO: 38778 - RNA, 64 nt, hsa
acaauaugguauaacaacaagugaauuugaagacucauuuaaaauauuguguuauuuauaaagu

SEQ ID NO: 38779 - RNA, 64 nt, hsa
aagguuaaacuuauggcuauuuuuaaagggcuauucauuuaaucugaguuuucccuuauuuuca

SEQ ID NO: 38780 - RNA, 64 nt, hsa
auuuucuuuauuguguuggugcaauauuuuauuaucauuuaaccucaggauauucagaccaaca

SEQ ID NO: 38781 - RNA, 64 nt, hsa
aaacccuggugcuuccccugcagaauacuguacuucauuuaacagaaugauugauuuuucuuuc

SEQ ID NO: 38782 - RNA, 64 nt, hsa
ugaauguauuauucaggaagaauacugagugccuucauuuaacuaaaguugaauguaaaaguca

SEQ ID NO: 38783 - RNA, 64 nt, hsa
uuagaauuauaaauuguuaaaaccuugauaauugucauuuaauuauauuucagguguccugaac

SEQ ID NO: 38784 - RNA, 64 nt, hsa
aaaugaaaguguucauccagauuucauacuuuacucauuuaacaaauuaucuuuaguuaauugc

SEQ ID NO: 38785 - RNA, 64 nt, hsa
uauacagagaaacuauaagcaauuaugugggaaaucauuuaauaauauuaaaucuuagaaguua

SEQ ID NO: 38786 - RNA, 64 nt, hsa
uaaaauggccaaauauauaccgugaaaauugguuucauuuaacaaaagaucagaucccuccuuc

SEQ ID NO: 38787 - RNA, 64 nt, hsa
cuucacuuuacugcauaggaaacaaucuaccucaucauuuaaaaugacaugggugucgguuuug

SEQ ID NO: 38788 - RNA, 64 nt, hsa
agauaacuuucuggcauuuagaauuuuguuccauucauuuaauuuguucaucugagaauuuuuu

SEQ ID NO: 38789 - RNA, 64 nt, hsa
cuguuguguuuauguagaaaauucacaaaucuguucauuuaauuuuuuaauuugagaauuuuua

SEQ ID NO: 38790 - RNA, 64 nt, hsa
aacuaauguuuuuaagguuuuuaggaaaaucaggucauuuaagaaauuguuuuguaguuucugg

SEQ ID NO: 38791 - RNA, 64 nt, hsa
ucuuugguauuucauauaggaauuauuuuuuuuuucauuuaaaacaaauccacaucuuuuguaa

SEQ ID NO: 38792 - RNA, 64 nt, hsa
uagcaagcacuugauaaaagcaauggcaagugcucuccaauaaaguagggggagaaagcaaacc

SEQ ID NO: 38793 - RNA, 64 nt, hsa
ccacugcacuccggccuaggcaacgagagcaaaacuccaauacaaacaaacaaacaaacaccug

SEQ ID NO: 38794 - RNA, 64 nt, hsa
aaaguauacuuuuugcaguagaucaugcccugaccuccaauaaaaaccucuuuaaaacaaugcu

SEQ ID NO: 38795 - RNA, 64 nt, hsa
ccagcuccuuucuccugugaauggaggcagagaccuccaauaaagugccuucugggcuuuuucu

SEQ ID NO: 38796 - RNA, 64 nt, hsa
cccaccugcuggcccccuuguccuuccucacccccuccaauauagucucggagcuacaaccgca

SEQ ID NO: 38797 - RNA, 64 nt, hsa
gaaaagcaguuugugcuauacuuuucccccaacccuccaauaaaucuuaaauuuaaaaccuaca

SEQ ID NO: 38798 - RNA, 64 nt, hsa
cccauuuuccuuuuauaaaacauucuacccucaccuccaauauaaacacauuaaaagaguacaa

SEQ ID NO: 38799 - RNA, 64 nt, hsa
gagcaagaaacaaaaagaagccaaaagcagaaggcuccaauaugaacaagauaaaucuaucuuc

SEQ ID NO: 38800 - RNA, 50 nt, hsa
gcaauucuaggggcuuauagcuccaauaauggaauggugagugauuagag

SEQ ID NO: 38801 - RNA, 64 nt, hsa
accuccugucauuuuuguccugaugauguuucuucuccaauaucuucuuuuaccuaucaauauu

SEQ ID NO: 38802 - RNA, 64 nt, hsa
aguauccaaauccaaaaauccaaaauucaaaaugcuccaauaagcauuucccuugaguuucauu

SEQ ID NO: 38803 - RNA, 64 nt, hsa
guuuucccuuguuuuccucucauugcauguuucccuccaauauugguucauugucaucaaucau

SEQ ID NO: 38804 - RNA, 64 nt, hsa
uccgaucuggaacacauauuggaauuggggccaacuccaauauaggguggguaaggccuuauaa

SEQ ID NO: 38805 - RNA, 64 nt, hsa
uuuuccaauuuuaccuguauuaccaaacuggguucuccaauaauguccaaauuguaauguugcc

SEQ ID NO: 38806 - RNA, 64 nt, hsa
agaguccuuucuucucuacauccaggggccuuuucuccaauaaugugccuuuaacucuagggac

SEQ ID NO: 38807 - RNA, 51 nt, hsa
cagcucagcaagaagcuuaaucuccaauaaacaucuauguuaaauccaaau

SEQ ID NO: 38808 - RNA, 64 nt, hsa
aaucaauauacaggguaauagcuuuggcucagagcuccaauaaugugcuucagaucuguccaug

SEQ ID NO: 38809 - RNA, 64 nt, hsa
cauuuaaaaaaauaacaaacauuuuuuaaaaggccuccaauacucuuauggagccuggauuuuu

SEQ ID NO: 38810 - RNA, 64 nt, hsa
ucuaggguggguuuacagcuuuuuguacuuuuaccuccaauaaagggaaaaugaagcuuuuuau

SEQ ID NO: 38811 - RNA, 64 nt, hsa
cccccuuuuuaaaaacaccuuuagagccuaauuacuccaauaaaaguaacuagagguuuggagu

SEQ ID NO: 38812 - RNA, 64 nt, hsa
ccuaacaaaaccagugauuuugauagaaauauuucuccaauauacuugcauccaccuacaaaua

SEQ ID NO: 38813 - RNA, 64 nt, hsa
ugcuuaucuguuacggccuccuuuuaucucucuucuccaauauuaaaaaaaauggaaaucaaau

SEQ ID NO: 38814 - RNA, 64 nt, hsa
aauaggagacaaaggagagugauugauuuucuuccuccaauaguugguuucaaauccuuuugaa

SEQ ID NO: 38815 - RNA, 64 nt, hsa
uuaagcuaaaugguauuuucauuuuucucaagcucuccaauaaauaugaccaccaagaugcaga

SEQ ID NO: 38816 - RNA, 64 nt, hsa
uagcugauauugacauaucugaggagggaggaggcuccaauacgacuacucccaauucacaggg

SEQ ID NO: 38817 - RNA, 64 nt, hsa
cugccucaguccugcaaccuaaagcuguagucgccuccaauagccauccaugccaucccugccu

SEQ ID NO: 38818 - RNA, 64 nt, hsa
uugcugaaugcuuaauuuauuuuuuacugugccacuccaauauuuaucaaauccaaauagcaug

SEQ ID NO: 38819 - RNA, 64 nt, hsa
caaaaguggccaugucgacauuuguccacccacccuccaauaagcuggagcgacaaagggacau

SEQ ID NO: 38820 - RNA, 61 nt, hsa
cuccacugagccacauuuaaggccacagaggcuccaauaccugggaauguucacaaaguca

SEQ ID NO: 38821 - RNA, 64 nt, hsa
ucggacugacuuuauucauauuuccaucaaacuucuccaauacaguaagagauaguguugaacc

SEQ ID NO: 38822 - RNA, 64 nt, hsa
caucaucauugccugcugaugugccacgaugcugcuccaauagacagcaauaagauugucucua

SEQ ID NO: 38823 - RNA, 64 nt, hsa
acgcuaagacacaggcuccaguaggggcuguugccuccaauaaagcagcagugagcuuugccuu

SEQ ID NO: 38824 - RNA, 64 nt, hsa
aaaaaccuguaucugacccacuuuguaauuuuugcuccaauauccauucuguagacuuuugaaa

SEQ ID NO: 38825 - RNA, 64 nt, hsa
caauaugaauuuguguguuaugaauuucugauuucuccaauaguauaugccacuauauaaauuu

SEQ ID NO: 38826 - RNA, 64 nt, hsa
uguacuuucacuuuugcugcuucacugccuugugcuccaauaaauccacuccuucaccacccau

SEQ ID NO: 38827 - RNA, 64 nt, hsa
caaggggugacacaaaguagcaaacugaauacuucuccaauagcaaccccaagcuaccuccuca

SEQ ID NO: 38828 - RNA, 64 nt, hsa
guaucccauaugguaucucuugcucuuccuucaacuccaauaaauuuaaugacuaaaugccaag

SEQ ID NO: 38829 - RNA, 64 nt, hsa
aaaaauuguccacugacauuugggauuuacuuuucuccaauaccugccaauacagaaaacuauu

SEQ ID NO: 38830 - RNA, 64 nt, hsa
cagucaagugaaaaauuaacauguggacuggacacuccaauaaauuauauaccugccuaaguug

SEQ ID NO: 38831 - RNA, 64 nt, hsa
cugauauggaagcacccauuaugcgcuguggccacuccaauaggugcugaguguacagagugga

SEQ ID NO: 38832 - RNA, 64 nt, hsa
accuccaucuuuauauucuucuguuauacuauuccuccaauaaagugauuuguagaaaaaaaug

SEQ ID NO: 38833 - RNA, 64 nt, hsa
ggcagggacgagggaaggaaaguaacuccugacucuccaauaaaaaccuguccaaccuguggca

SEQ ID NO: 38834 - RNA, 64 nt, hsa
aaccuaugcugaaaauacgauaaaagaaaaacaacuccaauaugcuaaaaguuaaauaugguau

SEQ ID NO: 38835 - RNA, 64 nt, hsa
ucuaguuagcaaucuuaaggcucuuuaagguuuucuccaauauuaaaaaauaucaccaaagaag

SEQ ID NO: 38836 - RNA, 64 nt, hsa
gguaagaauauucagcuggucuggguccucaagacuccaauagacacucuuagagaaggauugc

SEQ ID NO: 38837 - RNA, 64 nt, hsa
aguagaaaugaaugcauuuauucauuccuuccuucuccaauaguguuuaaguacaaucuuuuua

SEQ ID NO: 38838 - RNA, 64 nt, hsa
cuacaaggacacccaaggggugucugagucagggcuccaauagugcaguuaucguggccucucg

SEQ ID NO: 38839 - RNA, 64 nt, hsa
acuuuccggagucuauuuuuguuaagacaaucaacuccaauaacugagcugaaguuuuuguuua

SEQ ID NO: 38840 - RNA, 64 nt, hsa
uuggaguaggggcagagggagggagccaaggucacuccaauaaaacaagcucauggcacggacu

SEQ ID NO: 38841 - RNA, 64 nt, hsa
ccuaaaugggccccugggugcccagccuccccuccuccaauacauucucugauaaucugaccuu

SEQ ID NO: 38842 - RNA, 64 nt, hsa
ccugggugucacccccuuacuuuaauucuugggccuccaauaagugucccauaggugucuggcc

SEQ ID NO: 38843 - RNA, 64 nt, hsa
agaaagguuccuguguauugcaagguacaauuuucuccaauaaaucaggagaacaggaguuuga

SEQ ID NO: 38844 - RNA, 64 nt, hsa
uaaacacuugauacuuuucacugauaauggaucgcuccaauaaacauauauugugaaaaugcau

SEQ ID NO: 38845 - RNA, 64 nt, hsa
cccugggcacagcagcggccgaggggauguccugcuccaauacccgcacugcucuggaguuugc

SEQ ID NO: 38846 - RNA, 64 nt, hsa
cuugagguuaggaaacagguuaaaacucagagaacuccaauaauaaugguuuaaaaacaucagg

SEQ ID NO: 38847 - RNA, 64 nt, hsa
agcauauuuuguggcauuugaacuauauuuacugcuccaauauccguuauuuuccaaaggauuu

SEQ ID NO: 38848 - RNA, 64 nt, hsa
aauaaaaacggaguugaucaagaaauuaucuuuccuccaauaaagacagguauguguuuacgca

SEQ ID NO: 38849 - RNA, 64 nt, hsa
ccuccuggaaaaugguguuggguuuggucuccagcuccaauacuuauuaaggcuguugcugcca

SEQ ID NO: 38850 - RNA, 64 nt, hsa
ccaucaguguauaaucucucucucacacgccucucuccaauagacagcuuguauuugcaguauu

SEQ ID NO: 38851 - RNA, 64 nt, hsa
gcacugagaccuccacccacuguggacuccaugccuccaauaaaagguaguucugggcccagcg

SEQ ID NO: 38852 - RNA, 64 nt, hsa
uucagucagauaaaccuaaacauuaaauaaauaucuccaauauuaggauggaauacauauguau

SEQ ID NO: 38853 - RNA, 64 nt, hsa
ucauucuacaugaacugagguaauauuaugguaacuccaauauuugguuaaaaaaacuauacaa

SEQ ID NO: 38854 - RNA, 64 nt, hsa
ugcuuagcaggaagcauaaggaaaagccaucggccuccaauacccaugaugacagagggagcac

SEQ ID NO: 38855 - RNA, 64 nt, hsa
cagaugagggcccugcccccgccccacugacuuccuccaauaaagucaugucugcccccaaccu

SEQ ID NO: 38856 - RNA, 64 nt, hsa
uccaguaagaaucacagugcugggaaucuaguugcuccaauaugaggcagcuucaugugcagcu

SEQ ID NO: 38857 - RNA, 64 nt, hsa
ggggcuccugauccgcauccaagcuuaaccaaggcuccaauaaacgugcuaggaagcaagcugc

SEQ ID NO: 38858 - RNA, 64 nt, hsa
guuguuagcauuuucaaugugauauaaacagcuucuccaauacagcaaaccuaauugcacaaca

SEQ ID NO: 38859 - RNA, 64 nt, hsa
ucuaccucaaauagccccaggagugggcuuuagucuccaauauggagcaucucaagcuucuccu

SEQ ID NO: 38860 - RNA, 64 nt, hsa
auguaacuucauuauuuuaaaaauauuuuuagaacuccaauacucacccuguuaugucuugcua

SEQ ID NO: 38861 - RNA, 64 nt, hsa
uuccauaguagagaaaacaucuuaagagagcaagcuccaauaugcaagagcuuaucgauccugu

SEQ ID NO: 38862 - RNA, 64 nt, hsa
agaaacuaugauguggagaaaggacuaacaucuccuccaauaaaccccaaaugguuaauccaac

SEQ ID NO: 38863 - RNA, 64 nt, hsa
ggacacgguuguggauccagagaagaggccuagucuccaauaaaucuuaggaauuuugcaggaa

SEQ ID NO: 38864 - RNA, 64 nt, hsa
agguagcauuuuugcugaaaucgggccugucacucuccaauaaagguucuggcacuucaaugcc

SEQ ID NO: 38865 - RNA, 64 nt, hsa
uaaauacaucacuguauaccgaucaggaaucuugcuccaauaaaggaacauaaagauuuuuuuu

SEQ ID NO: 38866 - RNA, 64 nt, hsa
cuggacccagcggcccagagucuagccagcuuggcuccaauaggagcucaguggcccuaaggag

SEQ ID NO: 38867 - RNA, 64 nt, hsa
gggcugcagaguuauaagccccaaacaggucaugcuccaauaaaaaugauucuaccuacaaccu

SEQ ID NO: 38868 - RNA, 64 nt, hsa
cgcggccccugauuucugcaugguguagaacuuucuccaauagucacauuggcaaagggagaac

SEQ ID NO: 38869 - RNA, 64 nt, hsa
uauguuauugugugaugcaguuuuuugcuucugucuccaauauuaaaccauuuuccuaauacuu

SEQ ID NO: 38870 - RNA, 64 nt, hsa
caucaccuugccacaguguccccggcuucuaagccuccaauaucacccugugagccucgcacag

SEQ ID NO: 38871 - RNA, 64 nt, hsa
cacuguccucuaaugccccacccaguggggaagucuccaauaggucccccugcuuauaacagcc

SEQ ID NO: 38872 - RNA, 64 nt, hsa
aaguguuuuaggaugaacuuuguuauaguuuuaacuccaauaaaguucaucaguuuaauugacu

SEQ ID NO: 38873 - RNA, 64 nt, hsa
acacugguuuacacuuuaugccggaugugcuuuucuccaauaucagugcucgagacacagugaa

SEQ ID NO: 38874 - RNA, 64 nt, hsa
agcgaucaguuguuccccuccuuccaaaaacagccuccaauaccacaaccugaaaagagccgaa

SEQ ID NO: 38875 - RNA, 64 nt, hsa
ucuacaucugcuucuccuguggcucugccaucagcuccaauaucaauaugaacucguauuggau

SEQ ID NO: 38876 - RNA, 64 nt, hsa
aguuggggauuaaaccauccuugccuucaguucucuccaauauuaccaggcccaacucagucuu

SEQ ID NO: 38877 - RNA, 64 nt, hsa
gcccagaagaauggucccagagaaagcagacuggcuccaauagauaucaggcagcaaucccaau

SEQ ID NO: 38878 - RNA, 64 nt, hsa
cagcugucucacguuguuuauucugcguccccuucuccaauaaaacaagccaguugggcguggu

SEQ ID NO: 38879 - RNA, 64 nt, hsa
ggaggauggcugcaaagaaguaugaggaaacuuucuccaauagaugagaauuuuccguaucuug

SEQ ID NO: 38880 - RNA, 64 nt, hsa
ccuuaagaccucagggggcgggugcuggggucuucuccaauaaauggggugucaaccuuaccca

SEQ ID NO: 38881 - RNA, 64 nt, hsa
gugcccuugccugccuucacccccaccaccacuucuccaauaaagccgccuggccuugucucug

SEQ ID NO: 38882 - RNA, 64 nt, hsa
ccuuccagugguuccccucaccuucugcagaagucuccaauauggaguacaugcacuugggcau

SEQ ID NO: 38883 - RNA, 64 nt, hsa
gucccggacgggaagcuggugaaagcuuccuuugcuccaauaagcuuugcaaucaaggccaaag

SEQ ID NO: 38884 - RNA, 64 nt, hsa
uauguccccauuugcuuugguuuuguccugccuucuccaauaucacgugcucaguuuugccucu

SEQ ID NO: 38885 - RNA, 64 nt, hsa
uaggguaugguaugugggacuucgcuguuuuuaucuccaauaaaaaaaaaaaaaagguuuguua

SEQ ID NO: 38886 - RNA, 64 nt, hsa
caucaccucuaucugccucaucucacacuguacucuccaauaaagcaccuuguugaaagaccuc

SEQ ID NO: 38887 - RNA, 64 nt, hsa
uuaguuuuuuuuuuucuuucaaccagugugccaucuccaauauuucuauaguauaccaaccacc

SEQ ID NO: 38888 - RNA, 64 nt, hsa
uauguugggaagcacaugcuugcucuaggaauaucuccaauaaagcuguuaacuauuuggugga

SEQ ID NO: 38889 - RNA, 64 nt, hsa
guuuccucucuuggagagccaaggauaagugacucuccaauagguucuucuauaccgauuucau

SEQ ID NO: 38890 - RNA, 64 nt, hsa
gcugaagcccaguuccuuucccauccauccccaacuccaauaaucccccacuccucgcaggucu

SEQ ID NO: 38891 - RNA, 64 nt, hsa
caaagauguaacaauuuuaaaauuuucuagauuacuccaauaaaguguuuuaaguuuuccuaug

SEQ ID NO: 38892 - RNA, 64 nt, hsa
gggaacugugcccaguauacuguuuuuuuucuuccuccaauaaaagugguguagugccgaaagu

SEQ ID NO: 38893 - RNA, 64 nt, hsa
uaugaucuccuugcaacucagugugaguugauuccuccaauaugggccagaugcuuuugaauga

SEQ ID NO: 38894 - RNA, 64 nt, hsa
gggagcaacccauggcucacaggucacuaagcgucuccaauaugacuauuaaaacugucaccuc

SEQ ID NO: 38895 - RNA, 64 nt, hsa
ccagaaaaguggcucucuuugguagggagaggggcuccaauauuucguucucuccccauggggc

SEQ ID NO: 38896 - RNA, 64 nt, hsa
cuccccucaggcuuuuuuugggugguccuccaaccuccaauacccaggccuggccucuucagag

SEQ ID NO: 38897 - RNA, 64 nt, hsa
ggggaaccuuccuuauccccugcccacauccccucuccaauaaagcaccugugcccucagcaau

SEQ ID NO: 38898 - RNA, 53 nt, hsa
aagucaaggaagaacuuuagcuucuccaauaccaggaaaaaagaugcuuauuu

SEQ ID NO: 38899 - RNA, 64 nt, hsa
uucacugaagauauuccaauuuccauacuauuuccuccaauagacccuuguugccuucucccuu

SEQ ID NO: 38900 - RNA, 64 nt, hsa
cuuuuaaaguucaugggugagggauaaaaugaggcuccaauacaugggaagcuuugcugaaaaa

SEQ ID NO: 38901 - RNA, 64 nt, hsa
cgacucagcaauacccgccccaccggcugugaugcuccaauaaacuuuuuuaugcuuuugcgga

SEQ ID NO: 38902 - RNA, 64 nt, hsa
gccaaacuccucugagaacagucagugcaagagacuccaauaauccauauugaaagagucagca

SEQ ID NO: 38903 - RNA, 64 nt, hsa
auauuugaccucaggcaccuguuucccccaccuacuccaauauuugcuggaggagcaaaugacc

SEQ ID NO: 38904 - RNA, 64 nt, hsa
cuccuccacuggguucagaggguaagaaagcacccuccaauaaacccaggcuccaggccguggg

SEQ ID NO: 38905 - RNA, 64 nt, hsa
ggggcaugaaugguuaacaaacaccagagcaguacuccaauauuggagagucgcugggggcaca

SEQ ID NO: 38906 - RNA, 64 nt, hsa
agucacuacuauaguggcuuaacauuuaaucugucuccaauauuuuaaccaagugacaccgagg

SEQ ID NO: 38907 - RNA, 64 nt, hsa
uauggaagugaguggacagccuuuguguguaucucuccaauaaagcucugugggccaaguccuc

SEQ ID NO: 38908 - RNA, 64 nt, hsa
aacguuuauagacauggaggcaggcaauaaauuccuccaauaauuuuuuuaucucuuuuguucu

SEQ ID NO: 38909 - RNA, 64 nt, hsa
cucugaugagggcgaauugcuaugacauuccaagcuccaauaaagacugucccagacuuuggcc

SEQ ID NO: 38910 - RNA, 64 nt, hsa
aagccccaugccgugcucauccuacccccaaucccuccaauaaaccugauucugcugcccagac

SEQ ID NO: 38911 - RNA, 64 nt, hsa
ugagucagaauuaaaggagggaauuguauugauacuccaauaccuaaauuucacaauaccacuu

SEQ ID NO: 38912 - RNA, 64 nt, hsa
aagcacucuucuaccaauguuugggugaccaccccuccaauaucccagaaugaauaagaacaau

SEQ ID NO: 38913 - RNA, 64 nt, hsa
uuuuuaaggcaaagcaagcuccccaaucccuguucuccaauauguguaugaugugacuuccaug

SEQ ID NO: 38914 - RNA, 64 nt, hsa
uccagucuuggccaucaaaucaaugauuuaaugacuccaauaauguguguguuuauaaccaucc

SEQ ID NO: 38915 - RNA, 64 nt, hsa
ggcaaccccuggauaugaauguuacccccuaagucuccaauauugcagguuucccuguauaacg

SEQ ID NO: 38916 - RNA, 64 nt, hsa
cgccaggucgguccucccugccaaccuuccccagcuccaauauguagcagucucucuggauggc

SEQ ID NO: 38917 - RNA, 64 nt, hsa
uacuggugccugaaacaccuggccugcuaggaggcuccaauaaagcuaacccggaccagaccug

SEQ ID NO: 38918 - RNA, 64 nt, hsa
gguaaaacaaaaagaaaaaaaaaaguucauacuucuccaauaaauaaagucucaccuguguccc

SEQ ID NO: 38919 - RNA, 64 nt, hsa
uacauuuuaugacuggaaacuuuuuuguacaacacuccaauaaacauuuugauuuuagguucug

SEQ ID NO: 38920 - RNA, 64 nt, hsa
ggagccacccccaaggacccugccagccacagaccuccaauaaagacagcauggaaacaaaguc

SEQ ID NO: 38921 - RNA, 64 nt, hsa
uacacuaaacaggugaaugcugacuuuuuucauucuccaauaaauuucacugaacugaaccugg

SEQ ID NO: 38922 - RNA, 64 nt, hsa
cccucuauauccccaagcccucaacugugagccacuccaauacccugccccucuuggcccccag

SEQ ID NO: 38923 - RNA, 64 nt, hsa
cugugguguauucugcguguccauggcggggguucuccaauacacucacacuguccauguucuu

SEQ ID NO: 38924 - RNA, 64 nt, hsa
uggcuaagauaccaaaaccacagugccgacagcucuccaauacucagguuaaugcugaaaaauc

SEQ ID NO: 38925 - RNA, 64 nt, hsa
gcagcguggacaucugucccagagggggcagaaucuccaauagaggacugagcacugcuucugg

SEQ ID NO: 38926 - RNA, 64 nt, hsa
uuacgagaaccucuucccccaauaguagacacaucuccaauacaaacacagguuuauaauaagu

SEQ ID NO: 38927 - RNA, 64 nt, hsa
ggcucacaggcugugccacccgucccuccgacagcuccaauacugugacccuccuuccucagga

SEQ ID NO: 38928 - RNA, 64 nt, hsa
ccaucucccagacccucuucccuuugcccuucuccuccaauacauaaaggacacagacaaggaa

SEQ ID NO: 38929 - RNA, 64 nt, hsa
cugugaagccaaacaauaugcuccugccuugcaccuccaauagguuuuauuauuuuuuuuaaau

SEQ ID NO: 38930 - RNA, 64 nt, hsa
ugcauccuuguccuugcaggugcuuuuuuagaugcuccaauaugucuucuuuuguuauuuucuu

SEQ ID NO: 38931 - RNA, 64 nt, hsa
cauguaccuuauaucccucucugaaacagaacagcuccaauagcaacaagcuaguuguucugcc

SEQ ID NO: 38932 - RNA, 64 nt, hsa
ggggaugaggcuuggcauaguccaaaauuuaagucuccaauaauuaauugcauuuuaaauuggc

SEQ ID NO: 38933 - RNA, 64 nt, hsa
ugaguguugccaccaacaggauuuuaucguuugacuccaauaccugaaauucugacuucucucc

SEQ ID NO: 38934 - RNA, 64 nt, hsa
uggcugucuacagacauuugaccaagacauacaucugauuuaccuuguguuuuuuuuuuuauug

SEQ ID NO: 38935 - RNA, 64 nt, hsa
uaucugccuuuuuaucuuugccaaaucuuuaccacugauuuaccauugccauaaaguagacugg

SEQ ID NO: 38936 - RNA, 64 nt, hsa
auaugaucuucuaaggagguugcauuauuuugaccugauuuauuuauuguacaagagcccaagu

SEQ ID NO: 38937 - RNA, 64 nt, hsa
cauucuuauaguuuguuugucacugagacggugccugauuuaauauauuuaagcugcuuaacuu

SEQ ID NO: 38938 - RNA, 64 nt, hsa
ucccagaggucauuugauuaccuaauuuacugaacugauuuagcagggaauggaauccauucca

SEQ ID NO: 38939 - RNA, 64 nt, hsa
gggaugccucuggcuggugaaguucucacauaggcugauuuaaauccagcaaaggucuauagaa

SEQ ID NO: 38940 - RNA, 64 nt, hsa
aguuuuuauucaauguauauaagacagguagugccugauuuacuacuuuauauaaaauaguacc

SEQ ID NO: 38941 - RNA, 64 nt, hsa
uuauauaaaauaguaccuccuucaguuacuguuucugauuuaauguacggaacuuuauuuguug

SEQ ID NO: 38942 - RNA, 64 nt, hsa
uaaugcuuggaauaaaaacucuuaaggcaacucacugauuuacuucuagcaauagcaugauguu

SEQ ID NO: 38943 - RNA, 64 nt, hsa
uauuaucagaauuucugaaaccuuuacaaaaauucugauuuauuccauuaauggccgguuaaac

SEQ ID NO: 38944 - RNA, 64 nt, hsa
cuuacuuugugucuaggaacaauggauuuuguaucugauuuaaaaugccaacacuguuuugucu

SEQ ID NO: 38945 - RNA, 64 nt, hsa
ugcaguauucuaaacauuucagcuaggaauaccacugauuuagaaacaaaacuguuugucucug

SEQ ID NO: 38946 - RNA, 64 nt, hsa
aaauacaguuuagcugcugaauuucuauaccucucugauuuacagauugcuaauuaaauggcua

SEQ ID NO: 38947 - RNA, 64 nt, hsa
caccccagcaauuaugaaaauaaucucugauucccugauuuaauaugcaaagucuagguuggua

SEQ ID NO: 38948 - RNA, 64 nt, hsa
augcaguacaggacauauauuuuuuaaaauaagucugauuuaauugggcacuauuuauuuacaa

SEQ ID NO: 38949 - RNA, 64 nt, hsa
aaccuacaauuuucccuugauaaccauauaaauucugauuuaagguccuaaauucuuaaccugg

SEQ ID NO: 38950 - RNA, 64 nt, hsa
aacacauucauuuggauaaguugugauuugacgacugauuuaaauaaaauauuugcuucacuua

SEQ ID NO: 38951 - RNA, 64 nt, hsa
ucacaaaauaguaaccaggagauguuuaaugugccugauuuaauguuuuuaauaaucacagcaa

SEQ ID NO: 38952 - RNA, 64 nt, hsa
cugcacccagccuacuucacucuucugaauuauucugauuuauuuucaacaacuuuugugaacu

SEQ ID NO: 38953 - RNA, 64 nt, hsa
uguuaauacuauauugcuguaugguauaugcaugcugauuuaccacuuaugcauagauauaucu

SEQ ID NO: 38954 - RNA, 64 nt, hsa
uguuaauacuguauugcuguaugguauauguaugcugauuuacuacuuaugcguaagugguaug

SEQ ID NO: 38955 - RNA, 64 nt, hsa
agaaauggguaaaaaaaaaaaaaaaaaaaaaacccugauuuauuacuaugucuuauuuaucaga

SEQ ID NO: 38956 - RNA, 64 nt, hsa
guugaaggagaaucaauucuucaacucaagaugucugauuuacugugaauuugcccaaucuuug

SEQ ID NO: 38957 - RNA, 64 nt, hsa
cuuaaacauaauauauaauggauauucauuuauacugauuuaugaaaguaaguuuuuaaacacu

SEQ ID NO: 38958 - RNA, 64 nt, hsa
uuuuuagaaaggaaaaguuuucuucauuuagcugcugauuuaaaaguaaaguucuccaauucuu

SEQ ID NO: 38959 - RNA, 64 nt, hsa
aaguaaugguacaguuacccaucuacucaaauaucugauuuaucucaccauccaauuaucuacc

SEQ ID NO: 38960 - RNA, 64 nt, hsa
agaaguucaacucauaaacgugauugauagguggcugauuuauuuagguuuugucaagcuaucu

SEQ ID NO: 38961 - RNA, 64 nt, hsa
uuaauucaaauugacagagauugauaaaaagaaacugauuuaccuaaguuuacuuuuuaauugc

SEQ ID NO: 38962 - RNA, 64 nt, hsa
uagaaagcuuguauaauucagauuuaucaauuuccugauuuaauguagacuuugacuuuuuuau

SEQ ID NO: 38963 - RNA, 64 nt, hsa
uuauaaaccagccacuucugaauacaauauguagcugauuuaauaagcuaguuagugaauggaa

SEQ ID NO: 38964 - RNA, 64 nt, hsa
gauuggaggagggacaguuucugguacccauccucugauuuauacauaugcauuuuuuccccuc

SEQ ID NO: 38965 - RNA, 64 nt, hsa
ccaacauaacaaucgugguaacagaaugcgacugcugauuuaccgauguauuuaauguaaguaa

SEQ ID NO: 38966 - RNA, 64 nt, hsa
gugggcaaaucaggaacaaaccaucacugauuuacugauuuaagcuagccaaacuguaagaaac

SEQ ID NO: 38967 - RNA, 64 nt, hsa
cugaaauagugggcaaaucaggaacaaaccaucacugauuuacugauuuaagcuagccaaacug

SEQ ID NO: 38968 - RNA, 64 nt, hsa
auuuuucuuuuaaguaaauuuuuuuuaaaaaauucugauuuagggcuaggugugguggcucagg

SEQ ID NO: 38969 - RNA, 64 nt, hsa
cauagcgagaccccuaucuguauuaaaaaaaaaucugauuuaauucuuuuauuuaucauaaggg

SEQ ID NO: 38970 - RNA, 64 nt, hsa
auauuagaaguuacaagacugauuuaaaccgucucugauuuaaugcaagauauauugugucuau

SEQ ID NO: 38971 - RNA, 64 nt, hsa
uaguugccagcccagaauauuagaaguuacaagacugauuuaaaccgucucugauuuaaugcaa

SEQ ID NO: 38972 - RNA, 64 nt, hsa
acuauaacugaacacaauguguauucauaguauacugauuuaauuucuaaguguaagugaauua

SEQ ID NO: 38973 - RNA, 64 nt, hsa
acuuuuguaaucagaauuuuuagaaaguauuuugcugauuuaaaggcuuaggcauguucaaacg

SEQ ID NO: 38974 - RNA, 63 nt, hsa
aucacgaaaauaauaauaauaaaucuuuaacauacuaccuaaagggaaccugcaauaaucuug

SEQ ID NO: 38975 - RNA, 63 nt, hsa
aaagaaagaaagaaaccuccagcguauuuuaucacuaccuauagaaagaaauccugcuuugag

SEQ ID NO: 38976 - RNA, 64 nt, hsa
cuuaccccccugggacagcuguuaccuuugcaguguugccgaaucacagcaguuaccuuugcag

SEQ ID NO: 38977 - RNA, 64 nt, hsa
aguguugccgaaucacagcaguuaccuuugcaguguugccgaaucacagcaguucuguuggaga

SEQ ID NO: 38978 - RNA, 64 nt, hsa
aaaacaacacauuagcuuauaguccuggggaucagaauuccaaaauggaugucccugaaugaaa

SEQ ID NO: 38979 - RNA, 64 nt, hsa
ggacucauucuaagggcaagacauugaaaaugaugaauuccaaucuggauacagucaugacagc

SEQ ID NO: 38980 - RNA, 64 nt, hsa
ugaaccauuccacauucccaccagcaauguaugagaauuccaauuucuguccacuuccucacca

SEQ ID NO: 38981 - RNA, 64 nt, hsa
caaaucccauaggauggcaagcaaaguucuucuagaauuccacaugcaauucacucuggcgacc

SEQ ID NO: 38982 - RNA, 64 nt, hsa
auccuuuauauuaagaaaauguuuuaaaauguaagaauuccauuuauucuguuuagaguacuuu

SEQ ID NO: 38983 - RNA, 64 nt, hsa
uggaagcugaggugagaggaucacuugagcccuggaauuccaugccagccuaugcaacaucaug

SEQ ID NO: 38984 - RNA, 64 nt, hsa
aggccugcuucccccucccccuccugcugugcuggaauuccacagggaccagggccaccgcagg

SEQ ID NO: 38985 - RNA, 64 nt, hsa
gucugcucauaggaccugcauccuuccuggggacgaauuccacucguccaagggacagcccacg

SEQ ID NO: 38986 - RNA, 64 nt, hsa
guaaaaagaauauaauaccuguggaaauaaaaaugaauuccaaguguauacuugcucgggugau

SEQ ID NO: 38987 - RNA, 64 nt, hsa
acaaaaauaaaaagcaaaacaaaaaucccaaaaugaauuccauucacaaacagaauuuuucaau

SEQ ID NO: 38988 - RNA, 64 nt, hsa
acauaaauuuucagcuauuucuguuccccugaacuaauuugagauuagacccaaacaugcuuuu

SEQ ID NO: 38989 - RNA, 64 nt, hsa
auaucuugaaucuacaaauaucuuuauauguauauaauuugaauauauacauguauguauauac

SEQ ID NO: 38990 - RNA, 64 nt, hsa
aaaaaaguuuucuagaauaagcaggaugauuguuuaauuugaagauggaacaggaaacuagagu

SEQ ID NO: 38991 - RNA, 64 nt, hsa
caagcuguuaccaaaaaauuuuuaaguauuuucuuaauuugaauaauaaaaccagaggaaaugc

SEQ ID NO: 38992 - RNA, 64 nt, hsa
cuaaagagcacuuacuguaaccuguugcuguguuuaauuugacuucucugccuuugacauuuaa

SEQ ID NO: 38993 - RNA, 64 nt, hsa
aaagcauugcuuuuauuuugaaaagcuucuuaauuaauuugauuaacaaauaugcuaauuuggg

SEQ ID NO: 38994 - RNA, 64 nt, hsa
uagaaauggcaaauuuguaagcgugucauuuaaguaauuugaugcucaguuuuagggucuaagu

SEQ ID NO: 38995 - RNA, 64 nt, hsa
cacagaugcuauuuuuucucaguuuuuaaugcuuuaauuugaaagaaaaaugcauccuaaccau

SEQ ID NO: 38996 - RNA, 64 nt, hsa
caaguacacauccugauuugguuucucccuguuguaauuugagauuucccaaauuaagucuuau

SEQ ID NO: 38997 - RNA, 64 nt, hsa
auacuguuccauacaaaagcuauuuuucaaaaauuaauuugaaccaaaacuacuacuauaggga

SEQ ID NO: 38998 - RNA, 64 nt, hsa
aucuuaaauuccuacaaugugaaacugaaacuaauaauuugauccugauguaugggacagcgua

SEQ ID NO: 38999 - RNA, 64 nt, hsa
caggaaccuaacagauuauuuugucucucauuauuaauuugaaagagccucuaaacuuuugaga

SEQ ID NO: 39000 - RNA, 64 nt, hsa
aguagccagguuaaauuuucuauacuuugguccauaauuugauuugauaugauuguuucauuua

SEQ ID NO: 39001 - RNA, 64 nt, hsa
acuuagguuucaggaaguugccaugggaaacaaauaauuugaacuuuggaacaggguuggcauu

SEQ ID NO: 39002 - RNA, 64 nt, hsa
guuuugguggaaaaaacauuuuaaguuuuacugauaauuugagguuagaugggaggaugaauug

SEQ ID NO: 39003 - RNA, 64 nt, hsa
aaauugaacuagcuaccauauaagcagauugcuuuaauuugaugggaaaauaguacacacauau

SEQ ID NO: 39004 - RNA, 64 nt, hsa
ucaagagucucucuucacuuccuucuaaagagacuaauuugagaguacaggugcauauuaauuu

SEQ ID NO: 39005 - RNA, 64 nt, hsa
cacacacacacacacacacacacauacacacauauaauuugaaagaggugaguauguacucuga

SEQ ID NO: 39006 - RNA, 64 nt, hsa
ugaaggugauaacugacacguguucacugaauuuuaauuugauaggcaauacaucuacccacuc

SEQ ID NO: 39007 - RNA, 64 nt, hsa
uucacuucaaaacaguauugacuuguauaccuuguaauuugaaauauuuucuuuguuaaaauag

SEQ ID NO: 39008 - RNA, 64 nt, hsa
ccaaaggaggauggcauauaauacaaaggcuuauuaauuugacuagaaaauuuaaaacauuacu

SEQ ID NO: 39009 - RNA, 64 nt, hsa
cuuuuuucuuuuggagggacaagaugaaaauauauaauuugaauugauuaaaauuggucguuac

SEQ ID NO: 39010 - RNA, 64 nt, hsa
caaacuuuaggaacuuuuccagauguaucgaauuuaauuugacauugaugucacucuucauacc

SEQ ID NO: 39011 - RNA, 64 nt, hsa
cuuguuaaugucuaaacuuuaaaaucaguacauuuaauuugaguuccaacuguuaagcauauuu

SEQ ID NO: 39012 - RNA, 64 nt, hsa
aaaaagaaucuccauuuucugaaggucuguuaguuaauuugagauaauuuguuaaaggcaagua

SEQ ID NO: 39013 - RNA, 64 nt, hsa
uauugaguucuaauguuacaucugaggaaguauguaauuugagaauuguaacuucuaagggauu

SEQ ID NO: 39014 - RNA, 64 nt, hsa
gugauccuaacaauuggcaugaugcuuuucuugguaauuugauauaagcaaguuguaauguaca

SEQ ID NO: 39015 - RNA, 64 nt, hsa
aggauaaaucagacuauacaaaaccuaaguguauuaauuugaugauugucacguacaacuuucu

SEQ ID NO: 39016 - RNA, 64 nt, hsa
uuaucaggaaagcuaaagaacuuuucaaaucuaguaauuugaauauagacacaaugcacuuuau

SEQ ID NO: 39017 - RNA, 64 nt, hsa
ggagauggggaucugguuuagggcaaucccuuuauaauuugaugugcuguggucuccuugguaa

SEQ ID NO: 39018 - RNA, 64 nt, hsa
aauaaaauaacaucaauagauuuuuaggcugaauuaauuugaaagcagcaauuugcuguucuca

SEQ ID NO: 39019 - RNA, 64 nt, hsa
ugaccuauucuuauuuaguuaacacaagugugauuaauuugauuucuuuaauuccuuauugaau

SEQ ID NO: 39020 - RNA, 64 nt, hsa
cuuuugucacagguaaaaucaguguugggaauuauaauuugagaaaaauauuacccaguaacau

SEQ ID NO: 39021 - RNA, 64 nt, hsa
acuacacuaauuauuuuaacuguauacaucuguuuaauuugaacacacuacaucguagggugac

SEQ ID NO: 39022 - RNA, 64 nt, hsa
aguauaucuauaugaucuugauauuguuuuauaauaauuugaagucuaaaagacugcauuuuua

SEQ ID NO: 39023 - RNA, 64 nt, hsa
gucaaaccuaagcauauuugaauaugaucucccauaauuugaaauugaaaucguauuguguggc

SEQ ID NO: 39024 - RNA, 64 nt, hsa
cacauagcacugcucauuuuacuuuuauuuuguguaauuugaugacacugucuaucaaaaaaga

SEQ ID NO: 39025 - RNA, 64 nt, hsa
uuaaaaguuuuccacauaaugaaaguccuucugauaauuugacaaauagcuauaauaggaacac

SEQ ID NO: 39026 - RNA, 64 nt, hsa
guguuugaguuaaaaaccaaacaucccuguaauuuaauuugaagauucuuuaacagauugcagc

SEQ ID NO: 39027 - RNA, 64 nt, hsa
gauacuauauucuuugaaaauucuugaaguucuuuaauuugaaauugaaacauuaauuuuugag

SEQ ID NO: 39028 - RNA, 64 nt, hsa
auauauauauauauguauauuuaaaaagugaauauaauuugaggcacagaagaauauucuuaaa

SEQ ID NO: 39029 - RNA, 64 nt, hsa
cauuuucaugacagauacauucaugcacaauccauaauuugaguuuuacauaaaauagaaauuu

SEQ ID NO: 39030 - RNA, 64 nt, hsa
auaaaauaaguauuuauuuaaacuaauguucucuuaauuugaccauugcagauuugggugacuu

SEQ ID NO: 39031 - RNA, 64 nt, hsa
ugauacgauaauauuacucuugauugcugcugcuuaauuugauguaauauguuuaaaguucagc

SEQ ID NO: 39032 - RNA, 64 nt, hsa
cauuugcuaguuagaauaucccuacucuucuaaauaauuugaaaguauagagcaguaacacagu

SEQ ID NO: 39033 - RNA, 64 nt, hsa
aucucuuugcuauuguaaaucuuucacuucaagauaauuugacaguugaguaucagcauaauuu

SEQ ID NO: 39034 - RNA, 64 nt, hsa
guuuuuuaauuaaaauauaaucacugaaguuuacuaauuugauuuuauaagguuuguagcauua

SEQ ID NO: 39035 - RNA, 64 nt, hsa
aauuauguucuuuuucccccuuuauggucuuaacuaauuugaauccuucaagaaggauuuuucc

SEQ ID NO: 39036 - RNA, 64 nt, hsa
uuuaccuuauuuaucuguaugaaauuccaguaguuaauuugaacauuuauuuauaugacguuug

SEQ ID NO: 39037 - RNA, 64 nt, hsa
agaaacaaaaucauggaucaagagauacucuugauaauuugaauagggccaaaacaaaguuggu

SEQ ID NO: 39038 - RNA, 64 nt, hsa
guagaaaauucacaaaucuguucauuuaauuuuuuaauuugagaauuuuuauuucuuuugacug

SEQ ID NO: 39039 - RNA, 64 nt, hsa
uucugucagacauuuaccaacuauuuucuaaaacuaauuugacaaaucaugacacuagaaaacg

SEQ ID NO: 39040 - RNA, 64 nt, hsa
cauccuagggugcuuuuuuguuuguguguguguguaauuugagugauuguaaauggcauugaug

SEQ ID NO: 39041 - RNA, 64 nt, hsa
uuccuauagguuacuucaccuuuuuuuuuuuuaauaauuugauuugauacauauguaguguuuu

SEQ ID NO: 39042 - RNA, 64 nt, hsa
auggacgcaaaugacagauaaaaacagcuuuaaauaauuugaacuuguuaauuagaauguuguu

SEQ ID NO: 39043 - RNA, 64 nt, hsa
uguuuucaguccauuaaaaaauccuaaccaaauuuaauuugaauucaacuuaauuuaagccacc

SEQ ID NO: 39044 - RNA, 64 nt, hsa
caauaaugaguaauagcacaaaguaaaagugacuuaauuugaaauuacuucuguuuggcuaguu

SEQ ID NO: 39045 - RNA, 64 nt, hsa
gaauaauaauguuguuaaagaggcuguuuagcacuaauuugaccaaaucuauagucaaaguuug

SEQ ID NO: 39046 - RNA, 64 nt, hsa
caacaaaaccugauucuggucuucuuuaccaauauaaucauaauguaaauaauaauuuguauau

SEQ ID NO: 39047 - RNA, 64 nt, hsa
aaagauuaacguuauugauacuuggauaacuggcuaaucauauuaaaggacuaugugguuccag

SEQ ID NO: 39048 - RNA, 64 nt, hsa
cuugcacuaucacccaggcuggagugcaguggcauaaucauaccucauugcagccucagacucc

SEQ ID NO: 39049 - RNA, 64 nt, hsa
ugcuaaauguuagucauugagguggggccaauuuuaaucauaagccuuaauaagauuuuucuaa

SEQ ID NO: 39050 - RNA, 64 nt, hsa
ggaacuuacgcaacacaccacugaguccucuaacuaaucauaugugcucagacacagcucaagc

SEQ ID NO: 39051 - RNA, 64 nt, hsa
gcaaauagaaauuuauaagcauuuuacuacaaguuaaucauauccuucaguagcuuauuucuuc

SEQ ID NO: 39052 - RNA, 64 nt, hsa
uccugaaucuaaagaaagacaacaugcugcuuuuuaaucauaggauggagaauuuuaaagaacu

SEQ ID NO: 39053 - RNA, 64 nt, hsa
auugccacucaaugcuggaauauuuugggucaccuaaucauagauuucucagggcaucaauacu

SEQ ID NO: 39054 - RNA, 60 nt, hsa
aguucgggagccacggaugacccuggacacucaagccaaaguuaggccacaccaggccca

SEQ ID NO: 39055 - RNA, 64 nt, hsa
aaguuaggccacaccaggcccaacccugugcuggucaagccagggcagucacagcugcuugggg

SEQ ID NO: 39056 - RNA, 64 nt, hsa
uuguuuguuaggcagugcuagagcuugaagccacucaagccaguuggggaggaaagggaugcgg

SEQ ID NO: 39057 - RNA, 64 nt, hsa
uuagccccuuagcacauguuccuaagguguguugucaagccaaccugaauucugccucccuguu

SEQ ID NO: 39058 - RNA, 64 nt, hsa
ggaagguuggauccaaggaggguguaauggagcaucaagccacucggcggcagcauggagcuau

SEQ ID NO: 39059 - RNA, 64 nt, hsa
ccugacugcccggcacagaugcuccagggaugauucaagccauuccaaaguucaacuuggugac

SEQ ID NO: 39060 - RNA, 64 nt, hsa
uuguagcguguggcugggccaggccccagcgggaggggcugagcuggggcugugugcuugcuag

SEQ ID NO: 39061 - RNA, 64 nt, hsa
ucacugaggcaacaugaagcccgaggcccagaugggggcugaacagguagggcacaucaguuaa

SEQ ID NO: 39062 - RNA, 64 nt, hsa
ggucccuggaguccccagcaccuggggcccugguggggcugaugucacagguguuuacugugcu

SEQ ID NO: 39063 - RNA, 64 nt, hsa
gccacccucauccccugccugggaggcucucccaggggcugauggggggguucugugagggaga

SEQ ID NO: 39064 - RNA, 57 nt, hsa
ggauccucacagucaagugacgaggcuggggcugaaagcagaagcaugcacagggag

SEQ ID NO: 39065 - RNA, 64 nt, hsa
acuuuuauugcuugucuggguggauggggcaggaggggcugagggccugucccagacaauaaag

SEQ ID NO: 39066 - RNA, 64 nt, hsa
auucauuuuauacaaagcccuccagccuguuuguggggcugaaaccccaucccuaaaauauugc

SEQ ID NO: 39067 - RNA, 64 nt, hsa
auuggagaaucuuaagaaaugcaagcuuguucagggggcugagaagauccugaguacacuaggu

SEQ ID NO: 39068 - RNA, 64 nt, hsa
uggggcugaaguuucuggggucacauggucagaaggggcugagcuggucuuucacugcaggccc

SEQ ID NO: 39069 - RNA, 64 nt, hsa
cagugccuuccuccagccucacaaccuuucugcuggggcugaaguuucuggggucacaugguca

SEQ ID NO: 39070 - RNA, 64 nt, hsa
aggucuccccauccccauucggggcugacgauggggggcugauggcugccccugcguggccuga

SEQ ID NO: 39071 - RNA, 64 nt, hsa
ucacacucagaaagaggucuccccauccccauucggggcugacgauggggggcugauggcugcc

SEQ ID NO: 39072 - RNA, 64 nt, hsa
gcccuggggucacagacauggaagggaccacccuggggcugacugcuuuucugugcuguugguu

SEQ ID NO: 39073 - RNA, 64 nt, hsa
ucucuugucccuuauagguaccuuggaggggccaggggcugaggaaggccggacccagguucca

SEQ ID NO: 39074 - RNA, 64 nt, hsa
ccuauuacggccugagucuggaugugucggggcuggggcugaacguguaccagacacagcuguu

SEQ ID NO: 39075 - RNA, 64 nt, hsa
aguuguacccuacggugcucagacagacagggauggggcugacugcacuggugggccggcuggg

SEQ ID NO: 39076 - RNA, 64 nt, hsa
ugugguacccaggccacacguugugcccgcucuuggggcugaccggcuguagggaccaccagcc

SEQ ID NO: 39077 - RNA, 64 nt, hsa
gaccccggaggcugucgguggaugugccgaugauggggcugacaguaugggcucugggcauccc

SEQ ID NO: 39078 - RNA, 64 nt, hsa
aagcuucgucuuguguuugcugcagagugauucgggggcugaccuagaccaguuugcaugauuc

SEQ ID NO: 39079 - RNA, 64 nt, hsa
caaucagccuuuaggucuuuaguccgggggacuuggggcugagagaguauaaauaacccugggc

SEQ ID NO: 39080 - RNA, 64 nt, hsa
caugacucacccauggcaggcggagggucccagaggggcugaguccucaaauccggcugaggca

SEQ ID NO: 39081 - RNA, 64 nt, hsa
agccuguggcuuugcccaccaggacuuuugagcuggggcugacuccugcaggggaagcccuggu

SEQ ID NO: 39082 - RNA, 64 nt, hsa
agagcucccacuacaugcaguggcccagggcagaggggcugauacauggccuuuuucagggggu

SEQ ID NO: 39083 - RNA, 64 nt, hsa
gcuuugaggagaggguaaacauaggcccggagauggggcugacaccucgaguggccagaauaug

SEQ ID NO: 39084 - RNA, 64 nt, hsa
gugccugagacacucaccucucugccucgcaguuggggcugaggcuggggcuggcugccagccu

SEQ ID NO: 39085 - RNA, 64 nt, hsa
ugcuggggcucaggcuguggggcaggcugggcagggggcugagcuggcagcgauucagagcccu

SEQ ID NO: 39086 - RNA, 64 nt, hsa
cugcccacugcagugccaagacggcagcaggacuggggcugauagcccaccccgcccccacugc

SEQ ID NO: 39087 - RNA, 64 nt, hsa
cacugcagcucccacaaagcacucuaagggagauggggcugaggacagcucaaaaaggagagga

SEQ ID NO: 39088 - RNA, 64 nt, hsa
ucccucccagccucaaccacaauucuuccaugcuggggcugaugugggcuaguaagacuccagu

SEQ ID NO: 39089 - RNA, 64 nt, hsa
gagaauuuguagaucauucucacuucaaauuccuggggcugauacuucucucaucuugcacccc

SEQ ID NO: 39090 - RNA, 64 nt, hsa
cacaggggcuuccagggaggccgcgcagggccguggggcugagccacgcucucguuuugucagg

SEQ ID NO: 39091 - RNA, 64 nt, hsa
ugucuggcggagaaagccagcucccugcacccucggggcugagucagaucugggucugccgcaa

SEQ ID NO: 39092 - RNA, 64 nt, hsa
uuggauaggagagcugggacuccaucucgacccuggggcugaggccugaguccuucuggacucu

SEQ ID NO: 39093 - RNA, 64 nt, hsa
ggcugcugggccccagguggcgcacggauggugaggggcugagaaugagggcaccgacugugaa

SEQ ID NO: 39094 - RNA, 64 nt, hsa
cuuuagccuagcagauuccuucuagcucccccugggggcugagccuaucagggcacaaagccag

SEQ ID NO: 39095 - RNA, 64 nt, hsa
cucauugaaaggugguugcuuggagaagggacauggggcugaaucucagacuucugaggugggg

SEQ ID NO: 39096 - RNA, 64 nt, hsa
cuguaggaaaccaaagaugggaaguggcuccuagggggcugacucuuccuuccuccuccucccc

SEQ ID NO: 39097 - RNA, 64 nt, hsa
ccucacacuccucacagccuacuuccccuuccccggggcugagagggugaaaguguguggggaa

SEQ ID NO: 39098 - RNA, 64 nt, hsa
uuauuucuguagcagccaaguccugcggcucccuggggcugagaucucccuuuguggaacuccg

SEQ ID NO: 39099 - RNA, 64 nt, hsa
ggccacuccagggaucauuguuguccuuuugugaggggcugaggcgacugucccauggaggcau

SEQ ID NO: 39100 - RNA, 64 nt, hsa
uggggaaggaaaaagcaggaaacugaaggaagcaggggcugaggaacacuuagagggugggcag

SEQ ID NO: 39101 - RNA, 64 nt, hsa
ggcagcugcagcaagaggcagcugaagcccucguggggcugaaagauucaucccaggcuccucg

SEQ ID NO: 39102 - RNA, 64 nt, hsa
cccgacaccaggaggagggccaggagaguuccagggggcugaggcacacagagaggccaacuuc

SEQ ID NO: 39103 - RNA, 64 nt, hsa
guauauugcucuggggacucucgccggggaagauggggcugauuucccaccuagagagguugau

SEQ ID NO: 39104 - RNA, 64 nt, hsa
cagccgggcagguggucacugagggccaugacgcggggcugaggaugccuccgcugggcaucuc

SEQ ID NO: 39105 - RNA, 64 nt, hsa
caaauuugccaucucacuccccaaggcucgggugggggcugaggcugaggccaaaggggcuggg

SEQ ID NO: 39106 - RNA, 64 nt, hsa
cacucugccugccugcuguugguccucucucuguggggcugaauugccaggggcgaggcccuuc

SEQ ID NO: 39107 - RNA, 64 nt, hsa
cucuggaagaggaaccaggagaagggcuggggccggggcugagggugcccuuuuccagccucag

SEQ ID NO: 39108 - RNA, 64 nt, hsa
gcccagcuguugggaacagcauggaggcagauguggggcugagcuggggaaucaggguaaaagg

SEQ ID NO: 39109 - RNA, 64 nt, hsa
uaccaccuucucccuccccacccccuccaggcccggggcugaaacagcccgaggacagccccag

SEQ ID NO: 39110 - RNA, 64 nt, hsa
cugcagggucugcuuuuacuuggggugggggggcggggcugacccugaacccucccccccgcca

SEQ ID NO: 39111 - RNA, 64 nt, hsa
ccaguuugcugaacuuugccgucuuguaagggugggggcugacggccgacccugggaggaggug

SEQ ID NO: 39112 - RNA, 64 nt, hsa
gaggcuuggaccugcuguggagggugcccagcagggggcugagcucugaggggugggugcucag

SEQ ID NO: 39113 - RNA, 64 nt, hsa
acagacaauagcuuauuuucuuuccgcccccuccggggcugagccugggucugaagacugaaug

SEQ ID NO: 39114 - RNA, 64 nt, hsa
cuggggcccccuaaccccaccccaggcagcggaaggggcugacugggucugguccuuaccaaca

SEQ ID NO: 39115 - RNA, 62 nt, hsa
ugucuccacugccaaguagaagugacucaaaacccucugacaaggauauucccuuggcuaug

SEQ ID NO: 39116 - RNA, 62 nt, hsa
gcucacugccaccuguggacacucugugucuacccucugagugggaacauacuucuaaguuc

SEQ ID NO: 39117 - RNA, 62 nt, hsa
gcccucuuugagcuauuuggcuacuucccugucccucugacuccuacugucccaauuuucuc

SEQ ID NO: 39118 - RNA, 62 nt, hsa
ccccccaacgcaaggaggaugcccaauuguugcccucugaaaaugcacaguucuccuggccc

SEQ ID NO: 39119 - RNA, 62 nt, hsa
uuuuuuuuuuugaaauuugccgagcaguggagcccucugacaauuugcaaggcccucugaga

SEQ ID NO: 39120 - RNA, 62 nt, hsa
cgagcaguggagcccucugacaauuugcaaggcccucugagaaaggaagcugcuuagagcca

SEQ ID NO: 39121 - RNA, 62 nt, hsa
gcuccuguucuggugauaccaaaccugcccaccccucugagucgucuuugcucauggacuug

SEQ ID NO: 39122 - RNA, 62 nt, hsa
gucccagaggacacaucccucgggaacucugccccucugacaaugagggccacagagaaggu

SEQ ID NO: 39123 - RNA, 62 nt, hsa
aggcagagccuuuggaugaccagaacaagguucccucugagaauuccaaggaguuccaugaa

SEQ ID NO: 39124 - RNA, 62 nt, hsa
ugcgaucuucagagcagggguccuuggugugacccucugaaugguccaggguugaucacacu

SEQ ID NO: 39125 - RNA, 62 nt, hsa
gccuuagucucccaaauccaccaugcaucugccccucugagggugucuucacuuugucucug

SEQ ID NO: 39126 - RNA, 62 nt, hsa
gagcagcugauaaguuucccuaccugauggcccccucugacauaaacugcacaccuggggug

SEQ ID NO: 39127 - RNA, 62 nt, hsa
ccccgugcccugacccggggaccacagggacacccucugagacgugcuggccccaggaggau

SEQ ID NO: 39128 - RNA, 62 nt, hsa
ucugcugacgggaacaagucauucugaaaggucccucugacccaggucaccaaauuugggcc

SEQ ID NO: 39129 - RNA, 62 nt, hsa
uggugagggaaggguacgaguacauuccuuuucccucugaccugggcgcuagcaagggcaaa

SEQ ID NO: 39130 - RNA, 62 nt, hsa
gggagcuguguuguuucccacccaccacccuucccucugaacaaaugccugagugcuggggc

SEQ ID NO: 39131 - RNA, 62 nt, hsa
gcuauucuauuggaguagccucccuaggcagucccucugaagccuuggagugcagguaaaug

SEQ ID NO: 39132 - RNA, 62 nt, hsa
ccaagaccugggucaguucuuugcuggugguccccucugaccacaagcuucugccugaagau

SEQ ID NO: 39133 - RNA, 62 nt, hsa
agcuuuuuaaauaucuuuuuccuucuacuccucccucugacucuaagaauucucucuucugg

SEQ ID NO: 39134 - RNA, 62 nt, hsa
cucaacuucuuuccucuggagacggggcaucucccucugauuuccuucugcuaugacaaaac

SEQ ID NO: 39135 - RNA, 62 nt, hsa
ugcucaucucuuccgugagauuugcucccagacccucugaucucccuccaacaaacccuggc

SEQ ID NO: 39136 - RNA, 62 nt, hsa
uggccuuguuaauuccaaguggcauguaucuucccucugagcuucauuucuucaagaugcuc

SEQ ID NO: 39137 - RNA, 62 nt, hsa
uugaagagguacccaucauaaugacagcaucucccucugaaggguuuuggucaaaaugggug

SEQ ID NO: 39138 - RNA, 62 nt, hsa
cuggaccuccucucagcacagccagcuccgugcccucugaauuauguuucgcagaaaagugu

SEQ ID NO: 39139 - RNA, 62 nt, hsa
ucugaccccaacuucucuuugaucucugaauccccucugacuccaacuucucuuucacccuc

SEQ ID NO: 39140 - RNA, 62 nt, hsa
gaccuauaaguucugguuuauguuugaccccucccucugagcugcacuucaccgcugaccuu

SEQ ID NO: 39141 - RNA, 62 nt, hsa
ugugcuggcauuucucacccuuucaucuuuagcccucugaguacuuugaagcacuuuugcau

SEQ ID NO: 39142 - RNA, 62 nt, hsa
uugagggaaacuguggaaggcaccuucaggcccccucugacuuguuguucuuggcacauguu

SEQ ID NO: 39143 - RNA, 62 nt, hsa
uagguuuggaggucugccaguuacaccaaguccccucugagauucgaucaggggacuggaua

SEQ ID NO: 39144 - RNA, 62 nt, hsa
gacaccagcccccugcauccuucaguagaccucccucugaacaccacagccagguccugccu

SEQ ID NO: 39145 - RNA, 62 nt, hsa
accgcaugaagauacuuguaagcacacaugaucccucugaauuguuuuacuuuccuguaacu

SEQ ID NO: 39146 - RNA, 62 nt, hsa
uggccgaagcauagauuguaaccccuccacuccccucugagauuggccuucggugaggaauu

SEQ ID NO: 39147 - RNA, 62 nt, hsa
agaguguggcugcuggacucuuuucgaaaugccccucugagucaggagccugguggggacaa

SEQ ID NO: 39148 - RNA, 62 nt, hsa
ggcgggaggcaugcaagccagugggggaaaaccccucugaagcugggcagcccucuaccugg

SEQ ID NO: 39149 - RNA, 62 nt, hsa
cuccaguuugacauuauucaugcaccacgauacccucugauuauuggaauccauuggcuuga

SEQ ID NO: 39150 - RNA, 62 nt, hsa
cgagagaagcugcccauccgcaguaauaucuucccucugaugcuggaaacugucgacggcca

SEQ ID NO: 39151 - RNA, 62 nt, hsa
uccucauuucauugccucucauacaguuuucucccucugauuuauuucauuuugguagugga

SEQ ID NO: 39152 - RNA, 62 nt, hsa
cucaugcaaaauauugguguggcugcaaauuucccucugaagcugacacaauuaaggaugaa

SEQ ID NO: 39153 - RNA, 62 nt, hsa
uugcuauugauguagugugauagaaaauucaccccucugaacuggcuccuucccagucaagg

SEQ ID NO: 39154 - RNA, 62 nt, hsa
cccauucauguuagaucguugaaacccuguaucccucugaaacacuggaagagcuaguaaau

SEQ ID NO: 39155 - RNA, 64 nt, hsa
cuauuuaacaagguccugguuucucuugcaacacaguagcuaaacuugccugcuuuuauaugca

SEQ ID NO: 39156 - RNA, 64 nt, hsa
ccaagugaauuuaaauaauugguguggauuggccaguagcuaagaagugggcuuuuaaagagua

SEQ ID NO: 39157 - RNA, 64 nt, hsa
ggauucaaggaauucucccugccucagccuccugaguagcuaggauuacaggugccugccacca

SEQ ID NO: 39158 - RNA, 64 nt, hsa
auuauggagggaaucaaaaauacugcuuucaguuaguagcuagcuuuaagucaggaguuaguaa

SEQ ID NO: 39159 - RNA, 64 nt, hsa
gcuucauucaaccuggcguuccccuccauaauuaagaugaaacauuccgguuuucucacaacac

SEQ ID NO: 39160 - RNA, 64 nt, hsa
gaagucccugauuccuucuuaaacuuggaaugauagaugaaauucacaccccugcagaucagaa

SEQ ID NO: 39161 - RNA, 64 nt, hsa
uuuuuuuuaaauaaaagacuaaagacagggagcuagaugaaauggcuuaauggugcuguuaagu

SEQ ID NO: 39162 - RNA, 64 nt, hsa
uguuaaguauuuguaccuaacagucuugugugacagaugaaaauaggauguaacauaaugaaac

SEQ ID NO: 39163 - RNA, 64 nt, hsa
acucaccaaaaugaauaguuguuucguuacauuuagaugaaaguuaaacuuuacugaauuucag

SEQ ID NO: 39164 - RNA, 64 nt, hsa
acuuucaaguuggagcaauugucuguguuugaaaagaugaaauaaaaauaauaaucaagggcaa

SEQ ID NO: 39165 - RNA, 64 nt, hsa
aauugcaauuacugguuggggggugcauuuuaaaagaugaaacaugcagcuucccuacauuaca

SEQ ID NO: 39166 - RNA, 64 nt, hsa
cacucagaaauccuucaaacaugauuaauuaugaagaugaaacacuagagucauauaagaaaua

SEQ ID NO: 39167 - RNA, 64 nt, hsa
agaaggcaaaaaauaucuuuuguacagaaaagcaagaugaaaaggaugugaaaugguagauaua

SEQ ID NO: 39168 - RNA, 64 nt, hsa
uauauauguacuacauuaaaaaguguugauuaauagaugaaauuuuuaaauuaauuuuuuaaaa

SEQ ID NO: 39169 - RNA, 64 nt, hsa
uaucaguuucaaauaauauuuucucuguaguaugagaugaaauuaaaaguggauagcuuucagg

SEQ ID NO: 39170 - RNA, 64 nt, hsa
uucucugugccagacacuguucuggaagauagcuagaugaaaaucuuugcacucacagagcuua

SEQ ID NO: 39171 - RNA, 64 nt, hsa
uuuuucauagaggcagaaaguaggaaccagauagagaugaaaaggggccacugaaaagugaauu

SEQ ID NO: 39172 - RNA, 64 nt, hsa
auaacgaguaaguagacaagaauaaagugguuugagaugaaaagaaccuaacauuauuuacagu

SEQ ID NO: 39173 - RNA, 64 nt, hsa
aauucagucccuaaauacaugaggcugggugagcagaugaaaccgguagccacugugcugaugc

SEQ ID NO: 39174 - RNA, 64 nt, hsa
uacaaugucuacuguacugugggucauuuagaugagaugaaaaacuuaauuaaaucugaagugu

SEQ ID NO: 39175 - RNA, 64 nt, hsa
acaguugugaaccaagaucuauaaagcgauauacagaugaaaauuugagacuauuuaaacuuau

SEQ ID NO: 39176 - RNA, 64 nt, hsa
gagcacuuccaaaauucuuauuuuuccuaacaaaagaugaaagcagggaauuucuaucuaaaug

SEQ ID NO: 39177 - RNA, 64 nt, hsa
uuuucaucgaaauugccugugugcacauauuuuuagaugaaaaaugaaacuaccuuacaauauu

SEQ ID NO: 39178 - RNA, 64 nt, hsa
aagguugauguguucauuccaguuauucacuuacagaugaaacuaaaacaaauaaaggcaagcu

SEQ ID NO: 39179 - RNA, 64 nt, hsa
cccaggcaaaauauagcaaucugccacaacugccagaugaaaagcaacaaucagaguagaaaaa

SEQ ID NO: 39180 - RNA, 64 nt, hsa
ccccuucacccacucccuccagaacauuuaguguagaugaaaauguggugauagaaaugggugc

SEQ ID NO: 39181 - RNA, 64 nt, hsa
auauuuaaaagacaaacaccuuauuugucggggaagaugaaaccgucccugaguugcaccauuc

SEQ ID NO: 39182 - RNA, 64 nt, hsa
auggaagaaacccuuccacguguaugcaagugggagaugaaaaccugcauuuuuaaaggacaaa

SEQ ID NO: 39183 - RNA, 64 nt, hsa
uuuccggaauauuggaauauucuguucuugauccagaugaaaucugauugagcaguguacuuac

SEQ ID NO: 39184 - RNA, 64 nt, hsa
uugcuguguauuuaguguaaaaguacaugcagaaagaugaaacacaaaguaauugauguauuuc

SEQ ID NO: 39185 - RNA, 64 nt, hsa
uuuaaagacaauucuagcagaauuuaucaaaacaagaugaaacacagaaaaguugaaaccacaa

SEQ ID NO: 39186 - RNA, 64 nt, hsa
uguguauuucagagcuggauacugccauuaccacagaugaaaguugcaaugaucuagcaguugu

SEQ ID NO: 39187 - RNA, 64 nt, hsa
uggaaagcagcuucuuagcugccuaauuaaugaaagaugaaaauaggaagugcccuggaggggg

SEQ ID NO: 39188 - RNA, 64 nt, hsa
caugccuggugccacagccaugguuuccauuucuagaugaaaggauggccuaggacauaggucu

SEQ ID NO: 39189 - RNA, 64 nt, hsa
uaaaaagccuaaauguucagaaaauuauuuuaaaagaugaaagagggaaauaggccauggacgg

SEQ ID NO: 39190 - RNA, 64 nt, hsa
uaauaauuaagcuaugauaggagaauaauaauaaagaugaaaagagaagguacccuaaggcuga

SEQ ID NO: 39191 - RNA, 64 nt, hsa
uaauugguuaaguagcuuaaugauuaggcaaacuagaugaaaagauuaggggcuuccacacugc

SEQ ID NO: 39192 - RNA, 64 nt, hsa
aaaaaauguauuuacuaagugucacauuucucuaagaugaaagauuuuuacucuagaaacugug

SEQ ID NO: 39193 - RNA, 64 nt, hsa
uuuucugacacccuuuaaugugguugcagaucucagaugaaaccaagcuuaauuauacuaugcc

SEQ ID NO: 39194 - RNA, 64 nt, hsa
uuauauaauucacuuuguuuuacuuuuguuccccagaugaaagaacucuaaguaaauacauuuu

SEQ ID NO: 39195 - RNA, 64 nt, hsa
uuguauaguuauugagaccuauaguguguggcuuagaugaaagggagaguaaauuuucauacca

SEQ ID NO: 39196 - RNA, 64 nt, hsa
gcaugagaauauaucaccugugguuuuuccuuugagaugaaacguaguuucuaguuauaucauu

SEQ ID NO: 39197 - RNA, 64 nt, hsa
uuagauguuugauacauuuuaaguauuuuuaaauagaugaaaauucuaaaugauuuucccucaa

SEQ ID NO: 39198 - RNA, 64 nt, hsa
acucccacaaaaauuuuauuggccuuuuuguaagagaugaaaaagaauugacacaguucucuuu

SEQ ID NO: 39199 - RNA, 64 nt, hsa
ucgguacaucuuaugguuuaaagaguagaaaauaagaugaaauauccuaaaauauaggagcaca

SEQ ID NO: 39200 - RNA, 64 nt, hsa
uuuuguuguuguugaaaagacuuugcuuacagcuagaugaaacuuucuauagaaaaaaaaaauu

SEQ ID NO: 39201 - RNA, 64 nt, hsa
uaaagaaaagaugaaaaaaaaaacuaucaaagaaagaugaaauaauaaaacuauuauauaaagg

SEQ ID NO: 39202 - RNA, 64 nt, hsa
agauucuggcuucuacugaagaaccauaaagaaaagaugaaaaaaaaaacuaucaaagaaagau

SEQ ID NO: 39203 - RNA, 64 nt, hsa
auucuuuagaugcucacauuguuuuaaauaaaauagaugaaaugggaaguuuagguaaucaucu

SEQ ID NO: 39204 - RNA, 64 nt, hsa
agaugaaaugggaaguuuagguaaucaucuagacagaugaaauuauuaucuagguaggagggcu

SEQ ID NO: 39205 - RNA, 64 nt, hsa
uccugcugugacaugucuguuagggaggcacucaagaugaaaacuacuucaacuaaaagccaac

SEQ ID NO: 39206 - RNA, 64 nt, hsa
aagagaaaagaaaaaaagagagaagaaaaaggagagaugaaaaaggaggaugaggagaagaauu

SEQ ID NO: 39207 - RNA, 64 nt, hsa
auaauguuuuugguuauuuggaaagauaguuuagagaugaaagguuuuuuuggguaacaauccc

SEQ ID NO: 39208 - RNA, 64 nt, hsa
cuugaagugcuaauaauguuaaagacacuuaagaagaugaaauaauauucaaauuucauuuuuu

SEQ ID NO: 39209 - RNA, 64 nt, hsa
cagccucagaacaaagugagacaguccagccuggagaugaaaucuuacagcuggguggcacugc

SEQ ID NO: 39210 - RNA, 64 nt, hsa
aguaaggaugugggggaagaccuggcaaggacacagaugaaacacaaacaauaguaauucucag

SEQ ID NO: 39211 - RNA, 64 nt, hsa
uguaauauuauguaauuaugugaacuuuugagagagaugaaaggauggucuccaaaaaauuaau

SEQ ID NO: 39212 - RNA, 64 nt, hsa
gcacucagggaaaugcaaauugaaaugcucagugagaugaaacuuccccuucauggaucuggca

SEQ ID NO: 39213 - RNA, 64 nt, hsa
uuggcuuuuccccucuacuuccaguccuuagguuagaugaaaaguaggugauugaaggagagga

SEQ ID NO: 39214 - RNA, 64 nt, hsa
caacagaacuaucaacuguauacuuauuugguggagaugaaauuucaagacagcaguaucgcag

SEQ ID NO: 39215 - RNA, 64 nt, hsa
cgacuccccgaggugcagcugccaaaagucucagagaugaaacuccccaaggugccugaaaugg

SEQ ID NO: 39216 - RNA, 64 nt, hsa
caccucccggaagugcagcucccgaaagucccagagaugaaacucccuaaaaugccugagaugg

SEQ ID NO: 39217 - RNA, 64 nt, hsa
cagcuuccaaaagucccagagaugaagcucccugagaugaaacucccugaggugaaacucccga

SEQ ID NO: 39218 - RNA, 64 nt, hsa
aagcuuccaaaggugccugagaugaaacuuccugagaugaaacucccugaagugcaacucccga

SEQ ID NO: 39219 - RNA, 64 nt, hsa
aaagucccugagaugaagcuuccaaaggugccugagaugaaacuuccugagaugaaacucccug

SEQ ID NO: 39220 - RNA, 64 nt, hsa
cggcuuccagaggugcagcugccgaaagugccagagaugaaagucccugagaugaagcuuccaa

SEQ ID NO: 39221 - RNA, 64 nt, hsa
cggcuuccagagguacagcugccgaaagugucagagaugaaacucccagaggugucagaggugg

SEQ ID NO: 39222 - RNA, 64 nt, hsa
cggcuuccagagguacagcugcugaaagugucggagaugaaacucccaaaggugccagagaugg

SEQ ID NO: 39223 - RNA, 64 nt, hsa
cggcuuccagagguagagcugcccaaagugucagagaugaaacucccaaaggugccagagaugg

SEQ ID NO: 39224 - RNA, 64 nt, hsa
cgacucccagagguggagcuccccaaggugucagagaugaaacucccaaaggugccagagaugg

SEQ ID NO: 39225 - RNA, 64 nt, hsa
cuaaaccuaguuugaaaucaacagucuugagaauagaugaaaauuuugaugaauaguggaauuc

SEQ ID NO: 39226 - RNA, 64 nt, hsa
guuaaauguucauggucaacuccaaggaauacugagaugaaaugugguaaaucaacuccacaga

SEQ ID NO: 39227 - RNA, 64 nt, hsa
caaagaaccugcucugaugacacuuagaggggagagaugaaagccaaacaaaugaauaaacaua

SEQ ID NO: 39228 - RNA, 64 nt, hsa
cuggaaagguaagacugaggucagaaaggugcagagaugaaaagauuuugaaggaccuuaugaa

SEQ ID NO: 39229 - RNA, 64 nt, hsa
uuuucaaaaaggaaaaagcuguagaacauuuuguagaugaaacuacuguuuaagauuaaugaau

SEQ ID NO: 39230 - RNA, 64 nt, hsa
gugccucucacaaaagauccuggauggaggaguaagaugaaauauuaugcuauuauaugaugcu

SEQ ID NO: 39231 - RNA, 64 nt, hsa
cgggagcaguuugcguguuuggguuuuuuaauugagaugaaauucaaauaaccuaaaaaucaau

SEQ ID NO: 39232 - RNA, 64 nt, hsa
auggcuuccuaaauggcccuguuuacggccuaugagaugaaauaugugauuuucucuaauguaa

SEQ ID NO: 39233 - RNA, 64 nt, hsa
cuuguugcuccuuucagguaaagaagcagauuuuagaugaaaagaucuacugcccuccugaggc

SEQ ID NO: 39234 - RNA, 64 nt, hsa
aggagaaggaaagccgauucuuuggaaguucagcagaugaaagcccaggccagggaggagaagg

SEQ ID NO: 39235 - RNA, 64 nt, hsa
cgcacgagggaugaguuggagaggaggcugcugcagaugaaagaagaagcaacaauggccaacg

SEQ ID NO: 39236 - RNA, 64 nt, hsa
gcuuaugaaauguaauuaaauuuauuaagaaaauagaugaaaaauuaggguacacagcuggcca

SEQ ID NO: 39237 - RNA, 64 nt, hsa
uccaaaaagaguaauaguuguuuacuagugugcuagaugaaaagcgugcaauaugcuuuaaagc

SEQ ID NO: 39238 - RNA, 64 nt, hsa
ugaagcaguuugaaaauuugaauugagucuuaacuuuaggaaaugagguuucauaauucugccu

SEQ ID NO: 39239 - RNA, 64 nt, hsa
ggcauguuugcaaaaauauggcacauguauacauuuuaggaaauguuacuuuuguuaaucuuua

SEQ ID NO: 39240 - RNA, 64 nt, hsa
acacagauaccaugaugagaguauauuaaagaaauuuaggaaagcaccugguuccuuucucccc

SEQ ID NO: 39241 - RNA, 64 nt, hsa
gauaacuccagcaggaaacuguaacugcuaugucuuuaggaaaauguagaagaaagaacauuau

SEQ ID NO: 39242 - RNA, 64 nt, hsa
guucaugaaggcaaauguauggaugagagugugguuuaggaaagagggcacugauaucagauua

SEQ ID NO: 39243 - RNA, 64 nt, hsa
aucuagucuccuugaaaaaaaaaucucuuggauguuuaggaaggaagacuuggccgugaugugg

SEQ ID NO: 39244 - RNA, 64 nt, hsa
uguggauccauggugauucuagacuucagauauauuuaggaaggcgcagauuucaaaucugugu

SEQ ID NO: 39245 - RNA, 64 nt, hsa
agaauaggaagaguagcacuuuccgccuaagcacuuuaggaaaucaccuuucuaagcccugggg

SEQ ID NO: 39246 - RNA, 64 nt, hsa
guuagaguuaugguaggcaaaaagaaaaggagaauuuaggaaauaaauaugcuauaaacaaggu

SEQ ID NO: 39247 - RNA, 64 nt, hsa
uucacacaaaagaauuaaaagcuuaaaaauaauuuuuaggaaacacaauauucaaaaucuaaac

SEQ ID NO: 39248 - RNA, 64 nt, hsa
aacaaaaacaguuuaggaagcauaauuacgaacauuuaggaaccaauauguauaaguaauucgg

SEQ ID NO: 39249 - RNA, 64 nt, hsa
cacucuugguucucuugccguagaacaaaaacaguuuaggaagcauaauuacgaacauuuagga

SEQ ID NO: 39250 - RNA, 64 nt, hsa
uagcagaauauauuugcagcuauugacuuuguaauuuaggaaaaauguauaauaagauaaaauc

SEQ ID NO: 39251 - RNA, 64 nt, hsa
auugcaaaauaauggccaguuguuuaggaaggccuuuaggaagacaaauaaauaacaaacaaac

SEQ ID NO: 39252 - RNA, 64 nt, hsa
uauuuccaaauaauugcaaaauaauggccaguuguuuaggaaggccuuuaggaagacaaauaaa

SEQ ID NO: 39253 - RNA, 64 nt, hsa
ucuaaggagagaaggguugucacauuauaaaaucuuuaggaaaaugugaacuggaaaacgcuuc

SEQ ID NO: 39254 - RNA, 64 nt, hsa
cuggugacuauuauugcggaccgugguacccaguuuuaggaauguggagaaaggaauucuguug

SEQ ID NO: 39255 - RNA, 64 nt, hsa
ugacagguguuccaauggccuuuaucaaaacauguuuaggaaaauugguacugugauaaauuug

SEQ ID NO: 39256 - RNA, 64 nt, hsa
auaaacgacuuaaugaaugauacaucagucagauuuuaggaaggcagucaauuauggauauuuu

SEQ ID NO: 39257 - RNA, 64 nt, hsa
uauggcaucagguaggagaaggagacgaagaugcuuuaggaagauaaaaaccuuacaaagaaug

SEQ ID NO: 39258 - RNA, 64 nt, hsa
ucaguacuuucuccucccauccuaagcuucucauuuuaggaacugacaugauaaggugguucuu

SEQ ID NO: 39259 - RNA, 64 nt, hsa
uuauucaugucuuuaaaucagauaccaaauauuuuuuaggaaagaaaaauguuauuacugucau

SEQ ID NO: 39260 - RNA, 64 nt, hsa
uguguauuugaacccaccaugacagaaaguaaauuuuaggaaauaguuaugagauuaagggaaa

SEQ ID NO: 39261 - RNA, 64 nt, hsa
aaauaaacaaaccagucuuuauuuuaaaagaaacuuuaggaaacaaacccacauaauaguuggg

SEQ ID NO: 39262 - RNA, 64 nt, hsa
aauaucaaauugauaguaacaacagaagcauaauuuuaggaaggcuuucgcaaaccuagccuuu

SEQ ID NO: 39263 - RNA, 64 nt, hsa
caaaggucuggacuaagcaaaacaacagugucaguuuaggaaauuauuacuacuuugaacacaa

SEQ ID NO: 39264 - RNA, 64 nt, hsa
caucuuugcucuuaacuccaagucugcccuucuuuuuaggaaacccuaaaggagaaggaagcag

SEQ ID NO: 39265 - RNA, 64 nt, hsa
uaaguuccuuuccuuuucuuuaaagaaguugaaguuuaggaauccuuuggugccaacugguguu

SEQ ID NO: 39266 - RNA, 64 nt, hsa
gcacaucuuggcuauguaauucuuguaauuuuuauuuaggaaguguugaagggagguggcaaga

SEQ ID NO: 39267 - RNA, 64 nt, hsa
guguuaauuccaggcagggaauuagcacaaaagguuuaggaaggaaucuuuuuuuaaagacuuc

SEQ ID NO: 39268 - RNA, 64 nt, hsa
caggaugacuuucuggccagaauaccggaaagcuuuuaggaagcuucguucacaugcuauuuaa

SEQ ID NO: 39269 - RNA, 64 nt, hsa
ucuuuuuuuuaaagacagcauggaaaguuuaagauuuaggaacuucuugagaaaucuucauaau

SEQ ID NO: 39270 - RNA, 64 nt, hsa
uuguuuuauaugcuuuuaagaauguagauuguaauuuaggaaauggcauauauucugcaaagug

SEQ ID NO: 39271 - RNA, 64 nt, hsa
accuuuuaaguuaauguauaugcuuaaaaacaguuuuaggaaaauauuugguagacaaagaguu

SEQ ID NO: 39272 - RNA, 64 nt, hsa
uugcccuaaauugcuaggugugacccagcaaucuuuuaggaagagauuuuacaguggugcuuua

SEQ ID NO: 39273 - RNA, 64 nt, hsa
aaauaggggauauuuaagguagcuucagcuagcuuuuaggaaaaucacuuugucuaacucagaa

SEQ ID NO: 39274 - RNA, 64 nt, hsa
gcuacuaaguucacauuagaauuagugccagaauuuuaggaacuucagagaucguguauugaga

SEQ ID NO: 39275 - RNA, 64 nt, hsa
aaaggaagggaagaccugaaagucauuugaacauuuuaggaaaagaauauuggagagaaaaagg

SEQ ID NO: 39276 - RNA, 64 nt, hsa
uuguaucaaggcagaggugaugccaugccauacuuuuaggaagucugagaugauaaauauuuca

SEQ ID NO: 39277 - RNA, 64 nt, hsa
ugucuuccacaguaaagaaaacuuaguggcuuaauuuaggaaacauguuaacaggacacuaugu

SEQ ID NO: 39278 - RNA, 64 nt, hsa
guaaaguauuaauuauugaacuuugaaccagauuuuuaggaaaauuauguucuuuuucccccuu

SEQ ID NO: 39279 - RNA, 64 nt, hsa
gaaagaacucauacucuauguguccccuauaaauuuuaggaauguuagggagccaauggaaucu

SEQ ID NO: 39280 - RNA, 64 nt, hsa
agaaaaacucugaauguaaggaauguggaaaucuuuuaggaauuucucauaccauaauuaccac

SEQ ID NO: 39281 - RNA, 64 nt, hsa
uuccucuucuucgugauaauauaaucucuauuuuuuuaggaaaacaaaaaugaaaaacuacucc

SEQ ID NO: 39282 - RNA, 64 nt, hsa
uucuauuaguauuuguaucuucaguucauuccacuuuaggaaacagagcugccaauugaaacag

SEQ ID NO: 39283 - RNA, 64 nt, hsa
acaucaagaauguaguguagcucauuauugagaauuuaggaaagccugaauccauuaauuaagg

SEQ ID NO: 39284 - RNA, 64 nt, hsa
aaucauauuugaagacaguaagacaguaaacuauuuuaggaagucaacccccauugcacucugu

SEQ ID NO: 39285 - RNA, 64 nt, hsa
guuuuccugguugcacucuguagacuggaucuguuuuaggaaguuacuuucacagugauguugu

SEQ ID NO: 39286 - RNA, 64 nt, hsa
cuggaguacuuggacagauguuauagugguuucuuuuaggaaaaucugucauuaaaaaaguuau

SEQ ID NO: 39287 - RNA, 64 nt, hsa
uuagcaaccauaaaauugucauaaaauuaauaaauuuaggaaagaauaaagauuuauauauuca

SEQ ID NO: 39288 - RNA, 64 nt, hsa
ggauuguuaaaaucauagaaagaucuuuuauuuuuuuaggaaucaaugacuuaacagaacucaa

SEQ ID NO: 39289 - RNA, 64 nt, hsa
gaguaugguaggggguuugaagaauccccuguccaccucccaaauccaggcccggcccccucug

SEQ ID NO: 39290 - RNA, 64 nt, hsa
cucaaucuccugaccucgugauccacccaccucgaccucccaaagugcugagauuacaggcgug

SEQ ID NO: 39291 - RNA, 64 nt, hsa
ugcaauuuccaaaagauauuuugguaagacaacaaccucccagugauaugccaccuuucaauuu

SEQ ID NO: 39292 - RNA, 64 nt, hsa
aguggccccgcaaucucggcucacugcaaccucuaccucccagguucaagcuauucuacugccu

SEQ ID NO: 39293 - RNA, 64 nt, hsa
agacagguccuccaguacccugucuucuagccccaccucccacuuggccagaaccaauguccau

SEQ ID NO: 39294 - RNA, 64 nt, hsa
aggggcagggucccuggccagaaggggcauggccaccucccaaccugaugaccucucuggcugg

SEQ ID NO: 39295 - RNA, 64 nt, hsa
aacucuguggcuggcagccacuauucucaguuacaccucccagugcccuucugaaaagugccag

SEQ ID NO: 39296 - RNA, 64 nt, hsa
aggaccaugugguuggaaggauagacugcccccuaccucccaccaccaccaugaaguuugguga

SEQ ID NO: 39297 - RNA, 64 nt, hsa
cgaacucuugagcucaagcagucuacccaccuugaccucccaaagugcugggauuacaggcuug

SEQ ID NO: 39298 - RNA, 64 nt, hsa
cugccuucugggcucaagcaauccucccacuucaaccucccaaguagcugggacuauaggcaug

SEQ ID NO: 39299 - RNA, 64 nt, hsa
ucgaacuccuggccuaggugauccacccgccucgaccucccaaagugcugggauuacaggcaug

SEQ ID NO: 39300 - RNA, 64 nt, hsa
uuugccauggaugagaguccugggugugaggaacaccucccaccaggcuagaggcaacugccca

SEQ ID NO: 39301 - RNA, 64 nt, hsa
gacgagacccccucaucucagaguaaugggaagaaccucccacaucucccuggcagcagaugag

SEQ ID NO: 39302 - RNA, 64 nt, hsa
ccaaggaaggccuaugaaaagguccugaugcccaaccucccaccccuucaauguggggacgaga

SEQ ID NO: 39303 - RNA, 64 nt, hsa
ugcaguggugugaucucagcucacugcaaccuccaccucccagguucaagcaauucuucugccu

SEQ ID NO: 39304 - RNA, 64 nt, hsa
cgcaguggugacaucucggcucacugcaaccuccaccucccagguucaagugauucuccugccu

SEQ ID NO: 39305 - RNA, 64 nt, hsa
auacauuucucaaauguacacuuguauuauaauaaccucccaguucuaggggauauuugugcaa

SEQ ID NO: 39306 - RNA, 64 nt, hsa
ugaacuccugaacucaagugauccaccugccucgaccucccaaaguacugggauuacaggcgug

SEQ ID NO: 39307 - RNA, 64 nt, hsa
uacaguagugcaaucucagcucacugcaaccuccaccucccagacucaagccauccucccaccu

SEQ ID NO: 39308 - RNA, 64 nt, hsa
ccaccucccagacucaagccauccucccaccucaaccucccaaguagcugggacuacaggcaua

SEQ ID NO: 39309 - RNA, 64 nt, hsa
cccguuagagagcugagacccuuauuuaaaacucaccucccaaucaccccaaacaaauggaaga

SEQ ID NO: 39310 - RNA, 64 nt, hsa
cccaccuggaaucccacaacaucagcucugugccaccucccaagagggcuccucacuaucuagg

SEQ ID NO: 39311 - RNA, 64 nt, hsa
cucgaucucuugaccucaugauccacccgccucgaccucccaaagugcugugauuacaggugug

SEQ ID NO: 39312 - RNA, 64 nt, hsa
ugcgguggugcaaucucggcucacugcaaccuccaccucccagguucaagcaauucuccugccu

SEQ ID NO: 39313 - RNA, 64 nt, hsa
ccauuguccccaaguaugaggugaacggggugaaaccucccauuggccaaaggacacggcucag

SEQ ID NO: 39314 - RNA, 64 nt, hsa
caaguucugugguucugagaagcccgaggucaucaccucccaguacaacaacaugcgcguggag

SEQ ID NO: 39315 - RNA, 64 nt, hsa
cucagcuccgccccauacccgucacuacagccucaccucccaccccugucacuacggccucacc

SEQ ID NO: 39316 - RNA, 64 nt, hsa
cagccucaccucccaccccugucacuacggccucaccucccaccccugucacuacagccucacc

SEQ ID NO: 39317 - RNA, 64 nt, hsa
cgguucaugagaggucugcucucaugaccuaaucaccucccaaaggccccaccucccaauacca

SEQ ID NO: 39318 - RNA, 64 nt, hsa
ugcucucaugaccuaaucaccucccaaaggccccaccucccaauaccaucacauuagggguuag

SEQ ID NO: 39319 - RNA, 64 nt, hsa
cucucagccgaugccccccgguaugggaaccagcaccucccaccaaccaaccacacccgguggg

SEQ ID NO: 39320 - RNA, 64 nt, hsa
cucucagccgaugccccccaguaugggaaccagcaccucccaccaaccagccacacccgguggg

SEQ ID NO: 39321 - RNA, 64 nt, hsa
cucucagccgaugccccccggugugggaaccagcaccucccaccaaccagccacacccaguggg

SEQ ID NO: 39322 - RNA, 64 nt, hsa
cacacccggggggcccccgggugcagaaaacagcaccucccaccaaccagccacucccgguggg

SEQ ID NO: 39323 - RNA, 64 nt, hsa
uuacuuugucccagguuggagucccuacccucccaccucccaccugauaugcagugcuuuugac

SEQ ID NO: 39324 - RNA, 64 nt, hsa
ucucccccuccuaccugagaggcugcacccuccaaccucccauuggcucgcuccccccccccca

SEQ ID NO: 39325 - RNA, 64 nt, hsa
gacucugugcccuugcucucuaacuucugagcccaccucccaggguaggcaccugggggcaugc

SEQ ID NO: 39326 - RNA, 64 nt, hsa
cccaggguaggcaccugggggcaugcaggugcccaccucccaggguaggcaccugggggcaugc

SEQ ID NO: 39327 - RNA, 64 nt, hsa
ucacaucuccugagcuuaguguccguggcuguccaccucccagccauacuugacuguccccaaa

SEQ ID NO: 39328 - RNA, 64 nt, hsa
gaauccucuucauucauugcuagugcuuccccucaccucccacucuccacuucccaguuugcaa

SEQ ID NO: 39329 - RNA, 64 nt, hsa
cuuccugugaacauuuguaaccacugcuucagucaccucccaccucuugccaccugcugcugcu

SEQ ID NO: 39330 - RNA, 64 nt, hsa
ccaacccaugaacucuucacuccuuggggaagccaccucccaucacaccccugagcagaguuag

SEQ ID NO: 39331 - RNA, 64 nt, hsa
gagagaagaagaagaagaagagacacaaaucucuaccucccauguuaagcuuugcaggacaggg

SEQ ID NO: 39332 - RNA, 64 nt, hsa
uuggcucacuugaucuuggcucacuguaaccuccaccucccaggcucaagugauccucccaccc

SEQ ID NO: 39333 - RNA, 61 nt, hsa
cgggaccggggccagccuaggggggccugugaccucccauggagcccagccccgcccucca

SEQ ID NO: 39334 - RNA, 64 nt, hsa
gccccgcccuccacaccuccggcgcuccgcacccaccucccacggccccgccccugcccccgcu

SEQ ID NO: 39335 - RNA, 64 nt, hsa
ccuccgcugggccuggauggcugccucaccucucaccucccaacgucccuagcccuuacguccu

SEQ ID NO: 39336 - RNA, 64 nt, hsa
uagcccaucuuucaagggaccucuccaugaucccaccucccauucacagauaccucucuuguag

SEQ ID NO: 39337 - RNA, 64 nt, hsa
cagagccugguguggggucugagacggccggagaaccucccaggcagggcucuguguuuugucu

SEQ ID NO: 39338 - RNA, 64 nt, hsa
gcuauguucccgccgcaguggggcccugacgcccaccucccaggugccccucgagcaaaaaccu

SEQ ID NO: 39339 - RNA, 64 nt, hsa
ccccaagucuucaaccagauauccucggcaacccaccucccacccuccuccucuucuccuucaa

SEQ ID NO: 39340 - RNA, 64 nt, hsa
uccccccaccccccaaacguccuggacugcacagaccucccacuccagaccauccaggccuggu

SEQ ID NO: 39341 - RNA, 64 nt, hsa
cccaaggugccugaaauggccgugcccgaugugcaccucccagaggugcagcugcccaaagucu

SEQ ID NO: 39342 - RNA, 64 nt, hsa
ccgaaggugcccgagauggccgugcccgaugugcaccucccagaagugcagcuuccaaaagucc

SEQ ID NO: 39343 - RNA, 64 nt, hsa
ggaugggcuuggccaaaacaggcucaggccaaagaccucccaagcuguauguacuuccaguauc

SEQ ID NO: 39344 - RNA, 64 nt, hsa
caggcuggagugaucucagcucacugcaaccuccaccucccagguucaagcgacucuccugccu

SEQ ID NO: 39345 - RNA, 64 nt, hsa
ucagucccugacuaacagccucagcacauccgacaccucccagcgugggaccccaagugaagac

SEQ ID NO: 39346 - RNA, 64 nt, hsa
cucacagccccggcccccugugcagggccguaguaccucccagcagggugaagaguccaagaag

SEQ ID NO: 39347 - RNA, 64 nt, hsa
gguuaauauacauauauaaauauauaaauacaaacacacacacacacuuuuuuuguacuguagc

SEQ ID NO: 39348 - RNA, 64 nt, hsa
uuaauauacauauauaaauauauaaauacaaacacacacacacacuuuuuuuguacuguagcaa

SEQ ID NO: 39349 - RNA, 64 nt, hsa
aauauacauauauaaauauauaaauacaaacacacacacacacuuuuuuuguacuguagcaauu

SEQ ID NO: 39350 - RNA, 64 nt, hsa
auaaaccaguguuuucuacuuuggcaacucacgucacacacauauuacacacaugugcgcauua

SEQ ID NO: 39351 - RNA, 64 nt, hsa
acgucacacacauauuacacacaugugcgcauuacacacacacaauacacauacaugcauauag

SEQ ID NO: 39352 - RNA, 64 nt, hsa
gucacacacauauuacacacaugugcgcauuacacacacacaauacacauacaugcauauagac

SEQ ID NO: 39353 - RNA, 64 nt, hsa
agagacaugcaacaacaacacacacgcacacacgcacacacacacacguacacacacauacaaa

SEQ ID NO: 39354 - RNA, 64 nt, hsa
agacaugcaacaacaacacacacgcacacacgcacacacacacacguacacacacauacaaaau

SEQ ID NO: 39355 - RNA, 64 nt, hsa
acaugcaacaacaacacacacgcacacacgcacacacacacacguacacacacauacaaaaucc

SEQ ID NO: 39356 - RNA, 64 nt, hsa
aacacacacgcacacacgcacacacacacacguacacacacauacaaaaucccucugcaguuuu

SEQ ID NO: 39357 - RNA, 64 nt, hsa
auguggccuaacaaaaggaaaaaauguuuuuaaacacacacacacacacacacacacacacaca

SEQ ID NO: 39358 - RNA, 64 nt, hsa
guggccuaacaaaaggaaaaaauguuuuuaaacacacacacacacacacacacacacacacaca

SEQ ID NO: 39359 - RNA, 64 nt, hsa
ggccuaacaaaaggaaaaaauguuuuuaaacacacacacacacacacacacacacacacacaua

SEQ ID NO: 39360 - RNA, 64 nt, hsa
ccuaacaaaaggaaaaaauguuuuuaaacacacacacacacacacacacacacacacacauaca

SEQ ID NO: 39361 - RNA, 64 nt, hsa
uaacaaaaggaaaaaauguuuuuaaacacacacacacacacacacacacacacacacauacaca

SEQ ID NO: 39362 - RNA, 64 nt, hsa
acaaaaggaaaaaauguuuuuaaacacacacacacacacacacacacacacacacauacacaga

SEQ ID NO: 39363 - RNA, 64 nt, hsa
aaaaggaaaaaauguuuuuaaacacacacacacacacacacacacacacacacauacacagaca

SEQ ID NO: 39364 - RNA, 64 nt, hsa
aaggaaaaaauguuuuuaaacacacacacacacacacacacacacacacacauacacagacaaa

SEQ ID NO: 39365 - RNA, 64 nt, hsa
ggaaaaaauguuuuuaaacacacacacacacacacacacacacacacacauacacagacaaaaa

SEQ ID NO: 39366 - RNA, 64 nt, hsa
aaaaaauguuuuuaaacacacacacacacacacacacacacacacacauacacagacaaaaaca

SEQ ID NO: 39367 - RNA, 64 nt, hsa
aaaauguuuuuaaacacacacacacacacacacacacacacacacauacacagacaaaaacaca

SEQ ID NO: 39368 - RNA, 64 nt, hsa
aauguuuuuaaacacacacacacacacacacacacacacacacauacacagacaaaaacacaaa

SEQ ID NO: 39369 - RNA, 64 nt, hsa
uguuuuuaaacacacacacacacacacacacacacacacacauacacagacaaaaacacaaaaa

SEQ ID NO: 39370 - RNA, 64 nt, hsa
uggugucauccugaaaaacaaaacccaguguuugcacacacacaaaaucuugaccccguuaucu

SEQ ID NO: 39371 - RNA, 64 nt, hsa
gugucauccugaaaaacaaaacccaguguuugcacacacacaaaaucuugaccccguuaucuau

SEQ ID NO: 39372 - RNA, 64 nt, hsa
cacagacccacggagcucucuguguuuggccucucacacacacacaggcccauagacagauggg

SEQ ID NO: 39373 - RNA, 64 nt, hsa
cagacccacggagcucucuguguuuggccucucacacacacacaggcccauagacagaugggca

SEQ ID NO: 39374 - RNA, 64 nt, hsa
gacccacggagcucucuguguuuggccucucacacacacacaggcccauagacagaugggcaga

SEQ ID NO: 39375 - RNA, 64 nt, hsa
gcagggacuaccuuucuuauaaacccagggggaccacacacacacacacacacacacacacaca

SEQ ID NO: 39376 - RNA, 64 nt, hsa
agggacuaccuuucuuauaaacccagggggaccacacacacacacacacacacacacacacaca

SEQ ID NO: 39377 - RNA, 64 nt, hsa
ggacuaccuuucuuauaaacccagggggaccacacacacacacacacacacacacacacacaca

SEQ ID NO: 39378 - RNA, 64 nt, hsa
acuaccuuucuuauaaacccagggggaccacacacacacacacacacacacacacacacacaca

SEQ ID NO: 39379 - RNA, 64 nt, hsa
uaccuuucuuauaaacccagggggaccacacacacacacacacacacacacacacacacacaca

SEQ ID NO: 39380 - RNA, 64 nt, hsa
ccuuucuuauaaacccagggggaccacacacacacacacacacacacacacacacacacacaca

SEQ ID NO: 39381 - RNA, 64 nt, hsa
uuucuuauaaacccagggggaccacacacacacacacacacacacacacacacacacacacaca

SEQ ID NO: 39382 - RNA, 64 nt, hsa
ucuuauaaacccagggggaccacacacacacacacacacacacacacacacacacacacacaca

SEQ ID NO: 39383 - RNA, 64 nt, hsa
uuauaaacccagggggaccacacacacacacacacacacacacacacacacacacacacacaca

SEQ ID NO: 39384 - RNA, 64 nt, hsa
auaaacccagggggaccacacacacacacacacacacacacacacacacacacacacacacaca

SEQ ID NO: 39385 - RNA, 64 nt, hsa
aaacccagggggaccacacacacacacacacacacacacacacacacacacacacacacacaca

SEQ ID NO: 39386 - RNA, 64 nt, hsa
acccagggggaccacacacacacacacacacacacacacacacacacacacacacacacacacu

SEQ ID NO: 39387 - RNA, 64 nt, hsa
ccagggggaccacacacacacacacacacacacacacacacacacacacacacacacacacucu

SEQ ID NO: 39388 - RNA, 64 nt, hsa
agggggaccacacacacacacacacacacacacacacacacacacacacacacacacacucuug

SEQ ID NO: 39389 - RNA, 64 nt, hsa
ggggaccacacacacacacacacacacacacacacacacacacacacacacacacacucuugau

SEQ ID NO: 39390 - RNA, 64 nt, hsa
ggaccacacacacacacacacacacacacacacacacacacacacacacacacacucuugaucc

SEQ ID NO: 39391 - RNA, 64 nt, hsa
accacacacacacacacacacacacacacacacacacacacacacacacacacucuugaucccu

SEQ ID NO: 39392 - RNA, 64 nt, hsa
cacacacacacacacacacacacacacacacacacacacacacacacacacucuugaucccuug

SEQ ID NO: 39393 - RNA, 64 nt, hsa
cacacacacacacacacacacacacacacacacacacacacacacacacucuugaucccuugcu

SEQ ID NO: 39394 - RNA, 64 nt, hsa
cacacacacacacacacacacacacacacacacacacacacacacacucuugaucccuugcuuc

SEQ ID NO: 39395 - RNA, 64 nt, hsa
cacacacacacacacacacacacacacacacacacacacacacacucuugaucccuugcuuccc

SEQ ID NO: 39396 - RNA, 64 nt, hsa
cacacacacacacacacacacacacacacacacacacacacacucuugaucccuugcuucccuc

SEQ ID NO: 39397 - RNA, 64 nt, hsa
cauguacauacaugcacauacucaaacaugcguacacacacacacauuuacacacgcaggacuc

SEQ ID NO: 39398 - RNA, 64 nt, hsa
uguacauacaugcacauacucaaacaugcguacacacacacacauuuacacacgcaggacucug

SEQ ID NO: 39399 - RNA, 64 nt, hsa
uacauacaugcacauacucaaacaugcguacacacacacacauuuacacacgcaggacucugga

SEQ ID NO: 39400 - RNA, 64 nt, hsa
auauagaaauauauacgaacaaaacacacgcgcgcacacacacacauacacgaaagagagagaa

SEQ ID NO: 39401 - RNA, 64 nt, hsa
auagaaauauauacgaacaaaacacacgcgcgcacacacacacauacacgaaagagagagaaac

SEQ ID NO: 39402 - RNA, 64 nt, hsa
agaaauauauacgaacaaaacacacgcgcgcacacacacacauacacgaaagagagagaaacaa

SEQ ID NO: 39403 - RNA, 64 nt, hsa
caacuuguuucuuaguucauauaaucucgggauacacacacacacacacauauauauacacaca

SEQ ID NO: 39404 - RNA, 64 nt, hsa
acuuguuucuuaguucauauaaucucgggauacacacacacacacacauauauauacacacaca

SEQ ID NO: 39405 - RNA, 64 nt, hsa
uuguuucuuaguucauauaaucucgggauacacacacacacacacauauauauacacacacaua

SEQ ID NO: 39406 - RNA, 64 nt, hsa
guuucuuaguucauauaaucucgggauacacacacacacacacauauauauacacacacauacg

SEQ ID NO: 39407 - RNA, 64 nt, hsa
uucuuaguucauauaaucucgggauacacacacacacacacauauauauacacacacauacgua

SEQ ID NO: 39408 - RNA, 64 nt, hsa
ucucgggauacacacacacacacacauauauauacacacacauacguauacacacacauacaua

SEQ ID NO: 39409 - RNA, 64 nt, hsa
cacacacacauauauauacacacacauacguauacacacacauacauauauauaaauauaccug

SEQ ID NO: 39410 - RNA, 64 nt, hsa
ccuucccacggcgugucccacggccagacacaugcacacacaucacacccucaaacacccagcu

SEQ ID NO: 39411 - RNA, 64 nt, hsa
cacacacaucacacccucaaacacccagcucagccacacacaacuacccuccaaaccaccacag

SEQ ID NO: 39412 - RNA, 64 nt, hsa
gaaucaugcagggaagggucugccccugcccuggcacacacaggcacccauucccucccccugc

SEQ ID NO: 39413 - RNA, 64 nt, hsa
cccugcugacauguguaugcguaugcauacacaccacacacacacacaugcacaagucaugugc

SEQ ID NO: 39414 - RNA, 64 nt, hsa
cugcugacauguguaugcguaugcauacacaccacacacacacacaugcacaagucaugugcga

SEQ ID NO: 39415 - RNA, 64 nt, hsa
gcugacauguguaugcguaugcauacacaccacacacacacacaugcacaagucaugugcgaac

SEQ ID NO: 39416 - RNA, 64 nt, hsa
ugacauguguaugcguaugcauacacaccacacacacacacaugcacaagucaugugcgaacag

SEQ ID NO: 39417 - RNA, 64 nt, hsa
uuucuggauuuauacguaaucacuccugccccaacacacacacacacacacacacacacacaca

SEQ ID NO: 39418 - RNA, 64 nt, hsa
ucuggauuuauacguaaucacuccugccccaacacacacacacacacacacacacacacacaca

SEQ ID NO: 39419 - RNA, 64 nt, hsa
uggauuuauacguaaucacuccugccccaacacacacacacacacacacacacacacacacaca

SEQ ID NO: 39420 - RNA, 64 nt, hsa
gauuuauacguaaucacuccugccccaacacacacacacacacacacacacacacacacacaca

SEQ ID NO: 39421 - RNA, 64 nt, hsa
uuuauacguaaucacuccugccccaacacacacacacacacacacacacacacacacacacaug

SEQ ID NO: 39422 - RNA, 64 nt, hsa
uauacguaaucacuccugccccaacacacacacacacacacacacacacacacacacacaugca

SEQ ID NO: 39423 - RNA, 64 nt, hsa
uacguaaucacuccugccccaacacacacacacacacacacacacacacacacacacaugcacg

SEQ ID NO: 39424 - RNA, 64 nt, hsa
cguaaucacuccugccccaacacacacacacacacacacacacacacacacacacaugcacgca

SEQ ID NO: 39425 - RNA, 64 nt, hsa
uaaucacuccugccccaacacacacacacacacacacacacacacacacacacaugcacgcaca

SEQ ID NO: 39426 - RNA, 64 nt, hsa
aucacuccugccccaacacacacacacacacacacacacacacacacacacaugcacgcacaca

SEQ ID NO: 39427 - RNA, 64 nt, hsa
cacuccugccccaacacacacacacacacacacacacacacacacacacaugcacgcacacaug

SEQ ID NO: 39428 - RNA, 64 nt, hsa
cuccugccccaacacacacacacacacacacacacacacacacacacaugcacgcacacaugau

SEQ ID NO: 39429 - RNA, 64 nt, hsa
ccugccccaacacacacacacacacacacacacacacacacacacaugcacgcacacaugauuu

SEQ ID NO: 39430 - RNA, 64 nt, hsa
ugccccaacacacacacacacacacacacacacacacacacacaugcacgcacacaugauuuug

SEQ ID NO: 39431 - RNA, 64 nt, hsa
ccccaacacacacacacacacacacacacacacacacacacaugcacgcacacaugauuuugau

SEQ ID NO: 39432 - RNA, 64 nt, hsa
agaagauuaagacagagaaacagacagaaagagacacacacacagccaggaguggguagauuuc

SEQ ID NO: 39433 - RNA, 64 nt, hsa
aagauuaagacagagaaacagacagaaagagacacacacacagccaggaguggguagauuucag

SEQ ID NO: 39434 - RNA, 64 nt, hsa
uggacuccuccuccauacuguaugugcaugcauucacacacacauauguacaugcacauagaug

SEQ ID NO: 39435 - RNA, 64 nt, hsa
gacuccuccuccauacuguaugugcaugcauucacacacacauauguacaugcacauagaugag

SEQ ID NO: 39436 - RNA, 64 nt, hsa
accuugagaguaaagugcugcccucugcccccaacacacacacauaucaauuccuggauuccuu

SEQ ID NO: 39437 - RNA, 64 nt, hsa
cuugagaguaaagugcugcccucugcccccaacacacacacauaucaauuccuggauuccuuag

SEQ ID NO: 39438 - RNA, 64 nt, hsa
uguguauacauauguaugugugaguguauguauacacacacacacacacacacacacacacuuu

SEQ ID NO: 39439 - RNA, 64 nt, hsa
uguauacauauguaugugugaguguauguauacacacacacacacacacacacacacacuuuug

SEQ ID NO: 39440 - RNA, 64 nt, hsa
uauacauauguaugugugaguguauguauacacacacacacacacacacacacacacuuuugca

SEQ ID NO: 39441 - RNA, 64 nt, hsa
uacauauguaugugugaguguauguauacacacacacacacacacacacacacacuuuugcaag

SEQ ID NO: 39442 - RNA, 64 nt, hsa
cauauguaugugugaguguauguauacacacacacacacacacacacacacacuuuugcaagag

SEQ ID NO: 39443 - RNA, 64 nt, hsa
uauguaugugugaguguauguauacacacacacacacacacacacacacacuuuugcaagagug

SEQ ID NO: 39444 - RNA, 64 nt, hsa
uguaugugugaguguauguauacacacacacacacacacacacacacacuuuugcaagagugau

SEQ ID NO: 39445 - RNA, 64 nt, hsa
uaugugugaguguauguauacacacacacacacacacacacacacacuuuugcaagagugaugg

SEQ ID NO: 39446 - RNA, 64 nt, hsa
ugugugaguguauguauacacacacacacacacacacacacacacuuuugcaagagugauggga

SEQ ID NO: 39447 - RNA, 64 nt, hsa
ugugaguguauguauacacacacacacacacacacacacacacuuuugcaagagugaugggaaa

SEQ ID NO: 39448 - RNA, 64 nt, hsa
ucucauucuucuaaaacuacugccuuucaaagugcacacacacgcguccacauacacugcauuc

SEQ ID NO: 39449 - RNA, 64 nt, hsa
agaaacagcuacugcgugcgugcgcgcacgcauacacacacacacacacacacuggcacaggga

SEQ ID NO: 39450 - RNA, 64 nt, hsa
aaacagcuacugcgugcgugcgcgcacgcauacacacacacacacacacacuggcacagggagg

SEQ ID NO: 39451 - RNA, 64 nt, hsa
acagcuacugcgugcgugcgcgcacgcauacacacacacacacacacacuggcacagggaggcu

SEQ ID NO: 39452 - RNA, 64 nt, hsa
agcuacugcgugcgugcgcgcacgcauacacacacacacacacacacuggcacagggaggcuac

SEQ ID NO: 39453 - RNA, 64 nt, hsa
cuacugcgugcgugcgcgcacgcauacacacacacacacacacacuggcacagggaggcuacaa

SEQ ID NO: 39454 - RNA, 64 nt, hsa
acugcgugcgugcgcgcacgcauacacacacacacacacacacuggcacagggaggcuacaacu

SEQ ID NO: 39455 - RNA, 64 nt, hsa
aguacagacguguaaauccuuccaccccgacccgcacacacacccacacugcugcccuggcggg

SEQ ID NO: 39456 - RNA, 64 nt, hsa
cccagguguacgcacgcgcgcgcgcgcgcacagacacacacacacacacacacacacacacaca

SEQ ID NO: 39457 - RNA, 64 nt, hsa
cagguguacgcacgcgcgcgcgcgcgcacagacacacacacacacacacacacacacacacaca

SEQ ID NO: 39458 - RNA, 64 nt, hsa
gguguacgcacgcgcgcgcgcgcgcacagacacacacacacacacacacacacacacacacaca

SEQ ID NO: 39459 - RNA, 64 nt, hsa
uguacgcacgcgcgcgcgcgcgcacagacacacacacacacacacacacacacacacacacaca

SEQ ID NO: 39460 - RNA, 64 nt, hsa
uacgcacgcgcgcgcgcgcgcacagacacacacacacacacacacacacacacacacacacagu

SEQ ID NO: 39461 - RNA, 64 nt, hsa
cgcacgcgcgcgcgcgcgcacagacacacacacacacacacacacacacacacacacacaguaa

SEQ ID NO: 39462 - RNA, 64 nt, hsa
cacgcgcgcgcgcgcgcacagacacacacacacacacacacacacacacacacacacaguaacc

SEQ ID NO: 39463 - RNA, 64 nt, hsa
cgcgcgcgcgcgcgcacagacacacacacacacacacacacacacacacacacacaguaaccac

SEQ ID NO: 39464 - RNA, 64 nt, hsa
cgcgcgcgcgcgcacagacacacacacacacacacacacacacacacacacacaguaaccacgg

SEQ ID NO: 39465 - RNA, 64 nt, hsa
cgcgcgcgcgcacagacacacacacacacacacacacacacacacacacacaguaaccacgggu

SEQ ID NO: 39466 - RNA, 64 nt, hsa
cgcgcgcgcacagacacacacacacacacacacacacacacacacacacaguaaccacggguag

SEQ ID NO: 39467 - RNA, 64 nt, hsa
cgcgcgcacagacacacacacacacacacacacacacacacacacacaguaaccacggguaggc

SEQ ID NO: 39468 - RNA, 64 nt, hsa
cgcgcacagacacacacacacacacacacacacacacacacacacaguaaccacggguaggcac

SEQ ID NO: 39469 - RNA, 64 nt, hsa
cgcacagacacacacacacacacacacacacacacacacacacaguaaccacggguaggcacca

SEQ ID NO: 39470 - RNA, 64 nt, hsa
cacagacacacacacacacacacacacacacacacacacacaguaaccacggguaggcaccagg

SEQ ID NO: 39471 - RNA, 64 nt, hsa
acucacuauauacaaaucauuagguuaaaacagacacacacacacacacacacacacacacaca

SEQ ID NO: 39472 - RNA, 64 nt, hsa
ucacuauauacaaaucauuagguuaaaacagacacacacacacacacacacacacacacacaca

SEQ ID NO: 39473 - RNA, 64 nt, hsa
acuauauacaaaucauuagguuaaaacagacacacacacacacacacacacacacacacacaca

SEQ ID NO: 39474 - RNA, 64 nt, hsa
uauauacaaaucauuagguuaaaacagacacacacacacacacacacacacacacacacacaca

SEQ ID NO: 39475 - RNA, 64 nt, hsa
uauacaaaucauuagguuaaaacagacacacacacacacacacacacacacacacacacacaca

SEQ ID NO: 39476 - RNA, 64 nt, hsa
uacaaaucauuagguuaaaacagacacacacacacacacacacacacacacacacacacacaca

SEQ ID NO: 39477 - RNA, 64 nt, hsa
caaaucauuagguuaaaacagacacacacacacacacacacacacacacacacacacacacaca

SEQ ID NO: 39478 - RNA, 64 nt, hsa
aaucauuagguuaaaacagacacacacacacacacacacacacacacacacacacacacacaca

SEQ ID NO: 39479 - RNA, 64 nt, hsa
ucauuagguuaaaacagacacacacacacacacacacacacacacacacacacacacacacaca

SEQ ID NO: 39480 - RNA, 64 nt, hsa
auuagguuaaaacagacacacacacacacacacacacacacacacacacacacacacacacaag

SEQ ID NO: 39481 - RNA, 64 nt, hsa
uagguuaaaacagacacacacacacacacacacacacacacacacacacacacacacacaagac

SEQ ID NO: 39482 - RNA, 64 nt, hsa
gguuaaaacagacacacacacacacacacacacacacacacacacacacacacacacaagaccu

SEQ ID NO: 39483 - RNA, 64 nt, hsa
uuaaaacagacacacacacacacacacacacacacacacacacacacacacacacaagaccugg

SEQ ID NO: 39484 - RNA, 64 nt, hsa
aaaacagacacacacacacacacacacacacacacacacacacacacacacacaagaccugggc

SEQ ID NO: 39485 - RNA, 64 nt, hsa
aacagacacacacacacacacacacacacacacacacacacacacacacacaagaccugggccc

SEQ ID NO: 39486 - RNA, 64 nt, hsa
cagacacacacacacacacacacacacacacacacacacacacacacacaagaccugggcccuu

SEQ ID NO: 39487 - RNA, 64 nt, hsa
gacacacacacacacacacacacacacacacacacacacacacacacaagaccugggcccuuaa

SEQ ID NO: 39488 - RNA, 64 nt, hsa
cacacacacacacacacacacacacacacacacacacacacacacaagaccugggcccuuaagu

SEQ ID NO: 39489 - RNA, 64 nt, hsa
cacacacacacacacacacacacacacacacacacacacacacaagaccugggcccuuaaguuu

SEQ ID NO: 39490 - RNA, 64 nt, hsa
cacacacacacacacacacacacacacacacacacacacacaagaccugggcccuuaaguuuac

SEQ ID NO: 39491 - RNA, 64 nt, hsa
gugugugugugugugugugugugucucccucucucacacacacaagagcaguuugcuguugcug

SEQ ID NO: 39492 - RNA, 64 nt, hsa
gugugugugugugugugugugucucccucucucacacacacaagagcaguuugcuguugcuguu

SEQ ID NO: 39493 - RNA, 64 nt, hsa
aacuugaauuaagaccaaacagaacaugagaauacacacacacacacacauauacacacacaca

SEQ ID NO: 39494 - RNA, 64 nt, hsa
cuugaauuaagaccaaacagaacaugagaauacacacacacacacacauauacacacacacaca

SEQ ID NO: 39495 - RNA, 64 nt, hsa
ugaauuaagaccaaacagaacaugagaauacacacacacacacacauauacacacacacacacu

SEQ ID NO: 39496 - RNA, 64 nt, hsa
aauuaagaccaaacagaacaugagaauacacacacacacacacauauacacacacacacacuuc

SEQ ID NO: 39497 - RNA, 64 nt, hsa
uuaagaccaaacagaacaugagaauacacacacacacacacauauacacacacacacacuucac

SEQ ID NO: 39498 - RNA, 64 nt, hsa
agaacaugagaauacacacacacacacacauauacacacacacacacuucacacauacacacca

SEQ ID NO: 39499 - RNA, 64 nt, hsa
aacaugagaauacacacacacacacacauauacacacacacacacuucacacauacacaccacu

SEQ ID NO: 39500 - RNA, 64 nt, hsa
caugagaauacacacacacacacacauauacacacacacacacuucacacauacacaccacucc

SEQ ID NO: 39501 - RNA, 64 nt, hsa
agaaucauauauaguccagucuucauuuuacauacacacacauauuuuacacacacacacauuu

SEQ ID NO: 39502 - RNA, 64 nt, hsa
ccagucuucauuuuacauacacacacauauuuuacacacacacacauuuuacacacacacacac

SEQ ID NO: 39503 - RNA, 64 nt, hsa
agucuucauuuuacauacacacacauauuuuacacacacacacauuuuacacacacacacacac

SEQ ID NO: 39504 - RNA, 64 nt, hsa
ucuucauuuuacauacacacacauauuuuacacacacacacauuuuacacacacacacacacac

SEQ ID NO: 39505 - RNA, 64 nt, hsa
uacacacacauauuuuacacacacacacauuuuacacacacacacacacacacacacauauguu

SEQ ID NO: 39506 - RNA, 64 nt, hsa
cacacacauauuuuacacacacacacauuuuacacacacacacacacacacacacauauguuuu

SEQ ID NO: 39507 - RNA, 64 nt, hsa
cacacauauuuuacacacacacacauuuuacacacacacacacacacacacacauauguuuuuc

SEQ ID NO: 39508 - RNA, 64 nt, hsa
cacauauuuuacacacacacacauuuuacacacacacacacacacacacacauauguuuuucua

SEQ ID NO: 39509 - RNA, 64 nt, hsa
cauauuuuacacacacacacauuuuacacacacacacacacacacacacauauguuuuucuagu

SEQ ID NO: 39510 - RNA, 64 nt, hsa
uauuuuacacacacacacauuuuacacacacacacacacacacacacauauguuuuucuagucu

SEQ ID NO: 39511 - RNA, 64 nt, hsa
uuuuacacacacacacauuuuacacacacacacacacacacacacauauguuuuucuagucucu

SEQ ID NO: 39512 - RNA, 64 nt, hsa
uuacacacacacacauuuuacacacacacacacacacacacacauauguuuuucuagucucugg

SEQ ID NO: 39513 - RNA, 64 nt, hsa
acacacacacacauuuuacacacacacacacacacacacacauauguuuuucuagucucuggca

SEQ ID NO: 39514 - RNA, 64 nt, hsa
uuucauaagauucaaccaaauaaauauauauauacacacacacauacauauacaccuauauaug

SEQ ID NO: 39515 - RNA, 64 nt, hsa
ucauaagauucaaccaaauaaauauauauauacacacacacauacauauacaccuauauaugug

SEQ ID NO: 39516 - RNA, 64 nt, hsa
uucaaguauauaugauuuaaaccugggcuacugacacacacacaguagccauuaguuagacucu

SEQ ID NO: 39517 - RNA, 64 nt, hsa
caaguauauaugauuuaaaccugggcuacugacacacacacaguagccauuaguuagacucuuc

SEQ ID NO: 39518 - RNA, 64 nt, hsa
cugggcuggacuggaggugggcaugccacccucacacacacagcugggcaaagccacaaggcug

SEQ ID NO: 39519 - RNA, 64 nt, hsa
cccugggcuggacuggaggugggcaugccacccucacacacacagcugggcaaagccacaaggc

SEQ ID NO: 39520 - RNA, 64 nt, hsa
ggucaggaggccuucaccgcugcuggggcacacacacacacaugcauacacacauacgacacac

SEQ ID NO: 39521 - RNA, 64 nt, hsa
agggucaggaggccuucaccgcugcuggggcacacacacacacaugcauacacacauacgacac

SEQ ID NO: 39522 - RNA, 64 nt, hsa
uaagggucaggaggccuucaccgcugcuggggcacacacacacacaugcauacacacauacgac

SEQ ID NO: 39523 - RNA, 64 nt, hsa
ucuaagggucaggaggccuucaccgcugcuggggcacacacacacacaugcauacacacauacg

SEQ ID NO: 39524 - RNA, 64 nt, hsa
uguguguguguguaugggccugaucacacacaaacacacacaccucuccuucauucacguccua

SEQ ID NO: 39525 - RNA, 64 nt, hsa
gaucuguguguguguguguguguaugggccugaucacacacaaacacacacaccucuccuucau

SEQ ID NO: 39526 - RNA, 64 nt, hsa
cuuucuuggcuggcaacacacacacacacacacacacacacauacacacacgacugaaucagau

SEQ ID NO: 39527 - RNA, 64 nt, hsa
gccuuucuuggcuggcaacacacacacacacacacacacacacauacacacacgacugaaucag

SEQ ID NO: 39528 - RNA, 64 nt, hsa
aagccuuucuuggcuggcaacacacacacacacacacacacacacauacacacacgacugaauc

SEQ ID NO: 39529 - RNA, 64 nt, hsa
ggaagccuuucuuggcuggcaacacacacacacacacacacacacacauacacacacgacugaa

SEQ ID NO: 39530 - RNA, 64 nt, hsa
agggaagccuuucuuggcuggcaacacacacacacacacacacacacacauacacacacgacug

SEQ ID NO: 39531 - RNA, 64 nt, hsa
auagggaagccuuucuuggcuggcaacacacacacacacacacacacacacauacacacacgac

SEQ ID NO: 39532 - RNA, 64 nt, hsa
uuauagggaagccuuucuuggcuggcaacacacacacacacacacacacacacauacacacacg

SEQ ID NO: 39533 - RNA, 64 nt, hsa
ccuuauagggaagccuuucuuggcuggcaacacacacacacacacacacacacacauacacaca

SEQ ID NO: 39534 - RNA, 64 nt, hsa
cuccuuauagggaagccuuucuuggcuggcaacacacacacacacacacacacacacauacaca

SEQ ID NO: 39535 - RNA, 64 nt, hsa
aacuccuuauagggaagccuuucuuggcuggcaacacacacacacacacacacacacacauaca

SEQ ID NO: 39536 - RNA, 64 nt, hsa
acagacaccacacacacacauacacacacacacacacacacaccugaggccaccagaagacacu

SEQ ID NO: 39537 - RNA, 64 nt, hsa
acacagacaccacacacacacauacacacacacacacacacacaccugaggccaccagaagaca

SEQ ID NO: 39538 - RNA, 64 nt, hsa
agacacagacaccacacacacacauacacacacacacacacacacaccugaggccaccagaaga

SEQ ID NO: 39539 - RNA, 64 nt, hsa
gcagacacagacaccacacacacacauacacacacacacacacacacaccugaggccaccagaa

SEQ ID NO: 39540 - RNA, 64 nt, hsa
acgcagacacagacaccacacacacacauacacacacacacacacacacaccugaggccaccag

SEQ ID NO: 39541 - RNA, 64 nt, hsa
acacgcagacacagacaccacacacacacauacacacacacacacacacacaccugaggccacc

SEQ ID NO: 39542 - RNA, 64 nt, hsa
acacacgcagacacagacaccacacacacacauacacacacacacacacacacaccugaggcca

SEQ ID NO: 39543 - RNA, 64 nt, hsa
guguucauguacacacgcagacacagacaccacacacacacauacacacacacacacacacaca

SEQ ID NO: 39544 - RNA, 64 nt, hsa
guguguucauguacacacgcagacacagacaccacacacacacauacacacacacacacacaca

SEQ ID NO: 39545 - RNA, 64 nt, hsa
auguguguucauguacacacgcagacacagacaccacacacacacauacacacacacacacaca

SEQ ID NO: 39546 - RNA, 64 nt, hsa
cuuuccugaacuggaacgucgggggcaaagcauacacacacacuccaauccauccaugcauaca

SEQ ID NO: 39547 - RNA, 64 nt, hsa
uacaugccuuuuccucccauccaccucccccgcacacacacaaagaugaccugggacaugauuu

SEQ ID NO: 39548 - RNA, 64 nt, hsa
aauacaugccuuuuccucccauccaccucccccgcacacacacaaagaugaccugggacaugau

SEQ ID NO: 39549 - RNA, 64 nt, hsa
agauuuuauauguguguguggauauauauacacacacacacagaaagaugaauauauauauaua

SEQ ID NO: 39550 - RNA, 64 nt, hsa
auagauuuuauauguguguguggauauauauacacacacacacagaaagaugaauauauauaua

SEQ ID NO: 39551 - RNA, 64 nt, hsa
caauagauuuuauauguguguguggauauauauacacacacacacagaaagaugaauauauaua

SEQ ID NO: 39552 - RNA, 64 nt, hsa
cacauacagacagaccuaccuauacauacgugcacacacacauacauauucauacacaauucau

SEQ ID NO: 39553 - RNA, 64 nt, hsa
cccacauacagacagaccuaccuauacauacgugcacacacacauacauauucauacacaauuc

SEQ ID NO: 39554 - RNA, 64 nt, hsa
uaguuccucaagcauaugugcuuauaugcacacacacacacauuuccauggacccaggucuugc

SEQ ID NO: 39555 - RNA, 64 nt, hsa
uuuaguuccucaagcauaugugcuuauaugcacacacacacacauuuccauggacccaggucuu

SEQ ID NO: 39556 - RNA, 64 nt, hsa
gcuuuaguuccucaagcauaugugcuuauaugcacacacacacacauuuccauggacccagguc

SEQ ID NO: 39557 - RNA, 64 nt, hsa
uggcuuuaguuccucaagcauaugugcuuauaugcacacacacacacauuuccauggacccagg

SEQ ID NO: 39558 - RNA, 64 nt, hsa
gguacuuugugacagaagacauguacacacacaccacacacauacauacacacucucucacucu

SEQ ID NO: 39559 - RNA, 64 nt, hsa
gacuauugugguacuuugugacagaagacauguacacacacaccacacacauacauacacacuc

SEQ ID NO: 39560 - RNA, 64 nt, hsa
ugaauaaucuuccaucuuccccgccacacauacacacacacacuuuuuguuucuuucagguaga

SEQ ID NO: 39561 - RNA, 64 nt, hsa
ugugaauaaucuuccaucuuccccgccacacauacacacacacacuuuuuguuucuuucaggua

SEQ ID NO: 39562 - RNA, 64 nt, hsa
agaacucuuuauuuucuaucauucuuucuagacacacacacaucagacuggcaacuguuuugua

SEQ ID NO: 39563 - RNA, 64 nt, hsa
caagaacucuuuauuuucuaucauucuuucuagacacacacacaucagacuggcaacuguuuug

SEQ ID NO: 39564 - RNA, 64 nt, hsa
uguguguauguauguacacacacacacacgugugcacacacaaugcacacaacuccuaugacug

SEQ ID NO: 39565 - RNA, 64 nt, hsa
uucuccccacugaauguguguauguauguacacacacacacacgugugcacacacaaugcacac

SEQ ID NO: 39566 - RNA, 64 nt, hsa
aguucuccccacugaauguguguauguauguacacacacacacacgugugcacacacaaugcac

SEQ ID NO: 39567 - RNA, 64 nt, hsa
ugaguucuccccacugaauguguguauguauguacacacacacacacgugugcacacacaaugc

SEQ ID NO: 39568 - RNA, 64 nt, hsa
gacacacacacacacacacacacacacacacacacacacacacucuuuuaggggacuaagagag

SEQ ID NO: 39569 - RNA, 64 nt, hsa
cugacacacacacacacacacacacacacacacacacacacacacucuuuuaggggacuaagag

SEQ ID NO: 39570 - RNA, 64 nt, hsa
aacugacacacacacacacacacacacacacacacacacacacacacucuuuuaggggacuaag

SEQ ID NO: 39571 - RNA, 64 nt, hsa
caaacugacacacacacacacacacacacacacacacacacacacacacucuuuuaggggacua

SEQ ID NO: 39572 - RNA, 64 nt, hsa
cucaaacugacacacacacacacacacacacacacacacacacacacacacucuuuuaggggac

SEQ ID NO: 39573 - RNA, 64 nt, hsa
uccucaaacugacacacacacacacacacacacacacacacacacacacacacucuuuuagggg

SEQ ID NO: 39574 - RNA, 64 nt, hsa
ucuccucaaacugacacacacacacacacacacacacacacacacacacacacacucuuuuagg

SEQ ID NO: 39575 - RNA, 64 nt, hsa
acucuccucaaacugacacacacacacacacacacacacacacacacacacacacacucuuuua

SEQ ID NO: 39576 - RNA, 64 nt, hsa
cuacucuccucaaacugacacacacacacacacacacacacacacacacacacacacacucuuu

SEQ ID NO: 39577 - RNA, 64 nt, hsa
uucuacucuccucaaacugacacacacacacacacacacacacacacacacacacacacacucu

SEQ ID NO: 39578 - RNA, 64 nt, hsa
aauucuacucuccucaaacugacacacacacacacacacacacacacacacacacacacacacu

SEQ ID NO: 39579 - RNA, 64 nt, hsa
ccaauucuacucuccucaaacugacacacacacacacacacacacacacacacacacacacaca

SEQ ID NO: 39580 - RNA, 64 nt, hsa
gcccaauucuacucuccucaaacugacacacacacacacacacacacacacacacacacacaca

SEQ ID NO: 39581 - RNA, 64 nt, hsa
cagcccaauucuacucuccucaaacugacacacacacacacacacacacacacacacacacaca

SEQ ID NO: 39582 - RNA, 64 nt, hsa
accagcccaauucuacucuccucaaacugacacacacacacacacacacacacacacacacaca

SEQ ID NO: 39583 - RNA, 64 nt, hsa
uuaccagcccaauucuacucuccucaaacugacacacacacacacacacacacacacacacaca

SEQ ID NO: 39584 - RNA, 64 nt, hsa
acuuaccagcccaauucuacucuccucaaacugacacacacacacacacacacacacacacaca

SEQ ID NO: 39585 - RNA, 64 nt, hsa
cacacacacacacacacacacacacacacacacacacacacacgcccuacucuucauuugcuag

SEQ ID NO: 39586 - RNA, 64 nt, hsa
cacacacacacacacacacacacacacacacacacacacacacacgcccuacucuucauuugcu

SEQ ID NO: 39587 - RNA, 64 nt, hsa
cacacacacacacacacacacacacacacacacacacacacacacacgcccuacucuucauuug

SEQ ID NO: 39588 - RNA, 64 nt, hsa
cacacacacacacacacacacacacacacacacacacacacacacacacgcccuacucuucauu

SEQ ID NO: 39589 - RNA, 64 nt, hsa
aacacacacacacacacacacacacacacacacacacacacacacacacacgcccuacucuuca

SEQ ID NO: 39590 - RNA, 64 nt, hsa
caaacacacacacacacacacacacacacacacacacacacacacacacacacgcccuacucuu

SEQ ID NO: 39591 - RNA, 64 nt, hsa
cccaaacacacacacacacacacacacacacacacacacacacacacacacacacgcccuacuc

SEQ ID NO: 39592 - RNA, 64 nt, hsa
cccccaaacacacacacacacacacacacacacacacacacacacacacacacacacgcccuac

SEQ ID NO: 39593 - RNA, 64 nt, hsa
accccccaaacacacacacacacacacacacacacacacacacacacacacacacacacgcccu

SEQ ID NO: 39594 - RNA, 64 nt, hsa
cuaccccccaaacacacacacacacacacacacacacacacacacacacacacacacacacgcc

SEQ ID NO: 39595 - RNA, 64 nt, hsa
cccuaccccccaaacacacacacacacacacacacacacacacacacacacacacacacacacg

SEQ ID NO: 39596 - RNA, 64 nt, hsa
cccccuaccccccaaacacacacacacacacacacacacacacacacacacacacacacacaca

SEQ ID NO: 39597 - RNA, 64 nt, hsa
cacccccuaccccccaaacacacacacacacacacacacacacacacacacacacacacacaca

SEQ ID NO: 39598 - RNA, 64 nt, hsa
cgcacccccuaccccccaaacacacacacacacacacacacacacacacacacacacacacaca

SEQ ID NO: 39599 - RNA, 64 nt, hsa
gccgcacccccuaccccccaaacacacacacacacacacacacacacacacacacacacacaca

SEQ ID NO: 39600 - RNA, 64 nt, hsa
ucgccgcacccccuaccccccaaacacacacacacacacacacacacacacacacacacacaca

SEQ ID NO: 39601 - RNA, 64 nt, hsa
caucgccgcacccccuaccccccaaacacacacacacacacacacacacacacacacacacaca

SEQ ID NO: 39602 - RNA, 64 nt, hsa
cccaucgccgcacccccuaccccccaaacacacacacacacacacacacacacacacacacaca

SEQ ID NO: 39603 - RNA, 64 nt, hsa
uucccaucgccgcacccccuaccccccaaacacacacacacacacacacacacacacacacaca

SEQ ID NO: 39604 - RNA, 64 nt, hsa
cauucccaucgccgcacccccuaccccccaaacacacacacacacacacacacacacacacaca

SEQ ID NO: 39605 - RNA, 64 nt, hsa
uccauucccaucgccgcacccccuaccccccaaacacacacacacacacacacacacacacaca

SEQ ID NO: 39606 - RNA, 64 nt, hsa
cacacaugcgugugcacccgcgcacgcacauacacacacacauauagcaguagcagcagcagca

SEQ ID NO: 39607 - RNA, 64 nt, hsa
cgcacacaugcgugugcacccgcgcacgcacauacacacacacauauagcaguagcagcagcag

SEQ ID NO: 39608 - RNA, 64 nt, hsa
ccuccacuucuucagcaccacacacacgcacacacacacacacgcacacaugcgugugcacccg

SEQ ID NO: 39609 - RNA, 64 nt, hsa
aaccuccacuucuucagcaccacacacacgcacacacacacacacgcacacaugcgugugcacc

SEQ ID NO: 39610 - RNA, 64 nt, hsa
gcaaccuccacuucuucagcaccacacacacgcacacacacacacacgcacacaugcgugugca

SEQ ID NO: 39611 - RNA, 64 nt, hsa
aagcaaccuccacuucuucagcaccacacacacgcacacacacacacacgcacacaugcgugug

SEQ ID NO: 39612 - RNA, 64 nt, hsa
agagaaggccaagcaaccuccacuucuucagcaccacacacacgcacacacacacacacgcaca

SEQ ID NO: 39613 - RNA, 64 nt, hsa
auuauauauauauauauauauacacacacacacacacacacacguauaucuauuuaugcacaua

SEQ ID NO: 39614 - RNA, 64 nt, hsa
acauuauauauauauauauauauacacacacacacacacacacacguauaucuauuuaugcaca

SEQ ID NO: 39615 - RNA, 64 nt, hsa
acacauuauauauauauauauauauacacacacacacacacacacacguauaucuauuuaugca

SEQ ID NO: 39616 - RNA, 64 nt, hsa
acacacauuauauauauauauauauauacacacacacacacacacacacguauaucuauuuaug

SEQ ID NO: 39617 - RNA, 64 nt, hsa
acacacacauuauauauauauauauauauacacacacacacacacacacacguauaucuauuua

SEQ ID NO: 39618 - RNA, 64 nt, hsa
auacacacacauuauauauauauauauauauacacacacacacacacacacacguauaucuauu

SEQ ID NO: 39619 - RNA, 64 nt, hsa
auauacacacacauuauauauauauauauauauacacacacacacacacacacacguauaucua

SEQ ID NO: 39620 - RNA, 64 nt, hsa
ggcagcucuuaaaacuaagaaaaaauaugauauacacacacauuauauauauauauauauauac

SEQ ID NO: 39621 - RNA, 64 nt, hsa
aaaaguuuacugccaugaaauacuccucccaccacacacacaugcuccaaaagaggaaagaaaa

SEQ ID NO: 39622 - RNA, 64 nt, hsa
uuaaaaguuuacugccaugaaauacuccucccaccacacacacaugcuccaaaagaggaaagaa

SEQ ID NO: 39623 - RNA, 64 nt, hsa
aaaagagagcucccuuagggaaaaaugaccaaaacacacacacacauuuacaauggacugcugg

SEQ ID NO: 39624 - RNA, 64 nt, hsa
aagagagcucccuuagggaaaaaugaccaaaacacacacacacauuuacaauggacugcuggug

SEQ ID NO: 39625 - RNA, 64 nt, hsa
gagagcucccuuagggaaaaaugaccaaaacacacacacacauuuacaauggacugcuggugca

SEQ ID NO: 39626 - RNA, 64 nt, hsa
aaagucucaauguuccauucagucugcagcuauucacacacacacacacacacacacacacaca

SEQ ID NO: 39627 - RNA, 64 nt, hsa
agucucaauguuccauucagucugcagcuauucacacacacacacacacacacacacacacaca

SEQ ID NO: 39628 - RNA, 64 nt, hsa
ucucaauguuccauucagucugcagcuauucacacacacacacacacacacacacacacacaca

SEQ ID NO: 39629 - RNA, 64 nt, hsa
ucaauguuccauucagucugcagcuauucacacacacacacacacacacacacacacacacaca

SEQ ID NO: 39630 - RNA, 64 nt, hsa
aauguuccauucagucugcagcuauucacacacacacacacacacacacacacacacacacaca

SEQ ID NO: 39631 - RNA, 64 nt, hsa
uguuccauucagucugcagcuauucacacacacacacacacacacacacacacacacacacaca

SEQ ID NO: 39632 - RNA, 64 nt, hsa
uuccauucagucugcagcuauucacacacacacacacacacacacacacacacacacacacaca

SEQ ID NO: 39633 - RNA, 64 nt, hsa
ccauucagucugcagcuauucacacacacacacacacacacacacacacacacacacacacaca

SEQ ID NO: 39634 - RNA, 64 nt, hsa
auucagucugcagcuauucacacacacacacacacacacacacacacacacacacacacacaca

SEQ ID NO: 39635 - RNA, 64 nt, hsa
ucagucugcagcuauucacacacacacacacacacacacacacacacacacacacacacacaaa

SEQ ID NO: 39636 - RNA, 64 nt, hsa
agucugcagcuauucacacacacacacacacacacacacacacacacacacacacacacaaaua

SEQ ID NO: 39637 - RNA, 64 nt, hsa
ucugcagcuauucacacacacacacacacacacacacacacacacacacacacacacaaauauu

SEQ ID NO: 39638 - RNA, 64 nt, hsa
ugcagcuauucacacacacacacacacacacacacacacacacacacacacacacaaauauugc

SEQ ID NO: 39639 - RNA, 64 nt, hsa
cagcuauucacacacacacacacacacacacacacacacacacacacacacacaaauauugcuu

SEQ ID NO: 39640 - RNA, 64 nt, hsa
gcuauucacacacacacacacacacacacacacacacacacacacacacacaaauauugcuugg

SEQ ID NO: 39641 - RNA, 64 nt, hsa
uauucacacacacacacacacacacacacacacacacacacacacacacaaauauugcuuggac

SEQ ID NO: 39642 - RNA, 64 nt, hsa
uucacacacacacacacacacacacacacacacacacacacacacacaaauauugcuuggacua

SEQ ID NO: 39643 - RNA, 64 nt, hsa
cacacacacacacacacacacacacacacacacacacacacacacaaauauugcuuggacuacc

SEQ ID NO: 39644 - RNA, 64 nt, hsa
cacacacacacacacacacacacacacacacacacacacacacaaauauugcuuggacuaccua

SEQ ID NO: 39645 - RNA, 64 nt, hsa
cacacacacacacacacacacacacacacacacacacacacaaauauugcuuggacuaccuaua

SEQ ID NO: 39646 - RNA, 64 nt, hsa
cgcacaaucuacacugccuuaccuucacuuaaaccacacacacaaggugcucagacaugaaaug

SEQ ID NO: 39647 - RNA, 64 nt, hsa
cacaaucuacacugccuuaccuucacuuaaaccacacacacaaggugcucagacaugaaaugua

SEQ ID NO: 39648 - RNA, 64 nt, hsa
acuccccuugccuuccccugucuucaccugccaccacacacacacacacacacacacacacaca

SEQ ID NO: 39649 - RNA, 64 nt, hsa
uccccuugccuuccccugucuucaccugccaccacacacacacacacacacacacacacacaca

SEQ ID NO: 39650 - RNA, 64 nt, hsa
cccuugccuuccccugucuucaccugccaccacacacacacacacacacacacacacacacaca

SEQ ID NO: 39651 - RNA, 64 nt, hsa
cuugccuuccccugucuucaccugccaccacacacacacacacacacacacacacacacacaca

SEQ ID NO: 39652 - RNA, 64 nt, hsa
ugccuuccccugucuucaccugccaccacacacacacacacacacacacacacacacacacacg

SEQ ID NO: 39653 - RNA, 64 nt, hsa
ccuuccccugucuucaccugccaccacacacacacacacacacacacacacacacacacacgca

SEQ ID NO: 39654 - RNA, 64 nt, hsa
uuccccugucuucaccugccaccacacacacacacacacacacacacacacacacacacgcacg

SEQ ID NO: 39655 - RNA, 64 nt, hsa
ccccugucuucaccugccaccacacacacacacacacacacacacacacacacacacgcacggc

SEQ ID NO: 39656 - RNA, 64 nt, hsa
ccugucuucaccugccaccacacacacacacacacacacacacacacacacacacgcacggcuu

SEQ ID NO: 39657 - RNA, 64 nt, hsa
ugucuucaccugccaccacacacacacacacacacacacacacacacacacacgcacggcuucc

SEQ ID NO: 39658 - RNA, 64 nt, hsa
ucuucaccugccaccacacacacacacacacacacacacacacacacacacgcacggcuuccua

SEQ ID NO: 39659 - RNA, 64 nt, hsa
uucaccugccaccacacacacacacacacacacacacacacacacacacgcacggcuuccuaua

SEQ ID NO: 39660 - RNA, 64 nt, hsa
caccugccaccacacacacacacacacacacacacacacacacacacgcacggcuuccuauaac

SEQ ID NO: 39661 - RNA, 64 nt, hsa
ccugccaccacacacacacacacacacacacacacacacacacacgcacggcuuccuauaacuu

SEQ ID NO: 39662 - RNA, 64 nt, hsa
ugccaccacacacacacacacacacacacacacacacacacacgcacggcuuccuauaacuucu

SEQ ID NO: 39663 - RNA, 64 nt, hsa
gcaguguuagaggaggagaugggagcggugacuacacacacacacacacacacacacacacaca

SEQ ID NO: 39664 - RNA, 64 nt, hsa
aguguuagaggaggagaugggagcggugacuacacacacacacacacacacacacacacacaca

SEQ ID NO: 39665 - RNA, 64 nt, hsa
uguuagaggaggagaugggagcggugacuacacacacacacacacacacacacacacacacaaa

SEQ ID NO: 39666 - RNA, 64 nt, hsa
uuagaggaggagaugggagcggugacuacacacacacacacacacacacacacacacacaaaca

SEQ ID NO: 39667 - RNA, 64 nt, hsa
agaggaggagaugggagcggugacuacacacacacacacacacacacacacacacacaaacaug

SEQ ID NO: 39668 - RNA, 64 nt, hsa
aggaggagaugggagcggugacuacacacacacacacacacacacacacacacacaaacaugca

SEQ ID NO: 39669 - RNA, 64 nt, hsa
gaggagaugggagcggugacuacacacacacacacacacacacacacacacacaaacaugcaca

SEQ ID NO: 39670 - RNA, 64 nt, hsa
ggagaugggagcggugacuacacacacacacacacacacacacacacacacaaacaugcacaca

SEQ ID NO: 39671 - RNA, 64 nt, hsa
agaugggagcggugacuacacacacacacacacacacacacacacacacaaacaugcacacaca

SEQ ID NO: 39672 - RNA, 64 nt, hsa
augggagcggugacuacacacacacacacacacacacacacacacacaaacaugcacacacaca

SEQ ID NO: 39673 - RNA, 64 nt, hsa
gggagcggugacuacacacacacacacacacacacacacacacacaaacaugcacacacacaua

SEQ ID NO: 39674 - RNA, 64 nt, hsa
gagcggugacuacacacacacacacacacacacacacacacacaaacaugcacacacacauaug

SEQ ID NO: 39675 - RNA, 64 nt, hsa
gcggugacuacacacacacacacacacacacacacacacacaaacaugcacacacacauaugca

SEQ ID NO: 39676 - RNA, 64 nt, hsa
cacacacacacacacacacacacacacaaacaugcacacacacauaugcauaucuugacauugc

SEQ ID NO: 39677 - RNA, 64 nt, hsa
cacacacacacacacacacacacacaaacaugcacacacacauaugcauaucuugacauugcuc

SEQ ID NO: 39678 - RNA, 64 nt, hsa
uuauccauagguuucucucccuccuucuccuucucacacacaacuguccauacuaacaaguuug

SEQ ID NO: 39679 - RNA, 64 nt, hsa
ucuguaauggguacaaugaagaaguuucuaaaaacacacacaaagcacauugggccaacuauuu

SEQ ID NO: 39680 - RNA, 64 nt, hsa
aucuuuuuuucuuccuucauauauauauacacaacacacacacacauauguauaucuauacaca

SEQ ID NO: 39681 - RNA, 64 nt, hsa
cuuuuuuucuuccuucauauauauauacacaacacacacacacauauguauaucuauacacaca

SEQ ID NO: 39682 - RNA, 64 nt, hsa
uuuuuucuuccuucauauauauauacacaacacacacacacauauguauaucuauacacacaug

SEQ ID NO: 39683 - RNA, 64 nt, hsa
aaaaauagauuugcaaaaagugaacagauugcuacacacacacacacacacacacacacacaca

SEQ ID NO: 39684 - RNA, 64 nt, hsa
aaauagauuugcaaaaagugaacagauugcuacacacacacacacacacacacacacacacaca

SEQ ID NO: 39685 - RNA, 64 nt, hsa
auagauuugcaaaaagugaacagauugcuacacacacacacacacacacacacacacacacaca

SEQ ID NO: 39686 - RNA, 64 nt, hsa
agauuugcaaaaagugaacagauugcuacacacacacacacacacacacacacacacacacaca

SEQ ID NO: 39687 - RNA, 64 nt, hsa
auuugcaaaaagugaacagauugcuacacacacacacacacacacacacacacacacacacagc

SEQ ID NO: 39688 - RNA, 64 nt, hsa
uugcaaaaagugaacagauugcuacacacacacacacacacacacacacacacacacacagcca

SEQ ID NO: 39689 - RNA, 64 nt, hsa
gcaaaaagugaacagauugcuacacacacacacacacacacacacacacacacacacagccauu

SEQ ID NO: 39690 - RNA, 64 nt, hsa
aaaaagugaacagauugcuacacacacacacacacacacacacacacacacacacagccauuca

SEQ ID NO: 39691 - RNA, 64 nt, hsa
aaagugaacagauugcuacacacacacacacacacacacacacacacacacacagccauucauc

SEQ ID NO: 39692 - RNA, 64 nt, hsa
agugaacagauugcuacacacacacacacacacacacacacacacacacacagccauucaucug

SEQ ID NO: 39693 - RNA, 64 nt, hsa
ugaacagauugcuacacacacacacacacacacacacacacacacacacagccauucaucuggg

SEQ ID NO: 39694 - RNA, 64 nt, hsa
aacagauugcuacacacacacacacacacacacacacacacacacacagccauucaucugggcu

SEQ ID NO: 39695 - RNA, 64 nt, hsa
cagauugcuacacacacacacacacacacacacacacacacacacagccauucaucugggcugg

SEQ ID NO: 39696 - RNA, 64 nt, hsa
gauugcuacacacacacacacacacacacacacacacacacacagccauucaucugggcuggca

SEQ ID NO: 39697 - RNA, 64 nt, hsa
uugcuacacacacacacacacacacacacacacacacacacagccauucaucugggcuggcaga

SEQ ID NO: 39698 - RNA, 64 nt, hsa
aguauggcggaggccaugggggccccucggcauucacacacagccuggccuccccugcggagcu

SEQ ID NO: 39699 - RNA, 64 nt, hsa
gaucuuuggggaagggagcuaccaacacuuuauacacacacacacgugcacacacacacacaca

SEQ ID NO: 39700 - RNA, 64 nt, hsa
ucuuuggggaagggagcuaccaacacuuuauacacacacacacgugcacacacacacacacaca

SEQ ID NO: 39701 - RNA, 64 nt, hsa
ggagcuaccaacacuuuauacacacacacacgugcacacacacacacacacacacuauauauau

SEQ ID NO: 39702 - RNA, 64 nt, hsa
agcuaccaacacuuuauacacacacacacgugcacacacacacacacacacacuauauauauau

SEQ ID NO: 39703 - RNA, 64 nt, hsa
cuaccaacacuuuauacacacacacacgugcacacacacacacacacacacuauauauauauau

SEQ ID NO: 39704 - RNA, 64 nt, hsa
accaacacuuuauacacacacacacgugcacacacacacacacacacacuauauauauauauau

SEQ ID NO: 39705 - RNA, 64 nt, hsa
caacacuuuauacacacacacacgugcacacacacacacacacacacuauauauauauauauua

SEQ ID NO: 39706 - RNA, 64 nt, hsa
acacuuuauacacacacacacgugcacacacacacacacacacacuauauauauauauauuauu

SEQ ID NO: 39707 - RNA, 64 nt, hsa
acuuuauacacacacacacgugcacacacacacacacacacacuauauauauauauauuauuua

SEQ ID NO: 39708 - RNA, 64 nt, hsa
gcagugguaggauugcagccgugggccugcuggacacacacauacaccaaagauguauuuggau

SEQ ID NO: 39709 - RNA, 64 nt, hsa
aguguccugugacuuaacacagaaacgcaauaaacacacacaaaauaguuucaugagugauucu

SEQ ID NO: 39710 - RNA, 64 nt, hsa
ggcguguguguauauauggauaaauauauauauacacacacacauauuacugcaaucugugauu

SEQ ID NO: 39711 - RNA, 64 nt, hsa
cguguguguauauauggauaaauauauauauacacacacacauauuacugcaaucugugauugc

SEQ ID NO: 39712 - RNA, 64 nt, hsa
uccugggauuauuauacugagauauauauauauacacacacacacacauauguguauauaugua

SEQ ID NO: 39713 - RNA, 64 nt, hsa
cugggauuauuauacugagauauauauauauacacacacacacacauauguguauauauguaua

SEQ ID NO: 39714 - RNA, 64 nt, hsa
gggauuauuauacugagauauauauauauacacacacacacacauauguguauauauguauaua

SEQ ID NO: 39715 - RNA, 64 nt, hsa
gauuauuauacugagauauauauauauacacacacacacacauauguguauauauguauauaua

SEQ ID NO: 39716 - RNA, 64 nt, hsa
uguauauauguauauauauaugugaguauauauacacacacacacacacacacacauauauaua

SEQ ID NO: 39717 - RNA, 64 nt, hsa
uauauauguauauauauaugugaguauauauacacacacacacacacacacacauauauauaua

SEQ ID NO: 39718 - RNA, 64 nt, hsa
uauauguauauauauaugugaguauauauacacacacacacacacacacacauauauauauaua

SEQ ID NO: 39719 - RNA, 64 nt, hsa
uauguauauauauaugugaguauauauacacacacacacacacacacacauauauauauauaca

SEQ ID NO: 39720 - RNA, 64 nt, hsa
uguauauauauaugugaguauauauacacacacacacacacacacacauauauauauauacaca

SEQ ID NO: 39721 - RNA, 64 nt, hsa
uauauauauaugugaguauauauacacacacacacacacacacacauauauauauauacacaca

SEQ ID NO: 39722 - RNA, 64 nt, hsa
uauauauaugugaguauauauacacacacacacacacacacacauauauauauauacacacacg

SEQ ID NO: 39723 - RNA, 64 nt, hsa
uauauaugugaguauauauacacacacacacacacacacacauauauauauauacacacacgca

SEQ ID NO: 39724 - RNA, 64 nt, hsa
cguccacaccacucaccacacauacauacacaugcacacacacacacaugcaauucuaccuuuu

SEQ ID NO: 39725 - RNA, 64 nt, hsa
uccacaccacucaccacacauacauacacaugcacacacacacacaugcaauucuaccuuuuuc

SEQ ID NO: 39726 - RNA, 64 nt, hsa
cacaccacucaccacacauacauacacaugcacacacacacacaugcaauucuaccuuuuucua

SEQ ID NO: 39727 - RNA, 64 nt, hsa
caccacucaccacacauacauacacaugcacacacacacacaugcaauucuaccuuuuucuaac

SEQ ID NO: 39728 - RNA, 64 nt, hsa
ugcuucuaaauaucuaaacucauuaacauggaaacacacacacaggagcuacaguacauauugg

SEQ ID NO: 39729 - RNA, 64 nt, hsa
cuucuaaauaucuaaacucauuaacauggaaacacacacacaggagcuacaguacauauuggca

SEQ ID NO: 39730 - RNA, 64 nt, hsa
aaguggcauguuagugaggaguucugauauuaagcacacacacacaugcacacaaauggacuuc

SEQ ID NO: 39731 - RNA, 64 nt, hsa
guggcauguuagugaggaguucugauauuaagcacacacacacaugcacacaaauggacuucuc

SEQ ID NO: 39732 - RNA, 64 nt, hsa
ggcauguuagugaggaguucugauauuaagcacacacacacaugcacacaaauggacuucucug

SEQ ID NO: 39733 - RNA, 64 nt, hsa
cacguuuuuguuuucgaauuagacuucuuuaaaacacacacacacacacacacacacacacaca

SEQ ID NO: 39734 - RNA, 64 nt, hsa
cguuuuuguuuucgaauuagacuucuuuaaaacacacacacacacacacacacacacacacaca

SEQ ID NO: 39735 - RNA, 64 nt, hsa
uuuuuguuuucgaauuagacuucuuuaaaacacacacacacacacacacacacacacacacaca

SEQ ID NO: 39736 - RNA, 64 nt, hsa
uuuguuuucgaauuagacuucuuuaaaacacacacacacacacacacacacacacacacacaca

SEQ ID NO: 39737 - RNA, 64 nt, hsa
uguuuucgaauuagacuucuuuaaaacacacacacacacacacacacacacacacacacacaca

SEQ ID NO: 39738 - RNA, 64 nt, hsa
uuuucgaauuagacuucuuuaaaacacacacacacacacacacacacacacacacacacacaca

SEQ ID NO: 39739 - RNA, 64 nt, hsa
uucgaauuagacuucuuuaaaacacacacacacacacacacacacacacacacacacacacaca

SEQ ID NO: 39740 - RNA, 64 nt, hsa
cgaauuagacuucuuuaaaacacacacacacacacacacacacacacacacacacacacacaca

SEQ ID NO: 39741 - RNA, 64 nt, hsa
aauuagacuucuuuaaaacacacacacacacacacacacacacacacacacacacacacacacc

SEQ ID NO: 39742 - RNA, 64 nt, hsa
uuagacuucuuuaaaacacacacacacacacacacacacacacacacacacacacacacacccc

SEQ ID NO: 39743 - RNA, 64 nt, hsa
agacuucuuuaaaacacacacacacacacacacacacacacacacacacacacacacaccccug

SEQ ID NO: 39744 - RNA, 64 nt, hsa
acuucuuuaaaacacacacacacacacacacacacacacacacacacacacacacaccccugau

SEQ ID NO: 39745 - RNA, 64 nt, hsa
uucuuuaaaacacacacacacacacacacacacacacacacacacacacacacaccccugaucc

SEQ ID NO: 39746 - RNA, 64 nt, hsa
cuuuaaaacacacacacacacacacacacacacacacacacacacacacacaccccugauccuu

SEQ ID NO: 39747 - RNA, 64 nt, hsa
uuaaaacacacacacacacacacacacacacacacacacacacacacacaccccugauccuugc

SEQ ID NO: 39748 - RNA, 64 nt, hsa
aaaacacacacacacacacacacacacacacacacacacacacacacaccccugauccuugcca

SEQ ID NO: 39749 - RNA, 64 nt, hsa
aacacacacacacacacacacacacacacacacacacacacacacaccccugauccuugccaac

SEQ ID NO: 39750 - RNA, 64 nt, hsa
cacacacacacacacacacacacacacacacacacacacacacaccccugauccuugccaacau

SEQ ID NO: 39751 - RNA, 64 nt, hsa
cacacacacacacacacacacacacacacacacacacacacaccccugauccuugccaacauga

SEQ ID NO: 39752 - RNA, 64 nt, hsa
uacacauaugcacacacgcauacacacaugcacgcacacacacauacacacaugcacgcacgca

SEQ ID NO: 39753 - RNA, 64 nt, hsa
cacauaugcacacacgcauacacacaugcacgcacacacacauacacacaugcacgcacgcacg

SEQ ID NO: 39754 - RNA, 64 nt, hsa
gaaucuuuuuuuucccuaauggacgaaggaacaacacacacacaaaaauuaaaugcaauaaagg

SEQ ID NO: 39755 - RNA, 64 nt, hsa
aucuuuuuuuucccuaauggacgaaggaacaacacacacacaaaaauuaaaugcaauaaaggaa

SEQ ID NO: 39756 - RNA, 64 nt, hsa
uuugaacugaaauggacacacaaacacacacacgcacacacagacccacagcuuugaaugauca

SEQ ID NO: 39757 - RNA, 64 nt, hsa
guuuuaguauuuugaacugaaauggacacacaaacacacacacgcacacacagacccacagcuu

SEQ ID NO: 39758 - RNA, 64 nt, hsa
agugaccauuauacuguguauauauauauaaacacacacacauauauauauauauauauaguac

SEQ ID NO: 39759 - RNA, 64 nt, hsa
gaagugaccauuauacuguguauauauauauaaacacacacacauauauauauauauauauagu

SEQ ID NO: 39760 - RNA, 64 nt, hsa
cgauaugucuguccaucuuucuccuuucuuccagcacacacagcuaagagauaagaaggcugca

SEQ ID NO: 39761 - RNA, 64 nt, hsa
uaucuuacuuuacacauacguguauguacacacacacacacaauacaagacauuuuuccuguuu

SEQ ID NO: 39762 - RNA, 64 nt, hsa
uauaucuuacuuuacacauacguguauguacacacacacacacaauacaagacauuuuuccugu

SEQ ID NO: 39763 - RNA, 64 nt, hsa
auuauaucuuacuuuacacauacguguauguacacacacacacacaauacaagacauuuuuccu

SEQ ID NO: 39764 - RNA, 64 nt, hsa
uuauuauaucuuacuuuacacauacguguauguacacacacacacacaauacaagacauuuuuc

SEQ ID NO: 39765 - RNA, 64 nt, hsa
acauucacuauuuucacacacacacacacacacacacacacacgaauccacagcaauccaucag

SEQ ID NO: 39766 - RNA, 64 nt, hsa
auacauucacuauuuucacacacacacacacacacacacacacacacacacacacacacacacg

SEQ ID NO: 39767 - RNA, 64 nt, hsa
acauacauucacuauuuucacacacacacacacacacacacacacacacacacacacacacaca

SEQ ID NO: 39768 - RNA, 64 nt, hsa
ccacauacauucacuauuuucacacacacacacacacacacacacacacacacacacacacaca

SEQ ID NO: 39769 - RNA, 64 nt, hsa
ucccacauacauucacuauuuucacacacacacacacacacacacacacacacacacacacaca

SEQ ID NO: 39770 - RNA, 64 nt, hsa
auucccacauacauucacuauuuucacacacacacacacacacacacacacacacacacacaca

SEQ ID NO: 39771 - RNA, 64 nt, hsa
acauucccacauacauucacuauuuucacacacacacacacacacacacacacacacacacaca

SEQ ID NO: 39772 - RNA, 64 nt, hsa
ucacauucccacauacauucacuauuuucacacacacacacacacacacacacacacacacaca

SEQ ID NO: 39773 - RNA, 64 nt, hsa
acucacauucccacauacauucacuauuuucacacacacacacacacacacacacacacacaca

SEQ ID NO: 39774 - RNA, 64 nt, hsa
auacucacauucccacauacauucacuauuuucacacacacacacacacacacacacacacaca

SEQ ID NO: 39775 - RNA, 64 nt, hsa
aaauacucacauucccacauacauucacuauuuucacacacacacacacacacacacacacaca

SEQ ID NO: 39776 - RNA, 64 nt, hsa
aacacaggcacacacaugcacacacccauaaacacacacacagugcuuuaagaaagggccaggu

SEQ ID NO: 39777 - RNA, 64 nt, hsa
caaacacaggcacacacaugcacacacccauaaacacacacacagugcuuuaagaaagggccag

SEQ ID NO: 39778 - RNA, 64 nt, hsa
aucugcaguugauguccccaaaugcaaacacaggcacacacaugcacacacccauaaacacaca

SEQ ID NO: 39779 - RNA, 64 nt, hsa
gcuuucugcuuaaaaacacacacacacacacacacacacacacggaaaaccuuuauuuuaaagu

SEQ ID NO: 39780 - RNA, 64 nt, hsa
uagcuuucugcuuaaaaacacacacacacacacacacacacacacggaaaaccuuuauuuuaaa

SEQ ID NO: 39781 - RNA, 64 nt, hsa
gauagcuuucugcuuaaaaacacacacacacacacacacacacacacggaaaaccuuuauuuua

SEQ ID NO: 39782 - RNA, 64 nt, hsa
gggauagcuuucugcuuaaaaacacacacacacacacacacacacacacggaaaaccuuuauuu

SEQ ID NO: 39783 - RNA, 64 nt, hsa
gagggauagcuuucugcuuaaaaacacacacacacacacacacacacacacggaaaaccuuuau

SEQ ID NO: 39784 - RNA, 64 nt, hsa
uugagggauagcuuucugcuuaaaaacacacacacacacacacacacacacacggaaaaccuuu

SEQ ID NO: 39785 - RNA, 64 nt, hsa
ccuugagggauagcuuucugcuuaaaaacacacacacacacacacacacacacacggaaaaccu

SEQ ID NO: 39786 - RNA, 64 nt, hsa
aaccuugagggauagcuuucugcuuaaaaacacacacacacacacacacacacacacggaaaac

SEQ ID NO: 39787 - RNA, 64 nt, hsa
uaaaccuugagggauagcuuucugcuuaaaaacacacacacacacacacacacacacacggaaa

SEQ ID NO: 39788 - RNA, 64 nt, hsa
uguaaaccuugagggauagcuuucugcuuaaaaacacacacacacacacacacacacacacgga

SEQ ID NO: 39789 - RNA, 64 nt, hsa
aacaugugcccgaacauacacacacacauauguacacacacaccucagaguacucuuucuuaca

SEQ ID NO: 39790 - RNA, 64 nt, hsa
ugugacuguugaauaacaugugcccgaacauacacacacacauauguacacacacaccucagag

SEQ ID NO: 39791 - RNA, 64 nt, hsa
ccugugacuguugaauaacaugugcccgaacauacacacacacauauguacacacacaccucag

SEQ ID NO: 39792 - RNA, 64 nt, hsa
aaauguaacacacacacacauacacacacacacacacacacagagacacaucuuaaggggaccc

SEQ ID NO: 39793 - RNA, 64 nt, hsa
acaaauguaacacacacacacauacacacacacacacacacacagagacacaucuuaaggggac

SEQ ID NO: 39794 - RNA, 64 nt, hsa
agacaaauguaacacacacacacauacacacacacacacacacacagagacacaucuuaagggg

SEQ ID NO: 39795 - RNA, 64 nt, hsa
ucagacaaauguaacacacacacacauacacacacacacacacacacagagacacaucuuaagg

SEQ ID NO: 39796 - RNA, 64 nt, hsa
guucagacaaauguaacacacacacacauacacacacacacacacacacagagacacaucuuaa

SEQ ID NO: 39797 - RNA, 64 nt, hsa
caguucagacaaauguaacacacacacacauacacacacacacacacacacagagacacaucuu

SEQ ID NO: 39798 - RNA, 64 nt, hsa
ugcaguucagacaaauguaacacacacacacauacacacacacacacacacacagagacacauc

SEQ ID NO: 39799 - RNA, 64 nt, hsa
gcuugguuguugcaguucagacaaauguaacacacacacacauacacacacacacacacacaca

SEQ ID NO: 39800 - RNA, 64 nt, hsa
augcuugguuguugcaguucagacaaauguaacacacacacacauacacacacacacacacaca

SEQ ID NO: 39801 - RNA, 64 nt, hsa
ccaugcuugguuguugcaguucagacaaauguaacacacacacacauacacacacacacacaca

SEQ ID NO: 39802 - RNA, 64 nt, hsa
cacacacacacacauauacacacacucacagacccacacacauacacacugucaugcacucaac

SEQ ID NO: 39803 - RNA, 64 nt, hsa
cucacuuauaaaccucuguacacacacacacacacacacacauauacacacacucacagaccca

SEQ ID NO: 39804 - RNA, 64 nt, hsa
uucucacuuauaaaccucuguacacacacacacacacacacacauauacacacacucacagacc

SEQ ID NO: 39805 - RNA, 64 nt, hsa
aguucucacuuauaaaccucuguacacacacacacacacacacacauauacacacacucacaga

SEQ ID NO: 39806 - RNA, 64 nt, hsa
aaaguucucacuuauaaaccucuguacacacacacacacacacacacauauacacacacucaca

SEQ ID NO: 39807 - RNA, 64 nt, hsa
agaaaguucucacuuauaaaccucuguacacacacacacacacacacacauauacacacacuca

SEQ ID NO: 39808 - RNA, 64 nt, hsa
gaagaaaguucucacuuauaaaccucuguacacacacacacacacacacacauauacacacacu

SEQ ID NO: 39809 - RNA, 64 nt, hsa
cagaagaaaguucucacuuauaaaccucuguacacacacacacacacacacacauauacacaca

SEQ ID NO: 39810 - RNA, 64 nt, hsa
cgcagaagaaaguucucacuuauaaaccucuguacacacacacacacacacacacauauacaca

SEQ ID NO: 39811 - RNA, 64 nt, hsa
acaaauauguguguauaaaauaaacauacacacacacacacaccccuauguaguuuuuaaaaca

SEQ ID NO: 39812 - RNA, 64 nt, hsa
auacaaauauguguguauaaaauaaacauacacacacacacacaccccuauguaguuuuuaaaa

SEQ ID NO: 39813 - RNA, 64 nt, hsa
auauacaaauauguguguauaaaauaaacauacacacacacacacaccccuauguaguuuuuaa

SEQ ID NO: 39814 - RNA, 64 nt, hsa
gaauauacaaauauguguguauaaaauaaacauacacacacacacacaccccuauguaguuuuu

SEQ ID NO: 39815 - RNA, 64 nt, hsa
acaggacacacacacacacacacacacacacacacacacacaccccuagagaaaaguacagauu

SEQ ID NO: 39816 - RNA, 64 nt, hsa
uuacaggacacacacacacacacacacacacacacacacacacaccccuagagaaaaguacaga

SEQ ID NO: 39817 - RNA, 64 nt, hsa
guuuacaggacacacacacacacacacacacacacacacacacacaccccuagagaaaaguaca

SEQ ID NO: 39818 - RNA, 64 nt, hsa
auguuuacaggacacacacacacacacacacacacacacacacacacaccccuagagaaaagua

SEQ ID NO: 39819 - RNA, 64 nt, hsa
agauguuuacaggacacacacacacacacacacacacacacacacacacaccccuagagaaaag

SEQ ID NO: 39820 - RNA, 64 nt, hsa
aaagauguuuacaggacacacacacacacacacacacacacacacacacacaccccuagagaaa

SEQ ID NO: 39821 - RNA, 64 nt, hsa
ucaaagauguuuacaggacacacacacacacacacacacacacacacacacacaccccuagaga

SEQ ID NO: 39822 - RNA, 64 nt, hsa
guucaaagauguuuacaggacacacacacacacacacacacacacacacacacacaccccuaga

SEQ ID NO: 39823 - RNA, 64 nt, hsa
ugguucaaagauguuuacaggacacacacacacacacacacacacacacacacacacaccccua

SEQ ID NO: 39824 - RNA, 64 nt, hsa
uuugguucaaagauguuuacaggacacacacacacacacacacacacacacacacacacacccc

SEQ ID NO: 39825 - RNA, 64 nt, hsa
gauuugguucaaagauguuuacaggacacacacacacacacacacacacacacacacacacacc

SEQ ID NO: 39826 - RNA, 64 nt, hsa
gugauuugguucaaagauguuuacaggacacacacacacacacacacacacacacacacacaca

SEQ ID NO: 39827 - RNA, 64 nt, hsa
uagugauuugguucaaagauguuuacaggacacacacacacacacacacacacacacacacaca

SEQ ID NO: 39828 - RNA, 64 nt, hsa
uauagugauuugguucaaagauguuuacaggacacacacacacacacacacacacacacacaca

SEQ ID NO: 39829 - RNA, 64 nt, hsa
uuuauagugauuugguucaaagauguuuacaggacacacacacacacacacacacacacacaca

SEQ ID NO: 39830 - RNA, 64 nt, hsa
uguauguguguauacacacacacagacacacacacacacacacgggaugaauggagccuuaaag

SEQ ID NO: 39831 - RNA, 64 nt, hsa
uguguauguguguauacacacacacagacacacacacacacacacgggaugaauggagccuuaa

SEQ ID NO: 39832 - RNA, 64 nt, hsa
ucuguguauguguguauacacacacacagacacacacacacacacacgggaugaauggagccuu

SEQ ID NO: 39833 - RNA, 64 nt, hsa
uaucuguguauguguguauacacacacacagacacacacacacacacacgggaugaauggagcc

SEQ ID NO: 39834 - RNA, 64 nt, hsa
uauaucuguguauguguguauacacacacacagacacacacacacacacacgggaugaauggag

SEQ ID NO: 39835 - RNA, 64 nt, hsa
guuguaaauauauaucuguguauguguguauacacacacacagacacacacacacacacacggg

SEQ ID NO: 39836 - RNA, 64 nt, hsa
auguuguaaauauauaucuguguauguguguauacacacacacagacacacacacacacacacg

SEQ ID NO: 39837 - RNA, 64 nt, hsa
uauuuaaauuucuacucacaauuugaucaucacacacacacaaauccuugaauaucauugccag

SEQ ID NO: 39838 - RNA, 64 nt, hsa
acuauuuaaauuucuacucacaauuugaucaucacacacacacaaauccuugaauaucauugcc

SEQ ID NO: 39839 - RNA, 64 nt, hsa
agacuauuuaaauuucuacucacaauuugaucaucacacacacacaaauccuugaauaucauug

SEQ ID NO: 39840 - RNA, 64 nt, hsa
aaagaaucagcuagaguugucaugauaaagucagcacacacaaaaaggcuucuuacacauaccu

SEQ ID NO: 39841 - RNA, 64 nt, hsa
acacugacuugauacagcaugaaguuucuagugccacacacaguauuuagaaaaccuuuaggcg

SEQ ID NO: 39842 - RNA, 64 nt, hsa
ugggcacaugggcacauacagacucacauacagacacacacauauauguacagacauguacucu

SEQ ID NO: 39843 - RNA, 64 nt, hsa
cagacacacacauauauguacagacauguacucucacacacacaggcaccagcauacacacguu

SEQ ID NO: 39844 - RNA, 64 nt, hsa
gacacacacauauauguacagacauguacucucacacacacaggcaccagcauacacacguuuu

SEQ ID NO: 39845 - RNA, 64 nt, hsa
ccaguauuucaucaaggacagggaauaucccucccacacacaggccagcugcucacccugccac

SEQ ID NO: 39846 - RNA, 64 nt, hsa
cuuggacagcagauccacacaccacuuccccacccacacacaguacccugggcugguuggacaa

SEQ ID NO: 39847 - RNA, 64 nt, hsa
ccccaucaaacacaguuacaccccacauaucucucacacacacacacacacgcacacacacaca

SEQ ID NO: 39848 - RNA, 64 nt, hsa
ccaucaaacacaguuacaccccacauaucucucacacacacacacacacgcacacacacacaca

SEQ ID NO: 39849 - RNA, 64 nt, hsa
aucaaacacaguuacaccccacauaucucucacacacacacacacacgcacacacacacacaca

SEQ ID NO: 39850 - RNA, 64 nt, hsa
caaacacaguuacaccccacauaucucucacacacacacacacacgcacacacacacacacaga

SEQ ID NO: 39851 - RNA, 64 nt, hsa
aacacaguuacaccccacauaucucucacacacacacacacacgcacacacacacacacagauc

SEQ ID NO: 39852 - RNA, 64 nt, hsa
caccccacauaucucucacacacacacacacacgcacacacacacacacagaucugacguaauc

SEQ ID NO: 39853 - RNA, 64 nt, hsa
ccccacauaucucucacacacacacacacacgcacacacacacacacagaucugacguaaucaa

SEQ ID NO: 39854 - RNA, 64 nt, hsa
ccacauaucucucacacacacacacacacgcacacacacacacacagaucugacguaaucaaac

SEQ ID NO: 39855 - RNA, 64 nt, hsa
acauaucucucacacacacacacacacgcacacacacacacacagaucugacguaaucaaacuc

SEQ ID NO: 39856 - RNA, 64 nt, hsa
auaucucucacacacacacacacacgcacacacacacacacagaucugacguaaucaaacucca

SEQ ID NO: 39857 - RNA, 64 nt, hsa
agcccacauauucuauuauagauauauaaauaaucacacacacacuugcugucaauguuuugag

SEQ ID NO: 39858 - RNA, 64 nt, hsa
cccacauauucuauuauagauauauaaauaaucacacacacacuugcugucaauguuuugaguc

SEQ ID NO: 39859 - RNA, 64 nt, hsa
aaguacaaguagaggaguuuuuuauuuuauauaucacacacacacacacacacacacacacaca

SEQ ID NO: 39860 - RNA, 64 nt, hsa
guacaaguagaggaguuuuuuauuuuauauaucacacacacacacacacacacacacacacaca

SEQ ID NO: 39861 - RNA, 64 nt, hsa
acaaguagaggaguuuuuuauuuuauauaucacacacacacacacacacacacacacacacaca

SEQ ID NO: 39862 - RNA, 64 nt, hsa
aaguagaggaguuuuuuauuuuauauaucacacacacacacacacacacacacacacacacaca

SEQ ID NO: 39863 - RNA, 64 nt, hsa
guagaggaguuuuuuauuuuauauaucacacacacacacacacacacacacacacacacacaca

SEQ ID NO: 39864 - RNA, 64 nt, hsa
agaggaguuuuuuauuuuauauaucacacacacacacacacacacacacacacacacacacaua

SEQ ID NO: 39865 - RNA, 64 nt, hsa
aggaguuuuuuauuuuauauaucacacacacacacacacacacacacacacacacacacauaua

SEQ ID NO: 39866 - RNA, 64 nt, hsa
gaguuuuuuauuuuauauaucacacacacacacacacacacacacacacacacacacauauaug

SEQ ID NO: 39867 - RNA, 64 nt, hsa
guuuuuuauuuuauauaucacacacacacacacacacacacacacacacacacacauauaugau

SEQ ID NO: 39868 - RNA, 64 nt, hsa
uuuuuauuuuauauaucacacacacacacacacacacacacacacacacacacauauaugauac

SEQ ID NO: 39869 - RNA, 64 nt, hsa
uuuauuuuauauaucacacacacacacacacacacacacacacacacacacauauaugauacaa

SEQ ID NO: 39870 - RNA, 64 nt, hsa
uauuuuauauaucacacacacacacacacacacacacacacacacacacauauaugauacaaau

SEQ ID NO: 39871 - RNA, 64 nt, hsa
uuuuauauaucacacacacacacacacacacacacacacacacacacauauaugauacaaaugc

SEQ ID NO: 39872 - RNA, 64 nt, hsa
uuauauaucacacacacacacacacacacacacacacacacacacauauaugauacaaaugcuu

SEQ ID NO: 39873 - RNA, 64 nt, hsa
auauaucacacacacacacacacacacacacacacacacacacauauaugauacaaaugcuuuc

SEQ ID NO: 39874 - RNA, 64 nt, hsa
auaucacacacacacacacacacacacacacacacacacacauauaugauacaaaugcuuucag

SEQ ID NO: 39875 - RNA, 64 nt, hsa
gaaaaauaaaguaggcaugaauaaauguucaggacacacacauacacucacacacaucacagua

SEQ ID NO: 39876 - RNA, 64 nt, hsa
gcaugaauaaauguucaggacacacacauacacucacacacaucacaguaucagcucuuucagu

SEQ ID NO: 39877 - RNA, 64 nt, hsa
agaaaauccuaaggaacucacacacacacacacacacacacacgcacacagcuauuagaacuaa

SEQ ID NO: 39878 - RNA, 64 nt, hsa
auagaaaauccuaaggaacucacacacacacacacacacacacacgcacacagcuauuagaacu

SEQ ID NO: 39879 - RNA, 64 nt, hsa
auauagaaaauccuaaggaacucacacacacacacacacacacacacgcacacagcuauuagaa

SEQ ID NO: 39880 - RNA, 64 nt, hsa
guauauagaaaauccuaaggaacucacacacacacacacacacacacacgcacacagcuauuag

SEQ ID NO: 39881 - RNA, 64 nt, hsa
uuguauauagaaaauccuaaggaacucacacacacacacacacacacacacgcacacagcuauu

SEQ ID NO: 39882 - RNA, 64 nt, hsa
uuuuguauauagaaaauccuaaggaacucacacacacacacacacacacacacgcacacagcua

SEQ ID NO: 39883 - RNA, 64 nt, hsa
aguuuuguauauagaaaauccuaaggaacucacacacacacacacacacacacacgcacacagc

SEQ ID NO: 39884 - RNA, 64 nt, hsa
acaguuuuguauauagaaaauccuaaggaacucacacacacacacacacacacacacgcacaca

SEQ ID NO: 39885 - RNA, 64 nt, hsa
acacaguuuuguauauagaaaauccuaaggaacucacacacacacacacacacacacacgcaca

SEQ ID NO: 39886 - RNA, 64 nt, hsa
cccccucacucucacacuugcacacauacacacacacacacacgaaaugguugguuugucaaaa

SEQ ID NO: 39887 - RNA, 64 nt, hsa
cacccccucacucucacacuugcacacauacacacacacacacacgaaaugguugguuugucaa

SEQ ID NO: 39888 - RNA, 64 nt, hsa
ugcacccccucacucucacacuugcacacauacacacacacacacacgaaaugguugguuuguc

SEQ ID NO: 39889 - RNA, 64 nt, hsa
caugcacccccucacucucacacuugcacacauacacacacacacacacgaaaugguugguuug

SEQ ID NO: 39890 - RNA, 64 nt, hsa
gauauacauauauacauauauauguauauauauacacacacauacauauguguguguauaguau

SEQ ID NO: 39891 - RNA, 64 nt, hsa
aaguuaaaauuauauauauauauauauauacacacacacacauauauauauauauauaauucaa

SEQ ID NO: 39892 - RNA, 64 nt, hsa
aaaaguuaaaauuauauauauauauauauauacacacacacacauauauauauauauauaauuc

SEQ ID NO: 39893 - RNA, 64 nt, hsa
ucaaaaguuaaaauuauauauauauauauauauacacacacacacauauauauauauauauaau

SEQ ID NO: 39894 - RNA, 64 nt, hsa
cugggagggcugaacccccacucacacaagcacacacacacaguccucacacacggaggccaga

SEQ ID NO: 39895 - RNA, 64 nt, hsa
ugcugggagggcugaacccccacucacacaagcacacacacacaguccucacacacggaggcca

SEQ ID NO: 39896 - RNA, 64 nt, hsa
gaugcugggagggcugaacccccacucacacaagcacacacacacaguccucacacacggaggc

SEQ ID NO: 39897 - RNA, 64 nt, hsa
uccaggugcuacccaggaguccccuccauguacacacacacaacucagggaaggagguccuggg

SEQ ID NO: 39898 - RNA, 64 nt, hsa
ccuccaggugcuacccaggaguccccuccauguacacacacacaacucagggaaggagguccug

SEQ ID NO: 39899 - RNA, 64 nt, hsa
ugucccucccuugcugaacacacacacacacacacacacacagguggggacugggcacagcucu

SEQ ID NO: 39900 - RNA, 64 nt, hsa
acugucccucccuugcugaacacacacacacacacacacacacagguggggacugggcacagcu

SEQ ID NO: 39901 - RNA, 64 nt, hsa
aaacugucccucccuugcugaacacacacacacacacacacacacagguggggacugggcacag

SEQ ID NO: 39902 - RNA, 64 nt, hsa
ccaaacugucccucccuugcugaacacacacacacacacacacacacagguggggacugggcac

SEQ ID NO: 39903 - RNA, 64 nt, hsa
ggccaaacugucccucccuugcugaacacacacacacacacacacacacagguggggacugggc

SEQ ID NO: 39904 - RNA, 64 nt, hsa
gaggccaaacugucccucccuugcugaacacacacacacacacacacacacagguggggacugg

SEQ ID NO: 39905 - RNA, 64 nt, hsa
aggaggccaaacugucccucccuugcugaacacacacacacacacacacacacagguggggacu

SEQ ID NO: 39906 - RNA, 64 nt, hsa
gcaggaggccaaacugucccucccuugcugaacacacacacacacacacacacacaggugggga

SEQ ID NO: 39907 - RNA, 64 nt, hsa
uugcaggaggccaaacugucccucccuugcugaacacacacacacacacacacacacagguggg

SEQ ID NO: 39908 - RNA, 64 nt, hsa
ccugugcccacucccuaucuccuucccaccccuacacacacacucccugcuugcaggaggccaa

SEQ ID NO: 39909 - RNA, 64 nt, hsa
acauucgacauaccccacugggcacacgcacaaacacacacacuauggggugggguggguguag

SEQ ID NO: 39910 - RNA, 64 nt, hsa
acaugcaaaacauacacacacacacacacacacacacacacacgcagaguugugauucucagua

SEQ ID NO: 39911 - RNA, 64 nt, hsa
aaacaugcaaaacauacacacacacacacacacacacacacacacgcagaguugugauucucag

SEQ ID NO: 39912 - RNA, 64 nt, hsa
gaaaacaugcaaaacauacacacacacacacacacacacacacacacgcagaguugugauucuc

SEQ ID NO: 39913 - RNA, 64 nt, hsa
aggaaaacaugcaaaacauacacacacacacacacacacacacacacacgcagaguugugauuc

SEQ ID NO: 39914 - RNA, 64 nt, hsa
aaaggaaaacaugcaaaacauacacacacacacacacacacacacacacacgcagaguugugau

SEQ ID NO: 39915 - RNA, 64 nt, hsa
ggaaaggaaaacaugcaaaacauacacacacacacacacacacacacacacacgcagaguugug

SEQ ID NO: 39916 - RNA, 64 nt, hsa
uaggaaaggaaaacaugcaaaacauacacacacacacacacacacacacacacacgcagaguug

SEQ ID NO: 39917 - RNA, 64 nt, hsa
gguaggaaaggaaaacaugcaaaacauacacacacacacacacacacacacacacacgcagagu

SEQ ID NO: 39918 - RNA, 64 nt, hsa
gugguaggaaaggaaaacaugcaaaacauacacacacacacacacacacacacacacacgcaga

SEQ ID NO: 39919 - RNA, 64 nt, hsa
uugugguaggaaaggaaaacaugcaaaacauacacacacacacacacacacacacacacacgca

SEQ ID NO: 39920 - RNA, 64 nt, hsa
guuugugguaggaaaggaaaacaugcaaaacauacacacacacacacacacacacacacacacg

SEQ ID NO: 39921 - RNA, 64 nt, hsa
gacaagcuuuugguuuuggcuaaauacacacacacacacacacgcucauauguguuuacucugu

SEQ ID NO: 39922 - RNA, 64 nt, hsa
uugacaagcuuuugguuuuggcuaaauacacacacacacacacacgcucauauguguuuacucu

SEQ ID NO: 39923 - RNA, 64 nt, hsa
uauugacaagcuuuugguuuuggcuaaauacacacacacacacacacgcucauauguguuuacu

SEQ ID NO: 39924 - RNA, 64 nt, hsa
guuauugacaagcuuuugguuuuggcuaaauacacacacacacacacacgcucauauguguuua

SEQ ID NO: 39925 - RNA, 64 nt, hsa
uaguuauugacaagcuuuugguuuuggcuaaauacacacacacacacacacgcucauauguguu

SEQ ID NO: 39926 - RNA, 64 nt, hsa
uucaggaacacacacacacacacacucacacacgcacacacaaucacaauuugcuacagcaaca

SEQ ID NO: 39927 - RNA, 64 nt, hsa
cugcuggcccuucaucuguucaggaacacacacacacacacacucacacacgcacacacaauca

SEQ ID NO: 39928 - RNA, 64 nt, hsa
cucugcuggcccuucaucuguucaggaacacacacacacacacacucacacacgcacacacaau

SEQ ID NO: 39929 - RNA, 64 nt, hsa
gucucugcuggcccuucaucuguucaggaacacacacacacacacacucacacacgcacacaca

SEQ ID NO: 39930 - RNA, 64 nt, hsa
gagucucugcuggcccuucaucuguucaggaacacacacacacacacacucacacacgcacaca

SEQ ID NO: 39931 - RNA, 64 nt, hsa
gggagucucugcuggcccuucaucuguucaggaacacacacacacacacacucacacacgcaca

SEQ ID NO: 39932 - RNA, 64 nt, hsa
uggccaccaacacacaaccacacacacacaaccacacacacaaaugggggcaaccacauccagu

SEQ ID NO: 39933 - RNA, 64 nt, hsa
uguggccaccaacacacaaccacacacacacaaccacacacacaaaugggggcaaccacaucca

SEQ ID NO: 39934 - RNA, 64 nt, hsa
gaggcucagcuguggccaccaacacacaaccacacacacacaaccacacacacaaaugggggca

SEQ ID NO: 39935 - RNA, 64 nt, hsa
cagaggcucagcuguggccaccaacacacaaccacacacacacaaccacacacacaaauggggg

SEQ ID NO: 39936 - RNA, 64 nt, hsa
gacagaggcucagcuguggccaccaacacacaaccacacacacacaaccacacacacaaauggg

SEQ ID NO: 39937 - RNA, 64 nt, hsa
augggauuauguaugauauauauauauauacacacacacacaaagggauagagagauuaccucu

SEQ ID NO: 39938 - RNA, 64 nt, hsa
auaugggauuauguaugauauauauauauauacacacacacacaaagggauagagagauuaccu

SEQ ID NO: 39939 - RNA, 64 nt, hsa
agauaugggauuauguaugauauauauauauauacacacacacacaaagggauagagagauuac

SEQ ID NO: 39940 - RNA, 64 nt, hsa
gcuuuguaggaagcacuuuuaauguuuucucucucacacacaaagauucaaaagaaaugugcau

SEQ ID NO: 39941 - RNA, 64 nt, hsa
uacacacacacacacacacacacacacacacacacacacacacuccauaccauuuccauucaac

SEQ ID NO: 39942 - RNA, 64 nt, hsa
gguacacacacacacacacacacacacacacacacacacacacacuccauaccauuuccauuca

SEQ ID NO: 39943 - RNA, 64 nt, hsa
cagguacacacacacacacacacacacacacacacacacacacacacuccauaccauuuccauu

SEQ ID NO: 39944 - RNA, 64 nt, hsa
ugcagguacacacacacacacacacacacacacacacacacacacacacuccauaccauuucca

SEQ ID NO: 39945 - RNA, 64 nt, hsa
ggugcagguacacacacacacacacacacacacacacacacacacacacacuccauaccauuuc

SEQ ID NO: 39946 - RNA, 64 nt, hsa
cuggugcagguacacacacacacacacacacacacacacacacacacacacacuccauaccauu

SEQ ID NO: 39947 - RNA, 64 nt, hsa
ugcuggugcagguacacacacacacacacacacacacacacacacacacacacacuccauacca

SEQ ID NO: 39948 - RNA, 64 nt, hsa
ccugcuggugcagguacacacacacacacacacacacacacacacacacacacacacuccauac

SEQ ID NO: 39949 - RNA, 64 nt, hsa
uuccugcuggugcagguacacacacacacacacacacacacacacacacacacacacacuccau

SEQ ID NO: 39950 - RNA, 64 nt, hsa
ucuuccugcuggugcagguacacacacacacacacacacacacacacacacacacacacacucc

SEQ ID NO: 39951 - RNA, 64 nt, hsa
uuucuuccugcuggugcagguacacacacacacacacacacacacacacacacacacacacacu

SEQ ID NO: 39952 - RNA, 64 nt, hsa
aguuucuuccugcuggugcagguacacacacacacacacacacacacacacacacacacacaca

SEQ ID NO: 39953 - RNA, 64 nt, hsa
gcaguuucuuccugcuggugcagguacacacacacacacacacacacacacacacacacacaca

SEQ ID NO: 39954 - RNA, 64 nt, hsa
cugcaguuucuuccugcuggugcagguacacacacacacacacacacacacacacacacacaca

SEQ ID NO: 39955 - RNA, 64 nt, hsa
accugcaguuucuuccugcuggugcagguacacacacacacacacacacacacacacacacaca

SEQ ID NO: 39956 - RNA, 64 nt, hsa
aaaccugcaguuucuuccugcuggugcagguacacacacacacacacacacacacacacacaca

SEQ ID NO: 39957 - RNA, 64 nt, hsa
cuaaaccugcaguuucuuccugcuggugcagguacacacacacacacacacacacacacacaca

SEQ ID NO: 39958 - RNA, 64 nt, hsa
acaauuuaugugcacacucacacaugcacacacacacacacauacacacucuucucuaaccagu

SEQ ID NO: 39959 - RNA, 64 nt, hsa
acacaauuuaugugcacacucacacaugcacacacacacacacauacacacucuucucuaacca

SEQ ID NO: 39960 - RNA, 64 nt, hsa
acacacaauuuaugugcacacucacacaugcacacacacacacacauacacacucuucucuaac

SEQ ID NO: 39961 - RNA, 64 nt, hsa
ucacacacaauuuaugugcacacucacacaugcacacacacacacacauacacacucuucucua

SEQ ID NO: 39962 - RNA, 64 nt, hsa
acucacacacaauuuaugugcacacucacacaugcacacacacacacacauacacacucuucuc

SEQ ID NO: 39963 - RNA, 64 nt, hsa
ccaagagagaaagcaagaaacuauaaugcacacucacacacaauuuaugugcacacucacacau

SEQ ID NO: 39964 - RNA, 64 nt, hsa
cucccccaaacacacacacacacacacacacacacacacacaauuaaguugcugcaaauucaaa

SEQ ID NO: 39965 - RNA, 64 nt, hsa
uccucccccaaacacacacacacacacacacacacacacacacaauuaaguugcugcaaauuca

SEQ ID NO: 39966 - RNA, 64 nt, hsa
ccuccucccccaaacacacacacacacacacacacacacacacacacacacaauuaaguugcug

SEQ ID NO: 39967 - RNA, 64 nt, hsa
caccuccucccccaaacacacacacacacacacacacacacacacacacacacaauuaaguugc

SEQ ID NO: 39968 - RNA, 64 nt, hsa
uucaccuccucccccaaacacacacacacacacacacacacacacacacacacacaauuaaguu

SEQ ID NO: 39969 - RNA, 64 nt, hsa
aguucaccuccucccccaaacacacacacacacacacacacacacacacacacacacaauuaag

SEQ ID NO: 39970 - RNA, 64 nt, hsa
ccaguucaccuccucccccaaacacacacacacacacacacacacacacacacacacacaauua

SEQ ID NO: 39971 - RNA, 64 nt, hsa
gcccaguucaccuccucccccaaacacacacacacacacacacacacacacacacacacacaau

SEQ ID NO: 39972 - RNA, 64 nt, hsa
aagcccaguucaccuccucccccaaacacacacacacacacacacacacacacacacacacaca

SEQ ID NO: 39973 - RNA, 64 nt, hsa
caaagcccaguucaccuccucccccaaacacacacacacacacacacacacacacacacacaca

SEQ ID NO: 39974 - RNA, 64 nt, hsa
aucaaagcccaguucaccuccucccccaaacacacacacacacacacacacacacacacacaca

SEQ ID NO: 39975 - RNA, 64 nt, hsa
cuaucaaagcccaguucaccuccucccccaaacacacacacacacacacacacacacacacaca

SEQ ID NO: 39976 - RNA, 64 nt, hsa
aucuaucaaagcccaguucaccuccucccccaaacacacacacacacacacacacacacacaca

SEQ ID NO: 39977 - RNA, 64 nt, hsa
cuagccugugcacgcgcgcgugcacacacacacacacacacacgaguucauaauguggugaugg

SEQ ID NO: 39978 - RNA, 64 nt, hsa
cacuagccugugcacgcgcgcgugcacacacacacacacacacacgaguucauaauguggugau

SEQ ID NO: 39979 - RNA, 64 nt, hsa
gacacuagccugugcacgcgcgcgugcacacacacacacacacacacgaguucauaauguggug

SEQ ID NO: 39980 - RNA, 64 nt, hsa
aggacacuagccugugcacgcgcgcgugcacacacacacacacacacacgaguucauaaugugg

SEQ ID NO: 39981 - RNA, 64 nt, hsa
gaaggacacuagccugugcacgcgcgcgugcacacacacacacacacacacgaguucauaaugu

SEQ ID NO: 39982 - RNA, 64 nt, hsa
cagaaggacacuagccugugcacgcgcgcgugcacacacacacacacacacacgaguucauaau

SEQ ID NO: 39983 - RNA, 64 nt, hsa
cacagaaggacacuagccugugcacgcgcgcgugcacacacacacacacacacacgaguucaua

SEQ ID NO: 39984 - RNA, 64 nt, hsa
ggucauguuuuugucacauuagagaauaaacagccacacacacauuuuuuuuuuuccuuuaaaa

SEQ ID NO: 39985 - RNA, 64 nt, hsa
ucauguuuuugucacauuagagaauaaacagccacacacacauuuuuuuuuuuccuuuaaaaca

SEQ ID NO: 39986 - RNA, 64 nt, hsa
ccaggcagucugugugugaggcauagccccuggacacacacacacagacacacacacugccugg

SEQ ID NO: 39987 - RNA, 64 nt, hsa
aggcagucugugugugaggcauagccccuggacacacacacacagacacacacacugccuggau

SEQ ID NO: 39988 - RNA, 64 nt, hsa
gcagucugugugugaggcauagccccuggacacacacacacagacacacacacugccuggaugc

SEQ ID NO: 39989 - RNA, 64 nt, hsa
ugugaggcauagccccuggacacacacacacagacacacacacugccuggaugcauguaugcac

SEQ ID NO: 39990 - RNA, 64 nt, hsa
acacagacacacacacugccuggaugcauguaugcacacacaugcgcgcacacgugcucccuga

SEQ ID NO: 39991 - RNA, 64 nt, hsa
acacgcacacccaugcgcagaugugcugccuggacacacacacacacacggauaugcugucugg

SEQ ID NO: 39992 - RNA, 64 nt, hsa
acgcacacccaugcgcagaugugcugccuggacacacacacacacacggauaugcugucuggac

SEQ ID NO: 39993 - RNA, 64 nt, hsa
gcacacccaugcgcagaugugcugccuggacacacacacacacacggauaugcugucuggacgc

SEQ ID NO: 39994 - RNA, 64 nt, hsa
acacccaugcgcagaugugcugccuggacacacacacacacacggauaugcugucuggacgcac

SEQ ID NO: 39995 - RNA, 64 nt, hsa
augcugccuggacacacagauaaugcugccuugacacacacaugcacggauauugccuggacac

SEQ ID NO: 39996 - RNA, 64 nt, hsa
gccuugacacacacaugcacggauauugccuggacacacacacacacacgugugcacagauaug

SEQ ID NO: 39997 - RNA, 64 nt, hsa
cuugacacacacaugcacggauauugccuggacacacacacacacacgugugcacagauaugcu

SEQ ID NO: 39998 - RNA, 64 nt, hsa
ugacacacacaugcacggauauugccuggacacacacacacacacgugugcacagauaugcugu

SEQ ID NO: 39999 - RNA, 64 nt, hsa
acacacacaugcacggauauugccuggacacacacacacacacgugugcacagauaugcugucu

SEQ ID NO: 40000 - RNA, 64 nt, hsa
acacacgugugcacagauaugcugucuggacacgcacacacaugcagauaugcugccuggacac

SEQ ID NO: 40001 - RNA, 64 nt, hsa
ugcugccuggacacacgcagauaugcugucuagucacacacacacgcagacaugcuguccggac

SEQ ID NO: 40002 - RNA, 64 nt, hsa
cugccuggacacacgcagauaugcugucuagucacacacacacgcagacaugcuguccggacac

SEQ ID NO: 40003 - RNA, 64 nt, hsa
cuagucacacacacacgcagacaugcuguccggacacacacacgcaugcacagauaugcugucc

SEQ ID NO: 40004 - RNA, 64 nt, hsa
acacacacacgcaugcacagauaugcuguccggacacacacacgcacgcagauaugcugccugg

SEQ ID NO: 40005 - RNA, 64 nt, hsa
ggacacacacacgcacgcagauaugcugccuggacacacacacagauaaugcugccucaacacu

SEQ ID NO: 40006 - RNA, 64 nt, hsa
acacacacacgcacgcagauaugcugccuggacacacacacagauaaugcugccucaacacuca

SEQ ID NO: 40007 - RNA, 64 nt, hsa
cucaacacucacacacgugcagauauugccuggacacacacaugugcacagauaugcugucugg

SEQ ID NO: 40008 - RNA, 64 nt, hsa
augcugccugggcacacacuuccggacacacaugcacacacaggugcagauaugcugccuggac

SEQ ID NO: 40009 - RNA, 64 nt, hsa
gucgaaaaugcaaacuuggggagggcggaaacaucacacacaagguuuccacuucacacuugga

SEQ ID NO: 40010 - RNA, 64 nt, hsa
aaauuucuaaggauaccagaaaggaaauggcaugcacacacacaaaaaauaccuaaauuuugga

SEQ ID NO: 40011 - RNA, 64 nt, hsa
auuucuaaggauaccagaaaggaaauggcaugcacacacacaaaaaauaccuaaauuuuggaug

SEQ ID NO: 40012 - RNA, 64 nt, hsa
acuaaccgaaaaaccgaaaauauacaaacagcuucacacacacacacacacacacacacacaca

SEQ ID NO: 40013 - RNA, 64 nt, hsa
uaaccgaaaaaccgaaaauauacaaacagcuucacacacacacacacacacacacacacacaca

SEQ ID NO: 40014 - RNA, 64 nt, hsa
accgaaaaaccgaaaauauacaaacagcuucacacacacacacacacacacacacacacacaca

SEQ ID NO: 40015 - RNA, 64 nt, hsa
cgaaaaaccgaaaauauacaaacagcuucacacacacacacacacacacacacacacacacaca

SEQ ID NO: 40016 - RNA, 64 nt, hsa
aaaaaccgaaaauauacaaacagcuucacacacacacacacacacacacacacacacacacaca

SEQ ID NO: 40017 - RNA, 64 nt, hsa
aaaccgaaaauauacaaacagcuucacacacacacacacacacacacacacacacacacacaca

SEQ ID NO: 40018 - RNA, 64 nt, hsa
accgaaaauauacaaacagcuucacacacacacacacacacacacacacacacacacacacaca

SEQ ID NO: 40019 - RNA, 64 nt, hsa
cgaaaauauacaaacagcuucacacacacacacacacacacacacacacacacacacacacaaa

SEQ ID NO: 40020 - RNA, 64 nt, hsa
aaaauauacaaacagcuucacacacacacacacacacacacacacacacacacacacacaaagg

SEQ ID NO: 40021 - RNA, 64 nt, hsa
aauauacaaacagcuucacacacacacacacacacacacacacacacacacacacacaaaggaa

SEQ ID NO: 40022 - RNA, 64 nt, hsa
uauacaaacagcuucacacacacacacacacacacacacacacacacacacacacaaaggaaga

SEQ ID NO: 40023 - RNA, 64 nt, hsa
uacaaacagcuucacacacacacacacacacacacacacacacacacacacacaaaggaagauc

SEQ ID NO: 40024 - RNA, 64 nt, hsa
caaacagcuucacacacacacacacacacacacacacacacacacacacacaaaggaagaucau

SEQ ID NO: 40025 - RNA, 64 nt, hsa
aacagcuucacacacacacacacacacacacacacacacacacacacacaaaggaagaucauca

SEQ ID NO: 40026 - RNA, 64 nt, hsa
cagcuucacacacacacacacacacacacacacacacacacacacacaaaggaagaucaucaau

SEQ ID NO: 40027 - RNA, 64 nt, hsa
gcuucacacacacacacacacacacacacacacacacacacacacaaaggaagaucaucaaugg

SEQ ID NO: 40028 - RNA, 64 nt, hsa
uucacacacacacacacacacacacacacacacacacacacacaaaggaagaucaucaauggcu

SEQ ID NO: 40029 - RNA, 64 nt, hsa
cacacacacacacacacacacacacacacacacacacacacaaaggaagaucaucaauggcugc

SEQ ID NO: 40030 - RNA, 64 nt, hsa
uuuagcaacuauauucuacaaauguuacuuauaacacacacacacacaucugaaauauaugccg

SEQ ID NO: 40031 - RNA, 64 nt, hsa
uagcaacuauauucuacaaauguuacuuauaacacacacacacacaucugaaauauaugccgaa

SEQ ID NO: 40032 - RNA, 64 nt, hsa
gcaacuauauucuacaaauguuacuuauaacacacacacacacaucugaaauauaugccgaaaa

SEQ ID NO: 40033 - RNA, 64 nt, hsa
aacuauauucuacaaauguuacuuauaacacacacacacacaucugaaauauaugccgaaaauu

SEQ ID NO: 40034 - RNA, 64 nt, hsa
gaaauauauauguguguauguguguauauauaugcacacacacacagauaaugcuuccagugaa

SEQ ID NO: 40035 - RNA, 64 nt, hsa
aauauauauguguguauguguguauauauaugcacacacacacagauaaugcuuccagugaaug

SEQ ID NO: 40036 - RNA, 64 nt, hsa
uauauauguguguauguguguauauauaugcacacacacacagauaaugcuuccagugaaugug

SEQ ID NO: 40037 - RNA, 64 nt, hsa
cauacauucaccgcccccccgcccccccaacgcgcacacacacguccucuccucccaggaaccu

SEQ ID NO: 40038 - RNA, 64 nt, hsa
auucaaauauuuacccgggacacacacccccccccacacacacacacagacacacucacacaca

SEQ ID NO: 40039 - RNA, 64 nt, hsa
ucaaauauuuacccgggacacacacccccccccacacacacacacagacacacucacacacaag

SEQ ID NO: 40040 - RNA, 64 nt, hsa
aaauauuuacccgggacacacacccccccccacacacacacacagacacacucacacacaagag

SEQ ID NO: 40041 - RNA, 64 nt, hsa
auauuuacccgggacacacacccccccccacacacacacacagacacacucacacacaagagcc

SEQ ID NO: 40042 - RNA, 64 nt, hsa
cacacccccccccacacacacacacagacacacucacacacaagagccaggaugguggaguuuu

SEQ ID NO: 40043 - RNA, 64 nt, hsa
uguguguguguguguguguauguaugugaauauacacacacacacacacacaggugagugugaa

SEQ ID NO: 40044 - RNA, 64 nt, hsa
uguguguguguguguguauguaugugaauauacacacacacacacacacaggugagugugaaua

SEQ ID NO: 40045 - RNA, 64 nt, hsa
uguguguguguguguauguaugugaauauacacacacacacacacacaggugagugugaauacu

SEQ ID NO: 40046 - RNA, 64 nt, hsa
uguguguguguguauguaugugaauauacacacacacacacacacaggugagugugaauacuuc

SEQ ID NO: 40047 - RNA, 64 nt, hsa
uguguguguguauguaugugaauauacacacacacacacacacaggugagugugaauacuuccu

SEQ ID NO: 40048 - RNA, 64 nt, hsa
uguguguguauguaugugaauauacacacacacacacacacaggugagugugaauacuuccuug

SEQ ID NO: 40049 - RNA, 64 nt, hsa
ccccaugacacaugagcgcucucacuuacccuuacacacacacacacacacacacacaccucua

SEQ ID NO: 40050 - RNA, 64 nt, hsa
ccaugacacaugagcgcucucacuuacccuuacacacacacacacacacacacacaccucuaac

SEQ ID NO: 40051 - RNA, 64 nt, hsa
augacacaugagcgcucucacuuacccuuacacacacacacacacacacacacaccucuaacag

SEQ ID NO: 40052 - RNA, 64 nt, hsa
gacacaugagcgcucucacuuacccuuacacacacacacacacacacacacaccucuaacagaa

SEQ ID NO: 40053 - RNA, 64 nt, hsa
cacaugagcgcucucacuuacccuuacacacacacacacacacacacacaccucuaacagaagg

SEQ ID NO: 40054 - RNA, 64 nt, hsa
caugagcgcucucacuuacccuuacacacacacacacacacacacacaccucuaacagaaggga

SEQ ID NO: 40055 - RNA, 64 nt, hsa
ugagcgcucucacuuacccuuacacacacacacacacacacacacaccucuaacagaagggaag

SEQ ID NO: 40056 - RNA, 64 nt, hsa
agcgcucucacuuacccuuacacacacacacacacacacacacaccucuaacagaagggaagaa

SEQ ID NO: 40057 - RNA, 64 nt, hsa
cgcucucacuuacccuuacacacacacacacacacacacacaccucuaacagaagggaagaagc

SEQ ID NO: 40058 - RNA, 64 nt, hsa
guaagauagaauguauuauauauauauauauauacacacacacauauauauagcugaaucuuug

SEQ ID NO: 40059 - RNA, 64 nt, hsa
aagauagaauguauuauauauauauauauauacacacacacauauauauagcugaaucuuuggu

SEQ ID NO: 40060 - RNA, 64 nt, hsa
ucugugcuuucaaaaaaaaaaacaaaaaaaaaaccacacacacacauaaaaaacccaacagguc

SEQ ID NO: 40061 - RNA, 64 nt, hsa
ugugcuuucaaaaaaaaaaacaaaaaaaaaaccacacacacacauaaaaaacccaacaggucaa

SEQ ID NO: 40062 - RNA, 64 nt, hsa
ugcuuucaaaaaaaaaaacaaaaaaaaaaccacacacacacauaaaaaacccaacaggucaaaa

SEQ ID NO: 40063 - RNA, 64 nt, hsa
aagguauucauggugacucaggaauacacacauacacacacacacacacacacacacacacaca

SEQ ID NO: 40064 - RNA, 64 nt, hsa
gguauucauggugacucaggaauacacacauacacacacacacacacacacacacacacacaca

SEQ ID NO: 40065 - RNA, 64 nt, hsa
uauucauggugacucaggaauacacacauacacacacacacacacacacacacacacacacaua

SEQ ID NO: 40066 - RNA, 64 nt, hsa
uucauggugacucaggaauacacacauacacacacacacacacacacacacacacacacauaca

SEQ ID NO: 40067 - RNA, 64 nt, hsa
cauggugacucaggaauacacacauacacacacacacacacacacacacacacacacauacaca

SEQ ID NO: 40068 - RNA, 64 nt, hsa
uggugacucaggaauacacacauacacacacacacacacacacacacacacacacauacacaca

SEQ ID NO: 40069 - RNA, 64 nt, hsa
gugacucaggaauacacacauacacacacacacacacacacacacacacacacauacacacaua

SEQ ID NO: 40070 - RNA, 64 nt, hsa
gacucaggaauacacacauacacacacacacacacacacacacacacacacauacacacauaua

SEQ ID NO: 40071 - RNA, 64 nt, hsa
cucaggaauacacacauacacacacacacacacacacacacacacacacauacacacauauaau

SEQ ID NO: 40072 - RNA, 64 nt, hsa
caggaauacacacauacacacacacacacacacacacacacacacacauacacacauauaauuu

SEQ ID NO: 40073 - RNA, 64 nt, hsa
ggaauacacacauacacacacacacacacacacacacacacacacauacacacauauaauuuga

SEQ ID NO: 40074 - RNA, 64 nt, hsa
aauacacacauacacacacacacacacacacacacacacacacauacacacauauaauuugaaa

SEQ ID NO: 40075 - RNA, 64 nt, hsa
uacacacauacacacacacacacacacacacacacacacacauacacacauauaauuugaaaga

SEQ ID NO: 40076 - RNA, 64 nt, hsa
auuguaaauauugugaacauuacuuaacuucacacacacacagagaagaguguggccccacccc

SEQ ID NO: 40077 - RNA, 64 nt, hsa
uuauuguaaauauugugaacauuacuuaacuucacacacacacagagaagaguguggccccacc

SEQ ID NO: 40078 - RNA, 64 nt, hsa
ucuuauuguaaauauugugaacauuacuuaacuucacacacacacagagaagaguguggcccca

SEQ ID NO: 40079 - RNA, 64 nt, hsa
gcugcagagaaaucuaccgagcaaggaaaaggcacacacacacguuugcaggggugucucgguu

SEQ ID NO: 40080 - RNA, 64 nt, hsa
uggcugcagagaaaucuaccgagcaaggaaaaggcacacacacacguuugcaggggugucucgg

SEQ ID NO: 40081 - RNA, 64 nt, hsa
aaaccucuaauuuuuggugacuuuucuacacacacacacacauacagucacauagauauucuua

SEQ ID NO: 40082 - RNA, 64 nt, hsa
uaaaaccucuaauuuuuggugacuuuucuacacacacacacacauacagucacauagauauucu

SEQ ID NO: 40083 - RNA, 64 nt, hsa
uauaaaaccucuaauuuuuggugacuuuucuacacacacacacacauacagucacauagauauu

SEQ ID NO: 40084 - RNA, 64 nt, hsa
guuauaaaaccucuaauuuuuggugacuuuucuacacacacacacacauacagucacauagaua

SEQ ID NO: 40085 - RNA, 64 nt, hsa
agguuuguggcacuguuccaagaggccuuacacacacacacaaauauauaauuuucuauacaua

SEQ ID NO: 40086 - RNA, 64 nt, hsa
ccagguuuguggcacuguuccaagaggccuuacacacacacacaaauauauaauuuucuauaca

SEQ ID NO: 40087 - RNA, 64 nt, hsa
guccagguuuguggcacuguuccaagaggccuuacacacacacacaaauauauaauuuucuaua

SEQ ID NO: 40088 - RNA, 64 nt, hsa
ugugauggaacacacacacacgcagacacacacacacacacaaaugcagacacacaacaucaag

SEQ ID NO: 40089 - RNA, 64 nt, hsa
gaugugauggaacacacacacacgcagacacacacacacacacaaaugcagacacacaacauca

SEQ ID NO: 40090 - RNA, 64 nt, hsa
augaugugauggaacacacacacacgcagacacacacacacacacaaaugcagacacacaacau

SEQ ID NO: 40091 - RNA, 64 nt, hsa
agaugaugugauggaacacacacacacgcagacacacacacacacacaaaugcagacacacaac

SEQ ID NO: 40092 - RNA, 64 nt, hsa
ggagaugaugugauggaacacacacacacgcagacacacacacacacacaaaugcagacacaca

SEQ ID NO: 40093 - RNA, 64 nt, hsa
cccagcguucuucaggagaugaugugauggaacacacacacacgcagacacacacacacacaca

SEQ ID NO: 40094 - RNA, 64 nt, hsa
aacccagcguucuucaggagaugaugugauggaacacacacacacgcagacacacacacacaca

SEQ ID NO: 40095 - RNA, 64 nt, hsa
cacugcauagauuacacgcacauagccacgcauacacacacagacacacagaugugggguacac

SEQ ID NO: 40096 - RNA, 64 nt, hsa
acagaugguguguaugccccucccuguuugacuucacacacacucauaacuuuccaaaugaaac

SEQ ID NO: 40097 - RNA, 64 nt, hsa
aaagauuuuuacucuagaaacugugcgagcacaacacacacaauccuuucuaacuuuauggaca

SEQ ID NO: 40098 - RNA, 64 nt, hsa
gaagggaagagugcuccaagacuuggaccaggcacacacacaccuccagaucaccuuggcaacu

SEQ ID NO: 40099 - RNA, 64 nt, hsa
aggaagggaagagugcuccaagacuuggaccaggcacacacacaccuccagaucaccuuggcaa

SEQ ID NO: 40100 - RNA, 64 nt, hsa
gcuuaugcucagaaaugccauacacacacacaaacacacacauuuaucauuuaaugcauaaauc

SEQ ID NO: 40101 - RNA, 64 nt, hsa
cacuaauaaagcuuaugcucagaaaugccauacacacacacaaacacacacauuuaucauuuaa

SEQ ID NO: 40102 - RNA, 64 nt, hsa
cacacuaauaaagcuuaugcucagaaaugccauacacacacacaaacacacacauuuaucauuu

SEQ ID NO: 40103 - RNA, 64 nt, hsa
uuucauaaagcacuuuuguggccuaguucccacacacacacaaaaguauuaggucuuuaaaacu

SEQ ID NO: 40104 - RNA, 64 nt, hsa
ucuuucauaaagcacuuuuguggccuaguucccacacacacacaaaaguauuaggucuuuaaaa

SEQ ID NO: 40105 - RNA, 64 nt, hsa
acucuuucauaaagcacuuuuguggccuaguucccacacacacacaaaaguauuaggucuuuaa

SEQ ID NO: 40106 - RNA, 64 nt, hsa
cucuuacacacacacacacacacacacauacacacacacacacuccuucucuaagauuccuugu

SEQ ID NO: 40107 - RNA, 64 nt, hsa
uacucuuacacacacacacacacacacacauacacacacacacacuccuucucuaagauuccuu

SEQ ID NO: 40108 - RNA, 64 nt, hsa
auuacucuuacacacacacacacacacacacauacacacacacacacuccuucucuaagauucc

SEQ ID NO: 40109 - RNA, 64 nt, hsa
cuuccagaucauuacucuuacacacacacacacacacacacauacacacacacacacuccuucu

SEQ ID NO: 40110 - RNA, 64 nt, hsa
gacuuccagaucauuacucuuacacacacacacacacacacacauacacacacacacacuccuu

SEQ ID NO: 40111 - RNA, 64 nt, hsa
gagacuuccagaucauuacucuuacacacacacacacacacacacauacacacacacacacucc

SEQ ID NO: 40112 - RNA, 64 nt, hsa
uugagacuuccagaucauuacucuuacacacacacacacacacacacauacacacacacacacu

SEQ ID NO: 40113 - RNA, 64 nt, hsa
cauugagacuuccagaucauuacucuuacacacacacacacacacacacauacacacacacaca

SEQ ID NO: 40114 - RNA, 64 nt, hsa
ugcauugagacuuccagaucauuacucuuacacacacacacacacacacacauacacacacaca

SEQ ID NO: 40115 - RNA, 64 nt, hsa
agugcauugagacuuccagaucauuacucuuacacacacacacacacacacacauacacacaca

SEQ ID NO: 40116 - RNA, 64 nt, hsa
cgagugcauugagacuuccagaucauuacucuuacacacacacacacacacacacauacacaca

SEQ ID NO: 40117 - RNA, 64 nt, hsa
gcacugggagaacuaacagaggagaaaggugaaacacacacacauucuuaaggcaauaaaacua

SEQ ID NO: 40118 - RNA, 64 nt, hsa
acugggagaacuaacagaggagaaaggugaaacacacacacauucuuaaggcaauaaaacuagg

SEQ ID NO: 40119 - RNA, 64 nt, hsa
ccagucaguauucccagccuugagcgcacgcgcgcacacacacacacacauacacacacgcauu

SEQ ID NO: 40120 - RNA, 64 nt, hsa
agucaguauucccagccuugagcgcacgcgcgcacacacacacacacauacacacacgcauuaa

SEQ ID NO: 40121 - RNA, 64 nt, hsa
ucaguauucccagccuugagcgcacgcgcgcacacacacacacacauacacacacgcauuaauu

SEQ ID NO: 40122 - RNA, 64 nt, hsa
aguauucccagccuugagcgcacgcgcgcacacacacacacacauacacacacgcauuaauuuu

SEQ ID NO: 40123 - RNA, 64 nt, hsa
uauucccagccuugagcgcacgcgcgcacacacacacacacauacacacacgcauuaauuuuug

SEQ ID NO: 40124 - RNA, 64 nt, hsa
uauauauuuuaugaauuacaugugguuuuauauacacacacacacacacacacacacacacaca

SEQ ID NO: 40125 - RNA, 64 nt, hsa
uauauuuuaugaauuacaugugguuuuauauacacacacacacacacacacacacacacacaca

SEQ ID NO: 40126 - RNA, 64 nt, hsa
uauuuuaugaauuacaugugguuuuauauacacacacacacacacacacacacacacacacaca

SEQ ID NO: 40127 - RNA, 64 nt, hsa
uuuuaugaauuacaugugguuuuauauacacacacacacacacacacacacacacacacacacu

SEQ ID NO: 40128 - RNA, 64 nt, hsa
uuaugaauuacaugugguuuuauauacacacacacacacacacacacacacacacacacacucu

SEQ ID NO: 40129 - RNA, 64 nt, hsa
augaauuacaugugguuuuauauacacacacacacacacacacacacacacacacacacucuga

SEQ ID NO: 40130 - RNA, 64 nt, hsa
gaauuacaugugguuuuauauacacacacacacacacacacacacacacacacacacucugaca

SEQ ID NO: 40131 - RNA, 64 nt, hsa
auuacaugugguuuuauauacacacacacacacacacacacacacacacacacacucugacauu

SEQ ID NO: 40132 - RNA, 64 nt, hsa
uacaugugguuuuauauacacacacacacacacacacacacacacacacacacucugacauuuu

SEQ ID NO: 40133 - RNA, 64 nt, hsa
caugugguuuuauauacacacacacacacacacacacacacacacacacacucugacauuuuau

SEQ ID NO: 40134 - RNA, 64 nt, hsa
ugugguuuuauauacacacacacacacacacacacacacacacacacacucugacauuuuauua

SEQ ID NO: 40135 - RNA, 64 nt, hsa
ugguuuuauauacacacacacacacacacacacacacacacacacacucugacauuuuauuaca

SEQ ID NO: 40136 - RNA, 64 nt, hsa
guuuuauauacacacacacacacacacacacacacacacacacacucugacauuuuauuacaag

SEQ ID NO: 40137 - RNA, 64 nt, hsa
uuuauauacacacacacacacacacacacacacacacacacacucugacauuuuauuacaagcu

SEQ ID NO: 40138 - RNA, 64 nt, hsa
acacugaagguugacacaggaaagucguacuguucacacacacaguuugagacuccaagccaag

SEQ ID NO: 40139 - RNA, 64 nt, hsa
acugaagguugacacaggaaagucguacuguucacacacacaguuugagacuccaagccaagag

SEQ ID NO: 40140 - RNA, 64 nt, hsa
ggggaagaagauugaucaaacugaaugaaacccccacacacacacacaugcauacacacacaca

SEQ ID NO: 40141 - RNA, 64 nt, hsa
ggaagaagauugaucaaacugaaugaaacccccacacacacacacaugcauacacacacacaca

SEQ ID NO: 40142 - RNA, 64 nt, hsa
aagaagauugaucaaacugaaugaaacccccacacacacacacaugcauacacacacacacaca

SEQ ID NO: 40143 - RNA, 64 nt, hsa
gaagauugaucaaacugaaugaaacccccacacacacacacaugcauacacacacacacacagc

SEQ ID NO: 40144 - RNA, 64 nt, hsa
cugaaugaaacccccacacacacacacaugcauacacacacacacacagccacacacacagaaa

SEQ ID NO: 40145 - RNA, 64 nt, hsa
gaaugaaacccccacacacacacacaugcauacacacacacacacagccacacacacagaaaau

SEQ ID NO: 40146 - RNA, 64 nt, hsa
augaaacccccacacacacacacaugcauacacacacacacacagccacacacacagaaaauau

SEQ ID NO: 40147 - RNA, 64 nt, hsa
gaaacccccacacacacacacaugcauacacacacacacacagccacacacacagaaaauauac

SEQ ID NO: 40148 - RNA, 64 nt, hsa
cacacacacacaugcauacacacacacacacagccacacacacagaaaauauacuguaaagaaa

SEQ ID NO: 40149 - RNA, 64 nt, hsa
cacacacacaugcauacacacacacacacagccacacacacagaaaauauacuguaaagaaaga

SEQ ID NO: 40150 - RNA, 64 nt, hsa
cucugccucuccugaaaccucugacaacccccuacacacacacacaggcauacucagacccacu

SEQ ID NO: 40151 - RNA, 64 nt, hsa
cugccucuccugaaaccucugacaacccccuacacacacacacaggcauacucagacccacuca

SEQ ID NO: 40152 - RNA, 64 nt, hsa
gccucuccugaaaccucugacaacccccuacacacacacacaggcauacucagacccacucaaa

SEQ ID NO: 40153 - RNA, 64 nt, hsa
ccagcguugguuacugaccaccccacccucccaccacacacacacacacacacacacacacaca

SEQ ID NO: 40154 - RNA, 64 nt, hsa
agcguugguuacugaccaccccacccucccaccacacacacacacacacacacacacacacaca

SEQ ID NO: 40155 - RNA, 64 nt, hsa
cguugguuacugaccaccccacccucccaccacacacacacacacacacacacacacacacaca

SEQ ID NO: 40156 - RNA, 64 nt, hsa
uugguuacugaccaccccacccucccaccacacacacacacacacacacacacacacacacaca

SEQ ID NO: 40157 - RNA, 64 nt, hsa
gguuacugaccaccccacccucccaccacacacacacacacacacacacacacacacacacaca

SEQ ID NO: 40158 - RNA, 64 nt, hsa
uuacugaccaccccacccucccaccacacacacacacacacacacacacacacacacacacaca

SEQ ID NO: 40159 - RNA, 64 nt, hsa
acugaccaccccacccucccaccacacacacacacacacacacacacacacacacacacacaca

SEQ ID NO: 40160 - RNA, 64 nt, hsa
ugaccaccccacccucccaccacacacacacacacacacacacacacacacacacacacacaca

SEQ ID NO: 40161 - RNA, 64 nt, hsa
accaccccacccucccaccacacacacacacacacacacacacacacacacacacacacacaca

SEQ ID NO: 40162 - RNA, 64 nt, hsa
caccccacccucccaccacacacacacacacacacacacacacacacacacacacacacacaca

SEQ ID NO: 40163 - RNA, 64 nt, hsa
ccccacccucccaccacacacacacacacacacacacacacacacacacacacacacacacaaa

SEQ ID NO: 40164 - RNA, 64 nt, hsa
ccacccucccaccacacacacacacacacacacacacacacacacacacacacacacacaaagu

SEQ ID NO: 40165 - RNA, 64 nt, hsa
acccucccaccacacacacacacacacacacacacacacacacacacacacacacacaaagugg

SEQ ID NO: 40166 - RNA, 64 nt, hsa
ccucccaccacacacacacacacacacacacacacacacacacacacacacacacaaaguggag

SEQ ID NO: 40167 - RNA, 64 nt, hsa
ucccaccacacacacacacacacacacacacacacacacacacacacacacacaaaguggagaa

SEQ ID NO: 40168 - RNA, 64 nt, hsa
ccaccacacacacacacacacacacacacacacacacacacacacacacacaaaguggagaaaa

SEQ ID NO: 40169 - RNA, 64 nt, hsa
accacacacacacacacacacacacacacacacacacacacacacacacaaaguggagaaaaau

SEQ ID NO: 40170 - RNA, 64 nt, hsa
cacacacacacacacacacacacacacacacacacacacacacacacaaaguggagaaaaaugu

SEQ ID NO: 40171 - RNA, 64 nt, hsa
cacacacacacacacacacacacacacacacacacacacacacacaaaguggagaaaaauguau

SEQ ID NO: 40172 - RNA, 64 nt, hsa
cacacacacacacacacacacacacacacacacacacacacacaaaguggagaaaaauguauac

SEQ ID NO: 40173 - RNA, 64 nt, hsa
cacacacacacacacacacacacacacacacacacacacacaaaguggagaaaaauguauacuc

SEQ ID NO: 40174 - RNA, 64 nt, hsa
agcccauuuguugaggcugaccuuccugaucauacacacacacagcccagcaaaagccucuccu

SEQ ID NO: 40175 - RNA, 64 nt, hsa
cccauuuguugaggcugaccuuccugaucauacacacacacagcccagcaaaagccucuccuga

SEQ ID NO: 40176 - RNA, 64 nt, hsa
uacuguuguuauuaaaaacagaacaaaaacaaaacacacacacacacaaaaacagaaacaaaaa

SEQ ID NO: 40177 - RNA, 64 nt, hsa
cuguuguuauuaaaaacagaacaaaaacaaaacacacacacacacaaaaacagaaacaaaaaaa

SEQ ID NO: 40178 - RNA, 64 nt, hsa
guuguuauuaaaaacagaacaaaaacaaaacacacacacacacaaaaacagaaacaaaaaaaac

SEQ ID NO: 40179 - RNA, 64 nt, hsa
uguuauuaaaaacagaacaaaaacaaaacacacacacacacaaaaacagaaacaaaaaaaacca

SEQ ID NO: 40180 - RNA, 64 nt, hsa
gagcacgugccacgcaugccucgugugcucaucucacacacaccccccucccgggucacgcaga

SEQ ID NO: 40181 - RNA, 64 nt, hsa
accccccucccgggucacgcagacaccccccaaccacacacaucucaugcuguacaccugaggc

SEQ ID NO: 40182 - RNA, 64 nt, hsa
cacacacacacacacacacaaacacacacacacacacacacacucugggacaagauuccuuuga

SEQ ID NO: 40183 - RNA, 64 nt, hsa
cucacacacacacacacacacaaacacacacacacacacacacacucugggacaagauuccuuu

SEQ ID NO: 40184 - RNA, 64 nt, hsa
cucucacacacacacacacacacaaacacacacacacacacacacacucugggacaagauuccu

SEQ ID NO: 40185 - RNA, 64 nt, hsa
cucucucacacacacacacacacacaaacacacacacacacacacacacucugggacaagauuc

SEQ ID NO: 40186 - RNA, 64 nt, hsa
aucucucucacacacacacacacacacaaacacacacacacacacacacacucugggacaagau

SEQ ID NO: 40187 - RNA, 64 nt, hsa
aaaucucucucacacacacacacacacacaaacacacacacacacacacacacucugggacaag

SEQ ID NO: 40188 - RNA, 64 nt, hsa
agaaaucucucucacacacacacacacacacaaacacacacacacacacacacacucugggaca

SEQ ID NO: 40189 - RNA, 64 nt, hsa
aaauauuaauagaaaucucucucacacacacacacacacacaaacacacacacacacacacaca

SEQ ID NO: 40190 - RNA, 64 nt, hsa
acaaauauuaauagaaaucucucucacacacacacacacacacaaacacacacacacacacaca

SEQ ID NO: 40191 - RNA, 64 nt, hsa
acacaaauauuaauagaaaucucucucacacacacacacacacacaaacacacacacacacaca

SEQ ID NO: 40192 - RNA, 64 nt, hsa
aaacacaaauauuaauagaaaucucucucacacacacacacacacacaaacacacacacacaca

SEQ ID NO: 40193 - RNA, 64 nt, hsa
agaaacacaaauauuaauagaaaucucucucacacacacacacacacacaaacacacacacaca

SEQ ID NO: 40194 - RNA, 64 nt, hsa
aaagaaacacaaauauuaauagaaaucucucucacacacacacacacacacaaacacacacaca

SEQ ID NO: 40195 - RNA, 64 nt, hsa
aaaaagaaacacaaauauuaauagaaaucucucucacacacacacacacacacaaacacacaca

SEQ ID NO: 40196 - RNA, 64 nt, hsa
uguugauauauauauauauauauauacacacacacacacacacuaugauggauaaaugcaugag

SEQ ID NO: 40197 - RNA, 64 nt, hsa
auuguugauauauauauauauauauauacacacacacacacacacuaugauggauaaaugcaug

SEQ ID NO: 40198 - RNA, 64 nt, hsa
auauuguugauauauauauauauauauauacacacacacacacacacuaugauggauaaaugca

SEQ ID NO: 40199 - RNA, 64 nt, hsa
auauauuguugauauauauauauauauauauacacacacacacacacacuaugauggauaaaug

SEQ ID NO: 40200 - RNA, 64 nt, hsa
uuauauauuguugauauauauauauauauauauacacacacacacacacacuaugauggauaaa

SEQ ID NO: 40201 - RNA, 64 nt, hsa
acacacauuacacacacacacagaaugcacauuucacacacauauacuuauuauucaaguugaa

SEQ ID NO: 40202 - RNA, 64 nt, hsa
auacaccuguaugugcacauacacacauuacacacacacacagaaugcacauuucacacacaua

SEQ ID NO: 40203 - RNA, 64 nt, hsa
guauacaccuguaugugcacauacacacauuacacacacacacagaaugcacauuucacacaca

SEQ ID NO: 40204 - RNA, 64 nt, hsa
auguauacaccuguaugugcacauacacacauuacacacacacacagaaugcacauuucacaca

SEQ ID NO: 40205 - RNA, 64 nt, hsa
ccugugauagcauacaaauucaaacauacagaaacacacacagauauggacacaguacaauucu

SEQ ID NO: 40206 - RNA, 64 nt, hsa
ugaaugcaacagaagacaaaagcacaggcaugcacacacacagaaccccaaaccacuaaaaacu

SEQ ID NO: 40207 - RNA, 64 nt, hsa
ucugaaugcaacagaagacaaaagcacaggcaugcacacacacagaaccccaaaccacuaaaaa

SEQ ID NO: 40208 - RNA, 64 nt, hsa
cauauacauacacaaacacaaucccacaugcaaacacacacagccacauauauacauguguagc

SEQ ID NO: 40209 - RNA, 64 nt, hsa
cccagguucuuuaguuuuuuauucauucaacucacacacacauaaacauauacauacacaaaca

SEQ ID NO: 40210 - RNA, 64 nt, hsa
ugcccagguucuuuaguuuuuuauucauucaacucacacacacauaaacauauacauacacaaa

SEQ ID NO: 40211 - RNA, 64 nt, hsa
gcucaccaacuguguggcccgauuccuaacaggccacacacagcccagggcuggggaccccugc

SEQ ID NO: 40212 - RNA, 64 nt, hsa
cacacacacacacacacacgaacacacacacacacacacacacgcacacauacacacuuauuuc

SEQ ID NO: 40213 - RNA, 64 nt, hsa
cacacacacacacacacacacgaacacacacacacacacacacacgcacacauacacacuuauu

SEQ ID NO: 40214 - RNA, 64 nt, hsa
agcacacacacacacacacacacgaacacacacacacacacacacacgcacacauacacacuua

SEQ ID NO: 40215 - RNA, 64 nt, hsa
cgagcacacacacacacacacacacgaacacacacacacacacacacacgcacacauacacacu

SEQ ID NO: 40216 - RNA, 64 nt, hsa
cacgagcacacacacacacacacacacgaacacacacacacacacacacacgcacacauacaca

SEQ ID NO: 40217 - RNA, 64 nt, hsa
cacacgagcacacacacacacacacacacgaacacacacacacacacacacacgcacacauaca

SEQ ID NO: 40218 - RNA, 64 nt, hsa
cacacacgagcacacacacacacacacacacgaacacacacacacacacacacacgcacacaua

SEQ ID NO: 40219 - RNA, 64 nt, hsa
acacagcacacacacacacgagcacacacacacacacacacacgaacacacacacacacacaca

SEQ ID NO: 40220 - RNA, 64 nt, hsa
aaacacagcacacacacacacgagcacacacacacacacacacacgaacacacacacacacaca

SEQ ID NO: 40221 - RNA, 64 nt, hsa
caaaacacagcacacacacacacgagcacacacacacacacacacacgaacacacacacacaca

SEQ ID NO: 40222 - RNA, 64 nt, hsa
cucaaaacacagcacacacacacacgagcacacacacacacacacacacgaacacacacacaca

SEQ ID NO: 40223 - RNA, 64 nt, hsa
gccucaaaacacagcacacacacacacgagcacacacacacacacacacacgaacacacacaca

SEQ ID NO: 40224 - RNA, 64 nt, hsa
aagccucaaaacacagcacacacacacacgagcacacacacacacacacacacgaacacacaca

SEQ ID NO: 40225 - RNA, 64 nt, hsa
uaaagccucaaaacacagcacacacacacacgagcacacacacacacacacacacgaacacaca

SEQ ID NO: 40226 - RNA, 64 nt, hsa
ucaaagcccacguaaagccucaaaacacagcacacacacacacgagcacacacacacacacaca

SEQ ID NO: 40227 - RNA, 64 nt, hsa
cuucaaagcccacguaaagccucaaaacacagcacacacacacacgagcacacacacacacaca

SEQ ID NO: 40228 - RNA, 64 nt, hsa
gccuucaaagcccacguaaagccucaaaacacagcacacacacacacgagcacacacacacaca

SEQ ID NO: 40229 - RNA, 64 nt, hsa
aaucgggaaauuuacacacacacacacacacacacacacacagaguaaccuguaacucucaauu

SEQ ID NO: 40230 - RNA, 64 nt, hsa
uaaaucgggaaauuuacacacacacacacacacacacacacacagaguaaccuguaacucucaa

SEQ ID NO: 40231 - RNA, 64 nt, hsa
gauaaaucgggaaauuuacacacacacacacacacacacacacacacacacacacacagaguaa

SEQ ID NO: 40232 - RNA, 64 nt, hsa
gugauaaaucgggaaauuuacacacacacacacacacacacacacacacacacacacacagagu

SEQ ID NO: 40233 - RNA, 64 nt, hsa
uagugauaaaucgggaaauuuacacacacacacacacacacacacacacacacacacacacaga

SEQ ID NO: 40234 - RNA, 64 nt, hsa
ucuagugauaaaucgggaaauuuacacacacacacacacacacacacacacacacacacacaca

SEQ ID NO: 40235 - RNA, 64 nt, hsa
acucuagugauaaaucgggaaauuuacacacacacacacacacacacacacacacacacacaca

SEQ ID NO: 40236 - RNA, 64 nt, hsa
ucacucuagugauaaaucgggaaauuuacacacacacacacacacacacacacacacacacaca

SEQ ID NO: 40237 - RNA, 64 nt, hsa
acucacucuagugauaaaucgggaaauuuacacacacacacacacacacacacacacacacaca

SEQ ID NO: 40238 - RNA, 64 nt, hsa
uuacucacucuagugauaaaucgggaaauuuacacacacacacacacacacacacacacacaca

SEQ ID NO: 40239 - RNA, 64 nt, hsa
aguuacucacucuagugauaaaucgggaaauuuacacacacacacacacacacacacacacaca

SEQ ID NO: 40240 - RNA, 64 nt, hsa
acacacacacacacacacaugcacacaacacauacacacacacgcacagaggugaacagaaacu

SEQ ID NO: 40241 - RNA, 64 nt, hsa
cacauaccuaccccaucccccacccccacacacacacacacaugcacacaacacauacacacac

SEQ ID NO: 40242 - RNA, 64 nt, hsa
agcacauaccuaccccaucccccacccccacacacacacacacaugcacacaacacauacacac

SEQ ID NO: 40243 - RNA, 64 nt, hsa
aaagcacauaccuaccccaucccccacccccacacacacacacacacacacaugcacacaacac

SEQ ID NO: 40244 - RNA, 64 nt, hsa
caaaagcacauaccuaccccaucccccacccccacacacacacacacacacacaugcacacaac

SEQ ID NO: 40245 - RNA, 64 nt, hsa
gccaaaagcacauaccuaccccaucccccacccccacacacacacacacacacacaugcacaca

SEQ ID NO: 40246 - RNA, 64 nt, hsa
uucaauucuuccuuuuuuauuacuauuucaaacacacacacauauauauauauauuaaacuuag

SEQ ID NO: 40247 - RNA, 64 nt, hsa
aauucaauucuuccuuuuuuauuacuauuucaaacacacacacauauauauauauauuaaacuu

SEQ ID NO: 40248 - RNA, 64 nt, hsa
ggagaggaaacccuagacucugugucacucucaacacacacagcuccuuucacuccugccugac

SEQ ID NO: 40249 - RNA, 64 nt, hsa
cgaggguuuucuuacccacauuccccaaucaauacacacacacugcagaacccagaacagaagg

SEQ ID NO: 40250 - RNA, 64 nt, hsa
uucugaaaagagugggcugauaaacuuguaaauccacacacaacucugagaauacccacugcca

SEQ ID NO: 40251 - RNA, 64 nt, hsa
cgcacacacacacacacacacacacacacacacacacacacacucucgcgcucucucucucaac

SEQ ID NO: 40252 - RNA, 64 nt, hsa
agcgcacacacacacacacacacacacacacacacacacacacacucucgcgcucucucucuca

SEQ ID NO: 40253 - RNA, 64 nt, hsa
aaagcgcacacacacacacacacacacacacacacacacacacacacucucgcgcucucucucu

SEQ ID NO: 40254 - RNA, 64 nt, hsa
uaaaagcgcacacacacacacacacacacacacacacacacacacacacucucgcgcucucucu

SEQ ID NO: 40255 - RNA, 64 nt, hsa
uuuaaaagcgcacacacacacacacacacacacacacacacacacacacacucucgcgcucucu

SEQ ID NO: 40256 - RNA, 64 nt, hsa
ugcucccuccaauuuaaaagcacacacacacacacacacacacacacacacacucucgcgcucu

SEQ ID NO: 40257 - RNA, 64 nt, hsa
caugcucccuccaauuuaaaagcacacacacacacacacacacacacacacacacucucgcgcu

SEQ ID NO: 40258 - RNA, 64 nt, hsa
gacaugcucccuccaauuuaaaagcacacacacacacacacacacacacacacacacucucgcg

SEQ ID NO: 40259 - RNA, 64 nt, hsa
cugacaugcucccuccaauuuaaaagcacacacacacacacacacacacacacacacacucucg

SEQ ID NO: 40260 - RNA, 64 nt, hsa
uccugacaugcucccuccaauuuaaaagcacacacacacacacacacacacacacacacacucu

SEQ ID NO: 40261 - RNA, 64 nt, hsa
aauccugacaugcucccuccaauuuaaaagcacacacacacacacacacacacacacacacacu

SEQ ID NO: 40262 - RNA, 64 nt, hsa
acaauccugacaugcucccuccaauuuaaaagcacacacacacacacacacacacacacacaca

SEQ ID NO: 40263 - RNA, 64 nt, hsa
uaacaauccugacaugcucccuccaauuuaaaagcacacacacacacacacacacacacacaca

SEQ ID NO: 40264 - RNA, 64 nt, hsa
uuacauaagcuguguauacacacacacacacacacacacacaccccuaccccacacugacuguc

SEQ ID NO: 40265 - RNA, 64 nt, hsa
auuuacauaagcuguguauacacacacacacacacacacacacaccccuaccccacacugacug

SEQ ID NO: 40266 - RNA, 64 nt, hsa
cgauuuacauaagcuguguauacacacacacacacacacacacacaccccuaccccacacugac

SEQ ID NO: 40267 - RNA, 64 nt, hsa
gucgauuuacauaagcuguguauacacacacacacacacacacacacaccccuaccccacacug

SEQ ID NO: 40268 - RNA, 64 nt, hsa
gagucgauuuacauaagcuguguauacacacacacacacacacacacacaccccuaccccacac

SEQ ID NO: 40269 - RNA, 64 nt, hsa
gagagucgauuuacauaagcuguguauacacacacacacacacacacacacaccccuaccccac

SEQ ID NO: 40270 - RNA, 64 nt, hsa
uggagagucgauuuacauaagcuguguauacacacacacacacacacacacacaccccuacccc

SEQ ID NO: 40271 - RNA, 64 nt, hsa
uguggagagucgauuuacauaagcuguguauacacacacacacacacacacacacaccccuacc

SEQ ID NO: 40272 - RNA, 64 nt, hsa
ucuguggagagucgauuuacauaagcuguguauacacacacacacacacacacacacaccccua

SEQ ID NO: 40273 - RNA, 64 nt, hsa
aaacacauuaugcuuuugcacacacacaccuguacacacacaccggcauguuuauacacaggga

SEQ ID NO: 40274 - RNA, 64 nt, hsa
augcaaaccuuugcaaacacauuaugcuuuugcacacacacaccuguacacacacaccggcaug

SEQ ID NO: 40275 - RNA, 64 nt, hsa
aaaugcaaaccuuugcaaacacauuaugcuuuugcacacacacaccuguacacacacaccggca

SEQ ID NO: 40276 - RNA, 64 nt, hsa
gcagauuuuuuagaagggauaggagacacacgcgcacacacacacacacacgaaacuugaaaug

SEQ ID NO: 40277 - RNA, 64 nt, hsa
agauuuuuuagaagggauaggagacacacgcgcacacacacacacacacgaaacuugaaauggc

SEQ ID NO: 40278 - RNA, 64 nt, hsa
auuuuuuagaagggauaggagacacacgcgcacacacacacacacacgaaacuugaaauggcuu

SEQ ID NO: 40279 - RNA, 64 nt, hsa
uuuuuagaagggauaggagacacacgcgcacacacacacacacacgaaacuugaaauggcuuug

SEQ ID NO: 40280 - RNA, 64 nt, hsa
uuuagaagggauaggagacacacgcgcacacacacacacacacgaaacuugaaauggcuuugcu

SEQ ID NO: 40281 - RNA, 64 nt, hsa
ggaaaauauauguguauguacacauguguauguacacacacacacacaccugccauacacuuua

SEQ ID NO: 40282 - RNA, 64 nt, hsa
aaaauauauguguauguacacauguguauguacacacacacacacaccugccauacacuuuaga

SEQ ID NO: 40283 - RNA, 64 nt, hsa
aauauauguguauguacacauguguauguacacacacacacacaccugccauacacuuuagaag

SEQ ID NO: 40284 - RNA, 64 nt, hsa
uauauguguauguacacauguguauguacacacacacacacaccugccauacacuuuagaagaa

SEQ ID NO: 40285 - RNA, 64 nt, hsa
uuugccaggccaauguugcugauggccccuccagcacacacacauaagcacugaaaucacuuua

SEQ ID NO: 40286 - RNA, 64 nt, hsa
ugccaggccaauguugcugauggccccuccagcacacacacauaagcacugaaaucacuuuacc

SEQ ID NO: 40287 - RNA, 64 nt, hsa
ggccuucccucccaggucugugucugauagcauacacacacacauauauauacacacacacaca

SEQ ID NO: 40288 - RNA, 64 nt, hsa
ccuucccucccaggucugugucugauagcauacacacacacauauauauacacacacacacaca

SEQ ID NO: 40289 - RNA, 64 nt, hsa
ugugucugauagcauacacacacacauauauauacacacacacacacacacacacacacacaca

SEQ ID NO: 40290 - RNA, 64 nt, hsa
ugucugauagcauacacacacacauauauauacacacacacacacacacacacacacacacaca

SEQ ID NO: 40291 - RNA, 64 nt, hsa
ucugauagcauacacacacacauauauauacacacacacacacacacacacacacacacacaca

SEQ ID NO: 40292 - RNA, 64 nt, hsa
ugauagcauacacacacacauauauauacacacacacacacacacacacacacacacacacaca

SEQ ID NO: 40293 - RNA, 64 nt, hsa
auagcauacacacacacauauauauacacacacacacacacacacacacacacacacacacaua

SEQ ID NO: 40294 - RNA, 64 nt, hsa
agcauacacacacacauauauauacacacacacacacacacacacacacacacacacacauaca

SEQ ID NO: 40295 - RNA, 64 nt, hsa
cauacacacacacauauauauacacacacacacacacacacacacacacacacacacauacaua

SEQ ID NO: 40296 - RNA, 64 nt, hsa
uacacacacacauauauauacacacacacacacacacacacacacacacacacacauacauaca

SEQ ID NO: 40297 - RNA, 64 nt, hsa
cacacacacauauauauacacacacacacacacacacacacacacacacacacauacauacaca

SEQ ID NO: 40298 - RNA, 64 nt, hsa
cacacacauauauauacacacacacacacacacacacacacacacacacacauacauacacaca

SEQ ID NO: 40299 - RNA, 64 nt, hsa
cacacauauauauacacacacacacacacacacacacacacacacacacauacauacacacaca

SEQ ID NO: 40300 - RNA, 64 nt, hsa
cacauauauauacacacacacacacacacacacacacacacacacacauacauacacacacaca

SEQ ID NO: 40301 - RNA, 64 nt, hsa
cauauauauacacacacacacacacacacacacacacacacacacauacauacacacacacaua

SEQ ID NO: 40302 - RNA, 64 nt, hsa
uauauauacacacacacacacacacacacacacacacacacacauacauacacacacacauaua

SEQ ID NO: 40303 - RNA, 64 nt, hsa
uauauacacacacacacacacacacacacacacacacacacauacauacacacacacauauaua

SEQ ID NO: 40304 - RNA, 64 nt, hsa
cacacacacacacacacacacacacacauacauacacacacacauauauauacacacacacaca

SEQ ID NO: 40305 - RNA, 64 nt, hsa
cacacacacacacacacacacacacauacauacacacacacauauauauacacacacacacaca

SEQ ID NO: 40306 - RNA, 64 nt, hsa
cacacacacauacauacacacacacauauauauacacacacacacacacacacacacacacacu

SEQ ID NO: 40307 - RNA, 64 nt, hsa
cacacacauacauacacacacacauauauauacacacacacacacacacacacacacacacucu

SEQ ID NO: 40308 - RNA, 64 nt, hsa
cacacauacauacacacacacauauauauacacacacacacacacacacacacacacacucucu

SEQ ID NO: 40309 - RNA, 64 nt, hsa
cacauacauacacacacacauauauauacacacacacacacacacacacacacacacucucucu

SEQ ID NO: 40310 - RNA, 64 nt, hsa
cauacauacacacacacauauauauacacacacacacacacacacacacacacacucucucucu

SEQ ID NO: 40311 - RNA, 64 nt, hsa
uacauacacacacacauauauauacacacacacacacacacacacacacacacucucucucucu

SEQ ID NO: 40312 - RNA, 64 nt, hsa
cauacacacacacauauauauacacacacacacacacacacacacacacacucucucucucucu

SEQ ID NO: 40313 - RNA, 64 nt, hsa
uacacacacacauauauauacacacacacacacacacacacacacacacucucucucucucuca

SEQ ID NO: 40314 - RNA, 64 nt, hsa
cacacacacauauauauacacacacacacacacacacacacacacacucucucucucucucaaa

SEQ ID NO: 40315 - RNA, 64 nt, hsa
cacacacauauauauacacacacacacacacacacacacacacacucucucucucucucaaaca

SEQ ID NO: 40316 - RNA, 64 nt, hsa
cacacauauauauacacacacacacacacacacacacacacacucucucucucucucaaacaca

SEQ ID NO: 40317 - RNA, 64 nt, hsa
cacacacacacacacacucucucucucucucaaacacacacaaaugcccaaccagcucuaagag

SEQ ID NO: 40318 - RNA, 64 nt, hsa
ugguuuuuacuuaacuguuucaaagccaagaccucacacacacaaaaaaugcacaaacaaugca

SEQ ID NO: 40319 - RNA, 64 nt, hsa
guuuuuacuuaacuguuucaaagccaagaccucacacacacaaaaaaugcacaaacaaugcaau

SEQ ID NO: 40320 - RNA, 64 nt, hsa
gagagacacucccagggacaagggaaggaagggacacacacacacacacacacacacacacaca

SEQ ID NO: 40321 - RNA, 64 nt, hsa
gagacacucccagggacaagggaaggaagggacacacacacacacacacacacacacacacaca

SEQ ID NO: 40322 - RNA, 64 nt, hsa
gacacucccagggacaagggaaggaagggacacacacacacacacacacacacacacacacaca

SEQ ID NO: 40323 - RNA, 64 nt, hsa
cacucccagggacaagggaaggaagggacacacacacacacacacacacacacacacacacaca

SEQ ID NO: 40324 - RNA, 64 nt, hsa
cucccagggacaagggaaggaagggacacacacacacacacacacacacacacacacacacaca

SEQ ID NO: 40325 - RNA, 64 nt, hsa
cccagggacaagggaaggaagggacacacacacacacacacacacacacacacacacacacaua

SEQ ID NO: 40326 - RNA, 64 nt, hsa
cagggacaagggaaggaagggacacacacacacacacacacacacacacacacacacacauaca

SEQ ID NO: 40327 - RNA, 64 nt, hsa
gggacaagggaaggaagggacacacacacacacacacacacacacacacacacacacauacauc

SEQ ID NO: 40328 - RNA, 64 nt, hsa
gacaagggaaggaagggacacacacacacacacacacacacacacacacacacacauacauccu

SEQ ID NO: 40329 - RNA, 64 nt, hsa
caagggaaggaagggacacacacacacacacacacacacacacacacacacacauacauccugc

SEQ ID NO: 40330 - RNA, 64 nt, hsa
agggaaggaagggacacacacacacacacacacacacacacacacacacacauacauccugcuu

SEQ ID NO: 40331 - RNA, 64 nt, hsa
ggaaggaagggacacacacacacacacacacacacacacacacacacacauacauccugcuuuc

SEQ ID NO: 40332 - RNA, 64 nt, hsa
aaggaagggacacacacacacacacacacacacacacacacacacacauacauccugcuuuccc

SEQ ID NO: 40333 - RNA, 64 nt, hsa
ggaagggacacacacacacacacacacacacacacacacacacacauacauccugcuuucccuc

SEQ ID NO: 40334 - RNA, 64 nt, hsa
aagggacacacacacacacacacacacacacacacacacacacauacauccugcuuucccuccc

SEQ ID NO: 40335 - RNA, 64 nt, hsa
gggacacacacacacacacacacacacacacacacacacacauacauccugcuuucccucccca

SEQ ID NO: 40336 - RNA, 64 nt, hsa
auuuaguuuacuagaaauucuuuaccuuaagcagcacacacauuuacuacacacacaguguuaa

SEQ ID NO: 40337 - RNA, 64 nt, hsa
aauucuuuaccuuaagcagcacacacauuuacuacacacacaguguuaacaaagcacugugcuu

SEQ ID NO: 40338 - RNA, 64 nt, hsa
ccgaaaacugguuucuaguaaagccuugaaugaacacacacacacacacacacacacacacaca

SEQ ID NO: 40339 - RNA, 64 nt, hsa
gaaaacugguuucuaguaaagccuugaaugaacacacacacacacacacacacacacacacaca

SEQ ID NO: 40340 - RNA, 64 nt, hsa
aaacugguuucuaguaaagccuugaaugaacacacacacacacacacacacacacacacacaca

SEQ ID NO: 40341 - RNA, 64 nt, hsa
acugguuucuaguaaagccuugaaugaacacacacacacacacacacacacacacacacacaca

SEQ ID NO: 40342 - RNA, 64 nt, hsa
ugguuucuaguaaagccuugaaugaacacacacacacacacacacacacacacacacacacaca

SEQ ID NO: 40343 - RNA, 64 nt, hsa
guuucuaguaaagccuugaaugaacacacacacacacacacacacacacacacacacacacaca

SEQ ID NO: 40344 - RNA, 64 nt, hsa
uucuaguaaagccuugaaugaacacacacacacacacacacacacacacacacacacacacaca

SEQ ID NO: 40345 - RNA, 64 nt, hsa
cuaguaaagccuugaaugaacacacacacacacacacacacacacacacacacacacacacaca

SEQ ID NO: 40346 - RNA, 64 nt, hsa
aguaaagccuugaaugaacacacacacacacacacacacacacacacacacacacacacacaca

SEQ ID NO: 40347 - RNA, 64 nt, hsa
uaaagccuugaaugaacacacacacacacacacacacacacacacacacacacacacacacaca

SEQ ID NO: 40348 - RNA, 64 nt, hsa
aagccuugaaugaacacacacacacacacacacacacacacacacacacacacacacacacacc

SEQ ID NO: 40349 - RNA, 64 nt, hsa
gccuugaaugaacacacacacacacacacacacacacacacacacacacacacacacacaccgu

SEQ ID NO: 40350 - RNA, 64 nt, hsa
cuugaaugaacacacacacacacacacacacacacacacacacacacacacacacacaccgucc

SEQ ID NO: 40351 - RNA, 64 nt, hsa
ugaaugaacacacacacacacacacacacacacacacacacacacacacacacacaccguccua

SEQ ID NO: 40352 - RNA, 64 nt, hsa
aaugaacacacacacacacacacacacacacacacacacacacacacacacacaccguccuaca

SEQ ID NO: 40353 - RNA, 64 nt, hsa
ugaacacacacacacacacacacacacacacacacacacacacacacacacaccguccuacacu

SEQ ID NO: 40354 - RNA, 64 nt, hsa
aacacacacacacacacacacacacacacacacacacacacacacacacaccguccuacacuuu

SEQ ID NO: 40355 - RNA, 64 nt, hsa
cacacacacacacacacacacacacacacacacacacacacacacacaccguccuacacuuuaa

SEQ ID NO: 40356 - RNA, 64 nt, hsa
cacacacacacacacacacacacacacacacacacacacacacacaccguccuacacuuuaagc

SEQ ID NO: 40357 - RNA, 64 nt, hsa
cacacacacacacacacacacacacacacacacacacacacacaccguccuacacuuuaagcug

SEQ ID NO: 40358 - RNA, 64 nt, hsa
cacacacacacacacacacacacacacacacacacacacacaccguccuacacuuuaagcugcu

SEQ ID NO: 40359 - RNA, 64 nt, hsa
ucucuuuucucuuuugcuuucuguuucuuaagggcacacacacgugcgugcgagcacacacaca

SEQ ID NO: 40360 - RNA, 64 nt, hsa
cuguuucuuaagggcacacacacgugcgugcgagcacacacacacauacgugcacagggucccc

SEQ ID NO: 40361 - RNA, 64 nt, hsa
guuucuuaagggcacacacacgugcgugcgagcacacacacacauacgugcacaggguccccga

SEQ ID NO: 40362 - RNA, 64 nt, hsa
uucuuaagggcacacacacgugcgugcgagcacacacacacauacgugcacaggguccccgagu

SEQ ID NO: 40363 - RNA, 64 nt, hsa
aguuugcuuaaaacacacacaccacacacacacacacacacaaaacccugugacuggaguguua

SEQ ID NO: 40364 - RNA, 64 nt, hsa
uuaguuugcuuaaaacacacacaccacacacacacacacacacaaaacccugugacuggagugu

SEQ ID NO: 40365 - RNA, 64 nt, hsa
auuuaguuugcuuaaaacacacacaccacacacacacacacacacaaaacccugugacuggagu

SEQ ID NO: 40366 - RNA, 64 nt, hsa
uaauuuaguuugcuuaaaacacacacaccacacacacacacacacacaaaacccugugacugga

SEQ ID NO: 40367 - RNA, 64 nt, hsa
uuuaauuuaguuugcuuaaaacacacacaccacacacacacacacacacaaaacccugugacug

SEQ ID NO: 40368 - RNA, 64 nt, hsa
uguuuaauuuaguuugcuuaaaacacacacaccacacacacacacacacacaaaacccugugac

SEQ ID NO: 40369 - RNA, 64 nt, hsa
aguguuuaauuuaguuugcuuaaaacacacacaccacacacacacacacacacaaaacccugug

SEQ ID NO: 40370 - RNA, 64 nt, hsa
cuaugcuuaaguguuuaauuuaguuugcuuaaaacacacacaccacacacacacacacacacaa

SEQ ID NO: 40371 - RNA, 64 nt, hsa
agaggcaaauccacagaaggggggcugcccuccacacacacacgcccgucacccacaccuugag

SEQ ID NO: 40372 - RNA, 64 nt, hsa
gcagaggcaaauccacagaaggggggcugcccuccacacacacacgcccgucacccacaccuug

SEQ ID NO: 40373 - RNA, 64 nt, hsa
uuauuuucccuccucccucuuguuuuagcuguuacacacacaguaauaccugaauauccaacgg

SEQ ID NO: 40374 - RNA, 64 nt, hsa
cagccaaaaucggaccucagcuuuaguccgucuucacacacaaauaagaaaacggcaaacccac

SEQ ID NO: 40375 - RNA, 64 nt, hsa
ccucugucuuucucucucccucucccacaccucacacacacauacucccacuugcaacuauucu

SEQ ID NO: 40376 - RNA, 64 nt, hsa
cuccucugucuuucucucucccucucccacaccucacacacacauacucccacuugcaacuauu

SEQ ID NO: 40377 - RNA, 64 nt, hsa
ggacaccuacuagcuucccuucccauucaacacacacacacauucuugcucuacccaaagcucu

SEQ ID NO: 40378 - RNA, 64 nt, hsa
uuggacaccuacuagcuucccuucccauucaacacacacacacauucuugcucuacccaaagcu

SEQ ID NO: 40379 - RNA, 64 nt, hsa
uguuggacaccuacuagcuucccuucccauucaacacacacacacauucuugcucuacccaaag

SEQ ID NO: 40380 - RNA, 64 nt, hsa
guuccacuugcacacacgcacacacucaugcucacacacacagagauauauuaaagcacaaguu

SEQ ID NO: 40381 - RNA, 64 nt, hsa
cuguuccacuugcacacacgcacacacucaugcucacacacacagagauauauuaaagcacaag

SEQ ID NO: 40382 - RNA, 64 nt, hsa
ccaggacagacagacagacagacagacagacacgcacacacacccaucucugucuagcaagcag

SEQ ID NO: 40383 - RNA, 64 nt, hsa
cacacacacacacacacacacacacacacacacacacacacaggugucuacugaccuggaguga

SEQ ID NO: 40384 - RNA, 64 nt, hsa
cacacacacacacacacacacacacacacacacacacacacacaggugucuacugaccuggagu

SEQ ID NO: 40385 - RNA, 64 nt, hsa
cacacacacacacacacacacacacacacacacacacacacacacaggugucuacugaccugga

SEQ ID NO: 40386 - RNA, 64 nt, hsa
cacacacacacacacacacacacacacacacacacacacacacacacaggugucuacugaccug

SEQ ID NO: 40387 - RNA, 64 nt, hsa
cacacacacacacacacacacacacacacacacacacacacacacacacaggugucuacugacc

SEQ ID NO: 40388 - RNA, 64 nt, hsa
cacacacacacacacacacacacacacacacacacacacacacacacacacaggugucuacuga

SEQ ID NO: 40389 - RNA, 64 nt, hsa
uacacacacacacacacacacacacacacacacacacacacacacacacacacaggugucuacu

SEQ ID NO: 40390 - RNA, 64 nt, hsa
ccuacacacacacacacacacacacacacacacacacacacacacacacacacacaggugucua

SEQ ID NO: 40391 - RNA, 64 nt, hsa
ccccuacacacacacacacacacacacacacacacacacacacacacacacacacacagguguc

SEQ ID NO: 40392 - RNA, 64 nt, hsa
uuccccuacacacacacacacacacacacacacacacacacacacacacacacacacacaggug

SEQ ID NO: 40393 - RNA, 64 nt, hsa
gauuccccuacacacacacacacacacacacacacacacacacacacacacacacacacacagg

SEQ ID NO: 40394 - RNA, 64 nt, hsa
uggauuccccuacacacacacacacacacacacacacacacacacacacacacacacacacaca

SEQ ID NO: 40395 - RNA, 64 nt, hsa
ccuggauuccccuacacacacacacacacacacacacacacacacacacacacacacacacaca

SEQ ID NO: 40396 - RNA, 64 nt, hsa
agccuggauuccccuacacacacacacacacacacacacacacacacacacacacacacacaca

SEQ ID NO: 40397 - RNA, 64 nt, hsa
gcagccuggauuccccuacacacacacacacacacacacacacacacacacacacacacacaca

SEQ ID NO: 40398 - RNA, 64 nt, hsa
augcagccuggauuccccuacacacacacacacacacacacacacacacacacacacacacaca

SEQ ID NO: 40399 - RNA, 64 nt, hsa
gaaugcagccuggauuccccuacacacacacacacacacacacacacacacacacacacacaca

SEQ ID NO: 40400 - RNA, 64 nt, hsa
gagaaugcagccuggauuccccuacacacacacacacacacacacacacacacacacacacaca

SEQ ID NO: 40401 - RNA, 64 nt, hsa
uggagaaugcagccuggauuccccuacacacacacacacacacacacacacacacacacacaca

SEQ ID NO: 40402 - RNA, 64 nt, hsa
gcuggagaaugcagccuggauuccccuacacacacacacacacacacacacacacacacacaca

SEQ ID NO: 40403 - RNA, 64 nt, hsa
aggcuggagaaugcagccuggauuccccuacacacacacacacacacacacacacacacacaca

SEQ ID NO: 40404 - RNA, 64 nt, hsa
gaaggcuggagaaugcagccuggauuccccuacacacacacacacacacacacacacacacaca

SEQ ID NO: 40405 - RNA, 64 nt, hsa
augaaggcuggagaaugcagccuggauuccccuacacacacacacacacacacacacacacaca

SEQ ID NO: 40406 - RNA, 64 nt, hsa
uauuuagguauacacacacacacacacacacauacacacacacggaccaaaauacuuacaccug

SEQ ID NO: 40407 - RNA, 64 nt, hsa
agcaguuacauauuuagguauacacacacacacacacacacauacacacacacggaccaaaaua

SEQ ID NO: 40408 - RNA, 64 nt, hsa
uaagcaguuacauauuuagguauacacacacacacacacacacauacacacacacggaccaaaa

SEQ ID NO: 40409 - RNA, 64 nt, hsa
auuaagcaguuacauauuuagguauacacacacacacacacacacauacacacacacggaccaa

SEQ ID NO: 40410 - RNA, 64 nt, hsa
ccauuaagcaguuacauauuuagguauacacacacacacacacacacauacacacacacggacc

SEQ ID NO: 40411 - RNA, 64 nt, hsa
aaccauuaagcaguuacauauuuagguauacacacacacacacacacacauacacacacacgga

SEQ ID NO: 40412 - RNA, 64 nt, hsa
gaaaccauuaagcaguuacauauuuagguauacacacacacacacacacacauacacacacacg

SEQ ID NO: 40413 - RNA, 64 nt, hsa
cagaaaccauuaagcaguuacauauuuagguauacacacacacacacacacacauacacacaca

SEQ ID NO: 40414 - RNA, 64 nt, hsa
auuccauauauacacacacacacacacacacacacacacacauacauacauacauauauauaua

SEQ ID NO: 40415 - RNA, 64 nt, hsa
uuauuccauauauacacacacacacacacacacacacacacacauacauacauacauauauaua

SEQ ID NO: 40416 - RNA, 64 nt, hsa
cuuuauuccauauauacacacacacacacacacacacacacacacauacauacauacauauaua

SEQ ID NO: 40417 - RNA, 64 nt, hsa
aacuuuauuccauauauacacacacacacacacacacacacacacacauacauacauacauaua

SEQ ID NO: 40418 - RNA, 64 nt, hsa
caaacuuuauuccauauauacacacacacacacacacacacacacacacauacauacauacaua

SEQ ID NO: 40419 - RNA, 64 nt, hsa
cucaaacuuuauuccauauauacacacacacacacacacacacacacacacauacauacauaca

SEQ ID NO: 40420 - RNA, 64 nt, hsa
aucucaaacuuuauuccauauauacacacacacacacacacacacacacacacauacauacaua

SEQ ID NO: 40421 - RNA, 64 nt, hsa
gaaucucaaacuuuauuccauauauacacacacacacacacacacacacacacacauacauaca

SEQ ID NO: 40422 - RNA, 64 nt, hsa
gggaaucucaaacuuuauuccauauauacacacacacacacacacacacacacacacauacaua

SEQ ID NO: 40423 - RNA, 64 nt, hsa
cagggaaucucaaacuuuauuccauauauacacacacacacacacacacacacacacacauaca

SEQ ID NO: 40424 - RNA, 64 nt, hsa
agcagggaaucucaaacuuuauuccauauauacacacacacacacacacacacacacacacaua

SEQ ID NO: 40425 - RNA, 64 nt, hsa
aaagcagggaaucucaaacuuuauuccauauauacacacacacacacacacacacacacacaca

SEQ ID NO: 40426 - RNA, 64 nt, hsa
gugaauuacuaguuucucuuuauuuagacaaacacacacacaccagauaauauaaacuuaauaa

SEQ ID NO: 40427 - RNA, 64 nt, hsa
aagugaauuacuaguuucucuuuauuuagacaaacacacacacaccagauaauauaaacuuaau

SEQ ID NO: 40428 - RNA, 64 nt, hsa
ucuuuucaaacacacacacacacgcgcgcgcgcgcacacacacucuucaaguuuuuuucaaagu

SEQ ID NO: 40429 - RNA, 64 nt, hsa
cuaccuucauuuucuaauucucuuuucaaacacacacacacacgcgcgcgcgcgcacacacacu

SEQ ID NO: 40430 - RNA, 64 nt, hsa
gucuaccuucauuuucuaauucucuuuucaaacacacacacacacgcgcgcgcgcgcacacaca

SEQ ID NO: 40431 - RNA, 64 nt, hsa
gugucuaccuucauuuucuaauucucuuuucaaacacacacacacacgcgcgcgcgcgcacaca

SEQ ID NO: 40432 - RNA, 64 nt, hsa
guauacauauguguauauaugauacauacacauacacacacacgagagacagaaggaaagagag

SEQ ID NO: 40433 - RNA, 64 nt, hsa
cauauauauauggauggauguaauauauguagaacacacacauagauguauauaggauacacac

SEQ ID NO: 40434 - RNA, 64 nt, hsa
aagagagagaaguaccacuguggcuagauauauacacacacauauauauauggauggauguaau

SEQ ID NO: 40435 - RNA, 64 nt, hsa
uauuuuucuuguggaggucuuugcucuaauaacacacacacacugucucucucucucucucucu

SEQ ID NO: 40436 - RNA, 64 nt, hsa
uguauuuuucuuguggaggucuuugcucuaauaacacacacacacugucucucucucucucucu

SEQ ID NO: 40437 - RNA, 64 nt, hsa
caguaugcuauaaaugauaccccccuaccacacccacacacacaguuuuugucuaaugaaaaug

SEQ ID NO: 40438 - RNA, 64 nt, hsa
guaugcuauaaaugauaccccccuaccacacccacacacacaguuuuugucuaaugaaaauguu

SEQ ID NO: 40439 - RNA, 64 nt, hsa
aggacugcaguauuugugugcccgauucuguaaacacacacacacagaguauauauguguauau

SEQ ID NO: 40440 - RNA, 64 nt, hsa
gacugcaguauuugugugcccgauucuguaaacacacacacacagaguauauauguguauauau

SEQ ID NO: 40441 - RNA, 64 nt, hsa
cugcaguauuugugugcccgauucuguaaacacacacacacagaguauauauguguauauauau

SEQ ID NO: 40442 - RNA, 64 nt, hsa
gaggugccccugcccagcccuguccagccuuguccacacacacaucucacgccccuggucucac

SEQ ID NO: 40443 - RNA, 64 nt, hsa
ggugccccugcccagcccuguccagccuuguccacacacacaucucacgccccuggucucacag

SEQ ID NO: 40444 - RNA, 64 nt, hsa
cagaaaauauuuucagccuacaguuauguucagucacacacacauacaaaauguuccuuuugcu

SEQ ID NO: 40445 - RNA, 64 nt, hsa
gaaaauauuuucagccuacaguuauguucagucacacacacauacaaaauguuccuuuugcuuu

SEQ ID NO: 40446 - RNA, 64 nt, hsa
uucucucugccguggcccagagccggcccagcugcacacacacaccaugcucucgcccugcugu

SEQ ID NO: 40447 - RNA, 64 nt, hsa
cucucugccguggcccagagccggcccagcugcacacacacaccaugcucucgcccugcuguaa

SEQ ID NO: 40448 - RNA, 64 nt, hsa
acgggauccuucucccgcugcccaccaacaccaacacacacacaccucuaagcugcuggccgaa

SEQ ID NO: 40449 - RNA, 64 nt, hsa
gggauccuucucccgcugcccaccaacaccaacacacacacaccucuaagcugcuggccgaaga

SEQ ID NO: 40450 - RNA, 64 nt, hsa
gcagcuaaguggguccuuauguacacaccacguucacacacacacagagggaccacgugugcac

SEQ ID NO: 40451 - RNA, 64 nt, hsa
agcuaaguggguccuuauguacacaccacguucacacacacacagagggaccacgugugcacgc

SEQ ID NO: 40452 - RNA, 64 nt, hsa
cuaaguggguccuuauguacacaccacguucacacacacacagagggaccacgugugcacgcau

SEQ ID NO: 40453 - RNA, 64 nt, hsa
uucuuccucucucucucucucacucacgcacacgcacacacacacacacacacacacacacaca

SEQ ID NO: 40454 - RNA, 64 nt, hsa
cuuccucucucucucucucacucacgcacacgcacacacacacacacacacacacacacacacu

SEQ ID NO: 40455 - RNA, 64 nt, hsa
uccucucucucucucucacucacgcacacgcacacacacacacacacacacacacacacacucc

SEQ ID NO: 40456 - RNA, 64 nt, hsa
cucucucucucucucacucacgcacacgcacacacacacacacacacacacacacacacuccau

SEQ ID NO: 40457 - RNA, 64 nt, hsa
cucucucucucucacucacgcacacgcacacacacacacacacacacacacacacacuccauuc

SEQ ID NO: 40458 - RNA, 64 nt, hsa
cucucucucucacucacgcacacgcacacacacacacacacacacacacacacacuccauucac

SEQ ID NO: 40459 - RNA, 64 nt, hsa
cucucucucacucacgcacacgcacacacacacacacacacacacacacacacuccauucacug

SEQ ID NO: 40460 - RNA, 64 nt, hsa
cucucucacucacgcacacgcacacacacacacacacacacacacacacacuccauucacuguc

SEQ ID NO: 40461 - RNA, 64 nt, hsa
cucucacucacgcacacgcacacacacacacacacacacacacacacacuccauucacugucuc

SEQ ID NO: 40462 - RNA, 64 nt, hsa
cucacucacgcacacgcacacacacacacacacacacacacacacacuccauucacugucucca

SEQ ID NO: 40463 - RNA, 64 nt, hsa
cacucacgcacacgcacacacacacacacacacacacacacacacuccauucacugucuccaug

SEQ ID NO: 40464 - RNA, 64 nt, hsa
cucacgcacacgcacacacacacacacacacacacacacacacuccauucacugucuccaugac

SEQ ID NO: 40465 - RNA, 64 nt, hsa
aaaaaacacaaaaaaacaaaaacaaaaaaccauacacacacacacacacacacaaaucagcauc

SEQ ID NO: 40466 - RNA, 64 nt, hsa
aaaacacaaaaaaacaaaaacaaaaaaccauacacacacacacacacacacaaaucagcaucau

SEQ ID NO: 40467 - RNA, 64 nt, hsa
aacacaaaaaaacaaaaacaaaaaaccauacacacacacacacacacacaaaucagcaucauaa

SEQ ID NO: 40468 - RNA, 64 nt, hsa
cacaaaaaaacaaaaacaaaaaaccauacacacacacacacacacacaaaucagcaucauaagg

SEQ ID NO: 40469 - RNA, 64 nt, hsa
caaaaaaacaaaaacaaaaaaccauacacacacacacacacacacaaaucagcaucauaaggga

SEQ ID NO: 40470 - RNA, 64 nt, hsa
aaaaaacaaaaacaaaaaaccauacacacacacacacacacacaaaucagcaucauaagggaau

SEQ ID NO: 40471 - RNA, 64 nt, hsa
aaaacaaaaacaaaaaaccauacacacacacacacacacacaaaucagcaucauaagggaaugu

SEQ ID NO: 40472 - RNA, 64 nt, hsa
aagugccuccccagccucagcccccaccuccagccacacacacauuacacacacacacacacac

SEQ ID NO: 40473 - RNA, 64 nt, hsa
gugccuccccagccucagcccccaccuccagccacacacacauuacacacacacacacacacac

SEQ ID NO: 40474 - RNA, 64 nt, hsa
gccucagcccccaccuccagccacacacacauuacacacacacacacacacacacaaaugugcc

SEQ ID NO: 40475 - RNA, 64 nt, hsa
cucagcccccaccuccagccacacacacauuacacacacacacacacacacacaaaugugccac

SEQ ID NO: 40476 - RNA, 64 nt, hsa
cagcccccaccuccagccacacacacauuacacacacacacacacacacacaaaugugccacac

SEQ ID NO: 40477 - RNA, 64 nt, hsa
gcccccaccuccagccacacacacauuacacacacacacacacacacacaaaugugccacaccc

SEQ ID NO: 40478 - RNA, 64 nt, hsa
ccccaccuccagccacacacacauuacacacacacacacacacacacaaaugugccacacccag

SEQ ID NO: 40479 - RNA, 64 nt, hsa
ccaccuccagccacacacacauuacacacacacacacacacacacaaaugugccacacccagac

SEQ ID NO: 40480 - RNA, 64 nt, hsa
accuccagccacacacacauuacacacacacacacacacacacaaaugugccacacccagacac

SEQ ID NO: 40481 - RNA, 64 nt, hsa
cuccagccacacacacauuacacacacacacacacacacacaaaugugccacacccagacacgc

SEQ ID NO: 40482 - RNA, 64 nt, hsa
uugguuacaaaacagacacagccaagauaagauccacacacacauuauuaacaaggaagugauu

SEQ ID NO: 40483 - RNA, 64 nt, hsa
gguuacaaaacagacacagccaagauaagauccacacacacauuauuaacaaggaagugauuug

SEQ ID NO: 40484 - RNA, 64 nt, hsa
uguguguuuacacauaugucugcaugcaugugaacacacacacacacacacacacaccaggcgu

SEQ ID NO: 40485 - RNA, 64 nt, hsa
uguguuuacacauaugucugcaugcaugugaacacacacacacacacacacacaccaggcgugu

SEQ ID NO: 40486 - RNA, 64 nt, hsa
uguuuacacauaugucugcaugcaugugaacacacacacacacacacacacaccaggcguguuu

SEQ ID NO: 40487 - RNA, 64 nt, hsa
uuuacacauaugucugcaugcaugugaacacacacacacacacacacacaccaggcguguuuga

SEQ ID NO: 40488 - RNA, 64 nt, hsa
uacacauaugucugcaugcaugugaacacacacacacacacacacacaccaggcguguuugagu

SEQ ID NO: 40489 - RNA, 64 nt, hsa
cacauaugucugcaugcaugugaacacacacacacacacacacacaccaggcguguuugagucc

SEQ ID NO: 40490 - RNA, 64 nt, hsa
cauaugucugcaugcaugugaacacacacacacacacacacacaccaggcguguuugaguccac

SEQ ID NO: 40491 - RNA, 64 nt, hsa
uaugucugcaugcaugugaacacacacacacacacacacacaccaggcguguuugaguccacag

SEQ ID NO: 40492 - RNA, 64 nt, hsa
gacggcucucccaucuuccugcaagucaucugcucacacacaguuggcagcacauagcguuucc

SEQ ID NO: 40493 - RNA, 64 nt, hsa
caggaugcccacggugacugccgcuccguccgugcacacacagcggugcucuucuccccuuagc

SEQ ID NO: 40494 - RNA, 64 nt, hsa
uauggacuuccucuuccugccccaccugcauaggcacacacaccuugaaucugcacccucugga

SEQ ID NO: 40495 - RNA, 64 nt, hsa
agccacgugaaacugcugauguuuuguuuagaugcacacacauggcagcguuucauacagguca

SEQ ID NO: 40496 - RNA, 64 nt, hsa
gguuucuuucagguuaacaagaggcauuugugcacacacacagggcucuuguguguguugucaa

SEQ ID NO: 40497 - RNA, 64 nt, hsa
gcgguuucuuucagguuaacaagaggcauuugugcacacacacagggcucuuguguguguuguc

SEQ ID NO: 40498 - RNA, 64 nt, hsa
ccuggauaugcugggagaggccugaaaaaagccacacacacaguaauugccauuuuaugacugu

SEQ ID NO: 40499 - RNA, 64 nt, hsa
auccuggauaugcugggagaggccugaaaaaagccacacacacaguaauugccauuuuaugacu

SEQ ID NO: 40500 - RNA, 64 nt, hsa
ucucaguuucucccucucucucccaacacacacacacacacaccccucacauacuauaaaauaa

SEQ ID NO: 40501 - RNA, 64 nt, hsa
uuucucaguuucucccucucucucccaacacacacacacacacaccccucacauacuauaaaau

SEQ ID NO: 40502 - RNA, 64 nt, hsa
auuuucucaguuucucccucucucucccaacacacacacacacacaccccucacauacuauaaa

SEQ ID NO: 40503 - RNA, 64 nt, hsa
ccauuuucucaguuucucccucucucucccaacacacacacacacacaccccucacauacuaua

SEQ ID NO: 40504 - RNA, 64 nt, hsa
caccauuuucucaguuucucccucucucucccaacacacacacacacacaccccucacauacua

SEQ ID NO: 40505 - RNA, 64 nt, hsa
uuggugagaccacuaaauuuuacauauaauuauacacacacauauguacauauauauguauaua

SEQ ID NO: 40506 - RNA, 64 nt, hsa
cacacacacacacacacacacacacacacacacacacacacacuccuuguaccccuugcccuuc

SEQ ID NO: 40507 - RNA, 64 nt, hsa
aacacacacacacacacacacacacacacacacacacacacacacuccuuguaccccuugcccu

SEQ ID NO: 40508 - RNA, 64 nt, hsa
ccaacacacacacacacacacacacacacacacacacacacacacacuccuuguaccccuugcc

SEQ ID NO: 40509 - RNA, 64 nt, hsa
ccccaacacacacacacacacacacacacacacacacacacacacacacuccuuguaccccuug

SEQ ID NO: 40510 - RNA, 64 nt, hsa
cuccccaacacacacacacacacacacacacacacacacacacacacacacuccuuguaccccu

SEQ ID NO: 40511 - RNA, 64 nt, hsa
cucuccccaacacacacacacacacacacacacacacacacacacacacacacuccuuguaccc

SEQ ID NO: 40512 - RNA, 64 nt, hsa
cacucuccccaacacacacacacacacacacacacacacacacacacacacacacuccuuguac

SEQ ID NO: 40513 - RNA, 64 nt, hsa
aacacucuccccaacacacacacacacacacacacacacacacacacacacacacacuccuugu

SEQ ID NO: 40514 - RNA, 64 nt, hsa
auaacacucuccccaacacacacacacacacacacacacacacacacacacacacacacuccuu

SEQ ID NO: 40515 - RNA, 64 nt, hsa
acauaacacucuccccaacacacacacacacacacacacacacacacacacacacacacacucc

SEQ ID NO: 40516 - RNA, 64 nt, hsa
ccacauaacacucuccccaacacacacacacacacacacacacacacacacacacacacacacu

SEQ ID NO: 40517 - RNA, 64 nt, hsa
caccacauaacacucuccccaacacacacacacacacacacacacacacacacacacacacaca

SEQ ID NO: 40518 - RNA, 64 nt, hsa
uccaccacauaacacucuccccaacacacacacacacacacacacacacacacacacacacaca

SEQ ID NO: 40519 - RNA, 64 nt, hsa
cauccaccacauaacacucuccccaacacacacacacacacacacacacacacacacacacaca

SEQ ID NO: 40520 - RNA, 64 nt, hsa
cccauccaccacauaacacucuccccaacacacacacacacacacacacacacacacacacaca

SEQ ID NO: 40521 - RNA, 64 nt, hsa
uccccauccaccacauaacacucuccccaacacacacacacacacacacacacacacacacaca

SEQ ID NO: 40522 - RNA, 64 nt, hsa
guuccccauccaccacauaacacucuccccaacacacacacacacacacacacacacacacaca

SEQ ID NO: 40523 - RNA, 64 nt, hsa
uuguuccccauccaccacauaacacucuccccaacacacacacacacacacacacacacacaca

SEQ ID NO: 40524 - RNA, 64 nt, hsa
uggggagcagaguuagggugcacgcuauggcgcacacacacagugcacguccacagugccauac

SEQ ID NO: 40525 - RNA, 64 nt, hsa
gcuggggagcagaguuagggugcacgcuauggcgcacacacacagugcacguccacagugccau

SEQ ID NO: 40526 - RNA, 64 nt, hsa
cacuugaguguaauacuugaugcaugcacacacacacacacauaccuucuuuauagcuacaaag

SEQ ID NO: 40527 - RNA, 64 nt, hsa
uucacuugaguguaauacuugaugcaugcacacacacacacacauaccuucuuuauagcuacaa

SEQ ID NO: 40528 - RNA, 64 nt, hsa
uguucacuugaguguaauacuugaugcaugcacacacacacacacauaccuucuuuauagcuac

SEQ ID NO: 40529 - RNA, 64 nt, hsa
ucuguucacuugaguguaauacuugaugcaugcacacacacacacacauaccuucuuuauagcu

SEQ ID NO: 40530 - RNA, 64 nt, hsa
auucuguucacuugaguguaauacuugaugcaugcacacacacacacacauaccuucuuuauag

SEQ ID NO: 40531 - RNA, 64 nt, hsa
uauguaugcgugcaugcgugcgcgcacacacacacacacacacugacauuauaucauggcauuu

SEQ ID NO: 40532 - RNA, 64 nt, hsa
auuauguaugcgugcaugcgugcgcgcacacacacacacacacacugacauuauaucauggcau

SEQ ID NO: 40533 - RNA, 64 nt, hsa
guauuauguaugcgugcaugcgugcgcgcacacacacacacacacacacacacugacauuauau

SEQ ID NO: 40534 - RNA, 64 nt, hsa
guguauuauguaugcgugcaugcgugcgcgcacacacacacacacacacacacacugacauuau

SEQ ID NO: 40535 - RNA, 64 nt, hsa
auguguauuauguaugcgugcaugcgugcgcgcacacacacacacacacacacacacugacauu

SEQ ID NO: 40536 - RNA, 64 nt, hsa
auauguguauuauguaugcgugcaugcgugcgcgcacacacacacacacacacacacacugaca

SEQ ID NO: 40537 - RNA, 64 nt, hsa
acauucaccugguagcaaaugacacaugcacgcacacacacauacacgcacaagcgccagugcg

SEQ ID NO: 40538 - RNA, 64 nt, hsa
aaacauucaccugguagcaaaugacacaugcacgcacacacacauacacgcacaagcgccagug

SEQ ID NO: 40539 - RNA, 64 nt, hsa
uugugugugcaaugcacacccagacacacgcacgcacacacacgcgcgcgcacacacaugcuuu

SEQ ID NO: 40540 - RNA, 64 nt, hsa
cacccagacacacgcacgcacacacacgcgcgcgcacacacaugcuuuuuucuguuccccuccg

SEQ ID NO: 40541 - RNA, 64 nt, hsa
aagcagccccuccucacacauacaugugcacaugcacacacaugcaugcacacacaugcacaca

SEQ ID NO: 40542 - RNA, 64 nt, hsa
cacacauacaugugcacaugcacacacaugcaugcacacacaugcacacauacacgcacaugca

SEQ ID NO: 40543 - RNA, 64 nt, hsa
caugcaugcacacauacacaggcauacaugcaugcacacacacaugcacgcacacacacaugca

SEQ ID NO: 40544 - RNA, 64 nt, hsa
ugcaugcacacauacacaggcauacaugcaugcacacacacaugcacgcacacacacaugcaca

SEQ ID NO: 40545 - RNA, 64 nt, hsa
cacaggcauacaugcaugcacacacacaugcacgcacacacacaugcacacauacacgugcaca

SEQ ID NO: 40546 - RNA, 64 nt, hsa
caggcauacaugcaugcacacacacaugcacgcacacacacaugcacacauacacgugcacaca

SEQ ID NO: 40547 - RNA, 64 nt, hsa
uacacaggcacacaugcaugcacacauacacaugcacacacacaugcacacauauaugcacagg

SEQ ID NO: 40548 - RNA, 64 nt, hsa
cacaggcacacaugcaugcacacauacacaugcacacacacaugcacacauauaugcacaggca

SEQ ID NO: 40549 - RNA, 64 nt, hsa
caugcacacacacaugcacacauauaugcacaggcacacacauguacgcacacacacaugcacu

SEQ ID NO: 40550 - RNA, 64 nt, hsa
ugcacacauauaugcacaggcacacacauguacgcacacacacaugcacugcacacauauccau

SEQ ID NO: 40551 - RNA, 64 nt, hsa
cacacauauaugcacaggcacacacauguacgcacacacacaugcacugcacacauauccaugc

SEQ ID NO: 40552 - RNA, 64 nt, hsa
cuaggcccuuuucuaugucuuuacaucucugucucacacacacacacguauacacacacacagu

SEQ ID NO: 40553 - RNA, 64 nt, hsa
aggcccuuuucuaugucuuuacaucucugucucacacacacacacguauacacacacacaguuu

SEQ ID NO: 40554 - RNA, 64 nt, hsa
gcccuuuucuaugucuuuacaucucugucucacacacacacacguauacacacacacaguuuau

SEQ ID NO: 40555 - RNA, 64 nt, hsa
cuuuacaucucugucucacacacacacacguauacacacacacaguuuauuuuuaauaaaauag

SEQ ID NO: 40556 - RNA, 64 nt, hsa
uuacaucucugucucacacacacacacguauacacacacacaguuuauuuuuaauaaaauagga

SEQ ID NO: 40557 - RNA, 64 nt, hsa
cacacaguuuauuuuuaauaaaauaggauuauaccacacacauccugucacuugcuuuuuugcu

SEQ ID NO: 40558 - RNA, 64 nt, hsa
cagccgccugacgaaauggaaacacacacagacacacacacaccuugcaaaaaaaaaauuguuu

SEQ ID NO: 40559 - RNA, 64 nt, hsa
aacagccgccugacgaaauggaaacacacacagacacacacacaccuugcaaaaaaaaaauugu

SEQ ID NO: 40560 - RNA, 64 nt, hsa
cgcagacaagaacagccgccugacgaaauggaaacacacacagacacacacacaccuugcaaaa

SEQ ID NO: 40561 - RNA, 64 nt, hsa
gcucuacaugacauucaggacacacacacacacacacacacaccacucgccuccacugaaucua

SEQ ID NO: 40562 - RNA, 64 nt, hsa
ucgcucuacaugacauucaggacacacacacacacacacacacaccacucgccuccacugaauc

SEQ ID NO: 40563 - RNA, 64 nt, hsa
gaucgcucuacaugacauucaggacacacacacacacacacacacaccacucgccuccacugaa

SEQ ID NO: 40564 - RNA, 64 nt, hsa
cagaucgcucuacaugacauucaggacacacacacacacacacacacaccacucgccuccacug

SEQ ID NO: 40565 - RNA, 64 nt, hsa
cccagaucgcucuacaugacauucaggacacacacacacacacacacacaccacucgccuccac

SEQ ID NO: 40566 - RNA, 64 nt, hsa
cucccagaucgcucuacaugacauucaggacacacacacacacacacacacaccacucgccucc

SEQ ID NO: 40567 - RNA, 64 nt, hsa
uccucccagaucgcucuacaugacauucaggacacacacacacacacacacacaccacucgccu

SEQ ID NO: 40568 - RNA, 64 nt, hsa
gcuccucccagaucgcucuacaugacauucaggacacacacacacacacacacacaccacucgc

SEQ ID NO: 40569 - RNA, 64 nt, hsa
uguuuuuuuaccaccuggugaaucagccauaacgcacacacacgccacccagccucuuguuucu

SEQ ID NO: 40570 - RNA, 64 nt, hsa
gcuucuccuuuuaaaauccccuccacuccucacacacacacaccucuugaaacccuuccccaag

SEQ ID NO: 40571 - RNA, 64 nt, hsa
augcuucuccuuuuaaaauccccuccacuccucacacacacacaccucuugaaacccuucccca

SEQ ID NO: 40572 - RNA, 64 nt, hsa
aaaugcuucuccuuuuaaaauccccuccacuccucacacacacacaccucuugaaacccuuccc

SEQ ID NO: 40573 - RNA, 64 nt, hsa
uauguauagacacacacacauaugcacacacacacacacacacccacagagagagagcugcaag

SEQ ID NO: 40574 - RNA, 64 nt, hsa
aauauguauagacacacacacauaugcacacacacacacacacacccacagagagagagcugca

SEQ ID NO: 40575 - RNA, 64 nt, hsa
auaauauguauagacacacacacauaugcacacacacacacacacacccacagagagagagcug

SEQ ID NO: 40576 - RNA, 64 nt, hsa
aaauaauauguauagacacacacacauaugcacacacacacacacacacccacagagagagagc

SEQ ID NO: 40577 - RNA, 64 nt, hsa
ccaaauaauauguauagacacacacacauaugcacacacacacacacacacccacagagagaga

SEQ ID NO: 40578 - RNA, 64 nt, hsa
aaccaaauaauauguauagacacacacacauaugcacacacacacacacacacccacagagaga

SEQ ID NO: 40579 - RNA, 64 nt, hsa
ccugugcugaccaaccaaauaauauguauagacacacacacauaugcacacacacacacacaca

SEQ ID NO: 40580 - RNA, 64 nt, hsa
cuccugugcugaccaaccaaauaauauguauagacacacacacauaugcacacacacacacaca

SEQ ID NO: 40581 - RNA, 64 nt, hsa
uauagacaaccagcuaaacugccuuuuuggugugcacacacauuucaugugcagacgugccucu

SEQ ID NO: 40582 - RNA, 64 nt, hsa
caggcauacucacacacagacacacacacacacacacacacagacucauccacacuucaaauug

SEQ ID NO: 40583 - RNA, 64 nt, hsa
cacaggcauacucacacacagacacacacacacacacacacacagacucauccacacuucaaau

SEQ ID NO: 40584 - RNA, 64 nt, hsa
cacacaggcauacucacacacagacacacacacacacacacacacagacucauccacacuucaa

SEQ ID NO: 40585 - RNA, 64 nt, hsa
cacacacaggcauacucacacacagacacacacacacacacacacacagacucauccacacuuc

SEQ ID NO: 40586 - RNA, 64 nt, hsa
cacacacacaggcauacucacacacagacacacacacacacacacacacagacucauccacacu

SEQ ID NO: 40587 - RNA, 64 nt, hsa
cucacacacacaggcauacucacacacagacacacacacacacacacacacagacucauccaca

SEQ ID NO: 40588 - RNA, 64 nt, hsa
cacucacacacacaggcauacucacacacagacacacacacacacacacacacagacucaucca

SEQ ID NO: 40589 - RNA, 64 nt, hsa
cacacucacacacacaggcauacucacacacagacacacacacacacacacacacagacucauc

SEQ ID NO: 40590 - RNA, 64 nt, hsa
aauauacacacacacucacacacacaggcauacucacacacagacacacacacacacacacaca

SEQ ID NO: 40591 - RNA, 64 nt, hsa
acuucaaaugcuacaaaauauacacacacacucacacacacaggcauacucacacacagacaca

SEQ ID NO: 40592 - RNA, 64 nt, hsa
aaacuucaaaugcuacaaaauauacacacacacucacacacacaggcauacucacacacagaca

SEQ ID NO: 40593 - RNA, 64 nt, hsa
ucuugccacaaaacuucaaaugcuacaaaauauacacacacacucacacacacaggcauacuca

SEQ ID NO: 40594 - RNA, 64 nt, hsa
uauguguguguguguguguguauauauacacacacacacacauacuuaaaucuugcccugcaug

SEQ ID NO: 40595 - RNA, 64 nt, hsa
uguauguguguguguguguguguauauauacacacacacacacauacuuaaaucuugcccugca

SEQ ID NO: 40596 - RNA, 64 nt, hsa
uguguauguguguguguguguguguauauauacacacacacacacauacuuaaaucuugcccug

SEQ ID NO: 40597 - RNA, 64 nt, hsa
uauguguauguguguguguguguguguauauauacacacacacacacauacuuaaaucuugccc

SEQ ID NO: 40598 - RNA, 64 nt, hsa
gggggcuucaauauauauauauaauacacacacacacacacaugcacacauaccgcacuucaua

SEQ ID NO: 40599 - RNA, 64 nt, hsa
augggggcuucaauauauauauauaauacacacacacacacacaugcacacauaccgcacuuca

SEQ ID NO: 40600 - RNA, 64 nt, hsa
aaaugggggcuucaauauauauauauaauacacacacacacacacaugcacacauaccgcacuu

SEQ ID NO: 40601 - RNA, 64 nt, hsa
guaaaugggggcuucaauauauauauauaauacacacacacacacacaugcacacauaccgcac

SEQ ID NO: 40602 - RNA, 64 nt, hsa
auguaaaugggggcuucaauauauauauauaauacacacacacacacacaugcacacauaccgc

SEQ ID NO: 40603 - RNA, 64 nt, hsa
cacacacacacacacacacacacacacacacacacacacacaaguaagagacucagccugcagu

SEQ ID NO: 40604 - RNA, 64 nt, hsa
cacacacacacacacacacacacacacacacacacacacacacaaguaagagacucagccugca

SEQ ID NO: 40605 - RNA, 64 nt, hsa
cacacacacacacacacacacacacacacacacacacacacacacaaguaagagacucagccug

SEQ ID NO: 40606 - RNA, 64 nt, hsa
cacacacacacacacacacacacacacacacacacacacacacacacaaguaagagacucagcc

SEQ ID NO: 40607 - RNA, 64 nt, hsa
cacacacacacacacacacacacacacacacacacacacacacacacacaaguaagagacucag

SEQ ID NO: 40608 - RNA, 64 nt, hsa
cacacacacacacacacacacacacacacacacacacacacacacacacacaaguaagagacuc

SEQ ID NO: 40609 - RNA, 64 nt, hsa
cacacacacacacacacacacacacacacacacacacacacacacacacacacaaguaagagac

SEQ ID NO: 40610 - RNA, 64 nt, hsa
uacacacacacacacacacacacacacacacacacacacacacacacacacacacaaguaagag

SEQ ID NO: 40611 - RNA, 64 nt, hsa
uauacacacacacacacacacacacacacacacacacacacacacacacacacacacaaguaag

SEQ ID NO: 40612 - RNA, 64 nt, hsa
cauauacacacacacacacacacacacacacacacacacacacacacacacacacacacaagua

SEQ ID NO: 40613 - RNA, 64 nt, hsa
cacauauacacacacacacacacacacacacacacacacacacacacacacacacacacacaag

SEQ ID NO: 40614 - RNA, 64 nt, hsa
cgcacauauacacacacacacacacacacacacacacacacacacacacacacacacacacaca

SEQ ID NO: 40615 - RNA, 64 nt, hsa
cacgcacauauacacacacacacacacacacacacacacacacacacacacacacacacacaca

SEQ ID NO: 40616 - RNA, 64 nt, hsa
cacacgcacauauacacacacacacacacacacacacacacacacacacacacacacacacaca

SEQ ID NO: 40617 - RNA, 64 nt, hsa
cacacacgcacauauacacacacacacacacacacacacacacacacacacacacacacacaca

SEQ ID NO: 40618 - RNA, 64 nt, hsa
cacacacacgcacauauacacacacacacacacacacacacacacacacacacacacacacaca

SEQ ID NO: 40619 - RNA, 64 nt, hsa
cacacacacacgcacauauacacacacacacacacacacacacacacacacacacacacacaca

SEQ ID NO: 40620 - RNA, 64 nt, hsa
cacacacacacacgcacauauacacacacacacacacacacacacacacacacacacacacaca

SEQ ID NO: 40621 - RNA, 64 nt, hsa
uacacacacacacacgcacauauacacacacacacacacacacacacacacacacacacacaca

SEQ ID NO: 40622 - RNA, 64 nt, hsa
uauacacacacacacacgcacauauacacacacacacacacacacacacacacacacacacaca

SEQ ID NO: 40623 - RNA, 64 nt, hsa
uauauacacacacacacacgcacauauacacacacacacacacacacacacacacacacacaca

SEQ ID NO: 40624 - RNA, 64 nt, hsa
uauauauacacacacacacacgcacauauacacacacacacacacacacacacacacacacaca

SEQ ID NO: 40625 - RNA, 64 nt, hsa
uauauauauacacacacacacacgcacauauacacacacacacacacacacacacacacacaca

SEQ ID NO: 40626 - RNA, 64 nt, hsa
uauauauauauacacacacacacacgcacauauacacacacacacacacacacacacacacaca

SEQ ID NO: 40627 - RNA, 64 nt, hsa
uccauauauauauauauauauauauauauacacacacacacacgcacauauacacacacacaca

SEQ ID NO: 40628 - RNA, 64 nt, hsa
gcuccauauauauauauauauauauauauauacacacacacacacgcacauauacacacacaca

SEQ ID NO: 40629 - RNA, 64 nt, hsa
aggcuccauauauauauauauauauauauauauacacacacacacacgcacauauacacacaca

SEQ ID NO: 40630 - RNA, 64 nt, hsa
aaacuauuucauccgcuguuuccuccccaaaacacacacacagagcaaacucccuuucauaaaa

SEQ ID NO: 40631 - RNA, 64 nt, hsa
auaaacuauuucauccgcuguuuccuccccaaaacacacacacagagcaaacucccuuucauaa

SEQ ID NO: 40632 - RNA, 64 nt, hsa
cuggaguuuuuccagcauacaauacaugcacgugcacacacauacacacacauccauuaauaua

SEQ ID NO: 40633 - RNA, 64 nt, hsa
uccagcauacaauacaugcacgugcacacacauacacacacauccauuaauauacuucaguaag

SEQ ID NO: 40634 - RNA, 64 nt, hsa
acauauauaauauauacacacagauacaaguguacacacacacaccacacaccacacacacccc

SEQ ID NO: 40635 - RNA, 64 nt, hsa
auauauaauauauacacacagauacaaguguacacacacacaccacacaccacacacaccccac

SEQ ID NO: 40636 - RNA, 64 nt, hsa
cacagauacaaguguacacacacacaccacacaccacacacaccccacuggcagucuuugugga

SEQ ID NO: 40637 - RNA, 64 nt, hsa
cucagucuuuaauccuggcagggauucacgggcgcacacacacacacucaggauucagaucuug

SEQ ID NO: 40638 - RNA, 64 nt, hsa
cagucuuuaauccuggcagggauucacgggcgcacacacacacacucaggauucagaucuuguu

SEQ ID NO: 40639 - RNA, 64 nt, hsa
gucuuuaauccuggcagggauucacgggcgcacacacacacacucaggauucagaucuuguuga

SEQ ID NO: 40640 - RNA, 64 nt, hsa
ggcccccuagaccagcucuuccagcuggauggagcacacacaggccuccagcugggccauguca

SEQ ID NO: 40641 - RNA, 64 nt, hsa
acuaagauuuucccaugcauaauuacaaauaaugcacacacacaaauguauaugcuggguagua

SEQ ID NO: 40642 - RNA, 64 nt, hsa
uaagauuuucccaugcauaauuacaaauaaugcacacacacaaauguauaugcuggguaguaug

SEQ ID NO: 40643 - RNA, 64 nt, hsa
aggauguugaagauaaugacacuaaaucuauggacacacacacacacacacacacacacacaca

SEQ ID NO: 40644 - RNA, 64 nt, hsa
gauguugaagauaaugacacuaaaucuauggacacacacacacacacacacacacacacacaca

SEQ ID NO: 40645 - RNA, 64 nt, hsa
uguugaagauaaugacacuaaaucuauggacacacacacacacacacacacacacacacacaca

SEQ ID NO: 40646 - RNA, 64 nt, hsa
uugaagauaaugacacuaaaucuauggacacacacacacacacacacacacacacacacacaca

SEQ ID NO: 40647 - RNA, 64 nt, hsa
gaagauaaugacacuaaaucuauggacacacacacacacacacacacacacacacacacacaca

SEQ ID NO: 40648 - RNA, 64 nt, hsa
agauaaugacacuaaaucuauggacacacacacacacacacacacacacacacacacacacaca

SEQ ID NO: 40649 - RNA, 64 nt, hsa
auaaugacacuaaaucuauggacacacacacacacacacacacacacacacacacacacacaca

SEQ ID NO: 40650 - RNA, 64 nt, hsa
aaugacacuaaaucuauggacacacacacacacacacacacacacacacacacacacacacaca

SEQ ID NO: 40651 - RNA, 64 nt, hsa
ugacacuaaaucuauggacacacacacacacacacacacacacacacacacacacacacacaca

SEQ ID NO: 40652 - RNA, 64 nt, hsa
acacuaaaucuauggacacacacacacacacacacacacacacacacacacacacacacacaca

SEQ ID NO: 40653 - RNA, 64 nt, hsa
acuaaaucuauggacacacacacacacacacacacacacacacacacacacacacacacacaca

SEQ ID NO: 40654 - RNA, 64 nt, hsa
uaaaucuauggacacacacacacacacacacacacacacacacacacacacacacacacacaca

SEQ ID NO: 40655 - RNA, 64 nt, hsa
aaucuauggacacacacacacacacacacacacacacacacacacacacacacacacacacaca

SEQ ID NO: 40656 - RNA, 64 nt, hsa
ucuauggacacacacacacacacacacacacacacacacacacacacacacacacacacacagu

SEQ ID NO: 40657 - RNA, 64 nt, hsa
uauggacacacacacacacacacacacacacacacacacacacacacacacacacacacaguuu

SEQ ID NO: 40658 - RNA, 64 nt, hsa
uggacacacacacacacacacacacacacacacacacacacacacacacacacacacaguuuaa

SEQ ID NO: 40659 - RNA, 64 nt, hsa
gacacacacacacacacacacacacacacacacacacacacacacacacacacacaguuuaaug

SEQ ID NO: 40660 - RNA, 64 nt, hsa
cacacacacacacacacacacacacacacacacacacacacacacacacacacaguuuaaugaa

SEQ ID NO: 40661 - RNA, 64 nt, hsa
cacacacacacacacacacacacacacacacacacacacacacacacacacaguuuaaugaagg

SEQ ID NO: 40662 - RNA, 64 nt, hsa
cacacacacacacacacacacacacacacacacacacacacacacacacaguuuaaugaaggcu

SEQ ID NO: 40663 - RNA, 64 nt, hsa
cacacacacacacacacacacacacacacacacacacacacacacacaguuuaaugaaggcuua

SEQ ID NO: 40664 - RNA, 64 nt, hsa
cacacacacacacacacacacacacacacacacacacacacacacaguuuaaugaaggcuuaaa

SEQ ID NO: 40665 - RNA, 64 nt, hsa
cacacacacacacacacacacacacacacacacacacacacacaguuuaaugaaggcuuaaaga

SEQ ID NO: 40666 - RNA, 64 nt, hsa
cacacacacacacacacacacacacacacacacacacacacaguuuaaugaaggcuuaaagaau

SEQ ID NO: 40667 - RNA, 64 nt, hsa
auggaaacccauugacauuccaaaacaauauauacacacacacauaaaucagccaaaaucagag

SEQ ID NO: 40668 - RNA, 64 nt, hsa
ggaaacccauugacauuccaaaacaauauauacacacacacauaaaucagccaaaaucagagaa

SEQ ID NO: 40669 - RNA, 64 nt, hsa
aagccguauauagaucaauguccacauauauauacacacacacauauauauauauaaaguguaa

SEQ ID NO: 40670 - RNA, 64 nt, hsa
gccguauauagaucaauguccacauauauauacacacacacauauauauauauaaaguguaaca

SEQ ID NO: 40671 - RNA, 64 nt, hsa
caaucaucccuucuugcuccucuuugugcacguacacacacacacacacacacacacacacaca

SEQ ID NO: 40672 - RNA, 64 nt, hsa
aucaucccuucuugcuccucuuugugcacguacacacacacacacacacacacacacacacacc

SEQ ID NO: 40673 - RNA, 64 nt, hsa
caucccuucuugcuccucuuugugcacguacacacacacacacacacacacacacacacacccc

SEQ ID NO: 40674 - RNA, 64 nt, hsa
ucccuucuugcuccucuuugugcacguacacacacacacacacacacacacacacacaccccug

SEQ ID NO: 40675 - RNA, 64 nt, hsa
ccuucuugcuccucuuugugcacguacacacacacacacacacacacacacacacaccccugcu

SEQ ID NO: 40676 - RNA, 64 nt, hsa
uucuugcuccucuuugugcacguacacacacacacacacacacacacacacacaccccugcuca

SEQ ID NO: 40677 - RNA, 64 nt, hsa
cuugcuccucuuugugcacguacacacacacacacacacacacacacacacaccccugcucaac

SEQ ID NO: 40678 - RNA, 64 nt, hsa
ugcuccucuuugugcacguacacacacacacacacacacacacacacacaccccugcucaacag

SEQ ID NO: 40679 - RNA, 64 nt, hsa
cuccucuuugugcacguacacacacacacacacacacacacacacacaccccugcucaacagag

SEQ ID NO: 40680 - RNA, 64 nt, hsa
ccucuuugugcacguacacacacacacacacacacacacacacacaccccugcucaacagaggu

SEQ ID NO: 40681 - RNA, 64 nt, hsa
ucuuugugcacguacacacacacacacacacacacacacacacaccccugcucaacagagguuu

SEQ ID NO: 40682 - RNA, 64 nt, hsa
uuugugcacguacacacacacacacacacacacacacacacaccccugcucaacagagguuuag

SEQ ID NO: 40683 - RNA, 64 nt, hsa
cacacacaugcacauacacacacacacacacacacacacacagugugcaacuagccccaguuuu

SEQ ID NO: 40684 - RNA, 64 nt, hsa
cacacacacaugcacauacacacacacacacacacacacacacagugugcaacuagccccaguu

SEQ ID NO: 40685 - RNA, 64 nt, hsa
cacacacacacaugcacauacacacacacacacacacacacacacagugugcaacuagccccag

SEQ ID NO: 40686 - RNA, 64 nt, hsa
cacacacacacacaugcacauacacacacacacacacacacacacacagugugcaacuagcccc

SEQ ID NO: 40687 - RNA, 64 nt, hsa
cacacacacacacacaugcacauacacacacacacacacacacacacacagugugcaacuagcc

SEQ ID NO: 40688 - RNA, 64 nt, hsa
aacacacacacacacacaugcacauacacacacacacacacacacacacacagugugcaacuag

SEQ ID NO: 40689 - RNA, 64 nt, hsa
uaaacacacacacacacacaugcacauacacacacacacacacacacacacacagugugcaacu

SEQ ID NO: 40690 - RNA, 64 nt, hsa
uuuaaacacacacacacacacaugcacauacacacacacacacacacacacacacagugugcaa

SEQ ID NO: 40691 - RNA, 64 nt, hsa
ccuuuaaacacacacacacacacaugcacauacacacacacacacacacacacacacagugugc

SEQ ID NO: 40692 - RNA, 64 nt, hsa
ccccuuuaaacacacacacacacacaugcacauacacacacacacacacacacacacacagugu

SEQ ID NO: 40693 - RNA, 64 nt, hsa
gggugaaaacagaguaccccuuuaaacacacacacacacacaugcacauacacacacacacaca

SEQ ID NO: 40694 - RNA, 64 nt, hsa
cagggugaaaacagaguaccccuuuaaacacacacacacacacaugcacauacacacacacaca

SEQ ID NO: 40695 - RNA, 64 nt, hsa
uucagggugaaaacagaguaccccuuuaaacacacacacacacacaugcacauacacacacaca

SEQ ID NO: 40696 - RNA, 64 nt, hsa
auuucagggugaaaacagaguaccccuuuaaacacacacacacacacaugcacauacacacaca

SEQ ID NO: 40697 - RNA, 64 nt, hsa
ugauuucagggugaaaacagaguaccccuuuaaacacacacacacacacaugcacauacacaca

SEQ ID NO: 40698 - RNA, 64 nt, hsa
aauuuauauauacauuguguguguguguaauacacacacacaacccccuauaccuggaagauug

SEQ ID NO: 40699 - RNA, 64 nt, hsa
aaaauuuauauauacauuguguguguguguaauacacacacacaacccccuauaccuggaagau

SEQ ID NO: 40700 - RNA, 64 nt, hsa
cauacaugcaugcacacauacauacauauguauacacacacauaauuugaaaacugauuggcac

SEQ ID NO: 40701 - RNA, 64 nt, hsa
aacguuuucuuucacacacacacacacacacacacacacacaugcuaggaugcggaaauccccu

SEQ ID NO: 40702 - RNA, 64 nt, hsa
guaacguuuucuuucacacacacacacacacacacacacacacaugcuaggaugcggaaauccc

SEQ ID NO: 40703 - RNA, 64 nt, hsa
cuguaacguuuucuuucacacacacacacacacacacacacacacaugcuaggaugcggaaauc

SEQ ID NO: 40704 - RNA, 64 nt, hsa
aacuguaacguuuucuuucacacacacacacacacacacacacacacaugcuaggaugcggaaa

SEQ ID NO: 40705 - RNA, 64 nt, hsa
uuaacuguaacguuuucuuucacacacacacacacacacacacacacacaugcuaggaugcgga

SEQ ID NO: 40706 - RNA, 64 nt, hsa
gguuaacuguaacguuuucuuucacacacacacacacacacacacacacacaugcuaggaugcg

SEQ ID NO: 40707 - RNA, 64 nt, hsa
acgguuaacuguaacguuuucuuucacacacacacacacacacacacacacacaugcuaggaug

SEQ ID NO: 40708 - RNA, 64 nt, hsa
uaacgguuaacuguaacguuuucuuucacacacacacacacacacacacacacacaugcuagga

SEQ ID NO: 40709 - RNA, 64 nt, hsa
uguaacgguuaacuguaacguuuucuuucacacacacacacacacacacacacacacaugcuag

SEQ ID NO: 40710 - RNA, 64 nt, hsa
auuguaacgguuaacuguaacguuuucuuucacacacacacacacacacacacacacacaugcu

SEQ ID NO: 40711 - RNA, 64 nt, hsa
caauuguaacgguuaacuguaacguuuucuuucacacacacacacacacacacacacacacaug

SEQ ID NO: 40712 - RNA, 64 nt, hsa
agcaauuguaacgguuaacuguaacguuuucuuucacacacacacacacacacacacacacaca

SEQ ID NO: 40713 - RNA, 64 nt, hsa
cucugcacaugcagcccucuccucgagcacgucacacacacaugccaguguggagagcgccucu

SEQ ID NO: 40714 - RNA, 64 nt, hsa
cucucugcacaugcagcccucuccucgagcacgucacacacacaugccaguguggagagcgccu

SEQ ID NO: 40715 - RNA, 64 nt, hsa
uuacacacacacaacacauacacacacacacacacacacacauaucacaguuuucacacagccc

SEQ ID NO: 40716 - RNA, 64 nt, hsa
uuuuacacacacacaacacauacacacacacacacacacacacauaucacaguuuucacacagc

SEQ ID NO: 40717 - RNA, 64 nt, hsa
ccuuuuacacacacacaacacauacacacacacacacacacacacauaucacaguuuucacaca

SEQ ID NO: 40718 - RNA, 64 nt, hsa
ggccuuuuacacacacacaacacauacacacacacacacacacacacauaucacaguuuucaca

SEQ ID NO: 40719 - RNA, 64 nt, hsa
aaggccuuuuacacacacacaacacauacacacacacacacacacacacauaucacaguuuuca

SEQ ID NO: 40720 - RNA, 64 nt, hsa
agaaggccuuuuacacacacacaacacauacacacacacacacacacacacauaucacaguuuu

SEQ ID NO: 40721 - RNA, 64 nt, hsa
ggagaaggccuuuuacacacacacaacacauacacacacacacacacacacacauaucacaguu

SEQ ID NO: 40722 - RNA, 64 nt, hsa
cuggagaaggccuuuuacacacacacaacacauacacacacacacacacacacacauaucacag

SEQ ID NO: 40723 - RNA, 64 nt, hsa
ggggcccuuccuggccuggagaaggccuuuuacacacacacaacacauacacacacacacacac

SEQ ID NO: 40724 - RNA, 64 nt, hsa
aaggggcccuuccuggccuggagaaggccuuuuacacacacacaacacauacacacacacacac

SEQ ID NO: 40725 - RNA, 64 nt, hsa
ccccgguauaccaagggagccaguuguguucagacacacacaucacagcuugacucacuaacug

SEQ ID NO: 40726 - RNA, 64 nt, hsa
cugucugcuucucucucucucacacacacacacacacacacagucccauuugcauaucacccuu

SEQ ID NO: 40727 - RNA, 64 nt, hsa
uacugucugcuucucucucucucacacacacacacacacacacagucccauuugcauaucaccc

SEQ ID NO: 40728 - RNA, 64 nt, hsa
gguacugucugcuucucucucucucacacacacacacacacacacagucccauuugcauaucac

SEQ ID NO: 40729 - RNA, 64 nt, hsa
cagguacugucugcuucucucucucucacacacacacacacacacacagucccauuugcauauc

SEQ ID NO: 40730 - RNA, 64 nt, hsa
ggcagguacugucugcuucucucucucucacacacacacacacacacacagucccauuugcaua

SEQ ID NO: 40731 - RNA, 64 nt, hsa
caggcagguacugucugcuucucucucucucacacacacacacacacacacagucccauuugca

SEQ ID NO: 40732 - RNA, 64 nt, hsa
cacaggcagguacugucugcuucucucucucucacacacacacacacacacacagucccauuug

SEQ ID NO: 40733 - RNA, 64 nt, hsa
aacacaggcagguacugucugcuucucucucucucacacacacacacacacacacagucccauu

SEQ ID NO: 40734 - RNA, 64 nt, hsa
uaaaaaccacccaaacacuagaugugugugugcacacacacagaaaccacgagguaguuuaaau

SEQ ID NO: 40735 - RNA, 64 nt, hsa
ccuaaaaaccacccaaacacuagaugugugugugcacacacacagaaaccacgagguaguuuaa

SEQ ID NO: 40736 - RNA, 64 nt, hsa
ggaaagagacaauuaauuguacauaauguauacacacacacaaaaaaaaauaccuguagaaaua

SEQ ID NO: 40737 - RNA, 64 nt, hsa
agggaaagagacaauuaauuguacauaauguauacacacacacaaaaaaaaauaccuguagaaa

SEQ ID NO: 40738 - RNA, 64 nt, hsa
aagaggcaaggagcuucugaagaaacugccucugcacacacaucacuggcugugaccccucagg

SEQ ID NO: 40739 - RNA, 64 nt, hsa
aauuuucauggcggaaugucucccccagcugccacacacacauuuuguauuaauuuuaaugauu

SEQ ID NO: 40740 - RNA, 64 nt, hsa
ucaauuuucauggcggaaugucucccccagcugccacacacacauuuuguauuaauuuuaauga

SEQ ID NO: 40741 - RNA, 64 nt, hsa
ccccgccacagagacacaccauuacauacacagacacacacagaaagacacacacagacacaaa

SEQ ID NO: 40742 - RNA, 64 nt, hsa
gaaacacaccauuacacacacauacacagaaagacacacacagacacacaaucacacgcagccc

SEQ ID NO: 40743 - RNA, 64 nt, hsa
gauacgcccuuccggccacagaaacacaccauuacacacacauacacagaaagacacacacaga

SEQ ID NO: 40744 - RNA, 64 nt, hsa
cagacacacacagaaagacacagacacaaaaucacacacacacccuccccgccacagagacaca

SEQ ID NO: 40745 - RNA, 64 nt, hsa
cacagacacacacagaaagacacagacacaaaaucacacacacacccuccccgccacagagaca

SEQ ID NO: 40746 - RNA, 64 nt, hsa
cuccccgccacagagacaccauuacauacacagacacacacagaaagacacagacacaaaauca

SEQ ID NO: 40747 - RNA, 64 nt, hsa
cacacacagaaagacacacacagacacaaaaucacacacacacccuccccgccacagagacacc

SEQ ID NO: 40748 - RNA, 64 nt, hsa
gacacacacagaaagacacacacagacacaaaaucacacacacacccuccccgccacagagaca

SEQ ID NO: 40749 - RNA, 64 nt, hsa
gacaccauuacauacacagacacacacagaaagacacacacagacacaaaaucacacacacacc

SEQ ID NO: 40750 - RNA, 64 nt, hsa
cuccccaccacagagacaccauuacauacacagacacacacagaaagacacacacagacacaaa

SEQ ID NO: 40751 - RNA, 64 nt, hsa
uaacugaagccuaggccccguccccaccucaaaucacacacacccccuccccaccacagagaca

SEQ ID NO: 40752 - RNA, 64 nt, hsa
aauuuugccuauaccuuuaagacaaacaaacaaacacacacacaaacaagcucuaagcugcugu

SEQ ID NO: 40753 - RNA, 64 nt, hsa
uuuugccuauaccuuuaagacaaacaaacaaacacacacacaaacaagcucuaagcugcuguag

SEQ ID NO: 40754 - RNA, 64 nt, hsa
uaaaguaaaaacuaaaaaaauacaaaauacaaaacacacacacacacacacacacacacacaca

SEQ ID NO: 40755 - RNA, 64 nt, hsa
aaguaaaaacuaaaaaaauacaaaauacaaaacacacacacacacacacacacacacacacaca

SEQ ID NO: 40756 - RNA, 64 nt, hsa
guaaaaacuaaaaaaauacaaaauacaaaacacacacacacacacacacacacacacacacaca

SEQ ID NO: 40757 - RNA, 64 nt, hsa
aaaaacuaaaaaaauacaaaauacaaaacacacacacacacacacacacacacacacacacaca

SEQ ID NO: 40758 - RNA, 64 nt, hsa
aaacuaaaaaaauacaaaauacaaaacacacacacacacacacacacacacacacacacacaca

SEQ ID NO: 40759 - RNA, 64 nt, hsa
acuaaaaaaauacaaaauacaaaacacacacacacacacacacacacacacacacacacacaca

SEQ ID NO: 40760 - RNA, 64 nt, hsa
uaaaaaaauacaaaauacaaaacacacacacacacacacacacacacacacacacacacacaaa

SEQ ID NO: 40761 - RNA, 64 nt, hsa
aaaaaauacaaaauacaaaacacacacacacacacacacacacacacacacacacacacaaaau

SEQ ID NO: 40762 - RNA, 64 nt, hsa
aaaauacaaaauacaaaacacacacacacacacacacacacacacacacacacacacaaaauaa

SEQ ID NO: 40763 - RNA, 64 nt, hsa
aauacaaaauacaaaacacacacacacacacacacacacacacacacacacacacaaaauaaau

SEQ ID NO: 40764 - RNA, 64 nt, hsa
uacaaaauacaaaacacacacacacacacacacacacacacacacacacacacaaaauaaaucc

SEQ ID NO: 40765 - RNA, 64 nt, hsa
caaaauacaaaacacacacacacacacacacacacacacacacacacacacaaaauaaauccgg

SEQ ID NO: 40766 - RNA, 64 nt, hsa
aaauacaaaacacacacacacacacacacacacacacacacacacacacaaaauaaauccgggu

SEQ ID NO: 40767 - RNA, 64 nt, hsa
auacaaaacacacacacacacacacacacacacacacacacacacacaaaauaaauccgggugu

SEQ ID NO: 40768 - RNA, 64 nt, hsa
acaaaacacacacacacacacacacacacacacacacacacacacaaaauaaauccgggugugc

SEQ ID NO: 40769 - RNA, 64 nt, hsa
aaaacacacacacacacacacacacacacacacacacacacacaaaauaaauccgggugugccu

SEQ ID NO: 40770 - RNA, 64 nt, hsa
aacacacacacacacacacacacacacacacacacacacacaaaauaaauccgggugugccuga

SEQ ID NO: 40771 - RNA, 64 nt, hsa
ccgccaaacaaggcaaaaaaauuuaaacaugaagcacacacacaaaaaaggcaguaggaaaaau

SEQ ID NO: 40772 - RNA, 64 nt, hsa
gccaaacaaggcaaaaaaauuuaaacaugaagcacacacacaaaaaaggcaguaggaaaaaugc

SEQ ID NO: 40773 - RNA, 64 nt, hsa
auuccugccucucaccaugcacgcauccauuguccacacacacacaaccagauaaucuucugaa

SEQ ID NO: 40774 - RNA, 64 nt, hsa
uccugccucucaccaugcacgcauccauuguccacacacacacaaccagauaaucuucugaaag

SEQ ID NO: 40775 - RNA, 64 nt, hsa
cugccucucaccaugcacgcauccauuguccacacacacacaaccagauaaucuucugaaagug

SEQ ID NO: 40776 - RNA, 64 nt, hsa
aggcaggcccgggccuguuggcaagcuucgaucucacacacacagaaacauacauucgugccug

SEQ ID NO: 40777 - RNA, 64 nt, hsa
gcaggcccgggccuguuggcaagcuucgaucucacacacacagaaacauacauucgugccugga

SEQ ID NO: 40778 - RNA, 64 nt, hsa
cugaugaauaugggccccuuauagagcugcaaaacacacacaugcguauagacauacauacaug

SEQ ID NO: 40779 - RNA, 64 nt, hsa
ccauacauagacaagcaucauaaaggcacaagugcacacacaucuaugcagacaagcuuccucg

SEQ ID NO: 40780 - RNA, 64 nt, hsa
ugugucuauaauuaaaaaaaaauauauauauauacacacacacauauacauacaaagucaaacu

SEQ ID NO: 40781 - RNA, 64 nt, hsa
ugucuauaauuaaaaaaaaauauauauauauacacacacacauauacauacaaagucaaacuga

SEQ ID NO: 40782 - RNA, 64 nt, hsa
cugggaaaccccuucucugugacccacuucucaucacacacauggaaacccauaggcccacaca

SEQ ID NO: 40783 - RNA, 64 nt, hsa
cacuucucaucacacacauggaaacccauaggcccacacacagguggugucacugucccuccug

SEQ ID NO: 40784 - RNA, 64 nt, hsa
cacaaggucauggccacacugugacacacuacaccacacacaacagccaacagcuacaacagcc

SEQ ID NO: 40785 - RNA, 64 nt, hsa
cagcagaaucaccaacacucuccgcuucccccagcacacacacauacaacacagaucauuuccc

SEQ ID NO: 40786 - RNA, 64 nt, hsa
gcagaaucaccaacacucuccgcuucccccagcacacacacauacaacacagaucauuucccag

SEQ ID NO: 40787 - RNA, 64 nt, hsa
uguucuuaauuuuuaacugcuggaaguguuaaaacacacacacacacacacacacauuuuuuuu

SEQ ID NO: 40788 - RNA, 64 nt, hsa
uucuuaauuuuuaacugcuggaaguguuaaaacacacacacacacacacacacauuuuuuuuuu

SEQ ID NO: 40789 - RNA, 64 nt, hsa
cuuaauuuuuaacugcuggaaguguuaaaacacacacacacacacacacacauuuuuuuuuuga

SEQ ID NO: 40790 - RNA, 64 nt, hsa
uaauuuuuaacugcuggaaguguuaaaacacacacacacacacacacacauuuuuuuuuugaga

SEQ ID NO: 40791 - RNA, 64 nt, hsa
auuuuuaacugcuggaaguguuaaaacacacacacacacacacacacauuuuuuuuuugagaac

SEQ ID NO: 40792 - RNA, 64 nt, hsa
uuuuaacugcuggaaguguuaaaacacacacacacacacacacacauuuuuuuuuugagaacuc

SEQ ID NO: 40793 - RNA, 64 nt, hsa
uuaacugcuggaaguguuaaaacacacacacacacacacacacauuuuuuuuuugagaacucca

SEQ ID NO: 40794 - RNA, 64 nt, hsa
aacugcuggaaguguuaaaacacacacacacacacacacacauuuuuuuuuugagaacuccaaa

SEQ ID NO: 40795 - RNA, 64 nt, hsa
cagccuggagaccaccgagagucgagcuggggcacacacacaccuggccgggacccggcaggga

SEQ ID NO: 40796 - RNA, 64 nt, hsa
ugcagccuggagaccaccgagagucgagcuggggcacacacacaccuggccgggacccggcagg

SEQ ID NO: 40797 - RNA, 64 nt, hsa
uuagguuacagcuggagguguguauauauacacacacacacauguauauacacauauauaugug

SEQ ID NO: 40798 - RNA, 64 nt, hsa
gguuagguuacagcuggagguguguauauauacacacacacacauguauauacacauauauaug

SEQ ID NO: 40799 - RNA, 64 nt, hsa
cugguuagguuacagcuggagguguguauauauacacacacacacauguauauacacauauaua

SEQ ID NO: 40800 - RNA, 64 nt, hsa
ucucuguaaauuaaaauguuacagcacacacauacacacacagagagcauuucaaggccacagc

SEQ ID NO: 40801 - RNA, 64 nt, hsa
agucauugcuucucuguaaauuaaaauguuacagcacacacauacacacacagagagcauuuca

SEQ ID NO: 40802 - RNA, 64 nt, hsa
gaaaacaacaacacaaaccacacacacucgcacacacacacauacacagagacucuuucauuuu

SEQ ID NO: 40803 - RNA, 64 nt, hsa
aagaaaacaacaacacaaaccacacacacucgcacacacacacauacacagagacucuuucauu

SEQ ID NO: 40804 - RNA, 64 nt, hsa
acaagaaaacaacaacacaaaccacacacacucgcacacacacacauacacagagacucuuuca

SEQ ID NO: 40805 - RNA, 64 nt, hsa
gagcuuuuuaauacaagaaaacaacaacacaaaccacacacacucgcacacacacacauacaca

SEQ ID NO: 40806 - RNA, 64 nt, hsa
aaguugaugauuuacacacacacacacacacacacacacacaccccuucuugaauggcuccaag

SEQ ID NO: 40807 - RNA, 64 nt, hsa
acaaguugaugauuuacacacacacacacacacacacacacacaccccuucuugaauggcucca

SEQ ID NO: 40808 - RNA, 64 nt, hsa
auacaaguugaugauuuacacacacacacacacacacacacacacaccccuucuugaauggcuc

SEQ ID NO: 40809 - RNA, 64 nt, hsa
cuauacaaguugaugauuuacacacacacacacacacacacacacacaccccuucuugaauggc

SEQ ID NO: 40810 - RNA, 64 nt, hsa
aacuauacaaguugaugauuuacacacacacacacacacacacacacacaccccuucuugaaug

SEQ ID NO: 40811 - RNA, 64 nt, hsa
uuaacuauacaaguugaugauuuacacacacacacacacacacacacacacaccccuucuugaa

SEQ ID NO: 40812 - RNA, 64 nt, hsa
gcuuaacuauacaaguugaugauuuacacacacacacacacacacacacacacaccccuucuug

SEQ ID NO: 40813 - RNA, 64 nt, hsa
aagcuuaacuauacaaguugaugauuuacacacacacacacacacacacacacacaccccuucu

SEQ ID NO: 40814 - RNA, 64 nt, hsa
caaagcuuaacuauacaaguugaugauuuacacacacacacacacacacacacacacaccccuu

SEQ ID NO: 40815 - RNA, 64 nt, hsa
cacaaagcuuaacuauacaaguugaugauuuacacacacacacacacacacacacacacacccc

SEQ ID NO: 40816 - RNA, 64 nt, hsa
uacacaaagcuuaacuauacaaguugaugauuuacacacacacacacacacacacacacacacc

SEQ ID NO: 40817 - RNA, 64 nt, hsa
uuguguuuuagucccuugcuccugcuucuuucuacacacacaucuaaagacggugcggcucgcu

SEQ ID NO: 40818 - RNA, 64 nt, hsa
agggguaggaggagggcccucagcuggcccuccccacacacaggacggcaggggcacugugagg

SEQ ID NO: 40819 - RNA, 64 nt, hsa
caugguuauuuauauauauagauaucuguauauacacacacacauaugugcacacacacacucu

SEQ ID NO: 40820 - RNA, 64 nt, hsa
ugguuauuuauauauauagauaucuguauauacacacacacauaugugcacacacacacucucu

SEQ ID NO: 40821 - RNA, 64 nt, hsa
uauagauaucuguauauacacacacacauaugugcacacacacacucucucuccauuaucgaac

SEQ ID NO: 40822 - RNA, 64 nt, hsa
uagauaucuguauauacacacacacauaugugcacacacacacucucucuccauuaucgaacga

SEQ ID NO: 40823 - RNA, 64 nt, hsa
accaaaugagcuaaguugcaaauauauauauauacacacacacacauauauguacauguguaug

SEQ ID NO: 40824 - RNA, 64 nt, hsa
caaaugagcuaaguugcaaauauauauauauacacacacacacauauauguacauguguaugua

SEQ ID NO: 40825 - RNA, 64 nt, hsa
aaugagcuaaguugcaaauauauauauauacacacacacacauauauguacauguguauguaca

SEQ ID NO: 40826 - RNA, 64 nt, hsa
aaauaugcuuucuuguugcauauaugcacagauacacacacacacacacacgaaaauaaauaaa

SEQ ID NO: 40827 - RNA, 64 nt, hsa
auaugcuuucuuguugcauauaugcacagauacacacacacacacacacgaaaauaaauaaaug

SEQ ID NO: 40828 - RNA, 64 nt, hsa
augcuuucuuguugcauauaugcacagauacacacacacacacacacgaaaauaaauaaauguu

SEQ ID NO: 40829 - RNA, 64 nt, hsa
gcuuucuuguugcauauaugcacagauacacacacacacacacacgaaaauaaauaaauguuca

SEQ ID NO: 40830 - RNA, 64 nt, hsa
uuucuuguugcauauaugcacagauacacacacacacacacacgaaaauaaauaaauguucaua

SEQ ID NO: 40831 - RNA, 64 nt, hsa
cuccagagcugcccaccucccacugcccccucagcacacacacaguccccaggcggccuagggg

SEQ ID NO: 40832 - RNA, 64 nt, hsa
ccagagcugcccaccucccacugcccccucagcacacacacaguccccaggcggccuaggggcc

SEQ ID NO: 40833 - RNA, 64 nt, hsa
auagacuccuauuuuucuuguuuuauauuaugaccacacacaucucugcuggaaagucaacaug

SEQ ID NO: 40834 - RNA, 64 nt, hsa
uuguaccauccacccauacccacacagucacagucacacacacauauguauuacuuacacuaua

SEQ ID NO: 40835 - RNA, 64 nt, hsa
guaccauccacccauacccacacagucacagucacacacacauauguauuacuuacacuauaua

SEQ ID NO: 40836 - RNA, 64 nt, hsa
cacauaugugggcauccagccucuggggccuuggcacacacacauucgugugcucugcugcaug

SEQ ID NO: 40837 - RNA, 64 nt, hsa
cauaugugggcauccagccucuggggccuuggcacacacacauucgugugcucugcugcaugug

SEQ ID NO: 40838 - RNA, 64 nt, hsa
aaugcaaucuccccuugauuuaaacacacagauacacacacacacacacacacacacaaaccuu

SEQ ID NO: 40839 - RNA, 64 nt, hsa
ugcaaucuccccuugauuuaaacacacagauacacacacacacacacacacacacaaaccuucu

SEQ ID NO: 40840 - RNA, 64 nt, hsa
caaucuccccuugauuuaaacacacagauacacacacacacacacacacacacaaaccuucugc

SEQ ID NO: 40841 - RNA, 64 nt, hsa
aucuccccuugauuuaaacacacagauacacacacacacacacacacacacaaaccuucugccu

SEQ ID NO: 40842 - RNA, 64 nt, hsa
cuccccuugauuuaaacacacagauacacacacacacacacacacacacaaaccuucugccuuu

SEQ ID NO: 40843 - RNA, 64 nt, hsa
ccccuugauuuaaacacacagauacacacacacacacacacacacacaaaccuucugccuuuga

SEQ ID NO: 40844 - RNA, 64 nt, hsa
ccuugauuuaaacacacagauacacacacacacacacacacacacaaaccuucugccuuugaug

SEQ ID NO: 40845 - RNA, 64 nt, hsa
uugauuuaaacacacagauacacacacacacacacacacacacaaaccuucugccuuugauguu

SEQ ID NO: 40846 - RNA, 64 nt, hsa
gauuuaaacacacagauacacacacacacacacacacacacaaaccuucugccuuugauguuac

SEQ ID NO: 40847 - RNA, 64 nt, hsa
agcagcuucaccagagcauuuccaacaccacagacacacacacgcacgcacacacacaaacaca

SEQ ID NO: 40848 - RNA, 64 nt, hsa
agcauuuccaacaccacagacacacacacgcacgcacacacacaaacacacaugcacacacaca

SEQ ID NO: 40849 - RNA, 64 nt, hsa
cauuuccaacaccacagacacacacacgcacgcacacacacaaacacacaugcacacacacaca

SEQ ID NO: 40850 - RNA, 64 nt, hsa
cacacacacgcacgcacacacacaaacacacaugcacacacacacaucucauuucucuaguguc

SEQ ID NO: 40851 - RNA, 64 nt, hsa
cacacacgcacgcacacacacaaacacacaugcacacacacacaucucauuucucuagugucuu

SEQ ID NO: 40852 - RNA, 64 nt, hsa
cacacgcacgcacacacacaaacacacaugcacacacacacaucucauuucucuagugucuuuu

SEQ ID NO: 40853 - RNA, 64 nt, hsa
cucagccucuucacaaugacuuucuaaaaaaaaucacacacacacacacacacacuacagaaga

SEQ ID NO: 40854 - RNA, 64 nt, hsa
cagccucuucacaaugacuuucuaaaaaaaaucacacacacacacacacacacuacagaagagg

SEQ ID NO: 40855 - RNA, 64 nt, hsa
gccucuucacaaugacuuucuaaaaaaaaucacacacacacacacacacacuacagaagaggau

SEQ ID NO: 40856 - RNA, 64 nt, hsa
cucuucacaaugacuuucuaaaaaaaaucacacacacacacacacacacuacagaagaggauug

SEQ ID NO: 40857 - RNA, 64 nt, hsa
cuucacaaugacuuucuaaaaaaaaucacacacacacacacacacacuacagaagaggauugca

SEQ ID NO: 40858 - RNA, 64 nt, hsa
ucacaaugacuuucuaaaaaaaaucacacacacacacacacacacuacagaagaggauugcaaa

SEQ ID NO: 40859 - RNA, 64 nt, hsa
acaaugacuuucuaaaaaaaaucacacacacacacacacacacuacagaagaggauugcaaaca

SEQ ID NO: 40860 - RNA, 64 nt, hsa
cauauauauauauacacacacacacacacacacacacacacauauauuuguauaaagcuaaguu

SEQ ID NO: 40861 - RNA, 64 nt, hsa
uacauauauauauauacacacacacacacacacacacacacacauauauuuguauaaagcuaag

SEQ ID NO: 40862 - RNA, 64 nt, hsa
cauacauauauauauauacacacacacacacacacacacacacacauauauuuguauaaagcua

SEQ ID NO: 40863 - RNA, 64 nt, hsa
uucauacauauauauauauacacacacacacacacacacacacacacauauauuuguauaaagc

SEQ ID NO: 40864 - RNA, 64 nt, hsa
uuuucauacauauauauauauacacacacacacacacacacacacacacauauauuuguauaaa

SEQ ID NO: 40865 - RNA, 64 nt, hsa
uguuuucauacauauauauauauacacacacacacacacacacacacacacauauauuuguaua

SEQ ID NO: 40866 - RNA, 64 nt, hsa
guuguuuucauacauauauauauauacacacacacacacacacacacacacacauauauuugua

SEQ ID NO: 40867 - RNA, 64 nt, hsa
uaguuguuuucauacauauauauauauacacacacacacacacacacacacacacauauauuug

SEQ ID NO: 40868 - RNA, 64 nt, hsa
gauaguuguuuucauacauauauauauauacacacacacacacacacacacacacacauauauu

SEQ ID NO: 40869 - RNA, 64 nt, hsa
cagauaguuguuuucauacauauauauauauacacacacacacacacacacacacacacauaua

SEQ ID NO: 40870 - RNA, 64 nt, hsa
aucagauaguuguuuucauacauauauauauauacacacacacacacacacacacacacacaua

SEQ ID NO: 40871 - RNA, 64 nt, hsa
uguccucuuucagaaaacagaaaaaaaacacacacacacacaacaaaaauuugaaccaaaacau

SEQ ID NO: 40872 - RNA, 64 nt, hsa
acuguccucuuucagaaaacagaaaaaaaacacacacacacacaacaaaaauuugaaccaaaac

SEQ ID NO: 40873 - RNA, 64 nt, hsa
aaacuguccucuuucagaaaacagaaaaaaaacacacacacacacaacaaaaauuugaaccaaa

SEQ ID NO: 40874 - RNA, 64 nt, hsa
auaaacuguccucuuucagaaaacagaaaaaaaacacacacacacacaacaaaaauuugaacca

SEQ ID NO: 40875 - RNA, 64 nt, hsa
gcaccucccuuucagccauucuucaagaaugggccacacacagcuagaaguccucucccagcua

SEQ ID NO: 40876 - RNA, 64 nt, hsa
acacagacacacauacacccaugaugugagcaaacacacacacgugcgccuucauagcccagcc

SEQ ID NO: 40877 - RNA, 64 nt, hsa
acacacaacacacacacauacacaccccugaacacacacacagacacacauacacccaugaugu

SEQ ID NO: 40878 - RNA, 64 nt, hsa
agacacacaacacacacacauacacaccccugaacacacacacagacacacauacacccaugau

SEQ ID NO: 40879 - RNA, 64 nt, hsa
ugcacacccugaaaacacacacagacacacaacacacacacauacacaccccugaacacacaca

SEQ ID NO: 40880 - RNA, 64 nt, hsa
caugcacacccugaaaacacacacagacacacaacacacacacauacacaccccugaacacaca

SEQ ID NO: 40881 - RNA, 64 nt, hsa
caaucuggcccucuccacaugcacacccugaaaacacacacagacacacaacacacacacauac

SEQ ID NO: 40882 - RNA, 64 nt, hsa
gccuaucccagcaaaacacacacacacacacacacacacacaaaauaaagacacacaaggacgu

SEQ ID NO: 40883 - RNA, 64 nt, hsa
uugccuaucccagcaaaacacacacacacacacacacacacacaaaauaaagacacacaaggac

SEQ ID NO: 40884 - RNA, 64 nt, hsa
cuuugccuaucccagcaaaacacacacacacacacacacacacacaaaauaaagacacacaagg

SEQ ID NO: 40885 - RNA, 64 nt, hsa
gacuuugccuaucccagcaaaacacacacacacacacacacacacacaaaauaaagacacacaa

SEQ ID NO: 40886 - RNA, 64 nt, hsa
aagacuuugccuaucccagcaaaacacacacacacacacacacacacacaaaauaaagacacac

SEQ ID NO: 40887 - RNA, 64 nt, hsa
aaaagacuuugccuaucccagcaaaacacacacacacacacacacacacacaaaauaaagacac

SEQ ID NO: 40888 - RNA, 64 nt, hsa
ccaaaagacuuugccuaucccagcaaaacacacacacacacacacacacacacaaaauaaagac

SEQ ID NO: 40889 - RNA, 64 nt, hsa
ucccaaaagacuuugccuaucccagcaaaacacacacacacacacacacacacacaaaauaaag

SEQ ID NO: 40890 - RNA, 64 nt, hsa
ugucccaaaagacuuugccuaucccagcaaaacacacacacacacacacacacacacaaaauaa

SEQ ID NO: 40891 - RNA, 64 nt, hsa
cgugucccaaaagacuuugccuaucccagcaaaacacacacacacacacacacacacacaaaau

SEQ ID NO: 40892 - RNA, 64 nt, hsa
aaaauggagucggggggccacauagaagcccucacacacacaugcccguaacaggauuuaucac

SEQ ID NO: 40893 - RNA, 64 nt, hsa
auaaaauggagucggggggccacauagaagcccucacacacacaugcccguaacaggauuuauc

SEQ ID NO: 40894 - RNA, 64 nt, hsa
cugcgcgugcggagcggagccccccguguucacacacacacaauggcaagcauagucgccuggu

SEQ ID NO: 40895 - RNA, 64 nt, hsa
gccugcgcgugcggagcggagccccccguguucacacacacacaauggcaagcauagucgccug

SEQ ID NO: 40896 - RNA, 64 nt, hsa
cggccugcgcgugcggagcggagccccccguguucacacacacacaauggcaagcauagucgcc

SEQ ID NO: 40897 - RNA, 64 nt, hsa
uagaaaaauucagaaaagcacacacucacauacacacacacaaaaucacucucuuaucccaucc

SEQ ID NO: 40898 - RNA, 64 nt, hsa
cuuagaaaaauucagaaaagcacacacucacauacacacacacaaaaucacucucuuaucccau

SEQ ID NO: 40899 - RNA, 64 nt, hsa
cacacacacacacacacacacacacacacacacacacacacaaacauauaaccuaugccaauaa

SEQ ID NO: 40900 - RNA, 64 nt, hsa
gacacacacacacacacacacacacacacacacacacacacacaaacauauaaccuaugccaau

SEQ ID NO: 40901 - RNA, 64 nt, hsa
cagacacacacacacacacacacacacacacacacacacacacacaaacauauaaccuaugcca

SEQ ID NO: 40902 - RNA, 64 nt, hsa
agcagacacacacacacacacacacacacacacacacacacacacacaaacauauaaccuaugc

SEQ ID NO: 40903 - RNA, 64 nt, hsa
gaagcagacacacacacacacacacacacacacacacacacacacacacaaacauauaaccuau

SEQ ID NO: 40904 - RNA, 64 nt, hsa
augaagcagacacacacacacacacacacacacacacacacacacacacacaaacauauaaccu

SEQ ID NO: 40905 - RNA, 64 nt, hsa
aaaugaagcagacacacacacacacacacacacacacacacacacacacacacaaacauauaac

SEQ ID NO: 40906 - RNA, 64 nt, hsa
aaaaaugaagcagacacacacacacacacacacacacacacacacacacacacacaaacauaua

SEQ ID NO: 40907 - RNA, 64 nt, hsa
agaaaaaugaagcagacacacacacacacacacacacacacacacacacacacacacaaacaua

SEQ ID NO: 40908 - RNA, 64 nt, hsa
uuagaaaaaugaagcagacacacacacacacacacacacacacacacacacacacacacaaaca

SEQ ID NO: 40909 - RNA, 64 nt, hsa
gauuagaaaaaugaagcagacacacacacacacacacacacacacacacacacacacacacaaa

SEQ ID NO: 40910 - RNA, 64 nt, hsa
uugauuagaaaaaugaagcagacacacacacacacacacacacacacacacacacacacacaca

SEQ ID NO: 40911 - RNA, 64 nt, hsa
guuugauuagaaaaaugaagcagacacacacacacacacacacacacacacacacacacacaca

SEQ ID NO: 40912 - RNA, 64 nt, hsa
uuguuugauuagaaaaaugaagcagacacacacacacacacacacacacacacacacacacaca

SEQ ID NO: 40913 - RNA, 64 nt, hsa
guuuguuugauuagaaaaaugaagcagacacacacacacacacacacacacacacacacacaca

SEQ ID NO: 40914 - RNA, 64 nt, hsa
uuguuuguuugauuagaaaaaugaagcagacacacacacacacacacacacacacacacacaca

SEQ ID NO: 40915 - RNA, 64 nt, hsa
aguuguuuguuugauuagaaaaaugaagcagacacacacacacacacacacacacacacacaca

SEQ ID NO: 40916 - RNA, 64 nt, hsa
ucaguuguuuguuugauuagaaaaaugaagcagacacacacacacacacacacacacacacaca

SEQ ID NO: 40917 - RNA, 64 nt, hsa
aaggcacaugagugugaccucugccauggggaaacacacacagagauaucuauacauauauaca

SEQ ID NO: 40918 - RNA, 64 nt, hsa
ucuccucaucaucauucccaacaacauccucugccacacacaacaaaacguaaguuucauuugg

SEQ ID NO: 40919 - RNA, 64 nt, hsa
ugccccuuuuggaaugaucucugaauauauaaaacacacacacaaagagcaauaguuugccccu

SEQ ID NO: 40920 - RNA, 64 nt, hsa
ccccuuuuggaaugaucucugaauauauaaaacacacacacaaagagcaauaguuugccccuuu

SEQ ID NO: 40921 - RNA, 64 nt, hsa
ugccccuuuuggaacgaccccugaauauauaaaacacacacacaccccgcgcacucucacuccu

SEQ ID NO: 40922 - RNA, 64 nt, hsa
ccccuuuuggaacgaccccugaauauauaaaacacacacacaccccgcgcacucucacuccuuu

SEQ ID NO: 40923 - RNA, 64 nt, hsa
gcuauaugacuacggauccauuagugaggagcgacacacacaccuguaggcauccugugcaaac

SEQ ID NO: 40924 - RNA, 64 nt, hsa
aauuuuaucuuuugguagaaauguguuuauuuaacacacacacacaccuaauacuacauucaaa

SEQ ID NO: 40925 - RNA, 64 nt, hsa
uuuuaucuuuugguagaaauguguuuauuuaacacacacacacaccuaauacuacauucaaagu

SEQ ID NO: 40926 - RNA, 64 nt, hsa
uuaucuuuugguagaaauguguuuauuuaacacacacacacaccuaauacuacauucaaaguau

SEQ ID NO: 40927 - RNA, 64 nt, hsa
uauauauauauauauauauauauauauauauauacacacacacacacauacacaaauauuccag

SEQ ID NO: 40928 - RNA, 64 nt, hsa
uauauauauauauauauauauauauauauauacacacacacacacauacacaaauauuccagga

SEQ ID NO: 40929 - RNA, 64 nt, hsa
uauauauauauauauauauauauauauauacacacacacacacauacacaaauauuccaggaua

SEQ ID NO: 40930 - RNA, 64 nt, hsa
uauauauauauauauauauauauauauacacacacacacacauacacaaauauuccaggauaca

SEQ ID NO: 40931 - RNA, 64 nt, hsa
cuuacauuaguuaagcuaagcagcaaaaagaaaacacacacacacacucacauuuagcccaugu

SEQ ID NO: 40932 - RNA, 64 nt, hsa
uacauuaguuaagcuaagcagcaaaaagaaaacacacacacacacucacauuuagcccauguca

SEQ ID NO: 40933 - RNA, 64 nt, hsa
cauuaguuaagcuaagcagcaaaaagaaaacacacacacacacucacauuuagcccaugucauu

SEQ ID NO: 40934 - RNA, 64 nt, hsa
gaaauggcccguggugggcugaccccccacccuccacacacacaguuccaugacccagcgggcc

SEQ ID NO: 40935 - RNA, 64 nt, hsa
aauggcccguggugggcugaccccccacccuccacacacacaguuccaugacccagcgggcccc

SEQ ID NO: 40936 - RNA, 64 nt, hsa
ucugcgugcagauuuuguacaaaaaaaaaaaagacacacacacauacaugauaaugauucccag

SEQ ID NO: 40937 - RNA, 64 nt, hsa
ugcgugcagauuuuguacaaaaaaaaaaaagacacacacacauacaugauaaugauucccagcc

SEQ ID NO: 40938 - RNA, 64 nt, hsa
cgcacgcacgcacacaaacaugcacacacgcaugcacacacacaaagccuuaagcagaagaaug

SEQ ID NO: 40939 - RNA, 64 nt, hsa
cacgcacgcacacaaacaugcacacacgcaugcacacacacaaagccuuaagcagaagaauguc

SEQ ID NO: 40940 - RNA, 64 nt, hsa
uguguguguguguauacauauauacacauauauacacacacacauacauauacauguguauaua

SEQ ID NO: 40941 - RNA, 64 nt, hsa
uguguguguguauacauauauacacauauauacacacacacauacauauacauguguauauaua

SEQ ID NO: 40942 - RNA, 64 nt, hsa
aaaaaugaucauggcuuuaaaaaaaaaacaaaaacacacacacaugaacucagauuugcaaacc

SEQ ID NO: 40943 - RNA, 64 nt, hsa
aaaugaucauggcuuuaaaaaaaaaacaaaaacacacacacaugaacucagauuugcaaaccag

SEQ ID NO: 40944 - RNA, 64 nt, hsa
uucuucauaucaauuuuguauaaauauauagaaacacacacacagccucagacuuacaaacuga

SEQ ID NO: 40945 - RNA, 64 nt, hsa
cuucauaucaauuuuguauaaauauauagaaacacacacacagccucagacuuacaaacugauu

SEQ ID NO: 40946 - RNA, 64 nt, hsa
gugcauucugaggucuaacccggggugccaggaacacacacauccuccaucccagcauagagaa

SEQ ID NO: 40947 - RNA, 64 nt, hsa
uuugucagguucacguccuauaacgguuaaaaaacacacacacacauacacaaaccguuucuau

SEQ ID NO: 40948 - RNA, 64 nt, hsa
ugucagguucacguccuauaacgguuaaaaaacacacacacacauacacaaaccguuucuauga

SEQ ID NO: 40949 - RNA, 64 nt, hsa
ucagguucacguccuauaacgguuaaaaaacacacacacacauacacaaaccguuucuaugaga

SEQ ID NO: 40950 - RNA, 64 nt, hsa
uuuaggacuguuuuuagacccuccuagccuugaacacacacauguacacacacacacacacaca

SEQ ID NO: 40951 - RNA, 64 nt, hsa
uuuagacccuccuagccuugaacacacacauguacacacacacacacacacacacacacacacc

SEQ ID NO: 40952 - RNA, 64 nt, hsa
uagacccuccuagccuugaacacacacauguacacacacacacacacacacacacacacacccu

SEQ ID NO: 40953 - RNA, 64 nt, hsa
gacccuccuagccuugaacacacacauguacacacacacacacacacacacacacacacccuuu

SEQ ID NO: 40954 - RNA, 64 nt, hsa
cccuccuagccuugaacacacacauguacacacacacacacacacacacacacacacccuuuca

SEQ ID NO: 40955 - RNA, 64 nt, hsa
cuccuagccuugaacacacacauguacacacacacacacacacacacacacacacccuuucauu

SEQ ID NO: 40956 - RNA, 64 nt, hsa
ccuagccuugaacacacacauguacacacacacacacacacacacacacacacccuuucauucc

SEQ ID NO: 40957 - RNA, 64 nt, hsa
uagccuugaacacacacauguacacacacacacacacacacacacacacacccuuucauucccu

SEQ ID NO: 40958 - RNA, 64 nt, hsa
gccuugaacacacacauguacacacacacacacacacacacacacacacccuuucauucccugu

SEQ ID NO: 40959 - RNA, 64 nt, hsa
cuugaacacacacauguacacacacacacacacacacacacacacacccuuucauucccugugu

SEQ ID NO: 40960 - RNA, 64 nt, hsa
ugaacacacacauguacacacacacacacacacacacacacacacccuuucauucccuguguug

SEQ ID NO: 40961 - RNA, 64 nt, hsa
aacacacacauguacacacacacacacacacacacacacacacccuuucauucccuguguugug

SEQ ID NO: 40962 - RNA, 64 nt, hsa
gacagacagacagacagacacacacacacacacacacacacauuuugggacaaguggggagccc

SEQ ID NO: 40963 - RNA, 64 nt, hsa
cggacagacagacagacagacacacacacacacacacacacacauuuugggacaaguggggagc

SEQ ID NO: 40964 - RNA, 64 nt, hsa
uacggacagacagacagacagacacacacacacacacacacacacauuuugggacaagugggga

SEQ ID NO: 40965 - RNA, 64 nt, hsa
cuuacggacagacagacagacagacacacacacacacacacacacacauuuugggacaaguggg

SEQ ID NO: 40966 - RNA, 64 nt, hsa
cacuuacggacagacagacagacagacacacacacacacacacacacacauuuugggacaagug

SEQ ID NO: 40967 - RNA, 64 nt, hsa
accacuuacggacagacagacagacagacacacacacacacacacacacacauuuugggacaag

SEQ ID NO: 40968 - RNA, 64 nt, hsa
cuaccacuuacggacagacagacagacagacacacacacacacacacacacacauuuugggaca

SEQ ID NO: 40969 - RNA, 64 nt, hsa
cucuaccacuuacggacagacagacagacagacacacacacacacacacacacacauuuuggga

SEQ ID NO: 40970 - RNA, 64 nt, hsa
gacucuaccacuuacggacagacagacagacagacacacacacacacacacacacacauuuugg

SEQ ID NO: 40971 - RNA, 64 nt, hsa
cauacacacacacccacacacacaaacacacacacacacacaauuuucacgauguauggucagg

SEQ ID NO: 40972 - RNA, 64 nt, hsa
gacauacacacacacccacacacacaaacacacacacacacacaauuuucacgauguaugguca

SEQ ID NO: 40973 - RNA, 64 nt, hsa
uggacauacacacacacccacacacacaaacacacacacacacacaauuuucacgauguauggu

SEQ ID NO: 40974 - RNA, 64 nt, hsa
cauggacauacacacacacccacacacacaaacacacacacacacacaauuuucacgauguaug

SEQ ID NO: 40975 - RNA, 64 nt, hsa
uacauggacauacacacacacccacacacacaaacacacacacacacacaauuuucacgaugua

SEQ ID NO: 40976 - RNA, 64 nt, hsa
caccagcauauacauggacauacacacacacccacacacacaaacacacacacacacacaauuu

SEQ ID NO: 40977 - RNA, 64 nt, hsa
accaccagcauauacauggacauacacacacacccacacacacaaacacacacacacacacaau

SEQ ID NO: 40978 - RNA, 64 nt, hsa
agggauaaaaaccaccagcauauacauggacauacacacacacccacacacacaaacacacaca

SEQ ID NO: 40979 - RNA, 64 nt, hsa
uacuuuacuucugguaugguuuauuaaccacacacacacacaaaagugaaaaacuguguugggg

SEQ ID NO: 40980 - RNA, 64 nt, hsa
cauacuuuacuucugguaugguuuauuaaccacacacacacacaaaagugaaaaacuguguugg

SEQ ID NO: 40981 - RNA, 64 nt, hsa
accauacuuuacuucugguaugguuuauuaaccacacacacacacaaaagugaaaaacuguguu

SEQ ID NO: 40982 - RNA, 64 nt, hsa
acaccauacuuuacuucugguaugguuuauuaaccacacacacacacaaaagugaaaaacugug

SEQ ID NO: 40983 - RNA, 64 nt, hsa
uagcccugguugcuucugauacacagccacugcacacacacacucacacucacacucccuuguc

SEQ ID NO: 40984 - RNA, 64 nt, hsa
ccuagcccugguugcuucugauacacagccacugcacacacacacucacacucacacucccuug

SEQ ID NO: 40985 - RNA, 64 nt, hsa
caugcacaaauacacacucaugcacacacacacucacacacaugcauacacuuagguuucaugc

SEQ ID NO: 40986 - RNA, 64 nt, hsa
cucccucguacaugcacaaauacacacucaugcacacacacacucacacacaugcauacacuua

SEQ ID NO: 40987 - RNA, 64 nt, hsa
uacucccucguacaugcacaaauacacacucaugcacacacacacucacacacaugcauacacu

SEQ ID NO: 40988 - RNA, 64 nt, hsa
acaugccugcaccugcagcgcgcacacgcacgcacacacacauacagagcucucugagggugau

SEQ ID NO: 40989 - RNA, 64 nt, hsa
caacaugccugcaccugcagcgcgcacacgcacgcacacacacauacagagcucucugagggug

SEQ ID NO: 40990 - RNA, 64 nt, hsa
cagacacacacacacacacacacacacacacacacacacacauucacccuaaggauccaaugga

SEQ ID NO: 40991 - RNA, 64 nt, hsa
cacagacacacacacacacacacacacacacacacacacacacauucacccuaaggauccaaug

SEQ ID NO: 40992 - RNA, 64 nt, hsa
uacacagacacacacacacacacacacacacacacacacacacacauucacccuaaggauccaa

SEQ ID NO: 40993 - RNA, 64 nt, hsa
cauacacagacacacacacacacacacacacacacacacacacacacauucacccuaaggaucc

SEQ ID NO: 40994 - RNA, 64 nt, hsa
uacauacacagacacacacacacacacacacacacacacacacacacacauucacccuaaggau

SEQ ID NO: 40995 - RNA, 64 nt, hsa
ccuacauacacagacacacacacacacacacacacacacacacacacacacauucacccuaagg

SEQ ID NO: 40996 - RNA, 64 nt, hsa
acccuacauacacagacacacacacacacacacacacacacacacacacacacauucacccuaa

SEQ ID NO: 40997 - RNA, 64 nt, hsa
ccacccuacauacacagacacacacacacacacacacacacacacacacacacacauucacccu

SEQ ID NO: 40998 - RNA, 64 nt, hsa
acccacccuacauacacagacacacacacacacacacacacacacacacacacacacauucacc

SEQ ID NO: 40999 - RNA, 64 nt, hsa
acacccacccuacauacacagacacacacacacacacacacacacacacacacacacacauuca

SEQ ID NO: 41000 - RNA, 64 nt, hsa
uaacacccacccuacauacacagacacacacacacacacacacacacacacacacacacacauu

SEQ ID NO: 41001 - RNA, 64 nt, hsa
cuuaacacccacccuacauacacagacacacacacacacacacacacacacacacacacacaca

SEQ ID NO: 41002 - RNA, 64 nt, hsa
cucuuaacacccacccuacauacacagacacacacacacacacacacacacacacacacacaca

SEQ ID NO: 41003 - RNA, 64 nt, hsa
aucucuuaacacccacccuacauacacagacacacacacacacacacacacacacacacacaca

SEQ ID NO: 41004 - RNA, 64 nt, hsa
aaaucucuuaacacccacccuacauacacagacacacacacacacacacacacacacacacaca

SEQ ID NO: 41005 - RNA, 64 nt, hsa
gaaaaucucuuaacacccacccuacauacacagacacacacacacacacacacacacacacaca

SEQ ID NO: 41006 - RNA, 64 nt, hsa
acuauaaauaccagugcuaucacagccacacauacacacacacagacauaaaauaaccaaacau

SEQ ID NO: 41007 - RNA, 63 nt, hsa
uauaaauaccagugcuaucacagccacacauacacacacacagacauaaaauaaccaaacauc

SEQ ID NO: 41008 - RNA, 64 nt, hsa
uggucuaaaaaagggaagauauuguagaagauuucacacacacacgcgugugugggagacaacu

SEQ ID NO: 41009 - RNA, 64 nt, hsa
gucuaaaaaagggaagauauuguagaagauuucacacacacacgcgugugugggagacaacuaa

SEQ ID NO: 41010 - RNA, 64 nt, hsa
aaaaaaaaaaaaaaaaaauauauauauauauauacacacacacacacacauauguacacauaca

SEQ ID NO: 41011 - RNA, 64 nt, hsa
aaaaaaaaaaaaaaaauauauauauauauauacacacacacacacacauauguacacauacaua

SEQ ID NO: 41012 - RNA, 64 nt, hsa
aaaaaaaaaaaaaauauauauauauauauacacacacacacacacauauguacacauacauaua

SEQ ID NO: 41013 - RNA, 64 nt, hsa
aaaaaaaaaaaauauauauauauauauacacacacacacacacauauguacacauacauauaua

SEQ ID NO: 41014 - RNA, 64 nt, hsa
aaaaaaaaaauauauauauauauauacacacacacacacacauauguacacauacauauauaua

SEQ ID NO: 41015 - RNA, 64 nt, hsa
aauauauauguguauauguauacacauauauauacacacacacauauauauauuuagaaacgug

SEQ ID NO: 41016 - RNA, 64 nt, hsa
uauauauguguauauguauacacauauauauacacacacacauauauauauuuagaaacgugag

SEQ ID NO: 41017 - RNA, 64 nt, hsa
ggacugcaaauuauccuucugccugccccugugacacacacacacacacacacacacacacaca

SEQ ID NO: 41018 - RNA, 64 nt, hsa
acugcaaauuauccuucugccugccccugugacacacacacacacacacacacacacacacaaa

SEQ ID NO: 41019 - RNA, 64 nt, hsa
ugcaaauuauccuucugccugccccugugacacacacacacacacacacacacacacacaaaca

SEQ ID NO: 41020 - RNA, 64 nt, hsa
caaauuauccuucugccugccccugugacacacacacacacacacacacacacacacaaacaau

SEQ ID NO: 41021 - RNA, 64 nt, hsa
aauuauccuucugccugccccugugacacacacacacacacacacacacacacacaaacaaucc

SEQ ID NO: 41022 - RNA, 64 nt, hsa
uuauccuucugccugccccugugacacacacacacacacacacacacacacacaaacaauccag

SEQ ID NO: 41023 - RNA, 64 nt, hsa
auccuucugccugccccugugacacacacacacacacacacacacacacacaaacaauccagug

SEQ ID NO: 41024 - RNA, 64 nt, hsa
ccuucugccugccccugugacacacacacacacacacacacacacacacaaacaauccaguguu

SEQ ID NO: 41025 - RNA, 64 nt, hsa
uucugccugccccugugacacacacacacacacacacacacacacacaaacaauccaguguuuu

SEQ ID NO: 41026 - RNA, 64 nt, hsa
cugccugccccugugacacacacacacacacacacacacacacacaaacaauccaguguuuugu

SEQ ID NO: 41027 - RNA, 64 nt, hsa
gccugccccugugacacacacacacacacacacacacacacacaaacaauccaguguuuuguca

SEQ ID NO: 41028 - RNA, 64 nt, hsa
cugccccugugacacacacacacacacacacacacacacacaaacaauccaguguuuugucaug

SEQ ID NO: 41029 - RNA, 64 nt, hsa
ugggaaaacgggcaaaauaauugugcuggauucucacacacacagaaauaucgaccaucacccu

SEQ ID NO: 41030 - RNA, 64 nt, hsa
ggaaaacgggcaaaauaauugugcuggauucucacacacacagaaauaucgaccaucacccucc

SEQ ID NO: 41031 - RNA, 64 nt, hsa
aacguguacacaagugugagcuccuacacgcauacacacacacacguguacaugcaccaaagca

SEQ ID NO: 41032 - RNA, 64 nt, hsa
cguguacacaagugugagcuccuacacgcauacacacacacacguguacaugcaccaaagcaug

SEQ ID NO: 41033 - RNA, 64 nt, hsa
gcagagagacguaugagcuucuacugcacacaugcacacacacacgcacacguacauucacuac

SEQ ID NO: 41034 - RNA, 64 nt, hsa
agagagacguaugagcuucuacugcacacaugcacacacacacgcacacguacauucacuacaa

SEQ ID NO: 41035 - RNA, 64 nt, hsa
ugcgcaggcuccugcaggcgugaauacacacaugcacacacauauacacacaugugccacaaac

SEQ ID NO: 41036 - RNA, 64 nt, hsa
cuggagacaguagaggcaugaacacacauggaugcacacacacacacgccaaugcacacacaca

SEQ ID NO: 41037 - RNA, 64 nt, hsa
ggagacaguagaggcaugaacacacauggaugcacacacacacacgccaaugcacacacacaga

SEQ ID NO: 41038 - RNA, 64 nt, hsa
agacaguagaggcaugaacacacauggaugcacacacacacacgccaaugcacacacacagaga

SEQ ID NO: 41039 - RNA, 64 nt, hsa
aacacacauggaugcacacacacacacgccaaugcacacacacagagauaugcacacacacgga

SEQ ID NO: 41040 - RNA, 64 nt, hsa
cacacauggaugcacacacacacacgccaaugcacacacacagagauaugcacacacacggaug

SEQ ID NO: 41041 - RNA, 64 nt, hsa
cacacacacgccaaugcacacacacagagauaugcacacacacggaugcacacacagaugguca

SEQ ID NO: 41042 - RNA, 64 nt, hsa
ugcacacacacagagauaugcacacacacggaugcacacacagauggucacacagagauacgca

SEQ ID NO: 41043 - RNA, 64 nt, hsa
caaacacaccgaugcacacgcacauagagauaugcacacacagaugcacacacagauauacaca

SEQ ID NO: 41044 - RNA, 64 nt, hsa
ugcacacgcacauagagauaugcacacacagaugcacacacagauauacacauggaugcacgca

SEQ ID NO: 41045 - RNA, 64 nt, hsa
cggaugcacagagauaugcacacaccgaugugcgcacacacagauaugcacacacauggaugag

SEQ ID NO: 41046 - RNA, 64 nt, hsa
uaugcacacaccgaugugcgcacacacagauaugcacacacauggaugagcacacacacaccaa

SEQ ID NO: 41047 - RNA, 64 nt, hsa
ugcgcacacacagauaugcacacacauggaugagcacacacacaccaaugcgcacacacaccga

SEQ ID NO: 41048 - RNA, 64 nt, hsa
cgcacacacagauaugcacacacauggaugagcacacacacaccaaugcgcacacacaccgaug

SEQ ID NO: 41049 - RNA, 64 nt, hsa
cacacacauggaugagcacacacacaccaaugcgcacacacaccgauguacacacacagaugca

SEQ ID NO: 41050 - RNA, 64 nt, hsa
cacacacacaccaaugcgcacacacaccgauguacacacacagaugcacacacagaugcacaca

SEQ ID NO: 41051 - RNA, 64 nt, hsa
aaugcgcacacacaccgauguacacacacagaugcacacacagaugcacacacaccgaugcuga

SEQ ID NO: 41052 - RNA, 64 nt, hsa
caccgauguacacacacagaugcacacacagaugcacacacaccgaugcugacuccaugugugc

SEQ ID NO: 41053 - RNA, 64 nt, hsa
aucacacacacacucacacucacauacacacacacacacacacucugacugucuuuauugcaga

SEQ ID NO: 41054 - RNA, 64 nt, hsa
acaucacacacacacucacacucacauacacacacacacacacacucugacugucuuuauugca

SEQ ID NO: 41055 - RNA, 64 nt, hsa
guacaucacacacacacucacacucacauacacacacacacacacacucugacugucuuuauug

SEQ ID NO: 41056 - RNA, 64 nt, hsa
auguacaucacacacacacucacacucacauacacacacacacacacacucugacugucuuuau

SEQ ID NO: 41057 - RNA, 64 nt, hsa
uaauguacaucacacacacacucacacucacauacacacacacacacacacucugacugucuuu

SEQ ID NO: 41058 - RNA, 64 nt, hsa
cacugugcccagcccuaacuuuuaauguacaucacacacacacucacacucacauacacacaca

SEQ ID NO: 41059 - RNA, 64 nt, hsa
gccacugugcccagcccuaacuuuuaauguacaucacacacacacucacacucacauacacaca

SEQ ID NO: 41060 - RNA, 64 nt, hsa
gagacacacacacacacacacacacacacacacacacacacagucuuuauugcagaagacagug

SEQ ID NO: 41061 - RNA, 64 nt, hsa
gugagacacacacacacacacacacacacacacacacacacacagucuuuauugcagaagacag

SEQ ID NO: 41062 - RNA, 64 nt, hsa
gcgugagacacacacacacacacacacacacacacacacacacacagucuuuauugcagaagac

SEQ ID NO: 41063 - RNA, 64 nt, hsa
aggcgugagacacacacacacacacacacacacacacacacacacacagucuuuauugcagaag

SEQ ID NO: 41064 - RNA, 64 nt, hsa
auaggcgugagacacacacacacacacacacacacacacacacacacacagucuuuauugcaga

SEQ ID NO: 41065 - RNA, 64 nt, hsa
uuauaggcgugagacacacacacacacacacacacacacacacacacacacagucuuuauugca

SEQ ID NO: 41066 - RNA, 64 nt, hsa
ccuuauaggcgugagacacacacacacacacacacacacacacacacacacacagucuuuauug

SEQ ID NO: 41067 - RNA, 64 nt, hsa
ugccuuauaggcgugagacacacacacacacacacacacacacacacacacacacagucuuuau

SEQ ID NO: 41068 - RNA, 64 nt, hsa
guugccuuauaggcgugagacacacacacacacacacacacacacacacacacacacagucuuu

SEQ ID NO: 41069 - RNA, 64 nt, hsa
guguugccuuauaggcgugagacacacacacacacacacacacacacacacacacacacagucu

SEQ ID NO: 41070 - RNA, 64 nt, hsa
guguguugccuuauaggcgugagacacacacacacacacacacacacacacacacacacacagu

SEQ ID NO: 41071 - RNA, 64 nt, hsa
caguguguugccuuauaggcgugagacacacacacacacacacacacacacacacacacacaca

SEQ ID NO: 41072 - RNA, 64 nt, hsa
gacaguguguugccuuauaggcgugagacacacacacacacacacacacacacacacacacaca

SEQ ID NO: 41073 - RNA, 64 nt, hsa
aagacaguguguugccuuauaggcgugagacacacacacacacacacacacacacacacacaca

SEQ ID NO: 41074 - RNA, 64 nt, hsa
agaagacaguguguugccuuauaggcgugagacacacacacacacacacacacacacacacaca

SEQ ID NO: 41075 - RNA, 64 nt, hsa
gcagaagacaguguguugccuuauaggcgugagacacacacacacacacacacacacacacaca

SEQ ID NO: 41076 - RNA, 64 nt, hsa
aggcgugagacagacacacauacacacacauacacacacacagagucuuuauugcagaagacag

SEQ ID NO: 41077 - RNA, 64 nt, hsa
acaggcgugagacagacacacauacacacacauacacacacacagagucuuuauugcagaagac

SEQ ID NO: 41078 - RNA, 64 nt, hsa
ugcuaggauuacaggcgugagacagacacacauacacacacauacacacacacagagucuuuau

SEQ ID NO: 41079 - RNA, 64 nt, hsa
cacacacacacacacacacacacacacacacacacacacacacuauuucagaagacaguguguu

SEQ ID NO: 41080 - RNA, 64 nt, hsa
cacacacacacacacacacacacacacacacacacacacacacacuauuucagaagacagugug

SEQ ID NO: 41081 - RNA, 64 nt, hsa
cacacacacacacacacacacacacacacacacacacacacacacacuauuucagaagacagug

SEQ ID NO: 41082 - RNA, 64 nt, hsa
cacacacacacacacacacacacacacacacacacacacacacacacacuauuucagaagacag

SEQ ID NO: 41083 - RNA, 64 nt, hsa
cacacacacacacacacacacacacacacacacacacacacacacacacacuauuucagaagac

SEQ ID NO: 41084 - RNA, 64 nt, hsa
cacacacacacacacacacacacacacacacacacacacacacacacacacacuauuucagaag

SEQ ID NO: 41085 - RNA, 64 nt, hsa
cacacacacacacacacacacacacacacacacacacacacacacacacacacacuauuucaga

SEQ ID NO: 41086 - RNA, 64 nt, hsa
cacacacacacacacacacacacacacacacacacacacacacacacacacacacacuauuuca

SEQ ID NO: 41087 - RNA, 64 nt, hsa
aacacacacacacacacacacacacacacacacacacacacacacacacacacacacacuauuu

SEQ ID NO: 41088 - RNA, 64 nt, hsa
acaacacacacacacacacacacacacacacacacacacacacacacacacacacacacacuau

SEQ ID NO: 41089 - RNA, 64 nt, hsa
auacaacacacacacacacacacacacacacacacacacacacacacacacacacacacacacu

SEQ ID NO: 41090 - RNA, 64 nt, hsa
auauacaacacacacacacacacacacacacacacacacacacacacacacacacacacacaca

SEQ ID NO: 41091 - RNA, 64 nt, hsa
uaauauacaacacacacacacacacacacacacacacacacacacacacacacacacacacaca

SEQ ID NO: 41092 - RNA, 64 nt, hsa
uuuaauauacaacacacacacacacacacacacacacacacacacacacacacacacacacaca

SEQ ID NO: 41093 - RNA, 64 nt, hsa
cuuuuaauauacaacacacacacacacacacacacacacacacacacacacacacacacacaca

SEQ ID NO: 41094 - RNA, 64 nt, hsa
aacuuuuaauauacaacacacacacacacacacacacacacacacacacacacacacacacaca

SEQ ID NO: 41095 - RNA, 64 nt, hsa
cuaacuuuuaauauacaacacacacacacacacacacacacacacacacacacacacacacaca

SEQ ID NO: 41096 - RNA, 64 nt, hsa
cccuaacuuuuaauauacaacacacacacacacacacacacacacacacacacacacacacaca

SEQ ID NO: 41097 - RNA, 64 nt, hsa
ggcccuaacuuuuaauauacaacacacacacacacacacacacacacacacacacacacacaca

SEQ ID NO: 41098 - RNA, 64 nt, hsa
cuggcccuaacuuuuaauauacaacacacacacacacacacacacacacacacacacacacaca

SEQ ID NO: 41099 - RNA, 64 nt, hsa
accuggcccuaacuuuuaauauacaacacacacacacacacacacacacacacacacacacaca

SEQ ID NO: 41100 - RNA, 64 nt, hsa
gcaccuggcccuaacuuuuaauauacaacacacacacacacacacacacacacacacacacaca

SEQ ID NO: 41101 - RNA, 64 nt, hsa
ccgcaccuggcccuaacuuuuaauauacaacacacacacacacacacacacacacacacacaca

SEQ ID NO: 41102 - RNA, 64 nt, hsa
caccgcaccuggcccuaacuuuuaauauacaacacacacacacacacacacacacacacacaca

SEQ ID NO: 41103 - RNA, 64 nt, hsa
uccaccgcaccuggcccuaacuuuuaauauacaacacacacacacacacacacacacacacaca

SEQ ID NO: 41104 - RNA, 64 nt, hsa
aacacacacacacacacacacacacacacacacacacacacaacaaaucuacauauacaaacaa

SEQ ID NO: 41105 - RNA, 64 nt, hsa
acaacacacacacacacacacacacacacacacacacacacacaacaaaucuacauauacaaac

SEQ ID NO: 41106 - RNA, 64 nt, hsa
guacaacacacacacacacacacacacacacacacacacacacacacacacaacaaaucuacau

SEQ ID NO: 41107 - RNA, 64 nt, hsa
auguacaacacacacacacacacacacacacacacacacacacacacacacacaacaaaucuac

SEQ ID NO: 41108 - RNA, 64 nt, hsa
uaauguacaacacacacacacacacacacacacacacacacacacacacacacacaacaaaucu

SEQ ID NO: 41109 - RNA, 64 nt, hsa
guuaauguacaacacacacacacacacacacacacacacacacacacacacacacacaacaaau

SEQ ID NO: 41110 - RNA, 64 nt, hsa
uuguuaauguacaacacacacacacacacacacacacacacacacacacacacacacacaacaa

SEQ ID NO: 41111 - RNA, 64 nt, hsa
uauuguuaauguacaacacacacacacacacacacacacacacacacacacacacacacacaac

SEQ ID NO: 41112 - RNA, 64 nt, hsa
aguauuguuaauguacaacacacacacacacacacacacacacacacacacacacacacacaca

SEQ ID NO: 41113 - RNA, 64 nt, hsa
agaguauuguuaauguacaacacacacacacacacacacacacacacacacacacacacacaca

SEQ ID NO: 41114 - RNA, 64 nt, hsa
acagaguauuguuaauguacaacacacacacacacacacacacacacacacacacacacacaca

SEQ ID NO: 41115 - RNA, 64 nt, hsa
ccacagaguauuguuaauguacaacacacacacacacacacacacacacacacacacacacaca

SEQ ID NO: 41116 - RNA, 64 nt, hsa
uuccacagaguauuguuaauguacaacacacacacacacacacacacacacacacacacacaca

SEQ ID NO: 41117 - RNA, 64 nt, hsa
uauuccacagaguauuguuaauguacaacacacacacacacacacacacacacacacacacaca

SEQ ID NO: 41118 - RNA, 64 nt, hsa
ucuauuccacagaguauuguuaauguacaacacacacacacacacacacacacacacacacaca

SEQ ID NO: 41119 - RNA, 64 nt, hsa
uuucuauuccacagaguauuguuaauguacaacacacacacacacacacacacacacacacaca

SEQ ID NO: 41120 - RNA, 64 nt, hsa
uguuucuauuccacagaguauuguuaauguacaacacacacacacacacacacacacacacaca

SEQ ID NO: 41121 - RNA, 64 nt, hsa
aauacacguaugguuaauguucaguccaacaaaccacacacaguaaauguuuauuaauagucau

SEQ ID NO: 41122 - RNA, 64 nt, hsa
uguuuuauugagugaagccuuaaaaagcacacaccacacacagcuaacugccaaaauacauuga

SEQ ID NO: 41123 - RNA, 64 nt, hsa
uggauggaugaauggacaaacaaaaugcgauacacacacacaauggaaugcuauuaagccuuaa

SEQ ID NO: 41124 - RNA, 64 nt, hsa
cauggauggaugaauggacaaacaaaaugcgauacacacacacaauggaaugcuauuaagccuu

SEQ ID NO: 41125 - RNA, 64 nt, hsa
guuuuacuccuuuuuuuaaaaacacaugcgcgcgcacacacacaugcuuuacaaguuuuauuau

SEQ ID NO: 41126 - RNA, 64 nt, hsa
uuuacuccuuuuuuuaaaaacacaugcgcgcgcacacacacaugcuuuacaaguuuuauuauaa

SEQ ID NO: 41127 - RNA, 64 nt, hsa
aguuuauguucuacugaaagaggacguguguauacacacacacacacacacacacacacagauu

SEQ ID NO: 41128 - RNA, 64 nt, hsa
uuuauguucuacugaaagaggacguguguauacacacacacacacacacacacacacagauugg

SEQ ID NO: 41129 - RNA, 64 nt, hsa
uauguucuacugaaagaggacguguguauacacacacacacacacacacacacacagauuggua

SEQ ID NO: 41130 - RNA, 64 nt, hsa
uguucuacugaaagaggacguguguauacacacacacacacacacacacacacagauugguaua

SEQ ID NO: 41131 - RNA, 64 nt, hsa
uucuacugaaagaggacguguguauacacacacacacacacacacacacacagauugguauaau

SEQ ID NO: 41132 - RNA, 64 nt, hsa
cuacugaaagaggacguguguauacacacacacacacacacacacacacagauugguauaaugg

SEQ ID NO: 41133 - RNA, 64 nt, hsa
acugaaagaggacguguguauacacacacacacacacacacacacacagauugguauaauggag

SEQ ID NO: 41134 - RNA, 64 nt, hsa
ugaaagaggacguguguauacacacacacacacacacacacacacagauugguauaauggagaa

SEQ ID NO: 41135 - RNA, 64 nt, hsa
aaagaggacguguguauacacacacacacacacacacacacacagauugguauaauggagaaga

SEQ ID NO: 41136 - RNA, 64 nt, hsa
agaggacguguguauacacacacacacacacacacacacacagauugguauaauggagaagaug

SEQ ID NO: 41137 - RNA, 64 nt, hsa
acgacucugguggggaaaaccguuuuuuaaaggacacacacacacacagcgaugcaucucucuc

SEQ ID NO: 41138 - RNA, 64 nt, hsa
gacucugguggggaaaaccguuuuuuaaaggacacacacacacacagcgaugcaucucucucua

SEQ ID NO: 41139 - RNA, 64 nt, hsa
cucugguggggaaaaccguuuuuuaaaggacacacacacacacagcgaugcaucucucucuaaa

SEQ ID NO: 41140 - RNA, 64 nt, hsa
cugguggggaaaaccguuuuuuaaaggacacacacacacacagcgaugcaucucucucuaaagc

SEQ ID NO: 41141 - RNA, 64 nt, hsa
uuuaaaaacaaauaaaugaauaaagcugcugugacacacacacaaaaggaauuuaauaguauaa

SEQ ID NO: 41142 - RNA, 64 nt, hsa
uaaaaacaaauaaaugaauaaagcugcugugacacacacacaaaaggaauuuaauaguauaaua

SEQ ID NO: 41143 - RNA, 64 nt, hsa
gaucccuguuucccaacugaaaggugugaacggacacacacacagccuggaugacgccuuggcu

SEQ ID NO: 41144 - RNA, 64 nt, hsa
ucccuguuucccaacugaaaggugugaacggacacacacacagccuggaugacgccuuggcugu

SEQ ID NO: 41145 - RNA, 64 nt, hsa
ccugucauucccaccacccugaggccccaaccgccacacacacaggagcauuuggagagaaggc

SEQ ID NO: 41146 - RNA, 64 nt, hsa
ugucauucccaccacccugaggccccaaccgccacacacacaggagcauuuggagagaaggcca

SEQ ID NO: 41147 - RNA, 64 nt, hsa
uuugccaagcucaauaauggacaaaggauacaaacacacacacaucuacuauuuuagauaaaug

SEQ ID NO: 41148 - RNA, 64 nt, hsa
ugccaagcucaauaauggacaaaggauacaaacacacacacaucuacuauuuuagauaaaugua

SEQ ID NO: 41149 - RNA, 64 nt, hsa
gauuuuucuuccuuaaacuugaacaccaaaaaaacacacacacacacacacguggggauagcug

SEQ ID NO: 41150 - RNA, 64 nt, hsa
uuuuucuuccuuaaacuugaacaccaaaaaaacacacacacacacacacguggggauagcugga

SEQ ID NO: 41151 - RNA, 64 nt, hsa
uuucuuccuuaaacuugaacaccaaaaaaacacacacacacacacacguggggauagcuggaca

SEQ ID NO: 41152 - RNA, 64 nt, hsa
ucuuccuuaaacuugaacaccaaaaaaacacacacacacacacacguggggauagcuggacaug

SEQ ID NO: 41153 - RNA, 64 nt, hsa
uuccuuaaacuugaacaccaaaaaaacacacacacacacacacguggggauagcuggacauguc

SEQ ID NO: 41154 - RNA, 64 nt, hsa
gcccaguguaugcauguguggguguguucaugcacacacacacucucucucuugucucucuguc

SEQ ID NO: 41155 - RNA, 64 nt, hsa
uagcccaguguaugcauguguggguguguucaugcacacacacacucucucucuugucucucug

SEQ ID NO: 41156 - RNA, 64 nt, hsa
ggccuuuuucccaugugugcagucugagcuuaggcacacacaggaggguuccaggacuuucuga

SEQ ID NO: 41157 - RNA, 64 nt, hsa
uccccauccccauaaaugcauacacauacaugcacacacacacguuaucccaugauguuccacu

SEQ ID NO: 41158 - RNA, 64 nt, hsa
gcuccccauccccauaaaugcauacacauacaugcacacacacacguuaucccaugauguucca

SEQ ID NO: 41159 - RNA, 64 nt, hsa
uuggcacccugauuauucauacaugucugccuaccacacacaaaauauauccuugguucuaucu

SEQ ID NO: 41160 - RNA, 64 nt, hsa
cagcagaguccugccuccucccaauccccacagacacacacauugauccuccuccucagcuccu

SEQ ID NO: 41161 - RNA, 64 nt, hsa
uuuaucuuucaugcuuucucuguacacacacacacacacacaaauuuuuccucaaucauuugaa

SEQ ID NO: 41162 - RNA, 64 nt, hsa
gcuuuaucuuucaugcuuucucuguacacacacacacacacacaaauuuuuccucaaucauuug

SEQ ID NO: 41163 - RNA, 64 nt, hsa
gugcuuuaucuuucaugcuuucucuguacacacacacacacacacaaauuuuuccucaaucauu

SEQ ID NO: 41164 - RNA, 64 nt, hsa
acgugcuuuaucuuucaugcuuucucuguacacacacacacacacacaaauuuuuccucaauca

SEQ ID NO: 41165 - RNA, 64 nt, hsa
auacgugcuuuaucuuucaugcuuucucuguacacacacacacacacacaaauuuuuccucaau

SEQ ID NO: 41166 - RNA, 64 nt, hsa
ucauacgugcuuuaucuuucaugcuuucucuguacacacacacacacacacaaauuuuuccuca

SEQ ID NO: 41167 - RNA, 64 nt, hsa
auauacacaccacacacacacaccacauacaccacacacacacguucccauccacucacccaca

SEQ ID NO: 41168 - RNA, 64 nt, hsa
agauauacacaccacacacacacaccacauacaccacacacacacguucccauccacucaccca

SEQ ID NO: 41169 - RNA, 64 nt, hsa
caguccuugaggauagacagauauacacaccacacacacacaccacauacaccacacacacacg

SEQ ID NO: 41170 - RNA, 64 nt, hsa
ggcaguccuugaggauagacagauauacacaccacacacacacaccacauacaccacacacaca

SEQ ID NO: 41171 - RNA, 64 nt, hsa
caggcaguccuugaggauagacagauauacacaccacacacacacaccacauacaccacacaca

SEQ ID NO: 41172 - RNA, 64 nt, hsa
gaguuuuccaauguuaauguaaacagaacuggcacacacacauuaagaugaauguaauuauuau

SEQ ID NO: 41173 - RNA, 64 nt, hsa
uggaguuuuccaauguuaauguaaacagaacuggcacacacacauuaagaugaauguaauuauu

SEQ ID NO: 41174 - RNA, 64 nt, hsa
cgcacacacacacacacacacacacacacacacacacacacacgaaggagagagagagaaaacu

SEQ ID NO: 41175 - RNA, 64 nt, hsa
cacgcacacacacacacacacacacacacacacacacacacacacgaaggagagagagagaaaa

SEQ ID NO: 41176 - RNA, 64 nt, hsa
cgcacgcacacacacacacacacacacacacacacacacacacacacgaaggagagagagagaa

SEQ ID NO: 41177 - RNA, 64 nt, hsa
cacgcacgcacacacacacacacacacacacacacacacacacacacacgaaggagagagagag

SEQ ID NO: 41178 - RNA, 64 nt, hsa
ugcacgcacgcacacacacacacacacacacacacacacacacacacacacgaaggagagagag

SEQ ID NO: 41179 - RNA, 64 nt, hsa
ugugcacgcacgcacacacacacacacacacacacacacacacacacacacacgaaggagagag

SEQ ID NO: 41180 - RNA, 64 nt, hsa
ccugugcacgcacgcacacacacacacacacacacacacacacacacacacacacgaaggagag

SEQ ID NO: 41181 - RNA, 64 nt, hsa
gcccugugcacgcacgcacacacacacacacacacacacacacacacacacacacacgaaggag

SEQ ID NO: 41182 - RNA, 64 nt, hsa
uggcccugugcacgcacgcacacacacacacacacacacacacacacacacacacacacgaagg

SEQ ID NO: 41183 - RNA, 64 nt, hsa
auuggcccugugcacgcacgcacacacacacacacacacacacacacacacacacacacacgaa

SEQ ID NO: 41184 - RNA, 64 nt, hsa
agauuggcccugugcacgcacgcacacacacacacacacacacacacacacacacacacacacg

SEQ ID NO: 41185 - RNA, 64 nt, hsa
gaagauuggcccugugcacgcacgcacacacacacacacacacacacacacacacacacacaca

SEQ ID NO: 41186 - RNA, 64 nt, hsa
cugaagauuggcccugugcacgcacgcacacacacacacacacacacacacacacacacacaca

SEQ ID NO: 41187 - RNA, 64 nt, hsa
gccugaagauuggcccugugcacgcacgcacacacacacacacacacacacacacacacacaca

SEQ ID NO: 41188 - RNA, 64 nt, hsa
aagccugaagauuggcccugugcacgcacgcacacacacacacacacacacacacacacacaca

SEQ ID NO: 41189 - RNA, 64 nt, hsa
auaagccugaagauuggcccugugcacgcacgcacacacacacacacacacacacacacacaca

SEQ ID NO: 41190 - RNA, 64 nt, hsa
ccauaagccugaagauuggcccugugcacgcacgcacacacacacacacacacacacacacaca

SEQ ID NO: 41191 - RNA, 64 nt, hsa
uuugaucaucggaaggagcagcauugcucagaaacacacacacacacacacacacuugacuuuc

SEQ ID NO: 41192 - RNA, 64 nt, hsa
ugaucaucggaaggagcagcauugcucagaaacacacacacacacacacacacuugacuuucuu

SEQ ID NO: 41193 - RNA, 64 nt, hsa
aucaucggaaggagcagcauugcucagaaacacacacacacacacacacacuugacuuucuugu

SEQ ID NO: 41194 - RNA, 64 nt, hsa
caucggaaggagcagcauugcucagaaacacacacacacacacacacacuugacuuucuugucu

SEQ ID NO: 41195 - RNA, 64 nt, hsa
ucggaaggagcagcauugcucagaaacacacacacacacacacacacuugacuuucuugucugc

SEQ ID NO: 41196 - RNA, 64 nt, hsa
ggaaggagcagcauugcucagaaacacacacacacacacacacacuugacuuucuugucugcca

SEQ ID NO: 41197 - RNA, 64 nt, hsa
aaggagcagcauugcucagaaacacacacacacacacacacacuugacuuucuugucugccaaa

SEQ ID NO: 41198 - RNA, 64 nt, hsa
gaugagaucacacgcaugcacgugcacacauguacacacacacaccuaccugcacagcacgcug

SEQ ID NO: 41199 - RNA, 64 nt, hsa
ugagaucacacgcaugcacgugcacacauguacacacacacaccuaccugcacagcacgcuguu

SEQ ID NO: 41200 - RNA, 64 nt, hsa
cagcucugcucaacugcgucuucucucagcccuccacacacacucacccccacucccacacaca

SEQ ID NO: 41201 - RNA, 64 nt, hsa
cucucagcccuccacacacacucacccccacucccacacacauacacacacacacacacauacc

SEQ ID NO: 41202 - RNA, 64 nt, hsa
uccacacacacucacccccacucccacacacauacacacacacacacacauaccccaucucccg

SEQ ID NO: 41203 - RNA, 64 nt, hsa
cacacacacucacccccacucccacacacauacacacacacacacacauaccccaucucccgag

SEQ ID NO: 41204 - RNA, 64 nt, hsa
cacacacucacccccacucccacacacauacacacacacacacacauaccccaucucccgaggg

SEQ ID NO: 41205 - RNA, 64 nt, hsa
cacacucacccccacucccacacacauacacacacacacacacauaccccaucucccgagggcu

SEQ ID NO: 41206 - RNA, 64 nt, hsa
cacucacccccacucccacacacauacacacacacacacacauaccccaucucccgagggcuga

SEQ ID NO: 41207 - RNA, 64 nt, hsa
aaaaaaagguuccaaaaaaaaccaaaacucaguacacacacacaggcacagaugcacacacacg

SEQ ID NO: 41208 - RNA, 64 nt, hsa
aaaaagguuccaaaaaaaaccaaaacucaguacacacacacaggcacagaugcacacacacgca

SEQ ID NO: 41209 - RNA, 64 nt, hsa
accaaaacucaguacacacacacaggcacagaugcacacacacgcagacagacacaccgacuuu

SEQ ID NO: 41210 - RNA, 64 nt, hsa
auuuuauaaacuaugcacaugcauuacacacaugcacacacauaugcacacacaugugcaaaca

SEQ ID NO: 41211 - RNA, 64 nt, hsa
augcacaugcauuacacacaugcacacacauaugcacacacaugugcaaacauagccacuuuuu

SEQ ID NO: 41212 - RNA, 64 nt, hsa
uuuauaccuguacacacacagacacacaagcagacacacacauauauacauacgcaauuguaua

SEQ ID NO: 41213 - RNA, 64 nt, hsa
auauuacucugccugucaaguuuuuauaccuguacacacacagacacacaagcagacacacaca

SEQ ID NO: 41214 - RNA, 64 nt, hsa
cacacacacacacacacacacacacacacacacacacacacacgccgagcagcugucucggguc

SEQ ID NO: 41215 - RNA, 64 nt, hsa
cacacacacacacacacacacacacacacacacacacacacacacgccgagcagcugucucggg

SEQ ID NO: 41216 - RNA, 64 nt, hsa
cacacacacacacacacacacacacacacacacacacacacacacacgccgagcagcugucucg

SEQ ID NO: 41217 - RNA, 64 nt, hsa
cacacacacacacacacacacacacacacacacacacacacacacacacgccgagcagcugucu

SEQ ID NO: 41218 - RNA, 64 nt, hsa
cacacacacacacacacacacacacacacacacacacacacacacacacacgccgagcagcugu

SEQ ID NO: 41219 - RNA, 64 nt, hsa
cacacacacacacacacacacacacacacacacacacacacacacacacacacgccgagcagcu

SEQ ID NO: 41220 - RNA, 64 nt, hsa
cacacacacacacacacacacacacacacacacacacacacacacacacacacacgccgagcag

SEQ ID NO: 41221 - RNA, 64 nt, hsa
cacacacacacacacacacacacacacacacacacacacacacacacacacacacacgccgagc

SEQ ID NO: 41222 - RNA, 64 nt, hsa
cacacacacacacacacacacacacacacacacacacacacacacacacacacacacacgccga

SEQ ID NO: 41223 - RNA, 64 nt, hsa
cacacacacacacacacacacacacacacacacacacacacacacacacacacacacacacgcc

SEQ ID NO: 41224 - RNA, 64 nt, hsa
uacacacacacacacacacacacacacacacacacacacacacacacacacacacacacacacg

SEQ ID NO: 41225 - RNA, 64 nt, hsa
auuacacacacacacacacacacacacacacacacacacacacacacacacacacacacacaca

SEQ ID NO: 41226 - RNA, 64 nt, hsa
aaauuacacacacacacacacacacacacacacacacacacacacacacacacacacacacaca

SEQ ID NO: 41227 - RNA, 64 nt, hsa
guaaauuacacacacacacacacacacacacacacacacacacacacacacacacacacacaca

SEQ ID NO: 41228 - RNA, 64 nt, hsa
caguaaauuacacacacacacacacacacacacacacacacacacacacacacacacacacaca

SEQ ID NO: 41229 - RNA, 64 nt, hsa
aacaguaaauuacacacacacacacacacacacacacacacacacacacacacacacacacaca

SEQ ID NO: 41230 - RNA, 64 nt, hsa
agaacaguaaauuacacacacacacacacacacacacacacacacacacacacacacacacaca

SEQ ID NO: 41231 - RNA, 64 nt, hsa
gcagaacaguaaauuacacacacacacacacacacacacacacacacacacacacacacacaca

SEQ ID NO: 41232 - RNA, 64 nt, hsa
cagcagaacaguaaauuacacacacacacacacacacacacacacacacacacacacacacaca

SEQ ID NO: 41233 - RNA, 64 nt, hsa
agcagcagaacaguaaauuacacacacacacacacacacacacacacacacacacacacacaca

SEQ ID NO: 41234 - RNA, 64 nt, hsa
gcagcagcagaacaguaaauuacacacacacacacacacacacacacacacacacacacacaca

SEQ ID NO: 41235 - RNA, 64 nt, hsa
cagcagcagcagaacaguaaauuacacacacacacacacacacacacacacacacacacacaca

SEQ ID NO: 41236 - RNA, 62 nt, hsa
cagcagcagcagaacaguaaauuacacacacacacacacacacacacacacacacacacaca

SEQ ID NO: 41237 - RNA, 60 nt, hsa
cagcagcagcagaacaguaaauuacacacacacacacacacacacacacacacacacaca

SEQ ID NO: 41238 - RNA, 58 nt, hsa
cagcagcagcagaacaguaaauuacacacacacacacacacacacacacacacacaca

SEQ ID NO: 41239 - RNA, 56 nt, hsa
cagcagcagcagaacaguaaauuacacacacacacacacacacacacacacacaca

SEQ ID NO: 41240 - RNA, 54 nt, hsa
cagcagcagcagaacaguaaauuacacacacacacacacacacacacacacaca

SEQ ID NO: 41241 - RNA, 64 nt, hsa
cccucaugcaagggugcguguacacauacacacacacacacaccuggccccagguggggguugu

SEQ ID NO: 41242 - RNA, 64 nt, hsa
cucccucaugcaagggugcguguacacauacacacacacacacaccuggccccagguggggguu

SEQ ID NO: 41243 - RNA, 64 nt, hsa
accucccucaugcaagggugcguguacacauacacacacacacacaccuggccccagguggggg

SEQ ID NO: 41244 - RNA, 64 nt, hsa
uuaccucccucaugcaagggugcguguacacauacacacacacacacaccuggccccagguggg

SEQ ID NO: 41245 - RNA, 64 nt, hsa
cucuguagcuggucucacugcccagagggaacugcacacacagacuucucucuuacguucaugg

SEQ ID NO: 41246 - RNA, 64 nt, hsa
cccccuaagugauagguuuaaacacacagagacacacacacacguuuccaaagugcagcagugu

SEQ ID NO: 41247 - RNA, 64 nt, hsa
ugcccccuaagugauagguuuaaacacacagagacacacacacacguuuccaaagugcagcagu

SEQ ID NO: 41248 - RNA, 64 nt, hsa
cacacacacacacacacacacacacacacacacacacacacacugccucccauccuucccucau

SEQ ID NO: 41249 - RNA, 64 nt, hsa
cacacacacacacacacacacacacacacacacacacacacacacugccucccauccuucccuc

SEQ ID NO: 41250 - RNA, 64 nt, hsa
cacacacacacacacacacacacacacacacacacacacacacacacugccucccauccuuccc

SEQ ID NO: 41251 - RNA, 64 nt, hsa
cacacacacacacacacacacacacacacacacacacacacacacacacugccucccauccuuc

SEQ ID NO: 41252 - RNA, 64 nt, hsa
cacacacacacacacacacacacacacacacacacacacacacacacacacugccucccauccu

SEQ ID NO: 41253 - RNA, 64 nt, hsa
cacacacacacacacacacacacacacacacacacacacacacacacacacacugccucccauc

SEQ ID NO: 41254 - RNA, 64 nt, hsa
cacacacacacacacacacacacacacacacacacacacacacacacacacacacugccuccca

SEQ ID NO: 41255 - RNA, 64 nt, hsa
cacacacacacacacacacacacacacacacacacacacacacacacacacacacacugccucc

SEQ ID NO: 41256 - RNA, 64 nt, hsa
cacacacacacacacacacacacacacacacacacacacacacacacacacacacacacugccu

SEQ ID NO: 41257 - RNA, 64 nt, hsa
uacacacacacacacacacacacacacacacacacacacacacacacacacacacacacacugc

SEQ ID NO: 41258 - RNA, 64 nt, hsa
ccuacacacacacacacacacacacacacacacacacacacacacacacacacacacacacacu

SEQ ID NO: 41259 - RNA, 64 nt, hsa
ucccuacacacacacacacacacacacacacacacacacacacacacacacacacacacacaca

SEQ ID NO: 41260 - RNA, 64 nt, hsa
ccucccuacacacacacacacacacacacacacacacacacacacacacacacacacacacaca

SEQ ID NO: 41261 - RNA, 64 nt, hsa
ccccucccuacacacacacacacacacacacacacacacacacacacacacacacacacacaca

SEQ ID NO: 41262 - RNA, 64 nt, hsa
acccccucccuacacacacacacacacacacacacacacacacacacacacacacacacacaca

SEQ ID NO: 41263 - RNA, 64 nt, hsa
ucacccccucccuacacacacacacacacacacacacacacacacacacacacacacacacaca

SEQ ID NO: 41264 - RNA, 64 nt, hsa
uaucacccccucccuacacacacacacacacacacacacacacacacacacacacacacacaca

SEQ ID NO: 41265 - RNA, 64 nt, hsa
uguaucacccccucccuacacacacacacacacacacacacacacacacacacacacacacaca

SEQ ID NO: 41266 - RNA, 64 nt, hsa
ccuguaucacccccucccuacacacacacacacacacacacacacacacacacacacacacaca

SEQ ID NO: 41267 - RNA, 64 nt, hsa
ucccuguaucacccccucccuacacacacacacacacacacacacacacacacacacacacaca

SEQ ID NO: 41268 - RNA, 64 nt, hsa
ccucccuguaucacccccucccuacacacacacacacacacacacacacacacacacacacaca

SEQ ID NO: 41269 - RNA, 64 nt, hsa
ccccucccuguaucacccccucccuacacacacacacacacacacacacacacacacacacaca

SEQ ID NO: 41270 - RNA, 64 nt, hsa
cuccccucccuguaucacccccucccuacacacacacacacacacacacacacacacacacaca

SEQ ID NO: 41271 - RNA, 64 nt, hsa
gccuccccucccuguaucacccccucccuacacacacacacacacacacacacacacacacaca

SEQ ID NO: 41272 - RNA, 64 nt, hsa
gagccuccccucccuguaucacccccucccuacacacacacacacacacacacacacacacaca

SEQ ID NO: 41273 - RNA, 64 nt, hsa
gggagccuccccucccuguaucacccccucccuacacacacacacacacacacacacacacaca

SEQ ID NO: 41274 - RNA, 64 nt, hsa
accagcuuuacucucugacacacacacgcacacacacacacaauuuuaacuuguuuuuuuguac

SEQ ID NO: 41275 - RNA, 64 nt, hsa
ccaccagcuuuacucucugacacacacacgcacacacacacacaauuuuaacuuguuuuuuugu

SEQ ID NO: 41276 - RNA, 64 nt, hsa
auccaccagcuuuacucucugacacacacacgcacacacacacacaauuuuaacuuguuuuuuu

SEQ ID NO: 41277 - RNA, 64 nt, hsa
ccauccaccagcuuuacucucugacacacacacgcacacacacacacaauuuuaacuuguuuuu

SEQ ID NO: 41278 - RNA, 64 nt, hsa
uaccuuagugccauccaccagcuuuacucucugacacacacacgcacacacacacacaauuuua

SEQ ID NO: 41279 - RNA, 64 nt, hsa
cucuugucaggcuacagagugguggaagaggacacacacacaucuccuccauguuccugccaca

SEQ ID NO: 41280 - RNA, 64 nt, hsa
uccucuugucaggcuacagagugguggaagaggacacacacacaucuccuccauguuccugcca

SEQ ID NO: 41281 - RNA, 64 nt, hsa
cucgugcacaggcacgcagaugcgcucacacguacacacacacaaaugcacgcccacuugcaca

SEQ ID NO: 41282 - RNA, 64 nt, hsa
cgugcacaggcacgcagaugcgcucacacguacacacacacaaaugcacgcccacuugcacaug

SEQ ID NO: 41283 - RNA, 64 nt, hsa
caccucucuccccccaugcaccucuccccaacaacacacacagcccccugcaccgcccgccccc

SEQ ID NO: 41284 - RNA, 64 nt, hsa
ucaccacaugugcacaugcacgugugugcacguacacacacauacacacacacgcgugcacaca

SEQ ID NO: 41285 - RNA, 64 nt, hsa
ugcacaugcacgugugugcacguacacacacauacacacacacgcgugcacacaccagagccca

SEQ ID NO: 41286 - RNA, 64 nt, hsa
cugcauacacacucgcaacaugucuacacacguccacacacacagacacacagauaccccaaau

SEQ ID NO: 41287 - RNA, 64 nt, hsa
gcauacacacucgcaacaugucuacacacguccacacacacagacacacagauaccccaaaucc

SEQ ID NO: 41288 - RNA, 64 nt, hsa
cauuccucacugaaaaagaaaacacacacccacccacacacacacacacagaagaaaaugaaag

SEQ ID NO: 41289 - RNA, 64 nt, hsa
uuccucacugaaaaagaaaacacacacccacccacacacacacacacagaagaaaaugaaagcu

SEQ ID NO: 41290 - RNA, 64 nt, hsa
ccucacugaaaaagaaaacacacacccacccacacacacacacacagaagaaaaugaaagcuga

SEQ ID NO: 41291 - RNA, 64 nt, hsa
ucacugaaaaagaaaacacacacccacccacacacacacacacagaagaaaaugaaagcugaca

SEQ ID NO: 41292 - RNA, 64 nt, hsa
acugaaaaagaaaacacacacccacccacacacacacacacagaagaaaaugaaagcugacaca

SEQ ID NO: 41293 - RNA, 64 nt, hsa
ucauacaacacgauuguauuuuggcaagcaaauacacacacacacacauacucucacacaggaa

SEQ ID NO: 41294 - RNA, 64 nt, hsa
auacaacacgauuguauuuuggcaagcaaauacacacacacacacauacucucacacaggaaac

SEQ ID NO: 41295 - RNA, 64 nt, hsa
acaacacgauuguauuuuggcaagcaaauacacacacacacacauacucucacacaggaaacga

SEQ ID NO: 41296 - RNA, 64 nt, hsa
aacacgauuguauuuuggcaagcaaauacacacacacacacauacucucacacaggaaacgacc

SEQ ID NO: 41297 - RNA, 64 nt, hsa
gauuccaggcgaugugcaaguguaugcacgugugcacacacaccacacauacacacacacaagc

SEQ ID NO: 41298 - RNA, 64 nt, hsa
aaguguaugcacgugugcacacacaccacacauacacacacacaagcuuuuuuacacaaauggu

SEQ ID NO: 41299 - RNA, 64 nt, hsa
guguaugcacgugugcacacacaccacacauacacacacacaagcuuuuuuacacaaaugguag

SEQ ID NO: 41300 - RNA, 64 nt, hsa
ggaaucagugcagccuguaaguucuccacauugacacacacacacacacacacacacacacacg

SEQ ID NO: 41301 - RNA, 64 nt, hsa
aaucagugcagccuguaaguucuccacauugacacacacacacacacacacacacacacacgac

SEQ ID NO: 41302 - RNA, 64 nt, hsa
ucagugcagccuguaaguucuccacauugacacacacacacacacacacacacacacacgacau

SEQ ID NO: 41303 - RNA, 64 nt, hsa
agugcagccuguaaguucuccacauugacacacacacacacacacacacacacacacgacaugc

SEQ ID NO: 41304 - RNA, 64 nt, hsa
ugcagccuguaaguucuccacauugacacacacacacacacacacacacacacacgacaugcuc

SEQ ID NO: 41305 - RNA, 64 nt, hsa
cagccuguaaguucuccacauugacacacacacacacacacacacacacacacgacaugcuccu

SEQ ID NO: 41306 - RNA, 64 nt, hsa
gccuguaaguucuccacauugacacacacacacacacacacacacacacacgacaugcuccuuu

SEQ ID NO: 41307 - RNA, 64 nt, hsa
cuguaaguucuccacauugacacacacacacacacacacacacacacacgacaugcuccuuucu

SEQ ID NO: 41308 - RNA, 64 nt, hsa
guaaguucuccacauugacacacacacacacacacacacacacacacgacaugcuccuuucugu

SEQ ID NO: 41309 - RNA, 64 nt, hsa
aaguucuccacauugacacacacacacacacacacacacacacacgacaugcuccuuucugugg

SEQ ID NO: 41310 - RNA, 64 nt, hsa
guucuccacauugacacacacacacacacacacacacacacacgacaugcuccuuucuguggca

SEQ ID NO: 41311 - RNA, 64 nt, hsa
ugcaguugcuuacuaaagguuuuaaccgcacaugcacacacacacgcuuucuuaugcaaucuau

SEQ ID NO: 41312 - RNA, 64 nt, hsa
caguugcuuacuaaagguuuuaaccgcacaugcacacacacacgcuuucuuaugcaaucuaugu

SEQ ID NO: 41313 - RNA, 64 nt, hsa
ccuggggggcaggaugccuggggacaguucaggacacacacacaguaggcccgcaauaaaagca

SEQ ID NO: 41314 - RNA, 64 nt, hsa
uggggggcaggaugccuggggacaguucaggacacacacacaguaggcccgcaauaaaagcaac

SEQ ID NO: 41315 - RNA, 64 nt, hsa
aacacaaggcggggaugcucccacgccacgugcacacacacagacccacauguggguggggggc

SEQ ID NO: 41316 - RNA, 64 nt, hsa
ccaacacaaggcggggaugcucccacgccacgugcacacacacagacccacauguggguggggg

SEQ ID NO: 41317 - RNA, 64 nt, hsa
auauauauauauauauauauauaugguaaacaagcacacacaauuuuauccaaugcaaacaaau

SEQ ID NO: 41318 - RNA, 64 nt, hsa
uacgacccgaccucucuauguaagcacacaugcgcacacacacuugcauucaugaaucugauau

SEQ ID NO: 41319 - RNA, 64 nt, hsa
uguucacacacacacacacacacacacacacacacacacacaggcucucgccccaggauagaag

SEQ ID NO: 41320 - RNA, 64 nt, hsa
uguguucacacacacacacacacacacacacacacacacacacaggcucucgccccaggauaga

SEQ ID NO: 41321 - RNA, 64 nt, hsa
uguguguucacacacacacacacacacacacacacacacacacacaggcucucgccccaggaua

SEQ ID NO: 41322 - RNA, 64 nt, hsa
gcuguguguucacacacacacacacacacacacacacacacacacacaggcucucgccccagga

SEQ ID NO: 41323 - RNA, 64 nt, hsa
uggcuguguguucacacacacacacacacacacacacacacacacacacaggcucucgccccag

SEQ ID NO: 41324 - RNA, 64 nt, hsa
gguggcuguguguucacacacacacacacacacacacacacacacacacacaggcucucgcccc

SEQ ID NO: 41325 - RNA, 64 nt, hsa
gagguggcuguguguucacacacacacacacacacacacacacacacacacacaggcucucgcc

SEQ ID NO: 41326 - RNA, 64 nt, hsa
acgagguggcuguguguucacacacacacacacacacacacacacacacacacacaggcucucg

SEQ ID NO: 41327 - RNA, 64 nt, hsa
ggacgagguggcuguguguucacacacacacacacacacacacacacacacacacacaggcucu

SEQ ID NO: 41328 - RNA, 64 nt, hsa
ccggacgagguggcuguguguucacacacacacacacacacacacacacacacacacacaggcu

SEQ ID NO: 41329 - RNA, 64 nt, hsa
ccccggacgagguggcuguguguucacacacacacacacacacacacacacacacacacacagg

SEQ ID NO: 41330 - RNA, 64 nt, hsa
ccccccggacgagguggcuguguguucacacacacacacacacacacacacacacacacacaca

SEQ ID NO: 41331 - RNA, 64 nt, hsa
ggccccccggacgagguggcuguguguucacacacacacacacacacacacacacacacacaca

SEQ ID NO: 41332 - RNA, 64 nt, hsa
cuggccccccggacgagguggcuguguguucacacacacacacacacacacacacacacacaca

SEQ ID NO: 41333 - RNA, 64 nt, hsa
cacuggccccccggacgagguggcuguguguucacacacacacacacacacacacacacacaca

SEQ ID NO: 41334 - RNA, 64 nt, hsa
ggcacuggccccccggacgagguggcuguguguucacacacacacacacacacacacacacaca

SEQ ID NO: 41335 - RNA, 64 nt, hsa
aagcuaacaccgacugcccgccccuccccugccacacacacagacacguaauaccagaccaacc

SEQ ID NO: 41336 - RNA, 64 nt, hsa
aaaagcuaacaccgacugcccgccccuccccugccacacacacagacacguaauaccagaccaa

SEQ ID NO: 41337 - RNA, 64 nt, hsa
uuucugcacagggagugagauuauuaaaguaacacacacacaaaguaaauugcaaaaugaaaaa

SEQ ID NO: 41338 - RNA, 64 nt, hsa
aauuucugcacagggagugagauuauuaaaguaacacacacacaaaguaaauugcaaaaugaaa

SEQ ID NO: 41339 - RNA, 64 nt, hsa
ccuagcugggugcaugugugugcacacacacacacacacacacccccacaccccuuugccgguu

SEQ ID NO: 41340 - RNA, 64 nt, hsa
acccuagcugggugcaugugugugcacacacacacacacacacacccccacaccccuuugccgg

SEQ ID NO: 41341 - RNA, 64 nt, hsa
cuacccuagcugggugcaugugugugcacacacacacacacacacacccccacaccccuuugcc

SEQ ID NO: 41342 - RNA, 64 nt, hsa
uucuacccuagcugggugcaugugugugcacacacacacacacacacacccccacaccccuuug

SEQ ID NO: 41343 - RNA, 64 nt, hsa
uuuucuacccuagcugggugcaugugugugcacacacacacacacacacacccccacaccccuu

SEQ ID NO: 41344 - RNA, 64 nt, hsa
uauuuucuacccuagcugggugcaugugugugcacacacacacacacacacacccccacacccc

SEQ ID NO: 41345 - RNA, 64 nt, hsa
cuuauuuucuacccuagcugggugcaugugugugcacacacacacacacacacacccccacacc

SEQ ID NO: 41346 - RNA, 64 nt, hsa
agccggaagucagaccuccucagucaccagaggacacacacaggggagaagccuuaugucugca

SEQ ID NO: 41347 - RNA, 64 nt, hsa
agugauaagucagauguuauuacacaccaaaggacacacacaggggggaagcccuacgucugca

SEQ ID NO: 41348 - RNA, 64 nt, hsa
cacccacacaaauaggcucugccgugcacuccuacacacacacacacacacacacacgcuuguu

SEQ ID NO: 41349 - RNA, 64 nt, hsa
cccacacaaauaggcucugccgugcacuccuacacacacacacacacacacacacgcuuguuca

SEQ ID NO: 41350 - RNA, 64 nt, hsa
cacacaaauaggcucugccgugcacuccuacacacacacacacacacacacacgcuuguucaca

SEQ ID NO: 41351 - RNA, 64 nt, hsa
cacaaauaggcucugccgugcacuccuacacacacacacacacacacacacgcuuguucacacu

SEQ ID NO: 41352 - RNA, 64 nt, hsa
caaauaggcucugccgugcacuccuacacacacacacacacacacacacgcuuguucacacuca

SEQ ID NO: 41353 - RNA, 64 nt, hsa
aauaggcucugccgugcacuccuacacacacacacacacacacacacgcuuguucacacucaga

SEQ ID NO: 41354 - RNA, 64 nt, hsa
uaggcucugccgugcacuccuacacacacacacacacacacacacgcuuguucacacucagaac

SEQ ID NO: 41355 - RNA, 64 nt, hsa
ggcucugccgugcacuccuacacacacacacacacacacacacgcuuguucacacucagaaccc

SEQ ID NO: 41356 - RNA, 64 nt, hsa
cccacugacccacccacccaccuacaccccccgccacacacacacacaaacgugcacacgcguc

SEQ ID NO: 41357 - RNA, 64 nt, hsa
cacugacccacccacccaccuacaccccccgccacacacacacacaaacgugcacacgcgucuc

SEQ ID NO: 41358 - RNA, 64 nt, hsa
cugacccacccacccaccuacaccccccgccacacacacacacaaacgugcacacgcgucucau

SEQ ID NO: 41359 - RNA, 64 nt, hsa
gacccacccacccaccuacaccccccgccacacacacacacaaacgugcacacgcgucucauuu

SEQ ID NO: 41360 - RNA, 64 nt, hsa
caaccagacucuguaacucacccccaccaccauacacacacacaaaaacagaaacaaaaucaaa

SEQ ID NO: 41361 - RNA, 64 nt, hsa
accagacucuguaacucacccccaccaccauacacacacacaaaaacagaaacaaaaucaaaac

SEQ ID NO: 41362 - RNA, 64 nt, hsa
uuguuuuucuuuucuaaaaugaagugagauuguucacacacacacacacacacacacacacaca

SEQ ID NO: 41363 - RNA, 64 nt, hsa
guuuuucuuuucuaaaaugaagugagauuguucacacacacacacacacacacacacacacaca

SEQ ID NO: 41364 - RNA, 64 nt, hsa
uuuucuuuucuaaaaugaagugagauuguucacacacacacacacacacacacacacacacaaa

SEQ ID NO: 41365 - RNA, 64 nt, hsa
uucuuuucuaaaaugaagugagauuguucacacacacacacacacacacacacacacacaaaca

SEQ ID NO: 41366 - RNA, 64 nt, hsa
cuuuucuaaaaugaagugagauuguucacacacacacacacacacacacacacacacaaacaca

SEQ ID NO: 41367 - RNA, 64 nt, hsa
uuucuaaaaugaagugagauuguucacacacacacacacacacacacacacacacaaacacaaa

SEQ ID NO: 41368 - RNA, 64 nt, hsa
ucuaaaaugaagugagauuguucacacacacacacacacacacacacacacacaaacacaaagg

SEQ ID NO: 41369 - RNA, 64 nt, hsa
uaaaaugaagugagauuguucacacacacacacacacacacacacacacacaaacacaaaggac

SEQ ID NO: 41370 - RNA, 64 nt, hsa
aaaugaagugagauuguucacacacacacacacacacacacacacacacaaacacaaaggacag

SEQ ID NO: 41371 - RNA, 64 nt, hsa
augaagugagauuguucacacacacacacacacacacacacacacacaaacacaaaggacaguc

SEQ ID NO: 41372 - RNA, 64 nt, hsa
gaagugagauuguucacacacacacacacacacacacacacacacaaacacaaaggacagucau

SEQ ID NO: 41373 - RNA, 64 nt, hsa
agugagauuguucacacacacacacacacacacacacacacacaaacacaaaggacagucauac

SEQ ID NO: 41374 - RNA, 64 nt, hsa
ugagauuguucacacacacacacacacacacacacacacacaaacacaaaggacagucauacau

SEQ ID NO: 41375 - RNA, 64 nt, hsa
cuagcucacacucauccacacuuaagcccucgugcacacacacaaauuauucagauguacaccc

SEQ ID NO: 41376 - RNA, 64 nt, hsa
agcucacacucauccacacuuaagcccucgugcacacacacaaauuauucagauguacacccac

SEQ ID NO: 41377 - RNA, 64 nt, hsa
gccugucugucaauuucugguugggcugggaggccacacacacacacugacaugacagggcuug

SEQ ID NO: 41378 - RNA, 64 nt, hsa
cugucugucaauuucugguugggcugggaggccacacacacacacugacaugacagggcuuggg

SEQ ID NO: 41379 - RNA, 64 nt, hsa
gucugucaauuucugguugggcugggaggccacacacacacacugacaugacagggcuugggca

SEQ ID NO: 41380 - RNA, 64 nt, hsa
cuccuuccucucguccuuggauagauucagcucccacacacacacccgcacugcccaggucccu

SEQ ID NO: 41381 - RNA, 64 nt, hsa
ccuuccucucguccuuggauagauucagcucccacacacacacccgcacugcccaggucccucc

SEQ ID NO: 41382 - RNA, 64 nt, hsa
gggcugggggaagaugcccucaacucacccccuacacacacaugagagagagcccccacccagu

SEQ ID NO: 41383 - RNA, 64 nt, hsa
cagccaccagcacccccauagggcccccagacaccacacacaugcgcgugcgcacacacacaaa

SEQ ID NO: 41384 - RNA, 64 nt, hsa
uagggcccccagacaccacacacaugcgcgugcgcacacacacaaacacacacacacuggacag

SEQ ID NO: 41385 - RNA, 64 nt, hsa
gggcccccagacaccacacacaugcgcgugcgcacacacacaaacacacacacacuggacagua

SEQ ID NO: 41386 - RNA, 64 nt, hsa
acaccacacacaugcgcgugcgcacacacacaaacacacacacacuggacaguagaugggccga

SEQ ID NO: 41387 - RNA, 64 nt, hsa
accacacacaugcgcgugcgcacacacacaaacacacacacacuggacaguagaugggccgaca

SEQ ID NO: 41388 - RNA, 64 nt, hsa
uaggggccccacccucugggcuucccaucagcgacacacacacacuuauggcaccagccuggac

SEQ ID NO: 41389 - RNA, 64 nt, hsa
ggggccccacccucugggcuucccaucagcgacacacacacacuuauggcaccagccuggacuc

SEQ ID NO: 41390 - RNA, 64 nt, hsa
guguccagguauuguguguaugcauuuaguugugcacacacaaauaugcuccuauacuggcauu

SEQ ID NO: 41391 - RNA, 64 nt, hsa
gcaggugcccggggcugggugaguggaauuaggacacacacaggcuugggcuucaaguucauuu

SEQ ID NO: 41392 - RNA, 64 nt, hsa
gauguaaaaaaaaaaaaaaaaaaaaaaaaaaaaacacacacacagaggaaagacgcucuuuagg

SEQ ID NO: 41393 - RNA, 64 nt, hsa
uguaaaaaaaaaaaaaaaaaaaaaaaaaaaaacacacacacagaggaaagacgcucuuuagguu

SEQ ID NO: 41394 - RNA, 64 nt, hsa
aaggaccccucaccuugcaacacacagacacacgcacacacacacacaggaggagaaaucucac

SEQ ID NO: 41395 - RNA, 64 nt, hsa
ggaccccucaccuugcaacacacagacacacgcacacacacacacaggaggagaaaucucacuu

SEQ ID NO: 41396 - RNA, 64 nt, hsa
accccucaccuugcaacacacagacacacgcacacacacacacaggaggagaaaucucacuuuu

SEQ ID NO: 41397 - RNA, 64 nt, hsa
cccucaccuugcaacacacagacacacgcacacacacacacaggaggagaaaucucacuuuucu

SEQ ID NO: 41398 - RNA, 64 nt, hsa
cuuucuaugaaaggagcugcuauguacacaugugcacacacacacaacugggaaucaacaauga

SEQ ID NO: 41399 - RNA, 64 nt, hsa
uucuaugaaaggagcugcuauguacacaugugcacacacacacaacugggaaucaacaaugagu

SEQ ID NO: 41400 - RNA, 64 nt, hsa
cuaugaaaggagcugcuauguacacaugugcacacacacacaacugggaaucaacaaugaguuu

SEQ ID NO: 41401 - RNA, 64 nt, hsa
uuauuuguuuauguuauuuaaauacacacccagacacacacacacacaguuuuugcuuuuucug

SEQ ID NO: 41402 - RNA, 64 nt, hsa
auuuguuuauguuauuuaaauacacacccagacacacacacacacaguuuuugcuuuuucugga

SEQ ID NO: 41403 - RNA, 64 nt, hsa
uuguuuauguuauuuaaauacacacccagacacacacacacacaguuuuugcuuuuucuggaaa

SEQ ID NO: 41404 - RNA, 64 nt, hsa
guuuauguuauuuaaauacacacccagacacacacacacacaguuuuugcuuuuucuggaaaau

SEQ ID NO: 41405 - RNA, 64 nt, hsa
cuuuuuuauuuuaagaggaagaagaagaaaggggcacacacacacaauaccgacgucuauccuu

SEQ ID NO: 41406 - RNA, 64 nt, hsa
uuuuuauuuuaagaggaagaagaagaaaggggcacacacacacaauaccgacgucuauccuuuc

SEQ ID NO: 41407 - RNA, 64 nt, hsa
uuuauuuuaagaggaagaagaagaaaggggcacacacacacaauaccgacgucuauccuuuccu

SEQ ID NO: 41408 - RNA, 64 nt, hsa
cuuccagccugggacacacacacacacacacacacacacacacgcacgcacacgcacacaucuu

SEQ ID NO: 41409 - RNA, 64 nt, hsa
cccuuccagccugggacacacacacacacacacacacacacacacgcacgcacacgcacacauc

SEQ ID NO: 41410 - RNA, 64 nt, hsa
agcccuuccagccugggacacacacacacacacacacacacacacacgcacgcacacgcacaca

SEQ ID NO: 41411 - RNA, 64 nt, hsa
cuagcccuuccagccugggacacacacacacacacacacacacacacacgcacgcacacgcaca

SEQ ID NO: 41412 - RNA, 64 nt, hsa
cccuagcccuuccagccugggacacacacacacacacacacacacacacacgcacgcacacgca

SEQ ID NO: 41413 - RNA, 64 nt, hsa
cucccuagcccuuccagccugggacacacacacacacacacacacacacacacgcacgcacacg

SEQ ID NO: 41414 - RNA, 64 nt, hsa
cccucccuagcccuuccagccugggacacacacacacacacacacacacacacacgcacgcaca

SEQ ID NO: 41415 - RNA, 64 nt, hsa
cucccucccuagcccuuccagccugggacacacacacacacacacacacacacacacgcacgca

SEQ ID NO: 41416 - RNA, 64 nt, hsa
cccucccucccuagcccuuccagccugggacacacacacacacacacacacacacacacgcacg

SEQ ID NO: 41417 - RNA, 64 nt, hsa
ggcccucccucccuagcccuuccagccugggacacacacacacacacacacacacacacacgca

SEQ ID NO: 41418 - RNA, 64 nt, hsa
cuggcccucccucccuagcccuuccagccugggacacacacacacacacacacacacacacacg

SEQ ID NO: 41419 - RNA, 64 nt, hsa
cacaaccaucuacacacaucuacacccccaagcacacacacaugguccgugccaugucaccucc

SEQ ID NO: 41420 - RNA, 64 nt, hsa
aacacaaccaucuacacacaucuacacccccaagcacacacacaugguccgugccaugucaccu

SEQ ID NO: 41421 - RNA, 64 nt, hsa
cacauauugagacuuaggaagagccacaagaccacacacacagcccuuacccuccucaggacua

SEQ ID NO: 41422 - RNA, 64 nt, hsa
gacacauauugagacuuaggaagagccacaagaccacacacacagcccuuacccuccucaggac

SEQ ID NO: 41423 - RNA, 64 nt, hsa
caccgggggccaccugcccucccccauccucucccacacacauuccagaagucagggcccccuc

SEQ ID NO: 41424 - RNA, 64 nt, hsa
uccuuaggauccccgcccccaccugcccccaaugcacacacagacccaccgggggccaccugcc

SEQ ID NO: 41425 - RNA, 64 nt, hsa
ucuacuucaagaccaccucucccugcaaacaccacacacacauggcaugcauguacgcacaugc

SEQ ID NO: 41426 - RNA, 64 nt, hsa
ucucuacuucaagaccaccucucccugcaaacaccacacacacauggcaugcauguacgcacau

SEQ ID NO: 41427 - RNA, 64 nt, hsa
cacacaugcacacacacgcgcgcgcacacacacacacacacauccaccccagggccaagagaaa

SEQ ID NO: 41428 - RNA, 64 nt, hsa
cacacacaugcacacacacgcgcgcgcacacacacacacacacauccaccccagggccaagaga

SEQ ID NO: 41429 - RNA, 64 nt, hsa
cacacacacaugcacacacacgcgcgcgcacacacacacacacacauccaccccagggccaaga

SEQ ID NO: 41430 - RNA, 64 nt, hsa
cacacacacacaugcacacacacgcgcgcgcacacacacacacacacauccaccccagggccaa

SEQ ID NO: 41431 - RNA, 64 nt, hsa
cacacacacacacaugcacacacacgcgcgcgcacacacacacacacacauccaccccagggcc

SEQ ID NO: 41432 - RNA, 64 nt, hsa
ugcacacacacacacaugcacacacacgcgcgcgcacacacacacacacacauccaccccaggg

SEQ ID NO: 41433 - RNA, 64 nt, hsa
cacccgugagcgccugugcacacacacacacaugcacacacacgcgcgcgcacacacacacaca

SEQ ID NO: 41434 - RNA, 64 nt, hsa
acucacaugacacccgugagcgccugugcacacacacacacaugcacacacacgcgcgcgcaca

SEQ ID NO: 41435 - RNA, 64 nt, hsa
ccacucacaugacacccgugagcgccugugcacacacacacacaugcacacacacgcgcgcgca

SEQ ID NO: 41436 - RNA, 64 nt, hsa
uaccacucacaugacacccgugagcgccugugcacacacacacacaugcacacacacgcgcgcg

SEQ ID NO: 41437 - RNA, 64 nt, hsa
ccuaccacucacaugacacccgugagcgccugugcacacacacacacaugcacacacacgcgcg

SEQ ID NO: 41438 - RNA, 64 nt, hsa
aacaaguugucuggccugacacagcaucacaucacacacacagaaauuaguauauccauguaug

SEQ ID NO: 41439 - RNA, 64 nt, hsa
auaacaaguugucuggccugacacagcaucacaucacacacacagaaauuaguauauccaugua

SEQ ID NO: 41440 - RNA, 64 nt, hsa
uauacauauaugucuauauauauauauagacacacacacacagacauauauuuccuucuuuaag

SEQ ID NO: 41441 - RNA, 64 nt, hsa
aguauacauauaugucuauauauauauauagacacacacacacagacauauauuuccuucuuua

SEQ ID NO: 41442 - RNA, 64 nt, hsa
aaaguauacauauaugucuauauauauauauagacacacacacacagacauauauuuccuucuu

SEQ ID NO: 41443 - RNA, 64 nt, hsa
cagccuuguuuaauguuuugagcaauaagauaugcacacacagguauuuuguugcuaaagagau

SEQ ID NO: 41444 - RNA, 64 nt, hsa
ccacagcaggaacugccccacuggccauuugagacacacacaggugguaaaugcucugcuggug

SEQ ID NO: 41445 - RNA, 64 nt, hsa
cacacacacacacacacacacacacacacacacacacacacacgccccucuacugcuauguggc

SEQ ID NO: 41446 - RNA, 64 nt, hsa
cacacacacacacacacacacacacacacacacacacacacacacacacacacgccccucuacu

SEQ ID NO: 41447 - RNA, 64 nt, hsa
cacacacacacacacacacacacacacacacacacacacacacacacacacacacgccccucua

SEQ ID NO: 41448 - RNA, 64 nt, hsa
cacacacacacacacacacacacacacacacacacacacacacacacacacacacacgccccuc

SEQ ID NO: 41449 - RNA, 64 nt, hsa
cacacacacacacacacacacacacacacacacacacacacacacacacacacacacacgcccc

SEQ ID NO: 41450 - RNA, 64 nt, hsa
aacacacacacacacacacacacacacacacacacacacacacacacacacacacacacacgcc

SEQ ID NO: 41451 - RNA, 64 nt, hsa
ccaacacacacacacacacacacacacacacacacacacacacacacacacacacacacacacg

SEQ ID NO: 41452 - RNA, 64 nt, hsa
cuccaacacacacacacacacacacacacacacacacacacacacacacacacacacacacaca

SEQ ID NO: 41453 - RNA, 64 nt, hsa
cgcuccaacacacacacacacacacacacacacacacacacacacacacacacacacacacaca

SEQ ID NO: 41454 - RNA, 64 nt, hsa
cacgcuccaacacacacacacacacacacacacacacacacacacacacacacacacacacaca

SEQ ID NO: 41455 - RNA, 64 nt, hsa
cccacgcuccaacacacacacacacacacacacacacacacacacacacacacacacacacaca

SEQ ID NO: 41456 - RNA, 64 nt, hsa
aacccacgcuccaacacacacacacacacacacacacacacacacacacacacacacacacaca

SEQ ID NO: 41457 - RNA, 64 nt, hsa
ccaacccacgcuccaacacacacacacacacacacacacacacacacacacacacacacacaca

SEQ ID NO: 41458 - RNA, 64 nt, hsa
ccccaacccacgcuccaacacacacacacacacacacacacacacacacacacacacacacaca

SEQ ID NO: 41459 - RNA, 64 nt, hsa
ucccccaacccacgcuccaacacacacacacacacacacacacacacacacacacacacacaca

SEQ ID NO: 41460 - RNA, 64 nt, hsa
ccucccccaacccacgcuccaacacacacacacacacacacacacacacacacacacacacaca

SEQ ID NO: 41461 - RNA, 64 nt, hsa
gcccucccccaacccacgcuccaacacacacacacacacacacacacacacacacacacacaca

SEQ ID NO: 41462 - RNA, 64 nt, hsa
gagcccucccccaacccacgcuccaacacacacacacacacacacacacacacacacacacaca

SEQ ID NO: 41463 - RNA, 64 nt, hsa
cugagcccucccccaacccacgcuccaacacacacacacacacacacacacacacacacacaca

SEQ ID NO: 41464 - RNA, 64 nt, hsa
ugcugagcccucccccaacccacgcuccaacacacacacacacacacacacacacacacacaca

SEQ ID NO: 41465 - RNA, 64 nt, hsa
cuugcugagcccucccccaacccacgcuccaacacacacacacacacacacacacacacacaca

SEQ ID NO: 41466 - RNA, 64 nt, hsa
gucuugcugagcccucccccaacccacgcuccaacacacacacacacacacacacacacacaca

SEQ ID NO: 41467 - RNA, 64 nt, hsa
auugggcagugguucacuuuaaaacacacacauacacacacaaaacaauuuuuuaagaaauccu

SEQ ID NO: 41468 - RNA, 64 nt, hsa
aaacuuucauauugggcagugguucacuuuaaaacacacacauacacacacaaaacaauuuuuu

SEQ ID NO: 41469 - RNA, 64 nt, hsa
ugccagauagugcaguguuuuggucacgguaacacacacacacucucccucaucuuucgugccc

SEQ ID NO: 41470 - RNA, 64 nt, hsa
acugccagauagugcaguguuuuggucacgguaacacacacacacucucccucaucuuucgugc

SEQ ID NO: 41471 - RNA, 64 nt, hsa
cauacauacaaacacaugcaaacauaccuacacacacacacacucuuacaaccuccaucauggg

SEQ ID NO: 41472 - RNA, 64 nt, hsa
cacauacauacaaacacaugcaaacauaccuacacacacacacacucuuacaaccuccaucaug

SEQ ID NO: 41473 - RNA, 64 nt, hsa
ugcacauacauacaaacacaugcaaacauaccuacacacacacacacucuuacaaccuccauca

SEQ ID NO: 41474 - RNA, 64 nt, hsa
agaggaauacaucucucacacauacucacaaacacacacacaagcacuugcacauacauacaaa

SEQ ID NO: 41475 - RNA, 64 nt, hsa
gcagaggaauacaucucucacacauacucacaaacacacacacaagcacuugcacauacauaca

SEQ ID NO: 41476 - RNA, 64 nt, hsa
gcccaaucccaguaaugcugcugccugacagaaacacacacacagccacaguugccaaaucccg

SEQ ID NO: 41477 - RNA, 64 nt, hsa
ccaaucccaguaaugcugcugccugacagaaacacacacacagccacaguugccaaaucccgua

SEQ ID NO: 41478 - RNA, 64 nt, hsa
guuggcuacuauuacaccuuaaaaauugaguuuacacacacacaauuaccuguuuauauggugc

SEQ ID NO: 41479 - RNA, 64 nt, hsa
uggcuacuauuacaccuuaaaaauugaguuuacacacacacaauuaccuguuuauauggugcuc

SEQ ID NO: 41480 - RNA, 64 nt, hsa
cucuugggucaacuggcuuacagauuuacaugugcacacacacacaaauuucuuaucacauuuu

SEQ ID NO: 41481 - RNA, 64 nt, hsa
cuugggucaacuggcuuacagauuuacaugugcacacacacacaaauuucuuaucacauuuucg

SEQ ID NO: 41482 - RNA, 64 nt, hsa
ugggucaacuggcuuacagauuuacaugugcacacacacacaaauuucuuaucacauuuucgac

SEQ ID NO: 41483 - RNA, 64 nt, hsa
acauauaaacaucacacacacagacagacacacacacacacaacaauuaacagucuucaggcaa

SEQ ID NO: 41484 - RNA, 64 nt, hsa
acacauauaaacaucacacacacagacagacacacacacacacaacaauuaacagucuucaggc

SEQ ID NO: 41485 - RNA, 64 nt, hsa
acacacauauaaacaucacacacacagacagacacacacacacacaacaauuaacagucuucag

SEQ ID NO: 41486 - RNA, 64 nt, hsa
uaacacacauauaaacaucacacacacagacagacacacacacacacaacaauuaacagucuuc

SEQ ID NO: 41487 - RNA, 64 nt, hsa
uguuuaagaaaaaauaacacacauauaaacaucacacacacagacagacacacacacacacaac

SEQ ID NO: 41488 - RNA, 64 nt, hsa
gcuguuuaagaaaaaauaacacacauauaaacaucacacacacagacagacacacacacacaca

SEQ ID NO: 41489 - RNA, 64 nt, hsa
uucaacuugcaaacugacuuuugggacaaaccaacacacacacagaagagaaagcaaagaacuu

SEQ ID NO: 41490 - RNA, 64 nt, hsa
caacuugcaaacugacuuuugggacaaaccaacacacacacagaagagaaagcaaagaacuugg

SEQ ID NO: 41491 - RNA, 64 nt, hsa
uagucugaaacagaccugaacagacagacagacgcacacacacaacagaugcgcagcaacuccc

SEQ ID NO: 41492 - RNA, 64 nt, hsa
gucugaaacagaccugaacagacagacagacgcacacacacaacagaugcgcagcaacuccccg

SEQ ID NO: 41493 - RNA, 64 nt, hsa
agccucccgcggggccacacacuuccccucccaacacacacacacaccugccaucuuggucaug

SEQ ID NO: 41494 - RNA, 64 nt, hsa
ccucccgcggggccacacacuuccccucccaacacacacacacaccugccaucuuggucaugag

SEQ ID NO: 41495 - RNA, 64 nt, hsa
ucccgcggggccacacacuuccccucccaacacacacacacaccugccaucuuggucaugagcu

SEQ ID NO: 41496 - RNA, 64 nt, hsa
agagaugcucaguguuaaaacugaaacacacaaacacacacacacacacauuuuucucuuguag

SEQ ID NO: 41497 - RNA, 64 nt, hsa
agaugcucaguguuaaaacugaaacacacaaacacacacacacacacauuuuucucuuguagau

SEQ ID NO: 41498 - RNA, 64 nt, hsa
augcucaguguuaaaacugaaacacacaaacacacacacacacacauuuuucucuuguagauuu

SEQ ID NO: 41499 - RNA, 64 nt, hsa
gcucaguguuaaaacugaaacacacaaacacacacacacacacauuuuucucuuguagauuuua

SEQ ID NO: 41500 - RNA, 64 nt, hsa
ucaguguuaaaacugaaacacacaaacacacacacacacacauuuuucucuuguagauuuuaau

SEQ ID NO: 41501 - RNA, 64 nt, hsa
accgccacauggcuuccuccugcgcgcaugugcgcacacacacacacacacgcacacacacaca

SEQ ID NO: 41502 - RNA, 64 nt, hsa
cgccacauggcuuccuccugcgcgcaugugcgcacacacacacacacacgcacacacacacaca

SEQ ID NO: 41503 - RNA, 64 nt, hsa
ccacauggcuuccuccugcgcgcaugugcgcacacacacacacacacgcacacacacacacaca

SEQ ID NO: 41504 - RNA, 64 nt, hsa
acauggcuuccuccugcgcgcaugugcgcacacacacacacacacgcacacacacacacacaca

SEQ ID NO: 41505 - RNA, 64 nt, hsa
auggcuuccuccugcgcgcaugugcgcacacacacacacacacgcacacacacacacacacacu

SEQ ID NO: 41506 - RNA, 64 nt, hsa
ccugcgcgcaugugcgcacacacacacacacacgcacacacacacacacacacucacugcggag

SEQ ID NO: 41507 - RNA, 64 nt, hsa
ugcgcgcaugugcgcacacacacacacacacgcacacacacacacacacacucacugcggagaa

SEQ ID NO: 41508 - RNA, 64 nt, hsa
cgcgcaugugcgcacacacacacacacacgcacacacacacacacacacucacugcggagaacc

SEQ ID NO: 41509 - RNA, 64 nt, hsa
cgcaugugcgcacacacacacacacacgcacacacacacacacacacucacugcggagaaccuu

SEQ ID NO: 41510 - RNA, 64 nt, hsa
caugugcgcacacacacacacacacgcacacacacacacacacacucacugcggagaaccuugu

SEQ ID NO: 41511 - RNA, 64 nt, hsa
ugugcgcacacacacacacacacgcacacacacacacacacacucacugcggagaaccuugugc

SEQ ID NO: 41512 - RNA, 64 nt, hsa
cacaugguaaccuacuguuugccagccuguaaaacacacacacacacacacacacacacacaaa

SEQ ID NO: 41513 - RNA, 64 nt, hsa
caugguaaccuacuguuugccagccuguaaaacacacacacacacacacacacacacacaaaua

SEQ ID NO: 41514 - RNA, 64 nt, hsa
ugguaaccuacuguuugccagccuguaaaacacacacacacacacacacacacacacaaauauu

SEQ ID NO: 41515 - RNA, 64 nt, hsa
guaaccuacuguuugccagccuguaaaacacacacacacacacacacacacacacaaauauuau

SEQ ID NO: 41516 - RNA, 64 nt, hsa
aaccuacuguuugccagccuguaaaacacacacacacacacacacacacacacaaauauuauua

SEQ ID NO: 41517 - RNA, 64 nt, hsa
ccuacuguuugccagccuguaaaacacacacacacacacacacacacacacaaauauuauuaga

SEQ ID NO: 41518 - RNA, 64 nt, hsa
uacuguuugccagccuguaaaacacacacacacacacacacacacacacaaauauuauuagaca

SEQ ID NO: 41519 - RNA, 64 nt, hsa
cuguuugccagccuguaaaacacacacacacacacacacacacacacaaauauuauuagacaaa

SEQ ID NO: 41520 - RNA, 64 nt, hsa
guuugccagccuguaaaacacacacacacacacacacacacacacaaauauuauuagacaaauu

SEQ ID NO: 41521 - RNA, 64 nt, hsa
uugccagccuguaaaacacacacacacacacacacacacacacaaauauuauuagacaaauuag

SEQ ID NO: 41522 - RNA, 64 nt, hsa
gccagccuguaaaacacacacacacacacacacacacacacaaauauuauuagacaaauuagau

SEQ ID NO: 41523 - RNA, 64 nt, hsa
caccagcagugguggagaugucgguccaugagcgcacacacaagacugagggacugucggcccu

SEQ ID NO: 41524 - RNA, 64 nt, hsa
cugucggcccucccagguggugucaacacaacaucacacacaggugggggggccugauagccca

SEQ ID NO: 41525 - RNA, 64 nt, hsa
guaaccacguggaaagcggccccugcugccccuccacacacacauacacacucacugaucuaca

SEQ ID NO: 41526 - RNA, 64 nt, hsa
aaccacguggaaagcggccccugcugccccuccacacacacauacacacucacugaucuacagc

SEQ ID NO: 41527 - RNA, 64 nt, hsa
agacccccgcaggccaccaggcauucuggacacgcacacacacacacacacacacacacacaca

SEQ ID NO: 41528 - RNA, 64 nt, hsa
acccccgcaggccaccaggcauucuggacacgcacacacacacacacacacacacacacacaca

SEQ ID NO: 41529 - RNA, 64 nt, hsa
ccccgcaggccaccaggcauucuggacacgcacacacacacacacacacacacacacacacaaa

SEQ ID NO: 41530 - RNA, 64 nt, hsa
ccgcaggccaccaggcauucuggacacgcacacacacacacacacacacacacacacacaaaac

SEQ ID NO: 41531 - RNA, 64 nt, hsa
gcaggccaccaggcauucuggacacgcacacacacacacacacacacacacacacacaaaacuu

SEQ ID NO: 41532 - RNA, 64 nt, hsa
aggccaccaggcauucuggacacgcacacacacacacacacacacacacacacacaaaacuuca

SEQ ID NO: 41533 - RNA, 64 nt, hsa
gccaccaggcauucuggacacgcacacacacacacacacacacacacacacacaaaacuucaca

SEQ ID NO: 41534 - RNA, 64 nt, hsa
caccaggcauucuggacacgcacacacacacacacacacacacacacacacaaaacuucacagc

SEQ ID NO: 41535 - RNA, 64 nt, hsa
ccaggcauucuggacacgcacacacacacacacacacacacacacacacaaaacuucacagcag

SEQ ID NO: 41536 - RNA, 64 nt, hsa
aggcauucuggacacgcacacacacacacacacacacacacacacacaaaacuucacagcaggc

SEQ ID NO: 41537 - RNA, 64 nt, hsa
gcauucuggacacgcacacacacacacacacacacacacacacacaaaacuucacagcaggcca

SEQ ID NO: 41538 - RNA, 64 nt, hsa
auucuggacacgcacacacacacacacacacacacacacacacaaaacuucacagcaggccagc

SEQ ID NO: 41539 - RNA, 64 nt, hsa
ucuggacacgcacacacacacacacacacacacacacacacaaaacuucacagcaggccagcug

SEQ ID NO: 41540 - RNA, 64 nt, hsa
ucacaccuccagccucacguucacuuaggcacaucacacacacacuggcacacgcaggcaucca

SEQ ID NO: 41541 - RNA, 64 nt, hsa
acaccuccagccucacguucacuuaggcacaucacacacacacuggcacacgcaggcauccauc

SEQ ID NO: 41542 - RNA, 64 nt, hsa
ucucugaagacuucucgcucaguuucagugaggacacacacaaagacgugggugaccauguugu

SEQ ID NO: 41543 - RNA, 64 nt, hsa
cacugaggauaagcuggagccacaaugcaugaggcacacacacagcaaggaugacgcuguaaac

SEQ ID NO: 41544 - RNA, 64 nt, hsa
cugaggauaagcuggagccacaaugcaugaggcacacacacagcaaggaugacgcuguaaacau

SEQ ID NO: 41545 - RNA, 64 nt, hsa
uuucaaacucuuaugcacucaugaaacacacagacacacacacacacaaacuugcauaaauuuu

SEQ ID NO: 41546 - RNA, 64 nt, hsa
ucaaacucuuaugcacucaugaaacacacagacacacacacacacaaacuugcauaaauuuucc

SEQ ID NO: 41547 - RNA, 64 nt, hsa
aaacucuuaugcacucaugaaacacacagacacacacacacacaaacuugcauaaauuuucccu

SEQ ID NO: 41548 - RNA, 64 nt, hsa
acucuuaugcacucaugaaacacacagacacacacacacacaaacuugcauaaauuuucccuga

SEQ ID NO: 41549 - RNA, 64 nt, hsa
cacauauuuaaaguguacgaguuaagucuugauacacacacacacacacacacacacacacaca

SEQ ID NO: 41550 - RNA, 64 nt, hsa
cauauuuaaaguguacgaguuaagucuugauacacacacacacacacacacacacacacacaca

SEQ ID NO: 41551 - RNA, 64 nt, hsa
uauuuaaaguguacgaguuaagucuugauacacacacacacacacacacacacacacacacaca

SEQ ID NO: 41552 - RNA, 64 nt, hsa
uuuaaaguguacgaguuaagucuugauacacacacacacacacacacacacacacacacacaca

SEQ ID NO: 41553 - RNA, 64 nt, hsa
uaaaguguacgaguuaagucuugauacacacacacacacacacacacacacacacacacacacu

SEQ ID NO: 41554 - RNA, 64 nt, hsa
aaguguacgaguuaagucuugauacacacacacacacacacacacacacacacacacacacuug

SEQ ID NO: 41555 - RNA, 64 nt, hsa
guguacgaguuaagucuugauacacacacacacacacacacacacacacacacacacacuugaa

SEQ ID NO: 41556 - RNA, 64 nt, hsa
guacgaguuaagucuugauacacacacacacacacacacacacacacacacacacacuugaaac

SEQ ID NO: 41557 - RNA, 64 nt, hsa
acgaguuaagucuugauacacacacacacacacacacacacacacacacacacacuugaaacua

SEQ ID NO: 41558 - RNA, 64 nt, hsa
gaguuaagucuugauacacacacacacacacacacacacacacacacacacacuugaaacuauc

SEQ ID NO: 41559 - RNA, 64 nt, hsa
guuaagucuugauacacacacacacacacacacacacacacacacacacacuugaaacuaucac

SEQ ID NO: 41560 - RNA, 64 nt, hsa
uaagucuugauacacacacacacacacacacacacacacacacacacacuugaaacuaucaccc

SEQ ID NO: 41561 - RNA, 64 nt, hsa
agucuugauacacacacacacacacacacacacacacacacacacacuugaaacuaucacccua

SEQ ID NO: 41562 - RNA, 64 nt, hsa
ucuugauacacacacacacacacacacacacacacacacacacacuugaaacuaucacccuauc

SEQ ID NO: 41563 - RNA, 64 nt, hsa
uugauacacacacacacacacacacacacacacacacacacacuugaaacuaucacccuaucag

SEQ ID NO: 41564 - RNA, 64 nt, hsa
cccagacacugugcugucucugcucucugcuacucacacacacccucaugugugaagggcagag

SEQ ID NO: 41565 - RNA, 64 nt, hsa
gcuguccuggcugagccccugcaggagccccggccacacacagcaagaaagauacaucugacca

SEQ ID NO: 41566 - RNA, 64 nt, hsa
aagagaguuaaggacacucacccccacccacgcacacacacaaggcagcgucgggugggagaga

SEQ ID NO: 41567 - RNA, 64 nt, hsa
aaaagagaguuaaggacacucacccccacccacgcacacacacaaggcagcgucgggugggaga

SEQ ID NO: 41568 - RNA, 64 nt, hsa
cauauacacacacacacacacacacacacacacacacacacauauauauauauauauauuuuuu

SEQ ID NO: 41569 - RNA, 64 nt, hsa
uacauauacacacacacacacacacacacacacacacacacacauauauauauauauauauuuu

SEQ ID NO: 41570 - RNA, 64 nt, hsa
uauacauauacacacacacacacacacacacacacacacacacacauauauauauauauauauu

SEQ ID NO: 41571 - RNA, 64 nt, hsa
uauauacauauacacacacacacacacacacacacacacacacacacauauauauauauauaua

SEQ ID NO: 41572 - RNA, 64 nt, hsa
cauauauacauauacacacacacacacacacacacacacacacacacacauauauauauauaua

SEQ ID NO: 41573 - RNA, 64 nt, hsa
cacauauauacauauacacacacacacacacacacacacacacacacacacauauauauauaua

SEQ ID NO: 41574 - RNA, 64 nt, hsa
cacacauauauacauauacacacacacacacacacacacacacacacacacacauauauauaua

SEQ ID NO: 41575 - RNA, 64 nt, hsa
cacacacauauauacauauacacacacacacacacacacacacacacacacacacauauauaua

SEQ ID NO: 41576 - RNA, 64 nt, hsa
cacacacacauauauacauauacacacacacacacacacacacacacacacacacacauauaua

SEQ ID NO: 41577 - RNA, 64 nt, hsa
cacacacacacauauauacauauacacacacacacacacacacacacacacacacacacauaua

SEQ ID NO: 41578 - RNA, 64 nt, hsa
cacacacacacacauauauacauauacacacacacacacacacacacacacacacacacacaua

SEQ ID NO: 41579 - RNA, 64 nt, hsa
cacacacacacacacauauauacauauacacacacacacacacacacacacacacacacacaca

SEQ ID NO: 41580 - RNA, 64 nt, hsa
cacacacacacacacacauauauacauauacacacacacacacacacacacacacacacacaca

SEQ ID NO: 41581 - RNA, 64 nt, hsa
cacacacacacacacacacauauauacauauacacacacacacacacacacacacacacacaca

SEQ ID NO: 41582 - RNA, 64 nt, hsa
cacacacacacacacacacacauauauacauauacacacacacacacacacacacacacacaca

SEQ ID NO: 41583 - RNA, 64 nt, hsa
uauauauauauauauacacacacacacacacacacacacacauauauacauauacacacacaca

SEQ ID NO: 41584 - RNA, 64 nt, hsa
uauauauauauauauauacacacacacacacacacacacacacauauauacauauacacacaca

SEQ ID NO: 41585 - RNA, 64 nt, hsa
auuauauauauauauauauacacacacacacacacacacacacacauauauacauauacacaca

SEQ ID NO: 41586 - RNA, 64 nt, hsa
auauuauauauauauauauauacacacacacacacacacacacacacauauauacauauacaca

SEQ ID NO: 41587 - RNA, 64 nt, hsa
auauauuauauauauauauauauacacacacacacacacacacacacacauauauacauauaca

SEQ ID NO: 41588 - RNA, 64 nt, hsa
auauauauuauauauauauauauauacacacacacacacacacacacacacauauauacauaua

SEQ ID NO: 41589 - RNA, 64 nt, hsa
auauauauauuauauauauauauauauacacacacacacacacacacacacacauauauacaua

SEQ ID NO: 41590 - RNA, 64 nt, hsa
auauauauauauuauauauauauauauauacacacacacacacacacacacacacauauauaca

SEQ ID NO: 41591 - RNA, 64 nt, hsa
auauauauauauauuauauauauauauauauacacacacacacacacacacacacacauauaua

SEQ ID NO: 41592 - RNA, 64 nt, hsa
auauauauauauauauuauauauauauauauauacacacacacacacacacacacacacauaua

SEQ ID NO: 41593 - RNA, 64 nt, hsa
uauggcaccaacaucacaugcacgcaugcccuuucacacacacuuucuacccaauucucaccua

SEQ ID NO: 41594 - RNA, 64 nt, hsa
cgcggcgauggcaucacacagacggugaugaugucacacacagacacagugacaacacacacca

SEQ ID NO: 41595 - RNA, 64 nt, hsa
acacacuauauauauauauauauauacacacacacacacacaauauauguauauauaguauaua

SEQ ID NO: 41596 - RNA, 64 nt, hsa
uaacacacuauauauauauauauauauacacacacacacacacaauauauguauauauaguaua

SEQ ID NO: 41597 - RNA, 64 nt, hsa
cauaacacacuauauauauauauauauauacacacacacacacacaauauauguauauauagua

SEQ ID NO: 41598 - RNA, 64 nt, hsa
uacauaacacacuauauauauauauauauauacacacacacacacacaauauauguauauauag

SEQ ID NO: 41599 - RNA, 64 nt, hsa
acuacauaacacacuauauauauauauauauauacacacacacacacacaauauauguauauau

SEQ ID NO: 41600 - RNA, 64 nt, hsa
cugguuauauuccaccauaacacacacacacacacacacacacuauauacauauaguguauaua

SEQ ID NO: 41601 - RNA, 64 nt, hsa
aacugguuauauuccaccauaacacacacacacacacacacacacuauauacauauaguguaua

SEQ ID NO: 41602 - RNA, 64 nt, hsa
ggaacugguuauauuccaccauaacacacacacacacacacacacacuauauacauauagugua

SEQ ID NO: 41603 - RNA, 64 nt, hsa
uaggaacugguuauauuccaccauaacacacacacacacacacacacacuauauacauauagug

SEQ ID NO: 41604 - RNA, 64 nt, hsa
cauaggaacugguuauauuccaccauaacacacacacacacacacacacacuauauacauauag

SEQ ID NO: 41605 - RNA, 64 nt, hsa
uacauaggaacugguuauauuccaccauaacacacacacacacacacacacacuauauacauau

SEQ ID NO: 41606 - RNA, 64 nt, hsa
cauacauaggaacugguuauauuccaccauaacacacacacacacacacacacacuauauacau

SEQ ID NO: 41607 - RNA, 64 nt, hsa
cacauacauaggaacugguuauauuccaccauaacacacacacacacacacacacacuauauac

SEQ ID NO: 41608 - RNA, 64 nt, hsa
gcuauacacacacacacacacacacacacacacacacacacacgaugcauuuaauaaagaugag

SEQ ID NO: 41609 - RNA, 64 nt, hsa
gugcuauacacacacacacacacacacacacacacacacacacacgaugcauuuaauaaagaug

SEQ ID NO: 41610 - RNA, 64 nt, hsa
augugcuauacacacacacacacacacacacacacacacacacacacgaugcauuuaauaaaga

SEQ ID NO: 41611 - RNA, 64 nt, hsa
guaugugcuauacacacacacacacacacacacacacacacacacacacgaugcauuuaauaaa

SEQ ID NO: 41612 - RNA, 64 nt, hsa
aaguaugugcuauacacacacacacacacacacacacacacacacacacacgaugcauuuaaua

SEQ ID NO: 41613 - RNA, 64 nt, hsa
ugaaguaugugcuauacacacacacacacacacacacacacacacacacacacgaugcauuuaa

SEQ ID NO: 41614 - RNA, 64 nt, hsa
ccugaaguaugugcuauacacacacacacacacacacacacacacacacacacacgaugcauuu

SEQ ID NO: 41615 - RNA, 64 nt, hsa
agccugaaguaugugcuauacacacacacacacacacacacacacacacacacacacgaugcau

SEQ ID NO: 41616 - RNA, 64 nt, hsa
caagccugaaguaugugcuauacacacacacacacacacacacacacacacacacacacgaugc

SEQ ID NO: 41617 - RNA, 64 nt, hsa
cgcaagccugaaguaugugcuauacacacacacacacacacacacacacacacacacacacgau

SEQ ID NO: 41618 - RNA, 64 nt, hsa
gccgcaagccugaaguaugugcuauacacacacacacacacacacacacacacacacacacacg

SEQ ID NO: 41619 - RNA, 64 nt, hsa
gugccgcaagccugaaguaugugcuauacacacacacacacacacacacacacacacacacaca

SEQ ID NO: 41620 - RNA, 64 nt, hsa
uggugccgcaagccugaaguaugugcuauacacacacacacacacacacacacacacacacaca

SEQ ID NO: 41621 - RNA, 64 nt, hsa
gguggugccgcaagccugaaguaugugcuauacacacacacacacacacacacacacacacaca

SEQ ID NO: 41622 - RNA, 63 nt, hsa
ggguggugccgcaagccugaaguaugugcuauacacacacacacacacacacacacacacaca

SEQ ID NO: 41623 - RNA, 64 nt, hsa
uguuaaaaaacaaaaaacaaaaaacaaaaaaccacacacacauuuuguacgggguggggagggg

SEQ ID NO: 41624 - RNA, 64 nt, hsa
cuuguuaaaaaacaaaaaacaaaaaacaaaaaaccacacacacauuuuguacgggguggggagg

SEQ ID NO: 41625 - RNA, 64 nt, hsa
gucaaugggccaauccucucuguccuuucagacacacacacaccuguguccaccccuucuguuc

SEQ ID NO: 41626 - RNA, 64 nt, hsa
augucaaugggccaauccucucuguccuuucagacacacacacaccuguguccaccccuucugu

SEQ ID NO: 41627 - RNA, 64 nt, hsa
guucacccucccggguggcucacacacucucauucacacacacaaaucucaggaacaaacgguc

SEQ ID NO: 41628 - RNA, 64 nt, hsa
ucacccucccggguggcucacacacucucauucacacacacaaaucucaggaacaaacgguccc

SEQ ID NO: 41629 - RNA, 64 nt, hsa
acccagagacagcacauacgugugcacacgcaugcacacacacauucaguauuuuaaaagaaug

SEQ ID NO: 41630 - RNA, 64 nt, hsa
ccagagacagcacauacgugugcacacgcaugcacacacacauucaguauuuuaaaagaauguu

SEQ ID NO: 41631 - RNA, 64 nt, hsa
agugaagauaugcgugcacgcacagacagacagacacacacacacacacacacacacacacaca

SEQ ID NO: 41632 - RNA, 64 nt, hsa
ugaagauaugcgugcacgcacagacagacagacacacacacacacacacacacacacacacaca

SEQ ID NO: 41633 - RNA, 64 nt, hsa
aagauaugcgugcacgcacagacagacagacacacacacacacacacacacacacacacacaca

SEQ ID NO: 41634 - RNA, 64 nt, hsa
gauaugcgugcacgcacagacagacagacacacacacacacacacacacacacacacacacaca

SEQ ID NO: 41635 - RNA, 64 nt, hsa
uaugcgugcacgcacagacagacagacacacacacacacacacacacacacacacacacacaca

SEQ ID NO: 41636 - RNA, 64 nt, hsa
ugcgugcacgcacagacagacagacacacacacacacacacacacacacacacacacacacaca

SEQ ID NO: 41637 - RNA, 64 nt, hsa
cgugcacgcacagacagacagacacacacacacacacacacacacacacacacacacacacaca

SEQ ID NO: 41638 - RNA, 64 nt, hsa
ugcacgcacagacagacagacacacacacacacacacacacacacacacacacacacacacaca

SEQ ID NO: 41639 - RNA, 64 nt, hsa
cacgcacagacagacagacacacacacacacacacacacacacacacacacacacacacacagu

SEQ ID NO: 41640 - RNA, 64 nt, hsa
cgcacagacagacagacacacacacacacacacacacacacacacacacacacacacacaguca

SEQ ID NO: 41641 - RNA, 64 nt, hsa
cacagacagacagacacacacacacacacacacacacacacacacacacacacacacagucaaa

SEQ ID NO: 41642 - RNA, 64 nt, hsa
cagacagacagacacacacacacacacacacacacacacacacacacacacacacagucaaaua

SEQ ID NO: 41643 - RNA, 64 nt, hsa
gacagacagacacacacacacacacacacacacacacacacacacacacacacagucaaauacu

SEQ ID NO: 41644 - RNA, 64 nt, hsa
cagacagacacacacacacacacacacacacacacacacacacacacacacagucaaauacugu

SEQ ID NO: 41645 - RNA, 64 nt, hsa
gacagacacacacacacacacacacacacacacacacacacacacacacagucaaauacuguuc

SEQ ID NO: 41646 - RNA, 64 nt, hsa
cagacacacacacacacacacacacacacacacacacacacacacacagucaaauacuguucuc

SEQ ID NO: 41647 - RNA, 64 nt, hsa
gacacacacacacacacacacacacacacacacacacacacacacagucaaauacuguucucug

SEQ ID NO: 41648 - RNA, 64 nt, hsa
cacacacacacacacacacacacacacacacacacacacacacagucaaauacuguucucugaa

SEQ ID NO: 41649 - RNA, 64 nt, hsa
cacacacacacacacacacacacacacacacacacacacacagucaaauacuguucucugaaaa

SEQ ID NO: 41650 - RNA, 64 nt, hsa
aacuuuccaugacaguagcauacugaugagacaacacacacacacacaaaacaacagcaacaac

SEQ ID NO: 41651 - RNA, 64 nt, hsa
cuuuccaugacaguagcauacugaugagacaacacacacacacacaaaacaacagcaacaacaa

SEQ ID NO: 41652 - RNA, 64 nt, hsa
uuccaugacaguagcauacugaugagacaacacacacacacacaaaacaacagcaacaacaaca

SEQ ID NO: 41653 - RNA, 64 nt, hsa
ccaugacaguagcauacugaugagacaacacacacacacacaaaacaacagcaacaacaacaga

SEQ ID NO: 41654 - RNA, 64 nt, hsa
gacaugcguccccucccuccccccgccaagugcucacacacaaccucacgcgcacacacacaca

SEQ ID NO: 41655 - RNA, 64 nt, hsa
ccccccgccaagugcucacacacaaccucacgcgcacacacacacacgcagauggaggcgccuc

SEQ ID NO: 41656 - RNA, 64 nt, hsa
ccccgccaagugcucacacacaaccucacgcgcacacacacacacgcagauggaggcgccucac

SEQ ID NO: 41657 - RNA, 64 nt, hsa
ccgccaagugcucacacacaaccucacgcgcacacacacacacgcagauggaggcgccucacug

SEQ ID NO: 41658 - RNA, 64 nt, hsa
gcuucuccggaucaguacaugcaugucacauuaacacacacacacacacacauauacacacaca

SEQ ID NO: 41659 - RNA, 64 nt, hsa
uucuccggaucaguacaugcaugucacauuaacacacacacacacacacauauacacacacaca

SEQ ID NO: 41660 - RNA, 64 nt, hsa
cuccggaucaguacaugcaugucacauuaacacacacacacacacacauauacacacacacaca

SEQ ID NO: 41661 - RNA, 64 nt, hsa
ccggaucaguacaugcaugucacauuaacacacacacacacacacauauacacacacacacaag

SEQ ID NO: 41662 - RNA, 64 nt, hsa
ggaucaguacaugcaugucacauuaacacacacacacacacacauauacacacacacacaagcu

SEQ ID NO: 41663 - RNA, 64 nt, hsa
aucaguacaugcaugucacauuaacacacacacacacacacauauacacacacacacaagcucg

SEQ ID NO: 41664 - RNA, 64 nt, hsa
augucacauuaacacacacacacacacacauauacacacacacacaagcucgaucagugugugu

SEQ ID NO: 41665 - RNA, 64 nt, hsa
gucacauuaacacacacacacacacacauauacacacacacacaagcucgaucaguguguguag

SEQ ID NO: 41666 - RNA, 64 nt, hsa
cacauuaacacacacacacacacacauauacacacacacacaagcucgaucaguguguguagga

SEQ ID NO: 41667 - RNA, 64 nt, hsa
gaaucccagcugauucccugacaggagccgacuucacacacaggugacucucaggcauuggcuc

SEQ ID NO: 41668 - RNA, 64 nt, hsa
ugaaggcaaaaacuguacuguguuucgcauuaagcacacacaucuggcccugacuucuggagau

SEQ ID NO: 41669 - RNA, 64 nt, hsa
cgcaaaggugccucauagcauagccagcauucagcacacacaaaccuacugcccacauuugggc

SEQ ID NO: 41670 - RNA, 64 nt, hsa
cucaugcaccugugcacacucacauccacccauacacacacacacacacacacacacacacaca

SEQ ID NO: 41671 - RNA, 64 nt, hsa
caugcaccugugcacacucacauccacccauacacacacacacacacacacacacacacacaca

SEQ ID NO: 41672 - RNA, 64 nt, hsa
ugcaccugugcacacucacauccacccauacacacacacacacacacacacacacacacacaca

SEQ ID NO: 41673 - RNA, 64 nt, hsa
caccugugcacacucacauccacccauacacacacacacacacacacacacacacacacacaca

SEQ ID NO: 41674 - RNA, 64 nt, hsa
ccugugcacacucacauccacccauacacacacacacacacacacacacacacacacacacacu

SEQ ID NO: 41675 - RNA, 64 nt, hsa
ugugcacacucacauccacccauacacacacacacacacacacacacacacacacacacacucc

SEQ ID NO: 41676 - RNA, 64 nt, hsa
ugcacacucacauccacccauacacacacacacacacacacacacacacacacacacacucccu

SEQ ID NO: 41677 - RNA, 64 nt, hsa
cacacucacauccacccauacacacacacacacacacacacacacacacacacacacucccuua

SEQ ID NO: 41678 - RNA, 64 nt, hsa
cacucacauccacccauacacacacacacacacacacacacacacacacacacacucccuuaca

SEQ ID NO: 41679 - RNA, 64 nt, hsa
cucacauccacccauacacacacacacacacacacacacacacacacacacacucccuuacacu

SEQ ID NO: 41680 - RNA, 64 nt, hsa
cacauccacccauacacacacacacacacacacacacacacacacacacacucccuuacacugu

SEQ ID NO: 41681 - RNA, 64 nt, hsa
cauccacccauacacacacacacacacacacacacacacacacacacacucccuuacacuguug

SEQ ID NO: 41682 - RNA, 64 nt, hsa
uccacccauacacacacacacacacacacacacacacacacacacacucccuuacacuguugua

SEQ ID NO: 41683 - RNA, 64 nt, hsa
cacccauacacacacacacacacacacacacacacacacacacacucccuuacacuguuguacu

SEQ ID NO: 41684 - RNA, 64 nt, hsa
cccauacacacacacacacacacacacacacacacacacacacucccuuacacuguuguacuuc

SEQ ID NO: 41685 - RNA, 64 nt, hsa
cucacaggucuugccuuuaaauuaccccucccugcacacacauacacagauacacacacacaaa

SEQ ID NO: 41686 - RNA, 64 nt, hsa
aaauuaccccucccugcacacacauacacagauacacacacacaaauauaauguaacgaucuuu

SEQ ID NO: 41687 - RNA, 64 nt, hsa
auuaccccucccugcacacacauacacagauacacacacacaaauauaauguaacgaucuuuua

SEQ ID NO: 41688 - RNA, 64 nt, hsa
acccuaccugcuguguuugugagaagaguaggaucacacacacaggugcaaucuugaccacacu

SEQ ID NO: 41689 - RNA, 64 nt, hsa
ccuaccugcuguguuugugagaagaguaggaucacacacacaggugcaaucuugaccacacuua

SEQ ID NO: 41690 - RNA, 64 nt, hsa
agggacagcacaggccacagagggcugcccccaccacacacacccccgcgucucgggagaaacc

SEQ ID NO: 41691 - RNA, 64 nt, hsa
auucacacacacacacacccccacaccccacucccacacacaguuccuacugucuucaguccau

SEQ ID NO: 41692 - RNA, 64 nt, hsa
ccaugcucaggccuuaggucuggccauucacacacacacacacccccacaccccacucccacac

SEQ ID NO: 41693 - RNA, 64 nt, hsa
auccaugcucaggccuuaggucuggccauucacacacacacacacccccacaccccacucccac

SEQ ID NO: 41694 - RNA, 64 nt, hsa
ccauccaugcucaggccuuaggucuggccauucacacacacacacacccccacaccccacuccc

SEQ ID NO: 41695 - RNA, 64 nt, hsa
ucccauccaugcucaggccuuaggucuggccauucacacacacacacacccccacaccccacuc

SEQ ID NO: 41696 - RNA, 64 nt, hsa
auaaacuugaacauguaacacacacacacacacacacacacaccauuuuaggaagugguucucc

SEQ ID NO: 41697 - RNA, 64 nt, hsa
uaauaaacuugaacauguaacacacacacacacacacacacacaccauuuuaggaagugguucu

SEQ ID NO: 41698 - RNA, 64 nt, hsa
acuaauaaacuugaacauguaacacacacacacacacacacacacaccauuuuaggaagugguu

SEQ ID NO: 41699 - RNA, 64 nt, hsa
ugacuaauaaacuugaacauguaacacacacacacacacacacacacaccauuuuaggaagugg

SEQ ID NO: 41700 - RNA, 64 nt, hsa
aaugacuaauaaacuugaacauguaacacacacacacacacacacacacaccauuuuaggaagu

SEQ ID NO: 41701 - RNA, 64 nt, hsa
cuaaugacuaauaaacuugaacauguaacacacacacacacacacacacacaccauuuuaggaa

SEQ ID NO: 41702 - RNA, 64 nt, hsa
cccuaaugacuaauaaacuugaacauguaacacacacacacacacacacacacaccauuuuagg

SEQ ID NO: 41703 - RNA, 64 nt, hsa
uccccuaaugacuaauaaacuugaacauguaacacacacacacacacacacacacaccauuuua

SEQ ID NO: 41704 - RNA, 64 nt, hsa
aguccccuaaugacuaauaaacuugaacauguaacacacacacacacacacacacacaccauuu

SEQ ID NO: 41705 - RNA, 64 nt, hsa
ggaaugcaaauauauauauauauacacacacacacacacacauacacauacaauccauauacau

SEQ ID NO: 41706 - RNA, 64 nt, hsa
ggggaaugcaaauauauauauauauacacacacacacacacacauacacauacaauccauauac

SEQ ID NO: 41707 - RNA, 64 nt, hsa
uuggggaaugcaaauauauauauauauacacacacacacacacacauacacauacaauccauau

SEQ ID NO: 41708 - RNA, 64 nt, hsa
auuuggggaaugcaaauauauauauauauacacacacacacacacacauacacauacaauccau

SEQ ID NO: 41709 - RNA, 64 nt, hsa
aaauuuggggaaugcaaauauauauauauauacacacacacacacacacauacacauacaaucc

SEQ ID NO: 41710 - RNA, 64 nt, hsa
uuaaauuuggggaaugcaaauauauauauauauacacacacacacacacacauacacauacaau

SEQ ID NO: 41711 - RNA, 64 nt, hsa
cucucucucacacacacacacacacacacacacacacacacagagacacggcaccauucugccu

SEQ ID NO: 41712 - RNA, 64 nt, hsa
cucucucucucacacacacacacacacacacacacacacacacagagacacggcaccauucugc

SEQ ID NO: 41713 - RNA, 64 nt, hsa
cucucucucucucacacacacacacacacacacacacacacacacagagacacggcaccauucu

SEQ ID NO: 41714 - RNA, 64 nt, hsa
cucucucucucucucacacacacacacacacacacacacacacacacagagacacggcaccauu

SEQ ID NO: 41715 - RNA, 64 nt, hsa
cucucucucucucucucacacacacacacacacacacacacacacacacagagacacggcacca

SEQ ID NO: 41716 - RNA, 64 nt, hsa
cucucucucucucucucucacacacacacacacacacacacacacacacacagagacacggcac

SEQ ID NO: 41717 - RNA, 64 nt, hsa
uucucucucucucucucucucacacacacacacacacacacacacacacacacagagacacggc

SEQ ID NO: 41718 - RNA, 64 nt, hsa
cuuucucucucucucucucucucacacacacacacacacacacacacacacacacagagacacg

SEQ ID NO: 41719 - RNA, 64 nt, hsa
cucuuucucucucucucucucucucacacacacacacacacacacacacacacacacagagaca

SEQ ID NO: 41720 - RNA, 64 nt, hsa
cacucuuucucucucucucucucucucacacacacacacacacacacacacacacacacagaga

SEQ ID NO: 41721 - RNA, 64 nt, hsa
ugcacucuuucucucucucucucucucucacacacacacacacacacacacacacacacacaga

SEQ ID NO: 41722 - RNA, 64 nt, hsa
ugugcacucuuucucucucucucucucucucacacacacacacacacacacacacacacacaca

SEQ ID NO: 41723 - RNA, 64 nt, hsa
agugugcacucuuucucucucucucucucucucacacacacacacacacacacacacacacaca

SEQ ID NO: 41724 - RNA, 64 nt, hsa
auagugugcacucuuucucucucucucucucucucacacacacacacacacacacacacacaca

SEQ ID NO: 41725 - RNA, 64 nt, hsa
auuugauuuguacuuagacacacgcguuuacacacacacacauaucacaagaucuguuagaaau

SEQ ID NO: 41726 - RNA, 64 nt, hsa
gaauuugauuuguacuuagacacacgcguuuacacacacacacauaucacaagaucuguuagaa

SEQ ID NO: 41727 - RNA, 64 nt, hsa
gugaauuugauuuguacuuagacacacgcguuuacacacacacacauaucacaagaucuguuag

SEQ ID NO: 41728 - RNA, 64 nt, hsa
gagcagaguauguggauacccggaaacacacacacacacacaucaucauuaucaucaucaucau

SEQ ID NO: 41729 - RNA, 64 nt, hsa
aagagcagaguauguggauacccggaaacacacacacacacacaucaucauuaucaucaucauc

SEQ ID NO: 41730 - RNA, 64 nt, hsa
ggaagagcagaguauguggauacccggaaacacacacacacacacaucaucauuaucaucauca

SEQ ID NO: 41731 - RNA, 64 nt, hsa
gaggaagagcagaguauguggauacccggaaacacacacacacacacaucaucauuaucaucau

SEQ ID NO: 41732 - RNA, 64 nt, hsa
gugaggaagagcagaguauguggauacccggaaacacacacacacacacaucaucauuaucauc

SEQ ID NO: 41733 - RNA, 64 nt, hsa
gauucuuguguacacacacacacacacacacacacacacacacccuaacuaguaucuucuugaa

SEQ ID NO: 41734 - RNA, 64 nt, hsa
aagauucuuguguacacacacacacacacacacacacacacacacccuaacuaguaucuucuug

SEQ ID NO: 41735 - RNA, 64 nt, hsa
ucaagauucuuguguacacacacacacacacacacacacacacacacccuaacuaguaucuucu

SEQ ID NO: 41736 - RNA, 64 nt, hsa
gcucaagauucuuguguacacacacacacacacacacacacacacacacccuaacuaguaucuu

SEQ ID NO: 41737 - RNA, 64 nt, hsa
gggcucaagauucuuguguacacacacacacacacacacacacacacacacccuaacuaguauc

SEQ ID NO: 41738 - RNA, 64 nt, hsa
cugggcucaagauucuuguguacacacacacacacacacacacacacacacacccuaacuagua

SEQ ID NO: 41739 - RNA, 64 nt, hsa
cucugggcucaagauucuuguguacacacacacacacacacacacacacacacacccuaacuag

SEQ ID NO: 41740 - RNA, 64 nt, hsa
cucucugggcucaagauucuuguguacacacacacacacacacacacacacacacacccuaacu

SEQ ID NO: 41741 - RNA, 64 nt, hsa
cacucucugggcucaagauucuuguguacacacacacacacacacacacacacacacacccuaa

SEQ ID NO: 41742 - RNA, 64 nt, hsa
cacacucucugggcucaagauucuuguguacacacacacacacacacacacacacacacacccu

SEQ ID NO: 41743 - RNA, 64 nt, hsa
gacacacucucugggcucaagauucuuguguacacacacacacacacacacacacacacacacc

SEQ ID NO: 41744 - RNA, 64 nt, hsa
cagacacacucucugggcucaagauucuuguguacacacacacacacacacacacacacacaca

SEQ ID NO: 41745 - RNA, 64 nt, hsa
uacgugcagauuaauuuauauauauauauauacacacacacauauacaguauaaauacucauuu

SEQ ID NO: 41746 - RNA, 64 nt, hsa
uauacgugcagauuaauuuauauauauauauauacacacacacauauacaguauaaauacucau

SEQ ID NO: 41747 - RNA, 64 nt, hsa
ggggcuucccuggugcugcagcacuuguaaaccacacacacagccucucucccuggacauacgu

SEQ ID NO: 41748 - RNA, 64 nt, hsa
guggggcuucccuggugcugcagcacuuguaaaccacacacacagccucucucccuggacauac

SEQ ID NO: 41749 - RNA, 64 nt, hsa
cacacaagugcacagagcacacugcacacaugcacacacacacgcgugcaugcacacuccucgc

SEQ ID NO: 41750 - RNA, 64 nt, hsa
cacacacaagugcacagagcacacugcacacaugcacacacacacgcgugcaugcacacuccuc

SEQ ID NO: 41751 - RNA, 64 nt, hsa
acagcacaugcacacaggugcacagaccacacagcacacacaagugcacagagcacacugcaca

SEQ ID NO: 41752 - RNA, 64 nt, hsa
caagugcacagaccacacacagcacuaacacaugcacacacaaagugcauaggccacacagcac

SEQ ID NO: 41753 - RNA, 64 nt, hsa
cacacacaguauacacauacacaagugcacagaccacacacagcacuaacacaugcacacacaa

SEQ ID NO: 41754 - RNA, 64 nt, hsa
ugcacagaucacacacaugcacacacguguagcucacacacaguauacacauacacaagugcac

SEQ ID NO: 41755 - RNA, 64 nt, hsa
acacaugcacgcuuacauguacacgugcacagaucacacacaugcacacacguguagcucacac

SEQ ID NO: 41756 - RNA, 64 nt, hsa
uuuguuagagugcacaucccuacgugcccacuggcacacacacgugcucacauacauguccgca

SEQ ID NO: 41757 - RNA, 64 nt, hsa
uuugagaguugagcuuuaacagccauggcaauuacacacacacacaaacauacacucacacaca

SEQ ID NO: 41758 - RNA, 64 nt, hsa
ugagaguugagcuuuaacagccauggcaauuacacacacacacaaacauacacucacacacaca

SEQ ID NO: 41759 - RNA, 64 nt, hsa
agaguugagcuuuaacagccauggcaauuacacacacacacaaacauacacucacacacacaau

SEQ ID NO: 41760 - RNA, 64 nt, hsa
ccauggcaauuacacacacacacaaacauacacucacacacacaauuacuauguauaacauaua

SEQ ID NO: 41761 - RNA, 64 nt, hsa
auggcaauuacacacacacacaaacauacacucacacacacaauuacuauguauaacauauaug

SEQ ID NO: 41762 - RNA, 64 nt, hsa
auuaaagaaacuuauuacuguugucaacugaauucacacacacacaaauauaguaccauagaaa

SEQ ID NO: 41763 - RNA, 64 nt, hsa
uaaagaaacuuauuacuguugucaacugaauucacacacacacaaauauaguaccauagaaaaa

SEQ ID NO: 41764 - RNA, 64 nt, hsa
aagaaacuuauuacuguugucaacugaauucacacacacacaaauauaguaccauagaaaaagu

SEQ ID NO: 41765 - RNA, 64 nt, hsa
uguucucucucucucucucucucucucucucuaucacacacacacacacacacacacacacaca

SEQ ID NO: 41766 - RNA, 64 nt, hsa
uucucucucucucucucucucucucucucuaucacacacacacacacacacacacacacacaca

SEQ ID NO: 41767 - RNA, 64 nt, hsa
cucucucucucucucucucucucucucuaucacacacacacacacacacacacacacacacaca

SEQ ID NO: 41768 - RNA, 64 nt, hsa
cucucucucucucucucucucucucuaucacacacacacacacacacacacacacacacacaca

SEQ ID NO: 41769 - RNA, 64 nt, hsa
cucucucucucucucucucucucuaucacacacacacacacacacacacacacacacacacaca

SEQ ID NO: 41770 - RNA, 64 nt, hsa
cucucucucucucucucucucuaucacacacacacacacacacacacacacacacacacacaau

SEQ ID NO: 41771 - RNA, 64 nt, hsa
cucucucucucucucucucuaucacacacacacacacacacacacacacacacacacacaauuu

SEQ ID NO: 41772 - RNA, 64 nt, hsa
cucucucucucucucucuaucacacacacacacacacacacacacacacacacacacaauuuca

SEQ ID NO: 41773 - RNA, 64 nt, hsa
cucucucucucucucuaucacacacacacacacacacacacacacacacacacacaauuucauu

SEQ ID NO: 41774 - RNA, 64 nt, hsa
cucucucucucucuaucacacacacacacacacacacacacacacacacacacaauuucauuca

SEQ ID NO: 41775 - RNA, 64 nt, hsa
cucucucucucuaucacacacacacacacacacacacacacacacacacacaauuucauucaua

SEQ ID NO: 41776 - RNA, 64 nt, hsa
cucucucucuaucacacacacacacacacacacacacacacacacacacaauuucauucauaua

SEQ ID NO: 41777 - RNA, 64 nt, hsa
cucucucuaucacacacacacacacacacacacacacacacacacacaauuucauucauauaug

SEQ ID NO: 41778 - RNA, 64 nt, hsa
cucucuaucacacacacacacacacacacacacacacacacacacaauuucauucauauauggu

SEQ ID NO: 41779 - RNA, 64 nt, hsa
cucuaucacacacacacacacacacacacacacacacacacacaauuucauucauauaugguau

SEQ ID NO: 41780 - RNA, 64 nt, hsa
cuaucacacacacacacacacacacacacacacacacacacaauuucauucauauaugguauug

SEQ ID NO: 41781 - RNA, 64 nt, hsa
guccuucccacaccuuuguuuaggagucaucauucacacacacacacacacacacacacacaca

SEQ ID NO: 41782 - RNA, 64 nt, hsa
ccuucccacaccuuuguuuaggagucaucauucacacacacacacacacacacacacacacaca

SEQ ID NO: 41783 - RNA, 64 nt, hsa
uucccacaccuuuguuuaggagucaucauucacacacacacacacacacacacacacacacaca

SEQ ID NO: 41784 - RNA, 64 nt, hsa
cccacaccuuuguuuaggagucaucauucacacacacacacacacacacacacacacacacaca

SEQ ID NO: 41785 - RNA, 64 nt, hsa
cacaccuuuguuuaggagucaucauucacacacacacacacacacacacacacacacacacaca

SEQ ID NO: 41786 - RNA, 64 nt, hsa
caccuuuguuuaggagucaucauucacacacacacacacacacacacacacacacacacacaca

SEQ ID NO: 41787 - RNA, 64 nt, hsa
ccuuuguuuaggagucaucauucacacacacacacacacacacacacacacacacacacacaca

SEQ ID NO: 41788 - RNA, 64 nt, hsa
uuuguuuaggagucaucauucacacacacacacacacacacacacacacacacacacacacaca

SEQ ID NO: 41789 - RNA, 64 nt, hsa
uguuuaggagucaucauucacacacacacacacacacacacacacacacacacacacacacacu

SEQ ID NO: 41790 - RNA, 64 nt, hsa
uuuaggagucaucauucacacacacacacacacacacacacacacacacacacacacacacucu

SEQ ID NO: 41791 - RNA, 64 nt, hsa
uaggagucaucauucacacacacacacacacacacacacacacacacacacacacacacucucu

SEQ ID NO: 41792 - RNA, 64 nt, hsa
ggagucaucauucacacacacacacacacacacacacacacacacacacacacacacucucuga

SEQ ID NO: 41793 - RNA, 64 nt, hsa
agucaucauucacacacacacacacacacacacacacacacacacacacacacacucucugagc

SEQ ID NO: 41794 - RNA, 64 nt, hsa
ucaucauucacacacacacacacacacacacacacacacacacacacacacacucucugagcac

SEQ ID NO: 41795 - RNA, 64 nt, hsa
aucauucacacacacacacacacacacacacacacacacacacacacacacucucugagcacau

SEQ ID NO: 41796 - RNA, 64 nt, hsa
cauucacacacacacacacacacacacacacacacacacacacacacacucucugagcacauua

SEQ ID NO: 41797 - RNA, 64 nt, hsa
uucacacacacacacacacacacacacacacacacacacacacucugagcacauuaucugugau

SEQ ID NO: 41798 - RNA, 64 nt, hsa
uaaauauuuacggauagauugcuagguagauagacacacacacaugcacacacacacaucugga

SEQ ID NO: 41799 - RNA, 64 nt, hsa
aauauuuacggauagauugcuagguagauagacacacacacaugcacacacacacaucuggaga

SEQ ID NO: 41800 - RNA, 64 nt, hsa
gauagauugcuagguagauagacacacacacaugcacacacacacaucuggagauggcaaaauc

SEQ ID NO: 41801 - RNA, 64 nt, hsa
uagauugcuagguagauagacacacacacaugcacacacacacaucuggagauggcaaaauccu

SEQ ID NO: 41802 - RNA, 64 nt, hsa
gauugcuagguagauagacacacacacaugcacacacacacaucuggagauggcaaaauccucu

SEQ ID NO: 41803 - RNA, 64 nt, hsa
ggaaggaacuacaagagagucggagaugaugcagcacacacacaauuccccagcccagugaugc

SEQ ID NO: 41804 - RNA, 64 nt, hsa
aaggaacuacaagagagucggagaugaugcagcacacacacaauuccccagcccagugaugcuu

SEQ ID NO: 41805 - RNA, 64 nt, hsa
aaaaaagcagcagacaacacacuguagagucuugcacacacacaagugcccaggcaaggugcuu

SEQ ID NO: 41806 - RNA, 64 nt, hsa
aaaagcagcagacaacacacuguagagucuugcacacacacaagugcccaggcaaggugcuugg

SEQ ID NO: 41807 - RNA, 64 nt, hsa
guucagcugccucugcacccccucccacccccagcacacacacaaguuggcccccagcugcgcc

SEQ ID NO: 41808 - RNA, 64 nt, hsa
ucagcugccucugcacccccucccacccccagcacacacacaaguuggcccccagcugcgccug

SEQ ID NO: 41809 - RNA, 64 nt, hsa
ccucugcccgccccugcugccccaccaccuucugcacacacagcgguggggaggcggggaggag

SEQ ID NO: 41810 - RNA, 64 nt, hsa
cagcaaaucacuucucucccugcgcucacacagacacacacacacacacguacaugcacacauu

SEQ ID NO: 41811 - RNA, 64 nt, hsa
gcaaaucacuucucucccugcgcucacacagacacacacacacacacguacaugcacacauuuu

SEQ ID NO: 41812 - RNA, 64 nt, hsa
aaaucacuucucucccugcgcucacacagacacacacacacacacguacaugcacacauuuuuc

SEQ ID NO: 41813 - RNA, 64 nt, hsa
aucacuucucucccugcgcucacacagacacacacacacacacguacaugcacacauuuuuccu

SEQ ID NO: 41814 - RNA, 64 nt, hsa
uugggcuuggcccucucugccugagagagcucagcacacacacagcucagacccacggacagga

SEQ ID NO: 41815 - RNA, 64 nt, hsa
gggcuuggcccucucugccugagagagcucagcacacacacagcucagacccacggacaggacc

SEQ ID NO: 41816 - RNA, 64 nt, hsa
acccucugugggccacacgugcacuugcacccaccacacacacacacacacacacacacacaca

SEQ ID NO: 41817 - RNA, 64 nt, hsa
ccucugugggccacacgugcacuugcacccaccacacacacacacacacacacacacacacaca

SEQ ID NO: 41818 - RNA, 64 nt, hsa
ucugugggccacacgugcacuugcacccaccacacacacacacacacacacacacacacacaca

SEQ ID NO: 41819 - RNA, 64 nt, hsa
ugugggccacacgugcacuugcacccaccacacacacacacacacacacacacacacacacaga

SEQ ID NO: 41820 - RNA, 64 nt, hsa
ugggccacacgugcacuugcacccaccacacacacacacacacacacacacacacacacagaca

SEQ ID NO: 41821 - RNA, 64 nt, hsa
ggccacacgugcacuugcacccaccacacacacacacacacacacacacacacacacagacaca

SEQ ID NO: 41822 - RNA, 64 nt, hsa
ccacacgugcacuugcacccaccacacacacacacacacacacacacacacacacagacacaca

SEQ ID NO: 41823 - RNA, 64 nt, hsa
acacgugcacuugcacccaccacacacacacacacacacacacacacacacacagacacacaga

SEQ ID NO: 41824 - RNA, 64 nt, hsa
acgugcacuugcacccaccacacacacacacacacacacacacacacacacagacacacagaca

SEQ ID NO: 41825 - RNA, 64 nt, hsa
gugcacuugcacccaccacacacacacacacacacacacacacacacacagacacacagacaca

SEQ ID NO: 41826 - RNA, 64 nt, hsa
gcacuugcacccaccacacacacacacacacacacacacacacacacagacacacagacacaua

SEQ ID NO: 41827 - RNA, 64 nt, hsa
acuugcacccaccacacacacacacacacacacacacacacacacagacacacagacacauacg

SEQ ID NO: 41828 - RNA, 64 nt, hsa
uugcacccaccacacacacacacacacacacacacacacacacagacacacagacacauacgca

SEQ ID NO: 41829 - RNA, 64 nt, hsa
gcacccaccacacacacacacacacacacacacacacacacagacacacagacacauacgcaca

SEQ ID NO: 41830 - RNA, 64 nt, hsa
uacgcacacacgugcacacauguacacacggauacacacacacacacacacacugcauaucuga

SEQ ID NO: 41831 - RNA, 64 nt, hsa
cgcacacacgugcacacauguacacacggauacacacacacacacacacacugcauaucugagc

SEQ ID NO: 41832 - RNA, 64 nt, hsa
cacacacgugcacacauguacacacggauacacacacacacacacacacugcauaucugagcgc

SEQ ID NO: 41833 - RNA, 64 nt, hsa
cacacgugcacacauguacacacggauacacacacacacacacacacugcauaucugagcgcgc

SEQ ID NO: 41834 - RNA, 64 nt, hsa
cacgugcacacauguacacacggauacacacacacacacacacacugcauaucugagcgcgccc

SEQ ID NO: 41835 - RNA, 64 nt, hsa
cgugcacacauguacacacggauacacacacacacacacacacugcauaucugagcgcgccccu

SEQ ID NO: 41836 - RNA, 64 nt, hsa
cauauauauauauauauauauauauauguguauacacacacacauagacagacauauauauaua

SEQ ID NO: 41837 - RNA, 64 nt, hsa
uauauauauauauauauauauauauguguauacacacacacauagacagacauauauauauaua

SEQ ID NO: 41838 - RNA, 64 nt, hsa
cguuauugugaagucuuucguagacaccccagagcacacacauccccuuaguccaccgguuaga

SEQ ID NO: 41839 - RNA, 64 nt, hsa
gcuugcuuucuuccuccuuacccuaccccccacucacacacacacacacacacacacacacaca

SEQ ID NO: 41840 - RNA, 64 nt, hsa
uugcuuucuuccuccuuacccuaccccccacucacacacacacacacacacacacacacacaca

SEQ ID NO: 41841 - RNA, 64 nt, hsa
gcuuucuuccuccuuacccuaccccccacucacacacacacacacacacacacacacacacaca

SEQ ID NO: 41842 - RNA, 64 nt, hsa
uuucuuccuccuuacccuaccccccacucacacacacacacacacacacacacacacacacaca

SEQ ID NO: 41843 - RNA, 64 nt, hsa
ucuuccuccuuacccuaccccccacucacacacacacacacacacacacacacacacacacaca

SEQ ID NO: 41844 - RNA, 64 nt, hsa
uuccuccuuacccuaccccccacucacacacacacacacacacacacacacacacacacacaca

SEQ ID NO: 41845 - RNA, 64 nt, hsa
ccuccuuacccuaccccccacucacacacacacacacacacacacacacacacacacacacaca

SEQ ID NO: 41846 - RNA, 64 nt, hsa
uccuuacccuaccccccacucacacacacacacacacacacacacacacacacacacacacacu

SEQ ID NO: 41847 - RNA, 64 nt, hsa
cuuacccuaccccccacucacacacacacacacacacacacacacacacacacacacacacuuu

SEQ ID NO: 41848 - RNA, 64 nt, hsa
uacccuaccccccacucacacacacacacacacacacacacacacacacacacacacacuuucu

SEQ ID NO: 41849 - RNA, 64 nt, hsa
cccuaccccccacucacacacacacacacacacacacacacacacacacacacacacuuucuau

SEQ ID NO: 41850 - RNA, 64 nt, hsa
cuaccccccacucacacacacacacacacacacacacacacacacacacacacacuuucuauaa

SEQ ID NO: 41851 - RNA, 64 nt, hsa
accccccacucacacacacacacacacacacacacacacacacacacacacacuuucuauaaaa

SEQ ID NO: 41852 - RNA, 64 nt, hsa
cccccacucacacacacacacacacacacacacacacacacacacacacacuuucuauaaaacu

SEQ ID NO: 41853 - RNA, 64 nt, hsa
cccacucacacacacacacacacacacacacacacacacacacacacacuuucuauaaaacuug

SEQ ID NO: 41854 - RNA, 64 nt, hsa
cacucacacacacacacacacacacacacacacacacacacacacacuuucuauaaaacuugaa

SEQ ID NO: 41855 - RNA, 64 nt, hsa
cucacacacacacacacacacacacacacacacacacacacacacuuucuauaaaacuugaaaa

SEQ ID NO: 41856 - RNA, 64 nt, hsa
cacacacacacacacacacacacacacacacacacacacacacuuucuauaaaacuugaaaaua

SEQ ID NO: 41857 - RNA, 64 nt, hsa
gaccacuucucugugucaucacacauacccacuucacacacacacaucccaaauaccaccacca

SEQ ID NO: 41858 - RNA, 64 nt, hsa
ccacuucucugugucaucacacauacccacuucacacacacacaucccaaauaccaccaccaac

SEQ ID NO: 41859 - RNA, 64 nt, hsa
acuucucugugucaucacacauacccacuucacacacacacaucccaaauaccaccaccaacca

SEQ ID NO: 41860 - RNA, 64 nt, hsa
uuucuucuguccaaacaaacaaacaaaaacuaaacacacacacaaacccccagaaacccacaau

SEQ ID NO: 41861 - RNA, 64 nt, hsa
ucuucuguccaaacaaacaaacaaaaacuaaacacacacacaaacccccagaaacccacaauau

SEQ ID NO: 41862 - RNA, 64 nt, hsa
aaaaaaacaaaaaaacaaaaaacaaaaaaacacacacacacaaaaaaagagaaaaaacauaaca

SEQ ID NO: 41863 - RNA, 64 nt, hsa
caaaaaaaacaaaaaaacaaaaaacaaaaaaacacacacacacaaaaaaagagaaaaaacauaa

SEQ ID NO: 41864 - RNA, 64 nt, hsa
aacaaaaaaaacaaaaaaacaaaaaacaaaaaaacacacacacacaaaaaaagagaaaaaacau

SEQ ID NO: 41865 - RNA, 64 nt, hsa
caagaggauuuaagggaggaauguuuauaggacacacacacaaaagcucuuucuauuuauaaua

SEQ ID NO: 41866 - RNA, 64 nt, hsa
cacaagaggauuuaagggaggaauguuuauaggacacacacacaaaagcucuuucuauuuauaa

SEQ ID NO: 41867 - RNA, 64 nt, hsa
gccuuacauccccuucuagcccuccucccauccacacacacaggcacccacccacaccaggucg

SEQ ID NO: 41868 - RNA, 64 nt, hsa
cugccuuacauccccuucuagcccuccucccauccacacacacaggcacccacccacaccaggu

SEQ ID NO: 41869 - RNA, 64 nt, hsa
uugugagaucuucagcuaccucauggugcaauaacacacacacgcuuaaccauguugauggcac

SEQ ID NO: 41870 - RNA, 64 nt, hsa
uaaauucuugugaaaaaaccuguguuuuuaguuacacacacacacacacacacaccuacuuaaa

SEQ ID NO: 41871 - RNA, 64 nt, hsa
aauucuugugaaaaaaccuguguuuuuaguuacacacacacacacacacacaccuacuuaaaug

SEQ ID NO: 41872 - RNA, 64 nt, hsa
uucuugugaaaaaaccuguguuuuuaguuacacacacacacacacacacaccuacuuaaaugga

SEQ ID NO: 41873 - RNA, 64 nt, hsa
cuugugaaaaaaccuguguuuuuaguuacacacacacacacacacacaccuacuuaaauggaau

SEQ ID NO: 41874 - RNA, 64 nt, hsa
ugugaaaaaaccuguguuuuuaguuacacacacacacacacacacaccuacuuaaauggaaucu

SEQ ID NO: 41875 - RNA, 64 nt, hsa
ugaaaaaaccuguguuuuuaguuacacacacacacacacacacaccuacuuaaauggaaucuaa

SEQ ID NO: 41876 - RNA, 64 nt, hsa
aaaaaaccuguguuuuuaguuacacacacacacacacacacaccuacuuaaauggaaucuaaac

SEQ ID NO: 41877 - RNA, 64 nt, hsa
ugcucuucaucauauauauaguuaugcauacauacacacacacacauacaguauauucuuuccu

SEQ ID NO: 41878 - RNA, 64 nt, hsa
cucuucaucauauauauaguuaugcauacauacacacacacacauacaguauauucuuuccuca

SEQ ID NO: 41879 - RNA, 64 nt, hsa
cuucaucauauauauaguuaugcauacauacacacacacacauacaguauauucuuuccucaaa

SEQ ID NO: 41880 - RNA, 64 nt, hsa
ucugaagggcauacaaugaaaagugaaggggaaacacacacacacaaaaaaacaaguauuuggc

SEQ ID NO: 41881 - RNA, 64 nt, hsa
ugaagggcauacaaugaaaagugaaggggaaacacacacacacaaaaaaacaaguauuuggcuu

SEQ ID NO: 41882 - RNA, 64 nt, hsa
aagggcauacaaugaaaagugaaggggaaacacacacacacaaaaaaacaaguauuuggcuugu

SEQ ID NO: 41883 - RNA, 64 nt, hsa
cuuaccaaagcagacgcgugcgcgugcacagaugcacacacacagaugucuuaaaagacuagaa

SEQ ID NO: 41884 - RNA, 64 nt, hsa
uaccaaagcagacgcgugcgcgugcacagaugcacacacacagaugucuuaaaagacuagaauc

SEQ ID NO: 41885 - RNA, 64 nt, hsa
uuugacuaauucugguacugaaaaguuagcuauacacacacacacacacacacacacacacaca

SEQ ID NO: 41886 - RNA, 64 nt, hsa
ugacuaauucugguacugaaaaguuagcuauacacacacacacacacacacacacacacacaca

SEQ ID NO: 41887 - RNA, 64 nt, hsa
acuaauucugguacugaaaaguuagcuauacacacacacacacacacacacacacacacacaca

SEQ ID NO: 41888 - RNA, 64 nt, hsa
uaauucugguacugaaaaguuagcuauacacacacacacacacacacacacacacacacacaca

SEQ ID NO: 41889 - RNA, 64 nt, hsa
auucugguacugaaaaguuagcuauacacacacacacacacacacacacacacacacacacaca

SEQ ID NO: 41890 - RNA, 64 nt, hsa
ucugguacugaaaaguuagcuauacacacacacacacacacacacacacacacacacacacaca

SEQ ID NO: 41891 - RNA, 64 nt, hsa
ugguacugaaaaguuagcuauacacacacacacacacacacacacacacacacacacacacaca

SEQ ID NO: 41892 - RNA, 64 nt, hsa
gcuauacacacacacacacacacacacacacacacacacacacacacacacacacacacacaca

SEQ ID NO: 41893 - RNA, 64 nt, hsa
uauacacacacacacacacacacacacacacacacacacacacacacacacacacacacacaaa

SEQ ID NO: 41894 - RNA, 64 nt, hsa
uacacacacacacacacacacacacacacacacacacacacacacacacacacacacacaaacu

SEQ ID NO: 41895 - RNA, 64 nt, hsa
cacacacacacacacacacacacacacacacacacacacacacacacacacacacacaaacuuc

SEQ ID NO: 41896 - RNA, 64 nt, hsa
cacacacacacacacacacacacacacacacacacacacacacacacacacacacaaacuucaa

SEQ ID NO: 41897 - RNA, 64 nt, hsa
cacacacacacacacacacacacacacacacacacacacacacacacacacacaaacuucaaaa

SEQ ID NO: 41898 - RNA, 64 nt, hsa
cacacacacacacacacacacacacacacacacacacacacacacacacacaaacuucaaaaau

SEQ ID NO: 41899 - RNA, 64 nt, hsa
cacacacacacacacacacacacacacacacacacacacacacacacacaaacuucaaaaaugc

SEQ ID NO: 41900 - RNA, 64 nt, hsa
cacacacacacacacacacacacacacacacacacacacacacacacaaacuucaaaaaugcuu

SEQ ID NO: 41901 - RNA, 64 nt, hsa
cacacacacacacacacacacacacacacacacacacacacacacaaacuucaaaaaugcuuaa

SEQ ID NO: 41902 - RNA, 64 nt, hsa
cacacacacacacacacacacacacacacacacacacacacacaaacuucaaaaaugcuuaacc

SEQ ID NO: 41903 - RNA, 64 nt, hsa
cacacacacacacacacacacacacacacacacacacacacaaacuucaaaaaugcuuaaccau

SEQ ID NO: 41904 - RNA, 64 nt, hsa
aguguuuaauuuccgauuuuuuccucugcauuuacacacacaccacacacgcacacacacacac

SEQ ID NO: 41905 - RNA, 64 nt, hsa
uuuuuccucugcauuuacacacacaccacacacgcacacacacacaccaaguaccaguauaagc

SEQ ID NO: 41906 - RNA, 64 nt, hsa
uuuccucugcauuuacacacacaccacacacgcacacacacacaccaaguaccaguauaagcau

SEQ ID NO: 41907 - RNA, 64 nt, hsa
uccucugcauuuacacacacaccacacacgcacacacacacaccaaguaccaguauaagcaucu

SEQ ID NO: 41908 - RNA, 64 nt, hsa
aguguuuaauuucagacuuuuuccucugcauuuacacacacacacacacacacacgcacacaca

SEQ ID NO: 41909 - RNA, 64 nt, hsa
uguuuaauuucagacuuuuuccucugcauuuacacacacacacacacacacacgcacacacaca

SEQ ID NO: 41910 - RNA, 64 nt, hsa
uuuaauuucagacuuuuuccucugcauuuacacacacacacacacacacacgcacacacacaca

SEQ ID NO: 41911 - RNA, 64 nt, hsa
uaauuucagacuuuuuccucugcauuuacacacacacacacacacacacgcacacacacacacc

SEQ ID NO: 41912 - RNA, 64 nt, hsa
auuucagacuuuuuccucugcauuuacacacacacacacacacacacgcacacacacacaccaa

SEQ ID NO: 41913 - RNA, 64 nt, hsa
uucagacuuuuuccucugcauuuacacacacacacacacacacacgcacacacacacaccaagu

SEQ ID NO: 41914 - RNA, 64 nt, hsa
cagacuuuuuccucugcauuuacacacacacacacacacacacgcacacacacacaccaaguac

SEQ ID NO: 41915 - RNA, 64 nt, hsa
ccucugcauuuacacacacacacacacacacacgcacacacacacaccaaguaccaguauaagc

SEQ ID NO: 41916 - RNA, 64 nt, hsa
ucugcauuuacacacacacacacacacacacgcacacacacacaccaaguaccaguauaagcau

SEQ ID NO: 41917 - RNA, 64 nt, hsa
ugcauuuacacacacacacacacacacacgcacacacacacaccaaguaccaguauaagcaucu

SEQ ID NO: 41918 - RNA, 64 nt, hsa
ugacccccuccauccuugacccccaacaccucaacacacacacacacacacacacacaaaauca

SEQ ID NO: 41919 - RNA, 64 nt, hsa
acccccuccauccuugacccccaacaccucaacacacacacacacacacacacacaaaaucaca

SEQ ID NO: 41920 - RNA, 64 nt, hsa
ccccuccauccuugacccccaacaccucaacacacacacacacacacacacacaaaaucacacc

SEQ ID NO: 41921 - RNA, 64 nt, hsa
ccuccauccuugacccccaacaccucaacacacacacacacacacacacacaaaaucacaccau

SEQ ID NO: 41922 - RNA, 64 nt, hsa
uccauccuugacccccaacaccucaacacacacacacacacacacacacaaaaucacaccauuu

SEQ ID NO: 41923 - RNA, 64 nt, hsa
cauccuugacccccaacaccucaacacacacacacacacacacacacaaaaucacaccauuuuc

SEQ ID NO: 41924 - RNA, 64 nt, hsa
uccuugacccccaacaccucaacacacacacacacacacacacacaaaaucacaccauuuucau

SEQ ID NO: 41925 - RNA, 64 nt, hsa
cuugacccccaacaccucaacacacacacacacacacacacacaaaaucacaccauuuucaugc

SEQ ID NO: 41926 - RNA, 64 nt, hsa
ugacccccaacaccucaacacacacacacacacacacacacaaaaucacaccauuuucaugccu

SEQ ID NO: 41927 - RNA, 64 nt, hsa
cagacuucuuccucugcauuuacacaccacacaacacacacacacacacacacacaccaaguac

SEQ ID NO: 41928 - RNA, 64 nt, hsa
gacuucuuccucugcauuuacacaccacacaacacacacacacacacacacacaccaaguacca

SEQ ID NO: 41929 - RNA, 64 nt, hsa
cuucuuccucugcauuuacacaccacacaacacacacacacacacacacacaccaaguaccauu

SEQ ID NO: 41930 - RNA, 64 nt, hsa
ucuuccucugcauuuacacaccacacaacacacacacacacacacacacaccaaguaccauuau

SEQ ID NO: 41931 - RNA, 64 nt, hsa
uuccucugcauuuacacaccacacaacacacacacacacacacacacaccaaguaccauuauaa

SEQ ID NO: 41932 - RNA, 64 nt, hsa
ccucugcauuuacacaccacacaacacacacacacacacacacacaccaaguaccauuauaagc

SEQ ID NO: 41933 - RNA, 64 nt, hsa
ucugcauuuacacaccacacaacacacacacacacacacacacaccaaguaccauuauaagcau

SEQ ID NO: 41934 - RNA, 64 nt, hsa
ugcauuuacacaccacacaacacacacacacacacacacacaccaaguaccauuauaagcaucu

SEQ ID NO: 41935 - RNA, 64 nt, hsa
aguguuuaauuucagauuuuuuccucugcauuuacacacacacgcacacaaaccacaccacaca

SEQ ID NO: 41936 - RNA, 64 nt, hsa
ucugcauuuacacacacacgcacacaaaccacaccacacacacacacacacacacacacacaca

SEQ ID NO: 41937 - RNA, 64 nt, hsa
ugcauuuacacacacacgcacacaaaccacaccacacacacacacacacacacacacacacaca

SEQ ID NO: 41938 - RNA, 64 nt, hsa
cauuuacacacacacgcacacaaaccacaccacacacacacacacacacacacacacacacaca

SEQ ID NO: 41939 - RNA, 64 nt, hsa
uuuacacacacacgcacacaaaccacaccacacacacacacacacacacacacacacacacaca

SEQ ID NO: 41940 - RNA, 64 nt, hsa
uacacacacacgcacacaaaccacaccacacacacacacacacacacacacacacacacacaca

SEQ ID NO: 41941 - RNA, 64 nt, hsa
cacacacacgcacacaaaccacaccacacacacacacacacacacacacacacacacacacaca

SEQ ID NO: 41942 - RNA, 64 nt, hsa
cacacacgcacacaaaccacaccacacacacacacacacacacacacacacacacacacacaca

SEQ ID NO: 41943 - RNA, 64 nt, hsa
cacacgcacacaaaccacaccacacacacacacacacacacacacacacacacacacacacaca

SEQ ID NO: 41944 - RNA, 64 nt, hsa
cacgcacacaaaccacaccacacacacacacacacacacacacacacacacacacacacacaca

SEQ ID NO: 41945 - RNA, 64 nt, hsa
cgcacacaaaccacaccacacacacacacacacacacacacacacacacacacacacacacacc

SEQ ID NO: 41946 - RNA, 64 nt, hsa
cacacaaaccacaccacacacacacacacacacacacacacacacacacacacacacacaccaa

SEQ ID NO: 41947 - RNA, 64 nt, hsa
cacaaaccacaccacacacacacacacacacacacacacacacacacacacacacacaccaagu

SEQ ID NO: 41948 - RNA, 64 nt, hsa
caaaccacaccacacacacacacacacacacacacacacacacacacacacacacaccaaguac

SEQ ID NO: 41949 - RNA, 64 nt, hsa
aaccacaccacacacacacacacacacacacacacacacacacacacacacacaccaaguacca

SEQ ID NO: 41950 - RNA, 64 nt, hsa
ccacaccacacacacacacacacacacacacacacacacacacacacacacaccaaguaccagu

SEQ ID NO: 41951 - RNA, 64 nt, hsa
acaccacacacacacacacacacacacacacacacacacacacacacacaccaaguaccaguau

SEQ ID NO: 41952 - RNA, 64 nt, hsa
accacacacacacacacacacacacacacacacacacacacacacacaccaaguaccaguauaa

SEQ ID NO: 41953 - RNA, 64 nt, hsa
cacacacacacacacacacacacacacacacacacacacacacacaccaaguaccaguauaagc

SEQ ID NO: 41954 - RNA, 64 nt, hsa
cacacacacacacacacacacacacacacacacacacacacacaccaaguaccaguauaagcau

SEQ ID NO: 41955 - RNA, 64 nt, hsa
cacacacacacacacacacacacacacacacacacacacacaccaaguaccaguauaagcaucu

SEQ ID NO: 41956 - RNA, 64 nt, hsa
ucuuauuuuugauaauggcucuuaaaucuuuaaacacacacacaaaaucguucuuuacuuucau

SEQ ID NO: 41957 - RNA, 64 nt, hsa
uuauuuuugauaauggcucuuaaaucuuuaaacacacacacaaaaucguucuuuacuuucauuu

SEQ ID NO: 41958 - RNA, 64 nt, hsa
uguguguguguguguauauguguuuauagagauacacacacauauauauguguguauauauaua

SEQ ID NO: 41959 - RNA, 64 nt, hsa
cauacauauauauacacacacgcauuugcacagacacacacauauaucaauucucaugagugua

SEQ ID NO: 41960 - RNA, 64 nt, hsa
uauccuggcaaugggguagucacugccacccuuccacacacacacacacacacacacacacaaa

SEQ ID NO: 41961 - RNA, 64 nt, hsa
uccuggcaaugggguagucacugccacccuuccacacacacacacacacacacacacacaaaaa

SEQ ID NO: 41962 - RNA, 64 nt, hsa
cuggcaaugggguagucacugccacccuuccacacacacacacacacacacacacacaaaaaaa

SEQ ID NO: 41963 - RNA, 64 nt, hsa
ggcaaugggguagucacugccacccuuccacacacacacacacacacacacacacaaaaaaaaa

SEQ ID NO: 41964 - RNA, 64 nt, hsa
caaugggguagucacugccacccuuccacacacacacacacacacacacacacaaaaaaaaauc

SEQ ID NO: 41965 - RNA, 64 nt, hsa
augggguagucacugccacccuuccacacacacacacacacacacacacacaaaaaaaaauccc

SEQ ID NO: 41966 - RNA, 64 nt, hsa
gggguagucacugccacccuuccacacacacacacacacacacacacacaaaaaaaaaucccuu

SEQ ID NO: 41967 - RNA, 64 nt, hsa
gguagucacugccacccuuccacacacacacacacacacacacacacaaaaaaaaaucccuucc

SEQ ID NO: 41968 - RNA, 64 nt, hsa
uagucacugccacccuuccacacacacacacacacacacacacacaaaaaaaaaucccuuccuu

SEQ ID NO: 41969 - RNA, 64 nt, hsa
gucacugccacccuuccacacacacacacacacacacacacacaaaaaaaaaucccuuccuugu

SEQ ID NO: 41970 - RNA, 64 nt, hsa
cacugccacccuuccacacacacacacacacacacacacacaaaaaaaaaucccuuccuugugg

SEQ ID NO: 41971 - RNA, 64 nt, hsa
caggcucccucccucccagauccaggaacacaugcacacacacacacacacacacgcagacaca

SEQ ID NO: 41972 - RNA, 64 nt, hsa
ggcucccucccucccagauccaggaacacaugcacacacacacacacacacacgcagacacaca

SEQ ID NO: 41973 - RNA, 64 nt, hsa
cucccucccucccagauccaggaacacaugcacacacacacacacacacacgcagacacacaca

SEQ ID NO: 41974 - RNA, 64 nt, hsa
cccucccucccagauccaggaacacaugcacacacacacacacacacacgcagacacacacaca

SEQ ID NO: 41975 - RNA, 64 nt, hsa
cucccucccagauccaggaacacaugcacacacacacacacacacacgcagacacacacacaca

SEQ ID NO: 41976 - RNA, 64 nt, hsa
cccucccagauccaggaacacaugcacacacacacacacacacacgcagacacacacacacaca

SEQ ID NO: 41977 - RNA, 64 nt, hsa
cucccagauccaggaacacaugcacacacacacacacacacacgcagacacacacacacacaca

SEQ ID NO: 41978 - RNA, 64 nt, hsa
aacacaugcacacacacacacacacacacgcagacacacacacacacacacauauauguauacg

SEQ ID NO: 41979 - RNA, 64 nt, hsa
cacaugcacacacacacacacacacacgcagacacacacacacacacacauauauguauacgca

SEQ ID NO: 41980 - RNA, 64 nt, hsa
caugcacacacacacacacacacacgcagacacacacacacacacacauauauguauacgcacg

SEQ ID NO: 41981 - RNA, 64 nt, hsa
ugcacacacacacacacacacacgcagacacacacacacacacacauauauguauacgcacgca

SEQ ID NO: 41982 - RNA, 64 nt, hsa
cacacacacacacacacacacgcagacacacacacacacacacauauauguauacgcacgcacc

SEQ ID NO: 41983 - RNA, 64 nt, hsa
cacacacacacacacacacgcagacacacacacacacacacauauauguauacgcacgcaccca

SEQ ID NO: 41984 - RNA, 64 nt, hsa
acugcuucuugcagucaacaagaaauaccaauaacacacacagaacaaaaaccaucaaaaucuc

SEQ ID NO: 41985 - RNA, 64 nt, hsa
ucucucugcaaaacuuuaguuuucugaugaucuacacacacacacacacacacacgugcacaca

SEQ ID NO: 41986 - RNA, 64 nt, hsa
ucucugcaaaacuuuaguuuucugaugaucuacacacacacacacacacacacgugcacacaca

SEQ ID NO: 41987 - RNA, 64 nt, hsa
ucugcaaaacuuuaguuuucugaugaucuacacacacacacacacacacacgugcacacacaca

SEQ ID NO: 41988 - RNA, 64 nt, hsa
ugcaaaacuuuaguuuucugaugaucuacacacacacacacacacacacgugcacacacacaca

SEQ ID NO: 41989 - RNA, 64 nt, hsa
caaaacuuuaguuuucugaugaucuacacacacacacacacacacacgugcacacacacacaca

SEQ ID NO: 41990 - RNA, 64 nt, hsa
aaacuuuaguuuucugaugaucuacacacacacacacacacacacgugcacacacacacacauu

SEQ ID NO: 41991 - RNA, 64 nt, hsa
acuuuaguuuucugaugaucuacacacacacacacacacacacgugcacacacacacacauuua

SEQ ID NO: 41992 - RNA, 64 nt, hsa
ugaugaucuacacacacacacacacacacacgugcacacacacacacauuuaaaugauauaaaa

SEQ ID NO: 41993 - RNA, 64 nt, hsa
augaucuacacacacacacacacacacacgugcacacacacacacauuuaaaugauauaaaaag

SEQ ID NO: 41994 - RNA, 64 nt, hsa
gaucuacacacacacacacacacacacgugcacacacacacacauuuaaaugauauaaaaagaa

SEQ ID NO: 41995 - RNA, 64 nt, hsa
ucuacacacacacacacacacacacgugcacacacacacacauuuaaaugauauaaaaagaaga

SEQ ID NO: 41996 - RNA, 64 nt, hsa
cacaaauuguucaguucuuaaaauguaauuaugucacacacacaaaaaauccuuuucaauccug

SEQ ID NO: 41997 - RNA, 64 nt, hsa
caaauuguucaguucuuaaaauguaauuaugucacacacacaaaaaauccuuuucaauccugag

SEQ ID NO: 41998 - RNA, 64 nt, hsa
uccuauccgaucugaaaacacacauacacaaaugcacacacaugcacacacacauuuaagggac

SEQ ID NO: 41999 - RNA, 64 nt, hsa
ucugaaaacacacauacacaaaugcacacacaugcacacacacauuuaagggacauagcaguaa

SEQ ID NO: 42000 - RNA, 64 nt, hsa
ugaaaacacacauacacaaaugcacacacaugcacacacacauuuaagggacauagcaguaaca

SEQ ID NO: 42001 - RNA, 64 nt, hsa
ugaguuuguaaucuaguuacagaaguaaggcauacacacacacaaagauaacaguaccuagaga

SEQ ID NO: 42002 - RNA, 64 nt, hsa
aguuuguaaucuaguuacagaaguaaggcauacacacacacaaagauaacaguaccuagagaga

SEQ ID NO: 42003 - RNA, 64 nt, hsa
agauaguaaaacaggcaaagcagaaucacaugugcacacacacauacacauguaaacauuggaa

SEQ ID NO: 42004 - RNA, 64 nt, hsa
auaguaaaacaggcaaagcagaaucacaugugcacacacacauacacauguaaacauuggaaug

SEQ ID NO: 42005 - RNA, 64 nt, hsa
auuauauuucuuuuuagauugucuaucuguauaacacacacacacacaccuaagagucucuauu

SEQ ID NO: 42006 - RNA, 64 nt, hsa
uauauuucuuuuuagauugucuaucuguauaacacacacacacacaccuaagagucucuauuuc

SEQ ID NO: 42007 - RNA, 64 nt, hsa
uauuucuuuuuagauugucuaucuguauaacacacacacacacaccuaagagucucuauuucac

SEQ ID NO: 42008 - RNA, 64 nt, hsa
uuucuuuuuagauugucuaucuguauaacacacacacacacaccuaagagucucuauuucacaa

SEQ ID NO: 42009 - RNA, 64 nt, hsa
gaaaaauucuuaaaauauauaugaauuuguguaacacacacagagacacacacacauacuacuu

SEQ ID NO: 42010 - RNA, 64 nt, hsa
aaauauauaugaauuuguguaacacacacagagacacacacacauacuacuuuaagggggugag

SEQ ID NO: 42011 - RNA, 64 nt, hsa
auauauaugaauuuguguaacacacacagagacacacacacauacuacuuuaagggggugagga

SEQ ID NO: 42012 - RNA, 64 nt, hsa
gauucucaaucucuuugaauuuuacuuacauuuacacacacacgcacacacauauguauauaca

SEQ ID NO: 42013 - RNA, 64 nt, hsa
cucuuugaauuuuacuuacauuuacacacacacgcacacacauauguauauacacauaucauuu

SEQ ID NO: 42014 - RNA, 64 nt, hsa
cucaaccucuuugaauuuuacuuauaauuacauacacacacacacugcuacuuauauaaauguu

SEQ ID NO: 42015 - RNA, 64 nt, hsa
caaccucuuugaauuuuacuuauaauuacauacacacacacacugcuacuuauauaaauguucu

SEQ ID NO: 42016 - RNA, 64 nt, hsa
ucccccagucucucuucucaaucccccuuucuaacacacacacacacacacacacacacacaca

SEQ ID NO: 42017 - RNA, 64 nt, hsa
ccccagucucucuucucaaucccccuuucuaacacacacacacacacacacacacacacacaca

SEQ ID NO: 42018 - RNA, 64 nt, hsa
ccagucucucuucucaaucccccuuucuaacacacacacacacacacacacacacacacacaca

SEQ ID NO: 42019 - RNA, 64 nt, hsa
agucucucuucucaaucccccuuucuaacacacacacacacacacacacacacacacacacaca

SEQ ID NO: 42020 - RNA, 64 nt, hsa
ucucucuucucaaucccccuuucuaacacacacacacacacacacacacacacacacacacaca

SEQ ID NO: 42021 - RNA, 64 nt, hsa
ucucuucucaaucccccuuucuaacacacacacacacacacacacacacacacacacacacaca

SEQ ID NO: 42022 - RNA, 64 nt, hsa
ucuucucaaucccccuuucuaacacacacacacacacacacacacacacacacacacacacaca

SEQ ID NO: 42023 - RNA, 64 nt, hsa
uucucaaucccccuuucuaacacacacacacacacacacacacacacacacacacacacacaca

SEQ ID NO: 42024 - RNA, 64 nt, hsa
cucaaucccccuuucuaacacacacacacacacacacacacacacacacacacacacacacaca

SEQ ID NO: 42025 - RNA, 64 nt, hsa
caaucccccuuucuaacacacacacacacacacacacacacacacacacacacacacacacaca

SEQ ID NO: 42026 - RNA, 64 nt, hsa
aucccccuuucuaacacacacacacacacacacacacacacacacacacacacacacacacaca

SEQ ID NO: 42027 - RNA, 64 nt, hsa
cccccuuucuaacacacacacacacacacacacacacacacacacacacacacacacacacaca

SEQ ID NO: 42028 - RNA, 64 nt, hsa
cccuuucuaacacacacacacacacacacacacacacacacacacacacacacacacacacaga

SEQ ID NO: 42029 - RNA, 64 nt, hsa
cuuucuaacacacacacacacacacacacacacacacacacacacacacacacacacacagagu

SEQ ID NO: 42030 - RNA, 64 nt, hsa
uucuaacacacacacacacacacacacacacacacacacacacacacacacacacacagaguca

SEQ ID NO: 42031 - RNA, 64 nt, hsa
cuaacacacacacacacacacacacacacacacacacacacacacacacacacacagagucagg

SEQ ID NO: 42032 - RNA, 64 nt, hsa
aacacacacacacacacacacacacacacacacacacacacacacacacacacagagucaggcc

SEQ ID NO: 42033 - RNA, 64 nt, hsa
cacacacacacacacacacacacacacacacacacacacacacacacacacagagucaggccgu

SEQ ID NO: 42034 - RNA, 64 nt, hsa
cacacacacacacacacacacacacacacacacacacacacacacacacagagucaggccguug

SEQ ID NO: 42035 - RNA, 64 nt, hsa
cacacacacacacacacacacacacacacacacacacacacacacacagagucaggccguugcu

SEQ ID NO: 42036 - RNA, 64 nt, hsa
cacacacacacacacacacacacacacacacacacacacacacacagagucaggccguugcuag

SEQ ID NO: 42037 - RNA, 64 nt, hsa
cacacacacacacacacacacacacacacacacacacacacacagagucaggccguugcuaguc

SEQ ID NO: 42038 - RNA, 64 nt, hsa
cacacacacacacacacacacacacacacacacacacacacagagucaggccguugcuagucag

SEQ ID NO: 42039 - RNA, 64 nt, hsa
cggacucacacgaagucacacgcacacaugcacgcacacacacauauggggaccugcacaccug

SEQ ID NO: 42040 - RNA, 64 nt, hsa
gacucacacgaagucacacgcacacaugcacgcacacacacauauggggaccugcacaccugca

SEQ ID NO: 42041 - RNA, 64 nt, hsa
ugcaugcacauauguguauguguguggaucuguacacacacacguauauauggccagaugcgua

SEQ ID NO: 42042 - RNA, 64 nt, hsa
acuuugggggguggggaaggggccaagcugcagacacacacagucauucauuucuguccacacc

SEQ ID NO: 42043 - RNA, 64 nt, hsa
ugugugugcuugugugugcgcacgugucggcgcucacacacacaugcuagcccacugaugcacc

SEQ ID NO: 42044 - RNA, 64 nt, hsa
ugugugcuugugugugcgcacgugucggcgcucacacacacaugcuagcccacugaugcaccca

SEQ ID NO: 42045 - RNA, 64 nt, hsa
gaguguauuuacagcuuguuaaauuagagacaugcacacacaaagaaucaguagggagaaacaa

SEQ ID NO: 42046 - RNA, 64 nt, hsa
uacguauauaaauauauauauauauacacacacacacacacauuagucauaucaccucuguuuc

SEQ ID NO: 42047 - RNA, 64 nt, hsa
uguacguauauaaauauauauauauauacacacacacacacacauuagucauaucaccucuguu

SEQ ID NO: 42048 - RNA, 64 nt, hsa
ucuguacguauauaaauauauauauauauacacacacacacacacauuagucauaucaccucug

SEQ ID NO: 42049 - RNA, 64 nt, hsa
gcucuguacguauauaaauauauauauauauacacacacacacacacauuagucauaucaccuc

SEQ ID NO: 42050 - RNA, 64 nt, hsa
gugcucuguacguauauaaauauauauauauauacacacacacacacacauuagucauaucacc

SEQ ID NO: 42051 - RNA, 64 nt, hsa
acaaaacaaacacacacacacacacauacacacacacacacaaaacuuugaggcagcgcauugu

SEQ ID NO: 42052 - RNA, 64 nt, hsa
aaacaaaacaaacacacacacacacacauacacacacacacacaaaacuuugaggcagcgcauu

SEQ ID NO: 42053 - RNA, 64 nt, hsa
aaaaacaaaacaaacacacacacacacacauacacacacacacacaaaacuuugaggcagcgca

SEQ ID NO: 42054 - RNA, 64 nt, hsa
cuaaaaacaaaacaaacacacacacacacacauacacacacacacacaaaacuuugaggcagcg

SEQ ID NO: 42055 - RNA, 64 nt, hsa
auaaaaaccccuaaaaacaaaacaaacacacacacacacacauacacacacacacacaaaacuu

SEQ ID NO: 42056 - RNA, 64 nt, hsa
uuauaaaaaccccuaaaaacaaaacaaacacacacacacacacauacacacacacacacaaaac

SEQ ID NO: 42057 - RNA, 64 nt, hsa
guuuauaaaaaccccuaaaaacaaaacaaacacacacacacacacauacacacacacacacaaa

SEQ ID NO: 42058 - RNA, 64 nt, hsa
uuguuuauaaaaaccccuaaaaacaaaacaaacacacacacacacacauacacacacacacaca

SEQ ID NO: 42059 - RNA, 64 nt, hsa
aguuguuuauaaaaaccccuaaaaacaaaacaaacacacacacacacacauacacacacacaca

SEQ ID NO: 42060 - RNA, 64 nt, hsa
cgcgcacacacacacacacacacacacacacacacacacacaccaaguaccaguauaggcaucu

SEQ ID NO: 42061 - RNA, 64 nt, hsa
cgcgcgcacacacacacacacacacacacacacacacacacacaccaaguaccaguauaggcau

SEQ ID NO: 42062 - RNA, 64 nt, hsa
cgcgcgcgcacacacacacacacacacacacacacacacacacacaccaaguaccaguauaggc

SEQ ID NO: 42063 - RNA, 64 nt, hsa
cgcgcgcgcgcacacacacacacacacacacacacacacacacacacaccaaguaccaguauag

SEQ ID NO: 42064 - RNA, 64 nt, hsa
cgcgcgcgcgcgcacacacacacacacacacacacacacacacacacacaccaaguaccaguau

SEQ ID NO: 42065 - RNA, 64 nt, hsa
ugcgcgcgcgcgcgcacacacacacacacacacacacacacacacacacacaccaaguaccagu

SEQ ID NO: 42066 - RNA, 64 nt, hsa
caugcgcgcgcgcgcgcacacacacacacacacacacacacacacacacacacaccaaguacca

SEQ ID NO: 42067 - RNA, 64 nt, hsa
cacaugcgcgcgcgcgcgcacacacacacacacacacacacacacacacacacacaccaaguac

SEQ ID NO: 42068 - RNA, 64 nt, hsa
cacacaugcgcgcgcgcgcgcacacacacacacacacacacacacacacacacacacaccaagu

SEQ ID NO: 42069 - RNA, 64 nt, hsa
gacacacaugcgcgcgcgcgcgcacacacacacacacacacacacacacacacacacacaccaa

SEQ ID NO: 42070 - RNA, 64 nt, hsa
cagacacacaugcgcgcgcgcgcgcacacacacacacacacacacacacacacacacacacacc

SEQ ID NO: 42071 - RNA, 64 nt, hsa
cacagacacacaugcgcgcgcgcgcgcacacacacacacacacacacacacacacacacacaca

SEQ ID NO: 42072 - RNA, 64 nt, hsa
cacacagacacacaugcgcgcgcgcgcgcacacacacacacacacacacacacacacacacaca

SEQ ID NO: 42073 - RNA, 64 nt, hsa
gccacacagacacacaugcgcgcgcgcgcgcacacacacacacacacacacacacacacacaca

SEQ ID NO: 42074 - RNA, 64 nt, hsa
augccacacagacacacaugcgcgcgcgcgcgcacacacacacacacacacacacacacacaca

SEQ ID NO: 42075 - RNA, 64 nt, hsa
acaugccacacagacacacaugcgcgcgcgcgcgcacacacacacacacacacacacacacaca

SEQ ID NO: 42076 - RNA, 64 nt, hsa
auuucagauuuuuuccucugcauuuacacaaacacacacacaugccacacagacacacaugcgc

SEQ ID NO: 42077 - RNA, 64 nt, hsa
uaauuucagauuuuuuccucugcauuuacacaaacacacacacaugccacacagacacacaugc

SEQ ID NO: 42078 - RNA, 64 nt, hsa
uacacacacacacacacacacacacagagacacacacacacaccaaguaccaguauaagcaucu

SEQ ID NO: 42079 - RNA, 64 nt, hsa
uuuacacacacacacacacacacacacagagacacacacacacaccaaguaccaguauaagcau

SEQ ID NO: 42080 - RNA, 64 nt, hsa
cauuuacacacacacacacacacacacacagagacacacacacacaccaaguaccaguauaagc

SEQ ID NO: 42081 - RNA, 64 nt, hsa
uuuucuccucugcauuuacacacacacacacacacacacacagagacacacacacacaccaagu

SEQ ID NO: 42082 - RNA, 64 nt, hsa
gauuuucuccucugcauuuacacacacacacacacacacacacagagacacacacacacaccaa

SEQ ID NO: 42083 - RNA, 64 nt, hsa
ccgauuuucuccucugcauuuacacacacacacacacacacacacagagacacacacacacacc

SEQ ID NO: 42084 - RNA, 64 nt, hsa
uuccgauuuucuccucugcauuuacacacacacacacacacacacacagagacacacacacaca

SEQ ID NO: 42085 - RNA, 64 nt, hsa
auuuccgauuuucuccucugcauuuacacacacacacacacacacacacagagacacacacaca

SEQ ID NO: 42086 - RNA, 64 nt, hsa
uaauuuccgauuuucuccucugcauuuacacacacacacacacacacacacagagacacacaca

SEQ ID NO: 42087 - RNA, 64 nt, hsa
uuuaauuuccgauuuucuccucugcauuuacacacacacacacacacacacacagagacacaca

SEQ ID NO: 42088 - RNA, 64 nt, hsa
uguuuaauuuccgauuuucuccucugcauuuacacacacacacacacacacacacagagacaca

SEQ ID NO: 42089 - RNA, 64 nt, hsa
aguguuuaauuuccgauuuucuccucugcauuuacacacacacacacacacacacacagagaca

SEQ ID NO: 42090 - RNA, 64 nt, hsa
cacacacacaaaccacaccacacacacacacacacacacacagacacacaccaaguaccaguau

SEQ ID NO: 42091 - RNA, 64 nt, hsa
cacacacacacaaaccacaccacacacacacacacacacacacagacacacaccaaguaccagu

SEQ ID NO: 42092 - RNA, 64 nt, hsa
uacacacacacacaaaccacaccacacacacacacacacacacacagacacacaccaaguacca

SEQ ID NO: 42093 - RNA, 64 nt, hsa
uuuacacacacacacaaaccacaccacacacacacacacacacacacagacacacaccaaguac

SEQ ID NO: 42094 - RNA, 64 nt, hsa
cauuuacacacacacacaaaccacaccacacacacacacacacacacacagacacacaccaagu

SEQ ID NO: 42095 - RNA, 64 nt, hsa
ugcauuuacacacacacacaaaccacaccacacacacacacacacacacacagacacacaccaa

SEQ ID NO: 42096 - RNA, 64 nt, hsa
ucugcauuuacacacacacacaaaccacaccacacacacacacacacacacacagacacacacc

SEQ ID NO: 42097 - RNA, 64 nt, hsa
ccucugcauuuacacacacacacaaaccacaccacacacacacacacacacacacagacacaca

SEQ ID NO: 42098 - RNA, 64 nt, hsa
uuccucugcauuuacacacacacacaaaccacaccacacacacacacacacacacacagacaca

SEQ ID NO: 42099 - RNA, 64 nt, hsa
uuuaauuucagauuuuuuccucugcauuuacacacacacacaaaccacaccacacacacacaca

SEQ ID NO: 42100 - RNA, 64 nt, hsa
uguuuaauuucagauuuuuuccucugcauuuacacacacacacaaaccacaccacacacacaca

SEQ ID NO: 42101 - RNA, 64 nt, hsa
aguguuuaauuucagauuuuuuccucugcauuuacacacacacacaaaccacaccacacacaca

SEQ ID NO: 42102 - RNA, 64 nt, hsa; identical to SEQ ID NO: 41907

SEQ ID NO: 42103 - RNA, 64 nt, hsa; identical to SEQ ID NO: 41906

SEQ ID NO: 42104 - RNA, 64 nt, hsa; identical to SEQ ID NO: 41905

SEQ ID NO: 42105 - RNA, 64 nt, hsa; identical to SEQ ID NO: 41904

SEQ ID NO: 42106 - RNA, 64 nt, hsa
accagacacacaaacacacacacacagacacacacacacacagacacaccaaguaccaguauaa

SEQ ID NO: 42107 - RNA, 64 nt, hsa
acaccagacacacaaacacacacacacagacacacacacacacagacacaccaaguaccaguau

SEQ ID NO: 42108 - RNA, 64 nt, hsa
acacaccagacacacaaacacacacacacagacacacacacacacagacacaccaaguaccagu

SEQ ID NO: 42109 - RNA, 64 nt, hsa
uuacacaccagacacacaaacacacacacacagacacacacacacacagacacaccaaguacca

SEQ ID NO: 42110 - RNA, 64 nt, hsa
cccucugcauuuacacaccagacacacaaacacacacacacagacacacacacacacagacaca

SEQ ID NO: 42111 - RNA, 64 nt, hsa
uccccucugcauuuacacaccagacacacaaacacacacacacagacacacacacacacagaca

SEQ ID NO: 42112 - RNA, 64 nt, hsa
uuuccccucugcauuuacacaccagacacacaaacacacacacacagacacacacacacacaga

SEQ ID NO: 42113 - RNA, 64 nt, hsa
cacacagacacacacacacacacacacacacacacacacacagagagauaaggaacaaaagugu

SEQ ID NO: 42114 - RNA, 64 nt, hsa
cacacacagacacacacacacacacacacacacacacacacacagagagauaaggaacaaaagu

SEQ ID NO: 42115 - RNA, 64 nt, hsa
cacacacacagacacacacacacacacacacacacacacacacacagagagauaaggaacaaaa

SEQ ID NO: 42116 - RNA, 64 nt, hsa
cacacacacacagacacacacacacacacacacacacacacacacacagagagauaaggaacaa

SEQ ID NO: 42117 - RNA, 64 nt, hsa
cacacacacacacagacacacacacacacacacacacacacacacacacagagagauaaggaac

SEQ ID NO: 42118 - RNA, 64 nt, hsa
cacacacacacacacagacacacacacacacacacacacacacacacacacagagagauaagga

SEQ ID NO: 42119 - RNA, 64 nt, hsa
uacacacacacacacacagacacacacacacacacacacacacacacacacacagagagauaag

SEQ ID NO: 42120 - RNA, 64 nt, hsa
cauacacacacacacacacagacacacacacacacacacacacacacacacacacagagagaua

SEQ ID NO: 42121 - RNA, 64 nt, hsa
cacauacacacacacacacacagacacacacacacacacacacacacacacacacacagagaga

SEQ ID NO: 42122 - RNA, 64 nt, hsa
uacacauacacacacacacacacagacacacacacacacacacacacacacacacacacagaga

SEQ ID NO: 42123 - RNA, 64 nt, hsa
aguacacauacacacacacacacacagacacacacacacacacacacacacacacacacacaga

SEQ ID NO: 42124 - RNA, 64 nt, hsa
ugaguacacauacacacacacacacacagacacacacacacacacacacacacacacacacaca

SEQ ID NO: 42125 - RNA, 64 nt, hsa
cuugaguacacauacacacacacacacacagacacacacacacacacacacacacacacacaca

SEQ ID NO: 42126 - RNA, 64 nt, hsa
cccuugaguacacauacacacacacacacacagacacacacacacacacacacacacacacaca

SEQ ID NO: 42127 - RNA, 64 nt, hsa
cacacagagacccuugaguacacauacacacacacacacacagacacacacacacacacacaca

SEQ ID NO: 42128 - RNA, 64 nt, hsa
cacacacagagacccuugaguacacauacacacacacacacacagacacacacacacacacaca

SEQ ID NO: 42129 - RNA, 64 nt, hsa
cacacacacagagacccuugaguacacauacacacacacacacacagacacacacacacacaca

SEQ ID NO: 42130 - RNA, 64 nt, hsa
cacacacacacagagacccuugaguacacauacacacacacacacacagacacacacacacaca

SEQ ID NO: 42131 - RNA, 64 nt, hsa
cacacacacacacagagacccuugaguacacauacacacacacacacacagacacacacacaca

SEQ ID NO: 42132 - RNA, 64 nt, hsa
ucggagaagcacuguugaaauuuauacacacacacacacacagagacccuugaguacacauaca

SEQ ID NO: 42133 - RNA, 64 nt, hsa
uuucggagaagcacuguugaaauuuauacacacacacacacacagagacccuugaguacacaua

SEQ ID NO: 42134 - RNA, 64 nt, hsa
uuuuucggagaagcacuguugaaauuuauacacacacacacacacagagacccuugaguacaca

SEQ ID NO: 42135 - RNA, 64 nt, hsa
cuuuuuucggagaagcacuguugaaauuuauacacacacacacacacagagacccuugaguaca

SEQ ID NO: 42136 - RNA, 64 nt, hsa
accuuuuuucggagaagcacuguugaaauuuauacacacacacacacacagagacccuugagua

SEQ ID NO: 42137 - RNA, 64 nt, hsa
uacacacacauauacauagacacacaaacacacacacacacauuaauaucuaucuugggggagg

SEQ ID NO: 42138 - RNA, 64 nt, hsa
cauacacacacauauacauagacacacaaacacacacacacacauuaauaucuaucuuggggga

SEQ ID NO: 42139 - RNA, 64 nt, hsa
cacauacacacacauauacauagacacacaaacacacacacacacauuaauaucuaucuugggg

SEQ ID NO: 42140 - RNA, 64 nt, hsa
cacacauacacacacauauacauagacacacaaacacacacacacacauuaauaucuaucuugg

SEQ ID NO: 42141 - RNA, 64 nt, hsa
cugucucccuccucaacacacacacacacacauacacacacauauacauagacacacaaacaca

SEQ ID NO: 42142 - RNA, 64 nt, hsa
cuccuccacacugucucccuccucaacacacacacacacacauacacacacauauacauagaca

SEQ ID NO: 42143 - RNA, 64 nt, hsa
agcuccuccacacugucucccuccucaacacacacacacacacauacacacacauauacauaga

SEQ ID NO: 42144 - RNA, 64 nt, hsa
uuagcuccuccacacugucucccuccucaacacacacacacacacauacacacacauauacaua

SEQ ID NO: 42145 - RNA, 64 nt, hsa
uuuuagcuccuccacacugucucccuccucaacacacacacacacacauacacacacauauaca

SEQ ID NO: 42146 - RNA, 64 nt, hsa
ccuuuuagcuccuccacacugucucccuccucaacacacacacacacacauacacacacauaua

SEQ ID NO: 42147 - RNA, 64 nt, hsa
ucccacauuuaaaguucuuauuuaaaaaaacacacacacacaaaugaaauuuuuaaucuuugaa

SEQ ID NO: 42148 - RNA, 64 nt, hsa
uaucccacauuuaaaguucuuauuuaaaaaaacacacacacacaaaugaaauuuuuaaucuuug

SEQ ID NO: 42149 - RNA, 64 nt, hsa
gauaucccacauuuaaaguucuuauuuaaaaaaacacacacacacaaaugaaauuuuuaaucuu

SEQ ID NO: 42150 - RNA, 64 nt, hsa
aauggucugguacaggaguuaaauaacaaugacacacacacaacaaaacaaacacaaaaccacu

SEQ ID NO: 42151 - RNA, 64 nt, hsa
aaaauggucugguacaggaguuaaauaacaaugacacacacacaacaaaacaaacacaaaacca

SEQ ID NO: 42152 - RNA, 64 nt, hsa
caaacacauacacacacauacacacacacagacacacacacacgaaacacaacacagacacuac

SEQ ID NO: 42153 - RNA, 64 nt, hsa
cacaaacacauacacacacauacacacacacagacacacacacacgaaacacaacacagacacu

SEQ ID NO: 42154 - RNA, 64 nt, hsa
cccacacacacacaaacacauacacacacauacacacacacagacacacacacacgaaacacaa

SEQ ID NO: 42155 - RNA, 64 nt, hsa
ugcccacacacacacaaacacauacacacacauacacacacacagacacacacacacgaaacac

SEQ ID NO: 42156 - RNA, 64 nt, hsa
aaagaaauucugcccacacacacacaaacacauacacacacauacacacacacagacacacaca

SEQ ID NO: 42157 - RNA, 64 nt, hsa
auuaggccuuaaauuaaaagaaauucugcccacacacacacaaacacauacacacacauacaca

SEQ ID NO: 42158 - RNA, 64 nt, hsa
ucauuaggccuuaaauuaaaagaaauucugcccacacacacacaaacacauacacacacauaca

SEQ ID NO: 42159 - RNA, 64 nt, hsa
acucauuaggccuuaaauuaaaagaaauucugcccacacacacacaaacacauacacacacaua

SEQ ID NO: 42160 - RNA, 64 nt, hsa
cucucacagacacacacacacacacacacacacacacacacacgcacguccacacucacauuaa

SEQ ID NO: 42161 - RNA, 64 nt, hsa
cucucucacagacacacacacacacacacacacacacacacacacgcacguccacacucacauu

SEQ ID NO: 42162 - RNA, 64 nt, hsa
cccucucucacagacacacacacacacacacacacacacacacacacgcacguccacacucaca

SEQ ID NO: 42163 - RNA, 64 nt, hsa
cucccucucucacagacacacacacacacacacacacacacacacacacgcacguccacacuca

SEQ ID NO: 42164 - RNA, 64 nt, hsa
cccucccucucucacagacacacacacacacacacacacacacacacacacgcacguccacacu

SEQ ID NO: 42165 - RNA, 64 nt, hsa
cucccucccucucucacagacacacacacacacacacacacacacacacacacgcacguccaca

SEQ ID NO: 42166 - RNA, 64 nt, hsa
cucucccucccucucucacagacacacacacacacacacacacacacacacacacgcacgucca

SEQ ID NO: 42167 - RNA, 64 nt, hsa
cucucucccucccucucucacagacacacacacacacacacacacacacacacacacgcacguc

SEQ ID NO: 42168 - RNA, 64 nt, hsa
cucucucucccucccucucucacagacacacacacacacacacacacacacacacacacgcacg

SEQ ID NO: 42169 - RNA, 64 nt, hsa
cucucucucucccucccucucucacagacacacacacacacacacacacacacacacacacgca

SEQ ID NO: 42170 - RNA, 64 nt, hsa
cucucucucucucccucccucucucacagacacacacacacacacacacacacacacacacacg

SEQ ID NO: 42171 - RNA, 64 nt, hsa
cucucucucucucucccucccucucucacagacacacacacacacacacacacacacacacaca

SEQ ID NO: 42172 - RNA, 64 nt, hsa
cucucucucucucucucccucccucucucacagacacacacacacacacacacacacacacaca

SEQ ID NO: 42173 - RNA, 64 nt, hsa
uucucccuccuucuuacacacacacacacacacacacacacaauccaucucuugcuuguuccua

SEQ ID NO: 42174 - RNA, 64 nt, hsa
acuucucccuccuucuuacacacacacacacacacacacacacaauccaucucuugcuuguucc

SEQ ID NO: 42175 - RNA, 64 nt, hsa
auacuucucccuccuucuuacacacacacacacacacacacacacaauccaucucuugcuuguu

SEQ ID NO: 42176 - RNA, 64 nt, hsa
cuauacuucucccuccuucuuacacacacacacacacacacacacacaauccaucucuugcuug

SEQ ID NO: 42177 - RNA, 64 nt, hsa
cccuauacuucucccuccuucuuacacacacacacacacacacacacacaauccaucucuugcu

SEQ ID NO: 42178 - RNA, 64 nt, hsa
cucccuauacuucucccuccuucuuacacacacacacacacacacacacacaauccaucucuug

SEQ ID NO: 42179 - RNA, 64 nt, hsa
cacucccuauacuucucccuccuucuuacacacacacacacacacacacacacaauccaucucu

SEQ ID NO: 42180 - RNA, 64 nt, hsa
accacucccuauacuucucccuccuucuuacacacacacacacacacacacacacaauccaucu

SEQ ID NO: 42181 - RNA, 64 nt, hsa
ccaccacucccuauacuucucccuccuucuuacacacacacacacacacacacacacaauccau

SEQ ID NO: 42182 - RNA, 64 nt, hsa
ugccaccacucccuauacuucucccuccuucuuacacacacacacacacacacacacacaaucc

SEQ ID NO: 42183 - RNA, 64 nt, hsa
cacacacacacacacacacacacacacacacacacacacacacguacacacaucccucacuucu

SEQ ID NO: 42184 - RNA, 64 nt, hsa
cacacacacacacacacacacacacacacacacacacacacacacguacacacaucccucacuu

SEQ ID NO: 42185 - RNA, 64 nt, hsa
cacacacacacacacacacacacacacacacacacacacacacacacguacacacaucccucac

SEQ ID NO: 42186 - RNA, 64 nt, hsa
cacacacacacacacacacacacacacacacacacacacacacacacacguacacacaucccuc

SEQ ID NO: 42187 - RNA, 64 nt, hsa
aacacacacacacacacacacacacacacacacacacacacacacacacacguacacacauccc

SEQ ID NO: 42188 - RNA, 64 nt, hsa
gaaacacacacacacacacacacacacacacacacacacacacacacacacacguacacacauc

SEQ ID NO: 42189 - RNA, 64 nt, hsa
cugaaacacacacacacacacacacacacacacacacacacacacacacacacacguacacaca

SEQ ID NO: 42190 - RNA, 64 nt, hsa
uucugaaacacacacacacacacacacacacacacacacacacacacacacacacacguacaca

SEQ ID NO: 42191 - RNA, 64 nt, hsa
uuuucugaaacacacacacacacacacacacacacacacacacacacacacacacacacguaca

SEQ ID NO: 42192 - RNA, 64 nt, hsa
gcuuuucugaaacacacacacacacacacacacacacacacacacacacacacacacacacgua

SEQ ID NO: 42193 - RNA, 64 nt, hsa
uggcuuuucugaaacacacacacacacacacacacacacacacacacacacacacacacacacg

SEQ ID NO: 42194 - RNA, 64 nt, hsa
aguggcuuuucugaaacacacacacacacacacacacacacacacacacacacacacacacaca

SEQ ID NO: 42195 - RNA, 64 nt, hsa
ggaguggcuuuucugaaacacacacacacacacacacacacacacacacacacacacacacaca

SEQ ID NO: 42196 - RNA, 64 nt, hsa
cuggaguggcuuuucugaaacacacacacacacacacacacacacacacacacacacacacaca

SEQ ID NO: 42197 - RNA, 64 nt, hsa
gacuggaguggcuuuucugaaacacacacacacacacacacacacacacacacacacacacaca

SEQ ID NO: 42198 - RNA, 64 nt, hsa
cagacuggaguggcuuuucugaaacacacacacacacacacacacacacacacacacacacaca

SEQ ID NO: 42199 - RNA, 64 nt, hsa
cccagacuggaguggcuuuucugaaacacacacacacacacacacacacacacacacacacaca

SEQ ID NO: 42200 - RNA, 64 nt, hsa
uucccagacuggaguggcuuuucugaaacacacacacacacacacacacacacacacacacaca

SEQ ID NO: 42201 - RNA, 64 nt, hsa
uuuucccagacuggaguggcuuuucugaaacacacacacacacacacacacacacacacacaca

SEQ ID NO: 42202 - RNA, 64 nt, hsa
uauuuucccagacuggaguggcuuuucugaaacacacacacacacacacacacacacacacaca

SEQ ID NO: 42203 - RNA, 64 nt, hsa
uuuauuuucccagacuggaguggcuuuucugaaacacacacacacacacacacacacacacaca

SEQ ID NO: 42204 - RNA, 64 nt, hsa
guuccaaaauauugacauugaauggaucaauacacacacacagacauauauauauauaugcaca

SEQ ID NO: 42205 - RNA, 64 nt, hsa
ggguuccaaaauauugacauugaauggaucaauacacacacacagacauauauauauauaugca

SEQ ID NO: 42206 - RNA, 64 nt, hsa
agauguuugggcacucagaugcuaucuuggugcacacacacaacauugcuguucagucacaaau

SEQ ID NO: 42207 - RNA, 64 nt, hsa
uuagauguuugggcacucagaugcuaucuuggugcacacacacaacauugcuguucagucacaa

SEQ ID NO: 42208 - RNA, 64 nt, hsa
cccaugcucuugcgugugcuugcacgugcacgcacacacacacccagugcucucuccacccgac

SEQ ID NO: 42209 - RNA, 64 nt, hsa
cccccaugcucuugcgugugcuugcacgugcacgcacacacacacccagugcucucuccacccg

SEQ ID NO: 42210 - RNA, 64 nt, hsa
acugcuucuugcagucaagaagaaauaccaauaacacacacagaacaaaaaccaucaaaaucuc

SEQ ID NO: 42211 - RNA, 64 nt, hsa
ucucucugcaaaccuuuaguuuucugaugaucuacacacacacauacacacacacacacacaca

SEQ ID NO: 42212 - RNA, 64 nt, hsa
ucucugcaaaccuuuaguuuucugaugaucuacacacacacauacacacacacacacacacacg

SEQ ID NO: 42213 - RNA, 64 nt, hsa
ccuuuaguuuucugaugaucuacacacacacauacacacacacacacacacacgugcacacaca

SEQ ID NO: 42214 - RNA, 64 nt, hsa
uuuaguuuucugaugaucuacacacacacauacacacacacacacacacacgugcacacacaca

SEQ ID NO: 42215 - RNA, 64 nt, hsa
uaguuuucugaugaucuacacacacacauacacacacacacacacacacgugcacacacacaca

SEQ ID NO: 42216 - RNA, 64 nt, hsa
guuuucugaugaucuacacacacacauacacacacacacacacacacgugcacacacacacauu

SEQ ID NO: 42217 - RNA, 64 nt, hsa
uuucugaugaucuacacacacacauacacacacacacacacacacgugcacacacacacauuua

SEQ ID NO: 42218 - RNA, 64 nt, hsa
ucugaugaucuacacacacacauacacacacacacacacacacgugcacacacacacauuuaaa

SEQ ID NO: 42219 - RNA, 64 nt, hsa
cacacacacauacacacacacacacacacacgugcacacacacacauuuaaaggauauaaaaag

SEQ ID NO: 42220 - RNA, 64 nt, hsa
cacacacauacacacacacacacacacacgugcacacacacacauuuaaaggauauaaaaagaa

SEQ ID NO: 42221 - RNA, 64 nt, hsa
cacacauacacacacacacacacacacgugcacacacacacauuuaaaggauauaaaaagaaga

SEQ ID NO: 42222 - RNA, 64 nt, hsa
cacaaauuguucaguucuuaaaauguaauuaugucacacacacaaaaaaauccuuuucaauccu

SEQ ID NO: 42223 - RNA, 64 nt, hsa
caaauuguucaguucuuaaaauguaauuaugucacacacacaaaaaaauccuuuucaauccuga

SEQ ID NO: 42224 - RNA, 64 nt, hsa
aaaguggaauguauuuaaaacuuguugaauuagacacacacacacagacacacacaaagaauca

SEQ ID NO: 42225 - RNA, 64 nt, hsa
aguggaauguauuuaaaacuuguugaauuagacacacacacacagacacacacaaagaaucagc

SEQ ID NO: 42226 - RNA, 64 nt, hsa
uggaauguauuuaaaacuuguugaauuagacacacacacacagacacacacaaagaaucagcag

SEQ ID NO: 42227 - RNA, 64 nt, hsa
uuaaaacuuguugaauuagacacacacacacagacacacacaaagaaucagcagagaaaacaaa

SEQ ID NO: 42228 - RNA, 64 nt, hsa
ggugaucuaagggccgcggccuccuccacacacacacacacaccaggggaaccaagagaaccac

SEQ ID NO: 42229 - RNA, 64 nt, hsa
aaggugaucuaagggccgcggccuccuccacacacacacacacaccaggggaaccaagagaacc

SEQ ID NO: 42230 - RNA, 64 nt, hsa
agaaggugaucuaagggccgcggccuccuccacacacacacacacaccaggggaaccaagagaa

SEQ ID NO: 42231 - RNA, 64 nt, hsa
caagaaggugaucuaagggccgcggccuccuccacacacacacacacaccaggggaaccaagag

SEQ ID NO: 42232 - RNA, 64 nt, hsa
cucaagaaggugaucuaagggccgcggccuccuccacacacacacacacaccaggggaaccaag

SEQ ID NO: 42233 - RNA, 64 nt, hsa
cuuugagugaaaagauaacacaggucuauugacucacacacauguuuuaagauggaaaacuuua

SEQ ID NO: 42234 - RNA, 64 nt, hsa
caagucagcuacucuccgugcccacuuccccccacacacacaccccacccuguugcugaccaag

SEQ ID NO: 42235 - RNA, 64 nt, hsa
ugcaagucagcuacucuccgugcccacuuccccccacacacacaccccacccuguugcugacca

SEQ ID NO: 42236 - RNA, 64 nt, hsa
gaaggggagaaagugacucuguucucuuagcaaccgucuguagcaaagaagugcuuccagcauc

SEQ ID NO: 42237 - RNA, 64 nt, hsa
auaauuggagaaaguucugcagcauggcuuuuuacgucuguaaauaaauaauuuuagaacagcc

SEQ ID NO: 42238 - RNA, 64 nt, hsa
caggccccaaguuuccucuggcagacaugcugcacgucuguacccuucucagaucaacucccug

SEQ ID NO: 42239 - RNA, 64 nt, hsa
gaucaggaccagccuggucaagauggugaaacuccgucuguacuaaaaauacaaaauuuagcuu

SEQ ID NO: 42240 - RNA, 64 nt, hsa
aggauggugucugugcacgugacuauuagaggagcgucuguagaaguaccugguuuggucagug

SEQ ID NO: 42241 - RNA, 64 nt, hsa
gccauccuaguuuuuaucucaagaugugucauaccgucuguaaugaagcaggcaugcccucuuu

SEQ ID NO: 42242 - RNA, 64 nt, hsa
gcggcaccgccauugucucaaccagccggcuccucgucuguacaccuggggauuucuuuugauu

SEQ ID NO: 42243 - RNA, 64 nt, hsa
augagugaucuugugugggaaaagccuucccaggcgucuguaccgaaaggagcagcaaacaagg

SEQ ID NO: 42244 - RNA, 64 nt, hsa
uaugguguaaccaugauucuauuauguauugguacgucuguagaccaagauauaauuuuuuaaa

SEQ ID NO: 42245 - RNA, 64 nt, hsa
uaacaauacuuccuuggacgggugcgguggcucacgucuguaaucccagcacuuugggaggcug

SEQ ID NO: 42246 - RNA, 64 nt, hsa
aaaaguacaaaaauuagaugggugugguguuucgcgucuguagucccagcuauuugggaagcug

SEQ ID NO: 42247 - RNA, 64 nt, hsa
uggaaccugcagaggccaaccuacaaccacauaucgucuguauugaaagacugugggaggauuc

SEQ ID NO: 42248 - RNA, 64 nt, hsa
aaguccugucugucuguaaggcguagaaucuguccgucuguaaggcguagaaugaggguuguua

SEQ ID NO: 42249 - RNA, 64 nt, hsa
aauaaucuguuauaugaacagacuucuaaaauaacgucuguauauuuuauauauagauacauau

SEQ ID NO: 42250 - RNA, 64 nt, hsa
uagccuggaccucgccgggggaccagggagugcacgucuguagaucuguacauaucugggccuu

SEQ ID NO: 42251 - RNA, 64 nt, hsa
uccugaccuaaucuuagcccggcgcaguggcucacgucuguaaucccagcacuuugggaggcug

SEQ ID NO: 42252 - RNA, 64 nt, hsa
aaauguggacaagcuaguuuucaaauuuugugugcgucuguaaguucuuaaagaaccagcuucu

SEQ ID NO: 42253 - RNA, 64 nt, hsa
cauuaagaauuaagaggcugggugcgguggcucacgucuguaaucccagcaccuugggaggccc

SEQ ID NO: 42254 - RNA, 64 nt, hsa
gaauggcaaacacucggcugggcacaguggcucacgucuguaaucuuugggagcacuuugggag

SEQ ID NO: 42255 - RNA, 64 nt, hsa
agggacugauguuauguucgacucagcacuugcccgucuguauugauugugucuuuuuuuuuuu

SEQ ID NO: 42256 - RNA, 64 nt, hsa
guuugguauuuagaauuagugcuguuguggagugcgucuguaaagugcuuguuuuaucauacuu

SEQ ID NO: 42257 - RNA, 64 nt, hsa
cauaugcuuguuuuguuugacucuuggcugccuacgucuguaggguccccugaaaaucccacuu

SEQ ID NO: 42258 - RNA, 64 nt, hsa
gagcugccccugucauagggagggggauucccagcgucuguagugcuuccuguuugcugaauaa

SEQ ID NO: 42259 - RNA, 64 nt, hsa
gcauuccugauaauuguauguauuguauaaagaacgucuguacauuggguuauaacacuaguau

SEQ ID NO: 42260 - RNA, 64 nt, hsa
uaaaguacaacaauuagcagggcaugguggugcacgucuguagucccagcuacucaggaggcug

SEQ ID NO: 42261 - RNA, 64 nt, hsa
uuuagagucccagggacaacuggaugaaacauuacgucuguagucaucuuauuugagauggggg

SEQ ID NO: 42262 - RNA, 64 nt, hsa
gccccgugucgugugcaugaucucugugagugugcgucuguacgggaagaggcagagggaggca

SEQ ID NO: 42263 - RNA, 64 nt, hsa
uuuucauaauaguggugauauguuugcguggauacgucuguacuauuucaucugguucauuuug

SEQ ID NO: 42264 - RNA, 64 nt, hsa
gggcccucgccgcggccgccacgaccccccuggacgucuguaagacccuucugaacacucagga

SEQ ID NO: 42265 - RNA, 64 nt, hsa
agaggaggaaguaauaguuucuaacugucggacccgucuguaaaccaaggacuaugaauacuaa

SEQ ID NO: 42266 - RNA, 64 nt, hsa
guuguuaauauuucaaaugugugguuuaugaauacgucuguauaaucggcuucuggagugaaac

SEQ ID NO: 42267 - RNA, 64 nt, hsa
guucaagaccagccuggccaacauggugaaaccucgucuguacuaaaaauacaaaauuuagcug

SEQ ID NO: 42268 - RNA, 64 nt, hsa
acaaaaguauuggacugucggaggugagccugugcgucuguaacccuuugugacuccugagcgu

SEQ ID NO: 42269 - RNA, 64 nt, hsa
ucugcuggucuccagccuuguauggaguuagaagcgucuguaucucuggagcagccaggcgcuc

SEQ ID NO: 42270 - RNA, 64 nt, hsa
agaguuaggaauuguguucaagugcuuggauuuccgucuguagauuuaacugcugaaauuguau

SEQ ID NO: 42271 - RNA, 64 nt, hsa
aaauuuagacaacuuggccagccgugguggcucacgucuguaaucccagcacuuugggaggcug

SEQ ID NO: 42272 - RNA, 64 nt, hsa
cucaugcacuccuugagaaguguuucuguauauccgucuguacgugugucauugcgugaagcag

SEQ ID NO: 42273 - RNA, 64 nt, hsa
ggacaaguacuaccuuccugggccucagcuuucucgucuguauaauggaagcaagacuuccaac

SEQ ID NO: 42274 - RNA, 64 nt, hsa
uaccuacgccuagggagcccguccuccaguauuccgucuguagcaggagcuagggcugcugccu

SEQ ID NO: 42275 - RNA, 64 nt, hsa
ggggaaagagcaaccccagcccgucccuuccccccgucuguauauagacauauauccucuuuuu

SEQ ID NO: 42276 - RNA, 64 nt, hsa
cuaauuuugcaugaguaaguuuacaaauauguaucgucuguaaagcagcaugugcagauuauuc

SEQ ID NO: 42277 - RNA, 64 nt, hsa
auaggaagagaaacauaacuacuguuccagguaacgucuguaucauacaguuaguguugccagu

SEQ ID NO: 42278 - RNA, 64 nt, hsa
aagaguccuuacugaagccaggcaccguggcucacgucuguaaucccagcgcuuugggaggccg

SEQ ID NO: 42279 - RNA, 64 nt, hsa
guuugagaccagccuggccaacauggcaaaaccccgucuguacucaaaaugcaaaaauuagcca

SEQ ID NO: 42280 - RNA, 64 nt, hsa
cuagaaagcauuuuaggccagccaugguggcucacgucuguaaucccaggacuuugggaggcug

SEQ ID NO: 42281 - RNA, 64 nt, hsa
ugauauuuacucuuccuuuuaaguuuucuaaguacgucuguagcaugaugguauagauuuucuu

SEQ ID NO: 42282 - RNA, 64 nt, hsa
cucgugcuggugugggcaugggacuggcuggaaacgucuguaugcagggagccagggugagggc

SEQ ID NO: 42283 - RNA, 64 nt, hsa
ugaagugcuguuaucggaaaccaucagacauuuccgucuguacucucagaaagcaccgaaugac

SEQ ID NO: 42284 - RNA, 64 nt, hsa
caccugagacuuauugggucccugauuccugcuucgucuguauccgcagaguaguugcauguca

SEQ ID NO: 42285 - RNA, 64 nt, hsa
aacaauguuaaugcuguaagugaaaguucacugucgucuguauacuaaauuuauugguguuucu

SEQ ID NO: 42286 - RNA, 64 nt, hsa
acaagacuuagacuucccgaguugugcagagugacgucuguacuuuuuauacuuagaacauuug

SEQ ID NO: 42287 - RNA, 64 nt, hsa
ugagaugauucagaaggggaggggagacagguaacgucuguaagcugaaguuucacuccggagu

SEQ ID NO: 42288 - RNA, 64 nt, hsa
aaaaaauguugaaccggcugggcgcgguggcucacgucuguaaucccagcacuuugggaggccg

SEQ ID NO: 42289 - RNA, 64 nt, hsa
ugcuccacagcuucaucaccaaaaggggccauuccgucuguaccaaccccagugacaagugggu

SEQ ID NO: 42290 - RNA, 64 nt, hsa
cuguuuuucacgaguaucaacuuucauacugacgcgucuguaaucuguucuuaugcucauuuug

SEQ ID NO: 42291 - RNA, 64 nt, hsa
guacucccaaugcuguguaucaugacacuaucuucgucuguaguauuuaugauguuaagauaau

SEQ ID NO: 42292 - RNA, 64 nt, hsa
ggcgagaaccacauuggacggucccggcucagaccgucuguacucagagcgacggaugcccccu

SEQ ID NO: 42293 - RNA, 64 nt, hsa
guuugugagaacucacgccgggggugaaaauguacgucuguagcauggagaagccuucagggua

SEQ ID NO: 42294 - RNA, 64 nt, hsa
guuccagaccaggcuggccagcauggugaaaccccgucuguacuaaaaauacaaaaaauuaacu

SEQ ID NO: 42295 - RNA, 64 nt, hsa
auuauuuaaaagacaggccgggcgcgguggcucacgucuguaaucccagcacuuugggaggcug

SEQ ID NO: 42296 - RNA, 64 nt, hsa
caaugagaaauuaccggccaggcguggugacucacgucuguaaucccagcacuuugggagggca

SEQ ID NO: 42297 - RNA, 64 nt, hsa
ggucuuugcuucugauuacaggagcacuguggaacgucuguaaauauguuuuuauaauuccaug

SEQ ID NO: 42298 - RNA, 64 nt, hsa
aauaugugcacuaucagcugggugcaguggcucacgucuguaaucccagcacuuugggaggccg

SEQ ID NO: 42299 - RNA, 64 nt, hsa
uauaaaaaauaaucuauuucuaugagaaaagaggcgucuguauauuuugggaaucuuuuccguu

SEQ ID NO: 42300 - RNA, 64 nt, hsa
ggcugugaggacacugcggggguuggggggggggcgucuguaccucaggggaugccccgcugug

SEQ ID NO: 42301 - RNA, 64 nt, hsa
gugcagggugggaggagaagaccaaacgaaguaacgucuguaaaaccccuuccuggacagcgua

SEQ ID NO: 42302 - RNA, 64 nt, hsa
cguagucagcccuugcgcucaguguagaaacccacgucuguaaggucggucuucguccaucugc

SEQ ID NO: 42303 - RNA, 64 nt, hsa
cacugcuggauggcucagagcaagcugggcuccccgucuguaagauggcaaaaaugcugccccc

SEQ ID NO: 42304 - RNA, 64 nt, hsa
cauauagccuagcauuuauaacagaauuguugaacgucuguaaaugauuuuuuuuuuuuuugca

SEQ ID NO: 42305 - RNA, 64 nt, hsa
cuaugcagaugccugggccguagcuugucuguagcgucuguauaauuauaauguugcccagugu

SEQ ID NO: 42306 - RNA, 64 nt, hsa
uggugucagcaguacacauggauaaucaguauuugacuguaauaguauaguaguuaaauacagc

SEQ ID NO: 42307 - RNA, 64 nt, hsa
gguagcaagaguuccugauacaaauagaugcaaugacuguaaauggugucagcaguacacaugg

SEQ ID NO: 42308 - RNA, 64 nt, hsa
gcccagggccgcccuagcaacuuccuguacauaugacuguaaaaugguaaacguguguauuaua

SEQ ID NO: 42309 - RNA, 64 nt, hsa
auguauacauauacauauauauaauauauaugaagacuguaaauguuaagacgacuaguguucu

SEQ ID NO: 42310 - RNA, 64 nt, hsa
cuuggggggugggggagauaaaaagaacuuaaaauggguaaaguaagaaauguuaaaaaguccc

SEQ ID NO: 42311 - RNA, 64 nt, hsa
agucccuguuuuguccugaaauuuuagucuauucuggguaaauaggauuuucugacacagauau

SEQ ID NO: 42312 - RNA, 64 nt, hsa
ucaggguccauuucucuuggauguaaaggaguccuggguaaaauguggcuguaaccuaaaccaa

SEQ ID NO: 42313 - RNA, 64 nt, hsa
cuucaccauacugguuucuucucuuugguugguguggguaaaagaaaacaaaacauuuccuaua

SEQ ID NO: 42314 - RNA, 64 nt, hsa
caacugugccucccucugucuguuuucacuugaauggguaaauaaccagcagcuagguuuugaa

SEQ ID NO: 42315 - RNA, 64 nt, hsa
uuuaggaugagacauuuuugguuuugguuuuguuuggguaaauuuuaaauggugugaaaaucga

SEQ ID NO: 42316 - RNA, 64 nt, hsa
uugaaagggugugugauuacaccauuguuaaugcuggguaaaaacuaucuucuugcagccuugc

SEQ ID NO: 42317 - RNA, 64 nt, hsa
ccuauaaucccggcuacucgggaggcugaggcaggagaaucaccugaacccgggaggcaaaggu

SEQ ID NO: 42318 - RNA, 64 nt, hsa
ccuguagucccaacuacuagggaggcugaggcaggagaaucacuugaacccaggagguggaggu

SEQ ID NO: 42319 - RNA, 64 nt, hsa
gagucauauacauuaguuuuaaucucuuaauauugagaaucagguugcaaaacggaugaguuau

SEQ ID NO: 42320 - RNA, 64 nt, hsa
uacauuuccauuuauuguuugaaaugucgaucaagagaaucaacagaugauaguccaauuuuua

SEQ ID NO: 42321 - RNA, 64 nt, hsa
ccuauaaucccagcuacuggggaggcugaggcaggagaaucacuugaacccgggggacagaggu

SEQ ID NO: 42322 - RNA, 64 nt, hsa
cccguaaucccagcuacucaggaggcugagacaggagaaucaccugaaccccagaggcagaggu

SEQ ID NO: 42323 - RNA, 64 nt, hsa
gccuguaaucucacuacacaggaggcugaggcaggagaaucacuugaaccugggaggcggaugu

SEQ ID NO: 42324 - RNA, 64 nt, hsa
guuagcaccauuaacuccuccugagcucugauaagagaaucaacauuucucaauaauuuccucc

SEQ ID NO: 42325 - RNA, 64 nt, hsa
ggcuucaauuauuugggugccuuaaaaacucaaugagaaucaugguaaaaaaaaaaaguuaacc

SEQ ID NO: 42326 - RNA, 64 nt, hsa
uacacaaaauuacugucacguggauuuugucaaggagaaucauaaaagcaggagaccaguagca

SEQ ID NO: 42327 - RNA, 64 nt, hsa
gcacccaguccacuggcaguggaauugcuuuccugagaaucauucugaggcugggcuauugcuu

SEQ ID NO: 42328 - RNA, 64 nt, hsa
uuguagaauguaugaggaagugggaaguaucucagagaaucagcuaaguuuccuaacuugucca

SEQ ID NO: 42329 - RNA, 64 nt, hsa
ccuguaaucccagcuacuugggaggcugaggcaggagaaucacuugagcccaggagguggaggu

SEQ ID NO: 42330 - RNA, 64 nt, hsa
accaacagggucaccaagcagacagggagcccgcgagaaucauucaaaacauccccagccacag

SEQ ID NO: 42331 - RNA, 64 nt, hsa
ccuuuaaucccagcuacucgggaggcugaggcacgagaaucacuugaacccaggaggcggaggu

SEQ ID NO: 42332 - RNA, 64 nt, hsa
ccuguaaucuuagcuacucaggaggcuaaggcaggagaaucacuugaaccugggacacggaggu

SEQ ID NO: 42333 - RNA, 64 nt, hsa
uuuuuaaaauaauuauacuugcacaugaaaauaaaauauaaagucaauaauaguccuuguagcc

SEQ ID NO: 42334 - RNA, 64 nt, hsa
augcaaaucaugcagaauuugaguuauaaauuuaaauauaaauugaccauugaugauauccagu

SEQ ID NO: 42335 - RNA, 64 nt, hsa
acauuacuuccauuucagaaaccauaucugauuuaauauaaacugcuaacuuaagaagagguga

SEQ ID NO: 42336 - RNA, 64 nt, hsa
uuuuguuguuaugcauugauuaagggcuagagcaaauauaaaauuaaaugucuuuuuccuccaa

SEQ ID NO: 42337 - RNA, 64 nt, hsa
uauuguggggauuaaguuagauaauguguuuuaaaauauaaagcuacauccaaagaaaugccaa

SEQ ID NO: 42338 - RNA, 64 nt, hsa
cacaaaugguaaauuauguggaucuuuugcauauaauauaaauguauagacauggugguaggaa

SEQ ID NO: 42339 - RNA, 64 nt, hsa
ugugaacauaaguguuuauuaaaaauggcaauuaaauauaaauuacuuuugugggggaaugccu

SEQ ID NO: 42340 - RNA, 64 nt, hsa
cuagcaauaaaaucuaauuuuuaaaaaguauauaaauauaaaauguauaaaugauggauagauu

SEQ ID NO: 42341 - RNA, 64 nt, hsa
uguuugugcauuuggggggaauucaucucucuuuaauauaaaguuggaugcggaacccaaauua

SEQ ID NO: 42342 - RNA, 64 nt, hsa
ccacguauguuuuuguguauuuguuaaugguuugaauauaaacacuauauggcagugucuuucc

SEQ ID NO: 42343 - RNA, 64 nt, hsa
uuaaguaauguuuagagucguagguauuaacuagaauauaaauccuuagaaauugucuuuauac

SEQ ID NO: 42344 - RNA, 64 nt, hsa
uacacugacaggauuuacuaguuaagcaauguuuaauauaaauuuuaaaaaacuucuguucuac

SEQ ID NO: 42345 - RNA, 64 nt, hsa
uguaacuaguacuaauuauaaauauaaaauacacaauauaaaauaugaaacucaauaauaaaca

SEQ ID NO: 42346 - RNA, 64 nt, hsa
guccaugucauauguguaacuaguacuaauuauaaauauaaaauacacaauauaaaauaugaaa

SEQ ID NO: 42347 - RNA, 64 nt, hsa
acauuuucacacuuaagauucaaaauuuuucccaaauauaaagaaaacuaagacagacuguaga

SEQ ID NO: 42348 - RNA, 64 nt, hsa
cacucauacauauauguguuccccuuuucccuguaauauaaauuacaaaucugggcuccuuuga

SEQ ID NO: 42349 - RNA, 64 nt, hsa
aaauuaaguuggacuaacauucacguaucaaacuaauauaaaaagaaauaaaaccaagagguga

SEQ ID NO: 42350 - RNA, 64 nt, hsa
guacuuauaacuguuauuaaauaccaaaucaaauaauauaaaagcuguaacauuuccuuuaaaa

SEQ ID NO: 42351 - RNA, 64 nt, hsa
agucuugaaugaauacaaaaggagcccauuuuauaauauaaaccuugauguacauguugagaua

SEQ ID NO: 42352 - RNA, 64 nt, hsa
aaauuaguuaccaaaucauaaacagaguggaauaaauauaaaugagauucuaacuaggaugaau

SEQ ID NO: 42353 - RNA, 64 nt, hsa
uuaguaguaucuuccauuguguagauuucuauauaauauaaauacauuuuaauuauuuguacua

SEQ ID NO: 42354 - RNA, 64 nt, hsa
ucccaucuccacuguuaucccuuugggguuuuuuaauauaaauuauuaguuuacaucauuuuug

SEQ ID NO: 42355 - RNA, 64 nt, hsa
cuaguuugcauuccugauaugauuuaaaacauguaauauaaagauguuaaaaaaaaaaaccaaa

SEQ ID NO: 42356 - RNA, 64 nt, hsa
aacauaaaguuauuauagugccuccuaagggguuaauauaaaucaaggaggaaguuuauauuua

SEQ ID NO: 42357 - RNA, 64 nt, hsa
guaaguggagaagggccuaccuuuuuaaaggacaaauauaaaaauagcaacaguaucuuugcua

SEQ ID NO: 42358 - RNA, 64 nt, hsa
uaaagaggaaaggcgauggugaugucuguaguacaauauaaaccauaauugugauuuaccuuaa

SEQ ID NO: 42359 - RNA, 64 nt, hsa
ucacucauagcauuucuauauuugaaaguagcccaauauaaaacuuuugauucuaaaauuaaac

SEQ ID NO: 42360 - RNA, 64 nt, hsa
gauuucaauuuuuaucaauucauaaauuaaaaacaauauaaaaauuccagagggguguguguau

SEQ ID NO: 42361 - RNA, 64 nt, hsa
auagagagguaagcauuaguggcacagcugagaaaauauaaaagguaguucugucucuauccug

SEQ ID NO: 42362 - RNA, 64 nt, hsa
agccuuggauguuccuguggaccugacaguuaaaaauauaaagaaccuaggauucaauuccaac

SEQ ID NO: 42363 - RNA, 64 nt, hsa
uagagucuagugaaaaaaaugagugggaagaaugaauauaaaaguaauaauauaaggaaaaagg

SEQ ID NO: 42364 - RNA, 64 nt, hsa
aaacaucgaaaggcuuaugccaaauggaagauagaauauaaaauaaaacguuacuuguauauug

SEQ ID NO: 42365 - RNA, 64 nt, hsa
aacauauauauauauauacauauauauaaauauaaauauaaauauaucucauugcagccaguga

SEQ ID NO: 42366 - RNA, 64 nt, hsa
guacauaacauauauauauauauacauauauauaaauauaaauauaaauauaucucauugcagc

SEQ ID NO: 42367 - RNA, 64 nt, hsa
uuuucauuucaguuuuccauaaacuguuacacaaaauauaaaccuaacguguauuuuucaggac

SEQ ID NO: 42368 - RNA, 64 nt, hsa
ucacagugaaaggcaaaauuauucacucagaaguaauauaaauuaccucuuuaaaaaguaacca

SEQ ID NO: 42369 - RNA, 64 nt, hsa
acaggauggaaaaaggucauauccuuugucaggaaauauaaacuugaaaguauguagucagcuc

SEQ ID NO: 42370 - RNA, 64 nt, hsa
ucaggcccuucaaagaugauauguggaggaauuaaauauaaaggaauuggagguuuuugcuaaa

SEQ ID NO: 42371 - RNA, 64 nt, hsa
aucccauuagcuuuuuuuuuuuuuuuuuuuuuucaauauaaaguguuuucuuuaaaagucauau

SEQ ID NO: 42372 - RNA, 64 nt, hsa
cuugcugcuuucaguauuuccugauuuuuuuguaaauauaaagaggaacuucaauuaugaaaaa

SEQ ID NO: 42373 - RNA, 64 nt, hsa
cuuccucuuuuuuuuuuaauuggguaggacacccaauauaaaaacagucaauauuugacaaugu

SEQ ID NO: 42374 - RNA, 64 nt, hsa
uucuauauugaauaaacaauguaacauagauaacaauauaaauaaaagugguaugaccagugcu

SEQ ID NO: 42375 - RNA, 64 nt, hsa
agucauuauaauugauauaauagcucuaacaugcaauauaaaauucauaggaguauuaauagcc

SEQ ID NO: 42376 - RNA, 64 nt, hsa
gaugagucuauauuaucuagcuuucuauuacccuaauauaaacugguauaagaagacuuuccuu

SEQ ID NO: 42377 - RNA, 64 nt, hsa
uuacuucuucucauacuauuuaagagaacaagcaaauauaaacagcaacuuguguuccuaacag

SEQ ID NO: 42378 - RNA, 64 nt, hsa
caaaguuaagaaucuuuauaguucuacuccauuaaauauaaagcaagauaauaaaaauuguugc

SEQ ID NO: 42379 - RNA, 64 nt, hsa
gcccgcugaugcauuguuuauuuuuuuugcucauaauauaaauaucagauuauguuuaggagug

SEQ ID NO: 42380 - RNA, 64 nt, hsa
accugcuccuuauugccauacccacgaacuguuaaauauaaaaaaauucaaaguauuugacauc

SEQ ID NO: 42381 - RNA, 64 nt, hsa
gaaaagaaaguuguaugugccacauaaaacucugaauauaaaaguugcuguucuacuauuuuaa

SEQ ID NO: 42382 - RNA, 64 nt, hsa
uauauguaauauauugacauaaaagacacaaacuaauauaaaguuauaguuauaucuuaaaaua

SEQ ID NO: 42383 - RNA, 64 nt, hsa
cuggagguguuugaucaguuuucaagaaacuuggaauauaaauaauuuuauaauucaacaaagg

SEQ ID NO: 42384 - RNA, 64 nt, hsa
guuucccaguuaacuaggguuuacuguuugagccaauauaaauguuuaacuguuugugauggca

SEQ ID NO: 42385 - RNA, 64 nt, hsa
aguguuuacuguacuauuucaaagcuucuaaauaaauauaaaauauauauauuauauuauauaa

SEQ ID NO: 42386 - RNA, 64 nt, hsa
uauuuuacauaguuuugugacuuaauuacacaugaauauaaaaucuauaauucuauaugaauau

SEQ ID NO: 42387 - RNA, 64 nt, hsa
acucuugugacauuuuuuugguuaucaacaacuaaauauaaauuacuuuggaaaaaguaaggcu

SEQ ID NO: 42388 - RNA, 64 nt, hsa
aaauaaaaguugaacuugaguuacauuuaauuuaaauauaaaugcauuuugagaaauguuaaga

SEQ ID NO: 42389 - RNA, 64 nt, hsa
acuuauuuacaaaccauauuaaaaggcuaauuuaaauauaaauaauauaaagugcucugaauaa

SEQ ID NO: 42390 - RNA, 64 nt, hsa
caaaccauauuaaaaggcuaauuuaaauauaaauaauauaaagugcucugaauaaagcagaaau

SEQ ID NO: 42391 - RNA, 64 nt, hsa
augucuuucucauauuucagaggaaagauuauaaaauauaaaauuucuuagagaacaccucuuu

SEQ ID NO: 42392 - RNA, 64 nt, hsa
ugaaagcuaaaaauagguucuaaaguaauguaaaaauauaaagcacaaauauacuugaauauug

SEQ ID NO: 42393 - RNA, 64 nt, hsa
ccuuaauuuguuuuccagaaucaaaagaaaauaaaauauaaauuuugaaacuaugagaacauau

SEQ ID NO: 42394 - RNA, 64 nt, hsa
uuguugguaaacuaaucauuuuauuauauauaaaaauauaaaugucuuuauuaauauuuuauua

SEQ ID NO: 42395 - RNA, 64 nt, hsa
uaauauuuuagaaaauauuccuuuuguaauacugaauauaaacauagagcuagaaucauauuau

SEQ ID NO: 42396 - RNA, 64 nt, hsa
cuuaacacauugaaacuauuauuuuuuagauuugaauauaaauguauuuuuuaaacacuuguua

SEQ ID NO: 42397 - RNA, 64 nt, hsa
cgcaggcuauuuguucagagaggccuuuuguuuaaauauaaauguuuaaauauaaauguuuguc

SEQ ID NO: 42398 - RNA, 64 nt, hsa
ucagagaggccuuuuguuuaaauauaaauguuuaaauauaaauguuugucuggauuggcuauaa

SEQ ID NO: 42399 - RNA, 64 nt, hsa
auagucuugcuuauuuuguugcgaaggccaguggaauauaaaaaucaauggcauuaaugaggag

SEQ ID NO: 42400 - RNA, 64 nt, hsa
aagauugaaaagacuaaugagaagauaacaugacaauauaaaaagacagaaacucaaaaaguau

SEQ ID NO: 42401 - RNA, 64 nt, hsa
agacgucaaucaaaaugucaaauaugugugucagaauauaaauaauuuuucacauuguauuguu

SEQ ID NO: 42402 - RNA, 64 nt, hsa
acuaguuaaauccucaccuaaucucuuggguaugaauauaaaugugugucaucguuauauuguu

SEQ ID NO: 42403 - RNA, 64 nt, hsa
gucugccacugaauuuccagugacuaaguggaaaaauauaaaacauaugaauauaaagaaagaa

SEQ ID NO: 42404 - RNA, 64 nt, hsa
uccagugacuaaguggaaaaauauaaaacauaugaauauaaagaaagaaagagacaagucaaau

SEQ ID NO: 42405 - RNA, 64 nt, hsa
acaaguuuuacgagggaaaacugaaaaaggaaguaauauaaauuuugugggguuuuuuugagau

SEQ ID NO: 42406 - RNA, 64 nt, hsa
uuccccaaugguaaccuuaccuuggaaacuaucaaauauaaauauacuuuaacuaagccaguga

SEQ ID NO: 42407 - RNA, 64 nt, hsa
caaaacauguugaacauccauguuguacaacugaaauauaaauaauuuugucaauuauaccuaa

SEQ ID NO: 42408 - RNA, 64 nt, hsa
guagaguuaacuuacuuuccauuuauccacugccaauauaaagaggaaacagggguuagggaaa

SEQ ID NO: 42409 - RNA, 64 nt, hsa
cauugcuagucuagaauagucuauuccuugugaaaauauaaauuuaauuuucaggaauccagua

SEQ ID NO: 42410 - RNA, 64 nt, hsa
gacaacauuauaacuaaaagucgaaagcacacaaaauauaaauaauaguguaugcaaguuaaug

SEQ ID NO: 42411 - RNA, 64 nt, hsa
aguacagugaauuuugcuuuauugcaaagcuuuaaauauaaauuucagagugcuucaguaaaaa

SEQ ID NO: 42412 - RNA, 64 nt, hsa
aaauguccuguucuuuuucugaaguguggauaucaauauaaaauuuguuaaagaauauuuuuaa

SEQ ID NO: 42413 - RNA, 64 nt, hsa
cugaaaagggaagagggguagauccuccaauguaaauauaaacaugccauaguuaacaaaugau

SEQ ID NO: 42414 - RNA, 64 nt, hsa
aagcaguuaauaguaugaucuuuaaaguuuugacaauauaaaauaaacuugguaacuguuuuac

SEQ ID NO: 42415 - RNA, 64 nt, hsa
gacaauauaaaauaaacuugguaacuguuuuacaaauauaaaaguauaauaaauaugcagccca

SEQ ID NO: 42416 - RNA, 64 nt, hsa
cauguacagaagaaauagaauacauguucaugcaaauauaaauuauguauucuaauauaggugu

SEQ ID NO: 42417 - RNA, 64 nt, hsa
augaugcuaguuuauuuuuuuagcagugaaaaugaauauaaaaaaggugacauaggucaaguuu

SEQ ID NO: 42418 - RNA, 64 nt, hsa
guaauuauuuaccaaacuuaaaaacauuucuauaaauauaaagcuuuucuuuauauuuaagaca

SEQ ID NO: 42419 - RNA, 64 nt, hsa
auaaauauaaagcuuuucuuuauauuuaagacaaaauauaaaggcuagaauuugguuccuucuc

SEQ ID NO: 42420 - RNA, 64 nt, hsa
uucuuguaaaguccauuuauguuaaucaaaguugaauauaaaaauccaccauugccuguuagcc

SEQ ID NO: 42421 - RNA, 64 nt, hsa
ucgguguuuuuauuuuuuuuuucuuauggaaaaaaauauaaaagaucacauauacugauuuuaa

SEQ ID NO: 42422 - RNA, 64 nt, hsa
cuguaauuuugagcacugcucuaacaacaagcauaauauaaaauuaguuagauuuugcaagucu

SEQ ID NO: 42423 - RNA, 64 nt, hsa
uguucauacuuguaaagcaucuuaugucauugagaauauaaagaacagugccuuagaagacagu

SEQ ID NO: 42424 - RNA, 64 nt, hsa
ccauauugccuuaugucccaaagccaaauauaaaaauauaaaugaugcuuuguauaauucauuu

SEQ ID NO: 42425 - RNA, 64 nt, hsa
uaaguucuccauauugccuuaugucccaaagccaaauauaaaaauauaaaugaugcuuuguaua

SEQ ID NO: 42426 - RNA, 64 nt, hsa
caagauguuucauuuuacuguauauuuuguaguuaauauaaauguugcucuaaucagauugcuu

SEQ ID NO: 42427 - RNA, 64 nt, hsa
uuaauaagauuuuucaaaaucgccaggacuggugaauauaaaugaugauugaacuggaauaaua

SEQ ID NO: 42428 - RNA, 64 nt, hsa
aaaccagccugggcaaaacccugucucuacuaaaaauauaaaaauuagccaggcaugauggcac

SEQ ID NO: 42429 - RNA, 64 nt, hsa
cuggccaacauggcaaaaccccgucucuaugaaaaauauaaaaauuagcugggcaugguggcag

SEQ ID NO: 42430 - RNA, 64 nt, hsa
cuauggauaaauaauuugagagcugccacccacaaauauaaauacaguacucaugcugacugaa

SEQ ID NO: 42431 - RNA, 64 nt, hsa
uacacaaauccugagguucuuaauuuuagcucagaauauaaauuagucaaaauacacuucaggu

SEQ ID NO: 42432 - RNA, 64 nt, hsa
cauauugcuauaguacuucuguaaagagaauaucaauauaaauaaggaaaauaaaucaaugaaa

SEQ ID NO: 42433 - RNA, 64 nt, hsa
uguguaccugcuuaguuaauuggcucagaauuuuaauauaaacaucacacuuuaauuuggagca

SEQ ID NO: 42434 - RNA, 64 nt, hsa
gucucauucuuuaagauacagaugugugaacuucaauauaaaguugcauuugccaaaauuuacc

SEQ ID NO: 42435 - RNA, 64 nt, hsa
auaaaaauuuaugaauauuaaaauuaucauuaauaauauaaaacacuuauuugagauuaaauua

SEQ ID NO: 42436 - RNA, 64 nt, hsa
cccaccuuuccaugcuuaagacaaaaaugucuuaaauauaaagcugugauuauaucaaaaaucc

SEQ ID NO: 42437 - RNA, 64 nt, hsa
auuuguuauucuaacucuauuuuuuaaaguuaauaauauaaaguggccauguaaaauauuuuau

SEQ ID NO: 42438 - RNA, 64 nt, hsa
aaaauaaaauuuuaacccaaaugaauaacuaagaaauauaaaacaagcacaaaaucuuagggaa

SEQ ID NO: 42439 - RNA, 64 nt, hsa
aaggaagauugaacuaauaaaauuuuauuucuuaaauauaaauuugaccuaaaauauuuucuca

SEQ ID NO: 42440 - RNA, 64 nt, hsa
aaaaugcuacuuaaaacuuugguuguuuuccuguaauauaaaagaaaaaguuaauuuaucaauu

SEQ ID NO: 42441 - RNA, 64 nt, hsa
gcauuacuuugaguuaaauuugaauagaguauuaaauauaaaguuguagauucuuauguguuuu

SEQ ID NO: 42442 - RNA, 64 nt, hsa
gaaagaacccuguuagaucuugguuugugauaaaaauauaaagacagaagacaugaggaaaaac

SEQ ID NO: 42443 - RNA, 64 nt, hsa
auuacgugaccggcaaauaaaucucauagcaguuaauauaaaacaucuuuggaggaugggagag

SEQ ID NO: 42444 - RNA, 64 nt, hsa
gcgcugcccccugagaaaacacuugaauugacgcaauauaaaacaaaaugugaaaaccaaagug

SEQ ID NO: 42445 - RNA, 64 nt, hsa
gauuuaaaaacaaaaaaacacaaaaaaauaguaaaauauaaaaacaaauuaauguuuuauagac

SEQ ID NO: 42446 - RNA, 64 nt, hsa
aaaacuuaaauauuauggaaaaaaaacauugcaaaauauaaaauaaauaaaaaaaggaaaggaa

SEQ ID NO: 42447 - RNA, 64 nt, hsa
caacugggccaauauaaacauguuugaauugucaaauauaaaauaauguuauugcaauacauac

SEQ ID NO: 42448 - RNA, 64 nt, hsa
auagccaauuaacacaaccaaauacaacugggccaauauaaacauguuugaauugucaaauaua

SEQ ID NO: 42449 - RNA, 64 nt, hsa
uaaugacugaaaaaaauuauuauuauaaaucaccaauauaaauuuauugccuacaauuguggac

SEQ ID NO: 42450 - RNA, 64 nt, hsa
uuauuugcuuuuuuuaaaaaggagauuauucuaaaauauaaacuuauuugcauauauuggagga

SEQ ID NO: 42451 - RNA, 64 nt, hsa
aaaacagccaaauaaaucacuuauggaaauguuuaauauaaauuuuauagucauagucauugga

SEQ ID NO: 42452 - RNA, 64 nt, hsa
gucauagucauuggaacuugcauccuguauuguaaauauaaauguauauauuaugcauuaaauc

SEQ ID NO: 42453 - RNA, 64 nt, hsa
uguacuagcccaguauuuauuuacauugcuuuguaauauaaaucuguuuuagaacugcagcggu

SEQ ID NO: 42454 - RNA, 64 nt, hsa
aaugcugucccauaaaaugccauuccuauuuucuaauauaaaacucuuuuccaggaagcaugcu

SEQ ID NO: 42455 - RNA, 64 nt, hsa
uucccauauuuuaaaaggagggaaaggacaauuuaauauaaauuucuguuugugcauuucugac

SEQ ID NO: 42456 - RNA, 64 nt, hsa
auguucaaaugagagagcuuucuuuucugagguuaauauaaagaguaucaaagguuccuaagga

SEQ ID NO: 42457 - RNA, 64 nt, hsa
cuuuaguaagaaaggauaaaaagguguggaagugaauauaaaaugcaucuaaacaugacauuua

SEQ ID NO: 42458 - RNA, 64 nt, hsa
cugcuaauucaaggcuuauacauuauauuuauagaauauaaauuugucaguggaauaaaauuuc

SEQ ID NO: 42459 - RNA, 64 nt, hsa
guuucugauuugaagaaacugacauuccuuuaaaaauauaaauauaaauacauacauacauaga

SEQ ID NO: 42460 - RNA, 64 nt, hsa
gauuugaagaaacugacauuccuuuaaaaauauaaauauaaauacauacauacauagauauaua

SEQ ID NO: 42461 - RNA, 64 nt, hsa
ucuuguuuuaagauacaaguaaaauuaaucuuuaaauauaaauguaaauuaguacacaaaacua

SEQ ID NO: 42462 - RNA, 64 nt, hsa
ccccuuauccuuaacauauauaguauauuuaaaaaauauaaaauuguauuguacuaaugugaug

SEQ ID NO: 42463 - RNA, 64 nt, hsa
uucauguagcguaucacauaacuuuuuugcaaaaaauauaaaaagaaauaaacuucaauguauu

SEQ ID NO: 42464 - RNA, 64 nt, hsa
uacugugcuagugacuggaggcccugcuacugcaaauauaaaacauaaaguuuguuuaaaaaaa

SEQ ID NO: 42465 - RNA, 64 nt, hsa
auuauaccagggauguauaguaagucagggaacuaauauaaaugaugacagucauggcugcacu

SEQ ID NO: 42466 - RNA, 64 nt, hsa
ucuggguauggaaauaacccugugaugauguguuaauauaaaauguugggagggaauauuccca

SEQ ID NO: 42467 - RNA, 64 nt, hsa
auacauuggaaauaaacaguagaaauaagcaaacaauauaaagagacacgggaaaugcuucucg

SEQ ID NO: 42468 - RNA, 64 nt, hsa
cuguaauuagagaauuuauuucauauaaaauaauaauauaaaguuugaacugauuagaauguuc

SEQ ID NO: 42469 - RNA, 64 nt, hsa
uaucaagugaguuugcugauuuuaaaaucuuaggaauauaaauaaagaucuuaauaaaagcaag

SEQ ID NO: 42470 - RNA, 64 nt, hsa
guaaaaaguaguauuuuguauauuuuuguaacaaaauauaaaugaagauauuuuaccaugaaga

SEQ ID NO: 42471 - RNA, 64 nt, hsa
ugaagagauugcacuuauccuugagaacagucuaaauauaaaugaagauauuuuaccaugaaga

SEQ ID NO: 42472 - RNA, 64 nt, hsa
aguuacaagcauugaacuucuuuaguauuauauuaauauaaaaacauuuuuguauguuuuauug

SEQ ID NO: 42473 - RNA, 64 nt, hsa
acaagacugucauuagaauugaauuauugggcuuaauauaaaucguaaccuaugaaguuuauuu

SEQ ID NO: 42474 - RNA, 64 nt, hsa
gaaugaaguucugaaaauggugaauauguggguaaauauaaaagauauuucucucuuuuuaaaa

SEQ ID NO: 42475 - RNA, 64 nt, hsa
auuaguagacaaggauauuaaaagagcuauuguaaauauaaaguagaggaaaacauaagauuga

SEQ ID NO: 42476 - RNA, 64 nt, hsa
cuggccaauauggugaaaccccaucucuacuaaaaauauaaaaaucagcaaaaaaaauuuagcc

SEQ ID NO: 42477 - RNA, 64 nt, hsa
ggagugagacaccaucucaaaaaauacauauaauaauauaaauaaaaauaucuuuuuugaaaau

SEQ ID NO: 42478 - RNA, 64 nt, hsa
uaaucuauuaauacugacucagugucugccuuuaaauauaaaugauauguugaaaacuuaagga

SEQ ID NO: 42479 - RNA, 64 nt, hsa
ugaaaacuuaaggaagcaaaugcuacauauaugcaauauaaaauaguaaugugaugcugaugcu

SEQ ID NO: 42480 - RNA, 64 nt, hsa
uuguauaauacuuuaauggaaugcuuuuuaaaaaaauauaaaaccaagguaaauuauuguuuca

SEQ ID NO: 42481 - RNA, 64 nt, hsa
uguugauacuccuguugauguuaaauuacuauauaauauaaacaguauguguuuuuauauauca

SEQ ID NO: 42482 - RNA, 64 nt, hsa
caaacuauauaauaaauauuuacaagcccaaacuaauauaaaugauugaaugggaacaaaucuc

SEQ ID NO: 42483 - RNA, 64 nt, hsa
cuagggaaaucugaauacaguguggacuucaguuaauauaaaugagaaaaugguuucauuggcu

SEQ ID NO: 42484 - RNA, 64 nt, hsa
ugccagaaaaacuuacauguaucagauuuuuaaaaauauaaauagagaacauuuugcaaaugcu

SEQ ID NO: 42485 - RNA, 64 nt, hsa
uggaaaaccagauaaaacaauguuacaaaaggcaaauauaaagaguauguuuucuuuuuagugc

SEQ ID NO: 42486 - RNA, 64 nt, hsa
gauuuacuuuucugaucucuuugagaaauagagaaauauaaaaguguguucuuaacuccagaac

SEQ ID NO: 42487 - RNA, 64 nt, hsa
ggacaaauucugacuguuggggaacuuacucugcaauauaaaaauaucuucaugcucugguagg

SEQ ID NO: 42488 - RNA, 64 nt, hsa
ugcuaucuuaauguucugaaauaaaacauuuuaaaauauaaauccuguaguuuaaaaggaagaa

SEQ ID NO: 42489 - RNA, 64 nt, hsa
uuuaaaacuguaucuuaaagagucauuuuaaaauaauauaaauauuaaaaaauguaacugcuau

SEQ ID NO: 42490 - RNA, 64 nt, hsa
gccuggucuuuuguagagacccugucucuacaaaaauauaaaaaucagccaggcgucgugcaca

SEQ ID NO: 42491 - RNA, 64 nt, hsa
guugaaauucuagauaagcaugcagaugacuuacaauauaaaugaagaauaggaaacauuuuau

SEQ ID NO: 42492 - RNA, 64 nt, hsa
uuccaugagaauuauuacuuuaaaaacaaaacaaaauauaaaaaacuguguuugaguaaacuga

SEQ ID NO: 42493 - RNA, 64 nt, hsa
aaguucaauaauaacuaaggcugugauuuuuuucaauauaaaaggcacagcuguuggccaaagu

SEQ ID NO: 42494 - RNA, 64 nt, hsa
uacuauccauguaauaagcacuugccuggaauaaaauauaaaacugaaauaaaccugcacugaa

SEQ ID NO: 42495 - RNA, 64 nt, hsa
gugaggacucggccacugugucucuguuuccugaaauauaaacuguagcgaccccagacuguag

SEQ ID NO: 42496 - RNA, 64 nt, hsa
uaagaccuaauccccaccucccuucuucuaacuaaauauaaaaagauccaggggacauaaaugu

SEQ ID NO: 42497 - RNA, 64 nt, hsa
agaacuuccaaauguuaauuuuuuuuuuuuugaaaauauaaauaauuacuauuuuguacugugu

SEQ ID NO: 42498 - RNA, 64 nt, hsa
ccuuuguuagguggagaagaaaugucucuagaggaauauaaauaccugauuucuugucaucgag

SEQ ID NO: 42499 - RNA, 64 nt, hsa
auaguaaauagcuuuacaccaggauggauucugaaauauaaauucuaaauuauauuuguuauaa

SEQ ID NO: 42500 - RNA, 64 nt, hsa
uuuugcauggacaugggccagguuuuucaaaaggaauauaaacaggaucucaaacuugauuaaa

SEQ ID NO: 42501 - RNA, 64 nt, hsa
caaguagccuauuuuauaugcacaaaucugccaaaauauaaagaacuuguguagauuuucuaca

SEQ ID NO: 42502 - RNA, 64 nt, hsa
ggcacagacaaccuuaucaaacaauauaaaagccaauauaaauucucauaagcacuauagaauu

SEQ ID NO: 42503 - RNA, 64 nt, hsa
ggaagucuggggggcacagacaaccuuaucaaacaauauaaaagccaauauaaauucucauaag

SEQ ID NO: 42504 - RNA, 64 nt, hsa
aauaaaaauauauaaaucucauuugagauuuaagaauauaaauaauuuucuuuuaaucuuuauu

SEQ ID NO: 42505 - RNA, 64 nt, hsa
acaagaaaaauaaagaaaagaugcacuuugcuuuaauauaaaugcaaauaacaaaugccaaauu

SEQ ID NO: 42506 - RNA, 64 nt, hsa
uuuuauguuauauauaaauauauuauuacuuguaaauauaaagacguuuuauaagcaucauuau

SEQ ID NO: 42507 - RNA, 64 nt, hsa
gggccacacagcaagaccccaucucuaaaaaauuaauauaaauauaaaauaaauuagccaggug

SEQ ID NO: 42508 - RNA, 64 nt, hsa
cacagcaagaccccaucucuaaaaaauuaauauaaauauaaaauaaauuagccaggugugaugu

SEQ ID NO: 42509 - RNA, 64 nt, hsa
ugggccccuugcuaauuaacuuccauuuuguaaaaauauaaacacauggggcuaugacuuuccc

SEQ ID NO: 42510 - RNA, 64 nt, hsa
cuggccaacauggugaaauccccucucuacuaaaaauauaaaaauuagccaaguuugguggcau

SEQ ID NO: 42511 - RNA, 64 nt, hsa
uaggaaagcauuuauacuugagauaaauuauacaaauauaaagacugugaaaaagccaucauua

SEQ ID NO: 42512 - RNA, 64 nt, hsa
gugaagaguauuuauuuugaaguugaacaucacaaauauaaaaaggguuguagugccuuuacuu

SEQ ID NO: 42513 - RNA, 64 nt, hsa
uggcucauuaauuuuuuuagucuuuuuuucuuuuaauauaaacauuuguguauagcuguucccu

SEQ ID NO: 42514 - RNA, 64 nt, hsa
aacuugugagcauucacacuacagagaaacuugaaauauaaagaagaagagaaagccuucagug

SEQ ID NO: 42515 - RNA, 64 nt, hsa
uuuaguagcugauaaagaaaccuuuuaaaaaaauaauauaaaugaaugaaauauaaacugugag

SEQ ID NO: 42516 - RNA, 64 nt, hsa
agaaaccuuuuaaaaaaauaauauaaaugaaugaaauauaaacugugagauaaauaucauuaua

SEQ ID NO: 42517 - RNA, 64 nt, hsa
ccaagauaauucacucuacucagccggcguggcaaauauaaaacuuacagagcguggcugugcu

SEQ ID NO: 42518 - RNA, 64 nt, hsa
uguauaaacauuaaaugucuuauauagcagcaaaaauauaaaauaguuguccauauuuucacag

SEQ ID NO: 42519 - RNA, 64 nt, hsa
guacugugggacauguuaauaagugcuauaaagaaauauaaaggguuugggagcaaaaagaggg

SEQ ID NO: 42520 - RNA, 64 nt, hsa
aaacacuuaaaacuuuuuguuauggaagaauucaaauauaaauaaaaaauugugaguaauaaaa

SEQ ID NO: 42521 - RNA, 64 nt, hsa
cccuccucacagauaaaugaaaaguaaguauucuaauauaaaaguucuaauacaaaagaguaga

SEQ ID NO: 42522 - RNA, 64 nt, hsa
auuaggauguggacaugcuauuaggguuaucuacaauauaaaugggaauuaggauaauauaguc

SEQ ID NO: 42523 - RNA, 64 nt, hsa
aauuaaaaauauuucaaauaugcagaaaaauaauaauauaaaugcccuuguacccuucacauac

SEQ ID NO: 42524 - RNA, 64 nt, hsa
ccugccuuuugccacucuuaaaaauugugcccaaaauauaaaaguguggaacuuuagaacuugg

SEQ ID NO: 42525 - RNA, 64 nt, hsa
ugaauuauuaagcauaugugcuuucgcagcugauaauauaaaaggaaaucccacagucuagaua

SEQ ID NO: 42526 - RNA, 64 nt, hsa
uuaaaaaacguacucuuauuaucuggaacauagaaauauaaaagguaacaucuaaagcuuagaa

SEQ ID NO: 42527 - RNA, 64 nt, hsa
ugaaaaagaagggggggagaauuccaggugccuuaauauaaaguuugaagcuucauccaccaaa

SEQ ID NO: 42528 - RNA, 64 nt, hsa
guaaauaugucccaauuuguauugauucucuuuaaauauaaaauguaaauaaaauauuccaaua

SEQ ID NO: 42529 - RNA, 64 nt, hsa
cggugcuacuaauccugcuguaucccggguuuuuaauauaaagguguuaagcuuauuuugcuuu

SEQ ID NO: 42530 - RNA, 64 nt, hsa
aucaucuccugacuuaauguuuuuuaaacccaccaauauaaauuuaauuaaagauauauguugu

SEQ ID NO: 42531 - RNA, 64 nt, hsa
auaucuguugcauguacuuuaaaguuuauuauaaaauauaaacagauauauaaagauguugacu

SEQ ID NO: 42532 - RNA, 64 nt, hsa
aaaucuaaagcagcucuuaugggcuucuaauuuuaauauaaauaaauaauuuaaauuuuauugg

SEQ ID NO: 42533 - RNA, 64 nt, hsa
uaaagacauaaauauagagagacuuauguguuugaauauaaaugauauauauggauuagcaugu

SEQ ID NO: 42534 - RNA, 64 nt, hsa
uauaaacauauuuuuauaucaaauauacaguucuaauauaaaaguuauaaauaauuauuuuugu

SEQ ID NO: 42535 - RNA, 64 nt, hsa
auauaacugauugaugaaagggcauauuuaggucaauauaaaauaauagcaaguauuuacugag

SEQ ID NO: 42536 - RNA, 64 nt, hsa
auaacuuugcuacccuggauucugaugcaauuucaauauaaaaaguuguuccuuucauaguuuu

SEQ ID NO: 42537 - RNA, 64 nt, hsa
ucaguuuuaguguuuuucaguauuagggaaagguaauauaaaaacagguaaaauguauaaaaau

SEQ ID NO: 42538 - RNA, 64 nt, hsa
aagucauauugggaaagauggcaaagcuuuugagaauauaaacacaccuguuuuguuuuucuua

SEQ ID NO: 42539 - RNA, 64 nt, hsa
ccuacacaaguguuucacauuggagacaucugcuaauauaaaugggagguuuuacugucaaguc

SEQ ID NO: 42540 - RNA, 64 nt, hsa
uauuaagcaguuaauaauuuauauguauggauauaauauaaaaugaauucauauaauuaaaaag

SEQ ID NO: 42541 - RNA, 64 nt, hsa
cugugccaccaauucaaaaguuauaggauuaggaaauauaaauuuauauuuggugauuggcagc

SEQ ID NO: 42542 - RNA, 64 nt, hsa
aaucacagcucacugcagccuuguccucccaggcucaagcuauccuugcaccucagccucccaa

SEQ ID NO: 42543 - RNA, 64 nt, hsa
ucacuuuuuggaauugucuugauuuuucggcaguucaagcuauaucgaauauaguucuguguag

SEQ ID NO: 42544 - RNA, 64 nt, hsa
cuaagccauccuguuagcuuuuaaaggaaguuaauuuaauuaacauuaauauacucuaugggcu

SEQ ID NO: 42545 - RNA, 64 nt, hsa
caagaccccaucuccauuuuuuuuuuaaugauuuuuuaauuaaaaaaaagaacaacaggauaga

SEQ ID NO: 42546 - RNA, 64 nt, hsa
uggaaaacuuaggacuuauuggguuauuauuauuuuuaauuaaagcugguuuaauuaaaaagaa

SEQ ID NO: 42547 - RNA, 64 nt, hsa
uuauuggguuauuauuauuuuuaauuaaagcugguuuaauuaaaaagaaagaaacuuuuuucug

SEQ ID NO: 42548 - RNA, 64 nt, hsa
gaagggaacaucgacuucuaauccagcuuucuuguuuaauuaugaccuaaaucuaauuuacuuc

SEQ ID NO: 42549 - RNA, 64 nt, hsa
uaaaaucuaaguaugaaauuaugaaaggacauucuuuaauuacugcccacucaacacauauuua

SEQ ID NO: 42550 - RNA, 64 nt, hsa
aaauaaaagguguuaauuugcuuuuuaaaacaaauuuaauuaucacauuuuaaauuacuuugug

SEQ ID NO: 42551 - RNA, 64 nt, hsa
auaucauuuagcaaguuggcauuaacauuuaugcuuuaauuaaaugccaguauaccuaugugug

SEQ ID NO: 42552 - RNA, 64 nt, hsa
gucugcagauuuuuuuauuauggugcagcuuuuuuuuaauuauguuuuuaaaauuauacaguug

SEQ ID NO: 42553 - RNA, 64 nt, hsa
guuuuauuuggcuguuuaaagccaaauucagcuauuuaauuaugguuucauggacacuguugag

SEQ ID NO: 42554 - RNA, 64 nt, hsa
cagaagcuuagaggucauuuuuuguaauuuucuuuuuaauuacuuuagagagcuagggaugcaa

SEQ ID NO: 42555 - RNA, 64 nt, hsa
cauacuucugugacaccccugcccauuuucugucuuuaauuaaccaagguguuaggugugacug

SEQ ID NO: 42556 - RNA, 64 nt, hsa
aaccaauuauaagugagaauacuguuuuccuuaguuuaauuaauacaauguuauguuuuuuaga

SEQ ID NO: 42557 - RNA, 64 nt, hsa
uuaugaaauuugugccuaauuuaacuuaacauuguuuaauuaaauggaaccacuacuuauauac

SEQ ID NO: 42558 - RNA, 64 nt, hsa
ucacuaagaaaagagcaguuguaacucaaugaaauuuaauuaaacaugcuacuuuugauuucau

SEQ ID NO: 42559 - RNA, 64 nt, hsa
gauaacuuuucaaaaauucaucauucacccuugauuuaauuauuucucuggcaaugauuuaaua

SEQ ID NO: 42560 - RNA, 64 nt, hsa
agaaugaaacauaccaccuuguuggcucuaccacuuuaauuaauaucacuauaacauaacugau

SEQ ID NO: 42561 - RNA, 64 nt, hsa
gucuacagaacaauuaguaauacccaaguaauauuuuaauuacuuuugcagcuguuacaguugc

SEQ ID NO: 42562 - RNA, 64 nt, hsa
aucuguguaaugugguuuuaguguugcuugguuguuuaauuauuuugagcuuguuuuguuuuug

SEQ ID NO: 42563 - RNA, 64 nt, hsa
auaaacuaguuccauauaaguauacaccuagaguuuuaauuaccuuuauaauguuucuuaaaag

SEQ ID NO: 42564 - RNA, 64 nt, hsa
aagaggaccuauaugaaugguuuuaugucauuuuuuuaauuaaaaaagaaaaauucauauaauc

SEQ ID NO: 42565 - RNA, 64 nt, hsa
uuacaaaaaaaaaacacaugguuaaauguuaaauuuuaauuaaggcccccaaaaauuaaauaua

SEQ ID NO: 42566 - RNA, 64 nt, hsa
ccucaagaugaaggcaaagcacgaaauguuauuuuuuaauuauuauuuauauauguauuuauaa

SEQ ID NO: 42567 - RNA, 64 nt, hsa
aagaacacccuauauuuugcauaguaccaaucauuuuaauuauuauucuucauaacaauuuuag

SEQ ID NO: 42568 - RNA, 64 nt, hsa
auguuuuuuauuaugcuguauuuucuuuuuauuuuuuaauuauuguuuauauuuucaauucaaa

SEQ ID NO: 42569 - RNA, 64 nt, hsa
uagcuuaucaauuugucauuuugaagcuaauuauuuuaauuagguuaacuauguacaauauuuu

SEQ ID NO: 42570 - RNA, 64 nt, hsa
uugcuuguacauuuuuuuuuaccuuucaaagguuuuuaauuauuuuuguuuuuauuuuuguacg

SEQ ID NO: 42571 - RNA, 64 nt, hsa
acugggcaacuacccuacaaguuuguacuuucauuuuaauuauuuucuaacagaaccgcucccg

SEQ ID NO: 42572 - RNA, 64 nt, hsa
cugauuuuaagugauauucagauggccuuuuaaauuuaauuauuauguauuuaaaauuuaauua

SEQ ID NO: 42573 - RNA, 64 nt, hsa
uggccuuuuaaauuuaauuauuauguauuuaaaauuuaauuaauuauagcaagugauaugaacu

SEQ ID NO: 42574 - RNA, 64 nt, hsa
uauuugaagauuuaauuacuucuuaguaugugcauuuaauuagaaaaagagaauaaaaaaugua

SEQ ID NO: 42575 - RNA, 64 nt, hsa
agauuuaagauauguaacaacaauuauuugaagauuuaauuacuucuuaguaugugcauuuaau

SEQ ID NO: 42576 - RNA, 64 nt, hsa
uuccuaauagauacuagauuguauugaauucuguuuuaauuauucucuagguaaguauguuuua

SEQ ID NO: 42577 - RNA, 64 nt, hsa
aagagaauagucaucaaauuuauaucucgaagauuuuaauuaaggaauugcuuauuguugagcu

SEQ ID NO: 42578 - RNA, 64 nt, hsa
ugccaauuaaagacuagaagggcacaacuuuuuuuuuaauuaccauagagaagauacauuaaaa

SEQ ID NO: 42579 - RNA, 64 nt, hsa
cugauaaaugucuguuggauucuuuuuggauuucuuuaauuaauuuguaaguaaccaagauaau

SEQ ID NO: 42580 - RNA, 64 nt, hsa
agagagaaauuaauaacaaaaagagugaaaauauuuuaauuagcaguagauggugcuacuggcu

SEQ ID NO: 42581 - RNA, 64 nt, hsa
cucugcauugagcauauuuucuuacuuuuauuauuuuaauuaauaugacauaagcaaucauuuu

SEQ ID NO: 42582 - RNA, 64 nt, hsa
agacuaacaugucaguuuuaucaauuauauuauguuuaauuauuuaagauuucuuuauguggaa

SEQ ID NO: 42583 - RNA, 64 nt, hsa
aauuccauuuuuuucccuugugcuaagguaaagauuuaauuaaauaauuuuggccucucauagu

SEQ ID NO: 42584 - RNA, 64 nt, hsa
uauucacagagguuggguaguguugggaggggaguuuaauuacucagauuggccuguuauuuga

SEQ ID NO: 42585 - RNA, 64 nt, hsa
aaacuuuaaaacacaaaucuucauauauacuuaauuuaauuagucaggcauccauuuugccuuu

SEQ ID NO: 42586 - RNA, 64 nt, hsa
auuuuuuaaaaagaaaauuaauuugcaucccucguuuaauuaaauuuauuuuucaguuuucuug

SEQ ID NO: 42587 - RNA, 64 nt, hsa
caaacucuccauuuuacuuauggcuuuucuaauuuuuaauuaauuaauuuauuuuuuugagaca

SEQ ID NO: 42588 - RNA, 64 nt, hsa
aaugccauguuguuuucacucucugcacugacuuuuuaauuauuuaaaacucuagaaagaugaa

SEQ ID NO: 42589 - RNA, 64 nt, hsa
uuuguuuguuuaguuauaacagaguaacauaccauuuaauuacaauuuuuagccagaaaagucc

SEQ ID NO: 42590 - RNA, 64 nt, hsa
ucuuuuuccugucaauugaaauuuaaagaaaaguuuuaauuauauaaauagcaaagggcuauug

SEQ ID NO: 42591 - RNA, 64 nt, hsa
uaaaagauucuucuguagaaguaugaguucuuccuuuaauuaucauuccaacuuucagcuguag

SEQ ID NO: 42592 - RNA, 64 nt, hsa
cguuuugacuggcuugagauucagaugcauaauuuuuaauuauaauuauugugaaguggagagc

SEQ ID NO: 42593 - RNA, 64 nt, hsa
ugauauaagcaaguuguaauguacauaguaauuauuuaauuacuguggcuuuuauuuuaaaaag

SEQ ID NO: 42594 - RNA, 64 nt, hsa
uuagaaugggcaacuaaaauauucguggugucaguuuaauuagugucaaacuggcaagucagag

SEQ ID NO: 42595 - RNA, 64 nt, hsa
agcagguaaagggauaguugcuuugucauccguuuuuaauuauuuuaacugacccuugacaauc

SEQ ID NO: 42596 - RNA, 64 nt, hsa
uuaaaaaaaaauguggaguuggagggcuaacauauuuaauuaaauaaauaaauaaaucuggguc

SEQ ID NO: 42597 - RNA, 64 nt, hsa
auuuguguaguuuuuaggugguuuuauauaacauuuuaauuacuugugauuuagauguauccau

SEQ ID NO: 42598 - RNA, 64 nt, hsa
augacuuuuuccucuaaaaacuggauccuaguguuuuaauuaccugugugcagcuauuuuaaau

SEQ ID NO: 42599 - RNA, 64 nt, hsa
aacaaucuguaacagaaucaagaaacaaauacauuuuaauuaaacaaucuauauggaacaaaca

SEQ ID NO: 42600 - RNA, 64 nt, hsa
uucuccauguauauaacagaaucaagaaacaaauuuuaauuaaacaaucuguaacagaaucaag

SEQ ID NO: 42601 - RNA, 64 nt, hsa
uauaaaauuguacgugucaauaacaguaaagaauuuuaauuaauucugucauuuaaaauucaug

SEQ ID NO: 42602 - RNA, 64 nt, hsa
cucgaaugacuuaggcagaacaugccuucccuaguuuaauuagucccuguuauaaccaguuauu

SEQ ID NO: 42603 - RNA, 64 nt, hsa
guucuauguuuuuaagcuacacgagaauuuuuuuuuuaauuaauucucacuguuuguucagucu

SEQ ID NO: 42604 - RNA, 64 nt, hsa
aucacuaguugccagaauaauaaaaugaacuguguuuaauuaugaauaauauguaagcuaggac

SEQ ID NO: 42605 - RNA, 64 nt, hsa
uuguauaguuugagggaugcuauguuaauguauuuuuaauuagauacauauuuuguaaaguguu

SEQ ID NO: 42606 - RNA, 64 nt, hsa
guuauuuuuauauguuuuaaaauguuuacucuuauuuaauuauuacaauaaacagaauuuuuuu

SEQ ID NO: 42607 - RNA, 64 nt, hsa
gcauuguauugauuuguacugguaguuuaugaaauuuaauuaaaacacaggccaugaauggaag

SEQ ID NO: 42608 - RNA, 64 nt, hsa
cacuuuuuuucccuugugaguuauagucugcuuauuuaauuaccacuuugcaagccuuacaaga

SEQ ID NO: 42609 - RNA, 64 nt, hsa
aaaugccauuacuuguauaucugacauuuaauuuuuuaauuauggagacuacaugcuuuuguag

SEQ ID NO: 42610 - RNA, 50 nt, hsa
agccaauggaucacucuugauuuaauuagaggcuaauaaaggcagaaugu

SEQ ID NO: 42611 - RNA, 64 nt, hsa
gauauauuuuuaagauaauaauauauguuuaccuuuuaauuaaugaaauaucuguauuuaauuu

SEQ ID NO: 42612 - RNA, 64 nt, hsa
aagguccaagauaccuaaaagagauuucaagagauuuaauuaaucaugaauguguaacacagug

SEQ ID NO: 42613 - RNA, 64 nt, hsa
gaugauugaagaguaaaugggggaaaaggcaguguuuaauuaacauaaaaacucauuuuuguau

SEQ ID NO: 42614 - RNA, 64 nt, hsa
uuguauuucuuggauuacuuugacuauucuaauguuuaauuacauaugguaacccuaaggccug

SEQ ID NO: 42615 - RNA, 64 nt, hsa
cagaagaggcaguuaugauuccacuucuccuacauuuaauuauuuuuaauugagaacaacucau

SEQ ID NO: 42616 - RNA, 64 nt, hsa
aauuaaaccuuuuuuuucccaacuaaagaauggauuuaauuaaacuauguauugaaaaaaaagu

SEQ ID NO: 42617 - RNA, 64 nt, hsa
aauauugaugauccuacuaauuauccugcuguucuuuaauuaaugcuuaaugaauaauauggca

SEQ ID NO: 42618 - RNA, 64 nt, hsa
ugaaucauuacauuuauaauaacaaaggccacaauuuaauuaauugguaagauauaaugcaaaa

SEQ ID NO: 42619 - RNA, 64 nt, hsa
gauauguuuucaguacaauuuugaacagcaacuuuuuaauuaaacaucuuccaguguuaggaag

SEQ ID NO: 42620 - RNA, 64 nt, hsa
uuuguuuguuuguuuaauguaucccuguucuguuuuuaauuaaacuccaagucucauuuuacau

SEQ ID NO: 42621 - RNA, 64 nt, hsa
uuuaacuguauaaaaauguucauuuuacacaauauuuaauuaaaguauuucuugucugugaauu

SEQ ID NO: 42622 - RNA, 64 nt, hsa
gccuaaaguuuaaaauaaaauuuacuucugauguuuuaauuaaaauguuugccacauuaacuuu

SEQ ID NO: 42623 - RNA, 64 nt, hsa
cuuaaauauuacauauuagggauuguaagaaaacuuuaauuaaaaauuaaagacuauauauaau

SEQ ID NO: 42624 - RNA, 64 nt, hsa
gggaagcaaaauuucuaaaggcaguuucuguuguuuuaauuaguauuuguguaguucaaaccag

SEQ ID NO: 42625 - RNA, 64 nt, hsa
cacaaguugggaaauguggcuucuguucauuucguuuaauuaaagcuaccuccuaaacuauagu

SEQ ID NO: 42626 - RNA, 64 nt, hsa
uuauauagaaaguaaacuguggucaauacuugcauuuaauuagacgaaacggggaguaauuaug

SEQ ID NO: 42627 - RNA, 64 nt, hsa
guauacugcacuggauucgccagagaagggaaaauuuaauuagugaaaaggaaagaacacuagg

SEQ ID NO: 42628 - RNA, 64 nt, hsa
aaaccagucuagggaagucuaugagaaaguagcauuuaauuaaaguuuaaaaaaaaaaagguug

SEQ ID NO: 42629 - RNA, 64 nt, hsa
guaaacacaggggacacagcuuaacaaugcaacuuuuaauuacuguuuucuuuuuucuuaaccu

SEQ ID NO: 42630 - RNA, 64 nt, hsa
uguuucagcaugacuauguauuuuucuauguuuuuuuaauuaaaaauuuuuaaaauacuuguuu

SEQ ID NO: 42631 - RNA, 64 nt, hsa
uuaaauuauguuuuaaacacaugccuuaaauuuguuuaauuaaauuuaacucugguuucuacca

SEQ ID NO: 42632 - RNA, 64 nt, hsa
ugagccauucacacuuuuuauuuaauuaaauguauuuaauuaaaucucaaauuuauuuuaaugu

SEQ ID NO: 42633 - RNA, 64 nt, hsa
gucauaaacgauucugagccauucacacuuuuuauuuaauuaaauguauuuaauuaaaucucaa

SEQ ID NO: 42634 - RNA, 64 nt, hsa
ugucuaauucaucuuugcuuccuguuacuuuauauuuaauuaaaaauuuuagugacuuuuuaac

SEQ ID NO: 42635 - RNA, 64 nt, hsa
guacugugauaacuacuuuuuauacuuuaucccauuuaauuauaaaaaccacucuugagaagua

SEQ ID NO: 42636 - RNA, 64 nt, hsa
uaugaaacccuaugguguuuguacauuuaauuaauuuaauuaagauauuugggcuuuuuuuuuu

SEQ ID NO: 42637 - RNA, 64 nt, hsa
uuuauucaguaugaaacccuaugguguuuguacauuuaauuaauuuaauuaagauauuugggcu

SEQ ID NO: 42638 - RNA, 64 nt, hsa
acagaaguauugauacaacuaagauccuaaauguuuuaauuaguguuuacuuaagccuuuuuca

SEQ ID NO: 42639 - RNA, 64 nt, hsa
auuuaauauauguagucaugcauuuaacuuaauauuuaauuauuugauuuauuuaauuuucuau

SEQ ID NO: 42640 - RNA, 64 nt, hsa
uauauuuuuccaaccacugauuacuuuucaggaauuuaauuauuuccagauaaauuucuuuauu

SEQ ID NO: 42641 - RNA, 64 nt, hsa
aaacucaugucauguuuauuaccuauaugguuguuuuaauuacauuugaauaauuauauuuuuc

SEQ ID NO: 42642 - RNA, 64 nt, hsa
aaaaaaaacuucuuuaggcauuugccuaaguuucuuuaauuagacuuguaggcacucuucacuu

SEQ ID NO: 42643 - RNA, 64 nt, hsa
uuggggggagaaaaaggaugucuuucaggauuauuuuaauuaauuuuuuucauaauugagacag

SEQ ID NO: 42644 - RNA, 64 nt, hsa
cuaagaauuacauuguauagccccacagauuaaauuuaauuaauuaauucaaaacauguuaaac

SEQ ID NO: 42645 - RNA, 64 nt, hsa
gaaauugcguuuacaacacugaagaccaaagcuuuuuaauuaguaaacaagcggaacauagaua

SEQ ID NO: 42646 - RNA, 64 nt, hsa
ucuuuauacgguuuacauaagcaauaucugucucuuuaauuauuaugauuaaugucguccuuca

SEQ ID NO: 42647 - RNA, 64 nt, hsa
uaaucuccaacuaauuacuacagauugacacguuuuuaauuagcuguccuuuguaagaagucag

SEQ ID NO: 42648 - RNA, 64 nt, hsa
guuuuccgugggccuuccccucccuugaaaugucuuuaauuaccuccccuucaucgucaggcca

SEQ ID NO: 42649 - RNA, 64 nt, hsa
cucugugcuguguuuucuaacacauuuuucuguuuuuaauuaaaaaaaaaaaaaaaagguuuuc

SEQ ID NO: 42650 - RNA, 64 nt, hsa
auaaaaucugaaguaucauaaauaaaguuauuuauuuaauuauacuaccagucuuuuuuacugg

SEQ ID NO: 42651 - RNA, 64 nt, hsa
gugcaguacuuugaaguuuuaauuauuaaccugcuuuaauuaaagcaguuuccuuucuuauaaa

SEQ ID NO: 42652 - RNA, 64 nt, hsa
aagaaaauucuguggcugugcaguacuuugaaguuuuaauuauuaaccugcuuuaauuaaagca

SEQ ID NO: 42653 - RNA, 64 nt, hsa
uuucuuuuaaaaauaugacauagccagugauguguuuaauuauauaacuguucuuacugauuuu

SEQ ID NO: 42654 - RNA, 64 nt, hsa
agcagguuuuucuguuaguuuuucccccauaacauuuaauuauuacuaaaauuguauuuacaau

SEQ ID NO: 42655 - RNA, 58 nt, hsa
ugaggagcacauuuuguuaacauucagauuuaauuacuguaaguaaaauuuaaaaugu

SEQ ID NO: 42656 - RNA, 64 nt, hsa
gaaaaauauuuauuuuuguuuuuguuggauagcuuuuaauuacauuucagagagguguaauuuu

SEQ ID NO: 42657 - RNA, 64 nt, hsa
uuuaugacuaacuuguagauaucguggguucuuauuuaauuauuuuuauaguuguuuugcauuu

SEQ ID NO: 42658 - RNA, 64 nt, hsa
ucuuauuuaauuauuuuuauaguuguuuugcauuuuuaauuauaauuuauuuauuuagaaagga

SEQ ID NO: 42659 - RNA, 64 nt, hsa
caggaauaaugaagcuuccuguguccuuuaacacuuuaauuacagaucuuagugauacauacca

SEQ ID NO: 42660 - RNA, 64 nt, hsa
aguguuguuaccauuuagcccauugguugccaucuuuaauuauuggcagugcaaagaucaucag

SEQ ID NO: 42661 - RNA, 64 nt, hsa
agaaauacauauuuuuauuugacuauguuuggaguuuaauuaauuauauauuuauacauuauuu

SEQ ID NO: 42662 - RNA, 64 nt, hsa
uaccuuauucuacaucauuaaccaguaaggacuuuuuaauuaaccacaauaccacuaucacacc

SEQ ID NO: 42663 - RNA, 64 nt, hsa
gagcaagguucaccuuuagauuuuuguauucucuuuuaauuaugcuccuuggcagguaugaaau

SEQ ID NO: 42664 - RNA, 64 nt, hsa
aauuuucuacaaaauuuaaagcuaccauaaugcuuuuaauuaguucuaaauucaaccaaaaaau

SEQ ID NO: 42665 - RNA, 64 nt, hsa
uaguauuuuauguguaauucuuccauuuauucuguuuaauuauacaacuaagaugaaauauuga

SEQ ID NO: 42666 - RNA, 64 nt, hsa
caccacagugaauuauggguaaggugauaauauguuuaauuagcuugauuuaaucaucccacac

SEQ ID NO: 42667 - RNA, 64 nt, hsa
accugcaaagaugaugugagauuuuuucuuguguuuuaauuauuuucacauuuucucucugcaa

SEQ ID NO: 42668 - RNA, 64 nt, hsa
auuuuguguauucuuauuuacuuaacauuuuacuuuuaauuauguaaauuugguuagaaaauaa

SEQ ID NO: 42669 - RNA, 64 nt, hsa
uucuggauuguguauggguguuggugaacuugguuuuaauuagugaacugcugagagacagagc

SEQ ID NO: 42670 - RNA, 64 nt, hsa
uacuuucauaauaaguugcauagguuuaauaauuuuuaauuauauggcuugaguuuaaauugua

SEQ ID NO: 42671 - RNA, 64 nt, hsa
gguauggccacaaggaagaauaguguacagagauuuuaauuaaugcaaguucugggaccuuuug

SEQ ID NO: 42672 - RNA, 64 nt, hsa
uugcugugauagugcaaagaagcacaggaaaauguuuaauuauccauuuuucugugauuuguaa

SEQ ID NO: 42673 - RNA, 64 nt, hsa
gaagugucaaaauaugagaaaagagcaucuucauuuuaauuaacugcuuuauaaaaauggcaac

SEQ ID NO: 42674 - RNA, 64 nt, hsa
cauauuuguuggguccuauucuacuguugauaguuuuaauuaucauugcuaucaaauaauuucu

SEQ ID NO: 42675 - RNA, 64 nt, hsa
uggucuaagaguucuaaaggaagguaggcaucuguuuaauuaguugguucacccuggcuuuacc

SEQ ID NO: 42676 - RNA, 64 nt, hsa
gcuuauccuagggucucacagaagagaggacauauuuaauuaaucuugugaauuacagaacagg

SEQ ID NO: 42677 - RNA, 64 nt, hsa; identical to SEQ ID NO: 42667

SEQ ID NO: 42678 - RNA, 64 nt, hsa; identical to SEQ ID NO: 42668

SEQ ID NO: 42679 - RNA, 64 nt, hsa
uauuaaaacagagauaugugcaugaaaucaagaaaaaagaaaugaacaaaagcaaagcauuagu

SEQ ID NO: 42680 - RNA, 64 nt, hsa
uuagaaugauaaaaaaaaaaaaaaaaaaccugacaaaagaaauaguaugaaaaguagaaaaaug

SEQ ID NO: 42681 - RNA, 64 nt, hsa
caaguucaaaaccaagaggcguuuuugagaguggaaaagaaauuuaaacuucccgaaagaaggu

SEQ ID NO: 42682 - RNA, 64 nt, hsa
cgagaccuugucucaaaaaaagacaaaaaaaacaaaaagaaauguagauucuugggccccacca

SEQ ID NO: 42683 - RNA, 64 nt, hsa
gucaaauuuuaucaugguauaauuuguaaaaauaaaaagaaauuacaaaagaaauuauggauuu

SEQ ID NO: 42684 - RNA, 64 nt, hsa
caugguauaauuuguaaaaauaaaaagaaauuacaaaagaaauuauggauuugucaauguaagu

SEQ ID NO: 42685 - RNA, 64 nt, hsa
aaaagacauaggacuuaacuggaaaaugaaaaaaaaaagaaaaagaaaaaacuaaacaaaaaau

SEQ ID NO: 42686 - RNA, 64 nt, hsa
cauaggacuuaacuggaaaaugaaaaaaaaaagaaaaagaaaaaacuaaacaaaaaaucccucu

SEQ ID NO: 42687 - RNA, 64 nt, hsa
gcccagagaagcccccuacauccccccgggaaaaaaaagaaaacuagacagaaacucaucuaua

SEQ ID NO: 42688 - RNA, 64 nt, hsa
aggccaccauauuuagaacuaguuaccuuauuaaaaaagaaaaaacagucuguuggcuucucag

SEQ ID NO: 42689 - RNA, 64 nt, hsa
uaauuuaaagacaucuauuaucugcuuugugcuuaaaagaaaaauucaaccuuuuuuuuuuuuu

SEQ ID NO: 42690 - RNA, 64 nt, hsa
gcucugugaaaucgucugauggucuguguggaagaaaagaaaaaucugucugccgccuauuucc

SEQ ID NO: 42691 - RNA, 64 nt, hsa
uacucccauggcaaagaaaaaaaaaagaaugaaaaaaagaaaaaaauuuggaaaaaaaaaucag

SEQ ID NO: 42692 - RNA, 64 nt, hsa
gcucuaguaugguguauuuaaauaauaaaaacuuaaaagaaaaaauauuuaaugguguuugggu

SEQ ID NO: 42693 - RNA, 64 nt, hsa
aacuagggaagauaauauuaaggaagacaaugugaaaagaaaaaugagccuggcaagaaugugu

SEQ ID NO: 42694 - RNA, 64 nt, hsa
cugggugacagagcaagugagacccugucucaaaaaaagaaaaagaaaaagaaaaaauauuuuc

SEQ ID NO: 42695 - RNA, 64 nt, hsa
gacagagcaagugagacccugucucaaaaaaagaaaaagaaaaagaaaaaauauuuucccuauu

SEQ ID NO: 42696 - RNA, 64 nt, hsa
gcaagugagacccugucucaaaaaaagaaaaagaaaaagaaaaaauauuuucccuauuagagaa

SEQ ID NO: 42697 - RNA, 64 nt, hsa
cauuucuuuuuaggcucugagacuaaaugagaggaaaagaaaagaaaaaaaaaaugauugucua

SEQ ID NO: 42698 - RNA, 64 nt, hsa
cuuuuuaggcucugagacuaaaugagaggaaaagaaaagaaaaaaaaaaugauugucuaaccaa

SEQ ID NO: 42699 - RNA, 64 nt, hsa
cuaggaccuaucauuucaucagagacaugaucagaaaagaaacugcuucugccccauuucuugu

SEQ ID NO: 42700 - RNA, 64 nt, hsa
uuucuuguuuuggagauuacuccaucuguccaucaaaagaaaccuguaaauaugaaagaacaaa

SEQ ID NO: 42701 - RNA, 64 nt, hsa
auagcaacaaaauauuuauucuacuguaaaugacaaaagaaaaagaaaaauugagccuugggac

SEQ ID NO: 42702 - RNA, 64 nt, hsa
acaaaauauuuauucuacuguaaaugacaaaagaaaaagaaaaauugagccuugggacgugccc

SEQ ID NO: 42703 - RNA, 64 nt, hsa
cccaccccucuuuuccaguccuugccuuccaaccaaaagaaauggauguuuugguggaaggaca

SEQ ID NO: 42704 - RNA, 64 nt, hsa
uauuggggaaggaagaugauacuucuuucucaagaaaagaaaauuggauuauuaggaauacauc

SEQ ID NO: 42705 - RNA, 64 nt, hsa
cagccuggguaacagagcaagacuccaucucaaaaaaagaaagaaagaaaaaagaaaguacaag

SEQ ID NO: 42706 - RNA, 64 nt, hsa
agcaagacuccaucucaaaaaaagaaagaaagaaaaaagaaaguacaaguuuauaaaguauuau

SEQ ID NO: 42707 - RNA, 64 nt, hsa
ccugggcugaaguuggcauuucaguuaaaagaaaaaaagaaacuagucccagauuugaaaacuu

SEQ ID NO: 42708 - RNA, 64 nt, hsa
gaaaaaacccugggcugaaguuggcauuucaguuaaaagaaaaaaagaaacuagucccagauuu

SEQ ID NO: 42709 - RNA, 64 nt, hsa
auucagggauacaaaugggcuucucucauucauuaaaagaaaacgcgacaucuuucuaagauuc

SEQ ID NO: 42710 - RNA, 64 nt, hsa
uuguaaauacauagaacaaauauuuaaaaaaacaaaaagaaauugacucaguacuauuucuuuu

SEQ ID NO: 42711 - RNA, 64 nt, hsa
ggauaacuaaaacuucaaauacacaaaaugaaacaaaagaaacaauuuaaguauuuuuuuaaaa

SEQ ID NO: 42712 - RNA, 64 nt, hsa
auaaauguucuuuauacagccuaguuaauguuuaaaaagaaaaaaauagcuugguuuuauuugu

SEQ ID NO: 42713 - RNA, 64 nt, hsa
gguugguuuaacaaaaaaaaaaagcuuuaaaaaaaaaagaaaaaaaggaaaagguuuuuagcuc

SEQ ID NO: 42714 - RNA, 64 nt, hsa
gagacaggggagacccuaugucaaaaaagaaauaaaaagaaaguaaaaguccccuagugauagc

SEQ ID NO: 42715 - RNA, 64 nt, hsa
uucagccuuggagacaggggagacccuaugucaaaaaagaaauaaaaagaaaguaaaagucccc

SEQ ID NO: 42716 - RNA, 64 nt, hsa
gaaugucuuacauguuuuauucaucauucuugaaaaaagaaauaauucaaaccuuggaauuaaa

SEQ ID NO: 42717 - RNA, 64 nt, hsa
agagagagaaggaauggcgugggaugggggaaagaaaagaaagagaagaagcuggggucuccag

SEQ ID NO: 42718 - RNA, 64 nt, hsa
uauauuuuccuuucugacacauaauuuggggcaaaaaagaaagucuuaagaguuuaucuuuucu

SEQ ID NO: 42719 - RNA, 64 nt, hsa
gacuggaaacuaguuggaaacaacauacuuauggaaaagaaagucagccuuuuuaugcuguuaa

SEQ ID NO: 42720 - RNA, 64 nt, hsa
ggaucaucccauucugguucccguucaaguucaaaaaagaaauaauguauuaaaauuuacaucu

SEQ ID NO: 42721 - RNA, 64 nt, hsa
uaaaacacuucuacuagggccaaaaagagaaaagaaaagaaaauuucuacuaauuucagaccuc

SEQ ID NO: 42722 - RNA, 64 nt, hsa
gaagcuaaaacacuucuacuagggccaaaaagagaaaagaaaagaaaauuucuacuaauuucag

SEQ ID NO: 42723 - RNA, 64 nt, hsa
cuuuaguuucucacagaaucauugcaauuauguuaaaagaaaucucuacauaaaucguauuugu

SEQ ID NO: 42724 - RNA, 64 nt, hsa
augcauugcuuguguaguagaaacuaguuuuuagaaaagaaagcaaacuuaagaaacacugacu

SEQ ID NO: 42725 - RNA, 64 nt, hsa
accacgggguaggagaaguuucuuuaaagacguaaaaagaaaaaaaccauaggcugcucugccu

SEQ ID NO: 42726 - RNA, 64 nt, hsa
aaagaauucagaacuacuuuccucugugacaccaaaaagaaaagucuauaaccugaaaauguuu

SEQ ID NO: 42727 - RNA, 64 nt, hsa
ugaauuuagcaaauuaaguuauuuuccuaaaaaaaaaagaaaaaaagaauucagaacuacuuuc

SEQ ID NO: 42728 - RNA, 64 nt, hsa
uauguaaagcaauuguaggaaauuugaaaggaaaaaaagaaaccgaagccaguauuuuaauaau

SEQ ID NO: 42729 - RNA, 64 nt, hsa
gggccugugucuucaggugcuuugccaaacucuuaaaagaaaguguccagugaacuuggaagug

SEQ ID NO: 42730 - RNA, 64 nt, hsa
aacacagcaagacucuaucucaaaaaaaagaaaaaaaagaaauacauagaguucagucccuaga

SEQ ID NO: 42731 - RNA, 64 nt, hsa
acccuggguaacacagcaagacucuaucucaaaaaaaagaaaaaaaagaaauacauagaguuca

SEQ ID NO: 42732 - RNA, 64 nt, hsa
ucacuucuacuccugcucuccuaguuccccccaaaaaagaaauacugaccagugucucuacuuu

SEQ ID NO: 42733 - RNA, 64 nt, hsa
acaacauagugagaccuugucuccacaaaaauaaaaaagaaacuauccaggagugguggugugu

SEQ ID NO: 42734 - RNA, 64 nt, hsa
augacagaguggagacucuguuucaaaaaaacagaaaagaaaauauaguuugauucuucauuuu

SEQ ID NO: 42735 - RNA, 64 nt, hsa
uuuucuagucacagauguuuucaaauuucuaagaaaaagaaaaugaggcucaagaggcugcuuc

SEQ ID NO: 42736 - RNA, 64 nt, hsa
ccuugcuggaacccuugcuagcaggcauucuuauaaaagaaacuuucgagccuccuuauauugc

SEQ ID NO: 42737 - RNA, 64 nt, hsa
gaaagagcuggagucagcacuguccagaaagccaaaaagaaacagaagaagagagacuaaaggu

SEQ ID NO: 42738 - RNA, 64 nt, hsa
cugcagucagagagcaagccccccaaaaaaaagaaaaagaaaaggaggcagaaagaggaggaag

SEQ ID NO: 42739 - RNA, 64 nt, hsa
ccucaacugcagucagagagcaagccccccaaaaaaaagaaaaagaaaaggaggcagaaagagg

SEQ ID NO: 42740 - RNA, 64 nt, hsa
aauuugucacauguaucacccccaaaaaaagagaaaaagaaaaauagaagacauauaaauuaaa

SEQ ID NO: 42741 - RNA, 64 nt, hsa
aaagaagagagggaggaagaaagggagagagaagaaaagaaaaaugaagaaaaguaauuagaau

SEQ ID NO: 42742 - RNA, 64 nt, hsa
ugagaauaauucuugcaauaaaugaagaaggaauaaaagaaauaggaagccacaaauuuguaug

SEQ ID NO: 42743 - RNA, 64 nt, hsa
cccuaacagaauugaguuuucuauuaaggauccaaaaagaaaaacaaaaugcuaaugaagccau

SEQ ID NO: 42744 - RNA, 64 nt, hsa
agagcaaaacuccagcucaaaaaaaaaaagaaagaaaagaaagcuggagcugguggcuuaggcc

SEQ ID NO: 42745 - RNA, 64 nt, hsa
cuggcaacaagagcaaaacuccagcucaaaaaaaaaaagaaagaaaagaaagcuggagcuggug

SEQ ID NO: 42746 - RNA, 64 nt, hsa
gaagccaaaaggauuuaaaaccgcugcucuaaagaaaagaaaacuggaggcugggcgcaguggc

SEQ ID NO: 42747 - RNA, 64 nt, hsa
gggaguuuagcaaguuuaggagagaauagucaugaaaagaaagggaagaaaggggagaagggaa

SEQ ID NO: 42748 - RNA, 64 nt, hsa
uguaugaggguaaucgagaugaggauauuaacucaaaagaaauagggugauuuuuaaaggauua

SEQ ID NO: 42749 - RNA, 64 nt, hsa
cacagauuauuuuuuggcuccaaaacuggauugcaaaagaaagaggagaagaauauuuugugug

SEQ ID NO: 42750 - RNA, 64 nt, hsa
aaaacuuuuuauacucuaaagugauacucagaacaaaagaaagucauaaaacuccugaauuuaa

SEQ ID NO: 42751 - RNA, 64 nt, hsa
uuuuuuaaaggaggcuuuuugcccaucaagaauaaaaagaaauaaaaccaaaggguuaccggac

SEQ ID NO: 42752 - RNA, 64 nt, hsa
cacuccuucucaccucgugagauuaagggcugugaaaagaaaucuagucuaacuccaacagaaa

SEQ ID NO: 42753 - RNA, 64 nt, hsa
accagguaguagaaguguguuaaaauguuccuguaaaagaaacauugguaaauuuaaauacaua

SEQ ID NO: 42754 - RNA, 64 nt, hsa
guuuuauuacauugaagaaacuaaaacauaaaugaaaagaaacacuagguuccugcacuuuuug

SEQ ID NO: 42755 - RNA, 64 nt, hsa
ugauuauuguguuuauauguauaaaaauaggagcaaaagaaaauacucugggaauagucauacu

SEQ ID NO: 42756 - RNA, 64 nt, hsa
acagcaacauucgccauacuagcggagguaaaacaaaagaaauauugaaaacugaggcaguuaa

SEQ ID NO: 42757 - RNA, 64 nt, hsa
cuauguaucuugaugcaaagacuaugauguuaauaaaagaaaguacagaagacacuuggcauuc

SEQ ID NO: 42758 - RNA, 64 nt, hsa
gggaaagauauuuaauauuuaauacuaagcuuuaaaaagaaaccugcuaucauugcuauguauc

SEQ ID NO: 42759 - RNA, 64 nt, hsa
cauggauagucuucuuggauuauuuuuauauuugaaaagaaaauguuuuauuugcacuacugag

SEQ ID NO: 42760 - RNA, 64 nt, hsa
acaugugcaaaucagaauauauuuaaaaaaaagcaaaagaaauucaauggauggauuaauauuu

SEQ ID NO: 42761 - RNA, 64 nt, hsa
uucauagaagucgugaauacuaaguaauguauacaaaagaaauaugugaugaugugucuacuuu

SEQ ID NO: 42762 - RNA, 64 nt, hsa
uaagauaagagacuaaaauaaaaugcuaaaucuuaaaagaaacuggguuuaugcacuaaacguu

SEQ ID NO: 42763 - RNA, 64 nt, hsa
aaagaugcagcaagcuuauuaaguauuauuuucuaaaagaaauaggaggcauuuucaucuuuau

SEQ ID NO: 42764 - RNA, 64 nt, hsa
gguauauacagccugaacucaggaggcagaaaucaaaagaaauccuugagggcuggaaccugag

SEQ ID NO: 42765 - RNA, 64 nt, hsa
cugccaugacacuaggcaaaaaauauuuccuguuaaaagaaagagaaaaagagagggauauuga

SEQ ID NO: 42766 - RNA, 64 nt, hsa
cucuuuccaguaaguucacauuuggauaauuuuaaaaagaaaaguaauuaccuuuguguuucca

SEQ ID NO: 42767 - RNA, 64 nt, hsa
guccuguguuaccaaguuuauaugugacaguugaaaaagaaauucccuugaaaugaucaugagg

SEQ ID NO: 42768 - RNA, 64 nt, hsa
gugaaagacacagauacccaguaugcuuaacgugaaaagaaaauguguucuguuuuguaaagga

SEQ ID NO: 42769 - RNA, 64 nt, hsa
ugaagauuaaccauuuuuuugucuuagaauaucaaaaagaaaaagaaaaagguguucuagcugu

SEQ ID NO: 42770 - RNA, 64 nt, hsa
uuaaccauuuuuuugucuuagaauaucaaaaagaaaaagaaaaagguguucuagcuguuugcau

SEQ ID NO: 42771 - RNA, 64 nt, hsa
uacucuuuuacuuugguuccuguugugcucuuguaaaagaaaaauauaauuuccugaagaauaa

SEQ ID NO: 42772 - RNA, 64 nt, hsa
agcaacuucaguucuuuuacugcaaagaacagaaaaaagaaagaaagcaaacaagaagacuccg

SEQ ID NO: 42773 - RNA, 64 nt, hsa
guuugugucuuguggaagaaauccucuuuguggaaaaagaaacaggguuuugaacucuguuaac

SEQ ID NO: 42774 - RNA, 64 nt, hsa
uguuuaagcugacucuuugcucuaauuuuggaaaaaaagaaaugugaagggucaacuccaacgu

SEQ ID NO: 42775 - RNA, 64 nt, hsa
auagacuuauugccaaaaacaaaaaauagcuuucaaaagaaauuuaaguucuaugagaaauucc

SEQ ID NO: 42776 - RNA, 64 nt, hsa
cuuauaauguaccuggaaaauaaaccucuugagaaaaagaaaaguucauacugauuauuggaaa

SEQ ID NO: 42777 - RNA, 64 nt, hsa
uuuugucuuaaaauauuaguggcuuacauuuuaaaaaagaaaaaucaccagcaugaacuugcac

SEQ ID NO: 42778 - RNA, 64 nt, hsa
accauacaugaguuauuucuaaguuugaaaaauaaaaagaaauugcaucacacuaauuacaaaa

SEQ ID NO: 42779 - RNA, 64 nt, hsa
gaagaggcuuaauuugggggugguaacuaaaaucaaaagaaaugauugacuugagggucucugu

SEQ ID NO: 42780 - RNA, 64 nt, hsa
aaaguguugcuagagaaaauuagggaaaaggugaaaaagaaaaaaugguaguaauugagcagaa

SEQ ID NO: 42781 - RNA, 64 nt, hsa
agauuuaucuaaguagaacugaauuggcuaggaaaaaagaaaaacugcauguuaaucauuuucc

SEQ ID NO: 42782 - RNA, 64 nt, hsa
cacaugacucauugaguaguaaugauucagaagaaaaagaaaaaggagacuuuauuggucaaua

SEQ ID NO: 42783 - RNA, 64 nt, hsa
ggagcaauuuaaacucccaguuguuuauuuucacaaaagaaaauaaaauugcaguugcaagacc

SEQ ID NO: 42784 - RNA, 64 nt, hsa
ccagcccaggcaacaagagugaaacccugucucaaaaagaaaaaaaaaguugaccuugagaauu

SEQ ID NO: 42785 - RNA, 64 nt, hsa
ccuccagaacugugaaaaauaaauuuguuauuuaaaaagaaaaaaaaaaaaacaaaaaccugag

SEQ ID NO: 42786 - RNA, 64 nt, hsa
aaaaaaaaaaaaaaaaaaaaaaaaaggaaaaaaaaaaagaaaaagaaaacgugugcauuuugua

SEQ ID NO: 42787 - RNA, 64 nt, hsa
aaaaaaaaaaaaaaaaaaaggaaaaaaaaaaagaaaaagaaaacgugugcauuuuguauaaugg

SEQ ID NO: 42788 - RNA, 64 nt, hsa
uaacugcauuauggcugcuuuaaccucagucaucaaaagaaacuugcuguuuuuuaggcuugau

SEQ ID NO: 42789 - RNA, 64 nt, hsa
gcuucucccugaaaaagagaaaaaaaaaaggaaaaaaagaaaagaaaagugaaaagaaaaacuc

SEQ ID NO: 42790 - RNA, 64 nt, hsa
ucccugaaaaagagaaaaaaaaaaggaaaaaaagaaaagaaaagugaaaagaaaaacucuuauu

SEQ ID NO: 42791 - RNA, 64 nt, hsa
agaaaaaaaaaaggaaaaaaagaaaagaaaagugaaaagaaaaacucuuauuggccuaaguucu

SEQ ID NO: 42792 - RNA, 64 nt, hsa
uauaugaaugguuuuaugucauuuuuuuaauuaaaaaagaaaaauucauauaaucguguuuaaa

SEQ ID NO: 42793 - RNA, 64 nt, hsa
aaaaacaguauaaacauuaauuuacuuuguguucaaaagaaaauuccaacugcuguuggggaag

SEQ ID NO: 42794 - RNA, 64 nt, hsa
agaaaauuccaacugcuguuggggaaggacacagaaaagaaaaauaaccacccaagaaaaacaa

SEQ ID NO: 42795 - RNA, 64 nt, hsa
gcaagagaacaagauccugucucaaaaaacaaaaaaaagaaagaauugauaguacaaaauccaa

SEQ ID NO: 42796 - RNA, 64 nt, hsa
gcucagcuauuuuaaagaggaaauuaaauauuauaaaagaaauaguaaagauaaguuauccuca

SEQ ID NO: 42797 - RNA, 64 nt, hsa
acaguaccuacuugaaaggaucauugugcggauuaaaagaaauaauauauguaaagcacuuuaa

SEQ ID NO: 42798 - RNA, 64 nt, hsa
cuacuugauuuacaaaaauguacauuuagagguuaaaagaaacagugagaaauguaaacauuca

SEQ ID NO: 42799 - RNA, 64 nt, hsa
uaaaauaaucaguguuuccaaucuguccuguuacaaaagaaacagauuauuauugaacuuaugc

SEQ ID NO: 42800 - RNA, 64 nt, hsa
acuuuaccuaagggcugucagauauaaguaacuuaaaagaaagagaaguuuucuugacuuuuga

SEQ ID NO: 42801 - RNA, 64 nt, hsa
aaaugcugauuuaacauuuaaguaucacagcauuaaaagaaaaagaaaguaaaccaguccuuug

SEQ ID NO: 42802 - RNA, 64 nt, hsa
ugauuuaacauuuaaguaucacagcauuaaaagaaaaagaaaguaaaccaguccuuuguauuca

SEQ ID NO: 42803 - RNA, 64 nt, hsa
uuuucuuuuuucuagaaaacacuuuccuggauaaaaaagaaaacauuccagaugcaugauccag

SEQ ID NO: 42804 - RNA, 64 nt, hsa
uugacauuuaauaacuuugcuggaaaaucuguaaaaaagaaaaacaaguuugcuagugacuaag

SEQ ID NO: 42805 - RNA, 64 nt, hsa
uacccuucccuucaaggaguaugucauauaucacaaaagaaauugccuuacacugguucauguu

SEQ ID NO: 42806 - RNA, 64 nt, hsa
aucaccaaugucuuagauggaaucgaccucguugaaaagaaauccaagaaccauauuagaugga

SEQ ID NO: 42807 - RNA, 64 nt, hsa
uauuuaauaugcuuauaaccuaguuaaagaaaggaaaagaaaacaaaaaacgaaugaaaauaac

SEQ ID NO: 42808 - RNA, 64 nt, hsa
acuuuuaaggauaaaucauaaagucaguugcucaaaaagaaaucaauaguugaauuagugagua

SEQ ID NO: 42809 - RNA, 64 nt, hsa
aguuggacuaacauucacguaucaaacuaauauaaaaagaaauaaaaccaagaggugauuuuug

SEQ ID NO: 42810 - RNA, 64 nt, hsa
acuuuuuuuuucuuaaagccaauuauuuugaugcaaaagaaauucaguuuauaagauaaaucug

SEQ ID NO: 42811 - RNA, 64 nt, hsa
cccuacauuccagcaucuuaccuucauaugcaguaaaagaaagaaagaaaaaaaaaggaaaaaa

SEQ ID NO: 42812 - RNA, 64 nt, hsa
gcuuuaauaaugucuuuuuaaaaauacuggcaccaaaagaaauagauccagaucuacuugguug

SEQ ID NO: 42813 - RNA, 64 nt, hsa
aguauaaaagcuacuuugcuccuggugagagcuuaaaagaaaugggcuguuuugcccaaaguuu

SEQ ID NO: 42814 - RNA, 64 nt, hsa
auagagcgagacuccgucucaaaaaaaaaaaaaaaaaagaaagaaauagcauugaagaaaauac

SEQ ID NO: 42815 - RNA, 64 nt, hsa
aaccuuguccucccugcugauuuguuucuaaaucaaaagaaaugaagaaaaaaguacugugacc

SEQ ID NO: 42816 - RNA, 64 nt, hsa
uuuguaaguguuguauguaccguugauguugauaaaaagaaaguuuauaucuugauuauuuugu

SEQ ID NO: 42817 - RNA, 64 nt, hsa
uacaaauucuaaaagauaaguguguuugcaaaaaaaaagaaaauaaauacauaaaaaagggaca

SEQ ID NO: 42818 - RNA, 64 nt, hsa
uaugaugcaaaaaaagaaaaagaaaaaaaaaaagaaaagaaaacuucaauuuucuggguaugca

SEQ ID NO: 42819 - RNA, 64 nt, hsa
aauguuaugaugcaaaaaaagaaaaagaaaaaaaaaaagaaaagaaaacuucaauuuucugggu

SEQ ID NO: 42820 - RNA, 64 nt, hsa
agauuuuuaucaaauguuaugaugcaaaaaaagaaaaagaaaaaaaaaaagaaaagaaaacuuc

SEQ ID NO: 42821 - RNA, 64 nt, hsa
aacaaaagauuuuuaucaaauguuaugaugcaaaaaaagaaaaagaaaaaaaaaaagaaaagaa

SEQ ID NO: 42822 - RNA, 64 nt, hsa
gguaaauugcacauugugcaacagaaccauuaauaaaagaaaggaguuaguuuugagguaacug

SEQ ID NO: 42823 - RNA, 64 nt, hsa
uuaagcacuucuuaacauuguagcagaaaauuccaaaagaaagacuagaacaaauugguaauuu

SEQ ID NO: 42824 - RNA, 64 nt, hsa
gaguaacaauaaagaaaaaaaaauacaaaggaagaaaagaaagaaaaacaaguguucagggcau

SEQ ID NO: 42825 - RNA, 64 nt, hsa
cgacuggagaagaaaaaaaagaaaaaagauagaaaaaagaaaaaguuucagaagagcagaagua

SEQ ID NO: 42826 - RNA, 64 nt, hsa
aauuacaggaaauuagaucgacuggagaagaaaaaaaagaaaaaagauagaaaaaagaaaaagu

SEQ ID NO: 42827 - RNA, 64 nt, hsa
cggucuguacuaaaaaaaaaaaaaaagaaaaagaaaaagaaaaaagaauacccaggugugguag

SEQ ID NO: 42828 - RNA, 64 nt, hsa
gaaacccggucuguacuaaaaaaaaaaaaaaagaaaaagaaaaagaaaaaagaauacccaggug

SEQ ID NO: 42829 - RNA, 64 nt, hsa
cguggugaaacccggucuguacuaaaaaaaaaaaaaaagaaaaagaaaaagaaaaaagaauacc

SEQ ID NO: 42830 - RNA, 64 nt, hsa
aaugaaggauuucuuauuuucuuggaauuuuguaaaaagaaauugugaaaaaugagcuuguaaa

SEQ ID NO: 42831 - RNA, 64 nt, hsa
ugauaagaguguaacauccagcucuaugugggaaaaaagaaauccugguuuguaauguuuguca

SEQ ID NO: 42832 - RNA, 64 nt, hsa
aggugauugcugcuauucuggaauguguccauugaaaagaaaauaggcgcuuugucuccuacaa

SEQ ID NO: 42833 - RNA, 64 nt, hsa
uugcgcauuguguaaguuggguaacaaaaauggcaaaagaaaugcagauuucccaguuaucuug

SEQ ID NO: 42834 - RNA, 64 nt, hsa
ggguggcaauuuauuuuaagaguauuuucugguaaaaagaaaaauguguauuuuaagaugaaau

SEQ ID NO: 42835 - RNA, 64 nt, hsa
gaaaaaauuuuuaggaaacucaccuuccucaucuaaaagaaaaaggcauuuuagagaaaacuaa

SEQ ID NO: 42836 - RNA, 64 nt, hsa
uuuuuuuuuuuuugcguucgugggguuguaaaagaaaagaaagcagaauguuuuaucaugguuu

SEQ ID NO: 42837 - RNA, 64 nt, hsa
uuuguuuuuuuuuuuuuugcguucgugggguuguaaaagaaaagaaagcagaauguuuuaucau

SEQ ID NO: 42838 - RNA, 64 nt, hsa
caaaaucucuacugcuuuggauccugggucaaaaaaaagaaaaaaaaaagaaaugcaaaacuuu

SEQ ID NO: 42839 - RNA, 64 nt, hsa
cugcuuuggauccugggucaaaaaaaagaaaaaaaaaagaaaugcaaaacuuuaggcccugccc

SEQ ID NO: 42840 - RNA, 64 nt, hsa
agaaagucagaccuguuucuuguaacuggguucaaaaagaaaaaaauaauaaaaauaaaagaga

SEQ ID NO: 42841 - RNA, 64 nt, hsa
ggcuauuaaaaaagugguggcaaaagacauccucaaaagaaagagaaaugaaauauuuuugaau

SEQ ID NO: 42842 - RNA, 64 nt, hsa
gcuaagaggauaaaggaacugagaccagaugagaaaaagaaaggauauagauuccuugagugga

SEQ ID NO: 42843 - RNA, 64 nt, hsa
uggacaaauuuaacaaguuuucuguuacuuuuuaaaaagaaaaaauccagaacauaagaacuau

SEQ ID NO: 42844 - RNA, 64 nt, hsa
uuuuacuggguuugcuuuucuuaaaacauaccaaaaaagaaaaaaauagaaaaaaaaaaaaaaa

SEQ ID NO: 42845 - RNA, 64 nt, hsa
agcaguuacaagaaacccuaaaacccuuggauauaaaagaaaucuguuuauugauuuuuaaauc

SEQ ID NO: 42846 - RNA, 64 nt, hsa
cagcaagacacucuggccaccauaaaaaacgcagaaaagaaaaaaagguuaagcauaaaaagaa

SEQ ID NO: 42847 - RNA, 64 nt, hsa
aaaaaacgcagaaaagaaaaaaagguuaagcauaaaaagaaagggaaaaagcagaaacacugca

SEQ ID NO: 42848 - RNA, 64 nt, hsa
cucagggcuggggccaagaggaaaaacagggaaaaaaagaaaaaaaaaagaaaaaggaaaagga

SEQ ID NO: 42849 - RNA, 64 nt, hsa
ggccaagaggaaaaacagggaaaaaaagaaaaaaaaaagaaaaaggaaaaggaagcggugugug

SEQ ID NO: 42850 - RNA, 64 nt, hsa
uguaaaguuuaauugaaagaauguaaagcaaccaaaaagaaaaaaaaaaagaaagaaagaggaa

SEQ ID NO: 42851 - RNA, 64 nt, hsa
uugaaagaauguaaagcaaccaaaaagaaaaaaaaaaagaaagaaagaggaaaagaaauccaua

SEQ ID NO: 42852 - RNA, 64 nt, hsa
caaccaaaaagaaaaaaaaaaagaaagaaagaggaaaagaaauccauacuaacccuuuuccauu

SEQ ID NO: 42853 - RNA, 64 nt, hsa
uacugcaaacuauuuaaagaaauauguauucuguaaaagaaaaaaaaaaugcggccuuuucaug

SEQ ID NO: 42854 - RNA, 64 nt, hsa
cccaccuuaacucuuucuugucaggaguauauaaaaaagaaagaaaacaaaacucgcccuacag

SEQ ID NO: 42855 - RNA, 64 nt, hsa
ugcagguagcaaagauguaauaaauuugcuuaaaaaaagaaauuaaaguuuuauuuagaaucaa

SEQ ID NO: 42856 - RNA, 64 nt, hsa
aaauacguuugacccauuuugaauaaggaaauugaaaagaaaaauuuaaaaggagaaaaaaaug

SEQ ID NO: 42857 - RNA, 64 nt, hsa
ucuacagaaccaaagacauguauagaaaguauggaaaagaaaacagacaguuuaguucagaaug

SEQ ID NO: 42858 - RNA, 64 nt, hsa
uguaaugcagaagcacuugaggcucaucuugcacaaaagaaaugucagacacucuuuggauuug

SEQ ID NO: 42859 - RNA, 64 nt, hsa
auauuuaguucacuauuauauaguggguuauauuaaaagaaaagaagaaaaauaucuaauuucu

SEQ ID NO: 42860 - RNA, 64 nt, hsa
cucauuaaaaaccuuuuuuuuuuaaaaaaaaaaaaaaagaaaaucucauuagugaacuuaucuu

SEQ ID NO: 42861 - RNA, 64 nt, hsa
gggcuuugcugcauucccuaagauaauuacaggaaaaagaaaauguaaaagugcuaacaaggcu

SEQ ID NO: 42862 - RNA, 64 nt, hsa
ugaaagaccgagacuccgccucaaaaaaaaaaaaaaaagaaagaaagaaagaaagaaagaaauc

SEQ ID NO: 42863 - RNA, 64 nt, hsa
gauucuuccugauucaaagacugucaaauaggaaaaaagaaaacaguaaaugaacaaaaacauc

SEQ ID NO: 42864 - RNA, 64 nt, hsa
agaaacauuugcugaguguuuuuaauaggagucaaaaagaaagggucuuuucagaaacugaagu

SEQ ID NO: 42865 - RNA, 64 nt, hsa
auaacagacaaggucaaaaaauagaugcaggcugaaaagaaaaggaagugggcuaagaugggaa

SEQ ID NO: 42866 - RNA, 64 nt, hsa
uauuuaucaaggaaauggaaaaugauacagcuauaaaagaaagcuguuauuuacuguaguugua

SEQ ID NO: 42867 - RNA, 64 nt, hsa
ggccacaguccagccaaauccuauaauauccuugaaaagaaacuauuaaaaaggauagacauuu

SEQ ID NO: 42868 - RNA, 64 nt, hsa
ugaaaugaaccuuggguuagaguuaugguaggcaaaaagaaaaggagaauuuaggaaauaaaua

SEQ ID NO: 42869 - RNA, 64 nt, hsa
aacccuuuugagguuuugauuuggaaauagauuuaaaagaaaacaggcuaagauaauauccuug

SEQ ID NO: 42870 - RNA, 64 nt, hsa
ucuugacaaagggauuuacacccuugacaaaaccaaaagaaauuaacaggccacagguuucuuu

SEQ ID NO: 42871 - RNA, 64 nt, hsa
aggaaaagguuaaacuggauuuuuuuuuuuaaaaaaaagaaaaaaaaagaagaaaaguauacca

SEQ ID NO: 42872 - RNA, 64 nt, hsa
gcaaacugcccuuuguccucaaagaaauuguugaaaaagaaaacuuuuuaaagagauuuuuugc

SEQ ID NO: 42873 - RNA, 64 nt, hsa
ggacauacauuccaagcuuuucaacucuaggagaaaaagaaaaucauguuuuccuguauuguaa

SEQ ID NO: 42874 - RNA, 64 nt, hsa
uguuuauugcuguuuugucuuucuuuuuucuaaaaaaagaaaaaaaagaaaaaaaggaaaagaa

SEQ ID NO: 42875 - RNA, 64 nt, hsa
cuguuuugucuuucuuuuuucuaaaaaaagaaaaaaaagaaaaaaaggaaaagaagaacaaaga

SEQ ID NO: 42876 - RNA, 64 nt, hsa
aguuauugaaauaggacuuaagaauuaccuauuaaaaagaaaucugauauauaaaaauauguac

SEQ ID NO: 42877 - RNA, 64 nt, hsa
ucucugauagagcuauuaaugacuuaguuucuguaaaagaaauggagaguugauaugguucaga

SEQ ID NO: 42878 - RNA, 64 nt, hsa
uguuaaggaguuuuucccaagaagaaaaguauuuaaaagaaauaccagugagugccuuaaaguu

SEQ ID NO: 42879 - RNA, 64 nt, hsa
cagguaucacagccuaaagaaauuaucuuuuugcaaaagaaauauuaaaugauuuagcagucuc

SEQ ID NO: 42880 - RNA, 64 nt, hsa
gucuguccacgcaauggaacauuauuagacucuaaaaagaaaugaaguacucacacaugccaca

SEQ ID NO: 42881 - RNA, 64 nt, hsa
aagaagcuaauguuuaagaagcauuugggaaagaaaaagaaauaaauguauccagauaggaaaa

SEQ ID NO: 42882 - RNA, 64 nt, hsa
uauuuuugucuuguuaagaaaauuuagcauuucuaaaagaaaaaagcaacccucuuucaaacug

SEQ ID NO: 42883 - RNA, 64 nt, hsa
guccucuccacuuuaucccacgauaucuaaaugaaaaagaaagaaaacccacacacaaagcaaa

SEQ ID NO: 42884 - RNA, 64 nt, hsa
cauucucauuguuacaugauuuuuuaaaaaaaggaaaagaaaaugugaaacacaauuuaguccu

SEQ ID NO: 42885 - RNA, 64 nt, hsa
gaucuuuggaaacuugccccuuauuuaaaaaaaaaaaagaaaaaaaagaguuuguuacucuauu

SEQ ID NO: 42886 - RNA, 64 nt, hsa
ugaggagaaaagaaagcacacugccuaaauguguaaaagaaaaaugcagagguuauuaaaaugu

SEQ ID NO: 42887 - RNA, 64 nt, hsa
aaauauuggccaagguguugcuuuaacugaggagaaaagaaagcacacugccuaaauguguaaa

SEQ ID NO: 42888 - RNA, 64 nt, hsa
uagucuuguuuguaaaaaaaaaaaaaaaaaaagaaaaagaaaaaaguguauuuuacuguuuucu

SEQ ID NO: 42889 - RNA, 64 nt, hsa
auaagcuagucuuguuuguaaaaaaaaaaaaaaaaaaagaaaaagaaaaaaguguauuuuacug

SEQ ID NO: 42890 - RNA, 64 nt, hsa
ugacagagugagacucuguuucaaaaaagaaaagaaaagaaacaugguucaaauuauaucuaaa

SEQ ID NO: 42891 - RNA, 64 nt, hsa
ccuggugacagagugagacucuguuucaaaaaagaaaagaaaagaaacaugguucaaauuauau

SEQ ID NO: 42892 - RNA, 64 nt, hsa
uccagccuggugacagagugagacucuguuucaaaaaagaaaagaaaagaaacaugguucaaau

SEQ ID NO: 42893 - RNA, 64 nt, hsa
cgaugugcagccaaaucugagaggccccauuuaaaaaagaaagaacaugggugguacauugagg

SEQ ID NO: 42894 - RNA, 64 nt, hsa
ccauaucuaugauaucgcauuaguccauguggggaaaagaaagaucagauuguuacugugucug

SEQ ID NO: 42895 - RNA, 64 nt, hsa
agagccagacucugucucaaaaaaaaaaaaaaagaaaagaaaaagauaaagggauugugaaaag

SEQ ID NO: 42896 - RNA, 64 nt, hsa
gugacagagccagacucugucucaaaaaaaaaaaaaaagaaaagaaaaagauaaagggauugug

SEQ ID NO: 42897 - RNA, 64 nt, hsa
uugucuggggccuggggaaagggcuuggacugugaaaagaaauguggccccuuuccaucuucaa

SEQ ID NO: 42898 - RNA, 64 nt, hsa
acgaagccuuucaggcugcuucuguuuaaaauauaaaagaaaacuuugcccccuuugcaucuuc

SEQ ID NO: 42899 - RNA, 64 nt, hsa
uuggacagaacagaauaauaugaagcaggaucacaaaagaaaaaaaacuuuggcuuucauauuc

SEQ ID NO: 42900 - RNA, 64 nt, hsa
cucuuuuuuauaucucuuuggcguuucccuacagaaaagaaauuggacagaacagaauaauaug

SEQ ID NO: 42901 - RNA, 64 nt, hsa
ggugucucuaugcccuuugaaagcaguuuuuauaaaaagaaagcccgggucugcagagaaugaa

SEQ ID NO: 42902 - RNA, 64 nt, hsa
uuuuccuauauauguuccuuacaaaaaaaaaaaaaaaagaaaucaagcagauggcuuaaagcug

SEQ ID NO: 42903 - RNA, 64 nt, hsa
augaagagaguugaguuuaacaauccuagcuuuuaaaagaaacuauuuaauguaaaauauucua

SEQ ID NO: 42904 - RNA, 64 nt, hsa
auaaauauguaugcauacuucugacaacuugauaaaaagaaaagcuacacccaaacaauacaac

SEQ ID NO: 42905 - RNA, 64 nt, hsa
acuuuguucuuccaaguccuaguggaaaagacaaaaaagaaacuaaguuacuugucugcaguca

SEQ ID NO: 42906 - RNA, 64 nt, hsa
ccuuaauauugaauauacuguuuaccucacacuaaaaagaaaaccagaagccuuauuugugauu

SEQ ID NO: 42907 - RNA, 64 nt, hsa
agaauuuuggugggcaucuaauccuacauaaugaaaaagaaaaacagaccauuuaaaaacucag

SEQ ID NO: 42908 - RNA, 64 nt, hsa
cuuccuggcuaucuuaaacaaguucauacauuugaaaagaaaaaaaaauguuguuuaaaaaaug

SEQ ID NO: 42909 - RNA, 64 nt, hsa
ugcuuagucuaaagacuguagcaaaaaaaaaaaaaaaagaaaaauuagauuuuacauaucuuug

SEQ ID NO: 42910 - RNA, 64 nt, hsa
aauugggucuaugauuuuuugccaaucuuagccuaaaagaaauugcuuuagcuucuggucagca

SEQ ID NO: 42911 - RNA, 64 nt, hsa
uuaucuuugacuuuuaccacaaaucuucauuuauaaaagaaaaagccaaagugaaaaaaaguua

SEQ ID NO: 42912 - RNA, 64 nt, hsa
guagcuacuguuuuuaauguaaagguuaaacuugaaaagaaauucuuaaucacggugccaaaau

SEQ ID NO: 42913 - RNA, 64 nt, hsa
ucugcucugagccuuaaaacacagauugaagaagaaaagaaagaaaaaacuuaaauauuuauuu

SEQ ID NO: 42914 - RNA, 64 nt, hsa
cuuuuaauguuuucucucucacacacaaagauucaaaagaaaugugcauauauuuauucuguaa

SEQ ID NO: 42915 - RNA, 64 nt, hsa
uagugcuuuuuuuuuuucaaaagaaaaggaaaauaaaagaaauauaucccuugcucccuuuaca

SEQ ID NO: 42916 - RNA, 64 nt, hsa
agagaagaaaauauauuagugcuuuuuuuuuuucaaaagaaaaggaaaauaaaagaaauauauc

SEQ ID NO: 42917 - RNA, 64 nt, hsa
aaaauuucuauucaggcuacuggaauugguuauuaaaagaaaaaggaaaaagaagaaucuugcu

SEQ ID NO: 42918 - RNA, 64 nt, hsa
aaucauaacuuuaauucaagaaugcaguuuuaccaaaagaaaaauuugaaaauuucuauucagg

SEQ ID NO: 42919 - RNA, 64 nt, hsa
ucugugacaaaaaaaaaaaaaaaaaaaagaaaaaaaaagaaaaaacagaaauauauccagcuaa

SEQ ID NO: 42920 - RNA, 64 nt, hsa
caaacaguguucugugacaaaaaaaaaaaaaaaaaaaagaaaaaaaaagaaaaaacagaaauau

SEQ ID NO: 42921 - RNA, 64 nt, hsa
auaugaacuuugguucuucaugagugcauuuugaaaaagaaaaaaaguacacauucagaaucug

SEQ ID NO: 42922 - RNA, 64 nt, hsa
ccaagaagcucaaagaaaagaaguacguuaaagaaaaagaaaaaaccucacuuuuccuuuauag

SEQ ID NO: 42923 - RNA, 64 nt, hsa
ugcaacuuuuuuugccuuggugacuuuugaaaaaaaaagaaaagaaaaagcagcauccuuauau

SEQ ID NO: 42924 - RNA, 64 nt, hsa
cuuuuuuugccuuggugacuuuugaaaaaaaaagaaaagaaaaagcagcauccuuauauuucuu

SEQ ID NO: 42925 - RNA, 64 nt, hsa
gcuaauguauaaugugcagaaaauauuuaauaucaaaagaaaauugauauuuuuauacaaguaa

SEQ ID NO: 42926 - RNA, 64 nt, hsa
ugcuaaccauuuauauaaaacuuaaaaacaagagaaaagaaaaaucaauuagaucuaaacaguu

SEQ ID NO: 42927 - RNA, 64 nt, hsa
uuccuugcuuagucuccuuucaguauuuggcaauaaaagaaagaagaaauagaacagcugaagu

SEQ ID NO: 42928 - RNA, 64 nt, hsa
auaaaucauauggcgagucagggaauaaaaagucaaaagaaacaaauagaagcuuuuuuuuuua

SEQ ID NO: 42929 - RNA, 64 nt, hsa
accugggugaugaagugagacucuccaaaaaaaaaaaagaaauuauuaaucccugccugugcuc

SEQ ID NO: 42930 - RNA, 64 nt, hsa
cagccagaacuuucuuucacgguuacuguuccugaaaagaaaaagccaccuagcccuaucaagc

SEQ ID NO: 42931 - RNA, 64 nt, hsa
auuaauuucaaaauuuaaagccaugcuaaaauuaaaaagaaaauauuaaauuacacaauuacac

SEQ ID NO: 42932 - RNA, 64 nt, hsa
uagccuagacaacauagugagacuuggucucuaaaaaagaaaaaaaaaaauaaaacugauguaa

SEQ ID NO: 42933 - RNA, 64 nt, hsa
aacugaaguggcauguuauguuuuuggcaugaacaaaagaaacaagagagaaaaaaaucaaaau

SEQ ID NO: 42934 - RNA, 64 nt, hsa
agcgauucuucugccucagccucccaaaugucagaaaagaaagcauacaugcuuaugcaugaaa

SEQ ID NO: 42935 - RNA, 64 nt, hsa
uuuuggaaggcuuuccacaaacuaaccuuggaugaaaagaaaaaauuccucuguaaguacugug

SEQ ID NO: 42936 - RNA, 64 nt, hsa
aagaaguauauuuuagaaauuuguuaaugagaguaaaagaaaauaaauguguauagcucaguuu

SEQ ID NO: 42937 - RNA, 64 nt, hsa
uagguuaaacaugguuagaaacaacugaaagcauaaaagaaaaaucuaggccgggugcaguggc

SEQ ID NO: 42938 - RNA, 64 nt, hsa
cauuugcuauaaaguugaacuuuguauggcuugaaaaagaaaugacaauauggaacaucccaag

SEQ ID NO: 42939 - RNA, 64 nt, hsa
aacauuuauaauugcaaaauaaaccaacuauaaaaaaagaaacuaagagagaauugguacuuua

SEQ ID NO: 42940 - RNA, 64 nt, hsa
aaaagagaauuuagaugagagaugcaauuuuuuaaaaagaaaauuaauuugcaucccucguuua

SEQ ID NO: 42941 - RNA, 64 nt, hsa
auaaggaugaucagagacuuuugccagcuacacuaaaagaaaauggccuucuugacugugaaga

SEQ ID NO: 42942 - RNA, 64 nt, hsa
aaaagaaacuaucucggucacgugagcgccagcgaaaagaaacuguaucagucauccagagacc

SEQ ID NO: 42943 - RNA, 64 nt, hsa
uagggccuuccuuuuugccuugugagcgccaaggaaaagaaacuaucucggucacgugagcgcc

SEQ ID NO: 42944 - RNA, 64 nt, hsa
accuggcuacaauuacuuugaacauuaauguugaaaaagaaaacaaccaaagaaaauugguacu

SEQ ID NO: 42945 - RNA, 64 nt, hsa
gagaggacaaguguaauaaaucaaaauugaccucaaaagaaaauguguaacagaguugagguug

SEQ ID NO: 42946 - RNA, 64 nt, hsa
uucucuaauuacuauacauugugcucauaugaauaaaagaaauuuuaaaagaaaaaaaaucaga

SEQ ID NO: 42947 - RNA, 64 nt, hsa
aauacccauuuaaugugaaaaacauaagagucuuaaaagaaauuaagccauuuaacauuuuuua

SEQ ID NO: 42948 - RNA, 64 nt, hsa
uugcccauaauaucaacuuucccuccuauaguuaaaaagaaaaaaaaugaaucuauuuuucucu

SEQ ID NO: 42949 - RNA, 64 nt, hsa
aaucaacaaugugauacguaaauuauagaaaaagaaaagaaacacaaaagcuauagauauacag

SEQ ID NO: 42950 - RNA, 64 nt, hsa
uguugaaucaacaaugugauacguaaauuauagaaaaagaaaagaaacacaaaagcuauagaua

SEQ ID NO: 42951 - RNA, 64 nt, hsa
gaauucauuggaagaaaucaccaaagauuauuacaaaagaaaaauauguugcuaagauuguguu

SEQ ID NO: 42952 - RNA, 64 nt, hsa
ucucauggaaaaauuaauuauaugguugaaauguaaaagaaaguaagcauaaaaaucgaguaau

SEQ ID NO: 42953 - RNA, 64 nt, hsa
gaaaaggaucaacaguuaauuugagccaaguaauaaaagaaauucugcauuugucacgaagaca

SEQ ID NO: 42954 - RNA, 64 nt, hsa
accaagucuuacauagaaaaaaaagguagauaugaaaagaaaaaucacagaagagagaaugcaa

SEQ ID NO: 42955 - RNA, 64 nt, hsa
cucagaaaaaagaagcugccaguucuuggaaugaaaaagaaauacagucuuacaccaucaagga

SEQ ID NO: 42956 - RNA, 64 nt, hsa
aaaaagccagugccuauugaguauaucaaaccaaaaaagaaaaaaaaaaguuuuaagagggguc

SEQ ID NO: 42957 - RNA, 64 nt, hsa
ggccaccaacaauuuagucauaucugauagguacaaaagaaaaccaagauuuugauaugaccac

SEQ ID NO: 42958 - RNA, 64 nt, hsa
uguuggcaaucaaagcaugcacuuguaacaaugaaaaagaaaaagcauuuuauauuacuacuca

SEQ ID NO: 42959 - RNA, 64 nt, hsa
gaauuaggcagucuuaaaaaaaaaaaaaaacagaaaaagaaaaaaaagaacguugcaaauuugu

SEQ ID NO: 42960 - RNA, 64 nt, hsa
cuuuuaaaaaugcuuauagagaaaaaaaauuuuaaaaagaaagcuaaugcuaguauauacugca

SEQ ID NO: 42961 - RNA, 64 nt, hsa
uaacagaauacgacagacuggguaauuuaaaaagaaaagaaauuuauuuucuuccuaguucugg

SEQ ID NO: 42962 - RNA, 64 nt, hsa
uacuauaacagaauacgacagacuggguaauuuaaaaagaaaagaaauuuauuuucuuccuagu

SEQ ID NO: 42963 - RNA, 64 nt, hsa
gcccuucccccugcaaaaagaaaaaaagaaaagaaaaagaaaaaaaucccuuguucucaguggu

SEQ ID NO: 42964 - RNA, 64 nt, hsa
cucccugcccuucccccugcaaaaagaaaaaaagaaaagaaaaagaaaaaaaucccuuguucuc

SEQ ID NO: 42965 - RNA, 64 nt, hsa
auauacucccugcccuucccccugcaaaaagaaaaaaagaaaagaaaaagaaaaaaaucccuug

SEQ ID NO: 42966 - RNA, 64 nt, hsa
uguagacgauauacucccugcccuucccccugcaaaaagaaaaaaagaaaagaaaaagaaaaaa

SEQ ID NO: 42967 - RNA, 64 nt, hsa
aaguaaaccauauauagggaaauuaacaccuaggaaaagaaaacuggcaagagaauugaugagg

SEQ ID NO: 42968 - RNA, 64 nt, hsa
ccaauguuucaucaucaggaacuuucgguuuuaaaaaagaaacauuacuuuugucugcuaaagu

SEQ ID NO: 42969 - RNA, 64 nt, hsa
ucaacuuaccaggcaccaaaagaaguaaaagcaaaaaagaaaaccuuucuucaccaaaucuugg

SEQ ID NO: 42970 - RNA, 64 nt, hsa
uccccacagauaacugaaaauuauuuaaaccgcuaaaagaaacuuucuuucucacuaaaucuuu

SEQ ID NO: 42971 - RNA, 64 nt, hsa
auuuaaagccacaaccacauacaacacaaagagaaaaagaaaugcaaaaaucucugcgugcagg

SEQ ID NO: 42972 - RNA, 64 nt, hsa
cugauaagcuucaaagcugcuuuauucaauaaaaaaaagaaaugaaaaagauauaugaauauga

SEQ ID NO: 42973 - RNA, 64 nt, hsa
ccagcuugggcaacagagcaagacuccaucucaaaaaagaaaaaagaaaagaaauagaauuauc

SEQ ID NO: 42974 - RNA, 64 nt, hsa
gggcaacagagcaagacuccaucucaaaaaagaaaaaagaaaagaaauagaauuaucaagcuuu

SEQ ID NO: 42975 - RNA, 64 nt, hsa
aagacuccaucucaaaaaaaaaaaaagaaaaaagaaaagaaauagaauuaucaagcuuuuaaaa

SEQ ID NO: 42976 - RNA, 64 nt, hsa
uaggcaauguagugagacccugucucuaauuuaaaaaagaaaaagaaaaaaacauucccagugg

SEQ ID NO: 42977 - RNA, 64 nt, hsa
auguagugagacccugucucuaauuuaaaaaagaaaaagaaaaaaacauucccaguggcagccu

SEQ ID NO: 42978 - RNA, 64 nt, hsa
gaaagcuugcuguacaaaggcaacagcaacuuaaaaaagaaaaucuggacaauagauguggacu

SEQ ID NO: 42979 - RNA, 64 nt, hsa
uuuugauaugacugaauugcaaucuauauuuuuaaaaagaaaaaucaaaauacauuaggguuua

SEQ ID NO: 42980 - RNA, 64 nt, hsa
cuccauaccuagccccucuuuuauaaucuuccuuaaaagaaagaguguagccuauaaauacuaa

SEQ ID NO: 42981 - RNA, 64 nt, hsa
aaccaaccacagaucaaaaauagaaaaaaaaaaaaaaagaaaaaaagaauguaaaauuuuaaaa

SEQ ID NO: 42982 - RNA, 64 nt, hsa
uuguucuuaaggcaucauaucuagaagcaaagaaaaaagaaaaauaacaauuuaaguuguguaa

SEQ ID NO: 42983 - RNA, 64 nt, hsa
aguuacuuauauuaauaauauucagaaaaaaaaaaaaagaaaaggaaaaagaaaaauauauauu

SEQ ID NO: 42984 - RNA, 64 nt, hsa
gacucugucucagaaaaaaaaaaaaagaaaaggaaaaagaaaaauauauauucuauauuuuuuu

SEQ ID NO: 42985 - RNA, 64 nt, hsa
uucauuguuuugcaaaaguguaugguaggggcuuaaaagaaacuauaaaguuuuauuugaauga

SEQ ID NO: 42986 - RNA, 64 nt, hsa
cauuuguguuucagcucacaguucuuugcuggguaaaagaaauacuuucugacagucaccugag

SEQ ID NO: 42987 - RNA, 64 nt, hsa
uaaagggaaaggggaaagaaagggaaaagggagaaaaagaaacacaagagacuuaaaggacagg

SEQ ID NO: 42988 - RNA, 64 nt, hsa
uuuggaguuagguccucacuugggggaaaaaaaaaaaagaaaagccaagcaaaccaauggugau

SEQ ID NO: 42989 - RNA, 64 nt, hsa
guugucguuuuaacaucuccacgucccuagcauaaaaagaaaaagaaaaaaauuuaaacugcuu

SEQ ID NO: 42990 - RNA, 64 nt, hsa
guuuuaacaucuccacgucccuagcauaaaaagaaaaagaaaaaaauuuaaacugcuuuuucgg

SEQ ID NO: 42991 - RNA, 64 nt, hsa
gaaguaucaucuauaagggagggcugggggcgggaaaagaaaaaaaaaagucauuuugaaauua

SEQ ID NO: 42992 - RNA, 64 nt, hsa
uucaauuacauccugacuuguauagacacagccaaaaagaaacuguuaauagccauccguccau

SEQ ID NO: 42993 - RNA, 64 nt, hsa
gguuugaauggaguugaaaguuuuacauaagugaaaaagaaaguuuaucuugggaguugaguug

SEQ ID NO: 42994 - RNA, 64 nt, hsa
uuuuuucuuccuguccccuccuaccccagucccuaaaagaaauggggaaaaaagaaaacaacag

SEQ ID NO: 42995 - RNA, 64 nt, hsa
cccuccuaccccagucccuaaaagaaauggggaaaaaagaaaacaacagcaagucagaaaaaaa

SEQ ID NO: 42996 - RNA, 64 nt, hsa
aaauacaaccgagaggggagauuuuuaaaaaagaaaaagaaacacaaauauuaauagaaaucuc

SEQ ID NO: 42997 - RNA, 64 nt, hsa
aggcuaaaauacaaccgagaggggagauuuuuaaaaaagaaaaagaaacacaaauauuaauaga

SEQ ID NO: 42998 - RNA, 64 nt, hsa
uuaguuaaaaaaaaauucccuaaagacuaacuugaaaagaaaaccacagcaggaugcuaaugga

SEQ ID NO: 42999 - RNA, 64 nt, hsa
aaauugucaaaauuguuuaccauagaaagaugacaaaagaaaauuuuccacauaggaaaaugcc

SEQ ID NO: 43000 - RNA, 64 nt, hsa
uuaauugugugcccauaaacacugauuuuuuuuaaaaagaaaacuuaguaauuauuugauggau

SEQ ID NO: 43001 - RNA, 64 nt, hsa
uuagaaaguagcacuugaugcaagggauguuuugaaaagaaaaaauugguaaugcgaauguaua

SEQ ID NO: 43002 - RNA, 64 nt, hsa
aaaugaaaaaagaaaagaaaagcauaauaaauuuaaaagaaaaggcugagaaaugaaacuuggu

SEQ ID NO: 43003 - RNA, 64 nt, hsa
acaaagucucaauccuuauuuuaaaugaaaaaagaaaagaaaagcauaauaaauuuaaaagaaa

SEQ ID NO: 43004 - RNA, 64 nt, hsa
uggggacaaagucucaauccuuauuuuaaaugaaaaaagaaaagaaaagcauaauaaauuuaaa

SEQ ID NO: 43005 - RNA, 64 nt, hsa
ucauggauaaaaacuaagcgcuugccuucuuuuaaaaagaaaaacugaugauuagauuagguua

SEQ ID NO: 43006 - RNA, 64 nt, hsa
augagauugaaauuuuuuaugaucucuaaaccauaaaagaaaacaccgacagcuguaaaauguu

SEQ ID NO: 43007 - RNA, 64 nt, hsa
guugaauaagaguuggcuuaaauuuuaaaaaagaaaaagaaaauugagguuuuaggauuuucau

SEQ ID NO: 43008 - RNA, 64 nt, hsa
agaaaaguugaauaagaguuggcuuaaauuuuaaaaaagaaaaagaaaauugagguuuuaggau

SEQ ID NO: 43009 - RNA, 64 nt, hsa
guaagaaaagaaaaaagaaaagaaaaaaagggaaaaaagaaaagcaaggaaaaggcucuuuauu

SEQ ID NO: 43010 - RNA, 64 nt, hsa
acgacuuaauguauguuguaagaaaagaaaaaagaaaagaaaaaaagggaaaaaagaaaagcaa

SEQ ID NO: 43011 - RNA, 64 nt, hsa
gauucacgacuuaauguauguuguaagaaaagaaaaaagaaaagaaaaaaagggaaaaaagaaa

SEQ ID NO: 43012 - RNA, 64 nt, hsa
aacaucugauucacgacuuaauguauguuguaagaaaagaaaaaagaaaagaaaaaaagggaaa

SEQ ID NO: 43013 - RNA, 62 nt, hsa
guauuuugagguuuuauuguuuuuuuaauaacuaaaaagaaaaaaggaacaguguaaauuug

SEQ ID NO: 43014 - RNA, 64 nt, hsa
guauuuuuuauauaacuucauuuuaaaauauauuaaaagaaaccuaaauguucaagauaucagc

SEQ ID NO: 43015 - RNA, 64 nt, hsa
cugugauauuuuagacugcaaguugaaaaaaauaaaaagaaaugagggcagguuccagggccug

SEQ ID NO: 43016 - RNA, 64 nt, hsa
ucuaauucccacaggaagcaugguauauaacaggaaaagaaaacuacauggggaaccagaagac

SEQ ID NO: 43017 - RNA, 64 nt, hsa
gaagauugaccaaaccauccaaaugccaaaaagaaaaagaaaaaaaaaagccucucuguccuau

SEQ ID NO: 43018 - RNA, 64 nt, hsa
ggaagagaagauugaccaaaccauccaaaugccaaaaagaaaaagaaaaaaaaaagccucucug

SEQ ID NO: 43019 - RNA, 64 nt, hsa
agagcaagacuccgucucaaaaaaaagaaaagaaaaaagaaagcauuguuuuaauugagagggg

SEQ ID NO: 43020 - RNA, 64 nt, hsa
gggugacagagcaagacuccgucucaaaaaaaagaaaagaaaaaagaaagcauuguuuuaauug

SEQ ID NO: 43021 - RNA, 64 nt, hsa
agcccgggugacagagcaagacuccgucucaaaaaaaagaaaagaaaaaagaaagcauuguuuu

SEQ ID NO: 43022 - RNA, 64 nt, hsa
gaaguaagauguaaauugaagaagccucacacguaaaagaaauguauuaauguauguaggagcu

SEQ ID NO: 43023 - RNA, 64 nt, hsa
acauuucacuuuucuguaaauauacauaaacuuaaaaagaaaaccucauggagucaucuugcac

SEQ ID NO: 43024 - RNA, 64 nt, hsa
ggggaagauuguguuacugcccuucacagugaaaaaaagaaaaaucuuucauuuuuaaaauuag

SEQ ID NO: 43025 - RNA, 64 nt, hsa
uaauucucaugcugaagcuguagccuaaaaagccaaaagaaaguugucuucauuguacaaacau

SEQ ID NO: 43026 - RNA, 64 nt, hsa
aaaauugcaguauuuaaagcuuaagcuuucaggaaaaagaaaauaagaauucagugugugcaug

SEQ ID NO: 43027 - RNA, 64 nt, hsa
aaucaguuuagcuuuguguuguaugcuaguuuaaaaaagaaaauauguaauauaauguaaaaaa

SEQ ID NO: 43028 - RNA, 64 nt, hsa
gggggggguaggagaggagaaaaaaaaagugaaaaaaagaaacgaaaaggacagacgaagaguu

SEQ ID NO: 43029 - RNA, 64 nt, hsa
aaggacagacgaagaguuuaaagagaaaagggaaaaaagaaagaaaaaguaagcagggcuggcu

SEQ ID NO: 43030 - RNA, 64 nt, hsa
cagucaguggagggcgagugguuucggaaaaaaaaaaagaaaaaaagaaaaaaaaagaaaaaaa

SEQ ID NO: 43031 - RNA, 64 nt, hsa
ggagggcgagugguuucggaaaaaaaaaaagaaaaaaagaaaaaaaaagaaaaaaaaaagauuu

SEQ ID NO: 43032 - RNA, 64 nt, hsa
ugguuucggaaaaaaaaaaagaaaaaaagaaaaaaaaagaaaaaaaaaagauuuuuuucuucuc

SEQ ID NO: 43033 - RNA, 64 nt, hsa
auucaaggccacaaaaacaauguuugggggaaaaaaaagaaaaaaucaugccagcuaaucaugu

SEQ ID NO: 43034 - RNA, 64 nt, hsa
ucagcagacuggaagcugaggaagaucuagaaguaaaagaaaaaauuagaugcguuaaaaugac

SEQ ID NO: 43035 - RNA, 64 nt, hsa
auuuuuuuuucugugacuauguuuucacuuacauaaaagaaauugugauagaccuuuuucauau

SEQ ID NO: 43036 - RNA, 64 nt, hsa
aagaugaagcaaaauuuuaaucuggcaauuaugaaaaagaaauauuuuagcucugaaggauuua

SEQ ID NO: 43037 - RNA, 64 nt, hsa
gcaguuuauuuuguuauguuggauaaauacuguuaaaagaaaccagucaguaacuauauuguua

SEQ ID NO: 43038 - RNA, 64 nt, hsa
cuccucuuuguuuuuaaaaguuauaacauggcugaaaagaaagauuaaaccuacuuucauaugu

SEQ ID NO: 43039 - RNA, 64 nt, hsa
uuauaauaaaauccuucuguaauaauaaaguuucaaaagaaaauguuuauuuguucucauuaaa

SEQ ID NO: 43040 - RNA, 64 nt, hsa
gauuuuuuuuuuccuucccaaccucucuugcaaaaaaagaaauggguuucugcuaaugaauuga

SEQ ID NO: 43041 - RNA, 64 nt, hsa
caucaugauuaaugaaaacuaucuuuugaguuugaaaagaaauuaauuugcaguguuuggauug

SEQ ID NO: 43042 - RNA, 64 nt, hsa
agaguucacacccacucuaaaaccauguccucugaaaagaaacaaaaauacagugaucaucaaa

SEQ ID NO: 43043 - RNA, 64 nt, hsa
guugagauucggcaguugcccaauuccuuuaauaaaaagaaacuaaauaauuugggccccaaag

SEQ ID NO: 43044 - RNA, 64 nt, hsa
gcaguguuucugggggagguuauggagggaagaaaaaagaaaaaucgauagugagugacugauu

SEQ ID NO: 43045 - RNA, 64 nt, hsa
auaaauaccauuaaacugugaucaguuaaaauuuaaaagaaaaaucagcacaaaagggcgcuaa

SEQ ID NO: 43046 - RNA, 64 nt, hsa
uguggaguaucccauucugaugaguacagaaaaaaaaagaaaaagaaaagaagagaaaaaauua

SEQ ID NO: 43047 - RNA, 64 nt, hsa
guaucccauucugaugaguacagaaaaaaaaagaaaaagaaaagaagagaaaaaauuaagaaaa

SEQ ID NO: 43048 - RNA, 64 nt, hsa
ucgcaagcccggggagagauuuauaaaaguaaacaaaagaaaaccuuccagcaacaaauuaaaa

SEQ ID NO: 43049 - RNA, 64 nt, hsa
caagaaagcaggaacguggagaaauuggagcaggaaaagaaauuaucaaagcaauagaaauagc

SEQ ID NO: 43050 - RNA, 64 nt, hsa
aaccguuauagacccaauaacaacuaaaccuuucaaaagaaaauauuuucuauuaugaauguug

SEQ ID NO: 43051 - RNA, 64 nt, hsa
cuuaacacugacuggucaucaguaucauuagugaaaaagaaacaaauuguuuguuaucaucucu

SEQ ID NO: 43052 - RNA, 64 nt, hsa
aaagcaaaacaagaagauacaucacuuuucauugaaaagaaaaguguagagcaugacugaauug

SEQ ID NO: 43053 - RNA, 64 nt, hsa
aguaauggugaaaauuguugucuuuggaaagcacaaaagaaaccuggaaaggcaguucggcuca

SEQ ID NO: 43054 - RNA, 64 nt, hsa
gaguccaaguuaucuugauuuaaaauugauagagaaaagaaacugucgagcaaguuauauaaca

SEQ ID NO: 43055 - RNA, 64 nt, hsa
ggggccucauuaaacuaaagagcuucugcacagaaaaagaaacuagcaacacaguaaacagaca

SEQ ID NO: 43056 - RNA, 64 nt, hsa
cacaaagucagagaugguggugaggcugcagagcaaaagaaacagacacuguuggugggaaagc

SEQ ID NO: 43057 - RNA, 64 nt, hsa
aauaagcaaauuauuggcuucuuucuucuagacuaaaagaaauuaaagagaugaaacaaucaau

SEQ ID NO: 43058 - RNA, 64 nt, hsa
gaagaaagagagaaagaaagaaacagaaaaaccuaaaagaaagcgaaugaauuugacaccuguu

SEQ ID NO: 43059 - RNA, 64 nt, hsa
aaguuccugauuuuuguuuuuauuuuuguguuacaaaagaaagcccucccucccugaacuugca

SEQ ID NO: 43060 - RNA, 64 nt, hsa
cauuuccuucaauuuccuuugaccuauaggcuaaaaaagaaaggcucauuccagccacagggca

SEQ ID NO: 43061 - RNA, 64 nt, hsa
uuucuguucuuguuuauccagcguaggaagaaggaaaagaaaaucuuugcuccucugccccauu

SEQ ID NO: 43062 - RNA, 64 nt, hsa
uuauauauuuuuucauuagggccauaucuccaaaaaaagaaagaaaaaauacaaaaaacaaaaa

SEQ ID NO: 43063 - RNA, 64 nt, hsa
uuguauuucaagauaauguaguuuaaaaaaaaaaaaaagaaaaaaacuugauguaaauuccucc

SEQ ID NO: 43064 - RNA, 64 nt, hsa
guuuauaucauuuuaacaaguuuuuuggaaauguaaaagaaaaaaguaaagcuccauuuuugug

SEQ ID NO: 43065 - RNA, 64 nt, hsa
cuugauguugauacacauuugaauuuuuuuuaaaaaaagaaaguuaucguagccagccuguaaa

SEQ ID NO: 43066 - RNA, 64 nt, hsa
agaccuugucucaaaaaaaaaaaaaaaaaaagaaaaaagaaaguacugucugucuuaaauuuug

SEQ ID NO: 43067 - RNA, 64 nt, hsa
cagagccagaccuugucucaaaaaaaaaaaaaaaaaaagaaaaaagaaaguacugucugucuua

SEQ ID NO: 43068 - RNA, 64 nt, hsa
uuuaaaaauuaaucaguuacaguaaagacuuugaaaaagaaauguacuuguuaggaaguagcuu

SEQ ID NO: 43069 - RNA, 64 nt, hsa
aaaaugaugcuguuuucucugcuaaagguaaaagaaaagaaaaaaauaguuggaaaauaagaca

SEQ ID NO: 43070 - RNA, 64 nt, hsa
ccucuaaaaugaugcuguuuucucugcuaaagguaaaagaaaagaaaaaaauaguuggaaaaua

SEQ ID NO: 43071 - RNA, 64 nt, hsa
uuuuguggugauucgugccauugcuuuuuuauuuaaaagaaaauuuuguaauuaaaugccuuuu

SEQ ID NO: 43072 - RNA, 64 nt, hsa
cugucauaauucuugcugagucaagaguguaaauaaaagaaauggcaggacucauauuauucag

SEQ ID NO: 43073 - RNA, 64 nt, hsa
ucaguuguccauguacacauagucauuauauuagaaaagaaaucuguucaacaaacuuguuuaa

SEQ ID NO: 43074 - RNA, 64 nt, hsa
cugcauucuuuaaaagacaagagaauuugguuauaaaagaaaugggcugacuaggcaugauuuu

SEQ ID NO: 43075 - RNA, 64 nt, hsa
ggauagcuuuucuaauaauuuucaucaauaggaaaaaagaaauacgucucauucuucaauacuu

SEQ ID NO: 43076 - RNA, 64 nt, hsa
caagagugagaaagaauaaauuguuauuaagagcaaaagaaaaauaaagugauugaugauaguu

SEQ ID NO: 43077 - RNA, 64 nt, hsa
uuaguaggggcuuauugucucucaaaacuaaccuaaaagaaaaugacacauuuuauaauagaau

SEQ ID NO: 43078 - RNA, 64 nt, hsa
ucucacuauaguauaagaaucuauuuuggagaaaaaaagaaaauaugagggucucgaagcauga

SEQ ID NO: 43079 - RNA, 64 nt, hsa
aagaaucaaaacaaaagcaaaaaaaaaaagcaaaaaaagaaaagagaaaaaaagaaaaaaugca

SEQ ID NO: 43080 - RNA, 64 nt, hsa
agcaaaaaaaaaaagcaaaaaaagaaaagagaaaaaaagaaaaaaugcaaauggaauaauuuuc

SEQ ID NO: 43081 - RNA, 64 nt, hsa
cuccagccugggugauagagcaagacugucucaaaaaagaaaaaaaagaaaaaauuuuaauuua

SEQ ID NO: 43082 - RNA, 64 nt, hsa
gggugauagagcaagacugucucaaaaaagaaaaaaaagaaaaaauuuuaauuuaauccuucug

SEQ ID NO: 43083 - RNA, 64 nt, hsa
aaaauuauuucagagaugugugcuccuggagggaaaaagaaauacagccucaacagauuaaaaa

SEQ ID NO: 43084 - RNA, 64 nt, hsa
gggugacuagcaaaacuccaucucaaaaaaaaaaaaaagaaagaaagaaacugaaaagugaggu

SEQ ID NO: 43085 - RNA, 64 nt, hsa
uaaauaaauaaauaaacaaaccagucuuuauuuuaaaagaaacuuuaggaaacaaacccacaua

SEQ ID NO: 43086 - RNA, 64 nt, hsa
uaguuucuaguuauaucauuacuuaaagggcuuaaaaagaaaaaacuuagcaaacuuuugaauc

SEQ ID NO: 43087 - RNA, 64 nt, hsa
uguaaaaugcaauuugaaaaaaauaaaacgcaaaaaaagaaacuguaaaggaaaccaagagauu

SEQ ID NO: 43088 - RNA, 64 nt, hsa
cuacacuucuuuuuucccccucauguguaaaaugaaaagaaaacuaaauuugcccuaauaccaa

SEQ ID NO: 43089 - RNA, 64 nt, hsa
ccuggcaacagagcaagagucugucucaaaaaaaaaaagaaaaaaagaaaaaaagaaaaaagaa

SEQ ID NO: 43090 - RNA, 64 nt, hsa
cagagcaagagucugucucaaaaaaaaaaagaaaaaaagaaaaaaagaaaaaagaaaaaucuca

SEQ ID NO: 43091 - RNA, 64 nt, hsa
gagucugucucaaaaaaaaaaagaaaaaaagaaaaaaagaaaaaagaaaaaucucauuauuuca

SEQ ID NO: 43092 - RNA, 64 nt, hsa
ucucaaaaaaaaaaagaaaaaaagaaaaaaagaaaaaagaaaaaucucauuauuucaaaaugau

SEQ ID NO: 43093 - RNA, 64 nt, hsa
ccugggccacagugcaagacuccaucucaaaaaaaaaagaaaagaaaaagccuguuuaaugcac

SEQ ID NO: 43094 - RNA, 64 nt, hsa
gccacagugcaagacuccaucucaaaaaaaaaagaaaagaaaaagccuguuuaaugcacaggug

SEQ ID NO: 43095 - RNA, 64 nt, hsa
ugaaagagcgagacuccgucucaaaaacaaaaaaaaaagaaaagaaauauauuuuauucauuca

SEQ ID NO: 43096 - RNA, 64 nt, hsa
gagcgagacuccgucucaaaaacaaaaaaaaaagaaaagaaauauauuuuauucauucacauua

SEQ ID NO: 43097 - RNA, 64 nt, hsa
uaucaugaucauccaaucucaaaugugaaaaaaaaaaagaaauuugauuuuagggauugugagu

SEQ ID NO: 43098 - RNA, 64 nt, hsa
uuugaggcuuuucuauauacuucucagagcacugaaaagaaaggaaggguuugcagaggagagu

SEQ ID NO: 43099 - RNA, 64 nt, hsa
gugaagaucugguuccagaaccgccgaaugaagcaaaagaaacgugagaaggagggucucuugc

SEQ ID NO: 43100 - RNA, 63 nt, hsa
ucuccagcgcagacuuuugacuggaugaaagucaaaagaaacccucccaaaacaggucagucc

SEQ ID NO: 43101 - RNA, 64 nt, hsa
acaugcauaaaagggucaaaccuguagaugcagaaaaagaaaaaaacuauaaauacaaaucugu

SEQ ID NO: 43102 - RNA, 64 nt, hsa
auuuuuccuuccucuguaagauaucccagcuuuaaaaagaaaaaaaaagaauuaccaagagaag

SEQ ID NO: 43103 - RNA, 64 nt, hsa
accuccagccuggacacucugucucgaaaaaaagaaaagaaacacgguuaauaacauauaaaua

SEQ ID NO: 43104 - RNA, 64 nt, hsa
agaucaccuccagccuggacacucugucucgaaaaaaagaaaagaaacacgguuaauaacauau

SEQ ID NO: 43105 - RNA, 64 nt, hsa
gagcaaaacuccgucucaaaaaagaaaagaaaagaaaagaaaucauagggccaaguucaaagga

SEQ ID NO: 43106 - RNA, 64 nt, hsa
aacaagagcaaaacuccgucucaaaaaagaaaagaaaagaaaagaaaucauagggccaaguuca

SEQ ID NO: 43107 - RNA, 64 nt, hsa
ugggcaacaagagcaaaacuccgucucaaaaaagaaaagaaaagaaaagaaaucauagggccaa

SEQ ID NO: 43108 - RNA, 64 nt, hsa
cagccugggcaacaagagcaaaacuccgucucaaaaaagaaaagaaaagaaaagaaaucauagg

SEQ ID NO: 43109 - RNA, 64 nt, hsa
caguuauauauuuuguuuuuaaaagggggggagcaaaagaaacaccaguguuagcuuaaucuua

SEQ ID NO: 43110 - RNA, 64 nt, hsa
uuaacuuauugcuagauaauaggguuuucagaugaaaagaaaacuuaaagaggaauggcccuca

SEQ ID NO: 43111 - RNA, 64 nt, hsa
agaaauucuucaugaacauaacucugcugaauguaaaagaaaauuuuuuuucaaaaaugcuguu

SEQ ID NO: 43112 - RNA, 64 nt, hsa
guauuagacuucuaaauaaggugugaaaucaucaaaaagaaaaaucaaaguagaaacuacuaau

SEQ ID NO: 43113 - RNA, 64 nt, hsa
aaaagucauaaaugcauaugacagaauggcuaucaaaagaaauagaaaaggaagacagcauuua

SEQ ID NO: 43114 - RNA, 64 nt, hsa
gcaaucaauuuugaauuuauaauucugcuauuuuaaaagaaauguagucuuguaguaugaaaua

SEQ ID NO: 43115 - RNA, 64 nt, hsa
ugacuauuuuaucaaauuugccuuaaaauaaugaaaaagaaaaguauaguuaaugguuucaaau

SEQ ID NO: 43116 - RNA, 64 nt, hsa
aaaccugguuuucuuuuuugguuucuucaaccaaaaaagaaagaaauugcaaaggaccaaaaaa

SEQ ID NO: 43117 - RNA, 64 nt, hsa
auuugaucaggucucuggaucuuauuugcaauucaaaagaaauuuuaaaaaaauccuacuaaca

SEQ ID NO: 43118 - RNA, 64 nt, hsa
cuccagccugggcgacaaaaugagacccugucucaaaagaaagcccucuccuuagcugagcaga

SEQ ID NO: 43119 - RNA, 64 nt, hsa
ugaccucccgucucucucggaaaaaaaaaaagaaaaaagaaaaagccgggugagguggugugua

SEQ ID NO: 43120 - RNA, 64 nt, hsa
aacauggugaccucccgucucucucggaaaaaaaaaaagaaaaaagaaaaagccgggugaggug

SEQ ID NO: 43121 - RNA, 64 nt, hsa
guuucaauacaagccauaggcucacagaaaaagaaaaagaaaauaaaaauuaaauuaaaaaaaa

SEQ ID NO: 43122 - RNA, 64 nt, hsa
ccuaaaguuucaauacaagccauaggcucacagaaaaagaaaaagaaaauaaaaauuaaauuaa

SEQ ID NO: 43123 - RNA, 64 nt, hsa
uauagcuaaguacacaauaagcaaaaacaaaaagaaaagaaaauuuuuguaguagcguuuuuua

SEQ ID NO: 43124 - RNA, 64 nt, hsa
uuaucuauagcuaaguacacaauaagcaaaaacaaaaagaaaagaaaauuuuuguaguagcguu

SEQ ID NO: 43125 - RNA, 64 nt, hsa
cugucuuuauuuuuguauauuguauuuauauauaaaaagaaacgucuacguaugcaugcuaaau

SEQ ID NO: 43126 - RNA, 64 nt, hsa
gccucuggagccgccauucugcagaguauuuggaaaaagaaaaaaggguuuaugcuuacgucuc

SEQ ID NO: 43127 - RNA, 64 nt, hsa
uugucucagaucccagauucuaugaucccugcuuaaaagaaaauguucacugcauguagguuga

SEQ ID NO: 43128 - RNA, 64 nt, hsa
aaaaauauaauuaccuguaagguuaucugguuuuaaaagaaaaaaaaaaagccuacaaacucag

SEQ ID NO: 43129 - RNA, 64 nt, hsa
uugcccaguuuuuaauuacacugagauaauuuugaaaagaaauagaaauuaagcuacuauauaa

SEQ ID NO: 43130 - RNA, 64 nt, hsa
aaaaugugaauaaauaaauguucugauaaaauagaaaagaaaguaaauuacagugauuuccauc

SEQ ID NO: 43131 - RNA, 64 nt, hsa
gcaaguuucccuaaguuugaguugauaguuauuaaaaagaaaacaaaacaaaaaaaaaaggcaa

SEQ ID NO: 43132 - RNA, 64 nt, hsa
aaacuggguauauuuaugauuucuuucagcguuaaaaagaaacauaguguugcccuuuuucuua

SEQ ID NO: 43133 - RNA, 61 nt, hsa
uucauguacuacaaaaauagcuaucugaggcaaaagaaacacaauuacaguuagcuccuca

SEQ ID NO: 43134 - RNA, 64 nt, hsa
cuagacacaauaaaacaucagaaccagcuaagggaaaagaaauaucuggaguacauuaaaagug

SEQ ID NO: 43135 - RNA, 64 nt, hsa
gggcaacaagagugaaacuccaucuccaaaaaaaaaaagaaaaaguaacaaaaggaaauuauuu

SEQ ID NO: 43136 - RNA, 64 nt, hsa
aguucaacuuuguggauuauuuuuccucugaaggaaaagaaaaggcuuaaugguuaggauuuuu

SEQ ID NO: 43137 - RNA, 64 nt, hsa
uggaaugcauuuguuuccaugagugaaaagaggaaaaagaaaauggcugugcugcauugcagga

SEQ ID NO: 43138 - RNA, 64 nt, hsa
guuuaaauaucucuggcucaaguguucacccaguaaaagaaagauccagaaagcacuguuuuua

SEQ ID NO: 43139 - RNA, 64 nt, hsa
aauuuaugagaauuuuggacaauuggaaagguagaaaagaaaagccaagaucauacuaaggacu

SEQ ID NO: 43140 - RNA, 64 nt, hsa
auaaaaccuacugcaacuuagaaaaaggaaagaaaaaagaaaacuuuuccaacugcugcauuaa

SEQ ID NO: 43141 - RNA, 64 nt, hsa
agaugacacaucauuuugacauuaucaauaggagaaaagaaaacuaacccuucuucugauuguu

SEQ ID NO: 43142 - RNA, 64 nt, hsa
auaguagaaaaggaaacuaguagggccaaaaaaaaaaagaaaaagaaaaagaaaaaagaaaaaa

SEQ ID NO: 43143 - RNA, 64 nt, hsa
gaaaaggaaacuaguagggccaaaaaaaaaaagaaaaagaaaaagaaaaaagaaaaaaaaagaa

SEQ ID NO: 43144 - RNA, 64 nt, hsa
gaaacuaguagggccaaaaaaaaaaagaaaaagaaaaagaaaaaagaaaaaaaaagaaaaaacu

SEQ ID NO: 43145 - RNA, 64 nt, hsa
guagggccaaaaaaaaaaagaaaaagaaaaagaaaaaagaaaaaaaaagaaaaaacugggaccu

SEQ ID NO: 43146 - RNA, 64 nt, hsa
aaaaaaaaagaaaaagaaaaagaaaaaagaaaaaaaaagaaaaaacugggaccuaaguauaaau

SEQ ID NO: 43147 - RNA, 64 nt, hsa
auuaucaaaaaccuagagaccaaucauauaucugaaaagaaauacccauuaaaaauucugccuc

SEQ ID NO: 43148 - RNA, 64 nt, hsa
gcuacuuaaaacuuugguuguuuuccuguaauauaaaagaaaaaguuaauuuaucaauugauug

SEQ ID NO: 43149 - RNA, 64 nt, hsa
uuaauugaacccauccacucugggcagguaagagaaaagaaaaagauaaggaaagaagagagaa

SEQ ID NO: 43150 - RNA, 64 nt, hsa
gaucacuacagaccaaaacagaagaagaagaaaaaaaagaaaaagaaaucuaagcaacauggua

SEQ ID NO: 43151 - RNA, 64 nt, hsa
uacagaccaaaacagaagaagaagaaaaaaaagaaaaagaaaucuaagcaacaugguaaguaca

SEQ ID NO: 43152 - RNA, 64 nt, hsa
aaaaaaauagcucaagacacaguuaaucgagaagaaaagaaauauguacagaaccauaaagaac

SEQ ID NO: 43153 - RNA, 64 nt, hsa
cauaggguggagaaggaggaguuaucuccacuccaaaagaaaaaaaaaaaguuuuuuaccuuac

SEQ ID NO: 43154 - RNA, 64 nt, hsa
caaagauauucucuauguuuuguaaguaaaaacaaaaagaaaaccuuucuuuuguuuuuuacac

SEQ ID NO: 43155 - RNA, 64 nt, hsa
guauuuucgaagaggagcaacugaacacuggaggaaaagaaaaugacacuuucugcuuuacaga

SEQ ID NO: 43156 - RNA, 64 nt, hsa
aguacauuaaguaaaauaaaauggaccagaaaagaaaagaaaccauaaauaucgugucauauuu

SEQ ID NO: 43157 - RNA, 64 nt, hsa
uagugaguacauuaaguaaaauaaaauggaccagaaaagaaaagaaaccauaaauaucguguca

SEQ ID NO: 43158 - RNA, 64 nt, hsa
guaggaucguaaaaaaauagaaaaaaagaaaaaaaaaagaaagaaagagggaaaaagagcuggu

SEQ ID NO: 43159 - RNA, 64 nt, hsa
ggaccaucucuguaggaucguaaaaaaauagaaaaaaagaaaaaaaaaagaaagaaagagggaa

SEQ ID NO: 43160 - RNA, 64 nt, hsa
gaauuagguuugaauugcuuuuuaaaaaaaaaagaaaagaaaaagacagcaucucacuauguug

SEQ ID NO: 43161 - RNA, 64 nt, hsa
gggaagaauuagguuugaauugcuuuuuaaaaaaaaaagaaaagaaaaagacagcaucucacua

SEQ ID NO: 43162 - RNA, 64 nt, hsa
ugucguuguuguaguuaaaggaauuucauuuuuuaaaagaaaucuucgaaggugugguuuucau

SEQ ID NO: 43163 - RNA, 64 nt, hsa
cagccugggcaacgggcgagacucugucucaaaaaaaagaaagaaagaaaagguacauguauau

SEQ ID NO: 43164 - RNA, 64 nt, hsa
caauuuuuuuaagacucugucuuaaaaaaaacuaaaaagaaaaaaagaagccccuucacucuac

SEQ ID NO: 43165 - RNA, 64 nt, hsa
uucaauaccaaauacaguaaaaacaaauguaaauaaaagaaaacacaucaucaauaaaacuguu

SEQ ID NO: 43166 - RNA, 64 nt, hsa
ucugccugagggcuugcauagcuuucacauuaaaaaaagaaaaagcuagcagauuuacuccuuu

SEQ ID NO: 43167 - RNA, 64 nt, hsa
gcaucuaaaaaugaaaggugaguaaccagauagcaaaagaaaagggaaagccauccaaauuuga

SEQ ID NO: 43168 - RNA, 64 nt, hsa
aaaaacaaauuggcuuugucucauugaucagacaaaaagaaacuaguauuaagggaagcgcaaa

SEQ ID NO: 43169 - RNA, 64 nt, hsa
uuuuguaguauaauauuaaugauuauucucuuguaaaagaaaaggaaaaauuaguaaagaaaaa

SEQ ID NO: 43170 - RNA, 64 nt, hsa
ucuugcagaaaaguugauugcaaagugugguagaaaaagaaauaaugguagcaguagagaauuu

SEQ ID NO: 43171 - RNA, 64 nt, hsa
gaaacuaaauggucuuuauaaaaguaauuacuuaaaaagaaaucaggggaagaaagauaucuau

SEQ ID NO: 43172 - RNA, 64 nt, hsa
uggccggacgaaacacacguguugcaucucaaggaaaagaaacaacaaaaugcuagugaaaaug

SEQ ID NO: 43173 - RNA, 64 nt, hsa
aaauaugcaaguuuuuaccuauaugucuuauaauaaaagaaauaaaauauuugaaaaaaggcau

SEQ ID NO: 43174 - RNA, 64 nt, hsa
agaaucgugacuauuauugcuccaucaaacugugaaaagaaaugauguggaccuugcuggaaac

SEQ ID NO: 43175 - RNA, 64 nt, hsa
auuuuauuccugggggggaucaugcuacacucucaaaagaaaauuaagaaaucauucagaucau

SEQ ID NO: 43176 - RNA, 64 nt, hsa
uuuguaacuuuacaguuaaacuaguuuuaguuuaaaaagaaaaaaugcagggugauuucuuauu

SEQ ID NO: 43177 - RNA, 64 nt, hsa
aacucauauuacaaaaacaaaauaaaauaauaaaaaaagaaagcaugauauuuacuguuuuguu

SEQ ID NO: 43178 - RNA, 64 nt, hsa
ggcaaaacuauuauauguaagggaaauauauacaaaaagaaaauuaaucauagucaccugacua

SEQ ID NO: 43179 - RNA, 64 nt, hsa
augcuuaccagauucacacuguuccagugucuauaaaagaaacacuuugaagucuauaaaaaau

SEQ ID NO: 43180 - RNA, 64 nt, hsa
cuccauuacucugauuuuugauacaguuuucagaaaaagaaaugaacauaaucaaguaaggaug

SEQ ID NO: 43181 - RNA, 64 nt, hsa
uuauuaaacugcaggaaauuaauucugaagaaggaaaagaaacugacaugguaauuuggauagg

SEQ ID NO: 43182 - RNA, 64 nt, hsa
ggcauacacacucaaaaagcaggauccaauacccaaaagaaauggaacuuaauguugugccaaa

SEQ ID NO: 43183 - RNA, 64 nt, hsa
gccuuucuucuuaaagugaggaggacaaauuugcaaaagaaauaggcuuuucuucuuuuuuaaa

SEQ ID NO: 43184 - RNA, 63 nt, hsa
uuuuaaauauucuaguagccacauuaauaaaguaaaaagaaacaggugagguuaauuugaaug

SEQ ID NO: 43185 - RNA, 64 nt, hsa
aucucuguucaucccuuccuauaaccucuagguaaaaagaaaagaaaaaaagaaauuucgagau

SEQ ID NO: 43186 - RNA, 64 nt, hsa
uguucaucccuuccuauaaccucuagguaaaaagaaaagaaaaaaagaaauuucgagauauuuu

SEQ ID NO: 43187 - RNA, 64 nt, hsa
ccuuccuauaaccucuagguaaaaagaaaagaaaaaaagaaauuucgagauauuuucaacauug

SEQ ID NO: 43188 - RNA, 64 nt, hsa
ccuacuuucaaguaaauauagcauuccuuuggcaaaaagaaaaaaaaaguaaaagaaaagaaaa

SEQ ID NO: 43189 - RNA, 64 nt, hsa
uauagcauuccuuuggcaaaaagaaaaaaaaaguaaaagaaaagaaaaaaaauguauuaccacc

SEQ ID NO: 43190 - RNA, 64 nt, hsa
cauuccuuuggcaaaaagaaaaaaaaaguaaaagaaaagaaaaaaaauguauuaccacccgaug

SEQ ID NO: 43191 - RNA, 64 nt, hsa
cucagguauuuguaguuuacccuaacgcuucuuuaaaagaaaguagguaaaaaaagaaaagggu

SEQ ID NO: 43192 - RNA, 64 nt, hsa
uacccuaacgcuucuuuaaaagaaaguagguaaaaaaagaaaaggguagauaaucuuucguaug

SEQ ID NO: 43193 - RNA, 64 nt, hsa
uaccauuaaagucauuaguauaauauugcuuucaaaaagaaaugguagacaaaacuauaaucca

SEQ ID NO: 43194 - RNA, 64 nt, hsa
gaaaauauacaaucaagauaucucauggcauauuaaaagaaaaaucuuaauagcaguguuggcu

SEQ ID NO: 43195 - RNA, 64 nt, hsa
uaucugcuucuuaaagaaucagccgagacaccauaaaagaaauaggcuuuuugugccuuuugcu

SEQ ID NO: 43196 - RNA, 64 nt, hsa
ccugggugacaagagugaaacuccaucucaaaaaaaaagaaaagaagguccagcuuuuggauuc

SEQ ID NO: 43197 - RNA, 64 nt, hsa
gcccgggugacaaagcaagacccugucucagaaaaaaagaaaauucaaggccaguuaagacaaa

SEQ ID NO: 43198 - RNA, 64 nt, hsa
uguauggaaucaacaccaccgagcucugugggaaaaaagaaaaaccugcucccuucgcucugcu

SEQ ID NO: 43199 - RNA, 64 nt, hsa
ccaacauguaucugucuacuuucucuuguuuaaaaaaagaaaaaaaaacuuaaaaaaauggggu

SEQ ID NO: 43200 - RNA, 64 nt, hsa
gcaacaguaaaaauuaauauaauauuuuccccacaaaagaaacacuuaacagaggcaagugcaa

SEQ ID NO: 43201 - RNA, 64 nt, hsa
ucuuaaaaaaagaaaaaaugaaaaaaaaaggaaaaaaagaaaaaaggaaaaaaacaguuugaac

SEQ ID NO: 43202 - RNA, 64 nt, hsa
uuuuccaguguguaacccaguuugaaaucuuaaaaaaagaaaaaaugaaaaaaaaaggaaaaaa

SEQ ID NO: 43203 - RNA, 64 nt, hsa
ccuuuccuucaagcagaaacaagcaacugagggaaaaagaaacacaacaauaguuuaagaaauu

SEQ ID NO: 43204 - RNA, 64 nt, hsa
uacggggaggaaagaccaaaaguauuugcaguacaaaagaaacuauaucaaacacuauguuaaa

SEQ ID NO: 43205 - RNA, 64 nt, hsa
cacucauuuccaaggcccuaacccuuauccuuuaaaaagaaauccucugaacugggucggucug

SEQ ID NO: 43206 - RNA, 64 nt, hsa
aacacaaaacugccaacuuugcacaaguuuccagaaaagaaaauacaauuagucacucaacaua

SEQ ID NO: 43207 - RNA, 64 nt, hsa
uucauuuauguuagcauuaaugcacauuuuuaaaaaaagaaaaaaacauggucuuguuuuuacu

SEQ ID NO: 43208 - RNA, 64 nt, hsa
uguugccugcaaaaauaaaagggaaaaaaaagaaaaaagaaacaaaaaggaacuucuuauaguu

SEQ ID NO: 43209 - RNA, 64 nt, hsa
ccaugacuguugccugcaaaaauaaaagggaaaaaaaagaaaaaagaaacaaaaaggaacuucu

SEQ ID NO: 43210 - RNA, 64 nt, hsa
uccuguggcaugcaaaagaaagcaaauuauuuuuaaaagaaaaaaaccaaaguacuuuuggugu

SEQ ID NO: 43211 - RNA, 64 nt, hsa
uguuuugaaacuagaaaucuguccuguggcaugcaaaagaaagcaaauuauuuuuaaaagaaaa

SEQ ID NO: 43212 - RNA, 64 nt, hsa
acaacacugauaauaggaaguaaaaacagaaaggaaaagaaauuaccacugggaaaaucuuuuu

SEQ ID NO: 43213 - RNA, 64 nt, hsa
uggagugaggauuacuuguaauuaaaauauuuauaaaagaaacaacuuuauucacagaguccag

SEQ ID NO: 43214 - RNA, 64 nt, hsa
aacugaauuuuugaaagacuauugcagguguuuaaaaagaaagaaaaguuguuuuaucuaauac

SEQ ID NO: 43215 - RNA, 64 nt, hsa
cugaaggagaaggaggguaguguuuugcaaaagaaaaagaaaagaaccaacagaauuuuaacuc

SEQ ID NO: 43216 - RNA, 64 nt, hsa
cagaugcugaaggagaaggaggguaguguuuugcaaaagaaaaagaaaagaaccaacagaauuu

SEQ ID NO: 43217 - RNA, 64 nt, hsa
cacacugagauauaauaaaagguguuuaucauaaaaaagaaacaguauuagauuuuggucucca

SEQ ID NO: 43218 - RNA, 64 nt, hsa
uuuuuauggauuguagacccaguuuugaaaccaaaaaagaaaccuagaaucuaaugcagaagag

SEQ ID NO: 43219 - RNA, 64 nt, hsa
uuuuaguaaggcauuugggguuggggaagcuagaaaaagaaaugggagcuggucacacagggcc

SEQ ID NO: 43220 - RNA, 64 nt, hsa
aacauuuggcaggaauuguccuuaugaaacaagaaaaagaaaaugaaaaguauuauuaagcuuc

SEQ ID NO: 43221 - RNA, 64 nt, hsa
gauuucuaaguuaaaucauuuucauuaaaaggaaaaaagaaaaaaaauuuuguaugucaauaac

SEQ ID NO: 43222 - RNA, 64 nt, hsa
uaaauuuacagaauauuauauaacccacugcugaaaaagaaaaaaaugauuguuuuagaaguua

SEQ ID NO: 43223 - RNA, 64 nt, hsa
uuucacuaauacuuacuguuaacugucuugagagaaaagaaaaauaugagagaacuauuguuug

SEQ ID NO: 43224 - RNA, 64 nt, hsa
ucauuuguauucagaugugaguagaagaacuaaaaaaagaaaguuacauaucacuaugacugaa

SEQ ID NO: 43225 - RNA, 64 nt, hsa
cuauguaguugagacaggauuugauaagucuaggaaaagaaagaugggaaaacgggauuccuuu

SEQ ID NO: 43226 - RNA, 64 nt, hsa
uuuugcuaagacuugaaacaaaaaauguaaauacaaaagaaaucaaguuuuguuuugaaagaug

SEQ ID NO: 43227 - RNA, 64 nt, hsa
cauuacaggcugcauucuugccuuacuguauagaaaaagaaaaaaggcuggguuuacuauugca

SEQ ID NO: 43228 - RNA, 64 nt, hsa
gucuucuguacaucuuacuggguuuaauuaaaaaaaaagaaaaaacucuguuguaaaaacaguu

SEQ ID NO: 43229 - RNA, 64 nt, hsa
gaaaugcaagagggaaggugauugguagugaguuaaaagaaaaagagaggaaaagagaguaguu

SEQ ID NO: 43230 - RNA, 64 nt, hsa
ccuugguuugcaauaccugcaaauaaugaguuugaaaagaaacaaugaaauguguuaaaaauuu

SEQ ID NO: 43231 - RNA, 64 nt, hsa
uuuccuuucacuggccacaguuguuugaugcauuaaaagaaaauaaaaaaaagaaaaaagagaa

SEQ ID NO: 43232 - RNA, 64 nt, hsa
ccacaguuguuugaugcauuaaaagaaaauaaaaaaaagaaaaaagagaaaagaaaaaaaaaga

SEQ ID NO: 43233 - RNA, 64 nt, hsa
ugcauuaaaagaaaauaaaaaaaagaaaaaagagaaaagaaaaaaaaagaaaaaaguuguaggc

SEQ ID NO: 43234 - RNA, 64 nt, hsa
gaaaauaaaaaaaagaaaaaagagaaaagaaaaaaaaagaaaaaaguuguaggcgaaucauuug

SEQ ID NO: 43235 - RNA, 64 nt, hsa
cuugaaggugugaugguagaaauaggaaaacaacaaaagaaaaacaauaacaaaaaaagaaagu

SEQ ID NO: 43236 - RNA, 64 nt, hsa
aauaggaaaacaacaaaagaaaaacaauaacaaaaaaagaaagugugauggcugggugcagugg

SEQ ID NO: 43237 - RNA, 64 nt, hsa
aaauaaauaaauagaaagagagagagaggaaaaaaaaagaaaagaacacuucuuuauuugaggg

SEQ ID NO: 43238 - RNA, 64 nt, hsa
aguaccugaucaggaucugggagaauuugaaaaaaaaagaaaaacuagaaaaauaaacaaaauu

SEQ ID NO: 43239 - RNA, 64 nt, hsa
aaaaaaagaaaaacuagaaaaauaaacaaaauuaaaaagaaaaaaaaauaccugagacugagua

SEQ ID NO: 43240 - RNA, 64 nt, hsa
gccuggaagacagagugagaccccaucucaggaaaaaagaaaaaaaaaaagaugucauucagca

SEQ ID NO: 43241 - RNA, 64 nt, hsa
aguuaaaucuaagaccucaaacuaugaaacagcuaaaagaaaacaucggggaaucucuccagga

SEQ ID NO: 43242 - RNA, 64 nt, hsa
ucaaagaagaagaaaaacaccaaaaccacaagggaaaagaaaaacccaguuucuuaggaaacgc

SEQ ID NO: 43243 - RNA, 64 nt, hsa
ccagauuauuuggauaaguccuuuuuaagaaaaaaaaagaaaaugaaaaacaacacaaaaaaaa

SEQ ID NO: 43244 - RNA, 64 nt, hsa
aaugaucauuucuucuuaaggcucaagauauuagaaaagaaaucagaccuaaauaaucauugau

SEQ ID NO: 43245 - RNA, 64 nt, hsa
ccuuuuuuuagaguuucuaauaaaguaguauguaaaaagaaacugcauuuuaagucagacagua

SEQ ID NO: 43246 - RNA, 64 nt, hsa
cagcuuuuuaauguagguuaccacuuauaagcacaaaagaaacauguauaagaaaccagauuua

SEQ ID NO: 43247 - RNA, 64 nt, hsa
cagagcgagacucugucuccccccgcaaaaaaaaaaaagaaagaaagaaagagaaaagaaaaga

SEQ ID NO: 43248 - RNA, 64 nt, hsa
cccccgcaaaaaaaaaaaagaaagaaagaaagagaaaagaaaagaaaagcaaccacagccagcc

SEQ ID NO: 43249 - RNA, 64 nt, hsa
gcaaaaaaaaaaaagaaagaaagaaagagaaaagaaaagaaaagcaaccacagccagccuuagg

SEQ ID NO: 43250 - RNA, 64 nt, hsa
gagacugaucauuccucuggguuaucugcaucucaaaagaaaaugcuuacccacaggaacuguu

SEQ ID NO: 43251 - RNA, 64 nt, hsa
uuuauuuccuaagaaauaauuuaauguuuaguaaaaaagaaaacagaaaaaagaaagaugcgug

SEQ ID NO: 43252 - RNA, 64 nt, hsa
aauaauuuaauguuuaguaaaaaagaaaacagaaaaaagaaagaugcguguguuggcuuacgca

SEQ ID NO: 43253 - RNA, 64 nt, hsa
acacauuuucuucaucugcacugauuauuucagcaaaagaaaucuaguauguuuucauacaucu

SEQ ID NO: 43254 - RNA, 64 nt, hsa
cgaucuaaaucuauaccuagugcagauuugcaaaaaaagaaaaggaauagucauuaaggauacc

SEQ ID NO: 43255 - RNA, 64 nt, hsa
cagucacucacugccauucucacacuauaacaagaaaagaaaugaagugcauaagucuccuggg

SEQ ID NO: 43256 - RNA, 64 nt, hsa
agagacacugcuuggguuccuuuuucaacuuggaaaaagaaagaaacacucaacaauaaagacu

SEQ ID NO: 43257 - RNA, 64 nt, hsa
agauguacguuguagacaaaguugcagaauuaaaaaaagaaaucugcuuuuaauuuauucuuuu

SEQ ID NO: 43258 - RNA, 64 nt, hsa
gauauaaagccccuauuggauucuucggaugcguaaaagaaauugccuguuucagccagaagac

SEQ ID NO: 43259 - RNA, 64 nt, hsa
agguuaauauaaagaguaucaaagguuccuaaggaaaagaaagcagugcuuuuauuugacuugu

SEQ ID NO: 43260 - RNA, 64 nt, hsa
uuguccccccaggcaucuucacucagcaggauauaaaagaaaaaaauguucaaaugagagagcu

SEQ ID NO: 43261 - RNA, 64 nt, hsa
cauaauggccagaaaauauuguauugcuuggcagaaaagaaaauaaggucuaaaggaaaguagc

SEQ ID NO: 43262 - RNA, 64 nt, hsa
cccagagcuucauucuccuggcuuuuagguuuguaaaagaaaaagggauaucuuuuuuauauuu

SEQ ID NO: 43263 - RNA, 64 nt, hsa
uaauggcaugauuuuuuuuaugcaaaaagaaaagaaaagaaaaccacccacauuuuaauuuagc

SEQ ID NO: 43264 - RNA, 64 nt, hsa
cacauuaauggcaugauuuuuuuuaugcaaaaagaaaagaaaagaaaaccacccacauuuuaau

SEQ ID NO: 43265 - RNA, 64 nt, hsa
uuccacacauuaauggcaugauuuuuuuuaugcaaaaagaaaagaaaagaaaaccacccacauu

SEQ ID NO: 43266 - RNA, 64 nt, hsa
aaagaaaaacacgucucaccacugugguugauucaaaagaaagugauucuauuuuuuaaagaaa

SEQ ID NO: 43267 - RNA, 64 nt, hsa
ccggguaaagcuguaugccaucauggggcaccugaaaagaaaaacacgucucaccacugugguu

SEQ ID NO: 43268 - RNA, 64 nt, hsa
ccacuacaguccagccugggugacagagaaaagaaaaagaaaacauuacauaauuuggcuagag

SEQ ID NO: 43269 - RNA, 64 nt, hsa
auuguuccacuacaguccagccugggugacagagaaaagaaaaagaaaacauuacauaauuugg

SEQ ID NO: 43270 - RNA, 64 nt, hsa
uguacuguuuguauaaaaaauagaaaaaaaaaagaaaagaaaaaaggcauaaaucuuuauugca

SEQ ID NO: 43271 - RNA, 64 nt, hsa
cuguuuguacuguuuguauaaaaaauagaaaaaaaaaagaaaagaaaaaaggcauaaaucuuua

SEQ ID NO: 43272 - RNA, 64 nt, hsa
uugcuguggacagaccuguaaggacuugcaaaacaaaagaaagugagggguuuuuuuaaccuca

SEQ ID NO: 43273 - RNA, 64 nt, hsa
ugggcuuuuuuuuccucucaaaaaaaaaaaaagaaaaagaaaaagaggaagaagcagcuuugcu

SEQ ID NO: 43274 - RNA, 64 nt, hsa
uuccagugggcuuuuuuuuccucucaaaaaaaaaaaaagaaaaagaaaaagaggaagaagcagc

SEQ ID NO: 43275 - RNA, 64 nt, hsa
ugcaaaguaauucaaaccuggccauguacuuuggaaaagaaagcauagagaugaauuguggugu

SEQ ID NO: 43276 - RNA, 64 nt, hsa
gaaguauuuccauaguugcugagaaucaaagcacaaaagaaaucccuaccuauguaaauguuug

SEQ ID NO: 43277 - RNA, 64 nt, hsa
cauaugaugacacacagugucuuucuccuguuugaaaagaaauugugucauauuggugugcugu

SEQ ID NO: 43278 - RNA, 64 nt, hsa
ugcacaaagcaaccgccaaauuguuucagagcagaaaagaaaaagggagaaaaccucuuagcaa

SEQ ID NO: 43279 - RNA, 64 nt, hsa
aaggaagggagaagguggcauaacuuuuuggaacaaaagaaaacacaaaauccuagcuugggau

SEQ ID NO: 43280 - RNA, 64 nt, hsa
uuaucuauucuaaacuaauaaucaauagauggacaaaagaaacaacaaccccaggagaugggac

SEQ ID NO: 43281 - RNA, 64 nt, hsa
ggagaugggaccugaucaugcaaccuggcacuggaaaagaaaucagcgggauuuuggggguggg

SEQ ID NO: 43282 - RNA, 64 nt, hsa
auacugcauggcaggagagcuuuacgcuaaagacaaaagaaacagcuuugggggccgggcgugg

SEQ ID NO: 43283 - RNA, 64 nt, hsa
ucuuauuuaucuuccugcaaacaaggguuaccugaaaagaaaaaaaaagucaacauugucaagc

SEQ ID NO: 43284 - RNA, 64 nt, hsa
auaaauaaaacaaacuuaaucuucaucuuuaaaaaaaagaaaaaagaaaccaaaaugagaauca

SEQ ID NO: 43285 - RNA, 64 nt, hsa
aaacaaacuuaaucuucaucuuuaaaaaaaagaaaaaagaaaccaaaaugagaaucaacacuuc

SEQ ID NO: 43286 - RNA, 64 nt, hsa
gauuuucuguaguaaaacuuuuaaauauuauuuuaaaagaaauauguauauaaauaucucuaua

SEQ ID NO: 43287 - RNA, 64 nt, hsa
ugcauuaauuuuguguguuuagaguucuguugucaaaagaaaacuaaugaauaaauuaguuugu

SEQ ID NO: 43288 - RNA, 63 nt, hsa
aggcagaugaagaggaauagcgacaguuugaguaaaagaaaagucauauugaagaagcccaga

SEQ ID NO: 43289 - RNA, 64 nt, hsa
aauaccaaaacuaaccucaucaaagauacagaaaaaaagaaauauagugagcccuaaaggacac

SEQ ID NO: 43290 - RNA, 64 nt, hsa
aaagacucauuuguguggaugcgugaccaugggaaaaagaaaaaaaaaaagauccauuuuuuag

SEQ ID NO: 43291 - RNA, 64 nt, hsa
uucacauuggaugacaccauguucuuccucuuugaaaagaaaaggggaaugugucccacuagug

SEQ ID NO: 43292 - RNA, 64 nt, hsa
aaugcaugaauauaaaucuauauuauuugcuaaaaaaagaaaaaacauuuguguuuuaguuucu

SEQ ID NO: 43293 - RNA, 64 nt, hsa
cucugauacuuuugaaacagaugugaaaaacagaaaaagaaaaaauugucugaaauguuuauuu

SEQ ID NO: 43294 - RNA, 64 nt, hsa
aaaauugauagcauuuagcauuucuuuuuucucaaaaagaaacuguaggaaauacaugacagag

SEQ ID NO: 43295 - RNA, 64 nt, hsa
uucccaaaaaauucuuaucucuguaugugauuggaaaagaaaagaucacauuuguauauucaac

SEQ ID NO: 43296 - RNA, 64 nt, hsa
acagagcaagacuccaucucaaaaauaaaauaaaaaaagaaagaaagaaaagaagaagaaaaga

SEQ ID NO: 43297 - RNA, 64 nt, hsa
ccaacauggcaaaaccccgucucuacaaaaauacaaaagaaauuagccagacaugauggcgggu

SEQ ID NO: 43298 - RNA, 64 nt, hsa
agcucugaguuuucagcaccaguagauuuguauuaaaagaaaaaaaaauggggccuuagcuucu

SEQ ID NO: 43299 - RNA, 64 nt, hsa
aacaaauagccaucugcuaucagcaucauuauguaaaagaaaauauauuuuagccccuaaaauu

SEQ ID NO: 43300 - RNA, 64 nt, hsa
cugggggacuggacgcugcuauugauucauuaaaaaaagaaaagaaaaauacaccaaggcucca

SEQ ID NO: 43301 - RNA, 64 nt, hsa
ggacuggacgcugcuauugauucauuaaaaaaagaaaagaaaaauacaccaaggcuccauguuc

SEQ ID NO: 43302 - RNA, 64 nt, hsa
ucacaggggaauguacuuuuuuaaaaaaaaaugaaaaagaaaaaaaaagcugcacauuuacagu

SEQ ID NO: 43303 - RNA, 64 nt, hsa
acuuacuaaaaaauguuucauugcgaagcagaggaaaagaaacguuuucagaccuaaaggaaau

SEQ ID NO: 43304 - RNA, 64 nt, hsa
cauaugcuauauacagcuuaacucacagaacuguaaaagaaaauuauaaaauaauucaacaugu

SEQ ID NO: 43305 - RNA, 64 nt, hsa
aauaauucaacauguccaucuuuuuagugauaauaaaagaaagcaugguauuaaacuaucauag

SEQ ID NO: 43306 - RNA, 64 nt, hsa
agcaugguauuaaacuaucauagaaguagacagaaaaagaaaaaaggacucauggcauuauuaa

SEQ ID NO: 43307 - RNA, 64 nt, hsa
aauauggcaagagcccaacucuacuaaaaauacaaaaagaaaagaaaacagccaagcuuggugg

SEQ ID NO: 43308 - RNA, 64 nt, hsa
ggcaagagcccaacucuacuaaaaauacaaaaagaaaagaaaacagccaagcuuggugguaugu

SEQ ID NO: 43309 - RNA, 64 nt, hsa
cuccaaccugagugacagagcaacacucugucuuaaaagaaaaaaaaaaaagagagagauagua

SEQ ID NO: 43310 - RNA, 64 nt, hsa
cauuuuuggucucuguuagaaguagacucuguugaaaagaaagaagcuaagcuaggugugaaga

SEQ ID NO: 43311 - RNA, 64 nt, hsa
ugcaaauuguauaaaauuagguacuucgauuaguaaaagaaaaaaauuugaauguuuuuuuuuu

SEQ ID NO: 43312 - RNA, 64 nt, hsa
auacuuacuuccugcauuuagagggaguuuauuuaaaagaaauaaaugacaaucaaaccaaauc

SEQ ID NO: 43313 - RNA, 64 nt, hsa
auuauuuguaaaucauguggcaucuauguauaauaaaagaaagagacaacuauauuacucaauu

SEQ ID NO: 43314 - RNA, 64 nt, hsa
ucauugccuuuguggaaaggcuucccuaugugguaaaagaaaggcauuccuccguaaccuaggc

SEQ ID NO: 43315 - RNA, 64 nt, hsa
ggaccaaaccaugcacauaaagcuuguaguuuaaaaaagaaaagcaaaaaaauaauuaugccug

SEQ ID NO: 43316 - RNA, 64 nt, hsa
uuuuaccuggaaauuccaugaccaauacaugugcaaaagaaaaugauggguugaauuuacugau

SEQ ID NO: 43317 - RNA, 64 nt, hsa
cuaaauuuuugcuaaggauguauuuugauuauugaaaagaaaauuucuauuuaaacuguaaaua

SEQ ID NO: 43318 - RNA, 64 nt, hsa
guuaagcaauguugaaaucaguuugcaucucuucaaaagaaaccucucagguuagcuuugaacu

SEQ ID NO: 43319 - RNA, 64 nt, hsa
cgaaaucaagucugucaaguacaauaacauuuuuaaaagaaaauggaucccacuguuccucuuu

SEQ ID NO: 43320 - RNA, 64 nt, hsa
uucaaaaaagugucuuuacaaaaaaacaaaaaagaaaagaaauuuauuuauuaaaaauucuauu

SEQ ID NO: 43321 - RNA, 64 nt, hsa
acuguuucaaaaaagugucuuuacaaaaaaacaaaaaagaaaagaaauuuauuuauuaaaaauu

SEQ ID NO: 43322 - RNA, 64 nt, hsa
ccugggugacagagcaagacucccucucaaaagaaaaagaaaaaagauguaaaaaccauucuua

SEQ ID NO: 43323 - RNA, 64 nt, hsa
cuccagccugggugacagagcaagacucccucucaaaagaaaaagaaaaaagauguaaaaacca

SEQ ID NO: 43324 - RNA, 64 nt, hsa
uuggaaaacaccccaaccccggaaaugugugggaaaaagaaaacaaaaacuuuccaaauuccaa

SEQ ID NO: 43325 - RNA, 64 nt, hsa
gccucaggcuucucuuacgaagaggaaacgcaaaaaaagaaaaggaaaaaccccgugcucgccc

SEQ ID NO: 43326 - RNA, 64 nt, hsa
cucaaaaaaaaaaaaaaaaagagagagagagagaaaaagaaaugcuguguuuaaucuucuuaaa

SEQ ID NO: 43327 - RNA, 64 nt, hsa
uaguucuguaucucguaauuguguauagcaugguaaaagaaaaaaaaaaagacagguaaauguu

SEQ ID NO: 43328 - RNA, 64 nt, hsa
caaaggagcuucuuguccccuuggucuuuuaauuaaaagaaauuccaacugacuuuuaaacuuu

SEQ ID NO: 43329 - RNA, 64 nt, hsa
cauguaaaagauguauuacaaucucaaagccaguaaaagaaaucuugcuucacuguucaccugc

SEQ ID NO: 43330 - RNA, 64 nt, hsa
acuuuaaaaggauuaaucugggcagacauuauguaaaagaaagguugcguuuaauauauuuuuu

SEQ ID NO: 43331 - RNA, 64 nt, hsa
uagacugauuuagaaaaacaaaugauuaguuaaaaaaagaaaauauacauuuguugguaacuaa

SEQ ID NO: 43332 - RNA, 64 nt, hsa
gaagacaauuucuguaaugguuuuaagagauuuaaaaagaaauucacugguucuuuacaaaaua

SEQ ID NO: 43333 - RNA, 64 nt, hsa
aaauaccguuaauucaaauugacagagauugauaaaaagaaacugauuuaccuaaguuuacuuu

SEQ ID NO: 43334 - RNA, 64 nt, hsa
ggcgacagugcaagacucugucuccaaaaaaaaaaaaagaaaaaagaaaaucccccuucauccc

SEQ ID NO: 43335 - RNA, 64 nt, hsa
gugcaagacucugucuccaaaaaaaaaaaaagaaaaaagaaaaucccccuucaucccccaggac

SEQ ID NO: 43336 - RNA, 64 nt, hsa
ccaucaaauggcuacaguucauuuaaauuuaaaaaaaagaaaaaagaaacagaaaacgugucuc

SEQ ID NO: 43337 - RNA, 64 nt, hsa
auggcuacaguucauuuaaauuuaaaaaaaagaaaaaagaaacagaaaacgugucucagauggc

SEQ ID NO: 43338 - RNA, 64 nt, hsa
aagcacaugaucaugggaaugauagcccagaacaaaaagaaaucuugucuuaccacaguguuuu

SEQ ID NO: 43339 - RNA, 64 nt, hsa
uuaugaauggaggauauucuacuguacuuuuuuaaaaagaaacuauuuuuguguuugaaaguga

SEQ ID NO: 43340 - RNA, 64 nt, hsa
acaaaauaccccaacacaggcgggggagagacgaaaaagaaaaggaaagagcaagauagacaaa

SEQ ID NO: 43341 - RNA, 64 nt, hsa
gaaagagcaagauagacaaaagccaaucagcuuaaaaagaaaaacaaggaaggggaaaagaaaa

SEQ ID NO: 43342 - RNA, 64 nt, hsa
gccaaucagcuuaaaaagaaaaacaaggaaggggaaaagaaaacucuugcgauuugggaggguu

SEQ ID NO: 43343 - RNA, 54 nt, hsa
aggaagaaaacaaggacuaagcaaaaaagaaagacccccccccccuuagcaacu

SEQ ID NO: 43344 - RNA, 64 nt, hsa
cauacuaccuaaagggaaccugcaauaaucuugaaaaagaaaaagagaaaaauuuuaaaauccu

SEQ ID NO: 43345 - RNA, 64 nt, hsa
aaaaaagagaaaaaaauaaaaaucaaaaaaaaaaaaaagaaagaaagaaaccuccagcguauuu

SEQ ID NO: 43346 - RNA, 64 nt, hsa
auuuauuuuuaagguaaaaauaauccaugaagauaaaagaaacauaugucugcgugcuacuuua

SEQ ID NO: 43347 - RNA, 64 nt, hsa
uauaaaaauauuugcauauauaaguuugacaaagaaaagaaaaucaauguuaaaccauuaaauc

SEQ ID NO: 43348 - RNA, 64 nt, hsa
uggagcaugaucuaaguacauagcacaugugaauaaaagaaaagcugacaguauauucugguuu

SEQ ID NO: 43349 - RNA, 64 nt, hsa
uuuuuaaagcugcucauuucauuuuguccaaccaaaaagaaaagggagauaacuaaugagcuuc

SEQ ID NO: 43350 - RNA, 64 nt, hsa
aagcaaaugugaaaagugaaaccuuaauuuuaucaaaagaaauuucuguaaaugguaugucucc

SEQ ID NO: 43351 - RNA, 64 nt, hsa
agguuuuaaaaagccuugaauggcccuugucuuaaaaagaaauuaggagccaggugcgguggca

SEQ ID NO: 43352 - RNA, 64 nt, hsa
guccagccugggugacauagcaagacccugucuuaaaagaaaaaugggaagaaagacaagguaa

SEQ ID NO: 43353 - RNA, 64 nt, hsa
aaucuggcaucuucuccaggccuaaaucuuaagaaaaagaaaugggugcugggguuugggggau

SEQ ID NO: 43354 - RNA, 64 nt, hsa
auaaacugaaguggcacugugacuuuaaaaauaaaaaagaaaucuacuuggaaguccuuuuugc

SEQ ID NO: 43355 - RNA, 64 nt, hsa
aaaagcaaagauccaccgagagaagaagagaaagaaaagaaaaagaaaaagcacaaaaaaagau

SEQ ID NO: 43356 - RNA, 64 nt, hsa
aaagauccaccgagagaagaagagaaagaaaagaaaaagaaaaagcacaaaaaaagaucucgaa

SEQ ID NO: 43357 - RNA, 64 nt, hsa
agcaguuguuccagggagcuucuaccuggaaaagaaaagaaaugaauagacuaucuagaacuug

SEQ ID NO: 43358 - RNA, 64 nt, hsa
auuccagcaguuguuccagggagcuucuaccuggaaaagaaaagaaaugaauagacuaucuaga

SEQ ID NO: 43359 - RNA, 64 nt, hsa
cauuuuuuuucuuuguaaugcaccugacagaaaaaaaagaaaaaugaauuucucuuuacuucuc

SEQ ID NO: 43360 - RNA, 64 nt, hsa
gaauguguuuuguuguuuugugcuacaauuuuuaaaaagaaaaaaguuuuguuuuguuuuuugg

SEQ ID NO: 43361 - RNA, 64 nt, hsa
gucacucuccccaaaauauuauauuuuuucuauaaaaagaaaaaaauggaaaaaaauuacaagg

SEQ ID NO: 43362 - RNA, 64 nt, hsa
agaguuuugguuuuugaacuagcaaugccugugaaaaagaaacugaauaccuaagauuucuguc

SEQ ID NO: 43363 - RNA, 64 nt, hsa
aaacacaaauaagcagaaaacauacuuauuuuaaaaaagaaaaaaaaggauaaaaaaacccaaa

SEQ ID NO: 43364 - RNA, 64 nt, hsa
uuuaauaauaaaauauugugcaauauauucaaagaaaagaaaacacaaauaagcagaaaacaua

SEQ ID NO: 43365 - RNA, 64 nt, hsa
ucaaauaauuauaagcauuuggcaaaaacaagagaaaagaaacuugccauauuuuacaagcugc

SEQ ID NO: 43366 - RNA, 64 nt, hsa
cacagucaaagaaagagaaaaaagauaaaguagaaaaagaaaaaagugaaaaggaaacaacuag

SEQ ID NO: 43367 - RNA, 64 nt, hsa
auuuuuaggaccaaucucauuuuuaauaagguuaaaaagaaaaaaaaagucuagcgaaaaaacu

SEQ ID NO: 43368 - RNA, 64 nt, hsa
gcagagaugagguccuucuggacuaaaagccaaaaaaagaaagaaaaaaauaauuuuucuuuuc

SEQ ID NO: 43369 - RNA, 64 nt, hsa
agagcgaaccucugucucaaaaaaaaaaaaagaaaaaagaaagaaagaaaaaaggcagaagccc

SEQ ID NO: 43370 - RNA, 64 nt, hsa
gggugacagagcgaaccucugucucaaaaaaaaaaaaagaaaaaagaaagaaagaaaaaaggca

SEQ ID NO: 43371 - RNA, 64 nt, hsa
accuauaagaauuaagggguaaagcacuaaacagaaaagaaaaaaaaaauagcaacucugguga

SEQ ID NO: 43372 - RNA, 64 nt, hsa
agaacaaguagccuauucucuuaaaaaguaugugaaaagaaaauuaugaaaaaauaugcauacc

SEQ ID NO: 43373 - RNA, 64 nt, hsa
cgggcacucuauauucauuaagguuuaugaauuaaaaagaaagcuuuauguaguuaugcauguc

SEQ ID NO: 43374 - RNA, 64 nt, hsa
ugggaaagacaccaaaucaugggcucacuuuaaaaaaagaaagaauaaaaaaaccuucagcugu

SEQ ID NO: 43375 - RNA, 64 nt, hsa
caguaugccacuucuuaaaacagaacaaaacaaaaaaagaaaauugugcucuuuucuaauccaa

SEQ ID NO: 43376 - RNA, 64 nt, hsa
uugaauuguguuuguuuuuuccuuugaugggcuuaaaagaaauuauccaaagggagaaagagca

SEQ ID NO: 43377 - RNA, 64 nt, hsa
ggaggaucccuaugacucaaaauaacuuguuuguaaaagaaaauuuguuuacuuacccauuagu

SEQ ID NO: 43378 - RNA, 64 nt, hsa
gauuuuauuuuuuaaucuaauuuuuuucuaaucaaaaagaaaauugagcuuaaggcaaaaggcc

SEQ ID NO: 43379 - RNA, 64 nt, hsa
aguacuugacuaaaaaaaaaagaaaaaaagaaaaaaaagaaagcauagacauauuuuuuuaaag

SEQ ID NO: 43380 - RNA, 64 nt, hsa
cuuuaagaaaguacuugacuaaaaaaaaaagaaaaaaagaaaaaaaagaaagcauagacauauu

SEQ ID NO: 43381 - RNA, 64 nt, hsa
uauuguuucuuuaagaaaguacuugacuaaaaaaaaaagaaaaaaagaaaaaaaagaaagcaua

SEQ ID NO: 43382 - RNA, 64 nt, hsa
cacacauucacccuaaggauccaauggaauacugaaaagaaaucacuuccuugaaaauuuuauu

SEQ ID NO: 43383 - RNA, 64 nt, hsa
gcuuagcaauguucuaaucacuauggacagauguaaaagaaacuauacaucauuuuugcccucu

SEQ ID NO: 43384 - RNA, 64 nt, hsa
uaugaauacaaagauaagugaaaagagagaaaggaaaagaaaaaggagaaaaacaaagagauuu

SEQ ID NO: 43385 - RNA, 64 nt, hsa
uugcuguugaucuuuuaucaauaauguucuauagaaaagaaaaaaaaaauauauauauauauau

SEQ ID NO: 43386 - RNA, 64 nt, hsa
acaaagcaaccccaaaagaguugauguguguuuuaaaagaaaaaacccaaugaggaacaauugg

SEQ ID NO: 43387 - RNA, 64 nt, hsa
caacaaaagcgaaacucugucucaaaaaagaaaaaaaagaaaaaaaagcacgugaccuuaugag

SEQ ID NO: 43388 - RNA, 64 nt, hsa
cagccugggcaacaaaagcgaaacucugucucaaaaaagaaaaaaaagaaaaaaaagcacguga

SEQ ID NO: 43389 - RNA, 64 nt, hsa
uuccuuguccugguugaagguaacguguuccuagaaaagaaaaugcugcauaggaaaacugaga

SEQ ID NO: 43390 - RNA, 64 nt, hsa
acccauuuagguaucacuaccaugaacuauagggaaaagaaaucaccuacucccugacacugug

SEQ ID NO: 43391 - RNA, 64 nt, hsa
uucauaaaacauuuucuugagagaguucaguuaaaaaagaaaaaaucagcgucauuuguucccu

SEQ ID NO: 43392 - RNA, 64 nt, hsa
aaaagaaacauuuaaugacgguuuaaaacuuuuuaaaagaaaacucaguauuauuuuugcaugu

SEQ ID NO: 43393 - RNA, 64 nt, hsa
caaauucagacgcagaacucuucagauuucuacaaaaagaaacauuuaaugacgguuuaaaacu

SEQ ID NO: 43394 - RNA, 64 nt, hsa
guaccuaugacuuuuuuaaacuaagaucuguuaaaaaagaaaucuguuucaacagaugaccgug

SEQ ID NO: 43395 - RNA, 64 nt, hsa
gguuauaacagcaaaugaaagacucuucacuccaaaaagaaaaguguuuuguuuuuuaauucuc

SEQ ID NO: 43396 - RNA, 64 nt, hsa
uagcgcugguacaguacacuaaaagacuuugauaaaaagaaacaauaauaaaaggccuccauuu

SEQ ID NO: 43397 - RNA, 64 nt, hsa
gcuuuucuucccuagaaacccaauucuaagcagaaaaagaaaaaaaacacaaaaaauaaaaaac

SEQ ID NO: 43398 - RNA, 64 nt, hsa
caugucuuuucaaaaugagaggcuuucauugaagaaaagaaaaaaacaacaguuaaaagcuuuu

SEQ ID NO: 43399 - RNA, 64 nt, hsa
ccuuaggaaaauuuaauauauuuuaaauuauuuuaaaagaaauacaacaucuuauucuuuagcu

SEQ ID NO: 43400 - RNA, 64 nt, hsa
ucaacguuaauaauucuggauuuucuuaucacaaaaaagaaaaugaaggaccucaaagcaccug

SEQ ID NO: 43401 - RNA, 64 nt, hsa
augugucuuucuuuuuggacauuuaccuuuuugaaaaagaaaacacuuaaaaugaucauuagga

SEQ ID NO: 43402 - RNA, 64 nt, hsa
ccgcugcacuccagccugggagacugcaucucaaaaaagaaaaauaaacgaaguaaaagauauu

SEQ ID NO: 43403 - RNA, 64 nt, hsa
gauugugucacugcacucuagccugggcgacagaaaaagaaaauuuagguggggaaaaaaauca

SEQ ID NO: 43404 - RNA, 64 nt, hsa
cuuaauuuggaauagagaaaccaguauauuuuaaaaaagaaaaauauucuuuguagcaacugua

SEQ ID NO: 43405 - RNA, 64 nt, hsa
gacuacauuaguauuagugacaucagguggauauaaaagaaaacccuuggaaagagaacugccu

SEQ ID NO: 43406 - RNA, 64 nt, hsa
aaaccacacauuaguacuuauguugcacaaugagaaaagaaauuaguuucaaauuuaccucagc

SEQ ID NO: 43407 - RNA, 64 nt, hsa
agacccccaucuuuacaaagaaaaaaaaaaggggaaaagaaaaucuuuuaaaucuuuggauuug

SEQ ID NO: 43408 - RNA, 64 nt, hsa
cugggugacacagcgagacuucaucucaaaaaaaaaaagaaaagaaaagcaauuguacuucacu

SEQ ID NO: 43409 - RNA, 64 nt, hsa
ugacacagcgagacuucaucucaaaaaaaaaaagaaaagaaaagcaauuguacuucacuaugcc

SEQ ID NO: 43410 - RNA, 64 nt, hsa
gcacauugcauguaguugagccacauuuuuuaaaaaaagaaaauggaugaccauuaauugacua

SEQ ID NO: 43411 - RNA, 64 nt, hsa
ugacccuuuugaauauaccuaaugauuuccuuaaaaaagaaauuuuaaacagacuuguuuaauc

SEQ ID NO: 43412 - RNA, 64 nt, hsa
ucaugaggucagcaguugagaccagccaaaaggaaaaagaaaauuaugagaguuacuuaaaggu

SEQ ID NO: 43413 - RNA, 64 nt, hsa
cggggaaacgacccuguggcugugagaaagugaaaaaagaaaaaaaaaaaggcauuggcauuuu

SEQ ID NO: 43414 - RNA, 64 nt, hsa
uuguauuaggacagaauuaaugaugcuuaaagagaaaagaaaaaaagagagaagaaaaaggaga

SEQ ID NO: 43415 - RNA, 64 nt, hsa
cagcuauugucuguuguguucagcugagaugcaaaaaagaaauuaagcaaaaaagaaaaagaug

SEQ ID NO: 43416 - RNA, 64 nt, hsa
uguucagcugagaugcaaaaaagaaauuaagcaaaaaagaaaaagaugaagacuuuucaugaau

SEQ ID NO: 43417 - RNA, 64 nt, hsa
ucaaauuuagcaauaaacaauuagcauuaguuaaaaaagaaacauauuccaagggcagguucga

SEQ ID NO: 43418 - RNA, 64 nt, hsa
ucaugugauucuagauuaacauuaaauagauugaaaaagaaacuuugcacgguaugagcuucau

SEQ ID NO: 43419 - RNA, 64 nt, hsa
augcaccaaccguaucauuauuuguuugaggaaaaaaagaaaucugcauuuuaauucauguugg

SEQ ID NO: 43420 - RNA, 64 nt, hsa
uuuaucuuauaucguagaucugauaacccuaucuaaaagaaagucacacgcuaaauguauucuu

SEQ ID NO: 43421 - RNA, 64 nt, hsa
auguagaaugacuauucuaaauauuaauguauuaaaaagaaaauacaacaaaauguauauuuag

SEQ ID NO: 43422 - RNA, 64 nt, hsa
uuuaaagggaaugauuggggggaaaaacuggugaaaaagaaauauaaaaaggacccuaaaaaga

SEQ ID NO: 43423 - RNA, 64 nt, hsa
uguuagcugauugugguaaacaauguuuaaugugaaaagaaauuaaaacuuucuucaucuguug

SEQ ID NO: 43424 - RNA, 64 nt, hsa
uuaauuacugggccaacuugagaggaaaaaauggaaaagaaacuaaaauguugggugaauucua

SEQ ID NO: 43425 - RNA, 64 nt, hsa
ugagacuccaucgcaaaaaaaaaaaaaaaaaaagaaaagaaaauuagccaggugugguggcaag

SEQ ID NO: 43426 - RNA, 64 nt, hsa
gagagugagacuccaucgcaaaaaaaaaaaaaaaaaaagaaaagaaaauuagccagguguggug

SEQ ID NO: 43427 - RNA, 64 nt, hsa
ucaacaaaaaucuucaaagacugguuucuuuuuuaaaagaaaaaacuugaaagaacacuucuaa

SEQ ID NO: 43428 - RNA, 64 nt, hsa
agacacuaauucauuaaauacuaauugauuguuuaaaagaaauauaaaugugacaaguggacau

SEQ ID NO: 43429 - RNA, 64 nt, hsa
augugccagcugaauuuaaaauauaauacuuuuaaaaagaaaauuauuacauccuuuacauuca

SEQ ID NO: 43430 - RNA, 64 nt, hsa
ugucaaacauaccuaacuuucuugcaauaaaugcaaaagaaacuggaacuugacaauuauaaau

SEQ ID NO: 43431 - RNA, 64 nt, hsa
agcaguaaacuauggggaaaaaaaaagaagaagaaaaagaaacucagggaucacugggagaagc

SEQ ID NO: 43432 - RNA, 64 nt, hsa
aaagaggcauuccagccccuauguuauugauggaaaaagaaaaagaagaaaagcaaucucgcag

SEQ ID NO: 43433 - RNA, 64 nt, hsa
ucaaccagugaggcugcccugaacaaaaaaaacaaaaagaaaaaaaaaaaaggaaagaaagaaa

SEQ ID NO: 43434 - RNA, 64 nt, hsa
ucagaauuaacuuagucuguaauguggcuucaaaaaaagaaagccuuuugacagcuacaugacu

SEQ ID NO: 43435 - RNA, 64 nt, hsa
uacauaaagacuugagaagggaauuguuuaagggaaaagaaaagaguaauaauuuuuuuuaaaa

SEQ ID NO: 43436 - RNA, 64 nt, hsa
uuaggcauuaccucagggaaaagccuugacagugaaaagaaacuacuuaaucgcuaauagcuag

SEQ ID NO: 43437 - RNA, 64 nt, hsa
uuaaucuuuaucauuuucuugaaguaaauaaacaaaaagaaacauuuguuugcauaggaauuca

SEQ ID NO: 43438 - RNA, 64 nt, hsa
caaaauucugaagucuggaaguuuuuccuucaagaaaagaaacugcauaaaaaauuuaaaacua

SEQ ID NO: 43439 - RNA, 64 nt, hsa
uuaauuauguaaaaaacaaaacuacaacaacaaaaaaagaaaaaaguuaaaaaagaaaaaaaca

SEQ ID NO: 43440 - RNA, 64 nt, hsa
caaaacuacaacaacaaaaaaagaaaaaaguuaaaaaagaaaaaaacaccaaaaaacaaaaaca

SEQ ID NO: 43441 - RNA, 64 nt, hsa
uuaaagucuuaaaauggaaugagaauguuguuuuaaaagaaaauagcaaaacaacaaaaaagca

SEQ ID NO: 43442 - RNA, 64 nt, hsa
uaaacuuauuuugcuuuaaaaaaaaaaaaaaagaaaaagaaaauuuaacuuaaaauauuuuagc

SEQ ID NO: 43443 - RNA, 64 nt, hsa
cccuuuuaaacuuauuuugcuuuaaaaaaaaaaaaaaagaaaaagaaaauuuaacuuaaaauau

SEQ ID NO: 43444 - RNA, 64 nt, hsa
gccuaguuuuuaguaaucuguacauuuuguuguaaaaagaaaaaccacucccaguccccagccc

SEQ ID NO: 43445 - RNA, 64 nt, hsa
cccccccuaaaauuuguggguuuuuuuuuuuaaaaaaagaaaaugaaaaacaaccaagcgcauc

SEQ ID NO: 43446 - RNA, 64 nt, hsa
cuauuuuucugaucuuauucaacuuuaguugugcaaaagaaauucuaagugaaugcgcguauga

SEQ ID NO: 43447 - RNA, 64 nt, hsa
cgaaggcugcaacggcccugccccaagccccagaaaaagaaacucuuggagggagucugcgggc

SEQ ID NO: 43448 - RNA, 64 nt, hsa
ggaugauuuaaaaacauuugacuuuugaauaauaaaaagaaaagugaagaguaagagaaauugu

SEQ ID NO: 43449 - RNA, 64 nt, hsa
auccaauaaguaaauucauggaaaggaagaaauuaaaagaaagugaggaaaaggaagugcuucu

SEQ ID NO: 43450 - RNA, 64 nt, hsa
accaugccucuguguuucaggugcccuucguuuuaaaagaaagauuauuggauuaaaagaugag

SEQ ID NO: 43451 - RNA, 64 nt, hsa
caggagaaaaaggguuguuugacaaccuuugagaaaaagaaacaaaaggaaguaguuaaaugcu

SEQ ID NO: 43452 - RNA, 64 nt, hsa
uuaauguaccuuuuuguuagugaauuuggaaauaaaaagaaaaaaaaaacaaaaacaaacaggc

SEQ ID NO: 43453 - RNA, 64 nt, hsa
uucaaagcuacacuuuugaguaaaaacccuuauuaaaagaaaaacaugauuaauauuuuugucu

SEQ ID NO: 43454 - RNA, 64 nt, hsa
uuuuuucucuuaaaaaaaauaacaccccauuaccaaaagaaaagguaagguggcaaccuuauuu

SEQ ID NO: 43455 - RNA, 64 nt, hsa
guuuucagugugaauucacugaauguuuauagacaaaagaaaauacacacuaaaacuaaucuuc

SEQ ID NO: 43456 - RNA, 64 nt, hsa
uaaucuauacugugaugauuugacucaaaaggagaaaagaaauuauguaguuuucaauucugau

SEQ ID NO: 43457 - RNA, 64 nt, hsa
gggagaaaacuagucuaaauuauuucaacuggaaaaaagaaaaaagaguccucuucuuuuccca

SEQ ID NO: 43458 - RNA, 64 nt, hsa
aacaggcaacuuuucaaaaacacagcuaucauagaaaagaaacuugccucauguaaacuggauu

SEQ ID NO: 43459 - RNA, 64 nt, hsa
uggcauuuucauagauccuugguuuagucugugaaaaagaaaccaucucucuggauaggcuguc

SEQ ID NO: 43460 - RNA, 64 nt, hsa
ucaaucacaucugauuguugaagguuauuaaauuaaaagaaagaucauuuguaacauacucuuu

SEQ ID NO: 43461 - RNA, 64 nt, hsa
guuuauuuuuuaaaauucuaaguagaguauauugaaaagaaaaagaagagccuuaacauauaua

SEQ ID NO: 43462 - RNA, 64 nt, hsa
uucccaggcuaauacaggaaacaagagguaccaaaaaagaaaguuuauuuuuuaaaauucuaag

SEQ ID NO: 43463 - RNA, 64 nt, hsa
accaauacuguguuuuauuaauaaucuucauaagaaaagaaacacuggauacuuuuuuguuguu

SEQ ID NO: 43464 - RNA, 64 nt, hsa
cgauguuagacauagccauaucuccuuucccuacaaaagaaaagcauacuguuaaaaugugcuu

SEQ ID NO: 43465 - RNA, 64 nt, hsa
gucuaguuuccagccauugaagugaacugcuaaaaaaagaaaaauaauugaaauguugagagag

SEQ ID NO: 43466 - RNA, 64 nt, hsa
caaacuucuguuuuauaauauguaauuuuucaugaaaagaaagggcucagaaaaauuaggaugu

SEQ ID NO: 43467 - RNA, 64 nt, hsa
uuccaggaacuacaagaugccaucugccguuugcaaaagaaaaaucuuuucccauauaauccaa

SEQ ID NO: 43468 - RNA, 64 nt, hsa
gaggaugugaagccacugaaagcuugacucagggaaaagaaaugugggaccaucacacacauga

SEQ ID NO: 43469 - RNA, 64 nt, hsa
uuaagcaaacagucccaaaccucuuaggggugaaaaaagaaacaugccacuugauuaggagaga

SEQ ID NO: 43470 - RNA, 64 nt, hsa
gggcaagaagagcgaaacugggucucaaguuaaaaaaagaaagcaaggaaagaguaauuuacaa

SEQ ID NO: 43471 - RNA, 64 nt, hsa
uucaccaaauggagcuuggcacuaaaauuuauguaaaagaaaaaucacaaaccuugaaaaauuu

SEQ ID NO: 43472 - RNA, 64 nt, hsa
gaauauauauuagauguaaagaauuuucugcaauaaaagaaacuagacuuguuaaucccugccu

SEQ ID NO: 43473 - RNA, 64 nt, hsa
aagcacuguuucuauuuuuuucuuuuuuuccaaaaaaagaaaguaauaaaaacuuaaauucuuu

SEQ ID NO: 43474 - RNA, 64 nt, hsa
ccaaggcccaggacacuugucagaaggaugcaaaaaaagaaaaaaguacauccacccucuuaau

SEQ ID NO: 43475 - RNA, 64 nt, hsa
gggguuuuguuucuguuguuguucaaaugcaaaaaaaagaaaaaaaaagaaaaaaaaaggugac

SEQ ID NO: 43476 - RNA, 64 nt, hsa
uucuguuguuguucaaaugcaaaaaaaagaaaaaaaaagaaaaaaaaaggugacucacauuguu

SEQ ID NO: 43477 - RNA, 64 nt, hsa
gaauuucgaaagaaauaauuggcaagauaaugagaaaagaaaaaagucaugguaggugaggugg

SEQ ID NO: 43478 - RNA, 64 nt, hsa
uuuuuguagccaagcagaguuguagagggggauaaaaagaaaagaaauuggauguauuuacagc

SEQ ID NO: 43479 - RNA, 64 nt, hsa
guagccaagcagaguuguagagggggauaaaaagaaaagaaauuggauguauuuacagcugucc

SEQ ID NO: 43480 - RNA, 64 nt, hsa
gccaaaaaaaaaaaaaaaaaaaaaaaaaaaagaaaaaagaaaaaaaaaauccaaaagagagaag

SEQ ID NO: 43481 - RNA, 64 nt, hsa
uuuaaaagccaaaaaaaaaaaaaaaaaaaaaaaaaaaagaaaaaagaaaaaaaaaauccaaaag

SEQ ID NO: 43482 - RNA, 64 nt, hsa
aaacuuccucucaaaaaaaaaaaaaaaaagaaagaaaagaaaacucugucucaaaaaaaaaaaa

SEQ ID NO: 43483 - RNA, 64 nt, hsa
acacgagcaaaacuuccucucaaaaaaaaaaaaaaaaagaaagaaaagaaaacucugucucaaa

SEQ ID NO: 43484 - RNA, 64 nt, hsa
ugugaaaggugauggguuuuauucguugggcuuuaaaagaaaagguuuggcagaacuaaaaaca

SEQ ID NO: 43485 - RNA, 64 nt, hsa
caaucaggcaagagaaagaaauaaaaggcaaccaaaaagaaaggaagucgaaguaucucuguuu

SEQ ID NO: 43486 - RNA, 64 nt, hsa
ggcaaccaagcgagacucugccuuaaaaaaaaaaaaaagaaaauguggcacauauacaccaugg

SEQ ID NO: 43487 - RNA, 64 nt, hsa
cuacacaugugccccugaaccuaaaaaaaaaguuaaaagaaaaacguuuggauuauuuucccuc

SEQ ID NO: 43488 - RNA, 64 nt, hsa
guuugcccaaggacuacaaauaaaccaacgggaaaaaagaaagguuccaguuuugucugaaaau

SEQ ID NO: 43489 - RNA, 64 nt, hsa
auugagaguggcaauuccgcuggagcugucugccaaaagaaacugccuacagacaucaucacag

SEQ ID NO: 43490 - RNA, 64 nt, hsa
auugaucugacuucucagccucauuuggacuaaaaaaagaaagcagaaauccaugaacacauug

SEQ ID NO: 43491 - RNA, 64 nt, hsa
uuuaauucuucccuuggauuaauauuuucuacugaaaagaaaugaaaucucaguuccacuauga

SEQ ID NO: 43492 - RNA, 64 nt, hsa
cugaaaagaaaugaaaucucaguuccacuaugauaaaagaaacgaaucaccagugucugucagu

SEQ ID NO: 43493 - RNA, 64 nt, hsa
guugauugacuguuaauugauucaggguacccuuaaaagaaaagaaguuuucccauugugaacc

SEQ ID NO: 43494 - RNA, 64 nt, hsa
ggcccaacuugggaguggggaaauugcuuaaaaaaaaagaaaaagaaaaaaaaaaagauuauuc

SEQ ID NO: 43495 - RNA, 64 nt, hsa
acuugggaguggggaaauugcuuaaaaaaaaagaaaaagaaaaaaaaaaagauuauucuaaaua

SEQ ID NO: 43496 - RNA, 64 nt, hsa
cgauuucagcacaugcacuacugaaauuuacacaaaaagaaagcugugaaauugaagucccaau

SEQ ID NO: 43497 - RNA, 64 nt, hsa
acuuaguuuuguuccaacaguuaaacuugcaaugaaaagaaaaugugccauuuuuuucacucag

SEQ ID NO: 43498 - RNA, 64 nt, hsa
aaagagaaaaacaauggaguuacuuauuuaaaaaaaaagaaagaaaguuaucucuucccaggag

SEQ ID NO: 43499 - RNA, 64 nt, hsa
acugugaauguagaagugggggggaggggggagaaaaagaaaacucuggcguuagaggauauag

SEQ ID NO: 43500 - RNA, 64 nt, hsa
uuguuuuuuugcagcuugcugauauuuuauauaaaaaagaaaagcaaagcaaaagagaagcuga

SEQ ID NO: 43501 - RNA, 64 nt, hsa
agcugauagucuugaauauuuuauuuuuuuaaugaaaagaaaaaacaagaaaguuauguuucau

SEQ ID NO: 43502 - RNA, 64 nt, hsa
cccuuuauaaagagauuuucaaguggauauauauaaaagaaacaguugcuuguaaaauauacuu

SEQ ID NO: 43503 - RNA, 64 nt, hsa
aauugaaauauuuucuugcaucaguauuggcuagaaaagaaaauaaauaaaaccaaguuaauuu

SEQ ID NO: 43504 - RNA, 64 nt, hsa
gucaaacuuuuuccagcaaaauggaagcaaagacaaaagaaacuuaccaauugauguuuuacgu

SEQ ID NO: 43505 - RNA, 64 nt, hsa
uaccuuccuuauauuuuuuuccucaacaguuuuaaaaagaaaaaaaggucuauuuuuuuuucuc

SEQ ID NO: 43506 - RNA, 64 nt, hsa
uggcagaagcgagaaaacuuuguuuauugaaaaaaaaagaaaaagaaagcaagaaaaaaagaua

SEQ ID NO: 43507 - RNA, 64 nt, hsa
aagcgagaaaacuuuguuuauugaaaaaaaaagaaaaagaaagcaagaaaaaaagauacuaugg

SEQ ID NO: 43508 - RNA, 64 nt, hsa
gcuaugcaaaaccuuucccagaccucaguuucuuaaaagaaagauguugcuacaguucccgauu

SEQ ID NO: 43509 - RNA, 64 nt, hsa
agaguauuuuuguacagauuugcuuucucuuacaaaaagaaaaaaaaaauccuguuguauuaac

SEQ ID NO: 43510 - RNA, 62 nt, hsa
auauuauuguuuacaauaaauauacauugcauuaaaaagaaaguggcccuguggauuuauuc

SEQ ID NO: 43511 - RNA, 64 nt, hsa
cuccccaaaaacuauugaaauaaaauaaaauauaaaaagaaagagaaagaaaagaaaauaguuc

SEQ ID NO: 43512 - RNA, 64 nt, hsa
ugaaauaaaauaaaauauaaaaagaaagagaaagaaaagaaaauaguuccaauuuaucaugcca

SEQ ID NO: 43513 - RNA, 64 nt, hsa
aggcucgccgugagccaggucuaaaguuugaagaaaaagaaaaaucuuaaaaaaaaaaaaaaaa

SEQ ID NO: 43514 - RNA, 64 nt, hsa
aaaaagaaaaaucuuaaaaaaaaaaaaaaaaaaaaaaagaaaaaaagaaaaacaggaaaaagga

SEQ ID NO: 43515 - RNA, 64 nt, hsa
aaaucuuaaaaaaaaaaaaaaaaaaaaaaagaaaaaaagaaaaacaggaaaaaggacuuuuuuu

SEQ ID NO: 43516 - RNA, 64 nt, hsa
ucccccagucugacauauuucauacagaauguuuaaaagaaaaacucugcuagucuuggcaaac

SEQ ID NO: 43517 - RNA, 64 nt, hsa
uuucuaugugaauauaagcuugugcacaauguuuaaaagaaaaacaaugaauuagaagagaucc

SEQ ID NO: 43518 - RNA, 64 nt, hsa
ugucuccgaaaaaaaaaaaaaaaaaaagaacggaaaaagaaaugcuuacauugucagggauccu

SEQ ID NO: 43519 - RNA, 64 nt, hsa
gggugacagagcgagacuccgucucaaaaaaaaaaaaagaaagcagauccucauggcuauagag

SEQ ID NO: 43520 - RNA, 64 nt, hsa
aguuuucccuugaggaaacaacagcuuuaaaagaaaaagaaaaaaaaagucuuugguaaauggc

SEQ ID NO: 43521 - RNA, 64 nt, hsa
agauaaaguuuucccuugaggaaacaacagcuuuaaaagaaaaagaaaaaaaaagucuuuggua

SEQ ID NO: 43522 - RNA, 64 nt, hsa
uucaaaucucuugcuuucuuucuuaaaaaaaagaaaaagaaaaagcaagaagaaggaagaaaga

SEQ ID NO: 43523 - RNA, 64 nt, hsa
gcaagauucaaaucucuugcuuucuuucuuaaaaaaaagaaaaagaaaaagcaagaagaaggaa

SEQ ID NO: 43524 - RNA, 64 nt, hsa
auagaaacuuugcuaguuaaaaaaaaaagaaaaaaaaagaaaaaaaaucccuuucuuguaaacu

SEQ ID NO: 43525 - RNA, 64 nt, hsa
agaaaguauaauagaaacuuugcuaguuaaaaaaaaaagaaaaaaaaagaaaaaaaaucccuuu

SEQ ID NO: 43526 - RNA, 64 nt, hsa
ugcaaaucaaagauauuugguagucaaaauaaguaaaagaaauauaggaauauuccagucaauc

SEQ ID NO: 43527 - RNA, 64 nt, hsa
cuuuuauaaagagacucaaagcuaaugauagcuuaaaagaaaaguuaaugccuucucauuggaa

SEQ ID NO: 43528 - RNA, 64 nt, hsa
uugaauauaaguaaccaugacuuguaaaaaaaaaaaaagaaagcaguuacucuuggagcuuaug

SEQ ID NO: 43529 - RNA, 64 nt, hsa
auugccgagaguccuguuauugagguagaaacagaaaagaaagacguucuugauuuuggugacu

SEQ ID NO: 43530 - RNA, 64 nt, hsa
gggcccuaaagaccuccuuugggaauucuggggaaaaagaaaaaguaaucuucuacuugcuuca

SEQ ID NO: 43531 - RNA, 64 nt, hsa
uuagcaguuucucuggaauuccugucucuccuuuaaaagaaaggagagaacauuuuagaacaau

SEQ ID NO: 43532 - RNA, 64 nt, hsa
caaacugcuuuguguauuguauauuuuuuuaagaaaaagaaaagccuuauuugacuuaugcuug

SEQ ID NO: 43533 - RNA, 64 nt, hsa
ugaaucuagagccuacuuuuauuuugguuaaagaaaaagaaaauaucaauaauucaauuuugug

SEQ ID NO: 43534 - RNA, 64 nt, hsa
acagagaggaaaauguauuuaaaagaaauacgagaaaagaaagugaaaguuuuacaaguuagag

SEQ ID NO: 43535 - RNA, 64 nt, hsa
gugaauauagaugaacagagaggaaaauguauuuaaaagaaauacgagaaaagaaagugaaagu

SEQ ID NO: 43536 - RNA, 64 nt, hsa
guuucuuguucaguuuuacuucuaauccaacaacaaaagaaaugucuggcuggucucagcuaga

SEQ ID NO: 43537 - RNA, 64 nt, hsa
cucaaacuaaaauuuauuuuuauaaaugaauuuuaaaagaaaaaauaucuacuucuuuuaaagu

SEQ ID NO: 43538 - RNA, 64 nt, hsa
aaaauaauagaagaaauagaaauuuugaauguauaaaagaaaaagaucaaguugucauuuuaga

SEQ ID NO: 43539 - RNA, 64 nt, hsa
aauauugaguaucacuaugugaagaaaguuuuggaaaagaaacaaugaagacugaauuaaauua

SEQ ID NO: 43540 - RNA, 61 nt, hsa
uuagaggacacacugguuaaaaauuaaacauaaaagaaauugcaucgauguaaucagaaug

SEQ ID NO: 43541 - RNA, 64 nt, hsa
aaaaugggagauuguuuucaggaauucagggaugaaaagaaagaauaauuuccauuaaguagaa

SEQ ID NO: 43542 - RNA, 64 nt, hsa
cacccuugguuucugaugauuuauaaguaacuacaaaagaaagagaccuguucuugaacagaua

SEQ ID NO: 43543 - RNA, 64 nt, hsa
ugggucugaaauucauacaugaagucaggaaaagaaaagaaacuuaguucuaccuugauuacau

SEQ ID NO: 43544 - RNA, 64 nt, hsa
ugaggugggucugaaauucauacaugaagucaggaaaagaaaagaaacuuaguucuaccuugau

SEQ ID NO: 43545 - RNA, 64 nt, hsa
uucagcuaaaauaguacuucacaggaaauauaggaaaagaaacacuaguucaguuuuauuccaa

SEQ ID NO: 43546 - RNA, 64 nt, hsa
aauuauuaaaugugaggagcuuuuuuaauacaggaaaagaaacaugucauccacuugaguuaau

SEQ ID NO: 43547 - RNA, 64 nt, hsa
aaugaacacaguugaguauuugaagugaauuugaaaaagaaauguuacuuaaucuuucccuaag

SEQ ID NO: 43548 - RNA, 64 nt, hsa
guaauuccuaaguaauuaagaauaaauaaguuccaaaagaaauuguagcuggaaucuuaauaac

SEQ ID NO: 43549 - RNA, 64 nt, hsa
ggaggaaagauuaugaaaggaacaggcucuuuaaaaaagaaaacaaaaagccagaaucuuccuu

SEQ ID NO: 43550 - RNA, 64 nt, hsa
cugagaaugaauaugggaacacgucauugauagcaaaagaaagguacaggcuuacgaaaaugau

SEQ ID NO: 43551 - RNA, 64 nt, hsa
ggaguaauagggaaagaagaguuacagaaaaugaaaaagaaaaugaguuacacugagaaugaau

SEQ ID NO: 43552 - RNA, 64 nt, hsa
cgagacuccgccucaaaaaaaaaaaaaaaagaaaaaaagaaauguaccuguuggcaggagaagg

SEQ ID NO: 43553 - RNA, 64 nt, hsa
cgacagagcgagacuccgccucaaaaaaaaaaaaaaaagaaaaaaagaaauguaccuguuggca

SEQ ID NO: 43554 - RNA, 64 nt, hsa
aaaggucuucugacacacuuaucuugcacaaagaaaaagaaaauuucuuuuacuguguuuaaug

SEQ ID NO: 43555 - RNA, 64 nt, hsa
gcauaggacgguaggguagaaauuugggagggaaaaaagaaauugggaggguacaggcaacagg

SEQ ID NO: 43556 - RNA, 64 nt, hsa
uuucagaaaaccugacucuaacugguuuauauacaaaagaaaacuuacuguaucauauaacaga

SEQ ID NO: 43557 - RNA, 64 nt, hsa
gaagauauccagaaaggagccacagcugacgccaaaaagaaaagaaaaaagauauauauauaua

SEQ ID NO: 43558 - RNA, 64 nt, hsa
uauccagaaaggagccacagcugacgccaaaaagaaaagaaaaaagauauauauauauauauau

SEQ ID NO: 43559 - RNA, 64 nt, hsa
cugggcaacaagagcaaaacuccgucucaaaauaaaaagaaaagaaaagaauggacaguguuug

SEQ ID NO: 43560 - RNA, 64 nt, hsa
caacaagagcaaaacuccgucucaaaauaaaaagaaaagaaaagaauggacaguguuugcagag

SEQ ID NO: 43561 - RNA, 64 nt, hsa
ucaaagacucuuguccucuugucccuccugagaaaaaagaaaacgaaaagugggguuuuuuucu

SEQ ID NO: 43562 - RNA, 64 nt, hsa
auuuuaauuguaacauuuuuagaaaaagaacaaaaaaagaaaaaaaaaagaaagaaacacagca

SEQ ID NO: 43563 - RNA, 64 nt, hsa
aacauuuuuagaaaaagaacaaaaaaagaaaaaaaaaagaaagaaacacagcaacuguagaugc

SEQ ID NO: 43564 - RNA, 64 nt, hsa
gggaagggaccuugcagggaccucucccuccaaaaaaagaaaaaaagaaaaagaaagaaaaaau

SEQ ID NO: 43565 - RNA, 64 nt, hsa
accuugcagggaccucucccuccaaaaaaagaaaaaaagaaaaagaaagaaaaaauaaaugagg

SEQ ID NO: 43566 - RNA, 64 nt, hsa
cagggaccucucccuccaaaaaaagaaaaaaagaaaaagaaagaaaaaauaaaugaggaaacgu

SEQ ID NO: 43567 - RNA, 64 nt, hsa
aauaaacaaacuaauaaaaagcaaaaaaaaaaaaaaaagaaaagaaaaaacacugcauuugggc

SEQ ID NO: 43568 - RNA, 64 nt, hsa
acaaacuaauaaaaagcaaaaaaaaaaaaaaaagaaaagaaaaaacacugcauuugggcaccau

SEQ ID NO: 43569 - RNA, 64 nt, hsa
aaaaaaaaaaaaaaaaaaaaggaaagaaagaaagaaaagaaaagaaaauccuuuuugcuuuaac

SEQ ID NO: 43570 - RNA, 64 nt, hsa
aaaaaaaaaaaaaaaggaaagaaagaaagaaaagaaaagaaaauccuuuuugcuuuaacuugcc

SEQ ID NO: 43571 - RNA, 64 nt, hsa
gaagugagaagggaaguuuagagaaaaaaaauuaaaaagaaacaaagucuccaagaaauauggg

SEQ ID NO: 43572 - RNA, 64 nt, hsa
gggaucuaauuaaacuaaagaccuucugcacagcaaaagaaacuaccaucagagucaacaggca

SEQ ID NO: 43573 - RNA, 64 nt, hsa
uacucaaucuaggacauguuccuuuacuccuuaaaaaagaaaggaaagaucucuaaauucaaag

SEQ ID NO: 43574 - RNA, 64 nt, hsa
aaaauacuaagacgugauagugaaaauagcuuugaaaagaaacuacauauggcaaaggugggga

SEQ ID NO: 43575 - RNA, 64 nt, hsa
ucaaaaucccccaaauguuaagguauaugguaaaaaaagaaauaucugggaucccgauguucuu

SEQ ID NO: 43576 - RNA, 64 nt, hsa
auaccaguuauaugaauugacuuaaguaucuugaaaaagaaacuuuagagaaagcaucaggggu

SEQ ID NO: 43577 - RNA, 64 nt, hsa
aagaaagaaagggaaagauggaaggaaggaaggaaaaagaaagagaaagagagagagagagaaa

SEQ ID NO: 43578 - RNA, 64 nt, hsa
gaaaaagaaagagaaagagagagagagagaaagaaaaagaaagaaaaguaagaaagaaaaaaga

SEQ ID NO: 43579 - RNA, 64 nt, hsa
gagagaaagaaaaagaaagaaaaguaagaaagaaaaaagaaaaagaaagaaaaguaagaaagaa

SEQ ID NO: 43580 - RNA, 64 nt, hsa
aagaaaaagaaagaaaaguaagaaagaaaaaagaaaaagaaagaaaaguaagaaagaaaaaaag

SEQ ID NO: 43581 - RNA, 64 nt, hsa
uuuaggcagcaagaauuggagaacucacacugcgaaaagaaaaccuuggguggcagugauuuga

SEQ ID NO: 43582 - RNA, 64 nt, hsa
agagcgagacuccaucuuaaaaaaaaaaaaaaaaaaaagaaagaaaagaaaauggaguucugag

SEQ ID NO: 43583 - RNA, 64 nt, hsa
cuccaucuuaaaaaaaaaaaaaaaaaaaagaaagaaaagaaaauggaguucugagagcuaggaa

SEQ ID NO: 43584 - RNA, 64 nt, hsa
cuccagucuggcaacagagcaagacuccaucucaaaaagaaaagaaaagaagacucugaccugu

SEQ ID NO: 43585 - RNA, 64 nt, hsa
gucuggcaacagagcaagacuccaucucaaaaagaaaagaaaagaagacucugaccuguacucu

SEQ ID NO: 43586 - RNA, 64 nt, hsa
gggugacacagcaagacuccaucucaaaaaaaaaaaaagaaaaagaaaugaauggguucaaaga

SEQ ID NO: 43587 - RNA, 64 nt, hsa
cacagcaagacuccaucucaaaaaaaaaaaaagaaaaagaaaugaauggguucaaagaccauaa

SEQ ID NO: 43588 - RNA, 64 nt, hsa
aauugucacauacccaugugacccgauaggaggcaaaagaaaugagacuucugggauuaguuua

SEQ ID NO: 43589 - RNA, 64 nt, hsa
cuuuuaaaugaaaaggugaaaguucucaacuuaaaaaagaaaagaaaaaaaucauauacugagg

SEQ ID NO: 43590 - RNA, 64 nt, hsa
aaaugaaaaggugaaaguucucaacuuaaaaaagaaaagaaaaaaaucauauacugagguugcu

SEQ ID NO: 43591 - RNA, 64 nt, hsa
caaaaaaaaaaguaaaaagaaaagaaaaaaaaaaaaaagaaacaaaccaccucuacauauuaug

SEQ ID NO: 43592 - RNA, 64 nt, hsa
ucugccaggggcgggcaaaaaaaaaaguaaaaagaaaagaaaaaaaaaaaaaagaaacaaacca

SEQ ID NO: 43593 - RNA, 64 nt, hsa
agagcucugccaggggcgggcaaaaaaaaaaguaaaaagaaaagaaaaaaaaaaaaaagaaaca

SEQ ID NO: 43594 - RNA, 64 nt, hsa
aaacacaaacagaagaggaaaaaaaagcaacaaaaaaagaaaacacacagaagagauuuaaaaa

SEQ ID NO: 43595 - RNA, 64 nt, hsa
uaaacgucuguggagcuucugcugcaaggaacaaaaaagaaaaaaaucaaaaaagcgacaaaaa

SEQ ID NO: 43596 - RNA, 64 nt, hsa
gaaaaaaaaaaacacaaaaaaagacaaaaaaaaaaaaagaaaauauuuuggcagguuauguuua

SEQ ID NO: 43597 - RNA, 64 nt, hsa
ugagacuccaucucaaaaaaaauaaaaaaaaagaaaaagaaauaaacucuaugaauguaaacca

SEQ ID NO: 43598 - RNA, 64 nt, hsa
acagagugagacuccaucucaaaaaaaauaaaaaaaaagaaaaagaaauaaacucuaugaaugu

SEQ ID NO: 43599 - RNA, 64 nt, hsa
aaaagaaaaaaaaaagacaaaaaaaaaaaaaaagaaaagaaaaaaaaucucaucacuugaagcc

SEQ ID NO: 43600 - RNA, 64 nt, hsa
aauggaaaagaaaaaaaaaagacaaaaaaaaaaaaaaagaaaagaaaaaaaaucucaucacuug

SEQ ID NO: 43601 - RNA, 64 nt, hsa
cuuccccauugcuguaaauauuucaacgaaauggaaaagaaaaaaaaaagacaaaaaaaaaaaa

SEQ ID NO: 43602 - RNA, 64 nt, hsa
gaagauagacacauuuggauuaaaauauucuagcaaaagaaauaauuggcaaagagagcuggaa

SEQ ID NO: 43603 - RNA, 64 nt, hsa
uaaaauuaauuagaaacuaucaaaaauguggcuuaaaagaaauuaaccaccuaggaauuuaaua

SEQ ID NO: 43604 - RNA, 64 nt, hsa
cccgacucucacuucauauguuuaaagaaugaguaaaagaaagcaauuacuacugcuaaaugug

SEQ ID NO: 43605 - RNA, 64 nt, hsa
ugggcaacaagagcaaaacucuaucucaaagaaaaaaagaaaauuucuacauauuaaaacuugu

SEQ ID NO: 43606 - RNA, 64 nt, hsa
agaugauauaucuggaauguccuuuuguucauacaaaagaaaaaugaggaugaauaacaaguuu

SEQ ID NO: 43607 - RNA, 64 nt, hsa
gagcaacacucugucucaaaaaaaaaaagaaaagaaaagaaaaagccagaaaaaguuggugccc

SEQ ID NO: 43608 - RNA, 64 nt, hsa
cagcagagcaacacucugucucaaaaaaaaaaagaaaagaaaagaaaaagccagaaaaaguugg

SEQ ID NO: 43609 - RNA, 64 nt, hsa
cugggcagcagagcaacacucugucucaaaaaaaaaaagaaaagaaaagaaaaagccagaaaaa

SEQ ID NO: 43610 - RNA, 64 nt, hsa
cugaugcccuuauuugaagcuccauuauuuuuuaaaaagaaauuauauaaaaauacuuuauugc

SEQ ID NO: 43611 - RNA, 64 nt, hsa
ucagccuggacaacauggcaaaaccccaucuauuaaaagaaaaaauaccugaugcccuuauuug

SEQ ID NO: 43612 - RNA, 64 nt, hsa
aaaacugaucaaaagcauaauugaaaguucugaaaaaagaaaaauaauaauauguagaaaaaug

SEQ ID NO: 43613 - RNA, 64 nt, hsa
cauuagacacuuaauaaaacuuaacuuccaaugaaaaagaaaucuuuuguaaaucauucuacuu

SEQ ID NO: 43614 - RNA, 64 nt, hsa
uuucauuugagagggagagcugugguacuggcuaaaaagaaaggaagauaacauccaguaacca

SEQ ID NO: 43615 - RNA, 64 nt, hsa
aagaauaagcagcagaacccuguuccauauggaaaaaagaaaaacaauuuuuugucccuaaugu

SEQ ID NO: 43616 - RNA, 64 nt, hsa
gcaagacacgcacagucaaccauuuuccgagaaaaaaagaaaauuccccacuuggaaagaaaga

SEQ ID NO: 43617 - RNA, 64 nt, hsa
gggccacugcagaugacucuccuuugaaaugagaaaaagaaaagaaagcaagaacagaaaacga

SEQ ID NO: 43618 - RNA, 64 nt, hsa
acugcagaugacucuccuuugaaaugagaaaaagaaaagaaagcaagaacagaaaacgaagcca

SEQ ID NO: 43619 - RNA, 64 nt, hsa
cagccugggcaacauagcgagaccucaucuccaaaaaagaaaacaaaaaacaaaaaaaggaaug

SEQ ID NO: 43620 - RNA, 64 nt, hsa
agaguccaucuguuuguccaucugcugaaaugagaaaagaaaaauuuaugcacugauuuaaaac

SEQ ID NO: 43621 - RNA, 64 nt, hsa
aaaauuuaugcacugauuuaaaacaaaccaaaaaaaaagaaaaaaacaaaaaaaaaaaucccuc

SEQ ID NO: 43622 - RNA, 64 nt, hsa
aagcacacccgugguugugaaaauaguauagcaaaaaagaaaaauccccgguuauugauguacu

SEQ ID NO: 43623 - RNA, 64 nt, hsa
aucaugggauuuaaauuuaucauaaccauguguaaaaagaaauuaauguaugaugacaucucac

SEQ ID NO: 43624 - RNA, 64 nt, hsa
ccaacccaguucuguuugacuauguagcaucuugaaaagaaaaauuauaauaaagccccaaaau

SEQ ID NO: 43625 - RNA, 64 nt, hsa
ucucagucauccuggcagccaaaaaugugccaggaaaagaaagaauguggagcacgcguggcuc

SEQ ID NO: 43626 - RNA, 64 nt, hsa
uuaaccaggacuauguagaaguagaaagaaaagaaaaagaaaaucuuuuuuaaaccagaauaaa

SEQ ID NO: 43627 - RNA, 64 nt, hsa
auuaauuuaaccaggacuauguagaaguagaaagaaaagaaaaagaaaaucuuuuuuaaaccag

SEQ ID NO: 43628 - RNA, 64 nt, hsa
auugaaagaauacuuuucuggcaaaaaaaaaaaaaaaagaaagaaaggaaaacaaaaagcacuu

SEQ ID NO: 43629 - RNA, 64 nt, hsa
uaaauaagaauuuuaauaaaaauccuguguuuaaaaaagaaaaaaagaaaaaaucccugcccuc

SEQ ID NO: 43630 - RNA, 64 nt, hsa
uuuauuuuauugugcaaacauuucucaaauauggaaaagaaaacccuguaggcagggagcccuc

SEQ ID NO: 43631 - RNA, 64 nt, hsa
cgguauuuuuguuuguaaguuaaaaagaaaaaaaaaaagaaaaaguuccgggcauuuugcauca

SEQ ID NO: 43632 - RNA, 64 nt, hsa
gguuuauuauuacgguauuuuuguuuguaaguuaaaaagaaaaaaaaaaagaaaaaguuccggg

SEQ ID NO: 43633 - RNA, 64 nt, hsa
guauuaacuuuaacuuauuaaaaaaaaaaaaagaaaaagaaaaacgauuuaaaaaaaaaaaaaa

SEQ ID NO: 43634 - RNA, 64 nt, hsa
auauuuguauuaacuuuaacuuauuaaaaaaaaaaaaagaaaaagaaaaacgauuuaaaaaaaa

SEQ ID NO: 43635 - RNA, 64 nt, hsa
gucccagaacugauguuuuuuuuuuaagguacugaaaagaaaugaaguugauguaugucccaag

SEQ ID NO: 43636 - RNA, 64 nt, hsa
gugguggugucaauaaacgcucuguggccaguguaaaagaaaaucccucgcaguuguggacauu

SEQ ID NO: 43637 - RNA, 64 nt, hsa
accacguuucuuuguugagcugugucuugaaggcaaaagaaaaaaaauuucuacaguagucuuu

SEQ ID NO: 43638 - RNA, 64 nt, hsa
cacaagcuaagagagcuugcaaaaaaaaaaagaaaaaagaaaaaaaaaaaccacguuucuuugu

SEQ ID NO: 43639 - RNA, 64 nt, hsa
cugaaugcacaagcuaagagagcuugcaaaaaaaaaaagaaaaaagaaaaaaaaaaaccacguu

SEQ ID NO: 43640 - RNA, 64 nt, hsa
gaaaaagaaaaagaagaaaacgaaaagaagaaacaaaagaaagcaucaugaugaauaaaauguc

SEQ ID NO: 43641 - RNA, 64 nt, hsa
cugaagaaauugagaaguauguugcugaaauugaaaaagaaaaagaagaaaacgaaaagaagaa

SEQ ID NO: 43642 - RNA, 64 nt, hsa
gguagauguaguugcuuaguagcauuuuggaaaaaaaagaaaaaaagguuugguuugguuuugu

SEQ ID NO: 43643 - RNA, 64 nt, hsa
gagcgaaacuccgucucaaaaaaaaaaaaaaaaaaaaagaaagaaaagaguaacagaaagauag

SEQ ID NO: 43644 - RNA, 64 nt, hsa
auguucagugagccuguuucauuugcuauauagaaaaagaaacuccuauuuuuaccuugcugga

SEQ ID NO: 43645 - RNA, 64 nt, hsa
cucuccccggguagugaugaacauuuacuacuauaaaagaaacagcuauuuaaugaaauuuuga

SEQ ID NO: 43646 - RNA, 64 nt, hsa
uaguaagaugaguggaaguguuuaucgagcaugcaaaagaaacccucacggcuaagggcucugg

SEQ ID NO: 43647 - RNA, 64 nt, hsa
acuuuuuuuguucuaggggaaaugaaugugcaaaaaaagaaaaagaacuguugguuauuugugu

SEQ ID NO: 43648 - RNA, 64 nt, hsa
ugugaaugcuucugauuuagcaaugcugugaauaaaaagaaagauuuuauacccuugacuuaac

SEQ ID NO: 43649 - RNA, 64 nt, hsa
uuauuccugguuaaucacuaugcauauuugaaauaaaagaaagcguaagccucugcaauuuuaa

SEQ ID NO: 43650 - RNA, 64 nt, hsa
aaaauuugaugugcuacaagccucaugaaagaacaaaagaaaugaagccuuuugauaugcauuc

SEQ ID NO: 43651 - RNA, 64 nt, hsa
ugggcaacagagcgagacucagucucaaaaagaaaaaagaaauuuauugcugaucacaaggaca

SEQ ID NO: 43652 - RNA, 64 nt, hsa
uccagccugggcaacagagcgagacucagucucaaaaagaaaaaagaaauuuauugcugaucac

SEQ ID NO: 43653 - RNA, 64 nt, hsa
ugaagugugaauuaauaagaaaugggguaaauagaaaagaaauuuauugcugauuggccaggug

SEQ ID NO: 43654 - RNA, 64 nt, hsa
cggaauucaaaaguuacaaaaaggguauucuuggaaaagaaaguuguuuuuuuuuagucuugcu

SEQ ID NO: 43655 - RNA, 64 nt, hsa
agucacauacacuacacacacugugccacguuuaaaaagaaaaaaaacaauucucggcugggcg

SEQ ID NO: 43656 - RNA, 64 nt, hsa
ucgacagagugaacucugucucaaaaaaaaaaaaaaaagaaaagaaagaagaagccauucccaa

SEQ ID NO: 43657 - RNA, 64 nt, hsa
agagugaacucugucucaaaaaaaaaaaaaaaagaaaagaaagaagaagccauucccaacguug

SEQ ID NO: 43658 - RNA, 64 nt, hsa
guugauuucuuaaugaugacuucaaaaauuaauaaaaagaaaagaaaaaaaugauuucuggccg

SEQ ID NO: 43659 - RNA, 64 nt, hsa
uuucuuaaugaugacuucaaaaauuaauaaaaagaaaagaaaaaaaugauuucuggccgggcgu

SEQ ID NO: 43660 - RNA, 64 nt, hsa
gcaccaaugugagaaccugucuuggaaaaaaaaaaaaagaaacauguuuuaguagaaguuuuau

SEQ ID NO: 43661 - RNA, 64 nt, hsa
aaaagaaacauguuuuaguagaaguuuuauuugaaaaagaaaaauaagcauaaauauauuccca

SEQ ID NO: 43662 - RNA, 64 nt, hsa
guguuaggcaauccuguaaucuuuuuugacucuuaaaagaaauucauuucugaaaugcuugguu

SEQ ID NO: 43663 - RNA, 64 nt, hsa
auuuaaagggggggaaccucaaaaguuuuuuuaaaaaagaaacuugucugccacaguauguuac

SEQ ID NO: 43664 - RNA, 64 nt, hsa
cauuucucuuuccagcugcuguuuuguaaaaagaaaaagaaaaaagaagcccaaacuagugaga

SEQ ID NO: 43665 - RNA, 64 nt, hsa
caccuacauuucucuuuccagcugcuguuuuguaaaaagaaaaagaaaaaagaagcccaaacua

SEQ ID NO: 43666 - RNA, 64 nt, hsa
ggaucugcggaaguaaccacaaaauauuaucgaaaaaagaaaagaauucuaaugaccagccgug

SEQ ID NO: 43667 - RNA, 64 nt, hsa
uucuguuuuuuaaccuuuuguuccgccauuuaaaaaaagaaaaaaaaaaagcuuauguuucuug

SEQ ID NO: 43668 - RNA, 64 nt, hsa
auuauuuucagaaaaacacugacugugucauuuaaaaagaaauaaaugauauguuauuauccca

SEQ ID NO: 43669 - RNA, 64 nt, hsa
aucauacuaaagacauuugcgcuuacuuuguugaaaaagaaaaagaaauuaaauuugaacacag

SEQ ID NO: 43670 - RNA, 64 nt, hsa
cuaaagacauuugcgcuuacuuuguugaaaaagaaaaagaaauuaaauuugaacacagugaaag

SEQ ID NO: 43671 - RNA, 64 nt, hsa
guauucuguuuauauuauacauauauauacacguaaaagaaauauccaagaaagugaugacauu

SEQ ID NO: 43672 - RNA, 64 nt, hsa
uuuagaaguaaaacacaaaacaaaaaagagagagaaaagaaaagaaaucacaauguauauaaaa

SEQ ID NO: 43673 - RNA, 64 nt, hsa
aaguaaaacacaaaacaaaaaagagagagaaaagaaaagaaaucacaauguauauaaaacagua

SEQ ID NO: 43674 - RNA, 64 nt, hsa
guuggaauuucuuugaauucuguuaguaaugcccaaaagaaaagucucaagcagucccccuauc

SEQ ID NO: 43675 - RNA, 64 nt, hsa
agaguaucuagaagggugaaaacaaaaaaaaauaaaaagaaacacagacgcccaggugucagcu

SEQ ID NO: 43676 - RNA, 64 nt, hsa
cuuuuguuaacuugauaauucuucaucuaccuuaaaaagaaaaaaauuacacauagucauucuu

SEQ ID NO: 43677 - RNA, 64 nt, hsa
uaaauggguugccaacauaagcuggcugagaaauaaaagaaaacaagacaguuguucauaaagu

SEQ ID NO: 43678 - RNA, 64 nt, hsa
ucuagaaauucucaguaugggguuucccucuggaaaaagaaaaucugaagacauuacaguugcc

SEQ ID NO: 43679 - RNA, 64 nt, hsa
ccagcuccuaccaguccagugugcuuauaagugcaaaagaaaguaaaggcaaccccagauuucu

SEQ ID NO: 43680 - RNA, 64 nt, hsa
ccuguuaauuauagaauggaccaaauacauuuuuaaaagaaaacugagaccaaucagauggaaa

SEQ ID NO: 43681 - RNA, 64 nt, hsa
uuggacaaacaguucuuuuacagugguuauauggaaaagaaauugauugcuauuuuggggggcu

SEQ ID NO: 43682 - RNA, 64 nt, hsa
gaaaaaauauacuugcuaucuauaaaaaagagaaaaaagaaaaaaaaugagaaaaaaguaagaa

SEQ ID NO: 43683 - RNA, 64 nt, hsa
gugauauaucaguguuugagagugaccucuagaaaaaagaaaaguguuuuuagaaaugcguaca

SEQ ID NO: 43684 - RNA, 64 nt, hsa
ugccagccugaacuauauuuaagagacuuuguaaaaaagaaaaauguauauagcugugaguuua

SEQ ID NO: 43685 - RNA, 64 nt, hsa
cuuuuccucaaguuacuuuccuucauuuucuuaaaaaagaaaaaaaauuauuaaauguuucuca

SEQ ID NO: 43686 - RNA, 64 nt, hsa
caacacuaacaugagaacacaagaacuuaagagaaaaagaaaccuacucaagaaaagacagaag

SEQ ID NO: 43687 - RNA, 64 nt, hsa
uccgagaaagaagaacguaagcacaggaaagagaaaaagaaaucuguugaagaaaggacagaag

SEQ ID NO: 43688 - RNA, 64 nt, hsa
gucaaggucaguucaggaaagcuuaagcaucgaaaaaagaaaaaaagccaugauguacccuccg

SEQ ID NO: 43689 - RNA, 64 nt, hsa
cuuugagacuuuguuuacguguggcaguguuguaaaaagaaacuaaagaucacauuuuaccugu

SEQ ID NO: 43690 - RNA, 64 nt, hsa
acucaaacucaguauuaccuacucaaugccuuuuaaaagaaaguuauaauggagaaaaaauuga

SEQ ID NO: 43691 - RNA, 64 nt, hsa
cucuucuuucccauuuuaaaaaagaaaagaaggaaaaagaaaaaaggggcaaggagccccgcgg

SEQ ID NO: 43692 - RNA, 64 nt, hsa
ucuucuacccucccccucuucuuucccauuuuaaaaaagaaaagaaggaaaaagaaaaaagggg

SEQ ID NO: 43693 - RNA, 64 nt, hsa
gugaaaugucacuccauugacccaccgaaaaaagaaaagaaaucuguuucuaccaaacauuucc

SEQ ID NO: 43694 - RNA, 64 nt, hsa
caguggugaaaugucacuccauugacccaccgaaaaaagaaaagaaaucuguuucuaccaaaca

SEQ ID NO: 43695 - RNA, 64 nt, hsa
agguaacaacgcuaagcuuuuuugagaugucuguuucuucuagauguucugaaguaccugauac

SEQ ID NO: 43696 - RNA, 64 nt, hsa
gaccuuggaagacagggcacuugggaugucguuuuucuucuaauauuguuugagcucaagguag

SEQ ID NO: 43697 - RNA, 64 nt, hsa
acuagagggcuaaggauucugucugcugcuuuguuucuucuaaguaggcauuuagaucauuccu

SEQ ID NO: 43698 - RNA, 64 nt, hsa
gaacuuuauuuacaguacuuugauuuggcagguuuucuucuacuugugcucugccuggagcugu

SEQ ID NO: 43699 - RNA, 64 nt, hsa
gugacuuuuuuuaagcauccugacaggaaauguuuucuucuacauggaaagauagacagcagcc

SEQ ID NO: 43700 - RNA, 64 nt, hsa
ucaggauagaacagccuggcuuauuuggggauuuuucuucuagaaaucaaaugacugauaagca

SEQ ID NO: 43701 - RNA, 64 nt, hsa
cuacgauaauguguacuaugacaaacgugcuuuauucuucuaacgcaguaagaauuagguggaa

SEQ ID NO: 43702 - RNA, 64 nt, hsa
ugaaauucuuauuuugaccaucaaugccuaugaauucuucuaauacgugaagaaaauaguuuga

SEQ ID NO: 43703 - RNA, 64 nt, hsa
cuauaaggggcaaaaagucuuuuucuaauaaguauucuucuaugguaguaccuacagaucugcc

SEQ ID NO: 43704 - RNA, 64 nt, hsa
uucuucuaugguaguaccuacagaucugcccuucuucuucuaaaggguaagucauaaucugugu

SEQ ID NO: 43705 - RNA, 64 nt, hsa
ucaagguuuucauaugcagcucggauggacauuuuucuucuaagauggaacuuauuuuucagau

SEQ ID NO: 43706 - RNA, 64 nt, hsa
ccaccaauaaaaggauuuuucuugcuguuuugauuucuucuauuauuuguggaaugaauuauac

SEQ ID NO: 43707 - RNA, 64 nt, hsa
uccauccaaucacacugcugugauucagggaucuuucuucuaagacggacacauuugaaccuca

SEQ ID NO: 43708 - RNA, 64 nt, hsa
cauggacacccuuaauuuuaaaagguuuuaaucauucuucuauaaaauacauuuaaaauggaaa

SEQ ID NO: 43709 - RNA, 64 nt, hsa
ucuaaggauuuuuaaaaguuuacuucuugucuuguucuucuaaagcuuucuccaggacagauau

SEQ ID NO: 43710 - RNA, 64 nt, hsa
aaccuuuacuuauuucggcauauuuccucugggcuucuucuaguuucugccuuacaagcaaugc

SEQ ID NO: 43711 - RNA, 64 nt, hsa
aguucaucucauuuguauuccauugauuuuuuuuuucuucuaaacauuuuuucuucaaacagua

SEQ ID NO: 43712 - RNA, 64 nt, hsa
agggaacacaaauuuaugggcuuccugaugaugauucuucuaggcaucauguccuauaguuugu

SEQ ID NO: 43713 - RNA, 64 nt, hsa
auuuuaagucauaauuuguccuuaagcugcuuuuuucuucuauuaauuggaucauaguaaagag

SEQ ID NO: 43714 - RNA, 64 nt, hsa
uuuccuagguagaucaauccauuguaucauucaguucuucuaaagccuacguugguuaggcuga

SEQ ID NO: 43715 - RNA, 64 nt, hsa
uuaacacuauugaacagccgacuuugagcauuguuucuucuaacugccccucaacuaccauuau

SEQ ID NO: 43716 - RNA, 64 nt, hsa
aguauuugaagcucuuaaaauguacauauuuugguucuucuaucucaaauuauuuaaaaugcau

SEQ ID NO: 43717 - RNA, 64 nt, hsa
gccucagagaguugaggaccgcagcauccccuccacuccagaguugggugguauggauuuucaa

SEQ ID NO: 43718 - RNA, 64 nt, hsa
acagcacacaauuucaagccauuuucagaucagaacuccagaaguguugacaagaugccuauuc

SEQ ID NO: 43719 - RNA, 64 nt, hsa
acaguugcaguauuucaaagucccuauccaggucacuccagaaaaggguauugaaacguugaaa

SEQ ID NO: 43720 - RNA, 64 nt, hsa
cucauaacauauaugagguauacaaaauuuucuaacuccagauuguagucauuuugagagguac

SEQ ID NO: 43721 - RNA, 64 nt, hsa
cccuguaacuuaucuagaaagaaaagacccugagacuccagaaucugcuguugccauagcccca

SEQ ID NO: 43722 - RNA, 64 nt, hsa
cuugucugaggccucaucccucggaagccgucugacuccagagucugagcccccggcuaguacc

SEQ ID NO: 43723 - RNA, 64 nt, hsa
cagagcacagaccccagagucuugugguucucuaacuccagaaaggacaauguccccuauucag

SEQ ID NO: 43724 - RNA, 64 nt, hsa
ccacacaccugggcagccacuucauauaaagguuacuccagaccauguacaaaacacagccacu

SEQ ID NO: 43725 - RNA, 64 nt, hsa
aaugcuaccuuuugggaaacaaacugccccguuaacuccagaucauugcacuggaauguaauca

SEQ ID NO: 43726 - RNA, 64 nt, hsa
uaauuuacugugacuagauuugaagcaaauaaauacuccagauccaugcagcuagaacacacuu

SEQ ID NO: 43727 - RNA, 64 nt, hsa
ucugaccucaucaugguucuaguucucauacagaacuccagaauuuuuaaagaacucuauaauu

SEQ ID NO: 43728 - RNA, 64 nt, hsa
ccauguggcccaccagcagccuuuccaaaggggaacuccagagacauuucauaaugcaaacagc

SEQ ID NO: 43729 - RNA, 64 nt, hsa
aucccuuccugcccaucccuucccuacaaugcccacuccagacgcaaagauacacuuuuuuccu

SEQ ID NO: 43730 - RNA, 64 nt, hsa
cuaaaaugcagcuguuguuagacaacuguugaaaacuccagaaauacaucacccaagguggcag

SEQ ID NO: 43731 - RNA, 64 nt, hsa
aagccuccgcaggaugccggacaauggugaagaaacuccagauaucaaggaauugggaaauccu

SEQ ID NO: 43732 - RNA, 64 nt, hsa
ucagcaaaucucaugauaaaggacaaggucaagaacuccagagcacugagcagagaggcuggug

SEQ ID NO: 43733 - RNA, 64 nt, hsa
auuacuggguaaaagcagggcagcagggaacaaaacuccagacucuugggccguccccauuugc

SEQ ID NO: 43734 - RNA, 64 nt, hsa
caaccuaaaaauguaggcuuucauguugcaaagaacuccagagucaguaguuagguuugguuug

SEQ ID NO: 43735 - RNA, 64 nt, hsa
caguuuacugaacuccagaccaugcauguaguccacuccagaaaucaugcucgcuucccuuggc

SEQ ID NO: 43736 - RNA, 64 nt, hsa
uaagacuugggggugaaacuuuccaguuuacugaacuccagaccaugcauguaguccacuccag

SEQ ID NO: 43737 - RNA, 64 nt, hsa
ccuccucuacccaaagcucugucccccugcucccacuccagaagaacugcggcacgcgcuucgg

SEQ ID NO: 43738 - RNA, 64 nt, hsa
gucacugcccucucccugccugggggcuaugugcacuccagaccccugcccaggcucaggccca

SEQ ID NO: 43739 - RNA, 64 nt, hsa
cuucuggauacagccuuuuggguaaacacugggaacuccagaaguuguggggagaguggggaau

SEQ ID NO: 43740 - RNA, 64 nt, hsa
ugaaagacugcaauagaaaacucccaaacccagcacuccagacucgagggaagccagcuuccaa

SEQ ID NO: 43741 - RNA, 64 nt, hsa
agaaacucacccaaagccuguagccuccccaacuacuccagacuguccugcucacccuuuccuu

SEQ ID NO: 43742 - RNA, 64 nt, hsa
ggaaugccagaggagcaaggaugcagggcccaggacuccagagcugugaccuggcucugguuca

SEQ ID NO: 43743 - RNA, 64 nt, hsa
gaagguaacugagagcagaugguccuccauuucaacuccagaaguggggcucugggagggaugu

SEQ ID NO: 43744 - RNA, 64 nt, hsa
ccacccccuccagcuccaguuuccaaguuccugcacuccagaauccacaaagccgugccuuucu

SEQ ID NO: 43745 - RNA, 64 nt, hsa
cuucguccaaggcaccggugugugugugucuugcacuccagagcugaccuccaccgcccagccu

SEQ ID NO: 43746 - RNA, 64 nt, hsa
gugccacccagccacuuagggucuacagggugggacuccagaccuagagcguaaguauggaugu

SEQ ID NO: 43747 - RNA, 64 nt, hsa
gaugugacuuuuuuuuuaaagucaucucuucagcaauccagagguuccuugaccucauuauuug

SEQ ID NO: 43748 - RNA, 64 nt, hsa
gacagguuuuuuggaaacuguuaagauaaacuguaauccagacaccuaauucuucaguucacua

SEQ ID NO: 43749 - RNA, 64 nt, hsa
aauggaaccacuacuuauauacagauuuacaugcaauccagaucuuuaauuuugccuucacaaa

SEQ ID NO: 43750 - RNA, 64 nt, hsa
uaagauuagcuauuauuuguaggacugaaauaauaauccagauaauugguuuuugccuauacuu

SEQ ID NO: 43751 - RNA, 64 nt, hsa
uacaaaaaugauuguauuuaaagaaauuuuuuaaaauccagaaagucauuuaaaauagaaccuc

SEQ ID NO: 43752 - RNA, 64 nt, hsa
gauuucauaagucugccuugauucacugcucccuaauccagagcaguuaaauuucaaaaucaca

SEQ ID NO: 43753 - RNA, 64 nt, hsa
gccucagcccuggguggccagacucugugcucacaauccagagcaauggauccuccaacaccac

SEQ ID NO: 43754 - RNA, 64 nt, hsa
uacuuagaaccugaccagauguggcucggaggggaauccagacccgcugcugucuugcucuccc

SEQ ID NO: 43755 - RNA, 64 nt, hsa
aacaccaaagacggaagccaaauagguagccaaaaauccagauauuugagaagcaggaaauuua

SEQ ID NO: 43756 - RNA, 64 nt, hsa
uaagaauuuuacuuaggaaaaguauugaaguucaaauccagauaguauuacauuugaaauuguu

SEQ ID NO: 43757 - RNA, 64 nt, hsa
aauuuccaguggccugacaaugaacuacugcaggaauccagaugccgauacaggcccuuggugu

SEQ ID NO: 43758 - RNA, 64 nt, hsa
aauuugcaguggccugaccaggaacuacugcaggaauccagauucugggaaacaacccuggugu

SEQ ID NO: 43759 - RNA, 64 nt, hsa
aauuuccagugacuugaucaugaacuacugcaggaauccagauccuguggaaggcccuuggugu

SEQ ID NO: 43760 - RNA, 64 nt, hsa
cacauccauugauuuuacagggauuuuaguucguaauccagaaaguaauaaucagggauuuuau

SEQ ID NO: 43761 - RNA, 64 nt, hsa
guaauaaucagggauuuuauuuuaaucaggcaucaauccagauucacuguuauacugaaauauc

SEQ ID NO: 43762 - RNA, 64 nt, hsa
gaccuccagagaccauauuuucucucccuccauuucuacccagaccuccaggccuccuucugga

SEQ ID NO: 43763 - RNA, 64 nt, hsa
augccauagaggucaguuuuccucuuucuuggcuucuacccacaaacauucaccaaucauuuau

SEQ ID NO: 43764 - RNA, 64 nt, hsa
cgcagguuauccaccucugccuggaagucuauacucuacccagggcaucccucuggucagaggc

SEQ ID NO: 43765 - RNA, 64 nt, hsa
aagaauaacuugaucccugaugacagagccaacuucuacccauugcagcagaccaauguguaca

SEQ ID NO: 43766 - RNA, 64 nt, hsa
uuuuguuugaauuuauaaacaaggcugguggcugucuacccacccucccuucuagcagauuuug

SEQ ID NO: 43767 - RNA, 64 nt, hsa
acaaaccaaagugccugugacggggcggguggcgucuacccacccucccuucuagcagauucuu

SEQ ID NO: 43768 - RNA, 64 nt, hsa
uagaacuucagugggagagcugucugguucauauucuacccaggaaugguacuuuucagugcag

SEQ ID NO: 43769 - RNA, 64 nt, hsa
uugcacuguaggagauuuacuaauaucccuggccucuacccaguaguaccacuagcaccuauuc

SEQ ID NO: 43770 - RNA, 64 nt, hsa
gagaccagcauguucuccccaaagacuggaauauucuacccaaaugucaggaccaggauuuucu

SEQ ID NO: 43771 - RNA, 64 nt, hsa
ggaauauucuacccaaaugucaggaccaggauuuucuacccagagaccaagguguucuucccaa

SEQ ID NO: 43772 - RNA, 64 nt, hsa
gagaccaagguguucuucccaaagaccaaaauauucuacccauaugucaggaccaggauuuucu

SEQ ID NO: 43773 - RNA, 64 nt, hsa
aaaauauucuacccauaugucaggaccaggauuuucuacccagagaccaagguuaucuuccuaa

SEQ ID NO: 43774 - RNA, 64 nt, hsa
gagaccaagguuaucuuccuaaagaccaaaauauucuacccauaugucaggaccgggauuuucu

SEQ ID NO: 43775 - RNA, 64 nt, hsa
aaaauauucuacccauaugucaggaccgggauuuucuacccagagaccugcauguucucuccaa

SEQ ID NO: 43776 - RNA, 64 nt, hsa
gagaccugcauguucucuccaacgaccagaauauucuacccaaaugucaggaccaagauuuucu

SEQ ID NO: 43777 - RNA, 64 nt, hsa
uucugcacaucaugaugacuuuaccuccauucccucuacccagaacccuaaauuauucuguuau

SEQ ID NO: 43778 - RNA, 64 nt, hsa
uggauuggggagguuggucagggaagagagggguucuacccacagaucaacuguguaaucuuuu

SEQ ID NO: 43779 - RNA, 64 nt, hsa
uuagaagaauggaagguaaggggaaggucugucaucuacccaggacauucccaugaugaguaca

SEQ ID NO: 43780 - RNA, 64 nt, hsa
aaccaguauuucacuuuuaaaaagacaaggcaucucuacccauuaacucugcaagccacuccac

SEQ ID NO: 43781 - RNA, 64 nt, hsa
aacaaagaauauacauucuuuucaccccucccagucuacccauccagccuucaugauucauucc

SEQ ID NO: 43782 - RNA, 64 nt, hsa
ucuguaaaucagauaaaugcuuggaauuugauugucuacccaaucaacaguuuucccucuuugc

SEQ ID NO: 43783 - RNA, 64 nt, hsa
uauuugccuuggauucuguggauucuuuaaaccugugugcuaauaauucaaacaauguugcauu

SEQ ID NO: 43784 - RNA, 64 nt, hsa
gaacagaaaacuauaaacuuacuggggacaggaugugugcuaaagggcacagcaagacacuguc

SEQ ID NO: 43785 - RNA, 64 nt, hsa
cauuucuaccuagaguaccaguaaacaucucccagugugcuauaguagaaaaugucuacuccuc

SEQ ID NO: 43786 - RNA, 64 nt, hsa
auaccuuguuuaaagaauaauggcuuguucacgugugugcuaugaaaaaugaugucccauguuc

SEQ ID NO: 43787 - RNA, 64 nt, hsa
acagcuagcauguucacagauuugaaagaaguuucauuaaaagcaccauugcuuucuguacugc

SEQ ID NO: 43788 - RNA, 64 nt, hsa
acuaggccuuugaugcuuuaauucuucuucaguucauuaaaaguaacuacuaaggaaagguuaa

SEQ ID NO: 43789 - RNA, 64 nt, hsa
cuaacuuaguaaaguagaauaauuucaugguauucauuaaaaagcauaaaagucuuccucuugc

SEQ ID NO: 43790 - RNA, 64 nt, hsa
auaaaacauucuacccucaccuccaauauaaacacauuaaaagaguacaauaaaaauguuuaaa

SEQ ID NO: 43791 - RNA, 64 nt, hsa
cauuaaaauuaagauuuguuuucaaguggauguccauuaaaaguagaaaaauauuugggauaag

SEQ ID NO: 43792 - RNA, 64 nt, hsa
uaggcagcuggaaaaguauuugaaacuaaauugacauuaaaauuaagauuuguuuucaagugga

SEQ ID NO: 43793 - RNA, 64 nt, hsa
aucauguuguaaaguagcaucaguuguauccuuucauuaaaacuugauaaacaaaagaacgagu

SEQ ID NO: 43794 - RNA, 64 nt, hsa
aauaggugaagugcaagcuaguuucuauaaugaccauuaaaaaaauucugcuguguaauucuug

SEQ ID NO: 43795 - RNA, 64 nt, hsa
cauuucaguuguauuauaguccaguucuuaucaacauuaaaaccuauagcaaucauuucaaauc

SEQ ID NO: 43796 - RNA, 64 nt, hsa
gcaugugcaggagacauaucauccaaacauaaaccauuaaaauguuugugguuugcuuggcugu

SEQ ID NO: 43797 - RNA, 64 nt, hsa
uuuaugcuaauucugcuuauuuuagaguauuuuucauuaaaaggugagcaaagugaaagauacu

SEQ ID NO: 43798 - RNA, 64 nt, hsa
ugauguagaguagggcaaaucuguguguguaugucauuaaaaaaauucuaccaucuuucuuuau

SEQ ID NO: 43799 - RNA, 64 nt, hsa
ccauagcucuucacuuccuccagaagccuccuuacauuaaaaagccuuacaguuauccugcaag

SEQ ID NO: 43800 - RNA, 64 nt, hsa
ggacaggaaggucugauuugcaggauuuuuagagcauuaaaauaacuaucaggcagaagaaucu

SEQ ID NO: 43801 - RNA, 64 nt, hsa
ucagucugaugguucuguucuucauugugauugucauuaaaaagugguaaauugcucaauguaa

SEQ ID NO: 43802 - RNA, 64 nt, hsa
cuagaggaugugaucuaauuucuuucuagcucaucauuaaaaaggaaauuguaucaggacccau

SEQ ID NO: 43803 - RNA, 64 nt, hsa
uggagcacagguuugauauuuaugcuucuaaauacauuaaaacauuucugaauugcaguugaau

SEQ ID NO: 43804 - RNA, 64 nt, hsa
gugagacauuaaacauuuuagugcuaguuuaagccauuaaaaguaaaguuuaaguuuacgucau

SEQ ID NO: 43805 - RNA, 64 nt, hsa
uggcagcagcauuugaguccaugaaugcuauggucauuaaaauaauugauuauacuuuccuaaa

SEQ ID NO: 43806 - RNA, 64 nt, hsa
uaaagcugcagcuuucaacagguuuuaaaccuggcauuaaaauguaauggcaaaaccaauauuu

SEQ ID NO: 43807 - RNA, 64 nt, hsa
gguucugucccuggagacucuggaaauccuuuugcauuaaaaggacuuuacacaccuguguaaa

SEQ ID NO: 43808 - RNA, 64 nt, hsa
auuuggcccuauugaauuuucagggaccagaaaacauuaaaaaguucugcaucuuauaauggua

SEQ ID NO: 43809 - RNA, 64 nt, hsa
ucaaacuggccauuugacuucagagauuuguuuucauuaaaaaauaagccugccgccaaaauaa

SEQ ID NO: 43810 - RNA, 64 nt, hsa
auguuucaggcuuugugguccugaucaagguccucauuaaaaaauuggaguucacccuaggugc

SEQ ID NO: 43811 - RNA, 64 nt, hsa
aaugcaaucaguguaacuaggggcuguguuucugcauuaaaauaaauguuucaggcuuuguggu

SEQ ID NO: 43812 - RNA, 64 nt, hsa
uccucauucccuuuaacaugggggaaaaaacugacauuaaaagaugagacuaaaucuuuaucuu

SEQ ID NO: 43813 - RNA, 64 nt, hsa
cauuaaaauaauaucacaguaucaguggacuaaacauuaaaauguaccacucuaaucauuggcc

SEQ ID NO: 43814 - RNA, 64 nt, hsa
auaaaucuguaauaaaaaacuaaauuaaaccuugcauuaaaauaauaucacaguaucaguggac

SEQ ID NO: 43815 - RNA, 64 nt, hsa
augauaacugguaccuuaucuacuguaaauauuucauuaaaaaugaugcacacauagauauauu

SEQ ID NO: 43816 - RNA, 64 nt, hsa
uuuaauguuuuauuggcaacguaugcugcuuuuucauuaaaauaugcuauuaaaauuaaauggc

SEQ ID NO: 43817 - RNA, 64 nt, hsa
cugaggcaacuauggcauagaaauaaacauuugacauuaaaauaagcaguugaugugaguauug

SEQ ID NO: 43818 - RNA, 64 nt, hsa
cugggggccaggaauuggauucaguuuacacuaucauuaaaaaagagggagagagauaauaaac

SEQ ID NO: 43819 - RNA, 64 nt, hsa
uagucuugugccaauaagagaaguaaauaucaaacauuaaaauggucacuuuacaauuucagua

SEQ ID NO: 43820 - RNA, 64 nt, hsa
uagaauaucucacacauuuguaauggauaacgugcauuaaaauggaguucuuauuauagaauaa

SEQ ID NO: 43821 - RNA, 57 nt, hsa
caaccacuacaaccgugugauguaugccauuaaaaaaauuguuuuuuuaauuuucua

SEQ ID NO: 43822 - RNA, 64 nt, hsa
auauccuggguaugcauuauuuuaaauguuguaucauuaaaaaccucagaaugaugaaaaauau

SEQ ID NO: 43823 - RNA, 64 nt, hsa
uggcguauggcacucauuaaaaaggaucagagaccauuaaaagaggaccauaccuauuaaaaaa

SEQ ID NO: 43824 - RNA, 64 nt, hsa
caaaccugcaggcauaucauuggcguauggcacucauuaaaaaggaucagagaccauuaaaaga

SEQ ID NO: 43825 - RNA, 64 nt, hsa
cauaauguucuguuauacauaacauuaaaauguucauuaaaaucaauguugaacugcuuuuucu

SEQ ID NO: 43826 - RNA, 64 nt, hsa
uuccauuauauucauaauguucuguuauacauaacauuaaaauguucauuaaaaucaauguuga

SEQ ID NO: 43827 - RNA, 64 nt, hsa
auuuuuuuuuugggugucugcaaagguaaaaauccauuaaaaccuuaaguuaaauauaaauguu

SEQ ID NO: 43828 - RNA, 64 nt, hsa
acauuugcacaaucuaaaauguaagcaaaguagucauuaaaaauacacccucuacuugggcuuu

SEQ ID NO: 43829 - RNA, 64 nt, hsa
acuaaaaauacgaggaaaggagagugaggauuuucauuaaaagucucagcaguggguuucuugg

SEQ ID NO: 43830 - RNA, 64 nt, hsa
cuaaauaaauggcuuucaaacaaagcaacugggucauuaaaaccagcucaaaggggguuuaaaa

SEQ ID NO: 43831 - RNA, 64 nt, hsa
uuagaaagaccuauccaaauuagacagucaauuccauuaaaauaagaagugagaaaaacaaugu

SEQ ID NO: 43832 - RNA, 64 nt, hsa
uauggcgcauucaaaacagucucaguaacaaagacauuaaaagaaaacaauuuacuuucuaauu

SEQ ID NO: 43833 - RNA, 64 nt, hsa
caucugaagaaacuucccaaguguaagacucugccauuaaaacauuaccgagaggggacucaaa

SEQ ID NO: 43834 - RNA, 64 nt, hsa
aucucaauuuaguuuguuauuuauccuagugggccauuaaaaacuaccacauguguuucugucu

SEQ ID NO: 43835 - RNA, 64 nt, hsa
ucuccccuccccuccacaaaaaggagaaagagugcauuaaaauguuuaguuggguuuuuuaauu

SEQ ID NO: 43836 - RNA, 64 nt, hsa
guuaaguaaacuuuaguguguaaguugaguuugucauuaaaaucauaaaccagcugcgguaaca

SEQ ID NO: 43837 - RNA, 64 nt, hsa
ccugcaccuccgcagaccugcugugaugacuugccauuaaaagcauuguccaaaauccccuguu

SEQ ID NO: 43838 - RNA, 64 nt, hsa
cugacaauagugccaggaaacuaauuuccugauacauuaaaaaaauuccaugcaccacuugcaa

SEQ ID NO: 43839 - RNA, 64 nt, hsa
caaagugcagcagaguauuuauuuugaagagaaacauuaaaaguacaaagagguuuguaguacc

SEQ ID NO: 43840 - RNA, 64 nt, hsa
auuauuuaugaccuuuucuguggaagaguaagaacauuaaaaugaaagaugcaugaugaaaauc

SEQ ID NO: 43841 - RNA, 64 nt, hsa
agaccagacuuugugaaugguucagauauuuuuucauuaaaaaacaagguauggcagauggacu

SEQ ID NO: 43842 - RNA, 64 nt, hsa
uguccaugucuaauaaguaaaaacugauagaauacauuaaaaagucacugguuuaucauagaaa

SEQ ID NO: 43843 - RNA, 64 nt, hsa
aaauuacauuuauuaaaaaaguguguuccaaaggcauuaaaauuauauauguuaauaaggaagu

SEQ ID NO: 43844 - RNA, 64 nt, hsa
uaauaacaguggcucuaccuuuugacaucuggcucauuaaaaaauuuagcaauagaauguaaau

SEQ ID NO: 43845 - RNA, 64 nt, hsa
acuucucagcuucucccauagguaguuuaacaggcauuaaaauuuguaauugaaauguugcuuu

SEQ ID NO: 43846 - RNA, 64 nt, hsa
uuagccuaugguaguaauuuauguagaauaaaagcauuaaaaagaagcaaaucauuugcacucu

SEQ ID NO: 43847 - RNA, 64 nt, hsa
caaggcuccuuagauugggucguuacuaaaaguacauuaaaacacucuuguuuaucgaaguaua

SEQ ID NO: 43848 - RNA, 64 nt, hsa
auucuuuugcauugaugaauuuuguaucugcuuccauuaaaagcauaacagccauaguuguugc

SEQ ID NO: 43849 - RNA, 64 nt, hsa
gcuuucugaacucuaaugugccuucauugauuaucauuaaaauuaucauuaaaauugccuuauu

SEQ ID NO: 43850 - RNA, 64 nt, hsa
cuaaugugccuucauugauuaucauuaaaauuaucauuaaaauugccuuauuucuauggacuca

SEQ ID NO: 43851 - RNA, 64 nt, hsa
ucaauagucuauaaaaacaguuuuacuugcaauccauuaaaacaacaaacgaaaccuagugaag

SEQ ID NO: 43852 - RNA, 63 nt, hsa
uacaaauguuuaaauaaaauauugauuaaaaaaacauuaaaagugcaucaugaccaggugaaa

SEQ ID NO: 43853 - RNA, 64 nt, hsa
agcgagcccaagucauguaauugaaacuucuguacauuaaaagaacugauucaugaagacguuu

SEQ ID NO: 43854 - RNA, 64 nt, hsa
aaguuucuguuaugauugccauuucaauaaaugacauuaaaaaucuaaaggauauuauuguuug

SEQ ID NO: 43855 - RNA, 64 nt, hsa
accaggcagugaauaagcccuaggcagaauaaagcauuaaaauuucuuuuggggagagacuguc

SEQ ID NO: 43856 - RNA, 64 nt, hsa
aucuucauaccugcaaaaugguggaggcuauuuucauuaaaacugucagaauuugcuuacuaua

SEQ ID NO: 43857 - RNA, 64 nt, hsa
uuuauagcuuaucauucauguauuguccagcagacauuaaaagcccuguggauaauuaaguuau

SEQ ID NO: 43858 - RNA, 64 nt, hsa
uauuauggaagaauguauuugcagguaguaauagcauuaaaaaauauacucguguguaaacaca

SEQ ID NO: 43859 - RNA, 64 nt, hsa
aauagcaagaaaauugauguauauuuuaaugauacauuaaaauucccuuuuaaucauaauaguu

SEQ ID NO: 43860 - RNA, 64 nt, hsa
aaacagguuguggcuccuguugaauaagaugauccauuaaaaacugaacaagguugaggagaaa

SEQ ID NO: 43861 - RNA, 64 nt, hsa
uaaacaauuuuuuucuaacgugaaaaggauaaaacauuaaaaacucuugagaacuauaaaguga

SEQ ID NO: 43862 - RNA, 64 nt, hsa
uuuccauauuuuugaaagauuuuucagaugugaacauuaaaaauagggauuaaaugucuaggcu

SEQ ID NO: 43863 - RNA, 64 nt, hsa
uuuagugauauggcagcacggauauaacacuaugcauuaaaagcacuuuuuguaauaaguuuaa

SEQ ID NO: 43864 - RNA, 64 nt, hsa
uuuguuguuguuguuguuguuuucuuaaguguuacauuaaaacucuaaccaaggaaaggguucu

SEQ ID NO: 43865 - RNA, 64 nt, hsa
cauuuuuuccuuuacaauuuuaaacaaguuucuucauuaaaaacuauggugaugaaaugguuuu

SEQ ID NO: 43866 - RNA, 64 nt, hsa
aaaaaaagacugucaaaugaacuuuuacagaaugcauuaaaaaaaaaaaaaaacuccugugucg

SEQ ID NO: 43867 - RNA, 64 nt, hsa
uugauauaaucuuggcuucuuaaaaacuguguaucauuaaaauauauguucugcaagaauuaaa

SEQ ID NO: 43868 - RNA, 64 nt, hsa
uauuuaaucagcguguacuccauuugcauugaagcauuaaaaauuauuuuucuuaaaaucucuu

SEQ ID NO: 43869 - RNA, 64 nt, hsa
ucacucaguguuuguuaaauaaagcuauuagugucauuaaaauucaaaagacaguauaaugugu

SEQ ID NO: 43870 - RNA, 64 nt, hsa
guuuucauagugcuuucaaauacaccuuuuugaucauuaaaauaaaaaaauaaaucuugcucug

SEQ ID NO: 43871 - RNA, 64 nt, hsa
auauacccagucauaaaguauaagcaucaguugucauuaaaaguuuucagaaaaucuugagguu

SEQ ID NO: 43872 - RNA, 64 nt, hsa
aagccauuaaaagcuuggagauuacuguauuuggcauuaaaaaaaaaugucacuuaggucagca

SEQ ID NO: 43873 - RNA, 64 nt, hsa
cagauuucacauauucugucaucuuggcauaagccauuaaaagcuuggagauuacuguauuugg

SEQ ID NO: 43874 - RNA, 64 nt, hsa
caguccuuugcugcuauccacugugauuuuuaugcauuaaaagcacauuucauguguauucaac

SEQ ID NO: 43875 - RNA, 64 nt, hsa
ucuucuaguuugucuauuuuaauaaauggccuuacauuaaaaaauuguaaagaaauguauacca

SEQ ID NO: 43876 - RNA, 64 nt, hsa
aaauauuaccuaaauugguuagauacaaagaaaucauuaaaauuauuaauguauauaugaaaau

SEQ ID NO: 43877 - RNA, 64 nt, hsa
ugcuuuaugaagcuuuagaaaugagcucaugacucauuaaaaaauaauaaacgaugcuauuuua

SEQ ID NO: 43878 - RNA, 64 nt, hsa
gacuuuugaagaacaaaguaaaacuuuuuuuuuucauuaaaagaugucccagaggaaaggcccu

SEQ ID NO: 43879 - RNA, 64 nt, hsa
ucuguugaggaaaccuaggugucacuuuuuagaacauuaaaaagaaaguuguagggugggcuuu

SEQ ID NO: 43880 - RNA, 64 nt, hsa
aauucuguacagcuuuugauuauaacugcuuuagcauuaaaaauuguuuugaaagaagaacaca

SEQ ID NO: 43881 - RNA, 64 nt, hsa
gauuuguaggcaaagauguuaagagcauuguuuccauuaaaaucaauaacaaugaaaaacgguu

SEQ ID NO: 43882 - RNA, 64 nt, hsa
gaacaaaaacaccaaaucauuugaaaucacuguccauuaaaaaaaaucaccaguggaacuaaac

SEQ ID NO: 43883 - RNA, 64 nt, hsa
ucucggggacaacaucugaaggguauguugcaugcauuaaaaaaaaucaucucacaugcauuuu

SEQ ID NO: 43884 - RNA, 64 nt, hsa
acaauuuugacauguuuuccaagcucagaaagcucauuaaaaacaacuaaaacugaccugacuu

SEQ ID NO: 43885 - RNA, 64 nt, hsa
gccgaguuaccuggucacuguaauacugguucuccauuaaaauguagaugcuuugucuaauucc

SEQ ID NO: 43886 - RNA, 64 nt, hsa
gggaguucuagacuagccugggcgagacuucaucucuacaaaaaaagcaacaacgacaaaaaaa

SEQ ID NO: 43887 - RNA, 64 nt, hsa
aaguccaaucugggcaacauggggaaaccccagcucuacaaaaaaaauuagccugguguggugg

SEQ ID NO: 43888 - RNA, 64 nt, hsa
agauaaggucugaauaauagcagaaaaaccaacaucuacaaaacauuaaacuaguguuauacuu

SEQ ID NO: 43889 - RNA, 64 nt, hsa
aguguacuauagcggcauauagagcuagcuaaucucuacaaacccucuguaggccaguaguucu

SEQ ID NO: 43890 - RNA, 64 nt, hsa
aaucacagucugagcaacauggcaaaacccugugucuacaaaaaauaaaaaauuagcugggcau

SEQ ID NO: 43891 - RNA, 64 nt, hsa
aauuaugaaaucaaaagcugguucuuugaaaagaucuacaaaauggcaaacauuuagcuagauu

SEQ ID NO: 43892 - RNA, 64 nt, hsa
aaguauauacuuuuaaauuauggaguauuuuaagucuacaaaaagguauaaauaauaauauaau

SEQ ID NO: 43893 - RNA, 64 nt, hsa
gacaccagccugggcaacauagugagaccuugucucuacaaaaaauaaaauaaaauaaaaacca

SEQ ID NO: 43894 - RNA, 64 nt, hsa
gguggggaccuuggaaacaaguuuguccguccacucuacaaaguuuccuccucuccuacacuga

SEQ ID NO: 43895 - RNA, 64 nt, hsa
gagugcuaagagaaucacucuccuuaccuaguuaucuacaaauguucauuccagaaauguuuag

SEQ ID NO: 43896 - RNA, 64 nt, hsa
aaaaggcuuagauuuuuaaaauuuaauaauuauuucuacaaauuuucuauuuuucuugagguga

SEQ ID NO: 43897 - RNA, 64 nt, hsa
gcacuaccccaccuggcagcaccuagaccugagcucuacaaaaacacacugcuucacuuuguuu

SEQ ID NO: 43898 - RNA, 64 nt, hsa
aagaccagccugggcaaaguagggagaccccuucucuacaaauaguaauaaaaugaaccgggca

SEQ ID NO: 43899 - RNA, 64 nt, hsa
uauuuagcaguguaacuuuuagaccugcgugacaucuacaaagcgcccaauaaagaaagaggaa

SEQ ID NO: 43900 - RNA, 64 nt, hsa
ucuguuugucaguucauuccuguguguucuuaccucuacaaaguaaauuacacauuuaguuuuu

SEQ ID NO: 43901 - RNA, 64 nt, hsa
aggaguuuugagaccagccugggaaacaucugucucuacaaaaaaauacaaaaauuagcugggc

SEQ ID NO: 43902 - RNA, 64 nt, hsa
ucaagacaauccuggccaacggcgaaacucugucucuacaaaaaauauacaggcguguuagcau

SEQ ID NO: 43903 - RNA, 64 nt, hsa
aaggccagccugggcaacauggcaaaaccccauuucuacaaaaaauacaaaaauuagcugggca

SEQ ID NO: 43904 - RNA, 64 nt, hsa
uuaagaaacauaggcuaauucauacaugagagacucuacaaaccugaaagaugugacaaugcuu

SEQ ID NO: 43905 - RNA, 64 nt, hsa
aguaaacauaagaaaauucauacuggagagaaaaucuacaaaggugaagaauguggcaaagcuu

SEQ ID NO: 43906 - RNA, 64 nt, hsa
agaccagccugggcagaauggugaaaccaccuucucuacaaaaaauacauaaauuagcugggca

SEQ ID NO: 43907 - RNA, 64 nt, hsa
cucuuugugauuuucuacacagaagaucaugucaucuacaaagaaauaguuuuacuucuuucuu

SEQ ID NO: 43908 - RNA, 64 nt, hsa
auuuucuauuuuuguuuagaguuuguacacaaaaucuacaaauacauuacucuaaaauagcacc

SEQ ID NO: 43909 - RNA, 64 nt, hsa
agaauuugccugggcaguauagugagaucuuuucucuacaaaaaauuuaaaaauuagccaagug

SEQ ID NO: 43910 - RNA, 64 nt, hsa
guaacuuuucaaguaaaugcacaacuuuagaauuucuacaaauaaguucuuuuaaacagucuuu

SEQ ID NO: 43911 - RNA, 64 nt, hsa
accuuccuguauuuccacagagcaugcaagaacuucuacaaaacuucuauaccacacagaagcu

SEQ ID NO: 43912 - RNA, 64 nt, hsa
auauuucuuugagcacugugcuuuuaugugucuuucuacaaagggguuauuggucaguggaaga

SEQ ID NO: 43913 - RNA, 64 nt, hsa
gaauuuuauuaacuacaucuuuuggguucauccaucuacaaacacugauuaagggccccugggg

SEQ ID NO: 43914 - RNA, 64 nt, hsa
agaggccugugcaguagaguguagacccuuucauguacuguacuguacaccugauacuguaaac

SEQ ID NO: 43915 - RNA, 64 nt, hsa
ccugugcaguagaguguagacccuuucauguacuguacuguacaccugauacuguaaacauacu

SEQ ID NO: 43916 - RNA, 64 nt, hsa
ugcccuuuuuucauaccacaaaaguauuuuuugaguacuguacugacuuuuugcuaguuucuau

SEQ ID NO: 43917 - RNA, 64 nt, hsa
aauaggcugcaggucuccagagcauaucgaugcaguacuguacuagagcuguugugacugauuc

SEQ ID NO: 43918 - RNA, 64 nt, hsa
ugcggccaguauuagacuggaaguucauaccuaaguacuguaauaauaccucaauguuugagga

SEQ ID NO: 43919 - RNA, 64 nt, hsa
uuuuguauacaaauauauuguuaaucucuguuauguacuguacuaauucuuacacugccuguau

SEQ ID NO: 43920 - RNA, 64 nt, hsa
agcaaauaguuauuuuuugcacuugaacugaaacguacuguacuguaaauuaugacucauuuua

SEQ ID NO: 43921 - RNA, 64 nt, hsa
auaguuauuuuuugcacuugaacugaaacguacuguacuguaaauuaugacucauuuuaaguga

SEQ ID NO: 43922 - RNA, 64 nt, hsa
auuugugaaacugacuguaggaagucaaaaacuuguacuguaucuuguguuuacaguucugauu

SEQ ID NO: 43923 - RNA, 64 nt, hsa
aggaaaaauguacugaucauauaauuaacauuauguacuguauauaucauuuuagacacaucaa

SEQ ID NO: 43924 - RNA, 64 nt, hsa
augauuuuuuuuucuuacucauuucaccuucccuguacuguauguuuggaauugaucauaaaac

SEQ ID NO: 43925 - RNA, 64 nt, hsa
cucauucuuacccagggugcgcugcguccucaugguacuguaggcagcugaagaaccgccguuc

SEQ ID NO: 43926 - RNA, 64 nt, hsa
ugcuugugagaccauuagcauugcaggccaaaccguacuguauuuccuucucauaaccucaagg

SEQ ID NO: 43927 - RNA, 64 nt, hsa
acauccacgcuauuuauuaucgaggaguuuuaaaguacuguaacuuuaaaauaaauaacuacaa

SEQ ID NO: 43928 - RNA, 64 nt, hsa
ucuuagaagcucuaauuuuuguuuucuuuggcuaguacuguauaaaaaacagaauuguguuuua

SEQ ID NO: 43929 - RNA, 64 nt, hsa
uuauuaccaagcaucuuggucucucauucaacaaguacuguaucucacuuuaaacucuuugggg

SEQ ID NO: 43930 - RNA, 64 nt, hsa
guggcucucccuuaucauuuguauccagauuacuguacuguaggcuaaaauaacacaguauuua

SEQ ID NO: 43931 - RNA, 64 nt, hsa
caccucagcuggauugauuuccaaaugcuagcauguacuguaugggaggaugauccagauguuu

SEQ ID NO: 43932 - RNA, 64 nt, hsa
gaccuauuuaacaauuggugcauaaaugaaaguaguacuguauacuugaaacuguuuaaguaca

SEQ ID NO: 43933 - RNA, 64 nt, hsa
ucuaacuguggaauauaaauagcugaaaacuaauguacuguacauaaauuccagaggacucugc

SEQ ID NO: 43934 - RNA, 64 nt, hsa
caucuaaugaaaaacaaaaagcuaacaucuuuacguacuguaacugcucagagcuuuaaaagua

SEQ ID NO: 43935 - RNA, 64 nt, hsa
auuacacuauucuuauucuuuaguaacuuggguaguacuguaauauuuuuaaucaucuuaaagu

SEQ ID NO: 43936 - RNA, 64 nt, hsa
acacuuuguuaucaagcauauuuuaaaaagaacuguacuguaaauggaaugcuugacuuagcaa

SEQ ID NO: 43937 - RNA, 64 nt, hsa
gcuucacacagcuccccugcuucuaaaggauaagguacuguagccuugguccuggggaccaccu

SEQ ID NO: 43938 - RNA, 64 nt, hsa
aggaaacccugacuccuggggccauuuccuaaugguacuguaagccaagcagcuuugcuucugc

SEQ ID NO: 43939 - RNA, 64 nt, hsa
aaaugaugucucucugaauauccaaaaaaguacuguacuguagaaaugcucuuugaaaaagucu

SEQ ID NO: 43940 - RNA, 64 nt, hsa
ucuugaaaugaugucucucugaauauccaaaaaaguacuguacuguagaaaugcucuuugaaaa

SEQ ID NO: 43941 - RNA, 64 nt, hsa
uuacccaaccaaagagaucugaaguauguaugucguacuguaauggggguuuaugccuggacaa

SEQ ID NO: 43942 - RNA, 64 nt, hsa
uuucagaguucucaaaaauauuauuuuguugcauguacuguauguuuagaggcaaccaauuaua

SEQ ID NO: 43943 - RNA, 64 nt, hsa
cgcgccagauuuugaaaucucggagacaaaacuaguacuguaagauaaauuuuuuuguacugua

SEQ ID NO: 43944 - RNA, 64 nt, hsa
gagacaaaacuaguacuguaagauaaauuuuuuuguacuguauuuauuguguauaacgauuuuu

SEQ ID NO: 43945 - RNA, 64 nt, hsa
uuuccuaaacauugauaaagccuuuaaaauguuuguacuguaauacuuugcuuaaaagucauga

SEQ ID NO: 43946 - RNA, 64 nt, hsa
guuaaaaaaaagaacaaaaaaaaaaaaagaacuuguacuguauuuccuaaacauugauaaagcc

SEQ ID NO: 43947 - RNA, 64 nt, hsa
cacaauucuauauuuuaguauuuuuuaguaauuuguacuguauuuuccuugcaaauauuggagu

SEQ ID NO: 43948 - RNA, 64 nt, hsa
aaaacacuggaaaaagagacugaaaaaaagcaauguacuguacauuugccauauaauuuauauu

SEQ ID NO: 43949 - RNA, 64 nt, hsa
ugagacuucuccaagcugcuucacaagcaaacuaaccgaaaaaccgaaaauauacaaacagcuu

SEQ ID NO: 43950 - RNA, 64 nt, hsa
cuccaagcugcuucacaagcaaacuaaccgaaaaaccgaaaauauacaaacagcuucacacaca

SEQ ID NO: 43951 - RNA, 64 nt, hsa
uaaaauauacacuccuaagcaguauuauuuuaaaauccuuuacccuggcuaccuccccuacccg

SEQ ID NO: 43952 - RNA, 64 nt, hsa
ccauuauugauacaugugggcuuuuaaaaacuccauccuuuauaaauagucaagguuugggcca

SEQ ID NO: 43953 - RNA, 64 nt, hsa
cuacagcaggcauggauuguuuaugucguaugauauccuuuauuaaguaaguucacuuauagua

SEQ ID NO: 43954 - RNA, 64 nt, hsa
aguuacaucuggaaaugagcauuugaaauagauaauccuuuaagccuuguggcaaaauuuuugu

SEQ ID NO: 43955 - RNA, 64 nt, hsa
uaagcuuaugcaguuuauacuguauuuuuuauguauccuuuauauuuaccaaaccugacucccu

SEQ ID NO: 43956 - RNA, 64 nt, hsa
uaagagaauagaauuuucauuuguuuuucuuuaaauccuuuacuaauuauauaauuugaaagca

SEQ ID NO: 43957 - RNA, 64 nt, hsa
aaaguaucugauggagcuccugaugaccuaauguauccuuuagaaauuuaaaauagcauuagag

SEQ ID NO: 43958 - RNA, 64 nt, hsa
cuugucauguugguuuccaacaguccuuucgauuauccuuuauuuucuuauccucccuucucuu

SEQ ID NO: 43959 - RNA, 64 nt, hsa
uuaucacuguucaaagcacugucaaauuccuuucauccuuuaauaguuaagaucuuugaaucuu

SEQ ID NO: 43960 - RNA, 64 nt, hsa
ccucuugcccuguaccuuuccuucccauuaggacauccuuuaaauuauaagcauccuuuuugaa

SEQ ID NO: 43961 - RNA, 64 nt, hsa
guucugguggggaauuuaaaaaugcauccuggaaauccuuuaaagauuucagacuuugaaaggc

SEQ ID NO: 43962 - RNA, 64 nt, hsa
aacagaaaugucucaugacuuuuuuauguguaccauccuuuaauagaucucauacaccagaauu

SEQ ID NO: 43963 - RNA, 64 nt, hsa
uaugugcuuuaagugcugcucuaccugaaaagaaauccuuuaaauuaccuauggaagugauguc

SEQ ID NO: 43964 - RNA, 64 nt, hsa
aagugguuuggguuuguuguuuaaccuuagcgagauccuuuaacugcagcaauauucaagccag

SEQ ID NO: 43965 - RNA, 64 nt, hsa
uaaaauauaauacuuuuaaaaagaaaauuauuacauccuuuacauucaguuaagaucaaaccuc

SEQ ID NO: 43966 - RNA, 64 nt, hsa
augaagcuuaaauuacucaauuuaaaauuuuaaaauccuuuaaaacaacuuuucaauuaauauu

SEQ ID NO: 43967 - RNA, 64 nt, hsa
gguuuguaauaugggucuugguggguuuuguuuuauccuuuaaauuuuguucccaugaguuuug

SEQ ID NO: 43968 - RNA, 64 nt, hsa
aucuuuuauauauugcugcaguuuccuuauguuaauccuuuaacacuaagguaacaugacauaa

SEQ ID NO: 43969 - RNA, 64 nt, hsa
cagaagucuguuaauauugcuguuuugaaggacaauccuuuauuuuacuugagaccuuacaucu

SEQ ID NO: 43970 - RNA, 64 nt, hsa
agcuggcacccaucccagggcuccucuggagcuaauccuuuaagcaaaaugugcuugccuuuua

SEQ ID NO: 43971 - RNA, 64 nt, hsa
uccuguuuauggucaauaacuguuacuuuuaaguauccuuuaauaccuguaccuuuuguuuuag

SEQ ID NO: 43972 - RNA, 64 nt, hsa
aucauagauaaucacugucaaacuuuuggagcaaauccuuuaauacuaucucucauuguuuugg

SEQ ID NO: 43973 - RNA, 64 nt, hsa
gagaaaggccuuaugaauguagugaaugugggaaauccuuuagcuuaagguccaaccucauuca

SEQ ID NO: 43974 - RNA, 64 nt, hsa
cuggagaaaggcaugagugcgggcagugugggaaauccuuuagccgaaaaucuagccuuauuau

SEQ ID NO: 43975 - RNA, 64 nt, hsa
auccuacuucaagauggugguggcaauagucaggagaagguaacauuggaguccugguuugauu

SEQ ID NO: 43976 - RNA, 64 nt, hsa
uacguauacaauaaaacuaugcuauuaaaaaaaaagaagguaacugauaaaccaaaauugagca

SEQ ID NO: 43977 - RNA, 64 nt, hsa
uuuugaguuuuauugugguggugauuuucucaugagaagguagacaacacuucaguuuuucuug

SEQ ID NO: 43978 - RNA, 64 nt, hsa
guggauuggaccaaaaacuucuaaucacuuauuuagaagguauuuauaagugucuguccaugug

SEQ ID NO: 43979 - RNA, 64 nt, hsa
cuauuaaugugcacccagcuggucuccccaggcaagaagguauccucuucccaagguguaccca

SEQ ID NO: 43980 - RNA, 64 nt, hsa
gaaauaaucagguaaguuaaaaguucauuuccagagaagguaaaccccacuuaccaucucugca

SEQ ID NO: 43981 - RNA, 64 nt, hsa
cguugcuugauugagcuuauuacucucuauuuugagaagguagaagguaagagggcccauauuc

SEQ ID NO: 43982 - RNA, 64 nt, hsa
ugauugagcuuauuacucucuauuuugagaagguagaagguaagagggcccauauucauucuuu

SEQ ID NO: 43983 - RNA, 64 nt, hsa
uugcauuucugaguauuauguaaccuauuuuugcagaagguacuguuacauuaagugcaucugu

SEQ ID NO: 43984 - RNA, 64 nt, hsa
cugaaaaaaaagaaagcaaggauacuaagaaaauagaagguaaagaugagaagaaugauaaugg

SEQ ID NO: 43985 - RNA, 64 nt, hsa
gagagauacuuaggaaauccuaaaagaggcggcaagaagguaccucccuguguaacucaccuuc

SEQ ID NO: 43986 - RNA, 64 nt, hsa
aagaguaaacauuacucaguggaaagcuaaguucagaagguacuuuguuuuuccucccuugccu

SEQ ID NO: 43987 - RNA, 64 nt, hsa
aucaaucagaagguauucugaccuugugaacaucagaagguauuuuuuaacucccaagcaguag

SEQ ID NO: 43988 - RNA, 64 nt, hsa
uuuagauuuaaugaugcuucaguggaaaucaaucagaagguauucugaccuugugaacaucaga

SEQ ID NO: 43989 - RNA, 64 nt, hsa
guugccaaagguaauuuaggaagggucugaucauuuagaugagaguucuuuggggcuuauuuuc

SEQ ID NO: 43990 - RNA, 64 nt, hsa
aaggaugaauccauguuauuguauuguaaauaauuuagaugauuaaaauggauuguuuaaaaag

SEQ ID NO: 43991 - RNA, 64 nt, hsa
uagaaggcagcgccuccucuucacucuccucugauuagaugaaacuguuaccuuacccuaaaca

SEQ ID NO: 43992 - RNA, 64 nt, hsa
aaccacuggaauuuuucaaugccgucauuuucaguuagaugauuuugcacuuugagauuaaaau

SEQ ID NO: 43993 - RNA, 64 nt, hsa
uaugcuauaccaaucugcaguaaaaaaaauuuuuuuagaugauucuauauaacuucgucucaca

SEQ ID NO: 43994 - RNA, 64 nt, hsa
agcaaguauggugcuaaagucuacaccaauggaauuagaugagugcuaugcacuuaauuuuaaa

SEQ ID NO: 43995 - RNA, 64 nt, hsa
aagcaacuuuuguagaugcuguuucauacagcacuuagaugaauuauugaucuuccuaauauca

SEQ ID NO: 43996 - RNA, 64 nt, hsa
uuauccuuauauuuuucuaaagguaaauuauuuguuagaugaguaagcaagauaccauugucgu

SEQ ID NO: 43997 - RNA, 64 nt, hsa
ugaauauuguccugugaaaagaauagcaggacuuuuagaugaaaaguauucuuaaaaagaaaag

SEQ ID NO: 43998 - RNA, 64 nt, hsa
ugaaagugcacguuaaaccugagcgccuuuaccuuuagaugagugcuuuggccccucugugaau

SEQ ID NO: 43999 - RNA, 64 nt, hsa
ugucucuccucuagguaucguauuuuguugcucaagaauccaaaaugggucuguggacauaggg

SEQ ID NO: 44000 - RNA, 64 nt, hsa
cagagauuacacaguuaggaugcugacacagucuagaauccauaaugcucccuacaucucacac

SEQ ID NO: 44001 - RNA, 64 nt, hsa
uaggauaacuaaaauucugggccuaauuuuuuaaagaauccaagacaaacuaaacuuuacuagg

SEQ ID NO: 44002 - RNA, 64 nt, hsa
cauauguuuauucaaaauauuuuaucuuuuagcuagaauccacacauauauauccuauuugauu

SEQ ID NO: 44003 - RNA, 64 nt, hsa
uaguauuuuucuuuucacacaaucucuuuacagcagaauccagaguuggauuguaguuuaccuu

SEQ ID NO: 44004 - RNA, 64 nt, hsa
ucucugauuggcuuccaaccacugggauucaaagagaauccaagguucugccuaugucugauga

SEQ ID NO: 44005 - RNA, 64 nt, hsa
ggugucccauaccagcuuuuaaugguggaccuauagaauccaguacuuuuaauggugggaauuu

SEQ ID NO: 44006 - RNA, 64 nt, hsa
uugucaacauacagacuucaaaauaccccuuaugagaauccaaagaaugauguguguaagggaa

SEQ ID NO: 44007 - RNA, 64 nt, hsa
agccucugugagcucgcaccuuacugggugcaaaagaauccacggaacuugggagaaguccagu

SEQ ID NO: 44008 - RNA, 64 nt, hsa
ccgguauccacucucaucuucuuccaauaucaagagaauccagguucugucagauuaguaaggu

SEQ ID NO: 44009 - RNA, 64 nt, hsa
guuuacuucacauucacaccucaauagacaucagagaauccaugcuggacagaaaucuuacaaa

SEQ ID NO: 44010 - RNA, 64 nt, hsa
uuucaguaaugcuacaaccauugcaaaucauuggagaauccauaaugagagaucuuacaagugu

SEQ ID NO: 44011 - RNA, 64 nt, hsa
guuuacuucacauucacaccucauuagacaucagagaauccaugcuggacagaaaucuuacaaa

SEQ ID NO: 44012 - RNA, 64 nt, hsa
uuucaguaaugcuacaaccauugcacaucauuggagaauccacagugaagagaucuuacaagug

SEQ ID NO: 44013 - RNA, 64 nt, hsa
uggcagcuccaucuuccauuccugguuuuagggcagaauccauggagacugcuuccagaaggca

SEQ ID NO: 44014 - RNA, 64 nt, hsa
uugaaggcaguucccaccgaguuuuccgagccucagaauccaggagauacgcacagccccaccc

SEQ ID NO: 44015 - RNA, 64 nt, hsa
auaauguuuauucaaaguauuuuaucuuuuaucuagaauccacauauguauguccaauuugauu

SEQ ID NO: 44016 - RNA, 64 nt, hsa
uaggauaacuaaaauucugggccuaauuuuuuaaagaauccaagacaaacuaaacuuuacuggg

SEQ ID NO: 44017 - RNA, 64 nt, hsa; identical to SEQ ID NO: 44015

SEQ ID NO: 44018 - RNA, 64 nt, hsa; identical to SEQ ID NO: 44016

SEQ ID NO: 44019 - RNA, 64 nt, hsa
acacacaguucgucucugaggaaaguaaaauaaauggaauaagaguaaauuggguaaggagaua

SEQ ID NO: 44020 - RNA, 64 nt, hsa
gguucucauaucagagucaucauuuuucuuccuguggaauaaaaugccuuguggacuucccaaa

SEQ ID NO: 44021 - RNA, 64 nt, hsa
uaagugguccaggaguccaaguaagcagucuggcuggaauaaggcagcaucacggaaauucugu

SEQ ID NO: 44022 - RNA, 64 nt, hsa
ucuaacacauacuagagcaagaauuuacuugauuuggaauaauuaauagcuacuggacauuaua

SEQ ID NO: 44023 - RNA, 64 nt, hsa
ccucauccuguggaauaagaaaaugggauagaucuggaauaaaugugcaguauuguaguauuac

SEQ ID NO: 44024 - RNA, 64 nt, hsa
acauuuguaaccuggcacaguuucccucauccuguggaauaagaaaaugggauagaucuggaau

SEQ ID NO: 44025 - RNA, 64 nt, hsa
cucauuccugauuauuuccuuagauuuccagguauggaauaauuagguugaaguguuugaaauc

SEQ ID NO: 44026 - RNA, 64 nt, hsa
uuguauuaguggcuguauaguuuucuaucaaauguggaauaaacucaauuuauuucucccuuuu

SEQ ID NO: 44027 - RNA, 64 nt, hsa
ugacaguccaccugccgaccugauuccugcaucauggaauaaccacauggcuaccuucuauccu

SEQ ID NO: 44028 - RNA, 64 nt, hsa
agguaguucaugaaaaugcugugcacucauuccauggaauaaauguuggaaagcugaucuuuuc

SEQ ID NO: 44029 - RNA, 64 nt, hsa
caagaaaauuaaaugguaccacucuuccacaguuuggaauaauuuuauaauuguaaagauagaa

SEQ ID NO: 44030 - RNA, 64 nt, hsa
aaggauggagcccaaaauugcagagcaguaacuuuggaauaaaaccaggguggguauaaaacuu

SEQ ID NO: 44031 - RNA, 64 nt, hsa
agacaucauuggguucuuacuuuaagacaucuccuggaauaacuguucaaaugcagguuuuaga

SEQ ID NO: 44032 - RNA, 64 nt, hsa
uauuauacuuucaaaugacacauaguaaggagaauggaauaauacauguugcauauuuguuacc

SEQ ID NO: 44033 - RNA, 64 nt, hsa
ucagcugucacuguuguuuucuuguaacaugauauggaauaaaguauagcagaaucuccguaca

SEQ ID NO: 44034 - RNA, 64 nt, hsa; identical to SEQ ID NO: 44028

SEQ ID NO: 44035 - RNA, 64 nt, hsa
ugacaguccaccugccggccugauuccugcaucauggaauaaccacauggcuaccuucuauccu

SEQ ID NO: 44036 - RNA, 64 nt, hsa
uaaucaacggggaaaacaucuucuccaaaaaacuuggaauaaauccaaggaccaguuuuuaccc

SEQ ID NO: 44037 - RNA, 64 nt, hsa
ucaacacaaaauaaacuagaaggccagaggauaauggaauaaaagaucauugcaauuacuuauc

SEQ ID NO: 44038 - RNA, 64 nt, hsa
aauuuaaaugauauuuagguuuuuggcugaguacuggaauaaacagugagcauaucugguauau

SEQ ID NO: 44039 - RNA, 64 nt, hsa
uuguaacuuagcuuuauuuuucuuuuccugggaauggaauaacuaucucacuuccagauaucca

SEQ ID NO: 44040 - RNA, 64 nt, hsa
gcaacagagcaagacccugucucaaagcauaaaauggaauaacauaucaaaugaaacagggaaa

SEQ ID NO: 44041 - RNA, 64 nt, hsa
aaaguaugguacaucuaccuaaaggacuauuauguggaauaauacauacuaaugaaguauuaca

SEQ ID NO: 44042 - RNA, 64 nt, hsa
ucccgcuaauggaagaaguuuagaaucuuucagguggaauaaagucacaugaaaacaaaacaca

SEQ ID NO: 44043 - RNA, 64 nt, hsa
ccaucucucaagccccaaggacuggagccaccucuggaauaauguguuaaauaucuguauauua

SEQ ID NO: 44044 - RNA, 64 nt, hsa
gaacacuguguuacuuuacaagggcuuaugugacuggaauaagguggucccacuugacuguucc

SEQ ID NO: 44045 - RNA, 64 nt, hsa
ccuuuuuuuccaccauuaaggcuuuaagaacauguggaauaaguuuuuuagcugcuaaugacaa

SEQ ID NO: 44046 - RNA, 64 nt, hsa
uggggguugcggggggagggauggcggguggggguggaauaaaauacuauuuuuacugccacuc

SEQ ID NO: 44047 - RNA, 51 nt, hsa
agggagaagaugaugacuaaguggaauaaccuauuuugaaaaauuccuauu

SEQ ID NO: 44048 - RNA, 64 nt, hsa
ggcaggggcagaaaacucuggcaggcuuaagauuuggaauaaagucacagaauuaaggaagcac

SEQ ID NO: 44049 - RNA, 64 nt, hsa
uucuuccaguuuagaaucagccuugaaacauugauggaauaacucuguggcauuauugcauuau

SEQ ID NO: 44050 - RNA, 64 nt, hsa
aaaaggaaagaaaacuugaugugauugccauagguggaauaauccaacauaaauugccauagau

SEQ ID NO: 44051 - RNA, 64 nt, hsa
gcggcuguaacaugucucuugacaguagugcacuuggaauaauaaagguugggugauuauaucu

SEQ ID NO: 44052 - RNA, 64 nt, hsa
gaaguccacaccaccaucuacaaagccuuauugcuggaauaaugaacugaaagcagacagggac

SEQ ID NO: 44053 - RNA, 64 nt, hsa
aggauuagaaaaaucaccauuuucuagaccuuaauggaauaauggguccagaaaacaugaucuu

SEQ ID NO: 44054 - RNA, 64 nt, hsa
ggcuucuggcccaaaccccaagcagaaaagaaaauggaauaauggagcauuguuuuuccacauu

SEQ ID NO: 44055 - RNA, 64 nt, hsa
ugcccaaaauauaaaaguguggaacuuuagaacuuggaauaauuuuauugcagucuuccauuac

SEQ ID NO: 44056 - RNA, 59 nt, hsa
uccguagccuugaagauuagaagccuugaagauuacaacugugauuuccuuuuccucag

SEQ ID NO: 44057 - RNA, 64 nt, hsa
agagaauucaggauaguuuuguuuaaauucuugcagauuacauguuuuuacaguggccugcuau

SEQ ID NO: 44058 - RNA, 64 nt, hsa
cagacagucucacaaguaaacaccagcagcucauagauuacaaccaagaaagugacuguaucag

SEQ ID NO: 44059 - RNA, 64 nt, hsa
agcaauccuaccaccuuggccucccaaagugcugagauuacaggcaugagccauugcaccuggc

SEQ ID NO: 44060 - RNA, 64 nt, hsa
acacuuucgaggauuugcagugcgucuagcaccuagauuacagccaggaacauugguuaagaac

SEQ ID NO: 44061 - RNA, 63 nt, hsa
ucucucucuuuuaggaauaauaaauaugaaguaagauuacaacagagcagaacuugcacccac

SEQ ID NO: 44062 - RNA, 64 nt, hsa
guaauuggcuccaauucauaauauguucaccaggagauuacaauuuuuugcucuucuugucuuu

SEQ ID NO: 44063 - RNA, 64 nt, hsa
ugcugaauugaacauuuugaaguuuauagcuuccagauuacaaaggccaaggguaauagaaaug

SEQ ID NO: 44064 - RNA, 64 nt, hsa
uaagagauuaagaauauugcccaaauaauauuuuagauuacaggauuaauauauugaacaccuu

SEQ ID NO: 44065 - RNA, 64 nt, hsa
aguuauacuucuugguucacauuuuggaaaucagagauuacagauuacauggccauagcuuauc

SEQ ID NO: 44066 - RNA, 64 nt, hsa
cuucuugguucacauuuuggaaaucagagauuacagauuacauggccauagcuuaucuguguua

SEQ ID NO: 44067 - RNA, 64 nt, hsa
agugauucuccugccucauccucccaagaagcugagauuacagaugaccaccaccacuccuggc

SEQ ID NO: 44068 - RNA, 64 nt, hsa
ggugauccaccugccucagccucccaaagugcugagauuacaggcaugagccaccacgcccagc

SEQ ID NO: 44069 - RNA, 64 nt, hsa
ggcgauucuccugccucagcuucccgaguaacugagauuacaggcacccaccaccaugcccagc

SEQ ID NO: 44070 - RNA, 64 nt, hsa
ggugaucuaccugccucagccucccaaagugcugagauuacagacaugagccuccgcgccuugc

SEQ ID NO: 44071 - RNA, 64 nt, hsa
acaaauggauagagaagaaaagggucaaacaucgagauuacauggauguuaaauuauauggaga

SEQ ID NO: 44072 - RNA, 64 nt, hsa
aaaauuauuuuauuuaacuuuaagcaauaacuagagauuacaauuaaauuuuaaucaaaaugaa

SEQ ID NO: 44073 - RNA, 64 nt, hsa
agaggacauaugauucuuuccaagaugaacuugaagauuacauaaaagugcagaaagccagagg

SEQ ID NO: 44074 - RNA, 64 nt, hsa
agaagacauaugacucuuuccaagaugaacuugaagauuacaucaaaguacagaaagccagagg

SEQ ID NO: 44075 - RNA, 64 nt, hsa
ggaagacacaagacucuuaccaaaaugagugugcagauuacaucaaugugcagaaagccagagg

SEQ ID NO: 44076 - RNA, 64 nt, hsa
uuuguuaggccaagaagcaagagaguauuccuaguauucccaaccaugaaaaguaucauucuuu

SEQ ID NO: 44077 - RNA, 64 nt, hsa
uugcaagggcaguuuuucuugcauggguucucuauauucccagaguauguggcacaaucugugu

SEQ ID NO: 44078 - RNA, 64 nt, hsa
caauaaaugaaugaauggccuucccuucucaggcuauucccaccauuagucugcccaccuuucu

SEQ ID NO: 44079 - RNA, 64 nt, hsa
ucuuugcccaccucuaugacccagccucuugcaguauucccauacuugaugcagggaaggaacc

SEQ ID NO: 44080 - RNA, 64 nt, hsa
gccugcuaaaucauuguaugugucuguaguauucuauucccagaaacuauuugaccaugauaau

SEQ ID NO: 44081 - RNA, 64 nt, hsa
accuuucuaguaguuuaugauauugcccucuuuguauucccauuuucuacaguuuuuuccgcag

SEQ ID NO: 44082 - RNA, 64 nt, hsa
gccaccauccuauugcaaagguuccaacuguauauauucccaauagcaacguagcuucuaccau

SEQ ID NO: 44083 - RNA, 64 nt, hsa
uucauugagaguuuugucuugaaugucuuuugaauauucccaagcccaugaguccuugaaaaua

SEQ ID NO: 44084 - RNA, 64 nt, hsa
uauucuaauauuccuucuagucaguggaaauuuguauucccauacaaacucagaaugcuauauu

SEQ ID NO: 44085 - RNA, 64 nt, hsa
agaacuuacgcauccaauguggguugucacuuguuauucccaaguacuauuauuccauacuacu

SEQ ID NO: 44086 - RNA, 64 nt, hsa
aaucaugcaguauugaguuaugacuuguuaaaucuauucccaugccagaaucuuaucaauacau

SEQ ID NO: 44087 - RNA, 64 nt, hsa
cuagugcccucuuuucccuagggcauugcucuccuauucccacgccuuaacacagcucuauacc

SEQ ID NO: 44088 - RNA, 64 nt, hsa
auaucuuuaaaggagagaugucaacuuucugcacuauucccagccucugcuccucccugucuac

SEQ ID NO: 44089 - RNA, 64 nt, hsa
ucauagccagagaugguuuuccacuccuucuagauauucccaaaaagaggcugagacaggaggu

SEQ ID NO: 44090 - RNA, 64 nt, hsa
acaacuuuguaaggguuucuaagcuaugcccauuuauucccaaauauuaagcccuuaaaaaaau

SEQ ID NO: 44091 - RNA, 64 nt, hsa
uagaauccaugucagauuggugcuuccagacaucuauucccaguccaucagagugaaaugaagg

SEQ ID NO: 44092 - RNA, 64 nt, hsa
gcacugaaauauguauuuuaaugaugaucuuauuuauucccauuuuugcccuuaguuaacauuu

SEQ ID NO: 44093 - RNA, 64 nt, hsa
uuuuccuuauacaucucaaugcugagaguuaaaauauucccagguuaaaauuuuuuuaaaguac

SEQ ID NO: 44094 - RNA, 64 nt, hsa
aucuugguguuaauagaccaaauaaauaaauaaauauucccagcagcuugaaguucuguuaaau

SEQ ID NO: 44095 - RNA, 64 nt, hsa
agaccauaagauagaucccccauccucucagcccuauucccaugccucccucucauuggaggag

SEQ ID NO: 44096 - RNA, 64 nt, hsa
ccaugacccuaagaaguuuccucaugucuauuaauauucccaauccuaggcaccacugaguugu

SEQ ID NO: 44097 - RNA, 64 nt, hsa
aaacagucaaacuguuuuccaacgugacauuuuauauucccaccaggaauguuuaaaacuagug

SEQ ID NO: 44098 - RNA, 64 nt, hsa
gaaaacuuuaacaaacaggcugauaucuucauaauauucccagccuagaccaagcaggaagaac

SEQ ID NO: 44099 - RNA, 64 nt, hsa
ucuggcauucagagaagagucaggaaaacaauuguauucccagccugugucccaugggcacaag

SEQ ID NO: 44100 - RNA, 64 nt, hsa
gcccuuucugcacagcuggugucggcaucauacuaaaagcaauguuuaaaucaaacuaaagauu

SEQ ID NO: 44101 - RNA, 64 nt, hsa
guguguguuuuuuuuuuuuuuuuuuuuguuguuuaaaagcaaggcaugcuuguggaugacucug

SEQ ID NO: 44102 - RNA, 64 nt, hsa
caaacuuuuuuuagaauugaagucugaaacaaacaaaagcaauucaaugucaauagacauuaag

SEQ ID NO: 44103 - RNA, 64 nt, hsa
auuaaucccauuaucucaggaguguguugguuauaaaagcaaguuuggcucccucuuuuccuca

SEQ ID NO: 44104 - RNA, 64 nt, hsa
gauaaguuccaaauauguuaagggcuuuaauacaaaaagcaaaaauugucaguguuuggaugaa

SEQ ID NO: 44105 - RNA, 64 nt, hsa
acaauaagaaugaaucucagaaaauauuaaggaaaaaagcaaguuugaagagaccacauggggc

SEQ ID NO: 44106 - RNA, 64 nt, hsa
caaacuaguggucaaggacuaacuccuaaaaaaaaaaagcaacucuuaucaaggauuaauuuaa

SEQ ID NO: 44107 - RNA, 64 nt, hsa
acuaaauaaaacccaucagcaugggguuauguagaaaagcaauuuauuccauuuuaagcacuua

SEQ ID NO: 44108 - RNA, 64 nt, hsa
gggaccuauccuugucuugaaaguuuguugcuuuaaaagcaaguaucucuccauaaauauuaug

SEQ ID NO: 44109 - RNA, 64 nt, hsa
ucaggaaccagcggaucugcaaagaccuacaaucaaaagcaaauccccauuuuccuuuuauaaa

SEQ ID NO: 44110 - RNA, 64 nt, hsa
agagagcagagcaugcagugauggaagaagcaggaaaagcaagaagaaaagacagcagcaucaa

SEQ ID NO: 44111 - RNA, 64 nt, hsa
gaagcacccagaacaugcugagcagaacaucagaaaaagcaagaagaagaaaaggcgacaucaa

SEQ ID NO: 44112 - RNA, 64 nt, hsa
uauaagugauaguuuauuguagugauguuuuuauaaaagcaaaaggauauucacuuucagcgcu

SEQ ID NO: 44113 - RNA, 64 nt, hsa
agagcuggagaugcaagcucuaggcugcgcuuccaaaagcaaaugauaauuauguuaaugucau

SEQ ID NO: 44114 - RNA, 64 nt, hsa
auuuuaagacaucuauuuuaugcuuuuguuuaaaaaaagcaaaucuauuuucaaauugugcaau

SEQ ID NO: 44115 - RNA, 64 nt, hsa
caccugccccgggagggcagcggggaagacagagaaaagcaaacgcauuccuccucagcuccac

SEQ ID NO: 44116 - RNA, 64 nt, hsa
gacacacauuccuuugaaauccacccaguguuuaaaaagcaacuuggaaauuuacacauuagca

SEQ ID NO: 44117 - RNA, 64 nt, hsa
auccuuucuuaguuauuugcuccuugcaaauuaaaaaagcaacuaagagaaagaaaaacauugu

SEQ ID NO: 44118 - RNA, 64 nt, hsa
ugugcucugccuggagcuguuuccauaugauauaaaaagcaaguguaguauuccauuacuaugu

SEQ ID NO: 44119 - RNA, 64 nt, hsa
gagucccucaggaaaaaaaaaaaauucuguuuuaaaaagcaaucugauucuuagcucuugaaac

SEQ ID NO: 44120 - RNA, 64 nt, hsa
uguguauuguaaguagcaguuaaauuauuuuuuuaaaagcaauuucaguuuuaaucacugaaca

SEQ ID NO: 44121 - RNA, 64 nt, hsa
uccucuuauuuuucaguuuccagucaagauuauaaaaagcaaaugauugauauaauuugauauu

SEQ ID NO: 44122 - RNA, 64 nt, hsa
ggaaugaagaaggcaaaaaauaucuuuuguacagaaaagcaagaugaaaaggaugugaaauggu

SEQ ID NO: 44123 - RNA, 64 nt, hsa
ggucuaugauguguuuacuuuaaaaauugcuguuaaaagcaacacguauuaaauauguaauuau

SEQ ID NO: 44124 - RNA, 64 nt, hsa
caaggggaaggaccauuucguaauggucugacacaaaagcaaguuugauuuuugcagcacuagc

SEQ ID NO: 44125 - RNA, 64 nt, hsa
cacuugcaguguuacgaucggaaugcuuuuuauuaaaagcaaguagcaugaaguauugcuuaaa

SEQ ID NO: 44126 - RNA, 64 nt, hsa
cucacaagcaucuuugucuugcaaauccuaagggaaaagcaagucccugcagugagcacuaggg

SEQ ID NO: 44127 - RNA, 64 nt, hsa
acuuccgaauagaauguuuucuuuaagaggcaugaaaagcaacuauuguuguguuacaguguua

SEQ ID NO: 44128 - RNA, 64 nt, hsa
cucaguaagcagcuugccaaucacuccaggucugaaaagcaagucccccagccccaccccaggg

SEQ ID NO: 44129 - RNA, 64 nt, hsa
aaaagugauuuaaaaaugaucuuaccuguaccagaaaagcaaaguuaaaggaaacaaaauuugu

SEQ ID NO: 44130 - RNA, 64 nt, hsa
cuuugcauuuaugauuucuccagaaauuuaccacaaaagcaaaauuuuuaaaacugcauuuuua

SEQ ID NO: 44131 - RNA, 64 nt, hsa
aaggauuuuuuaaaaauuggcauuuuaaguguuuaaaagcaaauacugauuuucaaaaaaaugu

SEQ ID NO: 44132 - RNA, 64 nt, hsa
aaagggaguuacagaggcugcuuaaaagauggagaaaagcaaaacccaguauuuaaagucuaua

SEQ ID NO: 44133 - RNA, 64 nt, hsa
aaaugccuacuauuuuauaugcauauauuaaaagaaaagcaaagaccugagccgaggagaggau

SEQ ID NO: 44134 - RNA, 64 nt, hsa
ucaaaagaugucaguguuauaccuaaagcuaaaaaaaagcaaggguuugucauagagggaaccu

SEQ ID NO: 44135 - RNA, 64 nt, hsa
uuagaggucaaggaccuuccuguguaguuggugcaaaagcaaucuccacaggacagcacugcuu

SEQ ID NO: 44136 - RNA, 64 nt, hsa
uugaagauuuagaaguuauauaaaaaauuaauuuaaaagcaaaccaaaagagguuuccauuaac

SEQ ID NO: 44137 - RNA, 64 nt, hsa
ucugagugauugucaguguaaggccuuuuaaaacaaaagcaaguucuuuguuaggaauugguca

SEQ ID NO: 44138 - RNA, 64 nt, hsa
aguguuuugccaauuaauauuauaugcuuguaauaaaagcaaaagaaaagcuuaagugaaagug

SEQ ID NO: 44139 - RNA, 64 nt, hsa
cuaucaucauauggacucuauguaacacaaauucaaaagcaaacuaaaagcuauaugcagaguu

SEQ ID NO: 44140 - RNA, 64 nt, hsa
uaaaauaaaaaauauuugucuccaccuuuuccccaaaagcaacagcaagacauauuuuguuaga

SEQ ID NO: 44141 - RNA, 64 nt, hsa
uugaugauuuucuuuuaaagaaauuaguuuauuuaaaagcaagauagccuggguugggaguuag

SEQ ID NO: 44142 - RNA, 64 nt, hsa
gcugaauagguuuaagucagauaauagauuuuaaaaaagcaaaugaggcaaugugucaaaauuu

SEQ ID NO: 44143 - RNA, 64 nt, hsa
ugcauuaaaauuucaaaguuuaauuaauauaauuaaaagcaacagcaagcagcagccugugaag

SEQ ID NO: 44144 - RNA, 64 nt, hsa
uacaagaaaguuuguuugaauguguagaagaggaaaaagcaacaacagcaacaacacgaagaug

SEQ ID NO: 44145 - RNA, 64 nt, hsa
gccaagcaaaaaucaggcugagaaaaagcaaaagaaaagcaaaaaaaagaagaagaaacagcag

SEQ ID NO: 44146 - RNA, 64 nt, hsa
aagaaaaagaagccaagcaaaaaucaggcugagaaaaagcaaaagaaaagcaaaaaaaagaaga

SEQ ID NO: 44147 - RNA, 64 nt, hsa
aaugccaagguaauuuuaaauuuacauuuuuaauaaaagcaacauguugaaacaagagagggug

SEQ ID NO: 44148 - RNA, 64 nt, hsa
cuauacagcugucacucauuuguaguaaaacuuaaaaagcaaaaacaaaaaacaaaaaagaccu

SEQ ID NO: 44149 - RNA, 64 nt, hsa
acacuaugcacugcuguaacugguaguguucaguaaaagcaaaaugauaguuuucuagaugaca

SEQ ID NO: 44150 - RNA, 64 nt, hsa
augaauuaaagcaacaaaaagauauugauuggcaaaaagcaagauauaagagauucauuugcuu

SEQ ID NO: 44151 - RNA, 64 nt, hsa
aagcaucaggcugagauuugcacacaugggauguaaaagcaagcuguguguugcuuagucacuu

SEQ ID NO: 44152 - RNA, 64 nt, hsa
ugccaucugaaguucauuaaucuuuagaugacaaaaaagcaaaaaguucccagaacguuuuugc

SEQ ID NO: 44153 - RNA, 64 nt, hsa
uccuacuuaaauuuuaaguuaugagguuuaugucaaaagcaacauuucacaaauguacuuuuaa

SEQ ID NO: 44154 - RNA, 64 nt, hsa
gaugcccuuacugugccaaaacaaaaaucuuaagaaaagcaaguagacaccuucauaacuauga

SEQ ID NO: 44155 - RNA, 64 nt, hsa
uuagugaaaguauugaaaauacuaaauuauaacuaaaagcaacuuuuuauguuauugaaaauau

SEQ ID NO: 44156 - RNA, 64 nt, hsa
gagugucccauugcugccaaaaauacacgucuuuaaaagcaacaaaaauugaaauaagacaucg

SEQ ID NO: 44157 - RNA, 64 nt, hsa
uuccauuucuauacuuuaugggacacuagaaacuaaaagcaacaaauaaucugauauaaguccu

SEQ ID NO: 44158 - RNA, 64 nt, hsa
uagcagugagaagaaaccucaggaaaggauaugaaaaagcaaguggccagugucugggauacug

SEQ ID NO: 44159 - RNA, 64 nt, hsa
cacacaacucugagaauacccacugccagcaucaaaaagcaaagauacuaauuuuuuaagccaa

SEQ ID NO: 44160 - RNA, 64 nt, hsa
aguaguaccaaaaagguauuuuccuuucucauuuaaaagcaaaaaccucccuuuuuaauugccu

SEQ ID NO: 44161 - RNA, 64 nt, hsa
ggaccauaacuggcaaaauccuuaguguacggacaaaagcaaauuggaaaagccagccauuuac

SEQ ID NO: 44162 - RNA, 64 nt, hsa
ugaagaaauauuuuaaggaaaccuauuugaaaaaaaaagcaaagaccauuugauaaaagccuga

SEQ ID NO: 44163 - RNA, 64 nt, hsa
gaauaauagaaaaauucuacuuuaauuuccauuaaaaagcaaauagcauugacacauuuaaagc

SEQ ID NO: 44164 - RNA, 64 nt, hsa
cagauuuacaaguguaagcuauaugauuucuucaaaaagcaaaagcaauauaccuaauucauuu

SEQ ID NO: 44165 - RNA, 64 nt, hsa
uacaaguguaagcuauaugauuucuucaaaaagcaaaagcaauauaccuaauucauuuggauca

SEQ ID NO: 44166 - RNA, 64 nt, hsa
auuuaugcuguacauuucaguucaguguaugaccaaaagcaauauguuuauaagaagauguuug

SEQ ID NO: 44167 - RNA, 64 nt, hsa
cugguguucuaccugcaagaugugcagagggcauaaaagcaaaucaacacuuuauaguuauucu

SEQ ID NO: 44168 - RNA, 64 nt, hsa
guguaccuuucagcauccuaggaauuuuuauacuaaaagcaaaauguuuuuuccaguuagucuu

SEQ ID NO: 44169 - RNA, 64 nt, hsa
ggaacauugguuaagaacuguuggaaacaaaacuaaaagcaaacucaacauaugugauguuuau

SEQ ID NO: 44170 - RNA, 64 nt, hsa
uguguuauaugacaggacaaagcaaaaacaaacaaaaagcaagccugugaauauaauuuaauuu

SEQ ID NO: 44171 - RNA, 64 nt, hsa
uguuguuuucuguggguugcgacccaugcaaucaaaaagcaaaauuuugauugagauuuuuuac

SEQ ID NO: 44172 - RNA, 64 nt, hsa
guggcauuuucauuacaggagaguuuacuaugcuaaaagcaaaaaacaaaaaaaaaaaaaaagg

SEQ ID NO: 44173 - RNA, 64 nt, hsa
gguuugcauuuuuuaacauaaucuaagacagaaaaaaagcaauuuuuacuauguaacaauggua

SEQ ID NO: 44174 - RNA, 64 nt, hsa
ugaauaagaaaauaauguuuaaagaaaaaaaaaaaaaagcaaaccuccaaaacguggaccuaac

SEQ ID NO: 44175 - RNA, 64 nt, hsa
uuaugacuuggauauaugguugaagaaucaaaacaaaagcaaaaaaaaaaagcaaaaaaagaaa

SEQ ID NO: 44176 - RNA, 64 nt, hsa
auaugguugaagaaucaaaacaaaagcaaaaaaaaaaagcaaaaaaagaaaagagaaaaaaaga

SEQ ID NO: 44177 - RNA, 64 nt, hsa
agugaagagaugcaagacuuucaacugacuggcaaaaagcaagcuuuagcuugucuuauaggau

SEQ ID NO: 44178 - RNA, 64 nt, hsa
uacucaacuaccucagguauucaguaauacaaugaaaagcaaaauuguuccuuuuuuuugaaaa

SEQ ID NO: 44179 - RNA, 64 nt, hsa
auauccauggcaagcuuuguauauaaaugaacaaaaaagcaagcaaagcaaaacaauaaacuag

SEQ ID NO: 44180 - RNA, 64 nt, hsa
uucauaaaacauguaacacugaucuucagauagaaaaagcaaucuguuuauuuaccuguaaggg

SEQ ID NO: 44181 - RNA, 64 nt, hsa
ucagaugaacucugcuguuuagaaguaaccacagaaaagcaaagucaguguacacucugaguga

SEQ ID NO: 44182 - RNA, 64 nt, hsa
uuaacucauuuccuugagcuuauacaaaacauagaaaagcaaacuguuaaaguagucaauaauu

SEQ ID NO: 44183 - RNA, 64 nt, hsa
aggaugaccuggcaaauaagaucuugaauaggccaaaagcaaguaucuugcuguguguagucuc

SEQ ID NO: 44184 - RNA, 64 nt, hsa
auuggguauuagaaaucugaaaguacugucaucuaaaagcaauugugauuuuauuguaauuggu

SEQ ID NO: 44185 - RNA, 64 nt, hsa
uuugccuagcaagaaucacauucguuucccagugaaaagcaaaccagaacaaaacaaaaagcca

SEQ ID NO: 44186 - RNA, 64 nt, hsa
ucugauuauuuguauugaagaaaacaaauuuaccaaaagcaaaagcauaaaccccucccucuuu

SEQ ID NO: 44187 - RNA, 64 nt, hsa
uuuccuuuuaccuuucuccaccauccagagccacaaaagcaaaccuucuaccuccuaccuacuu

SEQ ID NO: 44188 - RNA, 64 nt, hsa
ucagcauauacauuucagccaaagccauagaagaaaaagcaauaguugcuugaauuaugaucau

SEQ ID NO: 44189 - RNA, 64 nt, hsa
ugaaaucagaagaacaaaaaagaagagcaagagaaaaagcaaauuugguaaguugugugugcuc

SEQ ID NO: 44190 - RNA, 64 nt, hsa
ccagauuuuuuauaugucugcauguuuaaaaaaaaaaagcaacaaaagaaaaugcacucuaacu

SEQ ID NO: 44191 - RNA, 64 nt, hsa
ugcugaauacuuuuuauaaugugaugauuauuaaaaaagcaaaaauuuuggucacuuccaagcu

SEQ ID NO: 44192 - RNA, 64 nt, hsa
aauacuucaguaauaauuauguauguuauggcuuaaaagcaaguuucagugaaggucaccuggc

SEQ ID NO: 44193 - RNA, 64 nt, hsa
aaauuuagauugguccuuuucaaaauucaaaaaaaaaagcaacaucuucauagaugaaugaaac

SEQ ID NO: 44194 - RNA, 64 nt, hsa
ugauaauaucacaacccagaaguaaccaccuuuaaaaagcaacccccauguaugccuauaugug

SEQ ID NO: 44195 - RNA, 64 nt, hsa
ucauagaaaacuugaaaaaugcagaaauguauaaaaaagcaaaaaugauuacugauaauaucac

SEQ ID NO: 44196 - RNA, 64 nt, hsa
gcgcauaccugcuuccaagaauaaaacaguucugaaaagcaaccgcaaagccgggcgcgguggc

SEQ ID NO: 44197 - RNA, 64 nt, hsa
aaaaaaaaagaaagaaagaaagagaaaagaaaagaaaagcaaccacagccagccuuagggaaaa

SEQ ID NO: 44198 - RNA, 64 nt, hsa
ggauuacaagcugucucucugacaccagugguaaaaaagcaaguagaauaguuucugagucugu

SEQ ID NO: 44199 - RNA, 64 nt, hsa
uaggggccauaucauucauggccaaaaaaaaccaaaaagcaaaaaacaaaaacaagucccaugu

SEQ ID NO: 44200 - RNA, 64 nt, hsa
augacuuagcuauuaguauauuuaaaaacuguucaaaagcaaaagagaaggaacaggaaugaaa

SEQ ID NO: 44201 - RNA, 64 nt, hsa
caauugucuaauuuacagcaguugugaucccacaaaaagcaaguuuauaccucagauuggggua

SEQ ID NO: 44202 - RNA, 64 nt, hsa
caguaaauccaugucuuuguuuguuuuucuauuaaaaagcaaucaagaaagauaaugugaaaaa

SEQ ID NO: 44203 - RNA, 64 nt, hsa
aggcccagacaggcucacucaagcucuuuaacugaaaagcaacaagccacuccaggacaagguu

SEQ ID NO: 44204 - RNA, 64 nt, hsa
ggaguaggagagaggaaacauuugacuuaucuggaaaagcaaaauguacuuaagaauaagaaua

SEQ ID NO: 44205 - RNA, 64 nt, hsa
uuuagaaguuaaaccacccgauaggccuucgagcaaaagcaaagauccaccgagagaagaagag

SEQ ID NO: 44206 - RNA, 64 nt, hsa
auucgucauccaaguccaggucuagaucacacucaaaagcaaagcauucucuucccagugccua

SEQ ID NO: 44207 - RNA, 64 nt, hsa
uuauucagugaauuacacauccucuuguucuuaaaaaagcaagugucuuugguguuggaggaca

SEQ ID NO: 44208 - RNA, 64 nt, hsa
acauauauauuuuuggaaaauggagcuaugguguaaaagcaacagguggaucaacccaguuguu

SEQ ID NO: 44209 - RNA, 64 nt, hsa
auguucacugaauaaauaaguaaauacauuauugaaaagcaaaucuguauaaaugugaaauuuu

SEQ ID NO: 44210 - RNA, 64 nt, hsa
agauccaacuauuucuuucaucagaaaaaguccgaaaagcaaaccuuaauuugaaauaacagcc

SEQ ID NO: 44211 - RNA, 64 nt, hsa
acugcuccagugaaaugugguacuuuuuucuuuuaaaagcaaccaagagagcugggaauaucug

SEQ ID NO: 44212 - RNA, 64 nt, hsa
cucugcaacagaauaugacaccaucuucccaggcaaaagcaacaucugguugaccaugauuuua

SEQ ID NO: 44213 - RNA, 64 nt, hsa
uaacuauuccuguguaaaaacaacaaaaacaaacaaaagcaagaaaaccacaacuaaaacugga

SEQ ID NO: 44214 - RNA, 64 nt, hsa
agagggaaggaauaaucauucaaaugaacuuuaaaaaagcaaauuucaugcacugauuaaaaua

SEQ ID NO: 44215 - RNA, 64 nt, hsa
cuaagacaugugaggaggaaaaggaaaaaaagcaaaaagcaagggagaaaagagaaaccgggag

SEQ ID NO: 44216 - RNA, 64 nt, hsa
agcaggccuaagacaugugaggaggaaaaggaaaaaaagcaaaaagcaagggagaaaagagaaa

SEQ ID NO: 44217 - RNA, 64 nt, hsa
aauguuguuuuaaaagaaaauagcaaaacaacaaaaaagcaaaccuuaaaaugugaagaaagug

SEQ ID NO: 44218 - RNA, 64 nt, hsa
aacaauaaacugguuguauggccauagcuauccgaaaagcaagagacaaagcaagacaaauauu

SEQ ID NO: 44219 - RNA, 64 nt, hsa
caaaagcaaaguaaucuuacaacuaugugcauacaaaagcaauacuauuuugugacuaaauauu

SEQ ID NO: 44220 - RNA, 64 nt, hsa
gaguuuuaugaaagaugguauaguuuuuauugacaaaagcaaaguaaucuuacaacuaugugca

SEQ ID NO: 44221 - RNA, 64 nt, hsa
gguaaaagggaugcuagaaauucaacugaagaaaaaaagcaagucaaguacguauucagcauua

SEQ ID NO: 44222 - RNA, 64 nt, hsa
aaagagcucccaucugaucugcagucauuacagaaaaagcaaauauucccucaacaucagaaca

SEQ ID NO: 44223 - RNA, 64 nt, hsa
acaugacuuggaacugaacuaacauuuuucuuuaaaaagcaaaacuuaaaaaaaaaaaaaaaga

SEQ ID NO: 44224 - RNA, 64 nt, hsa
agaggguggacggagcggggcccauucucaggucaaaagcaagauuucuacugucaugugggau

SEQ ID NO: 44225 - RNA, 64 nt, hsa
uaccggacacaccucugcuccaaaggaaauccaaaaaagcaaacacaagaaaucaaaauccaaa

SEQ ID NO: 44226 - RNA, 64 nt, hsa
uggcuuuaaguaaaaauccaaaaaguuuuuuuaaaaaagcaaaggaagcauacuugugaacuac

SEQ ID NO: 44227 - RNA, 64 nt, hsa
ucuuggcauuggaauucuacuggaaaaaaauacaaaaagcaaaacaaaacccucagcacuguua

SEQ ID NO: 44228 - RNA, 64 nt, hsa
cauagggucacuuugccauuaugcaaauggagauaaaagcaauucugacuguccaggagcuaau

SEQ ID NO: 44229 - RNA, 64 nt, hsa
cuuccuggaaguaauuguaagcauccugaaauaaaaaagcaagaauaugaagaaguaguucaga

SEQ ID NO: 44230 - RNA, 64 nt, hsa
cagaaugaauguagaaaaggcugaauucuguaauaaaagcaaacagccuggcuuagcaaggagc

SEQ ID NO: 44231 - RNA, 64 nt, hsa
auuuugucucauuugccaaaaaaaaaaaaaaaaaaaaagcaaacccccuaugguugauauuguu

SEQ ID NO: 44232 - RNA, 64 nt, hsa
uccagaaccuuuuugccuuuuuuuguuccccgugaaaagcaacauggacauuuccuucuagucc

SEQ ID NO: 44233 - RNA, 64 nt, hsa
ugaggcucuuucuauaaauacauauuguuuaaaaaaaagcaagaaaaaaaggaaaacaaaggaa

SEQ ID NO: 44234 - RNA, 64 nt, hsa
gcaacagagcgagacccugucuccaaaaaaaaaaaaaagcaauguuuauauuauaaaagagugu

SEQ ID NO: 44235 - RNA, 64 nt, hsa
uuauuuggaaccagaaaagcccaaccuaaauagcaaaagcaauccuaagcaaaaagagcaaugu

SEQ ID NO: 44236 - RNA, 64 nt, hsa
aaaucaaaacauagaugcuagugaggcugcagagaaaagcaaauacuuauacacugcugguggg

SEQ ID NO: 44237 - RNA, 64 nt, hsa
aaaccaccuuuugaagcagcaacuaucaagucugaaaagcaauugauguuuccauuaaucuuuu

SEQ ID NO: 44238 - RNA, 64 nt, hsa
cacuaaaugcugaaauguggaugcauaccgaaauaaaagcaauucauuguguacuaaagguuuu

SEQ ID NO: 44239 - RNA, 64 nt, hsa
ucagugaucagaauagauauccuuuuacacgcacaaaagcaauagauucauucaguggacaagu

SEQ ID NO: 44240 - RNA, 64 nt, hsa
auuuacauaguaaguuucacacuaccuuauuaccaaaagcaaacaccucuuacuuuaaacuaca

SEQ ID NO: 44241 - RNA, 64 nt, hsa
agcacuuuuuaaaacaaacaaacaaacaaaacaaaaaagcaaaccacauuuguuaucucaaauu

SEQ ID NO: 44242 - RNA, 64 nt, hsa
gcugcugacucacacugcuaacucuguuacugacaaaagcaaaucaauaacucuaaauucuggg

SEQ ID NO: 44243 - RNA, 64 nt, hsa
gauaaugggcuuuguuagcacuuucaaaaaaaaaaaaagcaaaccauacuuguccacuguccug

SEQ ID NO: 44244 - RNA, 64 nt, hsa
uccaccagggggaaggcuggcacaaggagaaaaaaaaagcaagcaucagcgaauaguauagugu

SEQ ID NO: 44245 - RNA, 64 nt, hsa
acauguaggguuggugagaaggaaagaugagaacaaaagcaacauuggguuaagggaacucgcu

SEQ ID NO: 44246 - RNA, 64 nt, hsa
uuagucuaacuuaaacggaugggauucacuuaacaaaagcaagaagaaaagcacacgaacaggu

SEQ ID NO: 44247 - RNA, 64 nt, hsa
acuuaaagaccaaaucauuuguuugcuuugaagaaaaagcaaaaacaagaacaaaaacaccaaa

SEQ ID NO: 44248 - RNA, 64 nt, hsa
ggauuucuauucaccuuuaauauauuuuuacaaaaaaagcaaacaauuuaaaaacaagcccacc

SEQ ID NO: 44249 - RNA, 64 nt, hsa
gcccccuguuuguuguuuuguguuguuuccaaugaaaagcaaguuuacccucagaguuaugcuu

SEQ ID NO: 44250 - RNA, 64 nt, hsa
uucuagcauauauguguccauuuccuuaugcuguaaaagcaaguccugcaaccaaacucccauc

SEQ ID NO: 44251 - RNA, 64 nt, hsa
gcucuccuagguagcccccucuucccugguaagaaaaagcaaaaggcauuucccacccugaaca

SEQ ID NO: 44252 - RNA, 64 nt, hsa
gcaauagaaugaugucugcucuagggaaaccuucaaaagcaauaaaaaugcuguguugaaaugc

SEQ ID NO: 44253 - RNA, 64 nt, hsa
aaaauguaacugcuaaucaagggugaugcacagcaaaagcaauggaccccaucccucuaaagcc

SEQ ID NO: 44254 - RNA, 64 nt, hsa
ggauuuaguuaggucauuaagauguugaucacacagcuucaaucacaauaugccaaguauaacc

SEQ ID NO: 44255 - RNA, 64 nt, hsa
uugcucuuuugguuuuuaacuuccuccauacauaagcuucaaggacaauaagauguuaaaaagg

SEQ ID NO: 44256 - RNA, 64 nt, hsa
uggcuaagagugcagcagagacugaggcauagccagcuucaaaagcgaucugacaugaaaguca

SEQ ID NO: 44257 - RNA, 64 nt, hsa
aacgagcuuguuucccugaaccucagaaauccucagcuucaaacauggggaaacaggccagagc

SEQ ID NO: 44258 - RNA, 64 nt, hsa
ugaagagccacucagaaaaggcccauggccauggagcuucaaggaaagaaaccccucaguuuuu

SEQ ID NO: 44259 - RNA, 64 nt, hsa
uucucaaacuccaaugcucacaaagcugaaaagaagcuucaaaacauugaucacccucucacaa

SEQ ID NO: 44260 - RNA, 64 nt, hsa
gagaagguugcuucauuggcccugggacuucucucugcaggaggagagaacgcugccucuccuc

SEQ ID NO: 44261 - RNA, 64 nt, hsa
uggccuuuggucagcguuuccacauccugcucugcugcaggagagggggcuaaggggcuggauc

SEQ ID NO: 44262 - RNA, 64 nt, hsa
ucaugucuguugugaccaggaaagcugcccccaucugcaggaagccacuaugccagaaagcugc

SEQ ID NO: 44263 - RNA, 64 nt, hsa
aaagcugaugcagagcccauuagccuaaaagcaacugcaggacaagccucccuggaugaucgag

SEQ ID NO: 44264 - RNA, 64 nt, hsa
augcaucacauuguucucuggugcuguaauuuggcugcaggagcuaggcugaaugccucccagg

SEQ ID NO: 44265 - RNA, 64 nt, hsa
ucccguauuucauuucugcacccagggggcggcucugcaggauugcuuacggagaacucugugu

SEQ ID NO: 44266 - RNA, 64 nt, hsa
augaaaagcucaggaucucucccaaggcuaccuacugcaggagggccaacaggugagaugggaa

SEQ ID NO: 44267 - RNA, 64 nt, hsa
ugugguugguucuagccccugcagagccugggagcugcaggaacugucugagaaaaucucccua

SEQ ID NO: 44268 - RNA, 64 nt, hsa
ucucccuugcucuuccccaaacugaaaauaccuacugcaggaucccucggggcacacugaagcu

SEQ ID NO: 44269 - RNA, 64 nt, hsa
uggguagaggaugcugaacugacucagcacccuccugcaggacgggguuagggaauuuggugcu

SEQ ID NO: 44270 - RNA, 64 nt, hsa
ugcgaugugugccccaaagcagaacuuacagggccugcaggaagcuggugucagggagagaaac

SEQ ID NO: 44271 - RNA, 64 nt, hsa
uuacugcagacaaaacuucuugucuggaagaguucugcaggaaauggccagccucaaacgacaa

SEQ ID NO: 44272 - RNA, 64 nt, hsa
agugaagagcagcaggcuguguuuguaaaaccuccugcaggaguaacuaagauuauaauuucca

SEQ ID NO: 44273 - RNA, 64 nt, hsa
uucccagcaggugaacagcucggagaagcugcagcugcaggagugcuugugggcuggugaguug

SEQ ID NO: 44274 - RNA, 64 nt, hsa
cguggcuugguuucacgcgcagcggcgccagacccugcaggagggcggcgugguggucuugcuc

SEQ ID NO: 44275 - RNA, 64 nt, hsa
gcuuuggaauuuccaguggccugacaaugaacuacugcaggaauccagaugccgauacaggccc

SEQ ID NO: 44276 - RNA, 64 nt, hsa
guucuggaauuugcaguggccugaccaggaacuacugcaggaauccagauucugggaaacaacc

SEQ ID NO: 44277 - RNA, 64 nt, hsa
cuuuuggaauuuccagugacuugaucaugaacuacugcaggaauccagauccuguggaaggccc

SEQ ID NO: 44278 - RNA, 60 nt, hsa
ugugauuuucaguggcuugaucuccaacuacugcaggaauccggauuguucggcaggccc

SEQ ID NO: 44279 - RNA, 64 nt, hsa
cuugaggagcugcagcaguaggcaugugcucagucugcaggaauuguuaccucacucccacagg

SEQ ID NO: 44280 - RNA, 64 nt, hsa
ggcaaagagcuacugaguaacgaugaaagcgaggcugcaggacugaagaagucgcacucgaguc

SEQ ID NO: 44281 - RNA, 64 nt, hsa
ccccggcccagggcugccaggaacaaguuccucucugcaggaucucacagcagcccugagaaga

SEQ ID NO: 44282 - RNA, 64 nt, hsa
gucugcaaggacgcagaauaagcagugagggcggcugcaggagaggaaggggcucccacagccc

SEQ ID NO: 44283 - RNA, 64 nt, hsa
ggcaaaaugccaccaggcuuugucccccauggcucugcaggaccugauggagaaggugaugguu

SEQ ID NO: 44284 - RNA, 64 nt, hsa
cacagaaucugaauuccugaugcgaucagcugagcugcaggaggccuugggaucaggaaaucua

SEQ ID NO: 44285 - RNA, 64 nt, hsa
gccugcucaugggguccuaaagcgcgggcuaagccugcaggaaagccggggcgguggggggggc

SEQ ID NO: 44286 - RNA, 64 nt, hsa
ugaagggcguccgcuggccacucugcaggggccccugcaggauuccaggcaccucccguuuguc

SEQ ID NO: 44287 - RNA, 64 nt, hsa
gcaugcggccacucggcaggccgcgggcauccggcugcaggaccagguggugaucaucgacgag

SEQ ID NO: 44288 - RNA, 64 nt, hsa
gggcaugcccuuccccaacaucaggucugcagagcugcaggagaagauggccuacuuggaucaa

SEQ ID NO: 44289 - RNA, 64 nt, hsa
ccccaccugugacugcagcaucuucccaccagugcugcaggaggcgacagaagucaaauauauc

SEQ ID NO: 44290 - RNA, 64 nt, hsa
aauuucugccuucuugacggcgaccagguggcugcugcaggagcuggugcugugagugggggua

SEQ ID NO: 44291 - RNA, 64 nt, hsa
cgaguucccccagcccuucaucaccaacccgcuccugcaggagugagucuuaccuccccuggcc

SEQ ID NO: 44292 - RNA, 64 nt, hsa
cacuucugcugggaacucccugacuauuccgcugcugcaggaacccagcuagcuggccaggugg

SEQ ID NO: 44293 - RNA, 64 nt, hsa
cuggugagaggaggaccuugugccugcccagagccugcaggacagcacgccuugaggucagagg

SEQ ID NO: 44294 - RNA, 64 nt, hsa
ucagaaacaacccgugcaucccugcccauggauucugcaggaccuagaagaguggcauugguuc

SEQ ID NO: 44295 - RNA, 64 nt, hsa
guucuccagugccaaguacccugcuccagagcgccugcaggaauauggcuccaucuucacgggc

SEQ ID NO: 44296 - RNA, 64 nt, hsa
ccagagcaagcaccgcccccuggacgagcgggcccugcaggacuuuccugugugcgugagcacc

SEQ ID NO: 44297 - RNA, 64 nt, hsa
gagguugcuggagcaagaggagagguugcuggagcugcaggagaggcugcuagagcagaagcgg

SEQ ID NO: 44298 - RNA, 64 nt, hsa
gagguugcuggagcaagaggagaggcuacuggagcugcaggagagccugcuagagcagaagcgg

SEQ ID NO: 44299 - RNA, 64 nt, hsa
ugggaguguuuuuauuguuagcuaauugcugugacugcaggaagugggaguguuucuguuguug

SEQ ID NO: 44300 - RNA, 64 nt, hsa
auguagucugccuugaaaagucuuucagcugugacugcaggaagugggaguguuuuuauuguua

SEQ ID NO: 44301 - RNA, 64 nt, hsa
aggaauucaagaacagcuuaucucuguaguuacacugcaggaucucucaugccuuuacuuacaa

SEQ ID NO: 44302 - RNA, 54 nt, hsa
uacauaauagauggauaugaauuacugcaggaacuucuggaggaaagcacucau

SEQ ID NO: 44303 - RNA, 64 nt, hsa
uggcgugaagaggccuggucagggccuuuaggggcugcaggacggaauggccgccuggggagcc

SEQ ID NO: 44304 - RNA, 64 nt, hsa
cugaggcaugagcaccugggcacagguuggggcucugcaggaugaggaagacaggccaaucccu

SEQ ID NO: 44305 - RNA, 64 nt, hsa
cagggccaaagaggcagaucagcugaagcaggaccugcaggaagcacgcgaggcggagcgaaga

SEQ ID NO: 44306 - RNA, 64 nt, hsa
cggcagaguggaauacauggaaaagagcaagcaucugcaggagcagcucaaugaacucaagaca

SEQ ID NO: 44307 - RNA, 64 nt, hsa
uaugacucgucgugggcgcauggcggcgcaccugcugcaggagcggccacgucucagcuucauu

SEQ ID NO: 44308 - RNA, 64 nt, hsa
cagcuccuccgucagugucugcauggguagcaggcugcaggaguggggucucugcacagccugg

SEQ ID NO: 44309 - RNA, 64 nt, hsa
agacuuucugaaaacacuugaugauguggaaaugcugcaggauuaaauaacuugaagagccuuu

SEQ ID NO: 44310 - RNA, 64 nt, hsa
uauacauaggcaucauuucacaaggucaguaaugcugcaggaaaagcaaaauugcaaucuacgu

SEQ ID NO: 44311 - RNA, 64 nt, hsa; identical to SEQ ID NO: 44254

SEQ ID NO: 44312 - RNA, 64 nt, hsa; identical to SEQ ID NO: 44255

SEQ ID NO: 44313 - RNA, 64 nt, hsa; identical to SEQ ID NO: 44256

SEQ ID NO: 44314 - RNA, 64 nt, hsa; identical to SEQ ID NO: 44257

SEQ ID NO: 44315 - RNA, 64 nt, hsa; identical to SEQ ID NO: 44258

SEQ ID NO: 44316 - RNA, 64 nt, hsa; identical to SEQ ID NO: 44259

SEQ ID NO: 44317 - RNA, 64 nt, hsa; identical to SEQ ID NO: 44260

SEQ ID NO: 44318 - RNA, 64 nt, hsa; identical to SEQ ID NO: 44261

SEQ ID NO: 44319 - RNA, 64 nt, hsa; identical to SEQ ID NO: 44262

SEQ ID NO: 44320 - RNA, 64 nt, hsa; identical to SEQ ID NO: 44263

SEQ ID NO: 44321 - RNA, 64 nt, hsa; identical to SEQ ID NO: 44264

SEQ ID NO: 44322 - RNA, 64 nt, hsa; identical to SEQ ID NO: 44265

SEQ ID NO: 44323 - RNA, 64 nt, hsa; identical to SEQ ID NO: 44266

SEQ ID NO: 44324 - RNA, 64 nt, hsa; identical to SEQ ID NO: 44267

SEQ ID NO: 44325 - RNA, 64 nt, hsa; identical to SEQ ID NO: 44268

SEQ ID NO: 44326 - RNA, 64 nt, hsa; identical to SEQ ID NO: 44269

SEQ ID NO: 44327 - RNA, 64 nt, hsa; identical to SEQ ID NO: 44270

SEQ ID NO: 44328 - RNA, 64 nt, hsa; identical to SEQ ID NO: 44271

SEQ ID NO: 44329 - RNA, 64 nt, hsa; identical to SEQ ID NO: 44272

SEQ ID NO: 44330 - RNA, 64 nt, hsa; identical to SEQ ID NO: 44273

SEQ ID NO: 44331 - RNA, 64 nt, hsa; identical to SEQ ID NO: 44274

SEQ ID NO: 44332 - RNA, 64 nt, hsa; identical to SEQ ID NO: 44275

SEQ ID NO: 44333 - RNA, 64 nt, hsa; identical to SEQ ID NO: 44276

SEQ ID NO: 44334 - RNA, 64 nt, hsa; identical to SEQ ID NO: 44277

SEQ ID NO: 44335 - RNA, 60 nt, hsa; identical to SEQ ID NO: 44278

SEQ ID NO: 44336 - RNA, 64 nt, hsa; identical to SEQ ID NO: 44279

SEQ ID NO: 44337 - RNA, 64 nt, hsa; identical to SEQ ID NO: 44280

SEQ ID NO: 44338 - RNA, 64 nt, hsa; identical to SEQ ID NO: 44281

SEQ ID NO: 44339 - RNA, 64 nt, hsa; identical to SEQ ID NO: 44282

SEQ ID NO: 44340 - RNA, 64 nt, hsa; identical to SEQ ID NO: 44283

SEQ ID NO: 44341 - RNA, 64 nt, hsa; identical to SEQ ID NO: 44284

SEQ ID NO: 44342 - RNA, 64 nt, hsa; identical to SEQ ID NO: 44285

SEQ ID NO: 44343 - RNA, 64 nt, hsa; identical to SEQ ID NO: 44286

SEQ ID NO: 44344 - RNA, 64 nt, hsa; identical to SEQ ID NO: 44287

SEQ ID NO: 44345 - RNA, 64 nt, hsa; identical to SEQ ID NO: 44288

SEQ ID NO: 44346 - RNA, 64 nt, hsa; identical to SEQ ID NO: 44289

SEQ ID NO: 44347 - RNA, 64 nt, hsa; identical to SEQ ID NO: 44290

SEQ ID NO: 44348 - RNA, 64 nt, hsa; identical to SEQ ID NO: 44291

SEQ ID NO: 44349 - RNA, 64 nt, hsa; identical to SEQ ID NO: 44292

SEQ ID NO: 44350 - RNA, 64 nt, hsa; identical to SEQ ID NO: 44293

SEQ ID NO: 44351 - RNA, 64 nt, hsa; identical to SEQ ID NO: 44294

SEQ ID NO: 44352 - RNA, 64 nt, hsa; identical to SEQ ID NO: 44295

SEQ ID NO: 44353 - RNA, 64 nt, hsa; identical to SEQ ID NO: 44296

SEQ ID NO: 44354 - RNA, 64 nt, hsa; identical to SEQ ID NO: 44297

SEQ ID NO: 44355 - RNA, 64 nt, hsa; identical to SEQ ID NO: 44298

SEQ ID NO: 44356 - RNA, 64 nt, hsa; identical to SEQ ID NO: 44299

SEQ ID NO: 44357 - RNA, 64 nt, hsa; identical to SEQ ID NO: 44300

SEQ ID NO: 44358 - RNA, 64 nt, hsa; identical to SEQ ID NO: 44301

SEQ ID NO: 44359 - RNA, 54 nt, hsa; identical to SEQ ID NO: 44302

SEQ ID NO: 44360 - RNA, 64 nt, hsa; identical to SEQ ID NO: 44303

SEQ ID NO: 44361 - RNA, 64 nt, hsa; identical to SEQ ID NO: 44304

SEQ ID NO: 44362 - RNA, 64 nt, hsa; identical to SEQ ID NO: 44305

SEQ ID NO: 44363 - RNA, 64 nt, hsa; identical to SEQ ID NO: 44306

SEQ ID NO: 44364 - RNA, 64 nt, hsa; identical to SEQ ID NO: 44307

SEQ ID NO: 44365 - RNA, 64 nt, hsa; identical to SEQ ID NO: 44308

SEQ ID NO: 44366 - RNA, 64 nt, hsa; identical to SEQ ID NO: 44309

SEQ ID NO: 44367 - RNA, 64 nt, hsa; identical to SEQ ID NO: 44310

SEQ ID NO: 44368 - RNA, 64 nt, hsa
uggugcuauuauuaggcuugcuuguuacacacacaggucuaagccuaguaugucaauaaagcaa

SEQ ID NO: 44369 - RNA, 64 nt, hsa
cuuucacuucauuauaugcaaguuuucaauaauuaggucuaaguggaguuuuaagguuacugau

SEQ ID NO: 44370 - RNA, 64 nt, hsa
acaauauccacacacugcaucaauacauaacuuuaggucuaagucuugcuaagggauaaacaaa

SEQ ID NO: 44371 - RNA, 64 nt, hsa
gaaaugguuuguaagaggggaaagaaaaggagaaaggucuaaucaagcucggguuguucaaaga

SEQ ID NO: 44372 - RNA, 64 nt, hsa
guguaaauuaauauggauaauuuuauuuaccuccaggucuaaaagguagugugacccaaauuug

SEQ ID NO: 44373 - RNA, 64 nt, hsa
uuucaugugaaaggacugggguuuuagcaaacacaggucuaaucucuuuuguguuuuugugcac

SEQ ID NO: 44374 - RNA, 64 nt, hsa
aaauuguauauguuuauacaggaucuuucagaucaugugcaauuuuuaucuaaccaaucagaaa

SEQ ID NO: 44375 - RNA, 64 nt, hsa
uaagaaaaugagaaauuauauuuauuagaauaaaaugugcaaauaaugacaauuauuugaaugu

SEQ ID NO: 44376 - RNA, 64 nt, hsa
aaacacacaaaagauuauguauuggcauuuauuuaugugcaaggugauaggaaaacugaaucca

SEQ ID NO: 44377 - RNA, 64 nt, hsa
aauuuccaagacaguuguaucacaaagcugugaaaugugcaagaguauacuuuguacccaucau

SEQ ID NO: 44378 - RNA, 64 nt, hsa
uuaacuaugagauuuuuaaaaaauggggccgcugaugugcaauaucaaagugaacuugugagua

SEQ ID NO: 44379 - RNA, 64 nt, hsa
aaguaccucucuuuugugacucuuguacagcuuaaugugcaauaaaggaaaaguuauaucuguc

SEQ ID NO: 44380 - RNA, 64 nt, hsa
gucuccuucaggugaucacacacaguggacgaguaugugcaaacauggacauaauaguucacuu

SEQ ID NO: 44381 - RNA, 64 nt, hsa
aucaaaguaaaucugcaaauuccuucuaaauuucaugugcaaauaauuauauauaaauauauuu

SEQ ID NO: 44382 - RNA, 64 nt, hsa
ccacauuuuuauuccguagauguuaaucucuuucaugugcaaucuuugcuucuuguaggcuauc

SEQ ID NO: 44383 - RNA, 64 nt, hsa
aggacaaccagaaguacacauuuacaauagauagaugugcaaaagaccuuuuuguagccaaaca

SEQ ID NO: 44384 - RNA, 64 nt, hsa
acauauauuuaaacuuacagauggaaauugcccaaugugcaaauuguuaaguaccacacuuuac

SEQ ID NO: 44385 - RNA, 64 nt, hsa
aggagacugaaacucaaacaacccugggcaaguaaugugcaaaagauggcaggguggggauuug

SEQ ID NO: 44386 - RNA, 64 nt, hsa
ccaggucuaccuguugcagagucaagggacuugcaugugcaaguuggguggaugcugggaggca

SEQ ID NO: 44387 - RNA, 64 nt, hsa
uucugggcugccagcaguacgugggaaagguggaaugugcaauaggaacagaucugugcauuuu

SEQ ID NO: 44388 - RNA, 64 nt, hsa
guucugugguuaccagaaauacugagugucugucaugugcaagacaaugcuaagaacagaauac

SEQ ID NO: 44389 - RNA, 64 nt, hsa
cuuuauuacugguuauauacauuuggccauuaugaugugcaagcaauuggaaaaaaagucaagu

SEQ ID NO: 44390 - RNA, 64 nt, hsa
gcuuaaaguguuaaaauacccuagauacuguguuaugugcaacuguagaaacccuccagaaauu

SEQ ID NO: 44391 - RNA, 64 nt, hsa
ugcaauacuucaauacuucauuuaaaauauuuuuaugugcaauaaaauguauuuguuuguauuu

SEQ ID NO: 44392 - RNA, 64 nt, hsa
ggaauauuugcaagacauagaauaguguuggaaaaugugcaauaugugauguggcaaaucucua

SEQ ID NO: 44393 - RNA, 64 nt, hsa
aagggauguuagcauucauuagaguaugaggaugagucccaagaagguucuuuggaaggaggac

SEQ ID NO: 44394 - RNA, 64 nt, hsa
uuuuuaagugggcuuccauuccauggauuuaaucagucccaagaagaucaaacucagcaguacu

SEQ ID NO: 44395 - RNA, 64 nt, hsa
aacguuggcaacaccauaaggauuucuuauguuaagucccaacuugggguugcaaaaucauuuu

SEQ ID NO: 44396 - RNA, 64 nt, hsa
uaucggaggcccuggaguuugugagcuuggcucuagucccaagaagggugagggagaauaaggg

SEQ ID NO: 44397 - RNA, 64 nt, hsa
uccuucagacauugacaugagaucuuaagcaaacagucccaaaccucuuaggggugaaaaaaga

SEQ ID NO: 44398 - RNA, 64 nt, hsa
ucucauacucccacaggcuagaccagagaugccaagucccaacagcacugagcugugugcacug

SEQ ID NO: 44399 - RNA, 64 nt, hsa
ucagcagaagaagcagccaugcccaguauucccacucuccaaaaggaacugaccagcuuauauu

SEQ ID NO: 44400 - RNA, 64 nt, hsa
ugucagaguuguggcucucagccauguagacacacucuccaaauggaguguuggaaaauguucu

SEQ ID NO: 44401 - RNA, 64 nt, hsa
auagccagaguuuaauacaucuucauucucaacacucuccaaagaacuugaccuaccuuauggg

SEQ ID NO: 44402 - RNA, 64 nt, hsa
aaugaaagauaccaagaacauggaggccaagaaacucuccaaggaccggaugaagaaguacaug

SEQ ID NO: 44403 - RNA, 64 nt, hsa
agagguagcauuuuugcugaaaucgggccugucacucuccaauaaagguucuggcacuucaaug

SEQ ID NO: 44404 - RNA, 64 nt, hsa
acacagaacacaggaguuugcuuuuggcuucucacucuccaaguaacccugaauuaggcccaga

SEQ ID NO: 44405 - RNA, 64 nt, hsa
gcuggccuaggagauaucugagggaggaggccaccucuccaagggcuucugcacccuccacccu

SEQ ID NO: 44406 - RNA, 64 nt, hsa
gggcucgccaugccggggguucauaggucacuggcucuccaagugccagaggugggcagguggu

SEQ ID NO: 44407 - RNA, 64 nt, hsa
ugacuguggagcacccagggacgugguuuuagagucuaccuaauauguuaaggacaaggaaacc

SEQ ID NO: 44408 - RNA, 64 nt, hsa
uaccuaauauguuaaggacaaggaaaccucugagucuaccuaauauguuaaggacaaggaaacc

SEQ ID NO: 44409 - RNA, 64 nt, hsa
uguagguaguauucucuuccuacuauauuucauaucuaccuacuacauuucauaucauuccuac

SEQ ID NO: 44410 - RNA, 64 nt, hsa
acuacauuucauaucauuccuacuacauuucauaucuaccuacauuuacauguagguagauaug

SEQ ID NO: 44411 - RNA, 64 nt, hsa
aagagguccagggagggauuuaggaaauaaaguuucuaccuauuugaugagccucuacucagcc

SEQ ID NO: 44412 - RNA, 64 nt, hsa
guucugcauugcuaaauaagggcuuccucugccuucuaccuacagugcauuugaacugccuucu

SEQ ID NO: 44413 - RNA, 64 nt, hsa
aagauauucugccaaaauaucaggaccagaauuuucuaccuaaggaccagaauuuuuuaucuag

SEQ ID NO: 44414 - RNA, 64 nt, hsa
aagauauucugccaaaauaucaggaccagaauuuucuaccuaaggaccagaauuuuuugucuag

SEQ ID NO: 44415 - RNA, 64 nt, hsa
gagaccagcauguucuccccaaagaccagaauauucuaccuaaauaucaaggccaggauuuucu

SEQ ID NO: 44416 - RNA, 64 nt, hsa
agaauauucuaccuaaauaucaaggccaggauuuucuaccuaaagaccaggacuuuuuaucuag

SEQ ID NO: 44417 - RNA, 64 nt, hsa
uugacuccuugugguuuaugucaucauacaugacucagcauaccugcuggugcagagcugaaga

SEQ ID NO: 44418 - RNA, 64 nt, hsa
cuuuuuccccaaagucuuaaaauaacuuauaucaucagcauaccuuuauugugaucuaucaaua

SEQ ID NO: 44419 - RNA, 64 nt, hsa
cagcauaagccaucaugugggcuuucuucauucuucagcauauuauccgcuucgcuuucuguuu

SEQ ID NO: 44420 - RNA, 64 nt, hsa
cuuuaauguuugaauguuucacucuguuguaaagucagcauaagccaucaugugggcuuucuuc

SEQ ID NO: 44421 - RNA, 62 nt, hsa
aaggcuuuaccaagcaaugaauuccuagugcaucagcauauucauaaaugaaauauacuccg

SEQ ID NO: 44422 - RNA, 64 nt, hsa
uauaugcauaugcagacauauguauauggucuggucagcauauguguauguaugcguauguaug

SEQ ID NO: 44423 - RNA, 64 nt, hsa
uaucacaguugagaguuuaaucaaaaugaccggaucagcauauucuuuuuuuagaugagacaga

SEQ ID NO: 44424 - RNA, 64 nt, hsa
ggauuacaggcgugagccaccacaccuggccagcucagcauauucuuaaguaggauucacauuu

SEQ ID NO: 44425 - RNA, 64 nt, hsa
ucuugauugcuuuauuaucaucauacuaguguguucauuauagaguaucuguagaggugaaugu

SEQ ID NO: 44426 - RNA, 64 nt, hsa
aaagcaagauucaauuccuuguucauuugaguguucauuauaugccaggcauugaccaguugca

SEQ ID NO: 44427 - RNA, 64 nt, hsa
aaagauucucauuauaaaugcuuaccuaggauucucauuauagaugcuuaucuagguuuucaua

SEQ ID NO: 44428 - RNA, 64 nt, hsa
agauuaaaugaugcugaggaaugaaaaaagauucucauuauaaaugcuuaccuaggauucucau

SEQ ID NO: 44429 - RNA, 64 nt, hsa
guucuaacaaucauauugugaaucauuuugaaguucauuauagcgauauugauaaauuguggaa

SEQ ID NO: 44430 - RNA, 64 nt, hsa
uauguagaaucaaauuauauaaacaguaccaauaucauuauagaaaaaaauaacauuuuaaugu

SEQ ID NO: 44431 - RNA, 64 nt, hsa
caauaucuuuaauauaaaucuuuuuacugagagaucauuauagaaacauguuaaaguugguuag

SEQ ID NO: 44432 - RNA, 64 nt, hsa
aauaacgauggugaugauaauuuuaguauuacugucauuauaauuauuauuauauucauucuac

SEQ ID NO: 44433 - RNA, 64 nt, hsa
uauauauauauuuguaaugagagcaaguauauacucauuauagaaucaauuuaagaaguuuaaa

SEQ ID NO: 44434 - RNA, 64 nt, hsa
gaagcacaagaguuccuacacaaaacucuguaaaucauuauagcuuuuguauaauaagaguagu

SEQ ID NO: 44435 - RNA, 64 nt, hsa
uauaaaauccuacuuuggccaaguuuguuucuuuucauuauaguuuauaugaaaagaucaccuu

SEQ ID NO: 44436 - RNA, 64 nt, hsa
ucuaaaaauuauuagcuguuacaaauggaacauuucauuauaacgugaucacuuugacuugagc

SEQ ID NO: 44437 - RNA, 64 nt, hsa
uaugugaggaaacaugcaaagcauuaggaaauuuauuuccuaaaaacaguuuuguaaaauuagu

SEQ ID NO: 44438 - RNA, 64 nt, hsa
cauuuacaugaguuaacauuuuuucauagaacuuauuuccuagauagaauuuuuuacuguuuuu

SEQ ID NO: 44439 - RNA, 64 nt, hsa
aggaccucauauuaagagcuaagcaaauggccacauuuccuauauuuugacagagauacugcug

SEQ ID NO: 44440 - RNA, 64 nt, hsa
aggcccucaucagaugcuggccccuuggucuugaauuuccuagccucuacaacuaagccaaaua

SEQ ID NO: 44441 - RNA, 64 nt, hsa
uaguuuacuuucccugguuggaaauuuauuucuuauuuccuaacauugaauucguuagaaaaaa

SEQ ID NO: 44442 - RNA, 64 nt, hsa
ucauuuugaucuagauauaaaauuaaaauuguccauuuccuauauaaauaccagcaagaucacu

SEQ ID NO: 44443 - RNA, 64 nt, hsa
uuaaguucuguuggcuagcuaugguuuucaguacauuuccuacuuuaagaguaauuacugacaa

SEQ ID NO: 44444 - RNA, 64 nt, hsa
uuccuacuuuaagaguaauuacugacaaauauguauuuccuauauguuuauacuuugauuauaa

SEQ ID NO: 44445 - RNA, 64 nt, hsa
gccauggcagacauugcuaaucaaucacagcacuauuuccuauuaagcccacugauuucuucac

SEQ ID NO: 44446 - RNA, 64 nt, hsa
guauauauucguauuccauguguuagauggaagcauuuccuauccagugugaauaaaaagaaca

SEQ ID NO: 44447 - RNA, 64 nt, hsa
aaauaauuacuuagaaacuccauuuuaaauaaucauuuccuagaaauucuuaaauauauacaga

SEQ ID NO: 44448 - RNA, 64 nt, hsa
ccaucaauaauuuaugaauaaguuuccagaacaaauuuccuaauaacacaaucagauugguuuu

SEQ ID NO: 44449 - RNA, 64 nt, hsa
uguccaauaacaggucaacuucagagacuaucugauuuccuaaugucagaguagaagauuuuau

SEQ ID NO: 44450 - RNA, 64 nt, hsa
gacccgaauuauaaaggccagcgccagaacccagauuuccuaacucuggugcucuuucccuuua

SEQ ID NO: 44451 - RNA, 64 nt, hsa
ugaauuacaguaaacccaucuuuccuuaacgaaaauuuccuauguuuacagucugucuauuggu

SEQ ID NO: 44452 - RNA, 64 nt, hsa
gauuuguauuucugauuaacaaauaaacagggguauuuccuaaggugaccaugguugaacuuua

SEQ ID NO: 44453 - RNA, 64 nt, hsa
gcaaacacugaacuuugucaauuaauuugaggcuauuuccuauuugaccccuuuucuuuuuuga

SEQ ID NO: 44454 - RNA, 64 nt, hsa
uguucuugcauuagcucaauugaugucaucacugauuuccuaaacuagaaacuauggaagcauc

SEQ ID NO: 44455 - RNA, 64 nt, hsa
cgcccucuugcuugaaaacuucacuugcuuccccauuuccuacucuuuaaggaaugauuucuuu

SEQ ID NO: 44456 - RNA, 64 nt, hsa
acuuaccaaagaauaagugucuuucugguguuuuauuuccuaucauaaaaauacaacagugcau

SEQ ID NO: 44457 - RNA, 64 nt, hsa
gcuuauaaaauuuaacuucuucauaauuuuaguaauuuccuagagguucuggguuuucugaaag

SEQ ID NO: 44458 - RNA, 64 nt, hsa
auguauaacuagcaacauuuaugguuauagguugauuuccuaaguguggcugaugguagccucu

SEQ ID NO: 44459 - RNA, 64 nt, hsa
cugcuacagccaagaccugcucuuguggagguacauuuccuaagccggaacacucaagcuuuuu

SEQ ID NO: 44460 - RNA, 64 nt, hsa
aauguuuaacaagaacacaaguguuccugauaagauuuccuacaguaagccagcucuauuguaa

SEQ ID NO: 44461 - RNA, 64 nt, hsa
ucuuguauguuaauugcaucuucauuggcuugguauuuccuaaauguuuaacaagaacacaagu

SEQ ID NO: 44462 - RNA, 64 nt, hsa
gaaugaaccuuugaggccuguaaaguggauuguaauuuccuauaagcuguaauaguggagguau

SEQ ID NO: 44463 - RNA, 64 nt, hsa
uuuaguuuuuuaauucauuuacuaaugcuauaaaauuuccuauauuaccccaguaauuugcauc

SEQ ID NO: 44464 - RNA, 64 nt, hsa
uucuugcugaccugaggcuauagggucacuugccauuuccuaccuucucugggggauuugaggg

SEQ ID NO: 44465 - RNA, 64 nt, hsa
cagccaaagcuggccccugaaccacugugugcccauuuccuagggaaggggaaggagaauaaac

SEQ ID NO: 44466 - RNA, 64 nt, hsa
ggaaaggaaagguauuuuguuucuuugucuauacauuuccuagauuucuaugcaguugggauuu

SEQ ID NO: 44467 - RNA, 64 nt, hsa
aucuauguacuaaauugcuuccagguaauuuuugauuuccuaaagugcacugagguuaucugga

SEQ ID NO: 44468 - RNA, 64 nt, hsa
agauaagguuuuuuacauguguaacaaucccaagauuuccuagauuaaaaucuuaauugauuuu

SEQ ID NO: 44469 - RNA, 64 nt, hsa
agcaagugcccugcacagaguaauaaguaaauugauuuccuaaucacaauucuaugugacuuau

SEQ ID NO: 44470 - RNA, 64 nt, hsa
guaguuacaaaggggucagucuuuuaaaauaaguauuuccuauuaaacuauauauauauacagu

SEQ ID NO: 44471 - RNA, 64 nt, hsa
uggccccuuugucuucguuugaaacauccccaacauuuccuacaaaucagcguaguuacaaagg

SEQ ID NO: 44472 - RNA, 64 nt, hsa
uccccacucuuuucuuccucuucaaaguauuuaaauuuccuagguuuucaugaaaaagcuggaa

SEQ ID NO: 44473 - RNA, 64 nt, hsa
ccccacuccuuucuucccuccucaaucuaguuaaauuuccuaagcuuucacaaaaauccgggaa

SEQ ID NO: 44474 - RNA, 64 nt, hsa
uaacuguacagugagugugggggaaauguaguaaccuaguuaguagucuucaauauaaccaauu

SEQ ID NO: 44475 - RNA, 64 nt, hsa
cccgcgaaaagguaaauacacccaaagggagggaccuaguuaagucacuggcaccuagauaagu

SEQ ID NO: 44476 - RNA, 64 nt, hsa
ugauuuuugggaaagggcaaaaugugucagaugcccuaguuaaucauguaauuuaauucuggua

SEQ ID NO: 44477 - RNA, 64 nt, hsa
uguccaaaccauuuuuuaguuacuucuuucuaauccuaguuauucagacaaaauuuggaaacuu

SEQ ID NO: 44478 - RNA, 64 nt, hsa
uuuuucauguugaaaggagaaaaagcacaaguucccuaguuaccauuuaauaugagggugcaag

SEQ ID NO: 44479 - RNA, 64 nt, hsa
aguccauuaacucuuugggccaugaccugugguaccuaguuaugguagugcaaaucagaucaga

SEQ ID NO: 44480 - RNA, 64 nt, hsa
uaguauggacaacuuuuugccacuaacugaauucuccaaauacucacacgugaaauuucaaaaa

SEQ ID NO: 44481 - RNA, 64 nt, hsa
uagaaaugucaguauuuuuguaauuauuucuaccuccaaauauauauauauugucuuucacugg

SEQ ID NO: 44482 - RNA, 64 nt, hsa
accucaucuugacuacauccgcaaagacccugucuccaaauaaggucacauuuacaggguacca

SEQ ID NO: 44483 - RNA, 64 nt, hsa
gggcacuguuuaauuaugaaagggggaaaaucauuccaaauaagaguuuaauuuuuauuaauua

SEQ ID NO: 44484 - RNA, 64 nt, hsa
ucccaaguacuauuauuccauacuacuauauucuuccaaauauuuggaacacucuuagaauucc

SEQ ID NO: 44485 - RNA, 64 nt, hsa
acagagcaguuaacuuuacucuugguucugagucuccaaauaauaauagccgacguuuauugag

SEQ ID NO: 44486 - RNA, 64 nt, hsa
agauuguuuuuguacauucucuuuguuuucauuuuccaaauauaaucuuuaauaaacuugauuu

SEQ ID NO: 44487 - RNA, 64 nt, hsa
uuucuguuuauuacaugaaauuacauuccauuuauccaaauauauguuuauauaauauuuccac

SEQ ID NO: 44488 - RNA, 64 nt, hsa
cugagaucaguucuacugaaauggcaacaacaacuccaaauacaucucucccuucuugaaaucc

SEQ ID NO: 44489 - RNA, 64 nt, hsa
augcuaaaccucuagggucugaugcuguuuuuguuccaaauauaaacgaaaggcacuagucagc

SEQ ID NO: 44490 - RNA, 64 nt, hsa
ccagguaaaaacagauauuguaccauguaccuaauccaaauaucauauaaacauuuuauuuaua

SEQ ID NO: 44491 - RNA, 64 nt, hsa
uuuauuagaauaauuucauacugaaauuauuuucuccaaauaaaaauuagauggaaaaauguga

SEQ ID NO: 44492 - RNA, 64 nt, hsa
auuuuccccaguucaaugcuaugccauuaccaacuccaaauaaucucaaauaauuuuccacuua

SEQ ID NO: 44493 - RNA, 64 nt, hsa
ucauauaauaaguacuggcuuacagcuaagugguuccaaauacugguaauuaaaacaaugaugu

SEQ ID NO: 44494 - RNA, 64 nt, hsa
agcuaggguuugcccucuucaugucuacucuccuuccaaauaguuauauccaaaacuguuuuuc

SEQ ID NO: 44495 - RNA, 64 nt, hsa
aucccauccuuuggguuguggguuuuuuguuuucuccaaauaaaucugaucuuuaaaguucauu

SEQ ID NO: 44496 - RNA, 64 nt, hsa
agaacuuuauuuuggaaaauuuauaagaaaguaauccaaauaagaaacacgauaguugaaaaua

SEQ ID NO: 44497 - RNA, 64 nt, hsa
auacuaccaguugugucuuuagauggcacacaaguccaaauaaguggucauacuucuuuauuca

SEQ ID NO: 44498 - RNA, 64 nt, hsa
gggggacagacagggaaagcugcgaauucucuuguccaaauaguggauugggcagacuggccug

SEQ ID NO: 44499 - RNA, 64 nt, hsa
cauagaugaaaacaaacuuggauuuuuuucuuuguccaaauaaaaaaaaaugauguaaagaaau

SEQ ID NO: 44500 - RNA, 64 nt, hsa
uaaaagcaauguuuaaaucaaacuaaagauuaaaaauuaaaauucguuuuugcaauaaugacaa

SEQ ID NO: 44501 - RNA, 64 nt, hsa
caccuuugaaaugcaccaaaugaauugaguuuguaauuaaaaaaauuuuuuucccuuucaguca

SEQ ID NO: 44502 - RNA, 64 nt, hsa
ggaauugguuguuuagggcacacuguuauaugggaauuaaaauauguuuaggcaggggugugua

SEQ ID NO: 44503 - RNA, 64 nt, hsa
aaauguaaaauucaguauaguuugaaagcggcacaauuaaaaauuaauuuucuaacaaaguugg

SEQ ID NO: 44504 - RNA, 64 nt, hsa
auuuccuauauuuugacagagauacugcuggaaaaauuaaaauuaaaaugccauaauagcuacc

SEQ ID NO: 44505 - RNA, 64 nt, hsa
uauauuuugacagagauacugcuggaaaaauuaaaauuaaaaugccauaauagcuaccuaacaa

SEQ ID NO: 44506 - RNA, 64 nt, hsa
aaaaaaaguacucugaacugcuccaaguaacgcuaauuaaaaacuugcuuuaaagauauugaau

SEQ ID NO: 44507 - RNA, 64 nt, hsa
gaacuuaguucagggacauagaagagucuuaaugaauuaaaaucauucacuugauuaaaugucu

SEQ ID NO: 44508 - RNA, 64 nt, hsa
caagugguuuuuucauuauguaaagcacccguugaauuaaaagaauuuguuuuuguucaaccuc

SEQ ID NO: 44509 - RNA, 64 nt, hsa
ugaauauauggacuuucucagauuaggaaauaccaauuaaaaauauaauaaauagcuacauuga

SEQ ID NO: 44510 - RNA, 64 nt, hsa
caucaccacuuauuaaaacacacauagaaugaugaauuaaaaaaguuuucuaggauugucuuuu

SEQ ID NO: 44511 - RNA, 64 nt, hsa
cuuuugcaugcuuaaggauuccaaacgacuaagaaauuaaaaaaaaaaagacugucauucauac

SEQ ID NO: 44512 - RNA, 64 nt, hsa
ccacagguauguggaauacggugaggaaaaaaaaaauuaaaaaaaaaaugcaagcugucaggau

SEQ ID NO: 44513 - RNA, 64 nt, hsa
uaugucaggaccuaaauggccuaagcaccugucaaauuaaaauuccaaaauucauugaaauccu

SEQ ID NO: 44514 - RNA, 64 nt, hsa
aggaaggugagcuccucaacaauaacuuugcaauaauuaaaacuacccuaaguaacuuuggcuu

SEQ ID NO: 44515 - RNA, 64 nt, hsa
augccaauuuuuacuguaauaaguaauguaucauaauuaaaaauuauuuauuuggacuucuucu

SEQ ID NO: 44516 - RNA, 64 nt, hsa
uuaauuuuuguccaaaguuaauuuuaaucuauacaauuaaaaccuuuugccuaucacucuggac

SEQ ID NO: 44517 - RNA, 64 nt, hsa
aacaguaccuuggcuuggcucuugacguggacagaauuaaaaaggaccaagaagaggaagaaga

SEQ ID NO: 44518 - RNA, 64 nt, hsa
uuugcuucacacacaguucaaccauuuaaccagaaauuaaaauaucacccuuuucagcccuccc

SEQ ID NO: 44519 - RNA, 64 nt, hsa
aaaaaaagaaaagauaagugcuuguucuagcauaaauuaaaagguccaagggaauuuaaucugg

SEQ ID NO: 44520 - RNA, 64 nt, hsa
cuugcaaaugagcagaauaaaugagguuuuuuucaauuaaaaauuacuauaaauccaggaggca

SEQ ID NO: 44521 - RNA, 64 nt, hsa
cacugaaauccugaagaggagagauuugguuauaaauuaaaaagguugggugaucuuaagugcc

SEQ ID NO: 44522 - RNA, 64 nt, hsa
gaacaauguucuuacaggucauaauguauuucacaauuaaaaaacuaaaauauguacccauuuu

SEQ ID NO: 44523 - RNA, 64 nt, hsa
uaugugaacagucuuauucuauguacacagauguaauuaaaauuguaauccuaacaaacaaaag

SEQ ID NO: 44524 - RNA, 64 nt, hsa
guauucauuuaagaggcaauaaggcaaaugccagaauuaaaaaaaaaaaucaucaaagacagaa

SEQ ID NO: 44525 - RNA, 64 nt, hsa
ucucuucauauguaagucaguauuuuugucuacaaauuaaaagucacuugucauucaaaaauga

SEQ ID NO: 44526 - RNA, 64 nt, hsa
acaugacaguugugucauuauuagagauuucaguaauuaaaaugggaaacagaagccuaaguua

SEQ ID NO: 44527 - RNA, 64 nt, hsa
uuucaaaaagaucuugaaaguaauauauuuaaucaauuaaaauguuuaucuguaacuuguugau

SEQ ID NO: 44528 - RNA, 64 nt, hsa
uaaggauuuuauaaacucaaauuggcaccuacugaauuaaaauacauaaaaucauuuaaauaua

SEQ ID NO: 44529 - RNA, 64 nt, hsa
augccucaguuuccucauuuugaucuagauauaaaauuaaaauuguccauuuccuauauaaaua

SEQ ID NO: 44530 - RNA, 64 nt, hsa
cauuuguauugcaaaaguuagaagucauuuuacaaauuaaaaaaacauuuuuuucuugguaguc

SEQ ID NO: 44531 - RNA, 64 nt, hsa
cugcuauuaucauuaucucagaaugcuuauuuccaauuaaaacgccuacagcugccuccuagaa

SEQ ID NO: 44532 - RNA, 64 nt, hsa
acuccagaaacauucugaagauguacuuggauuuaauuaaaaaguucacuuuguaagaacgugg

SEQ ID NO: 44533 - RNA, 64 nt, hsa
ccaggcauagccuggauacaguauaaaaauagauaauuaaaaagaugguugccaagcaaggaaa

SEQ ID NO: 44534 - RNA, 64 nt, hsa
uucugauguugccuuaauauucugcuauugcagcaauuaaaaauugucuucauguacauuugga

SEQ ID NO: 44535 - RNA, 64 nt, hsa
cagauaacauuuguguguuauaccuugauuggggaauuaaaagucauuuaacugaagauguuga

SEQ ID NO: 44536 - RNA, 64 nt, hsa
ccuguauauauauauucauucuccaguguugcugaauuaaaauucugcuggacuuuuuaacaua

SEQ ID NO: 44537 - RNA, 64 nt, hsa
ucauuuugauaaucauuugcuuccaguguuuaaaaauuaaaaaaagaauggggagaagguuaug

SEQ ID NO: 44538 - RNA, 64 nt, hsa
acagcugaaaauuuugagaagguaaaaguuucuuaauuaaaauaugaacauauuuagcuugcuu

SEQ ID NO: 44539 - RNA, 64 nt, hsa
cauuuuacauuuuagggcacaguucuuuggggcuaauuaaaaugggguuugcaggcuuuuuaug

SEQ ID NO: 44540 - RNA, 64 nt, hsa
cugagcaaccuaguaagaccucgucucuacuaauaauuaaaaaacuagcuggcaugguagcaca

SEQ ID NO: 44541 - RNA, 64 nt, hsa
uuucaaauaauauuuucucuguaguaugagaugaaauuaaaaguggauagcuuucaggaaagau

SEQ ID NO: 44542 - RNA, 64 nt, hsa
cuaaguaacccaguacaauaguugugaacugaauaauuaaaacuuuggcuucucuuaggaaaag

SEQ ID NO: 44543 - RNA, 64 nt, hsa
ucuuaucagaauaucuggcuggcccuguaauuuaaauuaaaauaaaauuuuggagaaacagcau

SEQ ID NO: 44544 - RNA, 64 nt, hsa
gggaaaaaaaacccaaaauuaugugaacaagcaaaauuaaaauuucauuuuaggcuauuggcua

SEQ ID NO: 44545 - RNA, 64 nt, hsa
uucguugcgaacuugaucagcuucuccaggauaaaauuaaaaacccaagcauugaucuguguac

SEQ ID NO: 44546 - RNA, 64 nt, hsa
uacaaagagugccauuggaacagcugugucuaagaauuaaaauuuuagagauguuuagugcuca

SEQ ID NO: 44547 - RNA, 64 nt, hsa
uugccaaccaauagaugagaauuuugaggaaaaaaauuaaaaauauguaaaauuaauaauuugc

SEQ ID NO: 44548 - RNA, 64 nt, hsa
ugcugcugauaugacacaccuuugaauuuguuaaaauuaaaaacaacguauuccuuuguagugu

SEQ ID NO: 44549 - RNA, 64 nt, hsa
cucaucucuacaaaaaguaaaaauuaaaaaaugaaauuaaaaauaaaauuaccuagguguggug

SEQ ID NO: 44550 - RNA, 64 nt, hsa
aacauagcaaaaucucaucucuacaaaaaguaaaaauuaaaaaaugaaauuaaaaauaaaauua

SEQ ID NO: 44551 - RNA, 64 nt, hsa
ucuuugacaaacaaauuauuuuuauuuguuuuaaaauuaaaauacuguguaccccccccccccc

SEQ ID NO: 44552 - RNA, 64 nt, hsa
cauacaacuuccaaaaggcaucugauuuuuaaaaaauuaaaauuucugaaaaccaaugcgacaa

SEQ ID NO: 44553 - RNA, 64 nt, hsa
aagaguuauguuuauuuuugaaggguauuaggauaauuaaaaauaauguaaugugccuagcaca

SEQ ID NO: 44554 - RNA, 64 nt, hsa
ugaacaucucaaaguuauauauacuggguauuaaaauuaaaagcaaguuauaucagugaaguaa

SEQ ID NO: 44555 - RNA, 64 nt, hsa
uugugaucuacugaaaagagguuauauuaaagcaaauuaaaauauuuuccuucucuguccucug

SEQ ID NO: 44556 - RNA, 64 nt, hsa
aaaauuauugggaaagauuuaaagugcaggcugcaauuaaaacauggagaaaaguagaaauaau

SEQ ID NO: 44557 - RNA, 64 nt, hsa
uuacugucuggcuuugcccuuaaaauaggguugcaauuaaaaugugauuggcuuagguaauccc

SEQ ID NO: 44558 - RNA, 64 nt, hsa
ugugauauuauuacauaauguaauuaaaaauaugaauuaaaauauuccuacagucuuuagcaug

SEQ ID NO: 44559 - RNA, 64 nt, hsa
uuguaaaauagacugugauauuauuacauaauguaauuaaaaauaugaauuaaaauauuccuac

SEQ ID NO: 44560 - RNA, 64 nt, hsa
cucucuggcuuuacccaaguucugaaugcauuguaauuaaaauuuaaguuuuucuuuuccccca

SEQ ID NO: 44561 - RNA, 64 nt, hsa
aaacuuacuaauucugauuuuaguguagccccuaaauuaaaaauggcuuccauaugccacucug

SEQ ID NO: 44562 - RNA, 64 nt, hsa
uggucuaauuuaaugucuuuaaguuucauauuacaauuaaaaccucauuuuuuuuuuccauuuu

SEQ ID NO: 44563 - RNA, 64 nt, hsa
agaccuuaaguaaaaggcacaauggguacuacagaauuaaaauguaggucuaacauaaugccag

SEQ ID NO: 44564 - RNA, 64 nt, hsa
aagaaucuuauaguacauguuaauauaugcaaccaauuaaaauguauaaauuaguguaagaaau

SEQ ID NO: 44565 - RNA, 64 nt, hsa
guaugugcaauggauaaauugccguuauuucaaaaauuaaaauucucauuuucuuucuuuuuuu

SEQ ID NO: 44566 - RNA, 64 nt, hsa
auuguauuucucauguuaaagccucuucccuugaaauuaaaaaaaaauuuuaacugauaaaacu

SEQ ID NO: 44567 - RNA, 64 nt, hsa
uaaauuauaucucuagggagaaaauguuguaaaaaauuaaaaguacaucccugauuguaaaaua

SEQ ID NO: 44568 - RNA, 64 nt, hsa
uucaagggauagggcagauuaccauuagaagcaaaauuaaaaguacaagcugggcaaacugaca

SEQ ID NO: 44569 - RNA, 64 nt, hsa
ugacuaagaauuuagguggaauugaugucugggcaauuaaaauaaauggcauaagagcuuaaaa

SEQ ID NO: 44570 - RNA, 64 nt, hsa
aaaguaccaaguaccagccguccaaacugaucacaauuaaaauucugacaguugccuuuuuuuu

SEQ ID NO: 44571 - RNA, 64 nt, hsa
ccuuucuacaugacauugcaguggugguuucuguaauuaaaauuuguuugccucaugucccuuu

SEQ ID NO: 44572 - RNA, 64 nt, hsa
ugggacagucccuucuaugaaagugcugaaauuuaauuaaaaucagucuuauaugaaguauguu

SEQ ID NO: 44573 - RNA, 64 nt, hsa
auaaguauuuuguugagguugaagaauugcuggcaauuaaaagaauagagcuaauuauggcuuu

SEQ ID NO: 44574 - RNA, 64 nt, hsa
uuggauaaguaugcuuuauuuuaccucuguuaaaaauuaaaauaaaugauucuauucauauuug

SEQ ID NO: 44575 - RNA, 64 nt, hsa
acuggguauaacaguauuuuaauuaaaaaaaaauaauuaaaagugaugucuuugcacaggugag

SEQ ID NO: 44576 - RNA, 64 nt, hsa
ugcugccgcauuccacuggguauaacaguauuuuaauuaaaaaaaaauaauuaaaagugauguc

SEQ ID NO: 44577 - RNA, 64 nt, hsa
cgucacuacccuuuuuggauucagggcuccucacaauuaaaaugaguguaaugaaacaagguga

SEQ ID NO: 44578 - RNA, 64 nt, hsa
gcuuggaaaagagguacccauucauauauuuauaaauuaaaacauaguuaucuaguaguaggag

SEQ ID NO: 44579 - RNA, 64 nt, hsa
acucaaacuacuaucuuuagauauaaacacuaguaauuaaaaugugccuuuugaagauguuuuc

SEQ ID NO: 44580 - RNA, 64 nt, hsa
aaacuuaauaaauugcuacuguuuuauaucauaaaauuaaaauaccaugguaauauuugcaaaa

SEQ ID NO: 44581 - RNA, 64 nt, hsa
augauccuaagaaaauuauguacuuuuaccugaaaauuaaaaccaauauuuauaaaaaguguau

SEQ ID NO: 44582 - RNA, 64 nt, hsa
gaacaaaagaaacaagagagaaaaaaaucaaaauaauuaaaauaaauuguuagagaaaaguuac

SEQ ID NO: 44583 - RNA, 64 nt, hsa
aggagaagagaaggaauuugaagagaaaaaggaaaauuaaaauuacuaauuaauuuuuagauuc

SEQ ID NO: 44584 - RNA, 64 nt, hsa
uuuguuucguuuuguuucuucuucugcauuuaaaaauuaaaagauugguuugaggaugugauga

SEQ ID NO: 44585 - RNA, 64 nt, hsa
aaaaaaucuaauaaaucuuagauuuuuaaaaaagaauuaaaaugugggaguucucagaaagaaa

SEQ ID NO: 44586 - RNA, 64 nt, hsa
ucucuuauaaucaugguaucuuucacagaauaaaaauuaaaaauaaugccagggugcaagugac

SEQ ID NO: 44587 - RNA, 64 nt, hsa
auuguacuacaguauuuucagaauaugggaaaucaauuaaaaauguaaucuaaucuaguuuaag

SEQ ID NO: 44588 - RNA, 64 nt, hsa
uuauuuuaacuaugaccuuuaauugaaaauaaauaauuaaaauaucagacauguuuuggaaaag

SEQ ID NO: 44589 - RNA, 64 nt, hsa
uuuuauucacuuguguuuguauauaaauggugagaauuaaaauaaaacguuaucucauugcaaa

SEQ ID NO: 44590 - RNA, 64 nt, hsa
ggauuuuguggcuucaaucuacgauguuaaaacaaauuaaaaacaccuaagugacuaccacuua

SEQ ID NO: 44591 - RNA, 64 nt, hsa
cugacaaaauauuuuaaaaauauauaaaacacaaaauuaaaauaaaguugcuggucagucuuag

SEQ ID NO: 44592 - RNA, 64 nt, hsa
gugugcaaagcuuauuuucuuuuaucugggcaaaaauuaaaacacauuccuuggaacagagcua

SEQ ID NO: 44593 - RNA, 64 nt, hsa
gggaaguuuccuugagccuaaaauaaaaagaaaaaauuaaaaagaaucaguuuuuuuaauuaaa

SEQ ID NO: 44594 - RNA, 64 nt, hsa
uaaaaagaaaaaauuaaaaagaaucaguuuuuuuaauuaaaaaaauagaaagcuguuaggcucc

SEQ ID NO: 44595 - RNA, 64 nt, hsa
aagaauuaaaaauuuuaaaaauuuaaauuaaaaaaauuaaaaauuuauagaaccauaucaacac

SEQ ID NO: 44596 - RNA, 64 nt, hsa
uaaauuuuaaagaauuaaaaauuuuaaaaauuuaaauuaaaaaaauuaaaaauuuauagaacca

SEQ ID NO: 44597 - RNA, 64 nt, hsa
aaacaggacaauuuaaaaauuuuaaauuuuaaagaauuaaaaauuuuaaaaauuuaaauuaaaa

SEQ ID NO: 44598 - RNA, 64 nt, hsa
gaugaaggcuuauugguaucaagaauuuaaaccaaauuaaaacugacagaggacauuuagauac

SEQ ID NO: 44599 - RNA, 64 nt, hsa
ugauaagaauaaauuuaauuuaccaaauauuguuaauuaaaauuuuagauacuuaacauuuauu

SEQ ID NO: 44600 - RNA, 64 nt, hsa
acuagaagcuauuacuaaaaauauauauagacaaaauuaaaagaaggaaugauaagaauaaauu

SEQ ID NO: 44601 - RNA, 64 nt, hsa
uuuuuauaccugccuuaaauaauuuggcaaucagaauuaaaaaguuuuuuuuuuuuuaaauaau

SEQ ID NO: 44602 - RNA, 64 nt, hsa
ucugcugccacgucgcaaaccacucaguaaaggaaauuaaaaauguauuugucauguuaaaaag

SEQ ID NO: 44603 - RNA, 64 nt, hsa
agagaacuugagauucaaaagaaaaagcuggauaaauuaaaaucugagguuaaugaaauggaaa

SEQ ID NO: 44604 - RNA, 64 nt, hsa
aaacuaucuuuguaacagauaaguuauuuauaaaaauuaaaaaacuuauauucuaauguggauu

SEQ ID NO: 44605 - RNA, 64 nt, hsa
guaagaaucagcuaagaugcauuauauauauuuuaauuaaaauuaaaacuucagauauuugugg

SEQ ID NO: 44606 - RNA, 64 nt, hsa
aucagcuaagaugcauuauauauauuuuaauuaaaauuaaaacuucagauauuuguggauuaca

SEQ ID NO: 44607 - RNA, 64 nt, hsa
auuguauuuugaguggauauuuuuguuugguaacaauuaaaauuuuaaaucguaaaaaauguac

SEQ ID NO: 44608 - RNA, 64 nt, hsa
guacugaaugccauucagugguacccugcaaaauaauuaaaauccuaacucuuauguuguguau

SEQ ID NO: 44609 - RNA, 64 nt, hsa
aagaucaaaucauauagguaacuucauagaccuaaauuaaaagugauuuuuggcuggacuggca

SEQ ID NO: 44610 - RNA, 64 nt, hsa
aacaaagacauuaaaagaaaacaauuuacuuucuaauuaaaauuuuguguuucuuaagaucaaa

SEQ ID NO: 44611 - RNA, 56 nt, hsa
caguugccaaccauuuguaguucacaaauuaaaacuggguuuccaggccuggugug

SEQ ID NO: 44612 - RNA, 64 nt, hsa
aaacaaaucauuguuuauuacuggucacuuagaaaauuaaaagggauagggccaggcacagugg

SEQ ID NO: 44613 - RNA, 64 nt, hsa
agagcaagacuccgucucaaagaaacaaacaaaaaauuaaaagggauagaauauaaugaaauau

SEQ ID NO: 44614 - RNA, 64 nt, hsa
gcccagucuguuucaaauaaaugaacucaaucuaaauuaaaaaagaaagaaauuugaaaaaacu

SEQ ID NO: 44615 - RNA, 64 nt, hsa
uugauuuagcauucauauuuuccaucuuauucccaauuaaaaguaugcagauuauuugcccaaa

SEQ ID NO: 44616 - RNA, 64 nt, hsa
cuccuagcauucaugauuuuuuuuucauacaaugaauuaaaauugcuaaaaucauggacuggcu

SEQ ID NO: 44617 - RNA, 64 nt, hsa
acuaagcuauuuugaagauuuuuaagcacugauaaauuaaaaaaaaaaaauuagacuccaccuu

SEQ ID NO: 44618 - RNA, 64 nt, hsa
aaaacaaaaaaaaaaacaaaaaaaaacaaaaguaaauuaaaaacaaaaccugaugaaacagaug

SEQ ID NO: 44619 - RNA, 64 nt, hsa
uuuuuaagguuucugaguuaaccagaaaaauagaaauuaaaaacaaaacaaaaaaaaaaacaaa

SEQ ID NO: 44620 - RNA, 64 nt, hsa
cagaaucuguugugagaaaugcccaggcuuuaaaaauuaaaaauggauggaucuucucugaacu

SEQ ID NO: 44621 - RNA, 64 nt, hsa
gaaagcaggauuuucuccuguaucugaauuuuaaaauuaaaaaggcagauaagacauaaauagu

SEQ ID NO: 44622 - RNA, 64 nt, hsa
auuuuaaaagaaauguagucuuguaguaugaaauaauuaaaaauuguuaaauguauauuuuggu

SEQ ID NO: 44623 - RNA, 64 nt, hsa
uaguaauuugcaaaagccacaacaguaguggaagaauuaaaauucauaaagucucaucauucug

SEQ ID NO: 44624 - RNA, 64 nt, hsa
uuuugacauuuaaaauacuucccucaauucuguaaauuaaaagaauaguuauuuuacaguucca

SEQ ID NO: 44625 - RNA, 64 nt, hsa
ucuauauguugcguugugaugacauuaucuuuuaaauuaaaaagagauuuggcuaguugugugu

SEQ ID NO: 44626 - RNA, 64 nt, hsa
ugaagaaaaucuacuuguaaaaggcucagaucuuaauuaaaagguaauuguagcacauuaccaa

SEQ ID NO: 44627 - RNA, 64 nt, hsa
auucgaacuuaacagaugccuccucuccaaagagaauuaaaaucguagcuuguacagaucaaga

SEQ ID NO: 44628 - RNA, 64 nt, hsa
agaacaaaguaguaaaauaaaaaaaaauuuaaaaaauuaaaaaauaaaaaaaagaggucacuaa

SEQ ID NO: 44629 - RNA, 64 nt, hsa
aauugcaggagauuuaauguauaaaauuucuaggaauuaaaagcuuaaacccaaaaauuguuca

SEQ ID NO: 44630 - RNA, 64 nt, hsa
caaaaauuguucauccauauauaagaaauuaucgaauuaaaacuuaauguaugucaauuauuuu

SEQ ID NO: 44631 - RNA, 64 nt, hsa
uuuaaagugaguuugagaaacaaguugaaacuaaaauuaaaauaccagccauuuaggugcuuuc

SEQ ID NO: 44632 - RNA, 64 nt, hsa
auaaugcuuauuaugguaaaauaaaauuggaaaaaauuaaaacugaccuauaagaguguuaagg

SEQ ID NO: 44633 - RNA, 64 nt, hsa
ugauugcuagaguuuuuguuaguacuuuggaugcaauuaaaacuaugugcuaucacaugugaaa

SEQ ID NO: 44634 - RNA, 64 nt, hsa
uaaaauuguucucuuaaauauucugaauccugguaauuaaaaguuuggguguauuuucuuuacc

SEQ ID NO: 44635 - RNA, 64 nt, hsa
gagaagggggaagaggaaaugaaaauagcacaaaaauuaaaauuggaacgaaguaagauaauua

SEQ ID NO: 44636 - RNA, 64 nt, hsa
uagcacaaaaauuaaaauuggaacgaaguaagauaauuaaaacaaaaaacuuauagauguuagg

SEQ ID NO: 44637 - RNA, 64 nt, hsa
aggcuuugucauuuagcauuagacuuuaaacaagaauuaaaaucaugugcuguauuuuuaaaau

SEQ ID NO: 44638 - RNA, 64 nt, hsa
aguuguauguauuucugaacuuggcaaaauuggaaauuaaaauuuuuaaaaauuacaaauauac

SEQ ID NO: 44639 - RNA, 64 nt, hsa
cacuggcacucagccagcugccuccuuccagagcaauuaaaagucuuagcaacaguccucuggu

SEQ ID NO: 44640 - RNA, 64 nt, hsa
cagcugaguuuauuauacuuguuuucuuuuacaaaauuaaaaacaucuaaaaccaggcccaagu

SEQ ID NO: 44641 - RNA, 64 nt, hsa
aaaagucacuaacuuuguguaccuauaaucccuaaauuaaaauuaaauuuuaauuggcuggcug

SEQ ID NO: 44642 - RNA, 64 nt, hsa
uuuaugauaauagaacuaugacagucuucaagucaauuaaaauccacccaccagucuuaggcau

SEQ ID NO: 44643 - RNA, 64 nt, hsa
aauacugaacuguaaggguuaguggagaguuuuuaauuaaaagaaugugugaaaaguacaugac

SEQ ID NO: 44644 - RNA, 64 nt, hsa
uuguaggccaacagagcucauaguacuugggaaaaauuaaaaagccucauuucuagccuucuuu

SEQ ID NO: 44645 - RNA, 64 nt, hsa
aggugauuauauucucucauguacaguuacaggaaauuaaaauguuaaaguaaccuaaaaugaa

SEQ ID NO: 44646 - RNA, 64 nt, hsa
ccaaacuguuggggugguacauuccuuuaggaccaauuaaaacauaauugagggucagugauac

SEQ ID NO: 44647 - RNA, 64 nt, hsa
aauauuuguaaauaaaguaccuguaucuagauuaaauuaaaauugguugcauuauuuucugaac

SEQ ID NO: 44648 - RNA, 64 nt, hsa
ugccucauugucuucuguacaucuuacuggguuuaauuaaaaaaaaagaaaaaacucuguugua

SEQ ID NO: 44649 - RNA, 64 nt, hsa
ugucaucuaaaagcuggccacuaaauuaaaaaaaaauuaaaaguuaugggauuaaaaaaaguua

SEQ ID NO: 44650 - RNA, 64 nt, hsa
gugaagaucacugucaucuaaaagcuggccacuaaauuaaaaaaaaauuaaaaguuaugggauu

SEQ ID NO: 44651 - RNA, 64 nt, hsa
ccugucacuuuugcagauauucuucgguuugaauaauuaaaaugaaccagauaucagggugguu

SEQ ID NO: 44652 - RNA, 64 nt, hsa
gaauaauuaaaaugaaccagauaucagggugguuaauuaaaaugaaccagauaucagggugguu

SEQ ID NO: 44653 - RNA, 64 nt, hsa
cauuuuacuguuuguuuuuauuaucuuaagugcuaauuaaaaaaaaaauaaaauuuuaaaaaaa

SEQ ID NO: 44654 - RNA, 64 nt, hsa
ugauugauagaaagaaaguugcuuuucuuuugagaauuaaaaacuuuggcuugauuucuuuuuu

SEQ ID NO: 44655 - RNA, 64 nt, hsa
cucuacaucguucacgagucuggggagcggacaaaauuaaaagacugcgaguacccgcugauuu

SEQ ID NO: 44656 - RNA, 64 nt, hsa
uuugaaaugccggugcuggacaguuuuguugaaaaauuaaaagaagaggaagaaagagaaauaa

SEQ ID NO: 44657 - RNA, 64 nt, hsa
aaucuugugcgguuuucuuucuuuuuuucuuuuuaauuaaaauacuauaauccauugagaaaua

SEQ ID NO: 44658 - RNA, 64 nt, hsa
ccugaaaguacauaacuucuaucacuugccacauaauuaaaagaacucacauuaagcgguuacu

SEQ ID NO: 44659 - RNA, 64 nt, hsa
aaaucugcgaucaucgucauuugcugugaacugaaauuaaaacuauucaugcuacccagccauu

SEQ ID NO: 44660 - RNA, 64 nt, hsa
cucacacuuacuguaagacauuaguaacauaauaaauuaaaagucacacgaaucucaccaacau

SEQ ID NO: 44661 - RNA, 64 nt, hsa
uauacugcuuacagguuuagauauagucuguuagaauuaaaaccaaguuuaguguucauauuua

SEQ ID NO: 44662 - RNA, 64 nt, hsa
agucauuuuauucucaagugcuuaaaauuaauguaauuaaaagcuuagcugacuacagaauagg

SEQ ID NO: 44663 - RNA, 64 nt, hsa
ucucucauuugccgacuuauuuuuauaggaagccaauuaaaaaaaaaaaaaguuuucuuauagu

SEQ ID NO: 44664 - RNA, 64 nt, hsa
ggaaagacauagggaagaaugggcuguaaauccuaauuaaaaauagaggucgacaugagauacc

SEQ ID NO: 44665 - RNA, 64 nt, hsa
aauagaagacauuuucacuggaauuacaaagcagaauuaaaauuauauuguagaaggaaacacc

SEQ ID NO: 44666 - RNA, 64 nt, hsa
uuuguaauauauucaugaggcuggaaguaagaagaauuaaaaauuuguccuaauuacaaugaga

SEQ ID NO: 44667 - RNA, 64 nt, hsa
cacgaaaguuuuuuuaaagaacagaaacuuuuccaauuaaaaaaaaaaagcagacuucugguuc

SEQ ID NO: 44668 - RNA, 64 nt, hsa
uagguauucuuuuugguuuaauuuuugccaauguaauuaaaaaaugguaugucauuuuuaaaau

SEQ ID NO: 44669 - RNA, 64 nt, hsa
uaaauauuaaaucauaacuugguaagaaacuccuaauuaaaagguuuuuuccaaaauucagguu

SEQ ID NO: 44670 - RNA, 64 nt, hsa
aagaaagaauaaagcuuaguccugugucuuuaaaaauuaaaaauuuuacuugauucccaucuau

SEQ ID NO: 44671 - RNA, 64 nt, hsa
uauuuguguguugugagaaauuuuugucauaagaaauuaaaagaacuuaccaggaagguuuuua

SEQ ID NO: 44672 - RNA, 64 nt, hsa
gguucgauacagcguauuuauugcuugucauguaaauuaaaaaccuuguauuuaacucuuuuca

SEQ ID NO: 44673 - RNA, 64 nt, hsa
acaauaucuuaaaguguccgauucacuacuuguuaauuaaaaaaguuaugauuaaugugaaacu

SEQ ID NO: 44674 - RNA, 64 nt, hsa
ggcuucugcuguuuuuuauuuuuaacauguucauaauuaaaaaguauuuuccagcaguccaaag

SEQ ID NO: 44675 - RNA, 64 nt, hsa
uuguuuuugguugaacaaaugcaagauugaacaaaauuaaaaauucauugaagcugaaauucca

SEQ ID NO: 44676 - RNA, 64 nt, hsa
auauuugaugugaugauucacuuuucaguucucaaauuaaaagaaaacuguuagaugcacacug

SEQ ID NO: 44677 - RNA, 64 nt, hsa
uuuaacagggcauuuaaguggcuagcaaaucaguaauuaaaaauuaagcuuucuacuccaagua

SEQ ID NO: 44678 - RNA, 64 nt, hsa
acccauuuuuccuuaaccaacacccaaaucaaacaauuaaaauauacaguguuuuuccacucac

SEQ ID NO: 44679 - RNA, 64 nt, hsa
guaacaaaggagcuucuuguccccuuggucuuuuaauuaaaagaaauuccaacugacuuuuaaa

SEQ ID NO: 44680 - RNA, 64 nt, hsa
gaaauaugucccccccuaacuuucuugcuucaaaaauuaaaauccagcaucccaagaucauucu

SEQ ID NO: 44681 - RNA, 64 nt, hsa
acaagccuaacauuggugcaaagauugccucuugaauuaaaaaaaaaaacuagauugacuauuu

SEQ ID NO: 44682 - RNA, 64 nt, hsa
agccugauuucauauuguauuuuaaacugugugaaauuaaaaacaaagaauuucauucauaaug

SEQ ID NO: 44683 - RNA, 64 nt, hsa
guacaggggaauuaugugugugaaugucaucuacaauuaaaaaaaauuagcacaucccuuuacu

SEQ ID NO: 44684 - RNA, 64 nt, hsa
uuaauaagacggucaacuucacacuuagggaaaaaauuaaaaugugauggccacuucuaauaau

SEQ ID NO: 44685 - RNA, 64 nt, hsa
aguaauuuaacaaagggagccugcugaauaacaaaauuaaaaugaugaaacaaaaguuugacag

SEQ ID NO: 44686 - RNA, 64 nt, hsa
ggaacucacagaacuuaaagaaaacaaauaauccaauuaaaaauggucaaaggggcugggcaug

SEQ ID NO: 44687 - RNA, 64 nt, hsa
cuauuguggaaaacaguguagagguuucucaaaaaauuaaaacuaucauacaacccagcagucc

SEQ ID NO: 44688 - RNA, 64 nt, hsa
uucagcaugacuauguauuuuucuauguuuuuuuaauuaaaaauuuuuaaaauacuuguuucag

SEQ ID NO: 44689 - RNA, 64 nt, hsa
cacuguugugaaucaccaaaggagcuauggagagaauuaaaacucaacauuacuguuaacugug

SEQ ID NO: 44690 - RNA, 64 nt, hsa
uuuauuuuaaaaaauaauaauaaaaauuuaaaaaaauuaaaaauaaaaaaaaccacagaaaaca

SEQ ID NO: 44691 - RNA, 64 nt, hsa
cuugaaaauuauuugucaucauaaaaaugaaacaaauuaaaauauuuauugccaggcaaggcca

SEQ ID NO: 44692 - RNA, 64 nt, hsa
ugggcaacaugacaagaccccaucucuacaaaaaaauuaaaaaauuagccaggcaugguggcac

SEQ ID NO: 44693 - RNA, 64 nt, hsa
aucaacuuauuccauuaaauagauacauuaaaaaaauuaaaaacugauucuucugcagagcacu

SEQ ID NO: 44694 - RNA, 64 nt, hsa
uauauaccucauucuuuaguguuguuaaaugaaaaauuaaaauuuguguuuauuauaagauacu

SEQ ID NO: 44695 - RNA, 64 nt, hsa
ccaaacuuauccagggccauagaaguaugaaucuaauuaaaacagaaaugggaauuauugcaca

SEQ ID NO: 44696 - RNA, 64 nt, hsa
cauauaccccaaaaugcuaaguggaaacugcaugaauuaaaagagggguaugauagggacauug

SEQ ID NO: 44697 - RNA, 64 nt, hsa
cuaauucaucuuugcuuccuguuacuuuauauuuaauuaaaaauuuuagugacuuuuuaacuug

SEQ ID NO: 44698 - RNA, 64 nt, hsa
uccaacuacauccuuaugauguuuuuaacaauaaaauuaaaacaacuguuaaacuaaaaaccac

SEQ ID NO: 44699 - RNA, 64 nt, hsa
aaaaucgggcacucuauauucauuaagguuuaugaauuaaaaagaaagcuuuauguaguuaugc

SEQ ID NO: 44700 - RNA, 64 nt, hsa
acagggcuuuacuaucuuuucaucucauuaauucaauuaaaaccauuaccuuaaaauuuuuuuc

SEQ ID NO: 44701 - RNA, 64 nt, hsa
uagugcauuugagcacacauuuuaauuuuccucuaauuaaaaugugcaguauuuucagugucaa

SEQ ID NO: 44702 - RNA, 64 nt, hsa
uugucgcugaguugacagaagcaacuauuguacaaauuaaaaauaaccauaagggagaaaccag

SEQ ID NO: 44703 - RNA, 64 nt, hsa
gggagaaaccagaagaauuccucugaccacuuacaauuaaaauauuuugucuucuuuaaaaaaa

SEQ ID NO: 44704 - RNA, 64 nt, hsa
cagaaaauggaggcuuucacaaggguuugaucagaauuaaaaccccaaacccgcccucuguuag

SEQ ID NO: 44705 - RNA, 64 nt, hsa
uguaacaaugucaguuguuaaaccuugacauuucaauuaaaacaugaauuguaguuauaacuca

SEQ ID NO: 44706 - RNA, 64 nt, hsa
cugauugugguaaacaauguuuaaugugaaaagaaauuaaaacuuucuucaucuguuguagaau

SEQ ID NO: 44707 - RNA, 64 nt, hsa
augcuuacuccuuagaguucagaugaauucuuaaaauuaaaaaaaaacuccauaguacuaauuu

SEQ ID NO: 44708 - RNA, 64 nt, hsa
acaaaaguaauuauucuugggugccuuucaagaaaauuaaaaauacuacucacuacaauaaaac

SEQ ID NO: 44709 - RNA, 64 nt, hsa
ugagcuuaaacaaaugccacucucaugcauucuaaauuaaaaaguuaaaaugauuaauaguuca

SEQ ID NO: 44710 - RNA, 64 nt, hsa
cugggacuauaggugcaugccaccacacccagcuaauuaaaaaaauuuuuuguguggagucuau

SEQ ID NO: 44711 - RNA, 64 nt, hsa
ugacaaagaguaguuuuaucagguaaauccugguaauuaaaaacgcauguuuuuaaaaauuagc

SEQ ID NO: 44712 - RNA, 64 nt, hsa
uguuaauuuuaaacacauuuuuuaagaaaaaaauaauuaaaaaagaaacagugcucaugucaua

SEQ ID NO: 44713 - RNA, 64 nt, hsa
acauaaauacauuuucuaagggggggggggaagaaauuaaaaaacaccuguuaauuuuaaacac

SEQ ID NO: 44714 - RNA, 64 nt, hsa
ugacuucucuuuuaaaauugaguagcagaugaaaaauuaaaauuugaacuugauuauuaauauc

SEQ ID NO: 44715 - RNA, 64 nt, hsa
gaaaaauuaaaauuugaacuugauuauuaauaucaauuaaaauguuuuauuuauuuuauuaaaa

SEQ ID NO: 44716 - RNA, 64 nt, hsa
aaacuguguaucauuaaaauauauguucugcaagaauuaaaacugaguccaugaaaauaccaua

SEQ ID NO: 44717 - RNA, 64 nt, hsa
uguuauauuccaaggaaaauugaaaguauucagaaauuaaaauauuauuugauaucugaaaccu

SEQ ID NO: 44718 - RNA, 64 nt, hsa
aaacaaguuguccaauugccaagaauauguuaacaauuaaaaguuccaaacuaaagccaauagc

SEQ ID NO: 44719 - RNA, 64 nt, hsa
gaaacauagcuauuaccaucucauauuacugucuaauuaaaauaaacauaacgcaaacauguuu

SEQ ID NO: 44720 - RNA, 64 nt, hsa
agaaacuaaauuuucaaaaaauuaauauguguacaauuaaaaugaaugaaagaaaaaccauuau

SEQ ID NO: 44721 - RNA, 64 nt, hsa
aacucccaagcccuaaagagaaccuucucacaagaauuaaaaacaaaaagggcaaaccuaggaa

SEQ ID NO: 44722 - RNA, 64 nt, hsa
uugggccaccuauuucaauaaaaaauaaaauauaaauuaaaaaaguugccgggggugguggcuc

SEQ ID NO: 44723 - RNA, 64 nt, hsa
uccauggucuuucugggccuuacugugcugguauaauuaaaauaaaauauauuuuguucuauug

SEQ ID NO: 44724 - RNA, 64 nt, hsa
cauguugggcugcaugauaaaaguuaauuauaaaaauuaaaagauuuuuuuuuuugagauggaa

SEQ ID NO: 44725 - RNA, 64 nt, hsa
ggauuauaggcguaagccaccaugccuggccaaaaauuaaaagauuuuaugaaacgaaauggcu

SEQ ID NO: 44726 - RNA, 64 nt, hsa
aaaaaaaaaaaugucuuaaccaaccgaaaagaaaaauuaaaaaaggauuuguauuaaaucuuau

SEQ ID NO: 44727 - RNA, 64 nt, hsa
aacugcaggcgccuuuguaaaaugcaaaauauuuaauuaaaagagauuuuaacauaaugagagc

SEQ ID NO: 44728 - RNA, 64 nt, hsa
ucuuaaaaucaaguaucaauacaaaauagaacacaauuaaaaucuuaauuguuggcugggcaca

SEQ ID NO: 44729 - RNA, 64 nt, hsa
uuuuucauuugauacuuuuaauuuacacuuaguaaauuaaaaguuguuuaauuuacuuggcauu

SEQ ID NO: 44730 - RNA, 64 nt, hsa
ugugcuguguuuucuaacacauuuuucuguuuuuaauuaaaaaaaaaaaaaaaagguuuucagu

SEQ ID NO: 44731 - RNA, 64 nt, hsa
aaucccccucugcgagaaacacccaagaaugaucaauuaaaaaaaaaauaauauaauaauaauu

SEQ ID NO: 44732 - RNA, 64 nt, hsa
agcguugguguugugagcggcccaugaaaagccaaauuaaaaaucaaggauucagucaaacuaa

SEQ ID NO: 44733 - RNA, 64 nt, hsa
cacauggcuuuaagaaccacacugaugccuugauaauuaaaaagaauacaagcauuccauguac

SEQ ID NO: 44734 - RNA, 64 nt, hsa
uggugccgauguugaacuuuuuuuaaggggagaaaauuaaaagaaauauacaguuugacuuuuu

SEQ ID NO: 44735 - RNA, 64 nt, hsa
aaguguugagccaugcuacaguuagucuugucccaauuaaaauacuaugcaguaucucuuacau

SEQ ID NO: 44736 - RNA, 64 nt, hsa
uacuuuguguuuagcuaccuuuuuauauuuaaaaaauuaaaaaugaaaauuacguucuuacaag

SEQ ID NO: 44737 - RNA, 64 nt, hsa
uuuggcuugcuguuuacucccuucuguaguuuuuaauuaaaaacuuuaaagauaagucuacauu

SEQ ID NO: 44738 - RNA, 64 nt, hsa
ccuauaaauuaaaaauuuuuuacuuaaauuuaagaauuaaaaaaauacaaaaaagaaaaaauga

SEQ ID NO: 44739 - RNA, 64 nt, hsa
caggcuuuccaguuuuuaccagaaaaccccuauaaauuaaaaauuuuuuacuuaaauuuaagaa

SEQ ID NO: 44740 - RNA, 64 nt, hsa
aauauuaaauuaaaaccuuuacuuuuguauaauaaauuaaaacucagaauaaaccugugaccac

SEQ ID NO: 44741 - RNA, 64 nt, hsa
cacguaagaaaguguuuuucuacuauuaauauuaaauuaaaaccuuuacuuuuguauaauaaau

SEQ ID NO: 44742 - RNA, 64 nt, hsa
auauucuguauuauaaccauuguuucuguaguuuaauuaaaacauuuucuugguguuagcuuuu

SEQ ID NO: 44743 - RNA, 64 nt, hsa
aagagauugacucagcauugccuucauuccuuaaaauuaaaaaccuacaaaaguugguguaaau

SEQ ID NO: 44744 - RNA, 64 nt, hsa
aacaaaaaaacuauauuaaacaggguuuaaaggaaauuaaaacagaacuaugagaaguacaauu

SEQ ID NO: 44745 - RNA, 64 nt, hsa
cacagaaucaccugagugucaauugaaaguugucaauuaaaagguaaccuuuuaaucucguagg

SEQ ID NO: 44746 - RNA, 64 nt, hsa
cauggaaaauucccuccucuuccccccuuuuuuuaauuaaaagaagucacuuaggaaaauaaca

SEQ ID NO: 44747 - RNA, 64 nt, hsa
uugaauuuuacuguuacacauaguuuuugacuugaauuaaaauacuagacaaagcagaaaugua

SEQ ID NO: 44748 - RNA, 64 nt, hsa
gaaaugaagugagaagggaaguuuagagaaaaaaaauuaaaaagaaacaaagucuccaagaaau

SEQ ID NO: 44749 - RNA, 64 nt, hsa
uauuagcuuuaaauguaaaugggcuaaaugcuccaauuaaaagacacagacaggcaaauuggau

SEQ ID NO: 44750 - RNA, 64 nt, hsa
caggaaagauccaaaauuaacacccuaacaucacaauuaaaagaacuagaauugcaagagcaaa

SEQ ID NO: 44751 - RNA, 64 nt, hsa
cugggcaacacggggagacccugucucuacaagaaauuaaaaauuagccaggcauaguuggcac

SEQ ID NO: 44752 - RNA, 64 nt, hsa
aaaugaugacuuuauugcuuagaaaguuguaaauaauuaaaagcuucccaagaguuaaaugaag

SEQ ID NO: 44753 - RNA, 64 nt, hsa
cuccaacugaaauguuaaggaagaagauagauccaauuaaaaaaaauuaaaaccaauuuaaaaa

SEQ ID NO: 44754 - RNA, 64 nt, hsa
aauguuaaggaagaagauagauccaauuaaaaaaaauuaaaaccaauuuaaaaaaaaaaagaac

SEQ ID NO: 44755 - RNA, 64 nt, hsa
cagagcaagacugucucaaaaaaauuaaaauuaaaauuaaaaacaaauaauccugccuuuuaca

SEQ ID NO: 44756 - RNA, 64 nt, hsa
gggcgacagagcaagacugucucaaaaaaauuaaaauuaaaauuaaaaacaaauaauccugccu

SEQ ID NO: 44757 - RNA, 64 nt, hsa
uagccugggcgacagagcaagacugucucaaaaaaauuaaaauuaaaauuaaaaacaaauaauc

SEQ ID NO: 44758 - RNA, 64 nt, hsa
gcaguguugcgcgucacaagagagccuguauauaaauuaaaauagucaagacaacacugaccuu

SEQ ID NO: 44759 - RNA, 64 nt, hsa
aggguagugacugagauguaaaaauagauuuuagaauuaaaacaaaauccaaguccucacaccc

SEQ ID NO: 44760 - RNA, 64 nt, hsa
aaauugucucuugucuccuucaguuaauuuucagaauuaaaaacauaccaugggaaaaaagcuu

SEQ ID NO: 44761 - RNA, 64 nt, hsa
agaaccugucucuuaaaaaaaaaaauuuuuuuuuaauuaaaaaaacccacccuuuuucauuucc

SEQ ID NO: 44762 - RNA, 64 nt, hsa
gagaacagagaugagauuugacaaaaaaaaauugaauuaaaaauaacacagucuuuuuaaaacu

SEQ ID NO: 44763 - RNA, 64 nt, hsa
augccaucuucccugcgaucaggcaaaaaaguggaauuaaaaagucaaaccuuuauaugcaugu

SEQ ID NO: 44764 - RNA, 64 nt, hsa
uguuuuugaaucaaugcaguuuggggaugaauauaauuaaaauauguuuaauaacuuagaauuc

SEQ ID NO: 44765 - RNA, 64 nt, hsa
accgaagcaaguguacccuuuauaggaacccucaaauuaaaaaaaaaugucuuuuaauggauga

SEQ ID NO: 44766 - RNA, 64 nt, hsa
augacauuccaaguugacauuuuuuuuucauuuuaauuaaaauuugaaauucugaacaccguca

SEQ ID NO: 44767 - RNA, 64 nt, hsa
gugaaugccaccuccugagauccucaccucuuggaauuaaaauuguuggucacuggggaaagcc

SEQ ID NO: 44768 - RNA, 64 nt, hsa
cugucucuaaagaaaaacuauagaaaauuuaaaaaauuaaaaaacggguaacaugguaaauuuu

SEQ ID NO: 44769 - RNA, 64 nt, hsa
agcauuugaugcauuauaacuuaaagguacuacaaauuaaaaauuaaaguauaaaguauuuuaa

SEQ ID NO: 44770 - RNA, 64 nt, hsa
uuaguagaguuuauagccuauuuuucuuuuuucuaauuaaaaccacuauacaaacuuacgaaac

SEQ ID NO: 44771 - RNA, 64 nt, hsa
auuccacuguuuucuuuggggaauggaaguucugaauuaaaagcccacuguggagaugcugugg

SEQ ID NO: 44772 - RNA, 64 nt, hsa
guuaaugcaaagcuaaaauaaaauuuuccuuggcaauuaaaaaugcugugcgcuaauacccugc

SEQ ID NO: 44773 - RNA, 64 nt, hsa
uuacuucugggaauuuguauguaacagccuagaaaauuaaaaggagguggaugcauccaaagca

SEQ ID NO: 44774 - RNA, 64 nt, hsa
gguucuguuuuaaaaaggauuuuguuugauuugaaauuaaaacuucaagcugaaugacuuauau

SEQ ID NO: 44775 - RNA, 64 nt, hsa
gaaaagauguucaugguacauuguaaaaaaauaaaauuaaaauuaaaaaaaguuugcagaaccg

SEQ ID NO: 44776 - RNA, 64 nt, hsa
auguucaugguacauuguaaaaaaauaaaauuaaaauuaaaaaaaguuugcagaaccgcauaua

SEQ ID NO: 44777 - RNA, 57 nt, hsa
cuaccaagaacaaagcauaaugcuggcaauuaaaaaugugguuuaguuuuccaaaca

SEQ ID NO: 44778 - RNA, 64 nt, hsa
uacuuauacaauguuuuguacuuguauuucaugaaauuaaaacagugaugcuaaaacuauggca

SEQ ID NO: 44779 - RNA, 64 nt, hsa
cagcaucugaauuucaaguucuuaaaauuucaaaaauuaaaauuuuucauuauuagcuauccau

SEQ ID NO: 44780 - RNA, 64 nt, hsa
cagagccucacugcagugucuaaagguagaugcaaauuaaaaugcagggaaaauaacuuuucug

SEQ ID NO: 44781 - RNA, 64 nt, hsa
ugugaugcagcuaccaugauucaaaaaaauuaaaaauuaaaaaaaaaaaaucugccacuuaucc

SEQ ID NO: 44782 - RNA, 64 nt, hsa
gagcuuuugugaugcagcuaccaugauucaaaaaaauuaaaaauuaaaaaaaaaaaaucugcca

SEQ ID NO: 44783 - RNA, 64 nt, hsa
auucacauguggcuguuaauaugugcuuguuuuuaauuaaaacaagaagcuuuaaacuggugug

SEQ ID NO: 44784 - RNA, 64 nt, hsa
uggugaacaaaaaucgaacccaugagugaacauaaauuaaaaaguugaucaaccuauuaaaaug

SEQ ID NO: 44785 - RNA, 64 nt, hsa
aacuuguuauucaguuacuaaauuugaggugaauaauuaaaaagaaaaggacauuaggagagug

SEQ ID NO: 44786 - RNA, 64 nt, hsa
auauguauggauauaauauaaaaugaauucauauaauuaaaaagaauuugguuaauaagaauuu

SEQ ID NO: 44787 - RNA, 64 nt, hsa; identical to SEQ ID NO: 44773

SEQ ID NO: 44788 - RNA, 64 nt, hsa
gguucuguuuuaaaaaggauuuuguuugauuugaaauuaaaacuucaaacugaaugacuuauau

SEQ ID NO: 44789 - RNA, 62 nt, hsa
gcgcaaguauuccauuugcauuugguaauuuuucaugccaccuauuuaugaauauauaaauc

SEQ ID NO: 44790 - RNA, 62 nt, hsa
cuccccuggcucuuagcaaccugcccuuuuauucaugccauuuggggucacagaugccuagc

SEQ ID NO: 44791 - RNA, 62 nt, hsa
ccuuugggcggccucugggcuugggcaccagcucaugccagccccagagggucaggguugga

SEQ ID NO: 44792 - RNA, 62 nt, hsa
gaggcuaacagauccaaugggaguccauggugucaugccaagacaguaucagacacagcccc

SEQ ID NO: 44793 - RNA, 62 nt, hsa
cgcaaucucacugcaagcuccacuuccuggguucaugccauuuuccugccucagccucccga

SEQ ID NO: 44794 - RNA, 62 nt, hsa
uguuuagauguuggagcagauuagagcagcauucaugccacucggagcaaccagacuuacag

SEQ ID NO: 44795 - RNA, 64 nt, hsa
gacagguaacgcagugcgggguuagggauuccccgggagagaggacgaagcgaggagaguucuc

SEQ ID NO: 44796 - RNA, 64 nt, hsa
aagacagcccgguaggcugcgucgcccgagccccgggagagaggagcgaagauccggaacucgc

SEQ ID NO: 44797 - RNA, 64 nt, hsa
cugcuccuuguugggcagacaccagcggugugcagggagagaccaaguaccaucuuuaucuaca

SEQ ID NO: 44798 - RNA, 64 nt, hsa
gugcuuccauacagugguuucugaagcuuuugcagggagagaagauggcuuaguguuuagacug

SEQ ID NO: 44799 - RNA, 64 nt, hsa
gcaggggauagcagugaggucagaagucuuucccgggagagagauggccuggguuaucauugcu

SEQ ID NO: 44800 - RNA, 64 nt, hsa
cucacccagaccuggccagggaaugauguaucuggggagagaaugagcuggaggagggggccuc

SEQ ID NO: 44801 - RNA, 64 nt, hsa
ccccuggacugcccauccugcugggauggcuguugggagagagugaugaccucguggccugugu

SEQ ID NO: 44802 - RNA, 64 nt, hsa
gagagaagggcgugccacccuugcugugcaacaugggagagaaguucuuauuguuggccaugaa

SEQ ID NO: 44803 - RNA, 64 nt, hsa
cggggagauuugagaggggaaaaccccgccaggagggagagagaggcaccccucugggaugcgg

SEQ ID NO: 44804 - RNA, 64 nt, hsa
guagcacuguucugguucuguuugcacgccaguggggagagaauaaagaggaaaauuuaacaga

SEQ ID NO: 44805 - RNA, 64 nt, hsa
caugaaauaaggcaucucugagaaaguggccccagggagagaauggaggacugggaggagaagc

SEQ ID NO: 44806 - RNA, 64 nt, hsa
uucucuggcaucaaguuucuugcagcugcucugagggagagacagugagcugcaagacugccuc

SEQ ID NO: 44807 - RNA, 64 nt, hsa
ccucacaccaccgccaggagaggccuuucccaccgggagagaaacuuccagaccagccccucac

SEQ ID NO: 44808 - RNA, 64 nt, hsa
ccucacaccacagccaggagaggccuuucccaccgggagagaaacuuccagaccagcccucuca

SEQ ID NO: 44809 - RNA, 64 nt, hsa
ggcugagccacaugaaggcagcacucagggccaggggagagagaagaggaucagcagugcagcc

SEQ ID NO: 44810 - RNA, 64 nt, hsa
uggccagagcagggcuggagggaaggagccaggagggagagagccucccaccuuuccccugcug

SEQ ID NO: 44811 - RNA, 64 nt, hsa
cacaugggguaagggggguugggggugggggagagggagagagcgaacacccacgcugguuucu

SEQ ID NO: 44812 - RNA, 64 nt, hsa
aucacagccccgaagguccugccuucaccccauugggagagagcagggcauccuggcaucugcg

SEQ ID NO: 44813 - RNA, 64 nt, hsa
cagaguugaugcuggauguucagauuccuaaguggggagagaguuuggacaucucacucaaaag

SEQ ID NO: 44814 - RNA, 64 nt, hsa
ugggaaagaagagggagggagagagaaagacgaagggagagagaaagcaguuuccaaggauaug

SEQ ID NO: 44815 - RNA, 64 nt, hsa
ggcaguacugaagagaaaugggaaagaagagggagggagagagaaagacgaagggagagagaaa

SEQ ID NO: 44816 - RNA, 64 nt, hsa
uggggugggggcagaacaugaguagcaaagaaaagggagagacgaaaaggguacaggcucacgu

SEQ ID NO: 44817 - RNA, 64 nt, hsa
augcacacaaagacagcaacuuuuguacagaguggggagagacuuuuucuuguauaugcuuaua

SEQ ID NO: 44818 - RNA, 64 nt, hsa
gagggagggagggagagaauggcccgagggaggagggagagaaggagggaggcgcuccugggac

SEQ ID NO: 44819 - RNA, 64 nt, hsa
uauaaacacuggaggggagggagggagggagggagggagagaauggcccgagggaggagggaga

SEQ ID NO: 44820 - RNA, 64 nt, hsa
agguugaucuaccgacaccuuccacuucuuuccugggagagacugcuggcuucauuggugauug

SEQ ID NO: 44821 - RNA, 64 nt, hsa
cuuaagcugugaucaugccacugcauuccagccugggagagagagaggaccugucuguugaaaa

SEQ ID NO: 44822 - RNA, 64 nt, hsa
cguugguauacagggcaggaaagagaggaauaaagggagagagcaguguggaaaccacgguggu

SEQ ID NO: 44823 - RNA, 64 nt, hsa
uuacugauuaaaguuuucuuuuauuuggguggccgggagagacccagggagguucuggagguuc

SEQ ID NO: 44824 - RNA, 64 nt, hsa
gaucuuuucuugacucucccacaugcucuguuaugggagagaauccccuacccuacucugaugu

SEQ ID NO: 44825 - RNA, 64 nt, hsa
ugucggaaccaggacacaaaagcagcaagaagcggggagagagagggauagaaaacaagcgcag

SEQ ID NO: 44826 - RNA, 64 nt, hsa
uauuuuuauauagcuugaaacauagagggagagagggagagagccuauaccccuuacuuagcau

SEQ ID NO: 44827 - RNA, 64 nt, hsa
cauuuguuuauuuuuauauagcuugaaacauagagggagagagggagagagccuauaccccuua

SEQ ID NO: 44828 - RNA, 64 nt, hsa
caaaaaaaaacaaaacaaaacaaaaaaaagacaugggagagaugguguuuuuccucuccaccac

SEQ ID NO: 44829 - RNA, 64 nt, hsa
ccugccucuccccacccugcccacauccacagaggggagagaagggucauagcuaaaugcaaca

SEQ ID NO: 44830 - RNA, 64 nt, hsa
acuauguuacaguguauaaaugauuccucuauuugggagagaucuuccaauccagaggagcccc

SEQ ID NO: 44831 - RNA, 64 nt, hsa
guggcuagaaaugcaacuuguauaaaacaaaaaugggagagagagagguauuaaacaaauaccc

SEQ ID NO: 44832 - RNA, 64 nt, hsa
uuuuggagucuuuguugcuauauuuuguggggcugggagagagagauuagauuauuuugacaug

SEQ ID NO: 44833 - RNA, 64 nt, hsa
ccuguuguaaugugcaggacccuucuccuuucaugggagagacagguaguuaccugaauauagg

SEQ ID NO: 44834 - RNA, 64 nt, hsa
gggagaagggaaaagagagaaggcagggagaguagggagagaaaaccuuccagcagcccaguaa

SEQ ID NO: 44835 - RNA, 64 nt, hsa
aaaggcugcuuuagcuguggaugcccuugauuaagggagagagcgccuaggagcugccugcccc

SEQ ID NO: 44836 - RNA, 64 nt, hsa
gggcaccaccaagaauuuguggccuaccuugugagggagagaacugagcaucuccagcauucuc

SEQ ID NO: 44837 - RNA, 64 nt, hsa
aggggucauccuugcccaucgggaccagaaaccugggagagacuuggaugaggagugguugggc

SEQ ID NO: 44838 - RNA, 64 nt, hsa
acaaaaaccccacaaaauaccccaacacaggcgggggagagacgaaaaagaaaaggaaagagca

SEQ ID NO: 44839 - RNA, 64 nt, hsa
uuuagaguuaguucuacccagcgaggaggaggcggggagagaaacugcguucucuuuccccagc

SEQ ID NO: 44840 - RNA, 64 nt, hsa
aaaauaguuugcaaaggaccagguaauuggggaggggagagaggugggggcaagggggaaaugc

SEQ ID NO: 44841 - RNA, 59 nt, hsa
ccccgguugcgcugguauaguugcccagcgggagagacacccccauccccacgcgggcc

SEQ ID NO: 44842 - RNA, 64 nt, hsa
agggauagacagucuccaagaaaagugaaguggugggagagaauugcuuuuuucuuuuuuuucu

SEQ ID NO: 44843 - RNA, 64 nt, hsa
auccggaugcuucggaccccacgccucugcaagugggagagacccgagcauccuccccaccccc

SEQ ID NO: 44844 - RNA, 64 nt, hsa
uucugaggagagagcuagcuaggggcugggaaaggggagagauuggaguccuggucucccuaag

SEQ ID NO: 44845 - RNA, 64 nt, hsa
gccuguucuuagcacugaguugaucgcuccaugggggagagaucagacauuccuuaucagagau

SEQ ID NO: 44846 - RNA, 64 nt, hsa
gaggcagagagggagagaggcagagagacagagagggagagagggacagagagagauagagcag

SEQ ID NO: 44847 - RNA, 64 nt, hsa
gaaggagagaggcagagagggagagaggcagagagggagagaggcagagagacagagagggaga

SEQ ID NO: 44848 - RNA, 64 nt, hsa
gaaagagacaggcagagaaggagagaggcagagagggagagaggcagagagggagagaggcaga

SEQ ID NO: 44849 - RNA, 64 nt, hsa
aaacagaggagacagagagggagagagagacagagggagagagagacagaggggaagagaggca

SEQ ID NO: 44850 - RNA, 64 nt, hsa
aggcagagagggagagaaacagaggagacagagagggagagagagacagagggagagagagaca

SEQ ID NO: 44851 - RNA, 64 nt, hsa
agauaugaggagagagagacagaggaggcagagagggagagaaacagaggagacagagagggag

SEQ ID NO: 44852 - RNA, 64 nt, hsa
agaggaggggagagagaaagagagguggggagaggggagagagauaugaggagagagagacaga

SEQ ID NO: 44853 - RNA, 64 nt, hsa
gagggaaaggaggagggagagagauggagaggaggggagagagaaagagagguggggagagggg

SEQ ID NO: 44854 - RNA, 64 nt, hsa
gugcauaaaugggggucagggagggaaaggaggagggagagagauggagaggaggggagagaga

SEQ ID NO: 44855 - RNA, 64 nt, hsa
uucucugugccucaguuuccuucuccuuugaggggggagagagaacagugcagccccauuuccg

SEQ ID NO: 44856 - RNA, 64 nt, hsa
aaaucuuuauugagugccuaccggugcaggcgcugggagagacaauagcuuugaggagcucaca

SEQ ID NO: 44857 - RNA, 64 nt, hsa
agagggcacaaggugacagcgucgggacugagaggggagagagacuggagcuggcaaggacgug

SEQ ID NO: 44858 - RNA, 64 nt, hsa
cuuauaaagaaaacuguuugggaaaauacguugagggagagaagaccuugggccaagaugcuaa

SEQ ID NO: 44859 - RNA, 64 nt, hsa
ggcuggagcaccccaaaagccaggggaaaguggagggagagaaacgugacacuguccgccucgg

SEQ ID NO: 44860 - RNA, 64 nt, hsa
cagggaugggccccguggaaccccgaagccuggcgggagagagagagagagaagucuccucugc

SEQ ID NO: 44861 - RNA, 64 nt, hsa
aaaaaaauuguuuuagcgcuggguuucccaaggugggagagacagacccagccuggagcuggcc

SEQ ID NO: 44862 - RNA, 64 nt, hsa
aaaccacuguauuuuucuguugagccuguacuuggggagagaucaguagcauuugaggaaguaa

SEQ ID NO: 44863 - RNA, 64 nt, hsa
cccuggcuugggagaccgcucucugcaagggagggggagagaagcagagggagagagaagguga

SEQ ID NO: 44864 - RNA, 64 nt, hsa
accgcucucugcaagggagggggagagaagcagagggagagagaaggugacacggauggaagag

SEQ ID NO: 44865 - RNA, 63 nt, hsa
aggagcacaacagaugccacgucuucgugcauucgccaacacgugcccucacagggccagcgu

SEQ ID NO: 44866 - RNA, 63 nt, hsa
gcugccugugucuucaccuguccuguccaccagcgccaacagccguggggaagccaaggagac

SEQ ID NO: 44867 - RNA, 64 nt, hsa
cugcaauaugaaaugagcacauucuuugauaaggcguaucuauucaugcuuuuguaccacuguu

SEQ ID NO: 44868 - RNA, 64 nt, hsa
acuagacagauacaguggagauagcuuucaaacccguaucuauuccuaacuacugccucuaaua

SEQ ID NO: 44869 - RNA, 64 nt, hsa
ccgaggagaggaugaauucaaguuuccuuaccugcguaucuacuaacaaacaugagaccucccu

SEQ ID NO: 44870 - RNA, 64 nt, hsa
ucuuuugaauuuccucaucccuccaucucaaucccguaucuacgcacccccccccccccaggca

SEQ ID NO: 44871 - RNA, 64 nt, hsa
uacaguuaguuauauuagcagcccucugagauggcguaucuaucggaaggauuucaaacaccaa

SEQ ID NO: 44872 - RNA, 64 nt, hsa
gccucucucugugacuggaaucucuccaccucaucguaucuaaggauaacccagaaacaugggg

SEQ ID NO: 44873 - RNA, 64 nt, hsa
ccuaggcucuauuaacauaauucuuuauuguaaacguaucuaaugcuaaaaguaauaaaauggu

SEQ ID NO: 44874 - RNA, 64 nt, hsa
gaugugugaauauuuguuuauauacauauaugcacguaucuauauguauauauaaaugcauuau

SEQ ID NO: 44875 - RNA, 64 nt, hsa
gcagacgcacaggccggaaaaggcgcaucuaacgcguaucuaggcuuugguaacugcggacaag

SEQ ID NO: 44876 - RNA, 64 nt, hsa
ggcucugcuacccaccuccggagacacaagcccacguaucuacuuucacuugcucauccuugcu

SEQ ID NO: 44877 - RNA, 64 nt, hsa
aagcuuuauuuguagcuucugccuuguuugacggcguaucuauucagggaagcgcacaguaaaa

SEQ ID NO: 44878 - RNA, 64 nt, hsa
aauugauuaaaaguauccaugucuuggauacauacguaucuauagagcuggcauguaauucuuc

SEQ ID NO: 44879 - RNA, 64 nt, hsa
agguaguaaaguauaaguaauuuuuugguuugaucguaucuaaaucacauucaaaauuaaaguu

SEQ ID NO: 44880 - RNA, 64 nt, hsa
uggaauacagaaaauuaaauauaccuguuaaguucguaucuaaaccuaagacauuaccaagguu

SEQ ID NO: 44881 - RNA, 64 nt, hsa
uaacauguugagauucucuaguuguuuucuuuggcguaucuaaccccuucuuuuguuuucugag

SEQ ID NO: 44882 - RNA, 64 nt, hsa
aggacucgggccacgaaaggaaagaaauguauaccguaucuaucuacccgacagcagcgaccga

SEQ ID NO: 44883 - RNA, 64 nt, hsa
caaagcucuggcucacaggccccaaacuaccagccguaucuagcauauccccacccuccaccca

SEQ ID NO: 44884 - RNA, 64 nt, hsa
gcuuauugaaugucaucuacugcuuuaggaaaaacguaucuaguguauuauuuuuaaaauugua

SEQ ID NO: 44885 - RNA, 64 nt, hsa
uucaggccccgcuugcaagagcuggaaaaaaacgcguaucuacuaggaggagccagggacuggg

SEQ ID NO: 44886 - RNA, 64 nt, hsa
gaaauuuuuuuaagugaggacucucuacccuugccguaucuaaggagcugagguaauacagauc

SEQ ID NO: 44887 - RNA, 64 nt, hsa
uugagcccaggaguugaagaacguggcgaaaccccguaucuauuauuuaaaaaaauugaaaaag

SEQ ID NO: 44888 - RNA, 64 nt, hsa
gugcaacgcggccuuuggugcccacgacuuccaucguaucuacaucagcugaaccugaaacuca

SEQ ID NO: 44889 - RNA, 64 nt, hsa
auuacuggugucauuuuguuuuaugacagacacacguaucuaacaaacaaacaaacagugaccu

SEQ ID NO: 44890 - RNA, 64 nt, hsa
agcaaauuccagcucugaaauggaguucucacaccguaucuagggacagaggcaucuggaugca

SEQ ID NO: 44891 - RNA, 64 nt, hsa
acugccucucuugagcacuucccuggagcuaccacguaucuagcuaauauguaugugucaguag

SEQ ID NO: 44892 - RNA, 64 nt, hsa
uacauuccgagcaagggauaaguuugaggaggaucguaucuaucgucaucuggagccugcucug

SEQ ID NO: 44893 - RNA, 64 nt, hsa
caguugaagagccuuuugaacgcaguagcccgcucguaucuaugguuucgcuuuccacaguuug

SEQ ID NO: 44894 - RNA, 64 nt, hsa
aguaaugcugcaggaaaagcaaaauugcaaucuacguaucuaugguacuaaggaaguccuguuu

SEQ ID NO: 44895 - RNA, 64 nt, hsa
ugaugcgauuuuuuguucuuuuauguuuauacaacguaucuauguuguguaggggaaauuuuuu

SEQ ID NO: 44896 - RNA, 64 nt, hsa
uagaaaaguuaacaugaagauuuuagaaggagagaacuuacaggacacagauuugugauucuuu

SEQ ID NO: 44897 - RNA, 64 nt, hsa
ucgucuuugaaaauguuaaauugagaaaccuguuaacuuacauuuuaugaauuggcacauugua

SEQ ID NO: 44898 - RNA, 64 nt, hsa
cuuaaugaaauaagcuccaaagagccaaaguaucaacuuacagaucguuuuuaaagcuuaaauu

SEQ ID NO: 44899 - RNA, 64 nt, hsa
guugguuugccauuguuaaaaacugauuuacaguaacuuacaacaacuguacuuuuguuggauu

SEQ ID NO: 44900 - RNA, 61 nt, hsa
caguccaugagacaacuugauuauucucuuuaacuuacagaauguuaguuuaaaauaauaa

SEQ ID NO: 44901 - RNA, 64 nt, hsa
cugggagauagggguugcuggcaugaaaauguauaacuuacaacauuuauuaauaaaaugauaa

SEQ ID NO: 44902 - RNA, 64 nt, hsa
auuuuuuagugcuaucaucauuccuaacaagacuaacuuacagaaaaauaauuauaucugacug

SEQ ID NO: 44903 - RNA, 64 nt, hsa
aggaaagaacaaccuuaaaacuuuuaacagauaaaacuuacagaaaccuaugauauagaauuca

SEQ ID NO: 44904 - RNA, 64 nt, hsa
uuugcaauaaguagauacauacugaaaaaaucuaaacuuacaauguuuauagucuugugugugc

SEQ ID NO: 44905 - RNA, 64 nt, hsa
gaaaauaaaaaacuuaguucuaccacauccaauuaacuuacacacccccuucccugucucaaca

SEQ ID NO: 44906 - RNA, 64 nt, hsa
auuuccugaauaaauguauguuuaugaauuuucuaacuuacauuuuguuguguccucugccaac

SEQ ID NO: 44907 - RNA, 64 nt, hsa
augucugucaucauucugcccccuuugccuuuaaaacuuacaaaaauacguguuuguuauuuga

SEQ ID NO: 44908 - RNA, 64 nt, hsa
aagacugaaagaguugggguucauuuucuguuacaacuuacaggaacauuuguacuuuaagaaa

SEQ ID NO: 44909 - RNA, 64 nt, hsa
agcaacuguuagcgucucuaugagcaaucaguagaacuuacacauccuaggaaaucuuucuuug

SEQ ID NO: 44910 - RNA, 64 nt, hsa
caaguaaagacuuauacagauagauuuuuguuuuaacuuacaauccguuuuuuccucuuuuuuu

SEQ ID NO: 44911 - RNA, 64 nt, hsa
uuuagaggauuauaugguugucuccagagaaauuaacuuacauuaucaaaaaauucuuugucua

SEQ ID NO: 44912 - RNA, 64 nt, hsa
guucucccuuguucuuuuaaauuuugugaaauauaacuuacaaauaaguacuuaaaacagagcu

SEQ ID NO: 44913 - RNA, 64 nt, hsa
uuuuuucagcaaaauacuucaaaugaauaguauuaacuuacaaaaagucacaaaaacuuacaug

SEQ ID NO: 44914 - RNA, 64 nt, hsa
aaaugaauaguauuaacuuacaaaaagucacaaaaacuuacaugagagugaaaauuuguuauga

SEQ ID NO: 44915 - RNA, 56 nt, hsa
ccccagacucauggguguagcaucaagaugcccaacagaggaacucuuucuuucua

SEQ ID NO: 44916 - RNA, 64 nt, hsa
auguucugauaguuuguacagaaaaaauaaaauggaugcccauguuuuauugcuauuacuaaau

SEQ ID NO: 44917 - RNA, 64 nt, hsa
gugaagacccaaggaaggccuaugaaaagguccugaugcccaaccucccaccccuucaaugugg

SEQ ID NO: 44918 - RNA, 64 nt, hsa
ccaggcucacuucaguguugaguccuccauugaggaugcccacugaggcagccaggccccucac

SEQ ID NO: 44919 - RNA, 64 nt, hsa
ugagucuucccuggccccuuggaagaggcccccagaugcccaggcucacuucaguguugagucc

SEQ ID NO: 44920 - RNA, 64 nt, hsa
uacuucauuuccugccccuuucagggccugugaggaugcccaugagcuaccgcuguacaguucu

SEQ ID NO: 44921 - RNA, 64 nt, hsa
uuagaaaaccagucugaauugggucugucuuugagaugcccaggccagcagaaagcagcucaga

SEQ ID NO: 44922 - RNA, 64 nt, hsa
gaguggaagcugccccaggcccuuaccaggugcagaugcccaaucuugaugcccagccaucaga

SEQ ID NO: 44923 - RNA, 64 nt, hsa
cccaggcccuuaccaggugcagaugcccaaucuugaugcccagccaucagaacugugagccaaa

SEQ ID NO: 44924 - RNA, 64 nt, hsa
ugagucagucugucuuguuugcugugccacgccugaugcccagcccagcagcaugcuuuguaca

SEQ ID NO: 44925 - RNA, 64 nt, hsa
auuagaaucaucugggagguuuuaaacaaauucugaugcccagguugcaccccaugccaaugaa

SEQ ID NO: 44926 - RNA, 64 nt, hsa
ggguggaaccaggaaccuccuccacaccagcgcugaugcccaauaaagaugcccacugaggaau

SEQ ID NO: 44927 - RNA, 64 nt, hsa
aaccuccuccacaccagcgcugaugcccaauaaagaugcccacugaggaaugaugaagcuuccu

SEQ ID NO: 44928 - RNA, 64 nt, hsa
guggugagcugcuggugggugagggugucuuuaagaugcccaccgugacagugccccagcuuga

SEQ ID NO: 44929 - RNA, 64 nt, hsa
agggcaagggcuggggcugggaugggagggugaagaugcccaagcugaagaugccuuccuuugg

SEQ ID NO: 44930 - RNA, 64 nt, hsa
ugcccucgaucuguccaucccacagcucagccuggaugcccaccugcccucaggcaagguagag

SEQ ID NO: 44931 - RNA, 64 nt, hsa
cagaacaggcagaagggauggaauuuggcuucaagaugcccaagaugaccaugcccaagcuagg

SEQ ID NO: 44932 - RNA, 64 nt, hsa
ccucacugcugagucucccaggacccccuuuggagaugcccauggcaugggcacugcccacagg

SEQ ID NO: 44933 - RNA, 64 nt, hsa
acugggguacuuuuaagaagggugcuccuuuuaagaugcccagaaaagcuguauuuaacucuug

SEQ ID NO: 44934 - RNA, 64 nt, hsa
gggcuuuuguucccuuuugacauaauauagucaaugcacuaacaauuauguauauucaaacuug

SEQ ID NO: 44935 - RNA, 64 nt, hsa
caaaguucauuuuauuuugaucaguucaguauauugcacuaauuauuuuagguauuuucauuau

SEQ ID NO: 44936 - RNA, 64 nt, hsa
accccccccaaaaaauagaaagaaaaaaaaaguuugcacuaauugagguacaucugcaagugag

SEQ ID NO: 44937 - RNA, 64 nt, hsa
agcaaggaucucgguggguugcucagagaggugaugcacuaagccuuaauccuggacaccagua

SEQ ID NO: 44938 - RNA, 64 nt, hsa
ugcuauacauuauucaaaaagucucccgcgcauuugcacuaaugauggcugcaugcauagcaau

SEQ ID NO: 44939 - RNA, 64 nt, hsa
agccauggaugcuuuccacaaaaugucaccucgcugcacuaaaggaugaugaauccuaaucauu

SEQ ID NO: 44940 - RNA, 64 nt, hsa
caaucccagggcuggcucugcacuaagagaaaauugcacuaaaugaaucucguucccaaagaac

SEQ ID NO: 44941 - RNA, 64 nt, hsa
cagaaaagcauaacaccaaucccagggcuggcucugcacuaagagaaaauugcacuaaaugaau

SEQ ID NO: 44942 - RNA, 64 nt, hsa
cuuuuuuaaaaaagaagcaauguaaagaccguaaugcacuaagcuuuuuuuuuuucuuuuacac

SEQ ID NO: 44943 - RNA, 64 nt, hsa
ccugauuuauuacuaugucuuauuuaucagacccugcacuaagauuaaaaguugugcaugggcu

SEQ ID NO: 44944 - RNA, 64 nt, hsa
uucuuuuucaaaauaacaugcaaaaaaagcugaaugcacuaacucacaaaacaaacacuugcac

SEQ ID NO: 44945 - RNA, 64 nt, hsa
gucuggucaacagccccaugcacucccuguaucuugcacuaaauuuuucuaacagggucuuagu

SEQ ID NO: 44946 - RNA, 64 nt, hsa
ugcacuaacuuggacugcacuaacuuguggagucugcacuaacuuggagaaguuagugucagaa

SEQ ID NO: 44947 - RNA, 64 nt, hsa
ugcacuaacuaacuugcacugcacuaacuuggacugcacuaacuuguggagucugcacuaacuu

SEQ ID NO: 44948 - RNA, 64 nt, hsa
ugcacuaauuuagacugcacuaacuaacuugcacugcacuaacuuggacugcacuaacuugugg

SEQ ID NO: 44949 - RNA, 64 nt, hsa
ccccuuaacuuguggagucugcacuaauuuagacugcacuaacuaacuugcacugcacuaacuu

SEQ ID NO: 44950 - RNA, 64 nt, hsa
aagucuuggacugagccccuuaacuuguggagucugcacuaauuuagacugcacuaacuaacuu

SEQ ID NO: 44951 - RNA, 64 nt, hsa
ugugccagcaggggggcugugccaaccuguucuuagaguguagcuguaagggcagugcccaugu

SEQ ID NO: 44952 - RNA, 64 nt, hsa
cuguaagggcagugcccauguguacauucugccuagaguguagccuaaagggcagggcccacgu

SEQ ID NO: 44953 - RNA, 64 nt, hsa
aguugccauguuaggaaggucagcugcacagccaagaguguaagaguguaaagaaaugccuuuu

SEQ ID NO: 44954 - RNA, 64 nt, hsa
uguuaggaaggucagcugcacagccaagaguguaagaguguaaagaaaugccuuuuuuuuuuuu

SEQ ID NO: 44955 - RNA, 60 nt, hsa
aaggcugaaucccugggcccagucagcccugcugcacauggcacaggcauugcacacggu

SEQ ID NO: 44956 - RNA, 60 nt, hsa
agggcugaguucccaggcccugccagcccugcugcacagggugcaggcauugcacacggu

SEQ ID NO: 44957 - RNA, 60 nt, hsa
cugcaugaguugggcuuccccuuacccagggcugcacagccaggugugagggucaccggc

SEQ ID NO: 44958 - RNA, 60 nt, hsa
caugcgugagugugguggugugaccuucaggcugcacagaggcaaggacccagauguggc

SEQ ID NO: 44959 - RNA, 60 nt, hsa
uucaggagccugacuuggaucagacuuggggcugcacaguggagcagguggguucccgug

SEQ ID NO: 44960 - RNA, 60 nt, hsa
cuaccugccacaccucagaggguuccuacagcugcacacaagcaguugagaguugaugac

SEQ ID NO: 44961 - RNA, 60 nt, hsa
auacaaaggacacacagggauuuugaaaaugcugcacaucccuuaauagucaucuacaua

SEQ ID NO: 44962 - RNA, 60 nt, hsa
guugauuuacuuuuuauuaaguucuccagagcugcacaacuaguuauguuuugauuuguu

SEQ ID NO: 44963 - RNA, 60 nt, hsa
aaugcccucauauugaguggucuguaaacggcugcacacuucaggcacuguaguugcuga

SEQ ID NO: 44964 - RNA, 60 nt, hsa
uggaacagcagcaaguuuuucagugcauaugcugcacaagaacaaaauauaaaucuguau

SEQ ID NO: 44965 - RNA, 60 nt, hsa
gccugccagcccagagcccuggaggagccggcugcacagagaggcuuuucuucccagcug

SEQ ID NO: 44966 - RNA, 60 nt, hsa
cagggcuccucauugcucccaucugccucugcugcacacacaggcaccagcagggaugcc

SEQ ID NO: 44967 - RNA, 60 nt, hsa
ggaaagcagagccuccugggaacacaucuggcugcacaggcugaaauauccacccagcag

SEQ ID NO: 44968 - RNA, 60 nt, hsa
cugggacccagucccacugacacgguggcggcugcacaacagcccugccugagaagcccc

SEQ ID NO: 44969 - RNA, 60 nt, hsa
gguuccugucccuccgggagaccuagagaagcugcacacccaggagcuuuccaugacccg

SEQ ID NO: 44970 - RNA, 60 nt, hsa
gcuggggcauuggcaagaucacagguugaugcugcacagccccauugacacaaacccuca

SEQ ID NO: 44971 - RNA, 60 nt, hsa
gcuguaucuucgccauugcaucuacucuuugcugcacacacugugcuugcuccuggcuuu

SEQ ID NO: 44972 - RNA, 60 nt, hsa
ugaaucuuccugaaguguacugacauuugggcugcacagagccccacaccuucacuuaca

SEQ ID NO: 44973 - RNA, 65 nt, hsa
acacuggcacacacaaaaaaguaguuuuaagcuuguuugcacaguucuuuuuuuccauuggaaau

SEQ ID NO: 44974 - RNA, 65 nt, hsa
uaagcagggagaauaaagauaauuguauuuuauguuuugcacacaaacgcagaauuuguauaacc

SEQ ID NO: 44975 - RNA, 65 nt, hsa
aaaccuccaucuugaagcuucuaugguucauagucuuugcacaggaaccugugguuuuaacaaac

SEQ ID NO: 44976 - RNA, 65 nt, hsa
gaaauguacugaaauaaucauuggaauauuugcauuuugcacaaugacugguaugauagcucuug

SEQ ID NO: 44977 - RNA, 65 nt, hsa
ccagcuguugcauuucuugcuuauucuguuuuguuuuugcacaucauaauggauuuuucuuagug

SEQ ID NO: 44978 - RNA, 65 nt, hsa
uaagguuuaugaauucaaguaauaauuagauuuuuuuugcacagacuuacuuaacuuccuuauug

SEQ ID NO: 44979 - RNA, 65 nt, hsa
ucccaggcaaaccaguaguggagguuuuacauuuguuugcacaucucaguauauuucuguugagg

SEQ ID NO: 44980 - RNA, 65 nt, hsa
uuugcacaucucaguauauuucuguugagguaaaguuugcacagucaucugacuucugaucaagc

SEQ ID NO: 44981 - RNA, 65 nt, hsa
caaggcagaaguuucaagauguguguuugucuguauuugcacauguguuuguguguguguguaug

SEQ ID NO: 44982 - RNA, 65 nt, hsa
cgucggcgggaagcgugggagguguagcuccuacuuuugcacaggcaccagcuaccucagggaca

SEQ ID NO: 44983 - RNA, 65 nt, hsa
guuagauaaggacugagugcuuccguugcaggcaguuugcacaauaccuaauuaaccuuccuauu

SEQ ID NO: 44984 - RNA, 65 nt, hsa
auauuuuaaaauuauaaauagauaauauauuauuuuuugcacauugugaucaguuugcccagaau

SEQ ID NO: 44985 - RNA, 65 nt, hsa
ccuagggcacuggacuuucuggcaugggggcuguguuugcacaaguuauuuucauguuaccugga

SEQ ID NO: 44986 - RNA, 65 nt, hsa
acuaaggagggucuggccagaggaacagaccagcuuuugcacaaugaagcgcaagggaacaagug

SEQ ID NO: 44987 - RNA, 65 nt, hsa
gagccccagguugauucaaugccuugggaacuauuuuugcacauuggaagccucaaaaacagucc

SEQ ID NO: 44988 - RNA, 65 nt, hsa
aagccaauucuuuuuuaucccuuuuagaaguagaauuugcacacuuacuacaauugaggaguguc

SEQ ID NO: 44989 - RNA, 65 nt, hsa
uguaaagguauucguuaauccugugaaugguagcuuuugcacagaacuuccaaaagcaaaacaaa

SEQ ID NO: 44990 - RNA, 65 nt, hsa
uguugaucuuaaaacuaguugauuuaaagaguuuuuuugcacaacauuucaauuauauuugugaa

SEQ ID NO: 44991 - RNA, 65 nt, hsa
uaauauaaucuucccauguuauuuaacaaauuguuuuugcacauaucugauuauauugaaagcag

SEQ ID NO: 44992 - RNA, 65 nt, hsa
uauucacacaaucguuuuucuaugugugagagggauuugcacacucuuauuuuucuguaaaauau

SEQ ID NO: 44993 - RNA, 65 nt, hsa
cagaaaauuauuuuaaauuucuaaguuauaauaaauuugcacacagauaacaugcaugcuauuua

SEQ ID NO: 44994 - RNA, 65 nt, hsa
agcuuagccuagcagucagugacuuacuugcacuuuuugcacauagauauaaaguaaaauuaugu

SEQ ID NO: 44995 - RNA, 65 nt, hsa
uaguaauacuuguauuuauuugaaacacugggcuguuugcacagcuccaacugugcaugcucaaa

SEQ ID NO: 44996 - RNA, 65 nt, hsa
caauauaagguacaugccuauacagaacuuaacauuuugcacagaauauaucaaauauauuuuga

SEQ ID NO: 44997 - RNA, 65 nt, hsa
acauauuauuguaauuuagguauguuuuguuuuguuuugcacaacuguaacccuguuguuacuuu

SEQ ID NO: 44998 - RNA, 65 nt, hsa
guauacuaguuccuacuuagaacaaaaguaucaaguuugcacacaaguaaucugccagcugaccu

SEQ ID NO: 44999 - RNA, 65 nt, hsa
aauuugccucagauauaucuguccuaaugcuuauauuugcacaaguauguaaaauaucguguuga

SEQ ID NO: 45000 - RNA, 65 nt, hsa
aucuggcugcauugauggccagauugucugcugccuuugcacaucuagugcugguuucagaaauu

SEQ ID NO: 45001 - RNA, 65 nt, hsa
uugcaccagccuuuaaacacuuuucgugaagaaauuuugcacaguaguuuaaaucuuuuguuaau

SEQ ID NO: 45002 - RNA, 65 nt, hsa
ggaucuuagagaaaaugaauauuuaaauuuuaaaguuugcacauuucaucuuuguccuaacauga

SEQ ID NO: 45003 - RNA, 65 nt, hsa
uauuucuaaauuugauuauauucucugaugaucccuuugcacagaacuaugcuuaucucauguuu

SEQ ID NO: 45004 - RNA, 65 nt, hsa
aagucuguacauauuuuuguaccuuuuauguaaauuuugcacagaaauuuuuggcauaaguuuau

SEQ ID NO: 45005 - RNA, 65 nt, hsa
cuaguauguuuaggguucuguguucagauauuuuguuugcacacuacuuuuuaggaaacuuauaa

SEQ ID NO: 45006 - RNA, 65 nt, hsa
auacuuaaaauaagcguccaguuauaaaaagccuauuugcacaacuuuuugggaauacuucuauu

SEQ ID NO: 45007 - RNA, 65 nt, hsa
aacacaauucagugguacuuggaauccuguuuuaauuugcacaaauuuaaauguagagagccccu

SEQ ID NO: 45008 - RNA, 65 nt, hsa
guuccagauuucacaccuacaauaauuccaaaagguuugcacauuagaguuuguaacaaaauauu

SEQ ID NO: 45009 - RNA, 65 nt, hsa
uugauuuaagucucacacacugugcuaauaaguccuuugcacauauuauuggauucuagagcaac

SEQ ID NO: 45010 - RNA, 65 nt, hsa
cagaagagaugaucaauaacuaaaauguuuuucguuuugcacaugguaaaauuuuagguagagag

SEQ ID NO: 45011 - RNA, 65 nt, hsa
uaccuguugcagaagcgguuaucuuucuuuuuuacuuugcacaucaguguuagccuuucccuauu

SEQ ID NO: 45012 - RNA, 65 nt, hsa
gccuuucccuauuucagcacaaucuuagacucauauuugcacacuuuugugucgugaaguucuag

SEQ ID NO: 45013 - RNA, 65 nt, hsa
aaggaugagggaacaggcaaggaacaaaggcaaccuuugcacacucaccugagcccuggggaccc

SEQ ID NO: 45014 - RNA, 65 nt, hsa
acccccugggaaugggggguacucacgcaccccgcuuugcacaccacagagugcccucacccacu

SEQ ID NO: 45015 - RNA, 65 nt, hsa
aaaaaccuagcuggaauaauaaugccauauuguauuuugcacacugcuuuauuuucuagaggcuc

SEQ ID NO: 45016 - RNA, 65 nt, hsa
uaaguucaguuauuagucugugaagugcuuuacuuuuugcacaauuuuaauagcuugcuauucag

SEQ ID NO: 45017 - RNA, 65 nt, hsa
acuaccuaaaauaaauaccaaagauaaugcauauuuuugcacaguggagcuuacacuuaaaagaa

SEQ ID NO: 45018 - RNA, 65 nt, hsa
ggugauguacucuuauauuuuucugggcuuuuccuuuugcacauuccaaaauucauuucauaaga

SEQ ID NO: 45019 - RNA, 65 nt, hsa
auacacaauggcaguauuaacaagcauuuuaaaccuuugcacaugauauugaaccuguucaguuu

SEQ ID NO: 45020 - RNA, 65 nt, hsa
accaaaguggcacaacugcacaguucucagauuucuuugcacagauugauuuuuauugcggguuu

SEQ ID NO: 45021 - RNA, 65 nt, hsa
gcuuuccuaguuacucaaauugacuuucccccaccuuugcacaggugcuuucaauaguuuuaaaa

SEQ ID NO: 45022 - RNA, 65 nt, hsa
guacgaugcucuaaucauauugcauuuaauuuuauuuugcacagugaccuuguagccacaugaga

SEQ ID NO: 45023 - RNA, 65 nt, hsa
acuuccacccugacggccgcgccauggccaccaaguuugcacacuugaagcuguugcugcgacac

SEQ ID NO: 45024 - RNA, 65 nt, hsa
uucuguuucuguuguuuuguuuuuaacaacuauacuuugcacacaugaaggucacugugguuugu

SEQ ID NO: 45025 - RNA, 64 nt, hsa
accacugcaaauuuuuucaguauaaaauuuuucacugcaaaaaaauuucaguagaaaauaagga

SEQ ID NO: 45026 - RNA, 64 nt, hsa
ucagguuaaauauucauugcauuuauaagaucuucugcaaaaagcccagaaaugguccuuuuca

SEQ ID NO: 45027 - RNA, 64 nt, hsa
ggccagugaacaccaucccagaagcauuuucccucugcaaaaugacguuucuucccacgucugu

SEQ ID NO: 45028 - RNA, 64 nt, hsa
gucuauauaagggaaugucuuccuuccuaucuaucugcaaaauggaaaucuagaccuccuucuu

SEQ ID NO: 45029 - RNA, 64 nt, hsa
ggaccuccagccaggcuucauuuaugcacuugugcugcaaaagaaaagucuagguuuuaaggcu

SEQ ID NO: 45030 - RNA, 64 nt, hsa
auugugaaggaauugagccagaucucucucccuacugcaaaacccuauuguaguaaaaaagucu

SEQ ID NO: 45031 - RNA, 64 nt, hsa
aaucuuggcacccagaagaauucaacugcgcucacugcaaaaauacaauggccuacauuggauu

SEQ ID NO: 45032 - RNA, 64 nt, hsa
accuucuuuccuuguuagguaguuaugaguaaaucugcaaaaggcaaugaaaaugccuuaaauu

SEQ ID NO: 45033 - RNA, 64 nt, hsa
uuuuauguauaauucuuucugccugccuacuuuucugcaaaaaugagauguacagauuucgguu

SEQ ID NO: 45034 - RNA, 64 nt, hsa
aaaaugaaggccaaacagaagcaggcuccagcuucugcaaaaacuuggauucacaaaugucccu

SEQ ID NO: 45035 - RNA, 64 nt, hsa
ccaagaauguuuugcuagagcuaacagacauagacugcaaaagaauaauuuggaaucagcuaug

SEQ ID NO: 45036 - RNA, 64 nt, hsa
gaccagccugggcaacauagcaagacccccaucucugcaaaaaaauaagaaaauuagcuuggca

SEQ ID NO: 45037 - RNA, 64 nt, hsa
augaaacagccaucuuaaaaaaaaaaaaaguaaacugcaaaaguacaaaaucauuuuucaaucu

SEQ ID NO: 45038 - RNA, 64 nt, hsa
ucccagugaugccuuauuugaaacugggcuuaaacugcaaaaagaaugaaguuggauuuaggaa

SEQ ID NO: 45039 - RNA, 64 nt, hsa
uuuuagccaaagguguacuuacuuccuuauuuaucugcaaaaggauggaaacugugggagucaa

SEQ ID NO: 45040 - RNA, 64 nt, hsa
ggcacaaugaagcguggauguguucugcagguugcugcaaaacucaccuuauucugacuuuugg

SEQ ID NO: 45041 - RNA, 64 nt, hsa
guaacuccaaguacaaggccgaccacaauggaugcugcaaaaacguugacuggggcaaaggauu

SEQ ID NO: 45042 - RNA, 64 nt, hsa
acgggacguggccagacuggguuugcguuccaaccugcaaaacacaaauacauuuuuuaaaauc

SEQ ID NO: 45043 - RNA, 64 nt, hsa
ggcuacuugucacaucacuuuccauaauuauuuacugcaaaaugauugagaggcuuuuggugca

SEQ ID NO: 45044 - RNA, 64 nt, hsa
gaucuucacuccagucacuagggacaauagaaaccugcaaaacacagauucauucguaaauauu

SEQ ID NO: 45045 - RNA, 64 nt, hsa
uaacuuuagguaggagcuguuuuuguuugaaguacugcaaaauuauauuguaacuuccccucac

SEQ ID NO: 45046 - RNA, 64 nt, hsa
aagccucagaaaagaaauaagcauauuucaaaagcugcaaaagguuuuucacugccugccucuu

SEQ ID NO: 45047 - RNA, 64 nt, hsa
guagaaaucaugucuucuuaauugcugaaccuuacugcaaaaacuugugauguaagaaauuugu

SEQ ID NO: 45048 - RNA, 64 nt, hsa
gaaaaacguuugcagaaauguaaguaaagccaaucugcaaaacuguauagcuuugacaauucca

SEQ ID NO: 45049 - RNA, 64 nt, hsa
cauaaaccugauuugcagugaucucuaaguaauucugcaaaauccgguauuacuaugucaaguu

SEQ ID NO: 45050 - RNA, 64 nt, hsa
aaaaacagcaaaacaaaaagcaaacaaaaaaaaacugcaaaagucuaaaauacccauuggugau

SEQ ID NO: 45051 - RNA, 64 nt, hsa
uagggaagaccugcugagggaccagccaagagggcugcaaaagugagggcuugucauuaccaga

SEQ ID NO: 45052 - RNA, 64 nt, hsa
aaagaccaaauuccuuggcaugccuuccagcacccugcaaaaugagacccucguggccuucccc

SEQ ID NO: 45053 - RNA, 64 nt, hsa
aagcgcggacccuucuggguccagggaggggucccugcaaaacuccaggcaggacuucucacca

SEQ ID NO: 45054 - RNA, 64 nt, hsa
ccagaaagcuucauccacagccuugcagcggcuccugcaaaaggaggugaaaucccugccucag

SEQ ID NO: 45055 - RNA, 64 nt, hsa
agcaagaaugccagaaauagccuucauuucuacccugcaaaauaauccagaucugcuuucuaaa

SEQ ID NO: 45056 - RNA, 64 nt, hsa
aaauccuagaguugauucauuguuuuccuccauccugcaaaagaagaucccuuuguuaagcagc

SEQ ID NO: 45057 - RNA, 64 nt, hsa
aauuuuucacccauuuacacauauccacaaaugacugcaaaagugccacggauaucaauuugag

SEQ ID NO: 45058 - RNA, 64 nt, hsa
aaucaaauaagcuaauaaagaaaagagguuuauacugcaaaagaagugaaacuauauguauuca

SEQ ID NO: 45059 - RNA, 64 nt, hsa
auaugaucccagaaaacaucugucucuacuucggcugcaaaacccaugguuuaaaucuauaugg

SEQ ID NO: 45060 - RNA, 64 nt, hsa
aucaggaaaacaggaaaacacagcuuucuagcagcugcaaaaugguuuaaugcccccuacauau

SEQ ID NO: 45061 - RNA, 64 nt, hsa
uuucuuguguuuuaauuauuuucacauuuucucucugcaaaacuuuaguuuucugaugaucuac

SEQ ID NO: 45062 - RNA, 64 nt, hsa
gcuauugugauguaugauguauguaguccuacaacugcaaaacgucuuacugaaccaacaauca

SEQ ID NO: 45063 - RNA, 64 nt, hsa
caguaacaaaaugaaaucucaaaacagagcucagcugcaaaaaagcauauuuucuguguuucug

SEQ ID NO: 45064 - RNA, 64 nt, hsa
uaacaguuauucuguuguuauaaaacuauacccacugcaaaaguaguagucaagugucuagguc

SEQ ID NO: 45065 - RNA, 64 nt, hsa
augcacgcacacacacauauggggaccugcacaccugcaaaacgagggaacaacuaagguggcu

SEQ ID NO: 45066 - RNA, 64 nt, hsa
caagcggcccugcagccacaaagcaacccgcccucugcaaaaacuaggcacauccgcagugcgc

SEQ ID NO: 45067 - RNA, 64 nt, hsa
agaauaguuguuaauuuguuuagaauuuaaguucuacucagaaucauaacaucuggcagaacag

SEQ ID NO: 45068 - RNA, 64 nt, hsa
uucauuaggaaaagccagauauaccaaagcgguuuacucagagucagggguguagcucuggcug

SEQ ID NO: 45069 - RNA, 64 nt, hsa
ccacacauuuuauuuguauuucagucacauuuauuacucagagugccauucuucucauauuguc

SEQ ID NO: 45070 - RNA, 64 nt, hsa
ggacuucaccacguggacaaacgaaagcacaggcuacucagacuuggccacaggucauagguca

SEQ ID NO: 45071 - RNA, 64 nt, hsa
uagaaauaaacuaggaaaugcagauguuuuuaacuacucagacuuuugaggaauuaauccuuuu

SEQ ID NO: 45072 - RNA, 64 nt, hsa
uuucaaauggauccuccagauggcauucaugucuuacucagaaagggcacugccauugucccca

SEQ ID NO: 45073 - RNA, 64 nt, hsa
cuguccuaagcgucaucuugagccuugcacaugauacucagauuccucacccuugcuuaggagu

SEQ ID NO: 45074 - RNA, 64 nt, hsa
ccaucacaguuuaaauguauaucuuuuaugucucuacucagaccauauuuuuaaaggggugccu

SEQ ID NO: 45075 - RNA, 64 nt, hsa
uccuugacuugagacuuguggucuucaggaaaacuacucagaauauaaugacuccucaucagua

SEQ ID NO: 45076 - RNA, 64 nt, hsa
cuugcauuuucugaugacuuuuauaaguuucaaauacucagacuuguggaauuuuauaauuuca

SEQ ID NO: 45077 - RNA, 64 nt, hsa
gaucccuugcuucccucccccagugcguucugugaucgccaaguucaaagcugugcacaugugg

SEQ ID NO: 45078 - RNA, 64 nt, hsa
ggugccaggccucagccucacccacagcagccccaucgccaaaggauggaaguaauuugaauag

SEQ ID NO: 45079 - RNA, 64 nt, hsa
uuuaauaaaucagcuggaacugauagaaacucgcaucgccaauagucucuauggaagucaaacu

SEQ ID NO: 45080 - RNA, 64 nt, hsa
caucauauaccucuugaagaagaaggagucagccaucgccaacuugucucuguagaagcuccgg

SEQ ID NO: 45081 - RNA, 64 nt, hsa
uguuuucucaagcuccagauuggcuagauuucagaucgccaacacauucgccacugggcaacua

SEQ ID NO: 45082 - RNA, 64 nt, hsa
cuauuagaucacuagcacugcuuuaccgcuccucaucgccaacacccccaugcucuguggccuu

SEQ ID NO: 45083 - RNA, 64 nt, hsa
gcccacugucuaccuugccagauccucagugcguaucgccaaugcaggaugcuccuuagaaaag

SEQ ID NO: 45084 - RNA, 64 nt, hsa
acguaugcaagucugugagugcgucugaggggacaucgccaaggacugacugagacacgaugcc

SEQ ID NO: 45085 - RNA, 64 nt, hsa
cacugguauguguggaugaugcugccagggcgccaucgccaaguaagaaagugaagcaaaucag

SEQ ID NO: 45086 - RNA, 64 nt, hsa
ggaggagugcuuugagcggguccauggcgaguguaucgccaacuuguccuuugacaucacuggc

SEQ ID NO: 45087 - RNA, 54 nt, hsa
gccaugcggcgcuccuaugaggccaucgccaagcacaaucaggugagcgaacga

SEQ ID NO: 45088 - RNA, 64 nt, hsa
caaaaugguuuuuaaguacuuggaaaaggagguaaucgccaaauaguuccauuuuuuuuuuuuu

SEQ ID NO: 45089 - RNA, 64 nt, hsa
aagugaauuaaucugauucacaggauuauguuuaaucgccaaaaacacacuggccaguguacca

SEQ ID NO: 45090 - RNA, 64 nt, hsa
ggcuucuaacaaaaacuacacauauguauuccugaucgccaaccuuucccccaccagcuaagga

SEQ ID NO: 45091 - RNA, 64 nt, hsa
gcuuaccuaccacggccgucuccaccagaaaaccaucgccaacuccugcgaucagcuugugacu

SEQ ID NO: 45092 - RNA, 64 nt, hsa
ggaagcuccagacucaaugugacccccagguggcaucgccaacuccugccucgugccaccucau

SEQ ID NO: 45093 - RNA, 64 nt, hsa
aagaagaaaaaaacgaaaacagucaaccaaccccaucgccaacuaagcgaggcaugccugagag

SEQ ID NO: 45094 - RNA, 64 nt, hsa
uuagcaaacggugucaugguuuggaauguucauuaucgccaagaaccugguuagaggcauaaag

SEQ ID NO: 45095 - RNA, 64 nt, hsa
ugugggaguuauuuauauccuacugcucaaggucaucgccaaggugugauuggaaaaauucaaa

SEQ ID NO: 45096 - RNA, 64 nt, hsa
cggggaggaggcuacgugguccccuuggggacugaucgccaaagcacgucaagguaagguugac

SEQ ID NO: 45097 - RNA, 64 nt, hsa
aggcgccugcuccaccagcugguggguguuuguaaucgccaagcaccagcuauaggucacagcc

SEQ ID NO: 45098 - RNA, 64 nt, hsa
ugguuuucucacgcauaaaauggagaguggauuaaucgccaaagauucuucugaucugacauuu

SEQ ID NO: 45099 - RNA, 64 nt, hsa
cuuugguuuguggcugaaagcuguugagugacucaucgccaagauuugcuguaaugcaggcuuu

SEQ ID NO: 45100 - RNA, 64 nt, hsa
cucugcugagggugacuccaaggcagcugagcugaucgccaacucacuggccacugcaggggac

SEQ ID NO: 45101 - RNA, 64 nt, hsa
gugggucacguggucugcagaaccaaagagaggaaucgccaaaacaaaucacgagaagagagaa

SEQ ID NO: 45102 - RNA, 64 nt, hsa
uacaguuucguuuccauucacgacgcguucacugaucgccaaauguaaacagaucgcacagagu

SEQ ID NO: 45103 - RNA, 64 nt, hsa
cggaccucuaauccaagcauauugcuugcuauuaaucgccaaaacaggacugcugaugaggaau

SEQ ID NO: 45104 - RNA, 64 nt, hsa
cguuaacguuuccuguaguauguuucuucaucucaucgccaagguaggcuuguguuuuucagug

SEQ ID NO: 45105 - RNA, 64 nt, hsa
gaugcagcauuucgugaaggucauccagggcuacaucgccaaccagauccugcacgucaccugg

SEQ ID NO: 45106 - RNA, 64 nt, hsa
gcugcauccuaaaauuccaaaauuauauugagcaaucgccaaggccuaaagccaacugacuuaa

SEQ ID NO: 45107 - RNA, 64 nt, hsa
aaaucaguguagaaguagaguuaccuaaaccuuuaucgccaaugcacagcuuggccuguuaagu

SEQ ID NO: 45108 - RNA, 64 nt, hsa
caacauucaggccacgugagcacugucuuaucacaucgccaauuaguuguaauaaacguucaac

SEQ ID NO: 45109 - RNA, 64 nt, hsa
gagcagcuccuccuaguuaaguuuccacuaaaucaucgccaaagaggacuucagagcccugggg

SEQ ID NO: 45110 - RNA, 64 nt, hsa
gcaguacaaugauuaguaauguaaaaauuaacacagaaauuaaccuaaggaaugaagggugggu

SEQ ID NO: 45111 - RNA, 64 nt, hsa
guucaaggaagaugcacuauucaguuaucuauugagaaauuauuuugcagugguuuuagugggu

SEQ ID NO: 45112 - RNA, 64 nt, hsa
aaauuuuaucaugguauaauuuguaaaaauaaaaagaaauuacaaaagaaauuauggauuuguc

SEQ ID NO: 45113 - RNA, 64 nt, hsa
gguauaauuuguaaaaauaaaaagaaauuacaaaagaaauuauggauuugucaauguaaguauu

SEQ ID NO: 45114 - RNA, 59 nt, hsa
uugacuuugcagccauguagugaauggaaagaaauuaugcaccuuuuauggaccaaauu

SEQ ID NO: 45115 - RNA, 64 nt, hsa
gauccaaaacauuguacccagcuuuuuaaaagagagaaauuaucacuacaacucccgagcacua

SEQ ID NO: 45116 - RNA, 64 nt, hsa
ggggagggagaaaauauuaaugggaaaggcauucagaaauuaugguuucuaccuuuuuaaaaag

SEQ ID NO: 45117 - RNA, 64 nt, hsa
gaaaagagguccagaugagagcagagauacagugagaaauuaugugaucuguguguugugggaa

SEQ ID NO: 45118 - RNA, 64 nt, hsa
aacaggaggaauagaaaugaagcagugaguguucagaaauuagaucuacaagaaguuuugcaaa

SEQ ID NO: 45119 - RNA, 64 nt, hsa
gguguucuugauaagggaagugagacaaaggagaagaaauuacucccugcaacaggaggaauag

SEQ ID NO: 45120 - RNA, 64 nt, hsa
agagaacauggucacccaaaagcaacuguaacucagaaauuaaguuacucagaaauuaaguagc

SEQ ID NO: 45121 - RNA, 64 nt, hsa
caaaagcaacuguaacucagaaauuaaguuacucagaaauuaaguagcucagaaauuaagaaag

SEQ ID NO: 45122 - RNA, 64 nt, hsa
ucagaaauuaaguuacucagaaauuaaguagcucagaaauuaagaaagaaugguauaaugaacc

SEQ ID NO: 45123 - RNA, 64 nt, hsa
agugaugauuguuuaguaacuaaauuuuagcaacagaaauuagaauuuugcuuuuucaaccagu

SEQ ID NO: 45124 - RNA, 64 nt, hsa
acuuacguguugucacuggauuaucauaaaagggagaaauuaaauauuacuguacucuuaguug

SEQ ID NO: 45125 - RNA, 64 nt, hsa
auuaucaaggaagccuuagauucacucugaucuaagaaauuauugaaauugacccuuuuuacac

SEQ ID NO: 45126 - RNA, 64 nt, hsa
agugccaaaaaaaaaaucucagaaaucuuaaugcagaaauuauauagucuccucagauuuuaau

SEQ ID NO: 45127 - RNA, 64 nt, hsa
uauacaacuuguuuuaaccuuugagaacauugacagaaauuaugcaaugguuuguugagauacg

SEQ ID NO: 45128 - RNA, 64 nt, hsa
caaaguggccuacucaagaggcccuaagacugguagaaauuaaaaggauuucaaaaacuuucua

SEQ ID NO: 45129 - RNA, 64 nt, hsa
auauaaccaucaauaaagaagcauucuuuuccaaagaaauuauuucuucaauuauuucucauuu

SEQ ID NO: 45130 - RNA, 64 nt, hsa
uuucuucaauuauuucucauuuauuguauuaagcagaaauuaccuuuucuuucucaaaaucagu

SEQ ID NO: 45131 - RNA, 64 nt, hsa
uugaaccucuuuauagcauugauacuaggugaacagaaauuaccugacuaauaauuugucuaac

SEQ ID NO: 45132 - RNA, 64 nt, hsa
cuauggggguuuuuaccacaguugccauuguggaagaaauuauuugguacauuaauaaaaaaag

SEQ ID NO: 45133 - RNA, 64 nt, hsa
ugacaaagggauuuacacccuugacaaaaccaaaagaaauuaacaggccacagguuucuuuaaa

SEQ ID NO: 45134 - RNA, 64 nt, hsa
aauugggaggcaauaguaucaauauccuaaauguagaaauuaaaagauacuguauaauuuuaug

SEQ ID NO: 45135 - RNA, 64 nt, hsa
ugguuuuaucucauauuuucuuggcaaaauugagagaaauuaggaacacugcuauuuuuuucuu

SEQ ID NO: 45136 - RNA, 64 nt, hsa
ugggugaugaagugagacucuccaaaaaaaaaaaagaaauuauuaaucccugccugugcucuac

SEQ ID NO: 45137 - RNA, 64 nt, hsa
ccuugauucuggcaaggcaaauaaagccagaaugagaaauuaccaucuucuacuagagaaaacc

SEQ ID NO: 45138 - RNA, 64 nt, hsa
aguuccaguuucuauggccuucccaccuucuguuagaaauuaguuuuaucuggcauuuuuaaac

SEQ ID NO: 45139 - RNA, 64 nt, hsa
uuuucuaauauagugacaucugcauuuaauuuccagaaauuaaauuaauuuucauguuugaaug

SEQ ID NO: 45140 - RNA, 64 nt, hsa
agagcagcgaucagauuaugaagaauuugucuugagaaauuacagaggauuuaaaccagaaugu

SEQ ID NO: 45141 - RNA, 64 nt, hsa
guauagauacccauuauacuuuaaauuuuucagcagaaauuaugcuuuuaucuucucugcagug

SEQ ID NO: 45142 - RNA, 64 nt, hsa
uuuugaauguuauuuguuauuuucaguauuuuggagaaauuauuuaauaaaaaaacaaucauuu

SEQ ID NO: 45143 - RNA, 64 nt, hsa
aguagauggugaaauuuauuaguuaauauaucccagaaauuagaaaccuuaauauguggacgua

SEQ ID NO: 45144 - RNA, 64 nt, hsa
cuuauucucauauaauacuaaucuaaacaguacuagaaauuacagugccaagagccaccaggag

SEQ ID NO: 45145 - RNA, 64 nt, hsa
guuguuaguagaaggucaauuuaaaauagggacuagaaauuauuugaaguuuucuuuauuacgg

SEQ ID NO: 45146 - RNA, 64 nt, hsa
gcgccacucaaguucuuuuaacccaagacuuuagagaaauuagguccaagauuuuuauauguuc

SEQ ID NO: 45147 - RNA, 64 nt, hsa
ucaaguggggaauaauaauaauguauaauaaucaagaaauuaguuuauuaaaaggaagcagaag

SEQ ID NO: 45148 - RNA, 64 nt, hsa
uacaaaaagguuuuagaaucacugcccuguugagagaaauuagggggaaaugauuacauuuaga

SEQ ID NO: 45149 - RNA, 64 nt, hsa
uuuaagaugggggaaaauuaagguuugagguuuuagaaauuagcaaguagugcauacccuucua

SEQ ID NO: 45150 - RNA, 64 nt, hsa
gucccugaguagcaagauuaggccucaccaaagaagaaauuaaccugcacuuucaaaaaguacc

SEQ ID NO: 45151 - RNA, 64 nt, hsa
uccuuuuuccuaguauaauacauuguuuucaaccagaaauuaaaguagauauccaacauuauuu

SEQ ID NO: 45152 - RNA, 64 nt, hsa
uuaugaccuuucaacuauagguaauaacucuuagagaaauuaauuuaauauuagaauuucuauu

SEQ ID NO: 45153 - RNA, 64 nt, hsa
ggucauguaaaauauuagacacuaauauuuucauagaaauuaggcuggagaaagaaggaagaaa

SEQ ID NO: 45154 - RNA, 64 nt, hsa
auaguauacuaucuacacucugcucaacaagcucagaaauuaaauauuuuuaauaauaaaaauc

SEQ ID NO: 45155 - RNA, 64 nt, hsa
aagcuuaaacccaaaaauuguucauccauauauaagaaauuaucgaauuaaaacuuaauguaug

SEQ ID NO: 45156 - RNA, 64 nt, hsa
aauugcuaaagaaggccuaugaagccucccuuucagaaauuaagaaaggccaugaaauagaaaa

SEQ ID NO: 45157 - RNA, 64 nt, hsa
ccucuguuuucagucacugcuucaaccaccugugagaaauuagaaaaagccaggaaugaguuac

SEQ ID NO: 45158 - RNA, 64 nt, hsa
cuauuacuuaaauguuuuaauuggacuguaguuuagaaauuacaggaccagcuuguuacagauu

SEQ ID NO: 45159 - RNA, 64 nt, hsa
ccguaggaugaauuagaaauaaauugugaugaaaagaaauuaacugcuuauuuaugaaucuaau

SEQ ID NO: 45160 - RNA, 64 nt, hsa
aagcgucuuuggugcuugggagaccaagaaaccaagaaauuaacaacugaaagcauuuuaaugg

SEQ ID NO: 45161 - RNA, 64 nt, hsa
gauuaacuacugacaugacuuggcuuucucauccagaaauuauggaaacagggucugucagugg

SEQ ID NO: 45162 - RNA, 64 nt, hsa
ggcaguucugcaagauguacuaaauauguauauuagaaauuauagaaaaucauguuguccguuu

SEQ ID NO: 45163 - RNA, 64 nt, hsa
augcaaaauacaguugucauuaauccugcacauuagaaauuauuagaaacauauuacuuuuuaa

SEQ ID NO: 45164 - RNA, 64 nt, hsa
aaaaaaaaaaaaaaaaaagugaugaaucaaaauuagaaauuaagaguuuuaagaaaacaugugg

SEQ ID NO: 45165 - RNA, 64 nt, hsa
ggaaaaacaggaaaagaauucacuuuuuaaaugaagaaauuagugaaaaaauugaccuaaugaa

SEQ ID NO: 45166 - RNA, 64 nt, hsa
aauaggaagaaaagaggauauauuuaagauacauagaaauuaugaugugaaguauucaugagaa

SEQ ID NO: 45167 - RNA, 64 nt, hsa
uuuuuaaccugugaaauuucuuuacaguuuuccaagaaauuaagcauaacagucucaucuacgg

SEQ ID NO: 45168 - RNA, 64 nt, hsa
gagucagauuuaauuuguuuuuugaagcacuuugagaaauuaauuuuaauuaacuuaaugagca

SEQ ID NO: 45169 - RNA, 64 nt, hsa
aaauauuuguguguugugagaaauuuuugucauaagaaauuaaaagaacuuaccaggaagguuu

SEQ ID NO: 45170 - RNA, 64 nt, hsa
cugacuguacuuacgcugcacugucgguguuaagagaaauuacucucacaagagcagaggccug

SEQ ID NO: 45171 - RNA, 64 nt, hsa
aucaagaacuuuaucaguaugcuuuguugaaagcagaaauuaagauaauaauugaguucaauuc

SEQ ID NO: 45172 - RNA, 64 nt, hsa
uuuuacuugcauuguaucuuauacuaaaggcuuuagaaauuacaacauaucagguuccccuacu

SEQ ID NO: 45173 - RNA, 64 nt, hsa
aucuacacauuagcauugucucuagagcuaagacagaaauuaaccccguucagucacaaagcag

SEQ ID NO: 45174 - RNA, 64 nt, hsa
guagaggaaaaucaaugcuuuaucugauaugcugagaaauuauuagauugccaauacucaugug

SEQ ID NO: 45175 - RNA, 64 nt, hsa
ucuauagcaguguucucucugaaugcugagcugaagaaauuauacguacauacacacauacaua

SEQ ID NO: 45176 - RNA, 64 nt, hsa
ucuagccauguagugcucucagucuucauaccccagaaauuauugguauauuuguagauaccga

SEQ ID NO: 45177 - RNA, 64 nt, hsa
ugguaaauuagaagcuacaauaauaauuaagggcagaaauuauacuuaaaaagugcagauccuu

SEQ ID NO: 45178 - RNA, 64 nt, hsa
guauuauuugauuucggauugaaugaauguaaauagaaauuaaaugcaaauuugaaugaacaua

SEQ ID NO: 45179 - RNA, 64 nt, hsa
ugucuggccugacacagcaucacaucacacacacagaaauuaguauauccauguaugucaaaua

SEQ ID NO: 45180 - RNA, 64 nt, hsa
uagcaugcuaaaauaaauuuuugugugugugugcagaaauuaaggguccaauugagauugggug

SEQ ID NO: 45181 - RNA, 64 nt, hsa
cuugaguacaguugaauuauuaaauaugcaaguuagaaauuaagucuacugaaaaauuuacauu

SEQ ID NO: 45182 - RNA, 64 nt, hsa
ucagauucauuucaaaaggacagugaacaagcugagaaauuauuuuaucaaagggcugaguuga

SEQ ID NO: 45183 - RNA, 64 nt, hsa
cuuugaaaugaucuacugaaauaccuaaauugauagaaauuaaucauacucaaucuaggacaug

SEQ ID NO: 45184 - RNA, 64 nt, hsa
agccugggcaacacggggagacccugucucuacaagaaauuaaaaauuagccaggcauaguugg

SEQ ID NO: 45185 - RNA, 64 nt, hsa
uuuauguuuagagauugcaguaaagacaggcauaagaaauuauaaaaguauuaauuuggggaac

SEQ ID NO: 45186 - RNA, 64 nt, hsa
caaccauaagagaauaccgcagaccaaauggcuuagaaauuaauuuaauuuuaaaucaaugagg

SEQ ID NO: 45187 - RNA, 64 nt, hsa
aauuaauuagaaacuaucaaaaauguggcuuaaaagaaauuaaccaccuaggaauuuaauauug

SEQ ID NO: 45188 - RNA, 64 nt, hsa
auaauaaauguagaaaugccuccugucaccucucagaaauuauuaaacauaauuuauucuaggu

SEQ ID NO: 45189 - RNA, 64 nt, hsa
ccagccuggugacagcgugagacucuuuaaaaaaagaaauuaaaagaguugagacaaacguuuc

SEQ ID NO: 45190 - RNA, 64 nt, hsa
ggaaaaauguaacuaggaagaaaaacccaauuuaagaaauuacauaaugcuuuccaaaggcacc

SEQ ID NO: 45191 - RNA, 64 nt, hsa
ucuguguuuuucagauuucauuuuuuguaaaaucagaaauuaaucuaaacauauucagugauaa

SEQ ID NO: 45192 - RNA, 64 nt, hsa
uauuucauggucaguuuauuuuguaagagacagaagaaauuauaucuauacauuaccuuguagc

SEQ ID NO: 45193 - RNA, 64 nt, hsa
aaaaucauaaaauauugagcugaugccuguauauagaaauuaagcguuucucgaaagcuguucu

SEQ ID NO: 45194 - RNA, 64 nt, hsa
uguguauacuuuacgcaucuuuccuuuugaguagagaaauuaugugugucauguggucuucuga

SEQ ID NO: 45195 - RNA, 64 nt, hsa
accuggauuuccuuggcuucuuugagaauguaagagaaauuaaaucugaauaaagaauucuucc

SEQ ID NO: 45196 - RNA, 64 nt, hsa
aaugagcaguaaaauagaugagauaaagaacuaaagaaauuaagagauagucaauucuugccuu

SEQ ID NO: 45197 - RNA, 63 nt, hsa
gaguaaaucagauguugaauucuuuugccaagggaauuauagcugcagguucucucucacugc

SEQ ID NO: 45198 - RNA, 63 nt, hsa
gcuuugcuuugucuggaagaaagauaaaauagugaauuauaaauaagucaggccgggcguggu

SEQ ID NO: 45199 - RNA, 63 nt, hsa
ccauagcacaacagguuuauagagauguauauagaauuauaguccuuauuuuuuuccuuugcg

SEQ ID NO: 45200 - RNA, 63 nt, hsa
aagguucuuguguauauuuggggggugggggaugaauuauaaauuauauucagcccugagugg

SEQ ID NO: 45201 - RNA, 63 nt, hsa
gaggaacauguagcgucuacacaggaaaguaaagaauuauagaauuaacuaauucuacuugaa

SEQ ID NO: 45202 - RNA, 63 nt, hsa
cucuguguggcacauaggaaaaugugagaccuagaauuauagcaacuuuuuuuuucuguuaaa

SEQ ID NO: 45203 - RNA, 63 nt, hsa
guauauuuuaagugggugaauuauaugguaugugaauuauaucucaauaaaguuguuaguaaa

SEQ ID NO: 45204 - RNA, 63 nt, hsa
uaaaaaccauugaguuguauauuuuaagugggugaauuauaugguaugugaauuauaucucaa

SEQ ID NO: 45205 - RNA, 63 nt, hsa
auaugacauaagcaaucauuuuaugcuguuuaugaauuauaaauguguuuauagcucauuugu

SEQ ID NO: 45206 - RNA, 63 nt, hsa
aggugcauauuaauuuucuugguucuuucagcugaauuauauugguccagaaguucaaaauca

SEQ ID NO: 45207 - RNA, 63 nt, hsa
aaaaaaaaagauaaagguuguacgguggucuuugaauuauaugucuaauucuauguguuuugu

SEQ ID NO: 45208 - RNA, 63 nt, hsa
uaaauauuaugugaaaucaaagcgccauauguagaauuauaucuucaggacuauuucacuaau

SEQ ID NO: 45209 - RNA, 63 nt, hsa
accuaacagucagaggucaguaucucagcgugugaauuauagaggaaauacagagagaaccuc

SEQ ID NO: 45210 - RNA, 63 nt, hsa
uuucaguagcuuuaucacaauauucacaauggagaauuauaugacaugguagcagaaauaggc

SEQ ID NO: 45211 - RNA, 63 nt, hsa
uaaaaaaaccaacagcagcacaggauguauuaagaauuauaugaagucagguuuguuuuuuuu

SEQ ID NO: 45212 - RNA, 63 nt, hsa
aauaaccuuuaaaggguuguuuuguuuuguuuugaauuauaggaguuauaaucuuuggagaug

SEQ ID NO: 45213 - RNA, 63 nt, hsa
gaugcauccaauccuaaaacuuacauuccaaaggaauuauaucauuauguuccuaaggaguaa

SEQ ID NO: 45214 - RNA, 63 nt, hsa
uguguuuuauucagguuguguaaugcucccguagaauuauagaacaauuaaauaugguuaguu

SEQ ID NO: 45215 - RNA, 63 nt, hsa
uaucuugauucuauguugucuggaaaaaauauggaauuauauaaaaagggaugcuuuuauaua

SEQ ID NO: 45216 - RNA, 63 nt, hsa
auuuucauguuugaaguucuaauauuaaguuuagaauuauaaugaucuacaguuguaucuuga

SEQ ID NO: 45217 - RNA, 63 nt, hsa
auacucaaauuauaauaaaacucuucauuuugugaauuauagaagcuacuuuuuauaaagcca

SEQ ID NO: 45218 - RNA, 63 nt, hsa
ucuuugggaaggaacacuaaagauguuuugaaugaauuauaguccacuggcauuuuaguguau

SEQ ID NO: 45219 - RNA, 63 nt, hsa
uaaauuuuugugggaaauuuugugauaacuugagaauuauacuuguuugaaucaaggcaacuc

SEQ ID NO: 45220 - RNA, 63 nt, hsa
cuuauuguaacauauaauauuagugaaaccauggaauuauaugaaaaugauacaugagaaaua

SEQ ID NO: 45221 - RNA, 63 nt, hsa
caccucucuaaagaaucuuuaguuuccgacguugaauuauagaccaguuugaguaaguacugc

SEQ ID NO: 45222 - RNA, 63 nt, hsa
acagcagugcaguccagagguuaagauguauuagaauuauacaauaucaguuuaaaaaucugu

SEQ ID NO: 45223 - RNA, 63 nt, hsa
cucacccaagcucucccuuacagaggcaacacagaauuauaaggaaucagaaaucccccuucu

SEQ ID NO: 45224 - RNA, 63 nt, hsa
ucucugagguucaguaucauuuuucaaauaaaggaauuauauuauuuccucugcauaauugaa

SEQ ID NO: 45225 - RNA, 63 nt, hsa
ugccauauuccaagucacauuauuuuaccaauggaauuauagaauuaacaguauuuuaaauua

SEQ ID NO: 45226 - RNA, 63 nt, hsa
cagauauagugaacacuggaaagauuuauuaaagaauuauauuuguguauacuuuauaaauua

SEQ ID NO: 45227 - RNA, 63 nt, hsa
acaacagaaaugcuccuggaacuucaaguugcugaauuauaaguuuauuuuuuaucaauaaau

SEQ ID NO: 45228 - RNA, 63 nt, hsa
uauauuuuuacauaaaagcuugaacauacagaugaauuauaaccuaugugaagaaaucuuaga

SEQ ID NO: 45229 - RNA, 63 nt, hsa
uagauauaaauaauucuaaacuuaaaaucacuagaauuauagcuuaaauauuaugaaauguac

SEQ ID NO: 45230 - RNA, 63 nt, hsa
uuaaauuuugacuguacuaacuauaaauguaaugaauuauaauaauuauaaaugguauaaaug

SEQ ID NO: 45231 - RNA, 64 nt, hsa
acccuacccuggcagggaccugagagcaucucaggaggggcagcgcaugugugcaugugcugug

SEQ ID NO: 45232 - RNA, 64 nt, hsa
gcaguucagaauggcaguccuggaggcagggggugaggggcaggucuaguguuccugcaccaaa

SEQ ID NO: 45233 - RNA, 64 nt, hsa
gaccaugcagucagaggggcagcuuuauacagaggaggggcacacuugucugugaguuugaagc

SEQ ID NO: 45234 - RNA, 64 nt, hsa
caugguugacacccuccuuuggaccaugcagucagaggggcagcuuuauacagaggaggggcac

SEQ ID NO: 45235 - RNA, 64 nt, hsa
uaagggcugcuggggcuaaagugccuugcugaaggaggggcagaguuaaacauuagccacaaug

SEQ ID NO: 45236 - RNA, 64 nt, hsa
cccacucaacacaccuaagccaguggcccucuaggaggggcagaagagccaaccagaggguucc

SEQ ID NO: 45237 - RNA, 64 nt, hsa
ugggcucagaaaaaggagggcuggcuggaggagugaggggcagcuuaaguuuggggaggguaga

SEQ ID NO: 45238 - RNA, 64 nt, hsa
uaagaagucuuaggcagcagcccagacauguauagaggggcaguuagagggagaacaggggugg

SEQ ID NO: 45239 - RNA, 64 nt, hsa
ccccacucugcugaggccagaggaagggaggccugaggggcagauugguucaugccuggggugg

SEQ ID NO: 45240 - RNA, 64 nt, hsa
aaaacagcgggagugugggggugccaugguguuggaggggcaggccuuuuugagccaaucccac

SEQ ID NO: 45241 - RNA, 64 nt, hsa
gccuggggacggagcacugugcagccggggagcugaggggcagggccguagacucacggcugca

SEQ ID NO: 45242 - RNA, 64 nt, hsa
cugcaaagcacagggccaccgccacagcccggcagaggggcacacucuggagaccuugcuggca

SEQ ID NO: 45243 - RNA, 64 nt, hsa
guucucccacugcccugucugcucugcugcuacagaggggcagggccucccccagcccacgcuu

SEQ ID NO: 45244 - RNA, 64 nt, hsa
uuuaagcuuuaugugaaagcuuaguuaaggugaggaggggcacacuccuaaauugcuggaugac

SEQ ID NO: 45245 - RNA, 64 nt, hsa
auccgacuaccagaaaaaaaaaauuguuuuggaggaggggcaaaaggaaccaugaucaggcuuu

SEQ ID NO: 45246 - RNA, 64 nt, hsa
ccugcugcuucaggguuuuuccccggcggguugggaggggcaggaggugggguggaaauagggu

SEQ ID NO: 45247 - RNA, 64 nt, hsa
ucccugccccucaccccagagggugaggaggaaugaggggcauuggugguuaggccgguuggcu

SEQ ID NO: 45248 - RNA, 64 nt, hsa
cgcacuagggacgucccucccugcugcugcuggggaggggcaggcugcuggagccgcccucuga

SEQ ID NO: 45249 - RNA, 64 nt, hsa
gagguggguggggccuucugggaaggugaguggagaggggcaccugccccccgcccuccccauc

SEQ ID NO: 45250 - RNA, 64 nt, hsa
aagggccucuuugacaagguaggagcugugcuuggaggggcaggaaaagaacugagcaugucgc

SEQ ID NO: 45251 - RNA, 64 nt, hsa
gccugaucgcugugggggcaggggccuggaguacgaggggcacccugggggcucccacccagaa

SEQ ID NO: 45252 - RNA, 64 nt, hsa
auuaaacuucuuuugcccccuucuuguccccuuugaggggcacuuaagauggagaaaucaguug

SEQ ID NO: 45253 - RNA, 64 nt, hsa
uccccgauuccuuguagagcugcugcaauucuuagaggggcaguucuaccuccucugucccucg

SEQ ID NO: 45254 - RNA, 64 nt, hsa
aucugugcccugggaagggagaaacagcagggaagaggggcaauacaacagggucaagggugca

SEQ ID NO: 45255 - RNA, 64 nt, hsa
caggcuggaggugacgaugaguuccugaaacuuggaggggcauguuaaagggaugacugugcau

SEQ ID NO: 45256 - RNA, 64 nt, hsa
gcccgggcccuuccuccaagacccuacagagccugaggggcaccuuggcuuccgccugugcuag

SEQ ID NO: 45257 - RNA, 64 nt, hsa
gaagccuuucuguaacaugcggccgucccgccgagaggggcaguuuugcucuuuuguacauuuu

SEQ ID NO: 45258 - RNA, 64 nt, hsa
uucagggcagugucuccaugaggguuuuccuguugaggggcaccacauacaauagugugaagua

SEQ ID NO: 45259 - RNA, 64 nt, hsa
aggggcaccacauacaauagugugaaguagguaugaggggcagucauuguauucuauaguuuuu

SEQ ID NO: 45260 - RNA, 64 nt, hsa
uccgcuuugaaagaagcaagacacguggccucgugaggggcaagcuaggccccagaggcccugg

SEQ ID NO: 45261 - RNA, 64 nt, hsa
guuucccugcugaaugccucgcucccuucaagacgaggggcagggaaggacaggacccucagga

SEQ ID NO: 45262 - RNA, 64 nt, hsa
gcccacuuugaggagggaggcacagggcuugggcgaggggcagaggccaucagaacugcccggc

SEQ ID NO: 45263 - RNA, 64 nt, hsa
ggccuccucccaguagccacggagccgggacccagaggggcagcgcagggcgcagagcacaccc

SEQ ID NO: 45264 - RNA, 64 nt, hsa
gccccggccccagccagaguuccugcggagugaagaggggcagcccuugcuuguugggauuccu

SEQ ID NO: 45265 - RNA, 64 nt, hsa
gccaggcgggcucaaggaaagggggucccagugggaggggcaggcugacaucuguguuucaagu

SEQ ID NO: 45266 - RNA, 64 nt, hsa
uauuaaacuuugaagcaacugugaauucauucuggaggggcaguggagaucaggagugacagau

SEQ ID NO: 45267 - RNA, 64 nt, hsa
aacacaccuuggagaaguggcaucagucaacagagaggggcagggaaggagacaccaagcucac

SEQ ID NO: 45268 - RNA, 64 nt, hsa
gcuaagagggaaggcccagguuugagagagcccagaggggcagagcccagagccuuguuuggcc

SEQ ID NO: 45269 - RNA, 64 nt, hsa
agggaauucuugauuuaggguggcugguggcaaggaggggcaggggauauggggacgugacugg

SEQ ID NO: 45270 - RNA, 64 nt, hsa
ccuucucuccugggcagccacaccacagagcggggaggggcaggugggggaauggaggcugcag

SEQ ID NO: 45271 - RNA, 64 nt, hsa
uggaaggaaguuuagaccugcccagguguggagcgaggggcacaggggcauccuaaccucagaa

SEQ ID NO: 45272 - RNA, 64 nt, hsa
uccucagcgugcagcccuagaggaccccagggcugaggggcaguggauccugcgggagucuccc

SEQ ID NO: 45273 - RNA, 64 nt, hsa
gggugggggcugcuccuuucccaagugguguugugaggggcaaugagggcaacaggagaugugg

SEQ ID NO: 45274 - RNA, 64 nt, hsa
gucacgagaacuuucgucccccaaucgagagcccgaggggcaccccagccccgccucugcuccc

SEQ ID NO: 45275 - RNA, 64 nt, hsa
gugcugggaacggcaaggcggucugggggauggggaggggcaaaggugagagaucaccuucccu

SEQ ID NO: 45276 - RNA, 64 nt, hsa
gaagggaaaugagggcuuuaguuuccugggcagggaggggcagcuucugagguugccaaaggcc

SEQ ID NO: 45277 - RNA, 64 nt, hsa
ccagagucuuggacucauggaaauagaaugaauagaggggcauucacaaggcacaccagugcaa

SEQ ID NO: 45278 - RNA, 64 nt, hsa
uaucccuacccacaacccugggaaguuggagcaagaggggcauacuauugggcugggaggauuu

SEQ ID NO: 45279 - RNA, 64 nt, hsa
gucauugccauccauauuugggagccacuggguggaggggcagggaggcaaaaugagacaagua

SEQ ID NO: 45280 - RNA, 64 nt, hsa
ggaggacugaugacacgagcugccauggcgggaggaggggcaguaguuauugauauggugagcc

SEQ ID NO: 45281 - RNA, 64 nt, hsa
uugucccugauuuuauuuucuuuuagggaaaauuguuucauaaaugugacacugauaaagccuu

SEQ ID NO: 45282 - RNA, 64 nt, hsa
uuuagcacuguuaaagcacgaauugguaacaguuguuucauaaaugagcacuguugugauaaca

SEQ ID NO: 45283 - RNA, 64 nt, hsa
uuccugaagacaguaauaaugcagacacaaacugguuucauauggugagagcagccacagcagc

SEQ ID NO: 45284 - RNA, 64 nt, hsa
ggaaauuaccaguuuagacuaaguuacaguauguguuucauaagugauuaaagcuauaucauuc

SEQ ID NO: 45285 - RNA, 64 nt, hsa
guaaggagcaccaaagcugaggcuggcucagagaucuccagagaagcugcagccugcccuggcc

SEQ ID NO: 45286 - RNA, 64 nt, hsa
aaugcugaccccucgucguaugaacugugcauagucuccagagcuucaaaggcaacacaagcuc

SEQ ID NO: 45287 - RNA, 64 nt, hsa
uuauuuguauuuaaagucauuaacuugaucccuuucuccagacuggccaugccgccauauaccu

SEQ ID NO: 45288 - RNA, 64 nt, hsa
cugcauuuuccuacaccccuuuccuggacugcucucuccagaaacagcacagcucauggagggu

SEQ ID NO: 45289 - RNA, 64 nt, hsa
ggggccuggaucagugggguguauucagagcaccucuccagaugcaccaugcaugcucacaguc

SEQ ID NO: 45290 - RNA, 64 nt, hsa
ucaaaauagaagaccuugcaagaagcagagucauucuccagaaggaacuugggagaugauggug

SEQ ID NO: 45291 - RNA, 64 nt, hsa
aguuuguaagaacaaucauaaaaggacuuguuagucuccagaacaucugcuaaaaugcaaguau

SEQ ID NO: 45292 - RNA, 64 nt, hsa
agauuguuuaacaguauguguggugaugucauuaucuccagagaggcuucaagaaauccuuugg

SEQ ID NO: 45293 - RNA, 64 nt, hsa
ggaauaucaaguauaaugauguaguaaaaagauuucuccagaaaacacuuugagauacuuaaag

SEQ ID NO: 45294 - RNA, 64 nt, hsa
gguaguucuguucuguggguuugugcuuccucuuucuccagaagccuucuggcugauuguuccg

SEQ ID NO: 45295 - RNA, 64 nt, hsa
cucugcccugagccaccacccuggacuggcccagucuccagagcuggcacacccugccuguuuu

SEQ ID NO: 45296 - RNA, 64 nt, hsa
aagggugaaccaggccuuccacccugaccuugcaucuccagacuguuccagagaaggugcgggg

SEQ ID NO: 45297 - RNA, 64 nt, hsa
ccugcauugaauugaauaugaauuucucuaacucucuccagaaaauggauggagauaacuuguc

SEQ ID NO: 45298 - RNA, 64 nt, hsa
ugugagauucuuuagccacuuuggggagccugucucuccagaagccuuucuuaguggugcccac

SEQ ID NO: 45299 - RNA, 64 nt, hsa
ccccgggccagcacuuggcaggcaggaggugcggucuccagaguggugggccagggcgggcugg

SEQ ID NO: 45300 - RNA, 64 nt, hsa
gcggcugggcuggugcagggagugugcugguuagucuccagacccucacagcagccacgccccc

SEQ ID NO: 45301 - RNA, 64 nt, hsa
ugacaacuuguugguaguuaggcacccaugaaugucuccagagacauccugagaggcaagauuc

SEQ ID NO: 45302 - RNA, 64 nt, hsa
gcaaccuucauaccuuuaucuggaaaaugccuucucuccagacaauaagacaguucacaucugg

SEQ ID NO: 45303 - RNA, 64 nt, hsa
ggggagugcguggugucagaucccauccugcuccucuccagaguuuccggucaccuccguguuc

SEQ ID NO: 45304 - RNA, 64 nt, hsa
ggggagugcguggugucagaucccauccugcuccucuccagaguuuccucucaccuccguguuc

SEQ ID NO: 45305 - RNA, 64 nt, hsa
aaaggguuuucaggaugaggaggucaagacaggaucuccagagcuaccgaguucaucugugggu

SEQ ID NO: 45306 - RNA, 64 nt, hsa
cccagaccccaccugaucugcaucuuuguuugcaucuccagagacaccugaggccccagagcuu

SEQ ID NO: 45307 - RNA, 64 nt, hsa
ucaguuccucuccuaaagacaaagguuagucugaucuccagacccgucagaauggaauacacag

SEQ ID NO: 45308 - RNA, 64 nt, hsa
ccagcacaaacucucccuuccaccuuuacgacccucuccagaccagaccuggaguccucuucaa

SEQ ID NO: 45309 - RNA, 64 nt, hsa
ccauccuaucccuugacauacuuaaucauauaucucuccagagaacucaccugacaaaugucuc

SEQ ID NO: 45310 - RNA, 64 nt, hsa
guuuuguguuuuuugguggguuucuuuccuuggcucuccagauuuacuuuuggggccuguucua

SEQ ID NO: 45311 - RNA, 64 nt, hsa
ccucuccagaugagaguacaccccaacagcacccucuccagaugcagccccaucuccucagcac

SEQ ID NO: 45312 - RNA, 64 nt, hsa
ccucuccagaugagaguacaccccaacagcacccucuccagaugagaguacaccccaacagcac

SEQ ID NO: 45313 - RNA, 64 nt, hsa; identical to SEQ ID NO: 45312

SEQ ID NO: 45314 - RNA, 64 nt, hsa
cccucuccagaugggagugcccccaacagcacccucuccagaugagaguacaccccaacagcac

SEQ ID NO: 45315 - RNA, 64 nt, hsa
ccugccuucccaggaguacaccccaacagcacccucuccagaugggagugcccccaacagcacc

SEQ ID NO: 45316 - RNA, 64 nt, hsa
guagacaggcuggauuccaguguugggacagccaucuccagaaaccugacuuaagagaguaaga

SEQ ID NO: 45317 - RNA, 64 nt, hsa
augcugguucccggaaugaaucagcugcugacugucuccagaagggcuggaaaggaugcugcca

SEQ ID NO: 45318 - RNA, 64 nt, hsa
gaaaaaggucaagauuucuaucacuuccccgucuucuccagaacuugugucuccagaggaguac

SEQ ID NO: 45319 - RNA, 64 nt, hsa
uucuaucacuuccccgucuucuccagaacuugugucuccagaggaguacgccgacuucagcagc

SEQ ID NO: 45320 - RNA, 64 nt, hsa
uauuuacuuugagacuaaagacugaagaauaaucuaaauucauacucagacaaaaaaaggaauu

SEQ ID NO: 45321 - RNA, 64 nt, hsa
gucucaggacaaaaggaggcucuucucauucagcuaaauucacauuugccccccccccccgccc

SEQ ID NO: 45322 - RNA, 64 nt, hsa
gucuagaugugaggcuuuuugugaaagagaagccuaaauucagcaucuccccuuccacccucac

SEQ ID NO: 45323 - RNA, 64 nt, hsa
aaaucacaaacuaguaagagacauaguugaagcuuaaauucaaguuuucuggcccugaacucau

SEQ ID NO: 45324 - RNA, 64 nt, hsa
gaaugcaggcaguauuuaggguaguuuaaaugaguaaauucagcacugguaccuuauuauugag

SEQ ID NO: 45325 - RNA, 64 nt, hsa
gcaaugaccucauaaaauaccucuucaaaaugcuuaaauucauuucacacauuaauuuuaucuc

SEQ ID NO: 45326 - RNA, 64 nt, hsa
uaaaaucagcaaugaaacaauaauuugaaauuucuaaauucauaggguagaaucaccuguaaaa

SEQ ID NO: 45327 - RNA, 64 nt, hsa
ccacauuaaucuguaucccauugucuggcuuuuguaaauucauccaggucaagacuaaguaugu

SEQ ID NO: 45328 - RNA, 64 nt, hsa
uuuaagccaaggagcugaaauauaucucaguuuauaaauucagguauauucuuuuugucuccau

SEQ ID NO: 45329 - RNA, 64 nt, hsa
accagucccauuuguaaauauuuacguaccuuuauaaauucaguugcaucuguggcaaaauuuc

SEQ ID NO: 45330 - RNA, 64 nt, hsa
uaguccaacucacaguccacuagcuucacuccuuuaaauucacuuugaaacaggccucauccca

SEQ ID NO: 45331 - RNA, 64 nt, hsa
ucucugauuguccucagccuccacuuccccagaguaaauucaaauugaaucgagcucugcugcu

SEQ ID NO: 45332 - RNA, 64 nt, hsa
guuaagacaaggucaugcuggaugaagguagaccuaaauucaauaugacugguuuccuuguaug

SEQ ID NO: 45333 - RNA, 64 nt, hsa
ucucuuuaacuuacagaauguuaguuuaaaauaauaaauucauccuuuuuuuggagaugauuaa

SEQ ID NO: 45334 - RNA, 64 nt, hsa
auaacuugauguuucauuuucuguugaggaaccauaaauucauucacagacuuaauauuuuuuu

SEQ ID NO: 45335 - RNA, 64 nt, hsa
aauaauuaaaccuguacauauuccauuuacaaaauaaauucagcccugcacuuucuuuagaugc

SEQ ID NO: 45336 - RNA, 64 nt, hsa
gccaaaagcugaaauuuuagcaagucugguguuuuaaauucauuauaaacuauuuauuaacuaa

SEQ ID NO: 45337 - RNA, 64 nt, hsa
auauucuguacaguacguuccuauuguuuaauaauaaauucaaaaauauuucuaaaaccuuaaa

SEQ ID NO: 45338 - RNA, 64 nt, hsa
ucuuaauucauuuacucuauuugaugauaaacuauaaauucauugaaaaugugaauucuauuau

SEQ ID NO: 45339 - RNA, 64 nt, hsa
uuaagucagauuuuuauuuaugagucuuugagacuaaauucaaucaccaccagguaucaaauca

SEQ ID NO: 45340 - RNA, 64 nt, hsa
cagcaaauauaugauucuagugucugacuuuuguuaaauucaguaaugcaguuuuuaaaaaccu

SEQ ID NO: 45341 - RNA, 64 nt, hsa
uuauuacaagggaccuugaacauguuuuguauguuaaauucaaaaguaaugcuucaaucagaua

SEQ ID NO: 45342 - RNA, 64 nt, hsa
cuuuguuucuuucauaugaaaaaaaugcauuuuauaaauucagaaagucauagauuucugaagg

SEQ ID NO: 45343 - RNA, 64 nt, hsa
caguguuauaaauucaacauagaggcugacaaccuaaauucaugguguaacacagcucuuuucc

SEQ ID NO: 45344 - RNA, 64 nt, hsa
gcauuauuaggcuauuucugaugcuucaguguuauaaauucaacauagaggcugacaaccuaaa

SEQ ID NO: 45345 - RNA, 64 nt, hsa
gaaagaaccauguggaaauggaauagaauugguauaaauucauaauuucuaaaccauguauaug

SEQ ID NO: 45346 - RNA, 64 nt, hsa
uguacaucaugcauucuuuucuguuugccuuuuuuaaauucagcaucauguuuuugugauacau

SEQ ID NO: 45347 - RNA, 64 nt, hsa
ugccauuuauuguuaaagauuuauuuuuacaaaguaaauucaggguuuuagauguguacacagc

SEQ ID NO: 45348 - RNA, 64 nt, hsa
aaaauguuuguuuuucacuggauucugaauauaauaaauucaaaguacccuuuuuuuagaguuu

SEQ ID NO: 45349 - RNA, 64 nt, hsa
ucaauaaaaagaggagacuguuaauguguacuuauaaauucacauugucaguauuuuuuaauau

SEQ ID NO: 45350 - RNA, 64 nt, hsa
uaaaguugauccuuuguauauuuccuuauucaaauaaauucagucaucuucuuaucagguugcu

SEQ ID NO: 45351 - RNA, 64 nt, hsa
cgaugcuugucuccugauccuuauucuuuaagucuaaauucagucuuuucaaaacaaaucacaa

SEQ ID NO: 45352 - RNA, 64 nt, hsa
uggcgucugugagaccucaauguaauaagaaaauuaaauucagcuucaggccuuuaaacugcag

SEQ ID NO: 45353 - RNA, 64 nt, hsa
uuuuccuaggcgcaauuuccuuaaacguacaguuuaaauucaaggcuggaccacucaguuauua

SEQ ID NO: 45354 - RNA, 64 nt, hsa
ugaaauaucacuucucccugaucugcagugaguauaaauucacuugucaccucagugcuuuaca

SEQ ID NO: 45355 - RNA, 64 nt, hsa
guaaauucagcucaaauugcaugaucugaggauuuaaauucacaaaaccugccacuacauucug

SEQ ID NO: 45356 - RNA, 64 nt, hsa
uuaaggaauuuauuucucccuuuacuacagcauguaaauucagcucaaauugcaugaucugagg

SEQ ID NO: 45357 - RNA, 64 nt, hsa
uccaccccuguauuucaagaucauugauaagcccuaaauucaaauucuuaagauauggaccuuu

SEQ ID NO: 45358 - RNA, 64 nt, hsa
aauuuaaagcuaccauaaugcuuuuaauuaguucuaaauucaaccaaaaaauguuuuacucuua

SEQ ID NO: 45359 - RNA, 64 nt, hsa
ugauaauuccaugauacagaguaucuuggcauuauaaauucaguaucccaggaccuaaaccuuu

SEQ ID NO: 45360 - RNA, 64 nt, hsa
uuguaccauguuacauguacacugcaccacagucuaaauucagaccagcauuugaaggacugca

SEQ ID NO: 45361 - RNA, 64 nt, hsa
uagcagcuucaccuggagagcugcuuuugcucaguaaauucaacuuccauguuuuaucuuuuuu

SEQ ID NO: 45362 - RNA, 64 nt, hsa
cacaaaguuuccuagacacacaggagaaguagcuuaaauucacuaauauuaauuuaaaaagcag

SEQ ID NO: 45363 - RNA, 64 nt, hsa
caguguuagaaguuugugauucuccaaauaugccuagauuuaaagcugauuuaauuuauggaaa

SEQ ID NO: 45364 - RNA, 64 nt, hsa
uuauaauauuguacauauggauuuuuuuauuguuuagauuuaaccagcuuuuaaaucucucuuu

SEQ ID NO: 45365 - RNA, 64 nt, hsa
uauuguagauuuacuguagguuuucaaccuuuuuuagauuuaugcauguggacauuuuuauaau

SEQ ID NO: 45366 - RNA, 64 nt, hsa
cacaaaccaguggucaaauguaaacacuauauuguagauuuacuguagguuuucaaccuuuuuu

SEQ ID NO: 45367 - RNA, 64 nt, hsa
uuauguuauggcuaaauacaguuaguggguaacuuagauuuauauuagcuagcaucuaauuugc

SEQ ID NO: 45368 - RNA, 64 nt, hsa
uuaccuuuaaacauuuggaagaagcacaaaaaaauagauuuaguuaacccagggaaacaucaau

SEQ ID NO: 45369 - RNA, 64 nt, hsa
uguaaaucaguauguuuuuacauaaugguuuuguuagauuuauuuuuccaucagugaaaacauu

SEQ ID NO: 45370 - RNA, 64 nt, hsa
auaaaauuuuaaaaagucaauucaguucuagaaauagauuuaaagaauaugaaguucuaucuag

SEQ ID NO: 45371 - RNA, 64 nt, hsa
acuccuuuuucccuuaaacuucuuucugucaaauuagauuuaaugagagaguacuauuuuuaag

SEQ ID NO: 45372 - RNA, 64 nt, hsa
gugguacuugugacuacguuuuuucaaauauagauagauuuaagcugcuaauuuuuuuuuuuuu

SEQ ID NO: 45373 - RNA, 64 nt, hsa
aauggcuguacagguagaccauaauucaguccuuuagauuuauuuuaugcagcaaaaagaagcu

SEQ ID NO: 45374 - RNA, 64 nt, hsa
uuaaagggcuauuucuguagacagaaguucagucuagauuuaggccaucucuagguuacaagau

SEQ ID NO: 45375 - RNA, 64 nt, hsa
uuccauugcugcuuauaugcaguguuagccgaauuagauuuacaagacaaucuaagcuuuccgg

SEQ ID NO: 45376 - RNA, 64 nt, hsa
aaggauacuuuauugcauuauuguugcagaagcauagauuuaauugcaucuuuauuuugaaaaa

SEQ ID NO: 45377 - RNA, 64 nt, hsa
auuacagaaacugauuaguuugucaguuugcagauagauuuagcacaguacucaucacucggau

SEQ ID NO: 45378 - RNA, 64 nt, hsa
uaaaaugucacaaaacaggaaccagcauucuaauuagauuuacuauaucaagauaugguucaaa

SEQ ID NO: 45379 - RNA, 64 nt, hsa
ggagcauggccauaaaauaaaauaaaauaaaauuuagauuuaagucgagcucaguggcucacau

SEQ ID NO: 45380 - RNA, 64 nt, hsa
acacaacaauacuuggacuuauuuauuuaaaauuuagauuuauuagagggagcauggccauaaa

SEQ ID NO: 45381 - RNA, 64 nt, hsa
gguuuucaguaaaguguucuugcacauccuucaauagauuuauucuuagacguuuuauauuugu

SEQ ID NO: 45382 - RNA, 64 nt, hsa
gacaggaaauugaccuugacgcuuucuuguuaaauagauuuaacaggaacaucugcacaucuuu

SEQ ID NO: 45383 - RNA, 64 nt, hsa
uuuauuagaauuugugauugauucugacaguguauagauuuaccuuauauugucuuuauuuucc

SEQ ID NO: 45384 - RNA, 64 nt, hsa
acauuucugaguaccauuaucuuaucuaguaauguagauuuacauagaauuaagaguugaaaga

SEQ ID NO: 45385 - RNA, 64 nt, hsa
ccacaaugcgcauguaguuaacaauuuugcacuguagauuuaacauuuuguuaagaggauagau

SEQ ID NO: 45386 - RNA, 64 nt, hsa
gcaggugaggcaaagugcugggacuuuuugguaauagauuuaauuaugaaugauuaguaggaaa

SEQ ID NO: 45387 - RNA, 64 nt, hsa
uggcaguauaaauucuggcuauauuuuuuguuguuagauuuauuuggcuguuaaguauugcgau

SEQ ID NO: 45388 - RNA, 64 nt, hsa
uauuuguguagaauaaugugggauaccugaauaauagauuuaaaaggaccaagugguaaaauug

SEQ ID NO: 45389 - RNA, 64 nt, hsa
aacuccaggauucaggaguuuuaauguuagaauuuagauuuaacagauagaguguggcuucauu

SEQ ID NO: 45390 - RNA, 64 nt, hsa
cuuugauuuuugaaguugggguaguaguuagaacuagauuuaacuagucuauaaugaacaugaa

SEQ ID NO: 45391 - RNA, 64 nt, hsa
aaaaucugcucaggagaaagaagcuaaaucugcauagauuuaguuuguagaauuuaauuuaaaa

SEQ ID NO: 45392 - RNA, 64 nt, hsa
aaugauaauuggcuuuuuaaauuuucaaacaacauagauuuacucaagaugaaauaaaaaggcc

SEQ ID NO: 45393 - RNA, 64 nt, hsa
guuaucugaguguaaguaaauuaauguucucauuuagauuuaucucccagugauuucuacucag

SEQ ID NO: 45394 - RNA, 64 nt, hsa
ucuuaaauuuugguccaaacugaacauauggaaauagauuuauuguaaguauuuacuuagagcu

SEQ ID NO: 45395 - RNA, 64 nt, hsa
uguaaauaccauauuuuugauaaaaauguguaaauagauuuaucaaugaugaguggacaugugg

SEQ ID NO: 45396 - RNA, 64 nt, hsa
aaucuauagcagaguuucucuauuuuauauuucauagauuuaaaaaacccaaauaaagauggau

SEQ ID NO: 45397 - RNA, 64 nt, hsa
aaggaacugggugguuugguuuuuguugcuuuuuuagauuuauugucccaugugggaugaguuu

SEQ ID NO: 45398 - RNA, 64 nt, hsa
cauucagcuuccugcugcuagcaaugccacgauuuagauuuaaugaugcuucaguggaaaucaa

SEQ ID NO: 45399 - RNA, 64 nt, hsa
agucccuucagacuggcccuuaagccaaacucaggcccagaauugcaguucagaauggcagucc

SEQ ID NO: 45400 - RNA, 64 nt, hsa
gacucuggaggucaucuggcggaggucucugggagcccagaacccacauaaaagccccagcuug

SEQ ID NO: 45401 - RNA, 64 nt, hsa
cagggccugggccuguuuccccagcugugaucuugcccagaaccucucuuggcuucauaaacag

SEQ ID NO: 45402 - RNA, 64 nt, hsa
ggagauggaucaagcucagagacuggcagugagagcccagaaggaccuguauaaaaugaaucug

SEQ ID NO: 45403 - RNA, 64 nt, hsa
agucagggucaacucccaggccucagaugcaggggcccagaacaccugcucucaccugagcccc

SEQ ID NO: 45404 - RNA, 64 nt, hsa
aacaccugcucucaccugaaccccaggugaaggggcccagaacaccugcucucaccugagcccc

SEQ ID NO: 45405 - RNA, 64 nt, hsa
ugagugccuuaaaguuggagaaguaacugcccaugcccagaaauaaggaugccagugcccagaa

SEQ ID NO: 45406 - RNA, 64 nt, hsa
guaacugcccaugcccagaaauaaggaugccagugcccagaagcagugagauuagucugugucc

SEQ ID NO: 45407 - RNA, 64 nt, hsa
aacuguggcuccugcagggcacccugcccagaaugcccagaagagaaccaugcauaccugcacu

SEQ ID NO: 45408 - RNA, 64 nt, hsa
acugcaguuaacuguggcuccugcagggcacccugcccagaaugcccagaagagaaccaugcau

SEQ ID NO: 45409 - RNA, 64 nt, hsa
cgcucagcucccgcccgacggcagcgccgccgccgcccagaaucccagcccagaaucccgaccg

SEQ ID NO: 45410 - RNA, 64 nt, hsa
cccgacggcagcgccgccgccgcccagaaucccagcccagaaucccgaccgccgcgccggacgc

SEQ ID NO: 45411 - RNA, 64 nt, hsa
agggaaagggaagcacaugaucaugggaaugauagcccagaacaaaaagaaaucuugucuuacc

SEQ ID NO: 45412 - RNA, 64 nt, hsa
uuuuuagaugaccaaaacuugcagggcaggggaugcccagaagaguggugagauaguaaaacac

SEQ ID NO: 45413 - RNA, 64 nt, hsa
gcggcaccaggagauggaggaugucaucaggcuggcccagaaggaggaggagaugaagguaggg

SEQ ID NO: 45414 - RNA, 64 nt, hsa
caaccaugaggggcauggcaaauuccucaucgcugcccagaacccugcugaugagcccacucca

SEQ ID NO: 45415 - RNA, 64 nt, hsa
cugcaacaaguggcauggcagauuccuggcagcugcccagaacccugcugaugagccugcucca

SEQ ID NO: 45416 - RNA, 64 nt, hsa
gcacugccagcgccugucuuacccgguggccuuggcccagaaggagccagaggcagcagccuca

SEQ ID NO: 45417 - RNA, 64 nt, hsa
caaauguuacacuagacauauguccuaaugugcugcccagaaaccucaacuguuccccagcuac

SEQ ID NO: 45418 - RNA, 64 nt, hsa
ccauccccagggagguggcccaggaaggugccuggcccagaauaaggaacuggcauacugcaaa

SEQ ID NO: 45419 - RNA, 64 nt, hsa
gacacagacaccggacaaaccauugucuuggggagcccagaagagaaagugggcaggguggggu

SEQ ID NO: 45420 - RNA, 64 nt, hsa
aguuaguuaggcauugaguuugcccugggcaaaagcccagaagugggaguaugugguauaucuu

SEQ ID NO: 45421 - RNA, 64 nt, hsa
aggaaacugaggucuagagaggucaagauuacuugcccagaaucacucaggcagcuagugauag

SEQ ID NO: 45422 - RNA, 64 nt, hsa
ucucacgaagaaucccucacucuucccggguucagcccagaagcccuuccaggcaugaucuucc

SEQ ID NO: 45423 - RNA, 64 nt, hsa
guccgcguguugcuggagggacacguguauuggagcccagaagaggggcuguguggccugggaa

SEQ ID NO: 45424 - RNA, 64 nt, hsa
gcggcagccaccaccaguguuguuuugaauaaaagcccagaagccuauuuaagaauuucuccgu

SEQ ID NO: 45425 - RNA, 64 nt, hsa
cuccacagugcucucuggagaagcaauaugagugacugaagaguggggccuuuugcuuuugccu

SEQ ID NO: 45426 - RNA, 64 nt, hsa
acugggggauuucuuaauuagauaaaaguucauuacugaagauggaauauuauauaagauggag

SEQ ID NO: 45427 - RNA, 64 nt, hsa
cccccuuucagcagcauucuuuuuagauuuagguacugaagaaucccagugaguucugcauuug

SEQ ID NO: 45428 - RNA, 64 nt, hsa
agacgaauguagccagagaggaggaaggagggaaacugaagacaccguggccccucggccuucu

SEQ ID NO: 45429 - RNA, 64 nt, hsa
ugaaugauuaaaucagaaaugggauucuugguaaacugaagacuuuuauuugggaaugaaaaac

SEQ ID NO: 45430 - RNA, 64 nt, hsa
uuuuucccaacaaaauuuuguuggggguuauguuacugaagaaugaacagaugaguaaguggag

SEQ ID NO: 45431 - RNA, 64 nt, hsa
uuccucagucuuuucuaaucauaagauaauucacacugaagagaaacugcaaacguggaaagug

SEQ ID NO: 45432 - RNA, 64 nt, hsa
gcuugucacaucuuacuguauauauauaauuccuacugaagaaauccccuggaaaugcaaaaaa

SEQ ID NO: 45433 - RNA, 64 nt, hsa
uauauaaucuugcuucccgccuguuuauggcaguacugaagagaaaugggaaagaagagggagg

SEQ ID NO: 45434 - RNA, 64 nt, hsa
cuuuucuaugacacaagucauaagaaguccauauacugaagagcguuugauuaaaauaaaguga

SEQ ID NO: 45435 - RNA, 64 nt, hsa
cagucaugugaaguauuugucuaaaacagagcaaacugaagaccaaauuauucuccuguugagg

SEQ ID NO: 45436 - RNA, 64 nt, hsa
uccuuaggugcucaauaaaggugugcuguauugaacugaagaagugagaaccaagcuuuuuuuu

SEQ ID NO: 45437 - RNA, 64 nt, hsa
gaauuucuaguaaaugaaauaccuauacuuugauacugaagacugccaaauacauaggaauuuu

SEQ ID NO: 45438 - RNA, 64 nt, hsa
gaauguuuuacuagcacugggugcucaccaugcaacugaagaaaauguggaaacucaaaagguc

SEQ ID NO: 45439 - RNA, 64 nt, hsa
uuuagcaggaaaaaagagaacaucaccuuguaaaacugaagauugugaccagucagaauaaugu

SEQ ID NO: 45440 - RNA, 64 nt, hsa
gauugugaccagaagauuuugaaaauuaaauauuacugaagauuucgacuuccacuguuaaaug

SEQ ID NO: 45441 - RNA, 64 nt, hsa
ggugucuagguuucugauaaaagggaugaucuuaacugaagaauuuaaagagauacuuaaacag

SEQ ID NO: 45442 - RNA, 64 nt, hsa
cuaaugggaaaguaaagguauuguuugaaggaaaacugaagaaaagacuuggcuuagaacaaau

SEQ ID NO: 45443 - RNA, 64 nt, hsa
aaagggggcagaagcaaagaagauacagaucugcacugaagacauuagacuggccauagaaaag

SEQ ID NO: 45444 - RNA, 64 nt, hsa
auaucgugccuuaacaauguggcuguccuuuuccacugaagaaggaaagacguuuugaucuaga

SEQ ID NO: 45445 - RNA, 64 nt, hsa
guccugaauucuuacuaaacauaagaacauucauacugaagaggaacccuaugagugugaagaa

SEQ ID NO: 45446 - RNA, 64 nt, hsa
guugucacacuucauuauagguaagauaguucauacugaagaaaacuucuacaagugugaacag

SEQ ID NO: 45447 - RNA, 64 nt, hsa
auuccuauuagcgaaauaguuuuuuaauauaaccacugaagaaaaucuguggugagaggaaaca

SEQ ID NO: 45448 - RNA, 64 nt, hsa
gugagaggaaacaucuuaccaucuggucauucauacugaagagaaacuccauaaguaucaucuc

SEQ ID NO: 45449 - RNA, 51 nt, hsa
aagaugaugaugauaucugaaauucaccagcugaguuucuauuucuucuau

SEQ ID NO: 45450 - RNA, 64 nt, hsa
ccuaugucaguugccaaaucuuuuaaacuuauguauucaccaagcccaaaaauagauuguggcu

SEQ ID NO: 45451 - RNA, 64 nt, hsa
ugacauuauucugaucacuggcuccaucauacauauucaccacuugagauucauaacauaucaa

SEQ ID NO: 45452 - RNA, 64 nt, hsa
uuaauauguuuagcauuaucuuuauggaauuuauauucaccaauuucaggaaaaccaaccauag

SEQ ID NO: 45453 - RNA, 64 nt, hsa
augaugauguaagaggaaagaacauuuuuuugugauucaccagacaucacuuuaaacuugguga

SEQ ID NO: 45454 - RNA, 64 nt, hsa
aaaucagcaaagagggaaggcagggccccuguagauucaccaguauaaacuucagcugcaggga

SEQ ID NO: 45455 - RNA, 64 nt, hsa
uacaggccaaaugaacuaaacauugccuugcuauauucaccaaaaggacuuaauucuuguuuuu

SEQ ID NO: 45456 - RNA, 64 nt, hsa
cauuauaaaaaugaacuaaacauugccuugcuauauucaccaaaaggacuuacuucuuguuuuu

SEQ ID NO: 45457 - RNA, 64 nt, hsa
cucgggugggauguuuguuggcucuguuguguuuauucaccaauuuguacauuauuuguugucc

SEQ ID NO: 45458 - RNA, 64 nt, hsa
ccgaccacaaaggugucugcggaaacucgaggacauucaccacgaugauuuuccucucuuugau

SEQ ID NO: 45459 - RNA, 64 nt, hsa
auguucuguuguuuuuaggauggagcugguuguuauucaccaacuaagggaacaguuagagcag

SEQ ID NO: 45460 - RNA, 64 nt, hsa
gaggagagccauuggcguggcccacaaaccuuggauucaccauccagacugcagauuggaugaa

SEQ ID NO: 45461 - RNA, 64 nt, hsa
gagaaaggaaaggauagaaucacaggcugcgucugcaccugaaaagugacccgcggaaacucua

SEQ ID NO: 45462 - RNA, 64 nt, hsa
agcacaggcaaggggugcuuguggcaguggccgggcaccugagccccagcucguuguuaaacgu

SEQ ID NO: 45463 - RNA, 64 nt, hsa
gcagugacauugcuggaccccugaaaaccauuccauaggagaauggguuccccaggcucacagu

SEQ ID NO: 45464 - RNA, 64 nt, hsa
uguuauaaaaaaucaguuaucacuauaccaugcuauaggagacugggcaaaaccuguacaauga

SEQ ID NO: 45465 - RNA, 64 nt, hsa
aaaguacaagcugggcaaacugacagaauacuagauaggagagacuaauuccaaccuucuaaau

SEQ ID NO: 45466 - RNA, 64 nt, hsa
aggaagucauuagaaucauuuuuaaguuucagauauaggagacuucaugcaauuuggagauaag

SEQ ID NO: 45467 - RNA, 64 nt, hsa
accaaaaaaaaaaaaagauauuugaaguguuuuuauaggagauguauuuuuaucauaguaaaug

SEQ ID NO: 45468 - RNA, 64 nt, hsa
cuguauauuggauuuugugauuauauuugagugaauaggagaaaacaauauauaacacacagag

SEQ ID NO: 45469 - RNA, 64 nt, hsa
ggcuguucuucauaggagacucagagaagacuucauaggagacucauuauuguuuacuggacau

SEQ ID NO: 45470 - RNA, 64 nt, hsa
agaccccagguacccacagcauuggcuguucuucauaggagacucagagaagacuucauaggag

SEQ ID NO: 45471 - RNA, 64 nt, hsa
gugaagcagccuuacuauucauagaagggcuagaauaggagaaaaugaaagguagugaguaauu

SEQ ID NO: 45472 - RNA, 64 nt, hsa
cuuucuucagcagcgugcaauagcuggcuccucuauaggagaugagcuucauugggaguuccua

SEQ ID NO: 45473 - RNA, 64 nt, hsa
aaaguuuucagucacagaucacgccuuaaaagacauaggagaauucauacuggagagaaaccuu

SEQ ID NO: 45474 - RNA, 64 nt, hsa
aaggucuucagucaagcuucauccuaugcaaaacauaggagaauucaugcaggagagaaauguc

SEQ ID NO: 45475 - RNA, 64 nt, hsa
aaggucuucagucaagcuucauccuaugcaaaacauaggagaauuuauacaggagagaaaccuc

SEQ ID NO: 45476 - RNA, 64 nt, hsa
caaaguuuccauuuggaaaucacaccuuaaagacauaggagaauuuauacuggagagaaagcuu

SEQ ID NO: 45477 - RNA, 64 nt, hsa
agcagcccacagcuguggggcuucagcagccacaccagcccagcccagcccagcucucgauacg

SEQ ID NO: 45478 - RNA, 64 nt, hsa
cccacagcuguggggcuucagcagccacaccagcccagcccagcccagcucucgauacguuugg

SEQ ID NO: 45479 - RNA, 64 nt, hsa
agcuguggggcuucagcagccacaccagcccagcccagcccagcucucgauacguuuggucuuu

SEQ ID NO: 45480 - RNA, 64 nt, hsa
cucacucugccaugagaacaggacaccauccugcccagcccagacgggguugcuccugguccaa

SEQ ID NO: 45481 - RNA, 64 nt, hsa
ggcuuagccaucucccuguccccagcaccccuccccagcccacagugguggccucugccucuuu

SEQ ID NO: 45482 - RNA, 64 nt, hsa
aggccugaugacuagaccccgccuuccgcucccaccagcccacauccaguggggucucagucca

SEQ ID NO: 45483 - RNA, 64 nt, hsa
caggugcuagggugccugcucuccuugcccugggccagcccaggauuguacgugggagaggcag

SEQ ID NO: 45484 - RNA, 64 nt, hsa
ucaggggcaggggacuaccuuccagugucucccuccagcccagcccugaccucaggaaguguca

SEQ ID NO: 45485 - RNA, 64 nt, hsa
aagagcccugcccaggagauagaagaccuggacuccagcccaccguggccacuggagaccucag

SEQ ID NO: 45486 - RNA, 64 nt, hsa
uagcccaacccagcccaacccggcccaacccagcccagcccagcucagcucagcuacugccaag

SEQ ID NO: 45487 - RNA, 64 nt, hsa
cggccuagcccaacccagcccaacccggcccaacccagcccagcccagcucagcucagcuacug

SEQ ID NO: 45488 - RNA, 56 nt, hsa
ccagcagcagcacggccuagcccaacccagcccaacccggcccaacccagcccagc

SEQ ID NO: 45489 - RNA, 64 nt, hsa
aaaucaccacauauuuggaaucucuuccacgggaccagcccagagcuaugccauggaaaugaua

SEQ ID NO: 45490 - RNA, 64 nt, hsa
agcugcccaccucuuuuuccauucccagucgcucccagcccaccucugccuccaagccccagau

SEQ ID NO: 45491 - RNA, 64 nt, hsa
cuuggcuguccccuccaucuggggauggagaaugccagcccaaagcuggagccaauggugaggg

SEQ ID NO: 45492 - RNA, 64 nt, hsa
caggaacauucccacauaauacauuccaucacagccagcccagcuccacucagggcuggcccgg

SEQ ID NO: 45493 - RNA, 64 nt, hsa
auaugcacaagagcaagugaugcccccagcgcccccagcccagcccacuccccgcauggggagg

SEQ ID NO: 45494 - RNA, 64 nt, hsa
cacaagagcaagugaugcccccagcgcccccagcccagcccacuccccgcauggggaggccgcc

SEQ ID NO: 45495 - RNA, 64 nt, hsa
gcaagauucugugggcagcuggcucugaauguagccagcccacauccauuccagagcugcagaa

SEQ ID NO: 45496 - RNA, 64 nt, hsa
uggccaggcugguaaauuuaggauauuacaauggccagcccagauggcucccugggcuggcaug

SEQ ID NO: 45497 - RNA, 64 nt, hsa
gaguaaauaucuacucacucauacagccagcccaccagcccaccauuaacucacugaacaauga

SEQ ID NO: 45498 - RNA, 64 nt, hsa
accaggcagaguaaauaucuacucacucauacagccagcccaccagcccaccauuaacucacug

SEQ ID NO: 45499 - RNA, 64 nt, hsa
uaaauguuaauaacaauggaauuggagcauuuaaccagcccaguaugacuuccaaaagaagaga

SEQ ID NO: 45500 - RNA, 64 nt, hsa
auagacaaaugacugucugggcccacacaguuaaccagcccauuucuccacacugguacaguag

SEQ ID NO: 45501 - RNA, 64 nt, hsa
gaguguccggugaccucccccagggccuccuugcccagcccaguccaggcugcugugccaaauc

SEQ ID NO: 45502 - RNA, 64 nt, hsa
uccagccccugcacacucccacccaggacagcccccagcccaacuaggaaagggccaugggcag

SEQ ID NO: 45503 - RNA, 64 nt, hsa
gcacuugauggcuacaaauaaaugucccguggccccagcccacucuacuggugucucucucucu

SEQ ID NO: 45504 - RNA, 64 nt, hsa
uggggugccauguguacuucugaaaauauuuuaaccagcccacccagcagucaguacacaugcc

SEQ ID NO: 45505 - RNA, 64 nt, hsa
ugaaccauucaucaccucugccuuccuccuauccccagcccaauaaauuaaaacaauuaacuga

SEQ ID NO: 45506 - RNA, 64 nt, hsa
ggaggagugaggagcccaggaacgacguggucuuccagcccaucuccggggaagacgugcgcga

SEQ ID NO: 45507 - RNA, 64 nt, hsa
caagaagugccaagauuggcuuggcaucugcacuccagcccaggacuguggucugccauugcaa

SEQ ID NO: 45508 - RNA, 64 nt, hsa
agcccggggcuccugagccucugcgugugcccucccagcccacaccagugcucucggccacuga

SEQ ID NO: 45509 - RNA, 64 nt, hsa
cuagggcugggcucucggggccaggcaggccagcccagcccacgccgagcugggcagcgucugc

SEQ ID NO: 45510 - RNA, 64 nt, hsa
agaaccuagggcugggcucucggggccaggcaggccagcccagcccacgccgagcugggcagcg

SEQ ID NO: 45511 - RNA, 64 nt, hsa
cuuccaaggugaggcaaaggcaucuggacuuguuccagcccagcccaccgggugacaucaccgg

SEQ ID NO: 45512 - RNA, 64 nt, hsa
aaggugaggcaaaggcaucuggacuuguuccagcccagcccaccgggugacaucaccgggcagg

SEQ ID NO: 45513 - RNA, 64 nt, hsa
uagaugcaagcaagguggacaagagcucaggacuccagcccacugccacugggugacacagacu

SEQ ID NO: 45514 - RNA, 64 nt, hsa
cuccccucccuugcugcucugccccugccagugcccagcccagcggcucugggaagggguuccc

SEQ ID NO: 45515 - RNA, 64 nt, hsa
gggccagugcccagacagggucauggggcucagaccagcccacuguagagaaucacucugaggc

SEQ ID NO: 45516 - RNA, 64 nt, hsa
accugagcugggguugcaaagucacuggccacauccagcccaaagauaaauuuuguuuguccag

SEQ ID NO: 45517 - RNA, 64 nt, hsa
cugcugcauguuguggguuaaagggagucucucaccagcccaggcccucaggaggaggagauac

SEQ ID NO: 45518 - RNA, 64 nt, hsa
ucuaauuagaaaaaggcuuggugaggcugagaaaccagcccacaauuacacaaagacaaaaaaa

SEQ ID NO: 45519 - RNA, 64 nt, hsa
caugaucugguacaggcaugcucaccagcccagcccagcccagcuguccuguccuccuuauucu

SEQ ID NO: 45520 - RNA, 64 nt, hsa
gcaaccaugaucugguacaggcaugcucaccagcccagcccagcccagcuguccuguccuccuu

SEQ ID NO: 45521 - RNA, 64 nt, hsa
caacugcaaccaugaucugguacaggcaugcucaccagcccagcccagcccagcuguccugucc

SEQ ID NO: 45522 - RNA, 64 nt, hsa
uauuuuuuguagagacgggguuucgccaaguugaccagcccaguuucaaacuccugaccucagg

SEQ ID NO: 45523 - RNA, 64 nt, hsa
uaugagugaguaucuuggugaugacuccuccugaccagcccaggaccagcuuucuugucaccuu

SEQ ID NO: 45524 - RNA, 64 nt, hsa
cgguacugaccagcucccguugggccaggccagcccagcccagagcacaggcuccagcaauaug

SEQ ID NO: 45525 - RNA, 64 nt, hsa
cccaccgguacugaccagcucccguugggccaggccagcccagcccagagcacaggcuccagca

SEQ ID NO: 45526 - RNA, 64 nt, hsa
ggcaggcggaucacuugaugccagaaguuugagaccagcccagccaacauggugaaaccccguc

SEQ ID NO: 45527 - RNA, 64 nt, hsa
ggccagcccuggcccuugaagggguuggcugugcccagcccaccuggcugcagugggcagcuca

SEQ ID NO: 45528 - RNA, 64 nt, hsa
aauaacucuugcagcccugaaggaccuagggagcccagcccaccuucccacggacugggguucc

SEQ ID NO: 45529 - RNA, 64 nt, hsa
gggcaaaaucaucccaaaccaggcugccccagccccagcccagcaacagugaacucccuugggu

SEQ ID NO: 45530 - RNA, 64 nt, hsa
gcaacugacccaguccgcaaauauuuauugggggccagcccagggcugggacugggcaugaggu

SEQ ID NO: 45531 - RNA, 64 nt, hsa
uccuugucucuugucuuuggccagcccccucagcccagcccaccccacccgcuguccggccaca

SEQ ID NO: 45532 - RNA, 64 nt, hsa
aacucaccccuggaauacaggggaaugaugacaaccagcccagccaggccugacucaucauggu

SEQ ID NO: 45533 - RNA, 64 nt, hsa
ggaagggaaagguuuuucuuguagggaacuggaaccagcccacaacugcacacuugugagcugu

SEQ ID NO: 45534 - RNA, 64 nt, hsa
cuccucuuccucagaguggcucgggucagcgcagccagcccagcucccugcagcccaagucuca

SEQ ID NO: 45535 - RNA, 64 nt, hsa
uggcuaugcacccccaccauuccuacacaucuugccagcccaccagcagccccacucacagcug

SEQ ID NO: 45536 - RNA, 64 nt, hsa
uaaggcuggacuccaauggcccauuccccucaccccagcccaagacgugggaggcugcuuccca

SEQ ID NO: 45537 - RNA, 64 nt, hsa
uuggccccucaccaaugcaucuaucugucugccaccagcccaccccacccugcccccacccuca

SEQ ID NO: 45538 - RNA, 64 nt, hsa
uugggggcacugcuguccccccuccagcuaggacccagcccauccccagaugccugagccuuug

SEQ ID NO: 45539 - RNA, 64 nt, hsa
ggccaggguggcaggaagacauccccccuccaucccagcccacuggaccagaacugggagagga

SEQ ID NO: 45540 - RNA, 64 nt, hsa
uauaaaaaugggucaguagcccuuccuguucucuccagcccagcauacaggaggaucaaaggag

SEQ ID NO: 45541 - RNA, 64 nt, hsa
uggggguuggauuugaagacuuuuaaguuuccuuccagcccagaaagucucucauucuaggccu

SEQ ID NO: 45542 - RNA, 64 nt, hsa
caacagcaccuccccgcugggaagagaagagggcccagcccagagccaccuggaucuaucccug

SEQ ID NO: 45543 - RNA, 64 nt, hsa
ugggcaggaagggagaacuugaaacagauucaggccagcccagccaggccaacagcaccucccc

SEQ ID NO: 45544 - RNA, 64 nt, hsa
ccacagcaccaucaggcagcacccaugggcuccaccagcccagcucugucccuccccuagguaa

SEQ ID NO: 45545 - RNA, 64 nt, hsa
gcugcuggcacacggggccgaccccagcgagugcccagcccacgagucccucacccacaucugc

SEQ ID NO: 45546 - RNA, 64 nt, hsa
ggcaaaggaccuggcguggccacuuccuccugccccagcccaaccucugggaacaggcagcucc

SEQ ID NO: 45547 - RNA, 64 nt, hsa
ucgggacagguagcacugcuguccagccacagccccagcccaggcagcccacagugcugcacgu

SEQ ID NO: 45548 - RNA, 64 nt, hsa
cuagacaugaaaugucaccuugcugaggcccagcccagcccagcauagcccgagggcuggaaaa

SEQ ID NO: 45549 - RNA, 64 nt, hsa
uauuucuagacaugaaaugucaccuugcugaggcccagcccagcccagcauagcccgagggcug

SEQ ID NO: 45550 - RNA, 64 nt, hsa
ccgacccuuugaguccccuugagugucuuaagaaccagcccacaacagccucucuuucuccucc

SEQ ID NO: 45551 - RNA, 64 nt, hsa
auccugacccuccccacugcaagcccagggagccccagcccaagauggccagccugaaacuguu

SEQ ID NO: 45552 - RNA, 64 nt, hsa
ccgcccgacggcagcgccgccgccgcccagaaucccagcccagaaucccgaccgccgcgccgga

SEQ ID NO: 45553 - RNA, 64 nt, hsa
cauaggucucccucucugggcaccaggacucaguccagcccaagacuacucugggcagcuccca

SEQ ID NO: 45554 - RNA, 64 nt, hsa
uuuguuuuguugagauggagucucgcucuguugcccagcccagaguacaguggcacuaucucag

SEQ ID NO: 45555 - RNA, 64 nt, hsa
aaagugcugggauuacaggcgugagccacugugcccagcccagguuuugaaguuguccgagaua

SEQ ID NO: 45556 - RNA, 64 nt, hsa
cacugccacagggacgccuucccuccccuccccuccagcccaccccugcacagccccuccuccu

SEQ ID NO: 45557 - RNA, 64 nt, hsa
ccguguucucaggagugguugaggacacagggccccagcccagcccucugcaccccccagcccg

SEQ ID NO: 45558 - RNA, 64 nt, hsa
ccauagugggccaggcugcccuccaugcugggccccagcccaggucugcacucgccuggaucac

SEQ ID NO: 45559 - RNA, 64 nt, hsa
ccuugcggggaggagaggguuugcuaaucugcucccagcccaaccuauuaccaccccaccucgc

SEQ ID NO: 45560 - RNA, 64 nt, hsa
caugguuacauacuaauugcugcagcucuguggcccagcccacugcuucagcugugggccaucu

SEQ ID NO: 45561 - RNA, 64 nt, hsa
ugugggccaucugaggguacgugccaucaucucuccagcccaggccccugggcaucucaugcug

SEQ ID NO: 45562 - RNA, 64 nt, hsa
gcagggaaggcaaacccucuuuauugaacauuagccagcccagcccagaccccagggcugccua

SEQ ID NO: 45563 - RNA, 64 nt, hsa
gaaggcaaacccucuuuauugaacauuagccagcccagcccagaccccagggcugccuaaggac

SEQ ID NO: 45564 - RNA, 64 nt, hsa
cucccuuccgacccucugggaaccucccagagguccagcccaucucggagcaucccggaggaaa

SEQ ID NO: 45565 - RNA, 64 nt, hsa
cuuagucccccaacucugagcccauguucugcccccagcccaaaggggacaggccucaccucua

SEQ ID NO: 45566 - RNA, 64 nt, hsa
gaggugaccagaggguucagagugggaggcggggccagcccaggccaggagcgccucaucuucc

SEQ ID NO: 45567 - RNA, 64 nt, hsa
gccucuucucgacgucuccuuccggagcugagauccagcccagggcgaauggcgagcuuggcuc

SEQ ID NO: 45568 - RNA, 64 nt, hsa
agugcuaagcugcccugaggguuuccuucggggaccagcccacagcacaccaagguggcccgga

SEQ ID NO: 45569 - RNA, 64 nt, hsa
gucuuggguguuagugucagccaugggaaaugagccagcccaagggcaucauccucagcagcau

SEQ ID NO: 45570 - RNA, 64 nt, hsa
guugccggaguacacagugacccaggagucugggccagcccaccgcaaagaauucaccaugacc

SEQ ID NO: 45571 - RNA, 64 nt, hsa
acagggcaaggagccaaggaccacagagccucagccagcccaggauccguccucauuuuauugg

SEQ ID NO: 45572 - RNA, 64 nt, hsa
aaauacggcucauguuaaugaguuacauuaucagccagcccagccuugcccaccauuuaagaaa

SEQ ID NO: 45573 - RNA, 64 nt, hsa
aauccccaaaggaaaacaccuauuuuucuacuacccagcccaagaaaccucaaaagcaugccuu

SEQ ID NO: 45574 - RNA, 64 nt, hsa
auacaacuucaagugcaugcucucugcagccagcccagcccagcuggugggaagcgucuguccg

SEQ ID NO: 45575 - RNA, 64 nt, hsa
gagugauacaacuucaagugcaugcucucugcagccagcccagcccagcuggugggaagcgucu

SEQ ID NO: 45576 - RNA, 64 nt, hsa
guucagccccuccucugccaccuccccuauccacccagcccauucucucuccuguccaaccuaa

SEQ ID NO: 45577 - RNA, 64 nt, hsa
cccagccuguggccaggucacugucuaccccagcccagcccagcccucugccgcuuguacauac

SEQ ID NO: 45578 - RNA, 64 nt, hsa
gccaacccagccuguggccaggucacugucuaccccagcccagcccagcccucugccgcuugua

SEQ ID NO: 45579 - RNA, 64 nt, hsa
guggcgggcuccacguuagcccaggcucugagagccagcccaggggcggcgcugcucagcuugg

SEQ ID NO: 45580 - RNA, 64 nt, hsa
gcugggcugccagugccaugcaagccacagccagccagcccauccacuucuuccacuccucccc

SEQ ID NO: 45581 - RNA, 64 nt, hsa
gaggguccaagaagacguaggcuucauuuucacaccagcccacaccauuccagugcucagccua

SEQ ID NO: 45582 - RNA, 64 nt, hsa
cugccuuaaucagaccgauuuccugcccaccugaccagcccagcgugguaaaccucuguauauu

SEQ ID NO: 45583 - RNA, 64 nt, hsa
auucaagcaauaagagggggguuccugggggcuuccagcccaggcuagaagcccccauggcuuc

SEQ ID NO: 45584 - RNA, 64 nt, hsa
agccugcugcaacagacccuccccgcgccccuccccagcccaucuuacugcaagcagcguccug

SEQ ID NO: 45585 - RNA, 64 nt, hsa
uggcugguguuugcagucccacguggcauggccuccagcccaacccacaguggagacuggagac

SEQ ID NO: 45586 - RNA, 64 nt, hsa
ugcagccaaaggugcaauuacuugaccugcagccccagcccacccucggcucugcagccgguuc

SEQ ID NO: 45587 - RNA, 64 nt, hsa
cuguuggacaccaacuuuagucuugggcugcaagccagcccagcugaggcgaaguggacuccag

SEQ ID NO: 45588 - RNA, 64 nt, hsa
augccaguggcccucgcgagcgccuggacaucuaccagcccacggcgcgcuucugccugcguuc

SEQ ID NO: 45589 - RNA, 64 nt, hsa
uacccggcagaccccucuuccuacagcccccucuccagcccagcuaccuccucgccaaguggga

SEQ ID NO: 45590 - RNA, 64 nt, hsa
ugugaccauuacgcccccucccuguuucuuaucaccagcccaucagcccacugacucccauaug

SEQ ID NO: 45591 - RNA, 64 nt, hsa
ccucugcaugaguucugcaccccaagcccuugccccagcccaguccagcagcagauguuacaau

SEQ ID NO: 45592 - RNA, 64 nt, hsa
cuggaaacgcccugugucucuggcuacagcaagaccagcccaggagcccaccagcaccugccuc

SEQ ID NO: 45593 - RNA, 64 nt, hsa
uaaugagaaaccaggacaggccaucugcagugacccagcccaggacgaaguuuacaaacaccuc

SEQ ID NO: 45594 - RNA, 64 nt, hsa
caggggagcccaggcugcccugcacuccugccucccagcccacagccaggugcuuucaucacag

SEQ ID NO: 45595 - RNA, 64 nt, hsa
cuccagccaaugaaugggaucauucuggaugucaccagcccaauaggcucagcucaugaugaca

SEQ ID NO: 45596 - RNA, 64 nt, hsa
caaaaucucuccuaccaagaugguguuccacuguccagcccagcaugaguagcagguagagcac

SEQ ID NO: 45597 - RNA, 64 nt, hsa
uucucuucugugggucuguaccagguacuccaggccagcccaugggcccggggccugaccccaa

SEQ ID NO: 45598 - RNA, 64 nt, hsa
aguugaaaccaaacaggccucucgcucacuccucccagcccaguaaugcugaggaguucaguug

SEQ ID NO: 45599 - RNA, 64 nt, hsa
auggccucagcccagcccacccucaccugcuuuuccagcccacaaagggggacgaucacggccc

SEQ ID NO: 45600 - RNA, 64 nt, hsa
uuauuacacagauaguggcggcaauggccucagcccagcccacccucaccugcuuuuccagccc

SEQ ID NO: 45601 - RNA, 64 nt, hsa
cagagacgaagggaaggguagccagggagggaguccagcccagcugccugcaggaagaucuggc

SEQ ID NO: 45602 - RNA, 64 nt, hsa
gggccgagugggguuugaaggcagccggcccggcccagcccaggagcgcuauuuauugcauauu

SEQ ID NO: 45603 - RNA, 64 nt, hsa
gaacuugccagauagaaaagacuuaaauggagaaccagcccaugccucacagacaguaggaucc

SEQ ID NO: 45604 - RNA, 64 nt, hsa
gauggugcuugcucuauuuggcuccuaacaguugccagcccaccuaaguucucuucgcuuaaag

SEQ ID NO: 45605 - RNA, 64 nt, hsa
acagagagcacgguguccagagcuggcccuucccccagcccacagccagcuccgugcccgagug

SEQ ID NO: 45606 - RNA, 64 nt, hsa
ugagucacuagggaaugucaccugaaugcacagcccagcccaugcaccugccccagccccucca

SEQ ID NO: 45607 - RNA, 64 nt, hsa
cgagcccuacuuccagguucugguuagcucagccccagcccagcccagcugcucugcccagagc

SEQ ID NO: 45608 - RNA, 64 nt, hsa
ccuacuuccagguucugguuagcucagccccagcccagcccagcugcucugcccagagcugggu

SEQ ID NO: 45609 - RNA, 64 nt, hsa
acccuggugaggaagcuccaguccugcucucuacccagcccaucuugccuccauggugccucug

SEQ ID NO: 45610 - RNA, 64 nt, hsa
cccauuaaccagggcaccaagcccacagguguccccagcccacuggaucagaaagaguucagua

SEQ ID NO: 45611 - RNA, 64 nt, hsa
caguccaggcaggaagcagcaccugccccccgcgccagcccagccccagccugagugcaggagc

SEQ ID NO: 45612 - RNA, 64 nt, hsa
guggcguguggcagaaucgcaccgccccggcuccccagcccaccgccaugcagggcucgcgugc

SEQ ID NO: 45613 - RNA, 64 nt, hsa
ucccugccuauggugucgcuuggcuaagugacucccagcccaagcccccucaagagucuggguc

SEQ ID NO: 45614 - RNA, 64 nt, hsa
cuucguugagggccauccauaugccagcugggggccagcccacaguggccauauuggcugcagc

SEQ ID NO: 45615 - RNA, 64 nt, hsa
gauuucagcccugggccugcaggagaggcugagaccagcccacccagccaguggucgagcacug

SEQ ID NO: 45616 - RNA, 64 nt, hsa
cucccaaagugcugggauuacaggcgcaagccacccagcccagcuucuuuccauuccuugauag

SEQ ID NO: 45617 - RNA, 64 nt, hsa
ucagggagugcagacaccuaaccccagggcacugccagcccacccccuuugacucuggggugca

SEQ ID NO: 45618 - RNA, 64 nt, hsa
ccucuccccaggaaguggcucagaccccucagccccagcccagacaaagaugucuuaaccucag

SEQ ID NO: 45619 - RNA, 64 nt, hsa
cugcaaauccccguuccccugcacuccucuucucccagcccaucccuccggccccugugccucu

SEQ ID NO: 45620 - RNA, 64 nt, hsa
agcccaucccuccggccccugugccucugcggccccagcccagcucccagggccgucaccugcu

SEQ ID NO: 45621 - RNA, 64 nt, hsa
agcccagcccccugccccggcccugcuccagaacccagcccagaucggaggacaaguuccucuc

SEQ ID NO: 45622 - RNA, 64 nt, hsa
aguuccucucuagaacccaauccaauuuggagccccagcccaacuccagaacccaacccuucuc

SEQ ID NO: 45623 - RNA, 64 nt, hsa
agcccaacuccagaacccaacccuucucuagaauccagcccagaucugaggccaagcuaugugc

SEQ ID NO: 45624 - RNA, 64 nt, hsa
gggggagaagaaauuuugagaauggaaaaaucccccagcccagcccagccccaccgaaaagcaa

SEQ ID NO: 45625 - RNA, 64 nt, hsa
agaagaaauuuugagaauggaaaaaucccccagcccagcccagccccaccgaaaagcaaaaauu

SEQ ID NO: 45626 - RNA, 64 nt, hsa
agcgggaugagcuggcggccagagaacgcccagcccagcccacccccgcucacguccugccgca

SEQ ID NO: 45627 - RNA, 64 nt, hsa
agagcagcgggaugagcuggcggccagagaacgcccagcccagcccacccccgcucacguccug

SEQ ID NO: 45628 - RNA, 64 nt, hsa
cagagcagguaggcgcccugcagccucccugcucccagcccaaggccagucggccugggaaguu

SEQ ID NO: 45629 - RNA, 64 nt, hsa
ggccucagaccagccaaccuuuguggaauaagccccagcccagccaaaccaaacccagaugccu

SEQ ID NO: 45630 - RNA, 64 nt, hsa
ggagaugccuggggaggggcuccuggaauccaggccagcccaacagcccuggcuggggaggugu

SEQ ID NO: 45631 - RNA, 64 nt, hsa
cuggggucuuugugaauauccagacuguuucagcccagcccaucucagccaacccuccuuagac

SEQ ID NO: 45632 - RNA, 64 nt, hsa
ccacccccacugggccugcuggccucccucggcuccagcccaaugccccagcuggccuucccca

SEQ ID NO: 45633 - RNA, 64 nt, hsa
ugaaaaggcauugggagaagcagucugggggaggccagcccagugcgggcacagcacaacacgg

SEQ ID NO: 45634 - RNA, 64 nt, hsa
acccagacccccuuuucuccauguaccugcugggccagcccauuucacaggugaggaacccgag

SEQ ID NO: 45635 - RNA, 64 nt, hsa
cccgcagggauggaggcagcuccugaacugguggccagcccacgggguacuggaagacaguggu

SEQ ID NO: 45636 - RNA, 64 nt, hsa
uaagagugcacuacagcccaggcuuaugccacccccagcccaccugccucaccacccuggcugu

SEQ ID NO: 45637 - RNA, 64 nt, hsa
aaugcacucaauuuaguacugaauggucuuucucccagcccauucccagcccuuccuauuuccu

SEQ ID NO: 45638 - RNA, 64 nt, hsa
ggccccacagagcccaaaacagaagggggcugccccagcccagcagagcacagaguuucuggag

SEQ ID NO: 45639 - RNA, 64 nt, hsa
acaguacccugggaggcauaggagaagggucgggccagcccagcccagggccugaguuagacua

SEQ ID NO: 45640 - RNA, 64 nt, hsa
acccugggaggcauaggagaagggucgggccagcccagcccagggccugaguuagacuauuucc

SEQ ID NO: 45641 - RNA, 64 nt, hsa
uggccccgggcuguggcgagacagcccaacucccccagcccagcucccccagcccagagccagg

SEQ ID NO: 45642 - RNA, 64 nt, hsa
ggcgagacagcccaacucccccagcccagcucccccagcccagagccagggaagaggaaggugg

SEQ ID NO: 45643 - RNA, 64 nt, hsa
ggucaccuacggcuguggccgugcaggccuccuuccagcccagaguggcccaguagagcaaggc

SEQ ID NO: 45644 - RNA, 64 nt, hsa
gggacaguccccuccgggaugaccugauucaccuccagcccagggaauggaaucuagaggaaua

SEQ ID NO: 45645 - RNA, 64 nt, hsa
gucaggcugugcugugugaugggcaggcuuugccccagcccaccccuggcaaggugcacuuguu

SEQ ID NO: 45646 - RNA, 64 nt, hsa
ccagcaccaucuguuccccuagacuucucaggggccagcccagucugggccacccuuuguuucc

SEQ ID NO: 45647 - RNA, 64 nt, hsa
ggaccccaaguaggcaacuguuauggcaguggguccagcccaggccagcacugccagccuccuc

SEQ ID NO: 45648 - RNA, 64 nt, hsa
ucgaucuucucacucuuacuucuagaaaaaagauccagcccaggcacggaaugggagggcccug

SEQ ID NO: 45649 - RNA, 64 nt, hsa
aggcugcagugaaccgugaucacgccacugcaccccagcccaggcaacaaagugagccccuguc

SEQ ID NO: 45650 - RNA, 64 nt, hsa
gcccacccaccaggccugagggggccgagcagggccagcccagugacuggugucccuugauucc

SEQ ID NO: 45651 - RNA, 64 nt, hsa
cucgagccagucuaugcccuuucuccaguaggccccagcccagaccucuucggcuucaggaacu

SEQ ID NO: 45652 - RNA, 64 nt, hsa
acugccccuguacaguccugccccccagcacccuccagcccacaaacagggcccuaagcacuuc

SEQ ID NO: 45653 - RNA, 64 nt, hsa
cucaguuugcuccacauggccgccacccccugcaccagcccacauccccacugccccuguacag

SEQ ID NO: 45654 - RNA, 64 nt, hsa
aucgcacucuggcagcaccgccucuucccgccgcccagcccaccccauggccggcuuucaggag

SEQ ID NO: 45655 - RNA, 64 nt, hsa
ucccacaugccaggggccuuugggugcuguuuugccagcccauuugggcagagaggcugugguu

SEQ ID NO: 45656 - RNA, 64 nt, hsa
ggcacucuuccagcucccuggggguugaccaggagccggucagagauggaccuggccagauguc

SEQ ID NO: 45657 - RNA, 64 nt, hsa
ccuuccucggcuagccaaaacagcuggcaggacugccggucacacaccagcacgucccaccucg

SEQ ID NO: 45658 - RNA, 64 nt, hsa
acaagugagucacaaacauucuguugaagggaaaucuagucaguugcuugaaagagcacagccc

SEQ ID NO: 45659 - RNA, 64 nt, hsa
aucaaaguuuaugauuaaauguaaggaagugguaucuagucaguccauaaagauugugcuaauu

SEQ ID NO: 45660 - RNA, 64 nt, hsa
cauuuugucgccugcacccacucccuucauacaaucuagucagaauagcaguucuagagcacag

SEQ ID NO: 45661 - RNA, 64 nt, hsa
ucugcagucaggucacugccuacugccugggggcucuagucauuccaguggaagacgaauguaa

SEQ ID NO: 45662 - RNA, 64 nt, hsa
uaucuaaauaggcauuuuuagucauuaaaaaaaaucuagucaccaggaggaucccuaugacuca

SEQ ID NO: 45663 - RNA, 64 nt, hsa
accugaagugguuuacuucuguggguuaagaaguucuagucaguguucauagucguuucguuuu

SEQ ID NO: 45664 - RNA, 64 nt, hsa
aguaacauuuuuuuguauagguauaccaugauuuguugaugaacaaauuuaccuguugaugaac

SEQ ID NO: 45665 - RNA, 64 nt, hsa
guauaccaugauuuguugaugaacaaauuuaccuguugaugaacauuuacguuguuaccaagau

SEQ ID NO: 45666 - RNA, 64 nt, hsa
aaucaacuucuacagaaacuuuugcagggacaguguugaugaggcaguuuagcuugccagggug

SEQ ID NO: 45667 - RNA, 64 nt, hsa
acaugucauccacuugaguuaauaguuuuccuacguugaugacagcccucaugaguagcaucca

SEQ ID NO: 45668 - RNA, 64 nt, hsa
ucuguccaguugaggccucaggaccacggcaugauuucaugacuccgaaguauuuuacagaaac

SEQ ID NO: 45669 - RNA, 64 nt, hsa
uuaaauauuuauaauguagcuucuuucaaaauauuuucaugaaaaauuacuuuuauuauaccau

SEQ ID NO: 45670 - RNA, 64 nt, hsa
aucuuuuauuucauguguauguaacuacuaaauuuuucaugacugaagagguuauagcacauau

SEQ ID NO: 45671 - RNA, 64 nt, hsa
gugucugggagguuuuuuuuuucuauuuuuauuuuuucaugaaaauuauuggugggccacugaa

SEQ ID NO: 45672 - RNA, 64 nt, hsa
guuauugguaccaaaacucuugccagauaaccaguuucaugaacuguuuguauggcagcccaug

SEQ ID NO: 45673 - RNA, 64 nt, hsa
uuacauaucaguaauuguuuuuauaauuugugguuuucaugaaacauugcuaugcauuuauuag

SEQ ID NO: 45674 - RNA, 64 nt, hsa
cauuguagauaucuauuuauauuuaaaguuuauguuucaugaacugcagcugcaggauucuggc

SEQ ID NO: 45675 - RNA, 64 nt, hsa
accuuguaagauaaauauaaauuggaguuaggaauuucaugaaccucacuaugaccaaaauuaa

SEQ ID NO: 45676 - RNA, 64 nt, hsa
uaauuguaguguaguuguucuauaaaccauauuuuuucaugauguggauauuuucuucuauuuc

SEQ ID NO: 45677 - RNA, 64 nt, hsa
cuggacucagaugcauagauuugguccaguguauuuucaugauaaagugaaauugagucagaac

SEQ ID NO: 45678 - RNA, 64 nt, hsa
uaacacagaaacgcaauaaacacacacaaaauaguuucaugagugauucuucagaugcccuucc

SEQ ID NO: 45679 - RNA, 64 nt, hsa
uucucauguuuauauaaugguaugcuugcauauauuucaugaauacauuguacauauuauguua

SEQ ID NO: 45680 - RNA, 64 nt, hsa
ucaaauaaaauaaaucuaagucgguuaaaauggauuucaugauuuucccucagaaaaugaguaa

SEQ ID NO: 45681 - RNA, 64 nt, hsa
cccggcugccauacugcaugcugcaggcucugccuuucaugaccccaggcaacagccagggccc

SEQ ID NO: 45682 - RNA, 64 nt, hsa
cccuacaaaggguggaagagaaaggacacaguauuuucaugaauuuaccauauaucuuuguuuu

SEQ ID NO: 45683 - RNA, 64 nt, hsa
auguauucuguaaaagaaaaaaaaaaugcggccuuuucaugaggaucgucugguuagaaaacau

SEQ ID NO: 45684 - RNA, 64 nt, hsa
acuagcacugacugaacuguaauguaggggaaaguuucaugaugguaucuauagucaagacgaa

SEQ ID NO: 45685 - RNA, 64 nt, hsa
uugacuuuuacagguaagugcaaaggagaagugguuucaugaaauguucuaauguauaauaaca

SEQ ID NO: 45686 - RNA, 64 nt, hsa
auauuugauuaucuuaaaaauuguuaaauaccguuuucaugaaauuucucaguauuguaacagc

SEQ ID NO: 45687 - RNA, 64 nt, hsa
uuguggccaagccacaugagaucaaagacacacuuuucaugaccucaaaugugggcccagccua

SEQ ID NO: 45688 - RNA, 64 nt, hsa
ugagaagagagaacuguaguugcuucacuuccuauuucaugacagaauaacugcaaacuuuuaa

SEQ ID NO: 45689 - RNA, 64 nt, hsa
gauauuuuuuacgauaauuagcugcaugugaauuuuucaugaccuucuuuacauuuuuuauuuu

SEQ ID NO: 45690 - RNA, 64 nt, hsa
ugagaauugaagacuuagccagucagauaaguuuuuucaugaacccguuguggaaauuauugga

SEQ ID NO: 45691 - RNA, 64 nt, hsa
gagcuggaaagaaauuuucuagcccaacucccuguuucaugaaagagaaaagaggcucagaaaa

SEQ ID NO: 45692 - RNA, 64 nt, hsa
uuggcccuggguguggguuuuacaagacugugucuuucaugacaucauagcccaaccaugugag

SEQ ID NO: 45693 - RNA, 64 nt, hsa
cggagccugccugccucugccguccucaguuuccuuucaugaggcuucuagccaaagaugauaa

SEQ ID NO: 45694 - RNA, 64 nt, hsa
auauucauuuuaauggcuuuuuugaaaguuccuuuuucaugaacacacccgagaaaucuuaaau

SEQ ID NO: 45695 - RNA, 64 nt, hsa
uguauuugcagcugagagaaaauaaucauucuuauuucaugaaaauuguggggaugaugaaaua

SEQ ID NO: 45696 - RNA, 64 nt, hsa
auauuuuucaugauuuugaaaccaugaagagauuuuucaugauuuugaaaucaugaagauauuu

SEQ ID NO: 45697 - RNA, 64 nt, hsa
gaaauuuuugcccaucccaaaaucauaagauauuuuucaugauuuugaaaccaugaagagauuu

SEQ ID NO: 45698 - RNA, 64 nt, hsa
ggagauuuuaccuugacuuauauuuuucaugacguuucaugauuugcuguugguuucaaaugaa

SEQ ID NO: 45699 - RNA, 64 nt, hsa
aauuacucuaggagauuuuaccuugacuuauauuuuucaugacguuucaugauuugcuguuggu

SEQ ID NO: 45700 - RNA, 64 nt, hsa
cagaaccuagguuuaggguacauguuuuucucuguuucaugaacuuacagugugguuugagcac

SEQ ID NO: 45701 - RNA, 64 nt, hsa
gcaaauacacagauuaugccaagagguaccacauuuucaugacagauacauucaugcacaaucc

SEQ ID NO: 45702 - RNA, 64 nt, hsa
ucuugaaauuugggagguuaauaccaaguauucauuucaugauguaaagaaacugaacagugaa

SEQ ID NO: 45703 - RNA, 64 nt, hsa; identical to SEQ ID NO: 45702

SEQ ID NO: 45704 - RNA, 64 nt, hsa
uucaaugcauugcauauuuagccuucggcauauuuuucaugaauagaucaugaagucauaggcu

SEQ ID NO: 45705 - RNA, 64 nt, hsa
gcacuuuccaaguucaucacaacaaccugcuuguuuucaugagacaauaauccgaaaaguucgc

SEQ ID NO: 45706 - RNA, 64 nt, hsa
caaccacuuuucuccuaucaguauaauuucaucauuucaugaauaugauaaaaauaaaauuguu

SEQ ID NO: 45707 - RNA, 64 nt, hsa
gguuccuggcauagagcuccuaaaacgcuuagaauuucaugagugauaagaguuuuuugguuuu

SEQ ID NO: 45708 - RNA, 64 nt, hsa
uagucacaguuuuccagggagggaaugauauaauuuucaugacaaugucaugugaugauagaau

SEQ ID NO: 45709 - RNA, 64 nt, hsa
acagagguuuugcuuuaugcuguagaauaccgacuuucaugaugacaacuugguuuaugcauga

SEQ ID NO: 45710 - RNA, 64 nt, hsa
aaccugucucucauuccuaaguugccucauuaauuuucaugaacaagaauauguaccuuuuuga

SEQ ID NO: 45711 - RNA, 64 nt, hsa
gccaaaaucaacauauaaugaagagaugccuuuguuucaugagauucaaacuugaugcuaugcu

SEQ ID NO: 45712 - RNA, 64 nt, hsa
uuuuuuaaauuugccaguuuuauuuucuaaauucuuucaugagcuugccuaaaauucggaaugg

SEQ ID NO: 45713 - RNA, 64 nt, hsa
agcuaauacuaauagccuaaaagauuuugugaaauuucaugaaaacuuuuuaauggcaauaaug

SEQ ID NO: 45714 - RNA, 64 nt, hsa
gguccucuguugcuauugucuucuauaaguggaguuucaugacuuacugcuuaacgaauaacua

SEQ ID NO: 45715 - RNA, 64 nt, hsa
aaaaaguauacuuauacaauguuuuguacuuguauuucaugaaauuaaaacagugaugcuaaaa

SEQ ID NO: 45716 - RNA, 64 nt, hsa
caaaugggucacuaucuggugaaaaaauaugguauuucaugaucuaagacuaccagucuuuuuc

SEQ ID NO: 45717 - RNA, 64 nt, hsa
gacucuucugaguccauuaucuuucacauacaguuuucaugaggcaaguuuuacucugcaaugg

SEQ ID NO: 45718 - RNA, 64 nt, hsa
gggcuauuuguucuuuggaaugacugcuccacuccacacucacaccucuauucacagaccagca

SEQ ID NO: 45719 - RNA, 64 nt, hsa
acuaaagagaaagaauacuugacagcucuaugcccacacucacauuacagcugaugugaaagag

SEQ ID NO: 45720 - RNA, 64 nt, hsa
aagcuuaaccaagagugagaggauaugucauguucacacucaaugcaauucguagugguuuucu

SEQ ID NO: 45721 - RNA, 64 nt, hsa
caaugcaccuagggaaaaaauuuaaggagguauucacacucagggucaugcacuugcacaaugu

SEQ ID NO: 45722 - RNA, 64 nt, hsa
aaacuauaaugcacacucacacacaauuuaugugcacacucacacaugcacacacacacacaca

SEQ ID NO: 45723 - RNA, 64 nt, hsa
gcuaaaccaagagagaaagcaagaaacuauaaugcacacucacacacaauuuaugugcacacuc

SEQ ID NO: 45724 - RNA, 64 nt, hsa
gagaauauuuauaacuuuuguaugagagagaauucacacucaacaagacacuaccagcaccacg

SEQ ID NO: 45725 - RNA, 64 nt, hsa
auuugcuggugguggcuucgggcucaugcccagacacacucacugccccgucuguccaaggccu

SEQ ID NO: 45726 - RNA, 64 nt, hsa
aaaauuacauuacaagauccagguucuucccccccacacucaaucaagccagcccucuccucuu

SEQ ID NO: 45727 - RNA, 64 nt, hsa
cccucuccucuucugucacguaaaggauauuuggcacacucaugcgucauucauucacaaaaca

SEQ ID NO: 45728 - RNA, 64 nt, hsa
augcucacauggacgcggacggacacacucauuacacacucacacgccccgacugcacccggug

SEQ ID NO: 45729 - RNA, 64 nt, hsa
accccgucugcaugcucacauggacgcggacggacacacucauuacacacucacacgccccgac

SEQ ID NO: 45730 - RNA, 64 nt, hsa
cgcccccgccugugucagguguggaugaggucgucacacucagaaggacaggcuugucugccag

SEQ ID NO: 45731 - RNA, 64 nt, hsa
uauuaacaacucuaacccaggacagaccacaagccacacucagaggccucacugugcugggggc

SEQ ID NO: 45732 - RNA, 64 nt, hsa
uucuaugagaauguggauuuauggcauugaguaucacacucagcucugcuguguuaacuuugug

SEQ ID NO: 45733 - RNA, 64 nt, hsa
uuaucuguacaguugugcaagauaugaaugguuucacacucaaauaaaaaauauugaaacgacc

SEQ ID NO: 45734 - RNA, 64 nt, hsa
ugcuucugauacacagccacugcacacacacacucacacucacacucccuugucugaugcccca

SEQ ID NO: 45735 - RNA, 64 nt, hsa
ccugguugcuucugauacacagccacugcacacacacacucacacucacacucccuugucugau

SEQ ID NO: 45736 - RNA, 64 nt, hsa
cucguacaugcacaaauacacacucaugcacacacacacucacacacaugcauacacuuagguu

SEQ ID NO: 45737 - RNA, 64 nt, hsa
ugagugaucuuacucccucguacaugcacaaauacacacucaugcacacacacacucacacaca

SEQ ID NO: 45738 - RNA, 64 nt, hsa
agcccuaacuuuuaauguacaucacacacacacucacacucacauacacacacacacacacacu

SEQ ID NO: 45739 - RNA, 64 nt, hsa
gugcccagcccuaacuuuuaauguacaucacacacacacucacacucacauacacacacacaca

SEQ ID NO: 45740 - RNA, 64 nt, hsa
uguuucaaauuggaaccuugaggcuaguuaguaucacacucaggccacacucagcacuugccca

SEQ ID NO: 45741 - RNA, 64 nt, hsa
ggaaccuugaggcuaguuaguaucacacucaggccacacucagcacuugcccacucuuguuuac

SEQ ID NO: 45742 - RNA, 64 nt, hsa
augugggcacuaacacgugugcguuccuggcgggcacacucaggaccgugccucacagggccca

SEQ ID NO: 45743 - RNA, 64 nt, hsa
cuggagucuguucucacaccugugcgcagguuugcacacucaaguucucaugggcaggcucagg

SEQ ID NO: 45744 - RNA, 64 nt, hsa
uuguuaaaagggacaauguggccacuucucuguggaaagggaguugguugggggguugagaugg

SEQ ID NO: 45745 - RNA, 64 nt, hsa
uagguuuucauaagcauuguuucuuuaaggcauggaaagggaagaaugcucaagcaagucaugu

SEQ ID NO: 45746 - RNA, 64 nt, hsa
cuuuggccagaaggaugaauacuuggauauuacugaaagggagggguggagauggguguggcag

SEQ ID NO: 45747 - RNA, 64 nt, hsa
uuaaccccucugagcccgggucucuucauuaguugaaagggauaguaauaccuacuugcagguu

SEQ ID NO: 45748 - RNA, 64 nt, hsa
gccucacaguggguaaauauaucauacaucucuugaaagggaaaauauccaugucaguuucuuu

SEQ ID NO: 45749 - RNA, 64 nt, hsa
ucuuccauugugggguagguggucggggaugggagaaagggaaaagucagggaaggggagaaga

SEQ ID NO: 45750 - RNA, 64 nt, hsa
aacgcagaaaagaaaaaaagguuaagcauaaaaagaaagggaaaaagcagaaacacugcagaag

SEQ ID NO: 45751 - RNA, 64 nt, hsa
aaagagaacacaccaaaaaagugaaagagaaauugaaagggaaaaaagacaaaaagcauaaggc

SEQ ID NO: 45752 - RNA, 64 nt, hsa
ggaucuggggacugagugugggagugcagagaaagaaagggaaacuggcugaggggauaccaua

SEQ ID NO: 45753 - RNA, 64 nt, hsa
uagaaggauggcaucuccauguagaauaaaugaagaaagggaggcccagccgcaggaaggcaga

SEQ ID NO: 45754 - RNA, 64 nt, hsa
agaugaagcagugaaagagacaggaauugggagggaaagggagaaugguguacccuuuauuucu

SEQ ID NO: 45755 - RNA, 64 nt, hsa
gugugggugcucauagaguugcccagcccagggggaaagggagcaagaguuguccagagaagac

SEQ ID NO: 45756 - RNA, 64 nt, hsa
cuugagaagcaggcggguugggugggaggaggaagaaagggaagaauuagguuugaauugcuuu

SEQ ID NO: 45757 - RNA, 64 nt, hsa
acugagaagcaggcggguugggugggaggaggaagaaagggaagaauuagguuugaauugcuuu

SEQ ID NO: 45758 - RNA, 64 nt, hsa
cuuuuccuuguauguucuugggugguuccuaagggaaagggaagcacaugaucaugggaaugau

SEQ ID NO: 45759 - RNA, 64 nt, hsa
aggaugaaagaaaggucgcagcaguagcuuuggggaaagggaggaagauauggcacuucuccaa

SEQ ID NO: 45760 - RNA, 64 nt, hsa
ggcugggguagcccccuccaguacaccccaaagugaaagggauaagagugcagccccagaauag

SEQ ID NO: 45761 - RNA, 64 nt, hsa
cucggugauauuuuuucuacgccaaaacagacgggaaagggaacaaaauaaagugaaauccaau

SEQ ID NO: 45762 - RNA, 64 nt, hsa
uaagaaggauuaauaauaaugcucugaauuuuucgaaagggauucuccuaaacccacccacuuc

SEQ ID NO: 45763 - RNA, 64 nt, hsa
ucugauugcacuuccuuaaguuaugaauguacuagaaagggacucauccagaauacuaugccuc

SEQ ID NO: 45764 - RNA, 64 nt, hsa
aguauuugugugugugguuuuuuuuccuuaauuugaaagggacagcacuguguauguuuauaaa

SEQ ID NO: 45765 - RNA, 64 nt, hsa
ggagcugguuauuggugugguccuagggagggcggaaagggaggcacugccauuuggagacauu

SEQ ID NO: 45766 - RNA, 64 nt, hsa
uuugcugaggaaaaggucacuuguaaacagaggagaaagggaaagaguacaaagcccuaaguuu

SEQ ID NO: 45767 - RNA, 64 nt, hsa
uuucuuuuuaauuaaaauacaagaagcagcugaggaaagggagacaagguauuuuauuucugac

SEQ ID NO: 45768 - RNA, 64 nt, hsa
aguaccccgcauucccaugaauagagccuccaaggaaagggaggaugggguguccuuuguugug

SEQ ID NO: 45769 - RNA, 64 nt, hsa
gaauaacuuucaguaguauggcagauggcacagagaaagggaaggggcucuggggacuucuccu

SEQ ID NO: 45770 - RNA, 64 nt, hsa
aggaggaagaaaaacaggccgagugaaggugcuggaaagggagggaggacgcgaggggaaaggc

SEQ ID NO: 45771 - RNA, 64 nt, hsa
ggggggaugacggggggugggaacaagauggauggaaagggagggaaagacaagaugcaacuag

SEQ ID NO: 45772 - RNA, 64 nt, hsa
caggggccaugaaugccgcagccuucagaugccagaaagggaaaggaauggauuccccugccug

SEQ ID NO: 45773 - RNA, 64 nt, hsa
uccucagaaccugugacuguuaccuucuguggcagaaagggacagugcagauguauguaaguua

SEQ ID NO: 45774 - RNA, 64 nt, hsa
uucucuccccugggccaggugcaagaggaacaaagaaagggacuccugcagcguccggcugacc

SEQ ID NO: 45775 - RNA, 64 nt, hsa
acucccuguugucccuuccauccugggcaaaacugaaagggacccggagcugggaaacccacgg

SEQ ID NO: 45776 - RNA, 64 nt, hsa
gaacccaggauaggaaauggguguguuuaguggggaaagggacggggugcagacggcagggcca

SEQ ID NO: 45777 - RNA, 64 nt, hsa
aggcaggucagagcagugcagggggaggagaggagaaagggaggaagcugggcugugugguccc

SEQ ID NO: 45778 - RNA, 64 nt, hsa
acaguugggcuuuguucauucuagccacggggaugaaagggaucuuuugcauugcagagauuuu

SEQ ID NO: 45779 - RNA, 64 nt, hsa
cagggcaguuagccagcucaaguucuuuuucagagaaagggacuuggccagugguuuaaguacc

SEQ ID NO: 45780 - RNA, 64 nt, hsa
cgcaauuguuuuguuuucauuucuuguagucuaacccuuuuaaugccuuuaccucaaguugcuu

SEQ ID NO: 45781 - RNA, 64 nt, hsa
auuuuagaguucauuccauuggggaauuuucuuucccuuuuauucuacccccacuaccgccuuu

SEQ ID NO: 45782 - RNA, 64 nt, hsa
ugaaguauagaauuugacucauacuuggaaaaagcccuuuuaacuuuuaucuuuuauucauuga

SEQ ID NO: 45783 - RNA, 64 nt, hsa
auguguuuggagaaggcugcaugacuuuguuuuucccuuuuagcaaaacuaaauaaaguuguca

SEQ ID NO: 45784 - RNA, 64 nt, hsa
caacaacaaaaaaccagugaaauucuacaagugucccuuuuaaaaauagugugugcuaacuaag

SEQ ID NO: 45785 - RNA, 64 nt, hsa
uagauuaagugcuuaguuuuauuccuaauucugccccuuuuaaccugauguguaccuuacucuu

SEQ ID NO: 45786 - RNA, 64 nt, hsa
guccagaaugauguuugauucuuaauuuuucugucccuuuuauaauuuguuuuaaugauuuugc

SEQ ID NO: 45787 - RNA, 64 nt, hsa
cugaaugcuuuuuuuuuuuggcccccaagaaagucccuuuuauagcacuuuagcacaggcaaug

SEQ ID NO: 45788 - RNA, 64 nt, hsa
guuggauuuuuuuauauaaauuagagcgucaauucccuuuuauucuuacauucucuugccaaaa

SEQ ID NO: 45789 - RNA, 64 nt, hsa
cuuuuauaauuuguguccuguauaugcccuuggacccuuuuauaaauuauuuuugcuuauugag

SEQ ID NO: 45790 - RNA, 64 nt, hsa
cuuccaauuuauaaucaagaaggggcucuggauccccuuuuaaauuacacacacucucacacac

SEQ ID NO: 45791 - RNA, 64 nt, hsa
cauucuuuuuuaguggagugaaaguucugaagcccccuuuuaacuuccucuugguuuuucauua

SEQ ID NO: 45792 - RNA, 64 nt, hsa
aaguagauauugguuuaaaggauguauacauugucccuuuuacauuguaagcauucaauaagaa

SEQ ID NO: 45793 - RNA, 64 nt, hsa
uguggaaggaagaaaggauauuguuuguuuuuuucccuuuuauuuuuaggauauuguuuggaaa

SEQ ID NO: 45794 - RNA, 64 nt, hsa
cacugguuuucaggaaaauguuccugucccugaccccuuuuagagcugggcugccuggggggag

SEQ ID NO: 45795 - RNA, 64 nt, hsa
ucuuacccuuggaggcuguguggggaauuuccagcccuuuuaugccugugugaucccaccccac

SEQ ID NO: 45796 - RNA, 64 nt, hsa
agaguuggggcccugagacugggguagcaacccccccuuuuaucuuuuaagaccuucccuuccu

SEQ ID NO: 45797 - RNA, 64 nt, hsa
cuaaauaggggagaucccagccuccacaaagaggcccuuuuauuuuuuauucugauuagccauu

SEQ ID NO: 45798 - RNA, 64 nt, hsa
aaaaagcauaucguuuauugagguuuuuuucccccccuuuuagagcauccggaagugauaacac

SEQ ID NO: 45799 - RNA, 64 nt, hsa
cuguucgcuccccuaacucgcccuuuuaauaagacccuuuuacucaaaguccuagcuuaacccu

SEQ ID NO: 45800 - RNA, 64 nt, hsa
aagcuccuccgagacuguucgcuccccuaacucgcccuuuuaauaagacccuuuuacucaaagu

SEQ ID NO: 45801 - RNA, 64 nt, hsa
cacucagcuguuacauuucacauccgauucagcccccuuuuauuuccaugugcuuuucgcagcc

SEQ ID NO: 45802 - RNA, 64 nt, hsa
acgggcuuguagcaccucagcuucuuuccucgcccccuuuuaucugaauccuaucaauuauucu

SEQ ID NO: 45803 - RNA, 64 nt, hsa
uucccaugucuacagcuagagaacucuuugggaucccuuuuauaagggcaccaaucccauucau

SEQ ID NO: 45804 - RNA, 64 nt, hsa
gccuuuaaugaucugggcccaggaugauuuccugcccuuuuaucauggguggaauuuuuuuuuc

SEQ ID NO: 45805 - RNA, 64 nt, hsa
cucucugucucaucucuccuccuuucucauuagccccuuuuaauuuguuuuuccuuuugacucc

SEQ ID NO: 45806 - RNA, 64 nt, hsa
aaguuaaaccugagacagagagcaaguaagcugucccuuuuaacuguuuuucuuuggucuuuag

SEQ ID NO: 45807 - RNA, 64 nt, hsa
caauaggauggagcuguuaauuauuuuccaaagaguaauagacaugcaaaaguuucaauaaaaa

SEQ ID NO: 45808 - RNA, 64 nt, hsa
agacaagacuaugauaucaaugaauguggguuaaguaauagauuuccagcuaaauuggucuaaa

SEQ ID NO: 45809 - RNA, 64 nt, hsa
ugugagauuugcauuuuacuuugcugacuuuguuguaauagaucccauucauuguccccuuugg

SEQ ID NO: 45810 - RNA, 64 nt, hsa
gaguugcuuuugcguuucucaugccuaggcaaguguaauagaaauuauguagcuccuuauguug

SEQ ID NO: 45811 - RNA, 64 nt, hsa
uaaaagauaccuuuuguaaaguugucaucucucuguaauagauaauggcugacuggaccauagu

SEQ ID NO: 45812 - RNA, 64 nt, hsa
gaauuuuuuagauacuaucauuagguuggauaugguaauagauauauuucagaauagcaagugg

SEQ ID NO: 45813 - RNA, 64 nt, hsa
gauguauaaugaaaaaggauaaugcaaaaauuauguaauagauaccaaauuagggaaguuuggc

SEQ ID NO: 45814 - RNA, 64 nt, hsa
auucaucugaacuggaccaguguugaucuguaauguaauagaaaaucugauagaccagcacuuc

SEQ ID NO: 45815 - RNA, 64 nt, hsa
gcauugcaauauggaauuuugcacauuuuuguuagcuuuacauuauuugcugauaccaacuuuu

SEQ ID NO: 45816 - RNA, 64 nt, hsa
ugagaguuuccaacaucaguugauugagcuucaggcuuuacaacguuuaucccuguagagauca

SEQ ID NO: 45817 - RNA, 64 nt, hsa
agcuaagaaauauaccuacacaaacuugucaggugcuuuacaacuacauaguacuuuuuaacaa

SEQ ID NO: 45818 - RNA, 64 nt, hsa
ucuguaugcaggugugccugucuuaaauuccaaagcuuuacauuucaacugaaaaagaaacuag

SEQ ID NO: 45819 - RNA, 64 nt, hsa
uuaugucacuaauaaugaguaguaacccaauuuagcuuuacaaagauuuuuucuauuacuuuuu

SEQ ID NO: 45820 - RNA, 64 nt, hsa
guggcuaaaaccccacaauaacuuuacauuccuagcuuuacagucuugcugugaauucucuggu

SEQ ID NO: 45821 - RNA, 64 nt, hsa
uuccucuaaccgugggccccagcagaacugcugagcuuuacaugguauccaugacaacugcuga

SEQ ID NO: 45822 - RNA, 64 nt, hsa
agacuccaggagggguauagauugugccgucauagcuuuacaggugguuuuaaaguuaacaggg

SEQ ID NO: 45823 - RNA, 64 nt, hsa
ccacgcuagguguuuugacauguuuaguguuucugcuuuacagugcugaauuccauauuuuaga

SEQ ID NO: 45824 - RNA, 64 nt, hsa
auuauuuuaugucuagaguagguccugaaguuuggcuuuacauuaaguuuagcacuguaucaga

SEQ ID NO: 45825 - RNA, 64 nt, hsa
cuaagaagcuacagauugucauaguuguuuuccugcuuuacaaaauugcuccagaucuggaaug

SEQ ID NO: 45826 - RNA, 64 nt, hsa
ugccaugaauuucuaccagaugugcuuuuauuuagcuuuacauauuccuuugaccaaauaguuu

SEQ ID NO: 45827 - RNA, 64 nt, hsa
uuacgaauaaaaaacuggauucugguuuacagcagcuuuacagugauaguuaaauuaacugggg

SEQ ID NO: 45828 - RNA, 64 nt, hsa
gcaguggcuucuaggaaacugggaguuuagaucagcuuuacagauacaucgaucagaggcuaaa

SEQ ID NO: 45829 - RNA, 64 nt, hsa
caguacaaugccaccaguaguacgaugagccgaagcuuuacauugugagaguagcaaguccagg

SEQ ID NO: 45830 - RNA, 64 nt, hsa
ugaaaguaguuuuugcugaguguauacauuuuuggcuuuacaguuucuuucagugcuuuaaaga

SEQ ID NO: 45831 - RNA, 64 nt, hsa
cugcagugaguauaaauucacuugucaccucagugcuuuacaguuugaaguggucacuuaccug

SEQ ID NO: 45832 - RNA, 64 nt, hsa
uggucacuuaccugaugguucccacaagccuuaggcuuuacaggguuguaucauugacuuaaaa

SEQ ID NO: 45833 - RNA, 64 nt, hsa
ugauauuaggacugaucagguguugucugccugauccaaucauuaucaaguuccauaauucauu

SEQ ID NO: 45834 - RNA, 64 nt, hsa
uauccuuuauagcuguuuauuuuuaaauccaggauccaaucaagaauuauacguuauauguagu

SEQ ID NO: 45835 - RNA, 64 nt, hsa
ggugcuuuccuuacccgagagguauuuugccuguuccaaucaaaccaccccauucagguccauc

SEQ ID NO: 45836 - RNA, 64 nt, hsa
ggagguaaaguugacuucuccucgugggcaguuuuccaaucaccuugugaguagacaccugcca

SEQ ID NO: 45837 - RNA, 64 nt, hsa
accuccaaucaguuuacuucauuucaaaacuauuuccaaucacaaggaaagauuuauuuaaaau

SEQ ID NO: 45838 - RNA, 64 nt, hsa
cuuggcauaauucacaaaagcagcugugacaaccuccaaucaguuuacuucauuucaaaacuau

SEQ ID NO: 45839 - RNA, 64 nt, hsa
cagaucaagccuccugaauccccucauuacaagauccaaucauaucaugccucacuacccucug

SEQ ID NO: 45840 - RNA, 64 nt, hsa
uuaagaaguggacaccacguggcaugauccuugauccaaucagauugagcccuggcgugaucca

SEQ ID NO: 45841 - RNA, 64 nt, hsa
aauuuaguaauucacaacauccacuuagaaguauuauaguaaucuuuuaaaguaacacaccaca

SEQ ID NO: 45842 - RNA, 64 nt, hsa
ucucaagcuucucucucaacuuaucagaacugccuauaguaaccaaaauuggauucaugaagaa

SEQ ID NO: 45843 - RNA, 64 nt, hsa
ggauagccacauuaaugaauuggugcugucaaaauauaguaauuuuuaaauuuguuaauaauga

SEQ ID NO: 45844 - RNA, 64 nt, hsa
cagcaugacuucuuuuaacuuggauuccuuuguauauaguaaaguuuaguauauauauauuuuu

SEQ ID NO: 45845 - RNA, 64 nt, hsa
ccgagccuccggagaauuaacucuauuacguuuguauaguaaguuuguaaacugcuuggcaaac

SEQ ID NO: 45846 - RNA, 64 nt, hsa
uugcuuaaugaagacauuuaacgguugugcuguuuauaguaaaauaaaacucccuaccuugcuu

SEQ ID NO: 45847 - RNA, 64 nt, hsa
cuuuuaauauuucuacauaaaauuuaagucaagauauaguaaaugguaaaugauuguacuuauu

SEQ ID NO: 45848 - RNA, 64 nt, hsa
ggaaaaugucuauauauuuuuaguuugauauaauuauaguaaaauuacuaugcaagcuguuuac

SEQ ID NO: 45849 - RNA, 64 nt, hsa
auuuuacauaaaaacuaauacuuucaauuuuuuauauaguaauauccccauuuuguaaauguua

SEQ ID NO: 45850 - RNA, 64 nt, hsa
aaugcacuguauucuuacaguuaauguuuauaacuauaguaaaaaauuaauauauauccuauua

SEQ ID NO: 45851 - RNA, 64 nt, hsa
ugaauuucugaacggaucagaguuucauaguuucuauaguaaaggcaaugucuauuucagggau

SEQ ID NO: 45852 - RNA, 64 nt, hsa
uaucuuacuggguugacuggaaaggaauggaaaauauaguaacacaugaaaaaaugcuacucca

SEQ ID NO: 45853 - RNA, 64 nt, hsa
ugacuauuaaauguugcacaucauucauucacuguauaguaaucauugacuaaagccauuuguc

SEQ ID NO: 45854 - RNA, 64 nt, hsa
cucauuuuacuaaaaucguauucuaauucuucauuauaguaaaucuaugagcaacuccuuacuu

SEQ ID NO: 45855 - RNA, 64 nt, hsa
caagucuauuugaaauagaaaacugucuauuuaauauaguaaaaucaaugcucccuuaauguug

SEQ ID NO: 45856 - RNA, 64 nt, hsa
aggagauugauucauaauucacaugucaauuuuuuauaguaauauguacuucuaauuuauuauu

SEQ ID NO: 45857 - RNA, 64 nt, hsa
aauaaauuaacuuuucuguaauuagauuguguuuuauaguaauucuugccugcuucuuagucuu

SEQ ID NO: 45858 - RNA, 64 nt, hsa
uagauagcaauaaaauaacauaaguggacauguuuauaguaaauacucugaaguaaacaaccgu

SEQ ID NO: 45859 - RNA, 64 nt, hsa
gacuuuuuuuagcaauuaguuugacauucgcuacuauaguaaccaagcacucauuauauaugca

SEQ ID NO: 45860 - RNA, 64 nt, hsa
auuuauacacuuuuuuauaaagcagauuuuaaaauauaguaacauccauuuuuuucccuugaaa

SEQ ID NO: 45861 - RNA, 64 nt, hsa
cagugcauuuauagagaaggauauuuuguaguaguauaguaauguguuauguaguacaguuuua

SEQ ID NO: 45862 - RNA, 64 nt, hsa
aggguugugaggcaaacuuccagccgucagggucucagcuaagcagaaggugcuggaaggcugg

SEQ ID NO: 45863 - RNA, 64 nt, hsa
ccccagccuuuggagcguucauucaguccuuucuucagcuaaugauuacugagcaccuguuugg

SEQ ID NO: 45864 - RNA, 64 nt, hsa
gaccugccaacagcauuacagggagauucuuugcucagcuaacacauuucuguuuuucaaaauu

SEQ ID NO: 45865 - RNA, 64 nt, hsa
uucauaaguuuuacaaucaaguauagaggggucuucagcuaacuuaguuauacauaaaugcuga

SEQ ID NO: 45866 - RNA, 64 nt, hsa
ugucuggucgggggauuccucuucuucaagcugcucagcuaacccagaagaggggagagaguac

SEQ ID NO: 45867 - RNA, 64 nt, hsa
uguuguuugcaauggcagagcauccuagaguuccucagcuaaccucucauuaugugucuuaaau

SEQ ID NO: 45868 - RNA, 64 nt, hsa
uggcuccaccuugaugggucaaccuuuguguggcuccugguaacauaacaacaacaguuacuau

SEQ ID NO: 45869 - RNA, 64 nt, hsa
guccuccacuuugcugguucagccuucguguggcuccugguaacguggcuccaccuugaugggu

SEQ ID NO: 45870 - RNA, 64 nt, hsa
ucccauucgccagauggaaccaucaguauuccucuccugguaccgcaaggccuccuggauccaa

SEQ ID NO: 45871 - RNA, 64 nt, hsa
cugcccccaggaaaaagagucucccccuuaaauuuccugguacccccucaccuaugccugaaag

SEQ ID NO: 45872 - RNA, 64 nt, hsa
ccagggucuggggagagcaacagcaccaggcuuuuccugguaguuggauugguacauucacugc

SEQ ID NO: 45873 - RNA, 64 nt, hsa
accaaaauauguaauuuuaaaaaacuaaaacacauccugguagucccagugauguguaaaugag

SEQ ID NO: 45874 - RNA, 64 nt, hsa
ggauggaggagacgggacaucuuucaccucaggcuccugguagagaagacaggggauucuacuc

SEQ ID NO: 45875 - RNA, 64 nt, hsa
gggagaagggcuuggggugaccugaagggaaccauccugguaccccacauccucuccuccggga

SEQ ID NO: 45876 - RNA, 64 nt, hsa
acacuguuguacaagaugucagcuuugcugaaacgcacauuaccuggaauaagugcuuuaauug

SEQ ID NO: 45877 - RNA, 64 nt, hsa
ugacugugucucuugaacauacuuaggauauucugcacauuauggaaaaagguaaauuuuagaa

SEQ ID NO: 45878 - RNA, 64 nt, hsa
uaucuuuaacagcucuuuguugaagccugugguagcacauuauguuuauaauugcacaugugca

SEQ ID NO: 45879 - RNA, 64 nt, hsa
uucuaagccuccuguugguuacuaaucucacuuggcacauuauaacuaaaggaauccccucaau

SEQ ID NO: 45880 - RNA, 64 nt, hsa
cuugcuuggggaacuugugucccuaauguguuuagauugcuagauugcuaaggagcugauacuu

SEQ ID NO: 45881 - RNA, 64 nt, hsa
gggaacuugugucccuaauguguuuagauugcuagauugcuaaggagcugauacuuugacagug

SEQ ID NO: 45882 - RNA, 64 nt, hsa
guaggaucuuguuuuguuuuaucaccagcacacagauugcuauaaacuguuacuuugugaauua

SEQ ID NO: 45883 - RNA, 64 nt, hsa
ggucccccucagcaagcccuacagagcuguggaggauugcuaucuggaggccuuccagcugcug

SEQ ID NO: 45884 - RNA, 64 nt, hsa
ggaaagacaaauucaucuguaguaguaacuggccgauugcuaaagaguucauaaggaggugaga

SEQ ID NO: 45885 - RNA, 64 nt, hsa
ugcagaaguuugaaaaccagguucauuuacgugagauugcuaaaugcaugggggaaagcagugg

SEQ ID NO: 45886 - RNA, 64 nt, hsa
accagaagugccaugcucagaaauguugguuacaugaaugaaugaaccaugaaugaaugaaauc

SEQ ID NO: 45887 - RNA, 64 nt, hsa
gaagugccaugcucagaaauguugguuacaugaaugaaugaaccaugaaugaaugaaaucucug

SEQ ID NO: 45888 - RNA, 64 nt, hsa
cucagaaauguugguuacaugaaugaaugaaccaugaaugaaugaaaucucuguccgugugcug

SEQ ID NO: 45889 - RNA, 64 nt, hsa
gugauuaccaccaacuuucugacuaagcuaaaaaugaaugaaaaugguggcuaaagaaaauagg

SEQ ID NO: 45890 - RNA, 64 nt, hsa
uguggaagaauguucaaguugaauccuaaugccgugaaugaaacacagucuguguagggaauga

SEQ ID NO: 45891 - RNA, 64 nt, hsa
acucuuuuaaggguauuuuaaaaauuaguaaauuugaaugaacuaaagauauaucucuaccuuc

SEQ ID NO: 45892 - RNA, 64 nt, hsa
uuaguucauucagauuuacuaauuuugguaaaucugaaugaacuaaagauguaucuguaccuuc

SEQ ID NO: 45893 - RNA, 64 nt, hsa
gucuuacucaaguacuaguaauuuaacuucaucaugaaugaacuauaauuuuuaaguuaugccc

SEQ ID NO: 45894 - RNA, 64 nt, hsa
guaacaggaauauuuugcagaauauagguuuaacugaaugaagccauauuaauaacugcauuuu

SEQ ID NO: 45895 - RNA, 64 nt, hsa
gcucaauuacuauuugacugacugacugaaugaaugaaugaaugaggaagaaaacuguggguaa

SEQ ID NO: 45896 - RNA, 64 nt, hsa
aggugcucaauuacuauuugacugacugacugaaugaaugaaugaaugaggaagaaaacugugg

SEQ ID NO: 45897 - RNA, 64 nt, hsa
caggaggugcucaauuacuauuugacugacugacugaaugaaugaaugaaugaggaagaaaacu

SEQ ID NO: 45898 - RNA, 64 nt, hsa
guggaggguuugcacuccacacaucuuucuugaaugaaugaaagaauaagugaguaugcuuggg

SEQ ID NO: 45899 - RNA, 64 nt, hsa
ccagguggaggguuugcacuccacacaucuuucuugaaugaaugaaagaauaagugaguaugcu

SEQ ID NO: 45900 - RNA, 64 nt, hsa
aggagguaucuagcaauggauaaauagauaccacugaaugaaauuaaauguugauuaggaacaa

SEQ ID NO: 45901 - RNA, 64 nt, hsa
aagugggaauguuuaauaaauauucauugaauaaugaaugaaccaucuucguacaugaauaaua

SEQ ID NO: 45902 - RNA, 64 nt, hsa
aucccagauugcuaaauguucuuuccaagaagucugaaugaauuauuauauacauuugcuauca

SEQ ID NO: 45903 - RNA, 64 nt, hsa
cccgcuguuacacagguguuuagauacguguuccugaaugaagcugcuuuugaauuuuguuaug

SEQ ID NO: 45904 - RNA, 64 nt, hsa
gaacuuuacuugcugauuuucuuuuauuuuucacugaaugaaguuugugcuugaaugaagagug

SEQ ID NO: 45905 - RNA, 64 nt, hsa
uuucuuuuauuuuucacugaaugaaguuugugcuugaaugaagaguguaucuuaaacccccuuu

SEQ ID NO: 45906 - RNA, 64 nt, hsa
uggaauuaaaugacgguaaaauuggcuaauuauuugaaugaaugaauggauggauguuuugcau

SEQ ID NO: 45907 - RNA, 64 nt, hsa
auuaaaugacgguaaaauuggcuaauuauuugaaugaaugaauggauggauguuuugcaugcuc

SEQ ID NO: 45908 - RNA, 64 nt, hsa
gugguaggugcucaguaaauguguguugaauaaaugaaugaaugaaugaacaaaugaaugaauu

SEQ ID NO: 45909 - RNA, 64 nt, hsa
uaggugcucaguaaauguguguugaauaaaugaaugaaugaaugaacaaaugaaugaauuugcu

SEQ ID NO: 45910 - RNA, 64 nt, hsa
ugcucaguaaauguguguugaauaaaugaaugaaugaaugaacaaaugaaugaauuugcuuacu

SEQ ID NO: 45911 - RNA, 64 nt, hsa
guguguugaauaaaugaaugaaugaaugaacaaaugaaugaauuugcuuacuucaaggcaaaag

SEQ ID NO: 45912 - RNA, 64 nt, hsa
agacuagaaauguaucuaaauugggggaacagaaugaaugaauuaaugaaugagaguuccuuug

SEQ ID NO: 45913 - RNA, 64 nt, hsa
gccuacaggauaaggaaguucacagccugcggggugaaugaacccaugugugaacugcacagag

SEQ ID NO: 45914 - RNA, 64 nt, hsa
ggagacucugucucaaaaaaaaaaaaaaaaaagaugaaugaaaauaugaaauauauaaacuagu

SEQ ID NO: 45915 - RNA, 64 nt, hsa
cagauuauaccuggaugauucaggagaguguauaugaaugaauaaagcauccaaguauauauga

SEQ ID NO: 45916 - RNA, 64 nt, hsa
guguauaugaaugaauaaagcauccaaguauauaugaaugaauaaaguauguaaguaucaccag

SEQ ID NO: 45917 - RNA, 64 nt, hsa
cccaaaaggcagaagcaacccaaauguucaucaaugaaugaaugaauggcuaagcaaaauguga

SEQ ID NO: 45918 - RNA, 64 nt, hsa
aaaggcagaagcaacccaaauguucaucaaugaaugaaugaauggcuaagcaaaaugugauaug

SEQ ID NO: 45919 - RNA, 64 nt, hsa
ggugccuagcacacaguaggcgcucaauaaauguugaaugaaugaaugauuuaaucaagacuug

SEQ ID NO: 45920 - RNA, 64 nt, hsa
ccuagcacacaguaggcgcucaauaaauguugaaugaaugaaugauuuaaucaagacuugauca

SEQ ID NO: 45921 - RNA, 64 nt, hsa
uuauuguggaaucuuugaaaggacaaggccucugugaaugaaucagucccagggaagcauuugg

SEQ ID NO: 45922 - RNA, 64 nt, hsa
auuguaaaucuuugcuaaguaguguuuuccuuggugaaugaagucauuguugucuucaagugua

SEQ ID NO: 45923 - RNA, 64 nt, hsa
gcaaugacucgaaguuugcaguauggagaacaggugaaugaaauccugugccguucuucagucu

SEQ ID NO: 45924 - RNA, 64 nt, hsa
uacacauuaguauguauaacuggcuuuaccaaauugaaugaaaaggagcuugugcaaaaaaauu

SEQ ID NO: 45925 - RNA, 64 nt, hsa
acaugaaaaaucauaaucugacuaauuuugggacugaaugaauaaguacaagagguuggauuuu

SEQ ID NO: 45926 - RNA, 64 nt, hsa
ugaagucaugaccaacaacacuguaacucaugccugaaugaagcuuaucugacacauaagcuuc

SEQ ID NO: 45927 - RNA, 64 nt, hsa
ggaugaggacgugucuaucacagucaguaugcccugaaugaaugggugucacccuccucccccu

SEQ ID NO: 45928 - RNA, 64 nt, hsa
uuuuccaugacccaguccuggguaaggcuucauuugaaugaaggguucugcugcuaaaaaaaaa

SEQ ID NO: 45929 - RNA, 64 nt, hsa
ucccagccaagggccucggggagcguucuaaauaugaaugaaugggauauuuugaaaugaacuu

SEQ ID NO: 45930 - RNA, 64 nt, hsa
uucuuugcaauacugcuuaauugcugauaccauaugaaugaaacaugggcugugauuacugcaa

SEQ ID NO: 45931 - RNA, 64 nt, hsa
ccuugcauguaacaagcacuccagaaauguuuguugaaugaaugaauggugucaugggugaaug

SEQ ID NO: 45932 - RNA, 64 nt, hsa
gcauguaacaagcacuccagaaauguuuguugaaugaaugaauggugucaugggugaaugaugg

SEQ ID NO: 45933 - RNA, 64 nt, hsa
gcuaugauauauuuauuauaaaauagggaaugaaugaaugaauauggauugcuguuaacuagaa

SEQ ID NO: 45934 - RNA, 64 nt, hsa
cacugcuaugauauauuuauuauaaaauagggaaugaaugaaugaauauggauugcuguuaacu

SEQ ID NO: 45935 - RNA, 64 nt, hsa
aacaaguuuacccagccugcuuugcuuuacugcaugaaugaaacugaugguucaauuucagaag

SEQ ID NO: 45936 - RNA, 64 nt, hsa
aaacaaaacaaaaaucuguguaacuguaaaacauugaaugaaacuauuuuaccugaacuagauu

SEQ ID NO: 45937 - RNA, 64 nt, hsa
gaagggagggggcaggggaggaggcaauucugaaugaaugaauggauuuuuuguuguuuuugca

SEQ ID NO: 45938 - RNA, 64 nt, hsa
gggggaagggagggggcaggggaggaggcaauucugaaugaaugaauggauuuuuuguuguuuu

SEQ ID NO: 45939 - RNA, 64 nt, hsa
cauggcuggcacauuguuggcacucaacaaugguugaaugaauaaaacaauaaaugaaugaaua

SEQ ID NO: 45940 - RNA, 64 nt, hsa
cacucaacaaugguugaaugaauaaaacaauaaaugaaugaauaacuaagauauagaaacucuc

SEQ ID NO: 45941 - RNA, 64 nt, hsa
ggauaagaaaaaauauauauugcucuucaacuagugaaugaaagaaacuucagaaagcuagaau

SEQ ID NO: 45942 - RNA, 64 nt, hsa
aaaaacuaaacuaucagucauuuacauccucucaugaaugaaaugcaguguagggagaggagau

SEQ ID NO: 45943 - RNA, 64 nt, hsa
uauggacguaauugcagaaggaacuucaaggagaugaaugaaugcuaaaaggguucuugacuga

SEQ ID NO: 45944 - RNA, 64 nt, hsa
augccuuuccgaaaacugguuucuaguaaagccuugaaugaacacacacacacacacacacaca

SEQ ID NO: 45945 - RNA, 64 nt, hsa
gagucccucuggaaccauauaaaguuccuggcuuugaaugaaccagaaguguuugcccacacag

SEQ ID NO: 45946 - RNA, 64 nt, hsa
uuuuuccagcuuuaagugccuauauaugauuauuugaaugaagaggaguaggaaggaaaaugga

SEQ ID NO: 45947 - RNA, 64 nt, hsa
cuuggggacuuuucccauauauuucacacuggagugaaugaaguuguacuucauuucuagagaa

SEQ ID NO: 45948 - RNA, 64 nt, hsa
aaaaaaagagugaauguaauagucuugcagaaaaugaaugaauaccuuuguucaauaaaggaaa

SEQ ID NO: 45949 - RNA, 64 nt, hsa
augauuaggaaaugugaggggcaacagaugugaaugaaugaaaguugagucuuucuuaaucuag

SEQ ID NO: 45950 - RNA, 64 nt, hsa
aucuaugauuaggaaaugugaggggcaacagaugugaaugaaugaaaguugagucuuucuuaau

SEQ ID NO: 45951 - RNA, 64 nt, hsa
agagcugccuuugauaaaugugcuguuaaacacuugaaugaagagaaugguggcagaaugagug

SEQ ID NO: 45952 - RNA, 64 nt, hsa
aaagguuuugguauuugcccacuucuagauagaaugaaugaaaacaacacaagcguuuuaugag

SEQ ID NO: 45953 - RNA, 64 nt, hsa
uguaauuaugcauccuagcuaaggcacagaagacugaaugaaugcaaggauucauuaacucuuu

SEQ ID NO: 45954 - RNA, 64 nt, hsa
uggucugucauuauauugcaaaauauuuuuccucugaaugaaauuaucacagguugucucaagc

SEQ ID NO: 45955 - RNA, 64 nt, hsa
auguggcaugguacaagauaaagaagucugugccugaaugaauacacgcagcaaaauucuccuc

SEQ ID NO: 45956 - RNA, 64 nt, hsa
caggcuucuguuuucagaguacuauggauaggccugaaugaagucauacccuauuagauagcuc

SEQ ID NO: 45957 - RNA, 64 nt, hsa
uuuaacauaugguagacauucaguaaauguuuguugaaugaaugcaugucuucuaaaaguuuuc

SEQ ID NO: 45958 - RNA, 64 nt, hsa
ccugcucucuccuguugcucugggauugcacuucugaaugaaguagcagcucauaagcuuuugc

SEQ ID NO: 45959 - RNA, 64 nt, hsa
uccagcacaaucauaaagugaaugacaaacccuuugaaugaaauuguggcacaaaaucuguuca

SEQ ID NO: 45960 - RNA, 64 nt, hsa
uuuccccccaaguuagucuuaaaucuuuuggguuugaaugaagguuuuacauaagaaauuauua

SEQ ID NO: 45961 - RNA, 64 nt, hsa
aggcaugaauaugcggcagagaaaacagcaauagugaaugaaugcaaaaggugcugagaaauuc

SEQ ID NO: 45962 - RNA, 64 nt, hsa
ucaacuucaaugucaucuucuccaugaagaccacugaaugaacaccuuuucauccagccuuaau

SEQ ID NO: 45963 - RNA, 64 nt, hsa
gagcuucuuacauggcuccaaauggucaaauaagugaaugaaugaauggacagaaaauucaauc

SEQ ID NO: 45964 - RNA, 64 nt, hsa
uucuuacauggcuccaaauggucaaauaagugaaugaaugaauggacagaaaauucaauccuuu

SEQ ID NO: 45965 - RNA, 64 nt, hsa
gugcccucucacuuuaggcagcuugcacuauucuugaaugaaugaagaauuauuuccucauuug

SEQ ID NO: 45966 - RNA, 64 nt, hsa
ccucucacuuuaggcagcuugcacuauucuugaaugaaugaagaauuauuuccucauuuggaag

SEQ ID NO: 45967 - RNA, 64 nt, hsa
cucaaagccuagcacauaguagguacugaaugaaugaaugaacaaggggugccaggagacugcu

SEQ ID NO: 45968 - RNA, 64 nt, hsa
uauccucaaagccuagcacauaguagguacugaaugaaugaaugaacaaggggugccaggagac

SEQ ID NO: 45969 - RNA, 64 nt, hsa
guuauauccucaaagccuagcacauaguagguacugaaugaaugaaugaacaaggggugccagg

SEQ ID NO: 45970 - RNA, 64 nt, hsa
uuucaguaagugggugaaugaaugacugaaugaaugaaugaauggcucagcugaggaauguaac

SEQ ID NO: 45971 - RNA, 64 nt, hsa
cagcuuucaguaagugggugaaugaaugacugaaugaaugaaugaauggcucagcugaggaaug

SEQ ID NO: 45972 - RNA, 64 nt, hsa
uaggcagcuuucaguaagugggugaaugaaugacugaaugaaugaaugaauggcucagcugagg

SEQ ID NO: 45973 - RNA, 64 nt, hsa
gagccuggcacuuaggcagcuuucaguaagugggugaaugaaugacugaaugaaugaaugaaug

SEQ ID NO: 45974 - RNA, 64 nt, hsa
cacuaaauaggagauucgaguuucccaguuuacaugaaugaagucugaauuuaagacggugaug

SEQ ID NO: 45975 - RNA, 64 nt, hsa
acaucugcaaccaaaucagcauccugucauuucgugaaugaaucucagacgcuguaacccggca

SEQ ID NO: 45976 - RNA, 64 nt, hsa
ggagagaaggaaaccugaggaguaguguuccuccugaaugaagguucaggucaccagccuucug

SEQ ID NO: 45977 - RNA, 64 nt, hsa
guaagagggcccauauucauucuuugccaugaaaugaaugaauuaggaagauuguauuuacuua

SEQ ID NO: 45978 - RNA, 64 nt, hsa
acuagcauggugccugccccuaauacauuuucacugaaugaaugaaucagugaguuaaugaaua

SEQ ID NO: 45979 - RNA, 64 nt, hsa
gcauggugccugccccuaauacauuuucacugaaugaaugaaucagugaguuaaugaauaaaua

SEQ ID NO: 45980 - RNA, 64 nt, hsa
auugcucucuuuauaaugauuaaucacuuuauuaugaaugaaugaaugaauuugauggauuuaa

SEQ ID NO: 45981 - RNA, 64 nt, hsa
cucucuuuauaaugauuaaucacuuuauuaugaaugaaugaaugaauuugauggauuuaaaaug

SEQ ID NO: 45982 - RNA, 64 nt, hsa
cuuuauaaugauuaaucacuuuauuaugaaugaaugaaugaauuugauggauuuaaaauggcuu

SEQ ID NO: 45983 - RNA, 64 nt, hsa
ugugcaguauuuaugugauugugccuaugcaugaugaaugaaugaauuucaguuguacauugcc

SEQ ID NO: 45984 - RNA, 64 nt, hsa
caguauuuaugugauugugccuaugcaugaugaaugaaugaauuucaguuguacauugccuaaa

SEQ ID NO: 45985 - RNA, 64 nt, hsa
auggccuaaaauauucauaaugguuggugucuuuugaaugaauucaugucaaaaauguuauuca

SEQ ID NO: 45986 - RNA, 64 nt, hsa
cacuugacuagucuuaaaacaaagaaagaacgaaugaaugaaugaaucuguggcuggaugcagu

SEQ ID NO: 45987 - RNA, 64 nt, hsa
ugacuagucuuaaaacaaagaaagaacgaaugaaugaaugaaucuguggcuggaugcaguggcu

SEQ ID NO: 45988 - RNA, 64 nt, hsa
cuugccacagagcggggacucgguaagcacuuaaugaaugaaugaauucuaagucaauccaaga

SEQ ID NO: 45989 - RNA, 64 nt, hsa
ccacagagcggggacucgguaagcacuuaaugaaugaaugaauucuaagucaauccaagagucu

SEQ ID NO: 45990 - RNA, 64 nt, hsa; identical to SEQ ID NO: 45984

SEQ ID NO: 45991 - RNA, 64 nt, hsa; identical to SEQ ID NO: 45983

SEQ ID NO: 45992 - RNA, 64 nt, hsa
aucagacaaaaugcagaaggaaaaaaaaacauauugaaugaagcacuuggaaagauuuuccaca

SEQ ID NO: 45993 - RNA, 64 nt, hsa
agcacaacuaaaauuucacaugcuaacgacaacuugaaugaacugcuggggcagugguaugugc

SEQ ID NO: 45994 - RNA, 64 nt, hsa
uguauuuaguugacuguauuauuugauuucggauugaaugaauguaaauagaaauuaaaugcaa

SEQ ID NO: 45995 - RNA, 64 nt, hsa
uugaaugaauguaaauagaaauuaaaugcaaauuugaaugaacauaaauagaagugauuuauuu

SEQ ID NO: 45996 - RNA, 64 nt, hsa
guuguauauguaacucuaagagaccuuccuagagugaaugaagguagaaaacugaaaagggagu

SEQ ID NO: 45997 - RNA, 64 nt, hsa
ucuucucacaauccgagcugcucuuuguccucugugaaugaagguacuuuugcuuccauuucau

SEQ ID NO: 45998 - RNA, 64 nt, hsa
augaagguacuuuugcuuccauuucauccaaggaugaaugaaaauguauagcaucugcccaaac

SEQ ID NO: 45999 - RNA, 64 nt, hsa
guguucauuaagggcucaauaaauguuagcugaaugaaugaauagcagcaacuagucuuuauuu

SEQ ID NO: 46000 - RNA, 64 nt, hsa
uuauguguucauuaagggcucaauaaauguuagcugaaugaaugaauagcagcaacuagucuuu

SEQ ID NO: 46001 - RNA, 64 nt, hsa
auuggaauaaagcaggaggcucaugggugguugcugaaugaagaacagaaucuuggugcuuugu

SEQ ID NO: 46002 - RNA, 64 nt, hsa
gccuagcacauagcaaggacucaacaaauuucauugaaugaaugaaaaaacauaguuuaccaaa

SEQ ID NO: 46003 - RNA, 64 nt, hsa
agcacauagcaaggacucaacaaauuucauugaaugaaugaaaaaacauaguuuaccaaauguc

SEQ ID NO: 46004 - RNA, 64 nt, hsa
uccccaguaaugaaaguacuuagaaaauaauuauugaaugaaugaaaucuaaacugugaaccug

SEQ ID NO: 46005 - RNA, 64 nt, hsa
caguaaugaaaguacuuagaaaauaauuauugaaugaaugaaaucuaaacugugaaccugaggg

SEQ ID NO: 46006 - RNA, 62 nt, hsa
cgcucuuaagacauggcuggagcucagucuucauugaaugaaguuugcugugguauugcaua

SEQ ID NO: 46007 - RNA, 64 nt, hsa
aguguguacaagcauucaagaaacugaugaaugaugaaugaaugaaugagccaaagaacaaaua

SEQ ID NO: 46008 - RNA, 64 nt, hsa
uguacaagcauucaagaaacugaugaaugaugaaugaaugaaugagccaaagaacaaauaaaug

SEQ ID NO: 46009 - RNA, 64 nt, hsa
gaguggcaaggccccugcucccagaggcuggauuugaaugaacuccgggccuguuuggggaggu

SEQ ID NO: 46010 - RNA, 64 nt, hsa
gaugaggggaggagggugcuggcuaaacaggaacugaaugaauggccugaagcucccucuccca

SEQ ID NO: 46011 - RNA, 64 nt, hsa
gcagagagcggauacucaaguaaguuuuguuaaaugaaugaaugaauuuagaaccacacaaugc

SEQ ID NO: 46012 - RNA, 64 nt, hsa
agagcggauacucaaguaaguuuuguuaaaugaaugaaugaauuuagaaccacacaaugccaag

SEQ ID NO: 46013 - RNA, 64 nt, hsa
ucaccaaacuuuuugacaaggcaacacauaacuuacacauaaaugucucuguucuugcauuuau

SEQ ID NO: 46014 - RNA, 64 nt, hsa
cauaggguuacucaccaaacuuuuugacaaggcaacacauaacuuacacauaaaugucucuguu

SEQ ID NO: 46015 - RNA, 64 nt, hsa
ccuaccaacuuauuagcugcuugaaaaauauaauacacauaaauaaaaaaauauauuuuucauu

SEQ ID NO: 46016 - RNA, 64 nt, hsa
gugaauuugaauacugcauuuacaguguagaguaacacauaacauuguaugcauggaaacaugg

SEQ ID NO: 46017 - RNA, 64 nt, hsa
uggcaaagccuuuaaccaguuuucaacccuuauuacacauaagauaauucauagcggagagaaa

SEQ ID NO: 46018 - RNA, 64 nt, hsa
uggaaaagcuuuucaccgauacucaauccuuaguacacauaagaaaauucauacuggggagaaa

SEQ ID NO: 46019 - RNA, 64 nt, hsa
cggaaaagccuuuaacugguccucaacucuuauuacacauaagauaauucacaguggagaaaaa

SEQ ID NO: 46020 - RNA, 64 nt, hsa
acaugcaugcacacauacauacauauguauacacacacauaauuugaaaacugauuggcacuuc

SEQ ID NO: 46021 - RNA, 64 nt, hsa
gagcgagcaagagagggagagaggaggaaaaaauacacauaauacaaacauacaugcaugcaca

SEQ ID NO: 46022 - RNA, 64 nt, hsa
uuuuuuuaauagcuauuugcuaaaugcuguucuuacacauaauuucuuaauuuucaccgagcag

SEQ ID NO: 46023 - RNA, 64 nt, hsa
ccaugccuuacgaaccaugccuuccucaguauccacacauaaacggcaguguuaaaacaugaau

SEQ ID NO: 46024 - RNA, 64 nt, hsa
uggaaaccaggggaguuuuaaagcccgagaaaccacacauaaucuuuuguugagaugaguuugc

SEQ ID NO: 46025 - RNA, 64 nt, hsa
uacugguguacaguaugaguggaauauaaacuguacacauaauuaucauguugauauaaaucau

SEQ ID NO: 46026 - RNA, 64 nt, hsa
uguucguaauaaaucaugugccacaucuugucuuacacauaaaagccacugcuuuuaacauccc

SEQ ID NO: 46027 - RNA, 64 nt, hsa
aagccacugcuuuuaacaucccauuguacauuuaacacauaaaugguguuaacaucccauugua

SEQ ID NO: 46028 - RNA, 64 nt, hsa
acauaaaugguguuaacaucccauuguacauuuaacacauaaauggccauugucuuugucucag

SEQ ID NO: 46029 - RNA, 64 nt, hsa
uggaauucaccuguguuucguguauaugccucauacacauaauuuugugcaugaaacagaguuu

SEQ ID NO: 46030 - RNA, 64 nt, hsa
ccagaauuguuuugcauuuuuugaauauuuguauacacauaaugagaccuuggggaugggaccc

SEQ ID NO: 46031 - RNA, 64 nt, hsa
gcugguguuuuguucaaucuggaagaaugacuguaucagucaauggggauuuuaacagacugcc

SEQ ID NO: 46032 - RNA, 64 nt, hsa
ucuucuuucuguagggaugagaauuccucuuuuaaucagucaagggagaugcuucaaagcugga

SEQ ID NO: 46033 - RNA, 64 nt, hsa
ccgucuuacaacucagggccaccugggaucagucaucagucagggugcguaagccuugaauacc

SEQ ID NO: 46034 - RNA, 64 nt, hsa
acagucaccgucuuacaacucagggccaccugggaucagucaucagucagggugcguaagccuu

SEQ ID NO: 46035 - RNA, 64 nt, hsa
ugccccuccccacccugaccgugcuaacuguguguacauauauauucuacauauauguauauua

SEQ ID NO: 46036 - RNA, 64 nt, hsa
ccugaccgugcuaacuguguguacauauauauucuacauauauguauauuaaaacugcacugcc

SEQ ID NO: 46037 - RNA, 64 nt, hsa
ucuguaccuuuauauauauguguguguacauauauacauauauaaacuguauaguguacauggu

SEQ ID NO: 46038 - RNA, 64 nt, hsa
uaaacuaaucuguaccuuuauauauauguguguguacauauauacauauauaaacuguauagug

SEQ ID NO: 46039 - RNA, 64 nt, hsa
cauuauucugauagauuguauacauauguacacauacauauacacauaugcacagucaagguca

SEQ ID NO: 46040 - RNA, 64 nt, hsa
gcauuuaucuaagaaacugugaggcuuucugguuuacauauaucuuacagguguuuuuuuguau

SEQ ID NO: 46041 - RNA, 64 nt, hsa
ugucuguguguguguguguauguauacacacauauacauauauauauacacauacauacacaua

SEQ ID NO: 46042 - RNA, 64 nt, hsa
uauauauacacauacauacacauacauacauacauacauauauaucugauaaaauugugauguu

SEQ ID NO: 46043 - RNA, 64 nt, hsa
caacaucaugaaacaucaucucuacauaaaaaaauacauauauacaaaaauuagcugggcauca

SEQ ID NO: 46044 - RNA, 64 nt, hsa
auuuucucugaaagucgagaauuccaagaacuguuacauauaaucauauauaugccuauaucua

SEQ ID NO: 46045 - RNA, 64 nt, hsa
uuuaauuugguuagaaguucuacaacauuguauguacauauacaaaauuucauuuucucugaaa

SEQ ID NO: 46046 - RNA, 64 nt, hsa
auggguuucuuucagauuuuuugaaccauccacuuacauauauuuuuaaaaaaugaaauccuuu

SEQ ID NO: 46047 - RNA, 64 nt, hsa
accauaugaucuguuuuguaucuuaaauuugauuuacauauauuauuuauuucugguaacucac

SEQ ID NO: 46048 - RNA, 64 nt, hsa
cagagugguaaauaucuauguuacauguagauuauacauauauauacacacguguauaugagau

SEQ ID NO: 46049 - RNA, 64 nt, hsa
caaauuauauauauacauauccacacacauacauuacauauaucuguguauauaaauccacaug

SEQ ID NO: 46050 - RNA, 64 nt, hsa
cauucauugagagacagugacagauauaauuuacuacauauauugauuuuuaaauaaaguugcc

SEQ ID NO: 46051 - RNA, 64 nt, hsa
aaacuucauuauagaauugaaccaagaggcauuauacauauagauauauacauauguaaugugu

SEQ ID NO: 46052 - RNA, 64 nt, hsa
ugggaaauauauauguuucugugauauacauauauacauauauauguauauauauacacacaca

SEQ ID NO: 46053 - RNA, 64 nt, hsa
gaaaaauuugggaaauauauauguuucugugauauacauauauacauauauauguauauauaua

SEQ ID NO: 46054 - RNA, 64 nt, hsa
uguguguacauauacauauauacauaucuacacauacauauauacacauauauguguguaugua

SEQ ID NO: 46055 - RNA, 64 nt, hsa
cuuguaugcuuguguguguaaauguguguacauauacauauauacauaucuacacauacauaua

SEQ ID NO: 46056 - RNA, 64 nt, hsa
gugugacuuguaugcuuguguguguaaauguguguacauauacauauauacauaucuacacaua

SEQ ID NO: 46057 - RNA, 64 nt, hsa
ugcgauuuuauauauauauauauauauauauacauacauauauauauaucauauagcuuaagcu

SEQ ID NO: 46058 - RNA, 64 nt, hsa
cagugggagggguugggauggguaaucucauuguuacauauagcaauuuuugaugcauuuuaua

SEQ ID NO: 46059 - RNA, 64 nt, hsa
aaacuuacaaggacaaagaggcuuguuggcacuuuacauauacaguguauacauguguacauau

SEQ ID NO: 46060 - RNA, 64 nt, hsa
uguuggcacuuuacauauacaguguauacauguguacauauauauacaaauauuuguaucuucu

SEQ ID NO: 46061 - RNA, 64 nt, hsa
uauauagagauauauguguguguguauguauauguacauauacauauauaugaguguauaauuc

SEQ ID NO: 46062 - RNA, 64 nt, hsa
gagauauauguguguguguauguauauguacauauacauauauaugaguguauaauucuaaauu

SEQ ID NO: 46063 - RNA, 64 nt, hsa
uauauauauauauacauauauauacauacacacauacauauaauuuuuuuuuuuuuugagaugg

SEQ ID NO: 46064 - RNA, 64 nt, hsa
cacacacauacauacauacauauauauauauauauacauauauauacauacacacauacauaua

SEQ ID NO: 46065 - RNA, 64 nt, hsa
cacacacacacacacacacacacacauacauacauacauauauauauauauauacauauauaua

SEQ ID NO: 46066 - RNA, 64 nt, hsa
cacguauguauagaugugugaauauuuguuuauauacauauaugcacguaucuauauguauaua

SEQ ID NO: 46067 - RNA, 64 nt, hsa
guaauuuauggaugcccagguuacauuuaaacuauacauauacauaauauauacauacgugugu

SEQ ID NO: 46068 - RNA, 64 nt, hsa
auguuuuuagaggcuuuuccguaaacauauaucuuacauauaauaaacuuuucaaaucuugcaa

SEQ ID NO: 46069 - RNA, 64 nt, hsa
uuuaguuacuauuaccauagccaaccuguaguuuuacauauacauuuucuuguggagcaauaga

SEQ ID NO: 46070 - RNA, 64 nt, hsa
ccaggguggguauaaaacuucuuauucuuaaauuuacauauaagaucuauuaagcuugacacau

SEQ ID NO: 46071 - RNA, 64 nt, hsa
aacuucccacaaaagcugacuuuuuugggucucuuacauauaaaguagguuauugaguugauuu

SEQ ID NO: 46072 - RNA, 64 nt, hsa
uauauguauauguguacauauggacauacacauuuacauauauauaaaguauauauauacauau

SEQ ID NO: 46073 - RNA, 64 nt, hsa
acauacacauuuacauauauauaaaguauauauauacauauauauauauauauauguaugaaac

SEQ ID NO: 46074 - RNA, 64 nt, hsa
cuaaauuuuacauauaauuauacacacacauauguacauauauauguauauaaucuugcuuccc

SEQ ID NO: 46075 - RNA, 64 nt, hsa
cccaaguccacaauuuggugagaccacuaaauuuuacauauaauuauacacacacauauguaca

SEQ ID NO: 46076 - RNA, 64 nt, hsa
gaugcacacauaucuguacauauacaugugaguguacauauauacacauauacacaucuaugua

SEQ ID NO: 46077 - RNA, 64 nt, hsa
guuauguguguggauauagaugcacacauaucuguacauauacaugugaguguacauauauaca

SEQ ID NO: 46078 - RNA, 64 nt, hsa
uauaugcaugcauguguauaaagaugcacaugcguacauauacauaacauacacacaauaugua

SEQ ID NO: 46079 - RNA, 64 nt, hsa
uucuaagugauuaaugcauacgaacagcuacauauacauauaucuaaaccugaaaaaugaauug

SEQ ID NO: 46080 - RNA, 64 nt, hsa
uaaaguuucuaagugauuaaugcauacgaacagcuacauauacauauaucuaaaccugaaaaau

SEQ ID NO: 46081 - RNA, 64 nt, hsa
aguguuugaguucagccucuucauuuacuccauuuacauauaaaagaucuugaaaagguaguug

SEQ ID NO: 46082 - RNA, 64 nt, hsa
guguucugagccauaguucucuaacaucuccgucuacauauaacacaaaacuuuuauaaauuau

SEQ ID NO: 46083 - RNA, 64 nt, hsa
uaaagcugaugggauucugucucaucucauaccuuacauauaagucucaguaguaucccuagag

SEQ ID NO: 46084 - RNA, 64 nt, hsa
uuugucuugcuuauagucauuaaaucauuacuuuuacauauauugcuguuacuucugcuuucuu

SEQ ID NO: 46085 - RNA, 64 nt, hsa
aauauaguaaaggauguuuuaugaagucacaagauacauauauuuuuauuuugaccuaaauuug

SEQ ID NO: 46086 - RNA, 64 nt, hsa
aaguauccuuacuaagagugcuccuuuuguauuuuacauauauacaguaugaaaauacauugga

SEQ ID NO: 46087 - RNA, 64 nt, hsa
gccagagauacucuaggcauguaaagcacaaacauacauauaaaaucugcgggcuucaaaaaau

SEQ ID NO: 46088 - RNA, 64 nt, hsa
uuuuuuuccucuucugcguuaccagguguguguguacauauaauauauauauauauauauuaua

SEQ ID NO: 46089 - RNA, 64 nt, hsa
auaucuauccugggaugggaaaaugagggagggauacauauacggagggggaucuuacucuucc

SEQ ID NO: 46090 - RNA, 64 nt, hsa
aaguuucaaggaaccauaaauauauguauacauauacauauauaaaauauauauauuaaaauaa

SEQ ID NO: 46091 - RNA, 64 nt, hsa
ccaaagaaguuucaaggaaccauaaauauauguauacauauacauauauaaaauauauauauua

SEQ ID NO: 46092 - RNA, 64 nt, hsa
uauauauauauauauguguguguguguguguguauacauauauacacauauauacacacacaca

SEQ ID NO: 46093 - RNA, 64 nt, hsa
uguauacauauauacacauauauacacacacacauacauauacauguguauauauauaccaucc

SEQ ID NO: 46094 - RNA, 64 nt, hsa
ugcuuggggugggggagucagcagcacccauuuguacauauaggucauucauacaucacauuuu

SEQ ID NO: 46095 - RNA, 64 nt, hsa
uauguauauacacacguacauacauucauauauauacauauauacauaaugugcuuaaccacug

SEQ ID NO: 46096 - RNA, 64 nt, hsa
uacauguauauauauauacauacacauauauguauacauauauacacauauauguauacauaua

SEQ ID NO: 46097 - RNA, 64 nt, hsa
cacauauauguauacauauauacacauauauguauacauauauacacauauguauacauauaua

SEQ ID NO: 46098 - RNA, 64 nt, hsa
uacacauauauguauacauauauacacauauguauacauauauauauauucuacaguaaaacug

SEQ ID NO: 46099 - RNA, 64 nt, hsa
guacauauaucuauguacagggguauuauauauauacauauaagaugaugauauauauaaugau

SEQ ID NO: 46100 - RNA, 64 nt, hsa
acuuuaauuuuauacauauaaauauauacauguguacauauaucuauguacagggguauuauau

SEQ ID NO: 46101 - RNA, 64 nt, hsa
gacaggaaacuacaaguuccacacuuuaauuuuauacauauaaauauauacauguguacauaua

SEQ ID NO: 46102 - RNA, 64 nt, hsa
gaauuucauauauauauacauauauauauacacauacauauauauauauauauauguauguaua

SEQ ID NO: 46103 - RNA, 64 nt, hsa
uauguuucuaaccacagagaauuucauauauauauacauauauauauacacauacauauauaua

SEQ ID NO: 46104 - RNA, 64 nt, hsa
uauauauacacacacacacacacauauguacacauacauauauauacauauauauguauauaua

SEQ ID NO: 46105 - RNA, 64 nt, hsa
cacacacacacacauauguacacauacauauauauacauauauauguauauauagaacacaugg

SEQ ID NO: 46106 - RNA, 64 nt, hsa
cauugaacaaauguguggguuuuuaaaaauuauauacauauaugaguugccuauauuugcuauu

SEQ ID NO: 46107 - RNA, 64 nt, hsa
aaaugauauguugaaaacuuaaggaagcaaaugcuacauauaugcaauauaaaauaguaaugug

SEQ ID NO: 46108 - RNA, 64 nt, hsa
cugugggguuggaugccgcgguucuauacauauauacauauauccacaucuauauagagagaua

SEQ ID NO: 46109 - RNA, 64 nt, hsa
cccggggccugugggguuggaugccgcgguucuauacauauauacauauauccacaucuauaua

SEQ ID NO: 46110 - RNA, 64 nt, hsa
aacaguauauacauauguguguauauacaguauauacauauauauauuuucacuugcuuucaag

SEQ ID NO: 46111 - RNA, 64 nt, hsa
aucugacaaagaugaaauccacuuuuaauauauauacauauauauuuguuaauauauuaaaaca

SEQ ID NO: 46112 - RNA, 64 nt, hsa
gacuauacagaaauuuaaauagaaauaguguauauacauauaaaauacaagcuauguuaggacc

SEQ ID NO: 46113 - RNA, 64 nt, hsa
uuuuguuuaugaauggaaagcuuugugcaaaauauacauauaagcagaguaagccuuuuaaaaa

SEQ ID NO: 46114 - RNA, 64 nt, hsa
auaaggacaugaguuaaauauauuuauauguacauacauauauauaucccuuuacauauauaug

SEQ ID NO: 46115 - RNA, 64 nt, hsa
uauauuuauauguacauacauauauauaucccuuuacauauauauguaugugggugugagugug

SEQ ID NO: 46116 - RNA, 64 nt, hsa
uauucaauaucuuacagugauacaguuuuguauuuacauauaaauauaccgacaugaucaaaac

SEQ ID NO: 46117 - RNA, 64 nt, hsa
uauuguaugugauaauaugaucguauucuauaaauacauauacacacgauacuccuuuccagaa

SEQ ID NO: 46118 - RNA, 64 nt, hsa
cuguaucaggcuaggacgcucugagcugugcauguacauauauacauauauagauacauuuaua

SEQ ID NO: 46119 - RNA, 64 nt, hsa
ggcuaggacgcucugagcugugcauguacauauauacauauauagauacauuuauaauauauac

SEQ ID NO: 46120 - RNA, 64 nt, hsa
uaucuggccucguuauauaguguauauauauguauacauauacauauauauaauauauaugaag

SEQ ID NO: 46121 - RNA, 64 nt, hsa
gccucguuauauaguguauauauauguauacauauacauauauauaauauauaugaagacugua

SEQ ID NO: 46122 - RNA, 64 nt, hsa
uuuagaaauuuauucaaagcuaaagauguauauauacauauacuuuuguguguauauauacaca

SEQ ID NO: 46123 - RNA, 64 nt, hsa
aagagaaucucagaaguaguuugcugcuaauauauacauauauuguauaaaaagguauauuuug

SEQ ID NO: 46124 - RNA, 64 nt, hsa
uaacaaaaugauggccaagguaguuccauauauauacauauauuccacauguguguauguggaa

SEQ ID NO: 46125 - RNA, 64 nt, hsa
guaauuguauuacaaugacuaaauuauaauuaaauacauauaauucccuuucgauagcaucuga

SEQ ID NO: 46126 - RNA, 64 nt, hsa
cuggcuguagguuuuaaauuuuuauaucuauacauacauauauacauauauauauaauguacaa

SEQ ID NO: 46127 - RNA, 64 nt, hsa
agguuuuaaauuuuuauaucuauacauacauauauacauauauauauaauguacaauauauaca

SEQ ID NO: 46128 - RNA, 64 nt, hsa
cugcucaaaaaauuuucaaagauuaaaacuauuauacauauacaggucauauaaaauuaccugg

SEQ ID NO: 46129 - RNA, 64 nt, hsa
aaauuuuauaaauguguauuucuguguauucacauacauauauauauacacacauauauaugua

SEQ ID NO: 46130 - RNA, 64 nt, hsa
ggaggaguuuuagggcuuggggagagggaggacacaucuggaggaaauggccuucuuuuuaaaa

SEQ ID NO: 46131 - RNA, 64 nt, hsa
cucugggagaugcuggaauaaaagacaagaguuacaucuggacuuggauugagguuuuguugug

SEQ ID NO: 46132 - RNA, 64 nt, hsa
uguucuggcagcagggacaccugggccaaugggccaucuggaccaaaggugggguguggggccc

SEQ ID NO: 46133 - RNA, 64 nt, hsa
guggccccugagaggugggggccucuccagggcacaucuggaguucuucuccagcuuacccuag

SEQ ID NO: 46134 - RNA, 64 nt, hsa
agcuccucguggcccuuccaaggugaggcaaaggcaucuggacuuguuccagcccagcccaccg

SEQ ID NO: 46135 - RNA, 64 nt, hsa
ugaauucaucuggcauugcuuugccuuaucaucucaucuggaguuuuuaaaugccauuuguuuc

SEQ ID NO: 46136 - RNA, 64 nt, hsa
uauauauauaucaaguuuuaaauuauugauaguucaucuggauuaccaaaaucacucugcagcc

SEQ ID NO: 46137 - RNA, 64 nt, hsa
uugguucaaacuguuggagaacagaguuggccugcaucuggaacacacuuguccucagcuuacc

SEQ ID NO: 46138 - RNA, 64 nt, hsa
ccuuaaucucugcccugggcaguuugcccucucccaucuggacuuagaugggagggcauagcag

SEQ ID NO: 46139 - RNA, 64 nt, hsa
gacuggcggugagguuuugauacccacacccagccaucuggagucauggagacccaccacgucu

SEQ ID NO: 46140 - RNA, 64 nt, hsa
uuaucaugacugccuccagugacaccacuguccucaucuggagccugaagggucaagugcuguc

SEQ ID NO: 46141 - RNA, 64 nt, hsa
accuggcuaccugugcagaugaucgcaccauccgcaucuggagcaccaaggacuuccugcagcg

SEQ ID NO: 46142 - RNA, 64 nt, hsa
gagauagccugggaugagcaauccuguuauaguacaucuggaccuucccuaccugggcucuggg

SEQ ID NO: 46143 - RNA, 64 nt, hsa
gagaauuuuuggaaccaacauucaaauucugccucaucuggagggaaaccaaaauugggagggg

SEQ ID NO: 46144 - RNA, 64 nt, hsa
uccauacagugacaauacaaauacaaaggaagaacaucuggauuucauccuugaccucauuuac

SEQ ID NO: 46145 - RNA, 64 nt, hsa
gaaggaacuagggauauuuaacuggagcagagaacaucuggagagagagcaagauuccuguccu

SEQ ID NO: 46146 - RNA, 64 nt, hsa
uggaccuccuucgcuggaaggucuuugacggcaccaucuggaaggacaucuacaaucaggagug

SEQ ID NO: 46147 - RNA, 64 nt, hsa
gccuuguccugaugcugugcucaaucagccuggccaucuggauuuucacacaguaaagcaggaa

SEQ ID NO: 46148 - RNA, 64 nt, hsa
uuguacucaguuugaggaggaucguaucuaucgucaucuggagccugcucuggcuuuccaguua

SEQ ID NO: 46149 - RNA, 64 nt, hsa
cauauuugugaugagacuagccaaacaaucucgucaucuggaggugcagaucuuagcggaccaa

SEQ ID NO: 46150 - RNA, 64 nt, hsa
cuucccuucuacccacccgccucccaccagaucccaucuggaaaucauaauaaagacauaugcc

SEQ ID NO: 46151 - RNA, 64 nt, hsa
gcaaggucuucugagcucaucuuaacuggugaggcaucuggaugugucugaucuuacugugaug

SEQ ID NO: 46152 - RNA, 64 nt, hsa
ucagcuagaucuguuucuauauaacuuugggagauuuucagaucuuuucuguuaaacuuucacu

SEQ ID NO: 46153 - RNA, 64 nt, hsa
gacuuucauauauuuucuguuguuuuuaaaauaguuuucagaauuaugcaaguaauaagugcau

SEQ ID NO: 46154 - RNA, 64 nt, hsa
cuucagaguaguguaggaauacuguagaaauacuuuuucagaaacgaauccauagcugacaaau

SEQ ID NO: 46155 - RNA, 64 nt, hsa
cuauuguuuaaaaaugauugauuuacuugcagauuuuucagaggauguuaugucuuugucauuc

SEQ ID NO: 46156 - RNA, 64 nt, hsa
aacuggccaacccuuugccuccacuauugaauuuuuuucagacccccauucuucaugcuggaaa

SEQ ID NO: 46157 - RNA, 64 nt, hsa
aaggaaaaagcacacagcacacaauuucaagccauuuucagaucagaacuccagaaguguugac

SEQ ID NO: 46158 - RNA, 64 nt, hsa
gaggccacagagugccuugacacaaagauuacauuuuucagacccccacuccucugcugcuguc

SEQ ID NO: 46159 - RNA, 64 nt, hsa
aguauauuaauaauugacuaggaagaugaacuuuuuuucagaucuuugggcagcugauaauuua

SEQ ID NO: 46160 - RNA, 64 nt, hsa
aaugauaucugggauuucuguggaacuuggcaaauuuucagagcaccuucacucacauaauguc

SEQ ID NO: 46161 - RNA, 64 nt, hsa
guugcuguuguacauggaaccaggacuagagauuuuuucagauuuauagacuuaaaaaauuaga

SEQ ID NO: 46162 - RNA, 64 nt, hsa
cuccucacacagaucccacuuacucuuuuuuuuuuuuucagagaccacagaccacagugauuuu

SEQ ID NO: 46163 - RNA, 64 nt, hsa
gucuggaaaugggaaagggagggguagaaguuccuuuucagaaauaaagaggcauucaugaagg

SEQ ID NO: 46164 - RNA, 64 nt, hsa
uaucuuggccugguuaugggguaggacacccagauuuucagacuuacaaucagugguccugguu

SEQ ID NO: 46165 - RNA, 64 nt, hsa
agugucaucucuacucuccucugccaugaggccauuuucagacaaguuaaaaaguagacuuuaa

SEQ ID NO: 46166 - RNA, 64 nt, hsa
uacucuacuucaccuaaccaccccuagaucugaguuuucagagugcuucugaaguacaguuuaa

SEQ ID NO: 46167 - RNA, 64 nt, hsa
gauacauaaauuuaaagaauauuuuuucucaguuuuuucagauauugccauacugaaccucauu

SEQ ID NO: 46168 - RNA, 64 nt, hsa
gacaaucaacaccguuccaaaggccugaaaauaauuuucagauaaagagacuccaagguugacu

SEQ ID NO: 46169 - RNA, 64 nt, hsa
cugaguggacugugcuugucaacggauguguagcuuuucagaaacuuaauuggggaugaauaga

SEQ ID NO: 46170 - RNA, 64 nt, hsa
uuaaaggcuuagcauuuaaguagcaacauugcgguuuucagacacauggugagguccauggcuc

SEQ ID NO: 46171 - RNA, 64 nt, hsa
auucaggacugcuggggaucaagcccaaggauguuuuucagagcucugugauuuaagaugcucg

SEQ ID NO: 46172 - RNA, 64 nt, hsa
caauaaauauuagaauaaauaugaaauugaacuauuuucagaaaaagggcaguauauuaagagc

SEQ ID NO: 46173 - RNA, 64 nt, hsa
aguuuuuuuaauacgaucuauuuuuauagguucuuuuucagaaguaaaauuuuguacauauaua

SEQ ID NO: 46174 - RNA, 64 nt, hsa
ucuaacaagaaagacauggaaaauuagcagcccauuuucagaaagaucaaaaugaucuaggguu

SEQ ID NO: 46175 - RNA, 64 nt, hsa
guucuccacacugugcaugcacccuugcuugccuuuuucagagaaaaagaaaauuuuacaacag

SEQ ID NO: 46176 - RNA, 64 nt, hsa
gcacuuuugaaaaaacaaaaaaccuccuuuuagcuuuucagauauguauuuaaauugaagucau

SEQ ID NO: 46177 - RNA, 64 nt, hsa
cacacaguagcaaaauuuggggaaauccauaacauuuucagaccaugaaugaauguuuccauuu

SEQ ID NO: 46178 - RNA, 64 nt, hsa
gccuaaacaauauugaaguauccauagggcacaauuuucagacauuuuaguaucuguauauagu

SEQ ID NO: 46179 - RNA, 64 nt, hsa
aaaagaaaaaggacgaugucagucaagcagcacuuuuucagaauauacagaacauaaauaauau

SEQ ID NO: 46180 - RNA, 64 nt, hsa
ggguauuuccaauacuugaauggcagauuggaguuuuucagaguauguguuucaucugcuaguc

SEQ ID NO: 46181 - RNA, 64 nt, hsa
agagaagugacuguuuuuuauugauaaggcaagauuuucagaaaaaugaguaaaauaauuaaug

SEQ ID NO: 46182 - RNA, 64 nt, hsa
auaaucacuuaaauuuuauauaucuuaauguauuuuuucagacuccuaauuaauucccacauuc

SEQ ID NO: 46183 - RNA, 64 nt, hsa
uagaagcuaggaauaauugaguuuuauagcacuauuuucagaauacgaaaagauacacaaucau

SEQ ID NO: 46184 - RNA, 64 nt, hsa
uccauuuuuguuguaaagacauuguuuuucagacuuuucagaucaauuagaaaaaugucauugc

SEQ ID NO: 46185 - RNA, 64 nt, hsa
aauuggaaauccauuuuuguuguaaagacauuguuuuucagacuuuucagaucaauuagaaaaa

SEQ ID NO: 46186 - RNA, 64 nt, hsa
agaaaagaagugauaguaguuaauuggcaucgauuuuucagauauugcacuaccuuauaauggu

SEQ ID NO: 46187 - RNA, 64 nt, hsa
auuaauuccugagugaaaaagugaacuauguuuuuuuucagaaaaauuauuuuaaaagaacuca

SEQ ID NO: 46188 - RNA, 64 nt, hsa
uuuuuuugauauggaccuguuggucuaugucaucuuuucagaagaaaagcauuuaauugccaau

SEQ ID NO: 46189 - RNA, 64 nt, hsa
cauauacuucuguuuguaaaaauaucaguuuuacuuuucagaggauuuguaagaaacauuuaaa

SEQ ID NO: 46190 - RNA, 64 nt, hsa
ugugguguucuucauugaguuuuuuucuucacuauuuucagaaguuuuuguucuuuuuuuuuuu

SEQ ID NO: 46191 - RNA, 64 nt, hsa
aguuuucauuuuuucuaaauccuccccuacaaaauuuucagauuggaaauuacucuuguauuug

SEQ ID NO: 46192 - RNA, 64 nt, hsa
gcucuugggauuggagaggaaaaauuagaggugauuuucagauuucuuguucuauggaagagga

SEQ ID NO: 46193 - RNA, 64 nt, hsa
uuuuuuugauauggaccuguugguccauaucaucuuuucagaagaaaagcauuuaauugccaau

SEQ ID NO: 46194 - RNA, 64 nt, hsa
gcauauacuucuguuuguaaaaauaucgguuuuauuuucagaggauuuguaagaaacauuuaaa

SEQ ID NO: 46195 - RNA, 64 nt, hsa
cuuauuuuuagaugguuacacuguuagaacacuauuuucagaaucugaauguaauuuguguaau

SEQ ID NO: 46196 - RNA, 64 nt, hsa
uucagaaucugaauguaauuuguguaauaaaguguuuucagagcauuagcugucaguguauuuu

SEQ ID NO: 46197 - RNA, 64 nt, hsa
ccagagaucauucuuccauacuuuacucccuccuuuuucagacuuguuuguaaaguacagaauc

SEQ ID NO: 46198 - RNA, 64 nt, hsa
ucuuuacauauaaaucugcuucaaccuuaggauguuuucagaccagaggcaacuuauucaugaa

SEQ ID NO: 46199 - RNA, 64 nt, hsa
ggaauggggaagcuuauuucaaucaaagcuaaaauuuucagaagucuguaaaaauggaaaaaca

SEQ ID NO: 46200 - RNA, 64 nt, hsa
acauuuugucaaucugaacagagcacagaacauuuuuucagacugaacagacuguuggaccagc

SEQ ID NO: 46201 - RNA, 64 nt, hsa
uuucagaaaguccauuuuuguuuaaaauuagaacuuuucagaaugccaaaugaaggcuaaaauu

SEQ ID NO: 46202 - RNA, 64 nt, hsa
auaucauaaccucuugguucauaugcugagaaauuuuucagaaaguccauuuuuguuuaaaauu

SEQ ID NO: 46203 - RNA, 64 nt, hsa
ugugaaaauauuuguucuuaugucaaagaauuauuuuucagauauauugguaaagauggacuga

SEQ ID NO: 46204 - RNA, 64 nt, hsa
gcuaacacauuaaacuucucacuuuauauacuuuuuuucagagaaauuuaucuuuaguuuuucu

SEQ ID NO: 46205 - RNA, 64 nt, hsa
guucuguccacugcuauggagcagaguuuucccauuuucagaagauaaugacucacaugggaau

SEQ ID NO: 46206 - RNA, 64 nt, hsa
caaccaccuuauuuuugagcuugguguuuugucuuuuucagaaacuaugagcugugucaccuga

SEQ ID NO: 46207 - RNA, 64 nt, hsa
acaugccauccauuauuuuaaauaaacuaauagguuuucagaauuaugaauuuuucagaacuca

SEQ ID NO: 46208 - RNA, 64 nt, hsa
uuaaauaaacuaauagguuuucagaauuaugaauuuuucagaacucauccaguccuuguaaucu

SEQ ID NO: 46209 - RNA, 64 nt, hsa
ugcucauauuucuggccaauguacagccucauauuuuucagaguaauacagauacuuguucuca

SEQ ID NO: 46210 - RNA, 64 nt, hsa
ugccaaacaugggaacagccuugaauaggauaaauuuucagagggcugccuaaaauauuuuauu

SEQ ID NO: 46211 - RNA, 64 nt, hsa
gugucaggcugcacuuugcuccauauaauuauuguuuucagauuucaacuuguauguguuuguc

SEQ ID NO: 46212 - RNA, 64 nt, hsa
ugacccccaaagacaagacaagcacuuauuuuuauuuucagaagacaaaagaaccaagaugcca

SEQ ID NO: 46213 - RNA, 64 nt, hsa
gccaagucacugcugccauguguguacuguauuauuuucagaaaaaaauauaauagucugaguc

SEQ ID NO: 46214 - RNA, 64 nt, hsa
uguguguucugcuuuauauguuauauucaauaucuuuucagaugcagucuauauuuuaugcuga

SEQ ID NO: 46215 - RNA, 64 nt, hsa
cugagaaaugcaauugcuauucuuuuuauauacuuuuucagauuuuuuauaugcuucuuuacua

SEQ ID NO: 46216 - RNA, 64 nt, hsa
aacaauuacuuuauuauuguuguuauuaauguuauuuucagaauggcuuuuuuuuuucuauuca

SEQ ID NO: 46217 - RNA, 64 nt, hsa
ugacuauggacaacucgggugccacuuuuuuuuuuuuucagauuccagugugacaugaggaauu

SEQ ID NO: 46218 - RNA, 64 nt, hsa
uuuuuuuaaggugaaaauguuuugacaaguuccuuuuucagaauagguuuuugagcagaacucu

SEQ ID NO: 46219 - RNA, 64 nt, hsa
cuuccacacuuuauuuccuuaauaauaauaaacuuuuucagaaagaauugaguagagcaaaaau

SEQ ID NO: 46220 - RNA, 64 nt, hsa
cacauuucuuucagggaaaaacaaugucaccaaauuuucagaguucuaaacuccuuuccuucaa

SEQ ID NO: 46221 - RNA, 64 nt, hsa
uuaagacaguuuucaguguaccguaaauguuguguuuucagaaaaagacaaaacgauggugcug

SEQ ID NO: 46222 - RNA, 64 nt, hsa
acagccuguaauacugcucucuuucaaaaacaaguuuucagauuuuuauaacagacccauuuug

SEQ ID NO: 46223 - RNA, 64 nt, hsa
cuuuuaugguuuuuaauuuuuaucaggacuaacauuuucagaaauagcaaggugugaucuagua

SEQ ID NO: 46224 - RNA, 64 nt, hsa
aauucaggucuguaugucauggaucguguugguauuuucagagaacaucccgcuucugaagcug

SEQ ID NO: 46225 - RNA, 64 nt, hsa
ugucucuaauuuaacuuauugcuagauaauaggguuuucagaugaaaagaaaacuuaaagagga

SEQ ID NO: 46226 - RNA, 64 nt, hsa
agagugauucuacaugggaaaaacaaaccagcuuuuuucagagagugaccgaauaggaagaagg

SEQ ID NO: 46227 - RNA, 64 nt, hsa
caggauauggaguuguaguagaaaaagcaccugcuuuucagaaagacuauuauuuccuaaccau

SEQ ID NO: 46228 - RNA, 64 nt, hsa
accuuuuacagcguauuacuuagugaacauuacauuuucagaauagauccuaauauuuuauuga

SEQ ID NO: 46229 - RNA, 64 nt, hsa
uaugcuuggaaacagcauagauauguugcugugguuuucagaauuuucucuuuuaaucacaaga

SEQ ID NO: 46230 - RNA, 64 nt, hsa
auauaaaaacaacaaauacuuccauauggagcauuuuucagaguuuucuaacccagucuuauuu

SEQ ID NO: 46231 - RNA, 64 nt, hsa
ggcaaugagugugccagaguuauuagugccaaguuuuucagaaaguuugaagcaccauggugug

SEQ ID NO: 46232 - RNA, 64 nt, hsa
aacacaaguggaguaugccaaauuuuauaugaauuuuucagauuaucuaagcuuccagguuuua

SEQ ID NO: 46233 - RNA, 64 nt, hsa
aauauaccgugguucauauguuagcauggcagcauuuucagauagcuuuuuguuuguugggaag

SEQ ID NO: 46234 - RNA, 64 nt, hsa
acugcaauugaaaaaaucauacucuauuaccaauuuuucagaacucauagauaaauaugaaugu

SEQ ID NO: 46235 - RNA, 64 nt, hsa
uaacucugaaagauggucauaugauauuccuucauuuucagagaguaauucugaaauucuguuu

SEQ ID NO: 46236 - RNA, 64 nt, hsa
aaaaccacauuaauuuaaauggagccuuucauuauuuucagauagcggggucuuuuccauuuau

SEQ ID NO: 46237 - RNA, 64 nt, hsa
caaaaauaucagaaaaguuggccaugguaaauaauuuucagaauucuuuuuuaaaauuuuaauu

SEQ ID NO: 46238 - RNA, 64 nt, hsa
agacccuacaauaagauuguuuuaucuguacauuuuuucagauauuuaacuguauaaaaauguu

SEQ ID NO: 46239 - RNA, 64 nt, hsa
uguagcuaaauauuuauacacuugucuugaauuuuuuucagauccacuuaaaauauuuagaaaa

SEQ ID NO: 46240 - RNA, 64 nt, hsa
aguuacacaucuucaacagacccccucuagaaauuuuucagaugcuucugggagacacccaaag

SEQ ID NO: 46241 - RNA, 64 nt, hsa
gcuguacaaugaccacuguuauuguuacuuugacuuuucagagcacacccuuccucugguuuuu

SEQ ID NO: 46242 - RNA, 64 nt, hsa
gaaguggcaaauuacauguagagugucuccuuccuuuucagagaacaguuaaucaaggcaaauc

SEQ ID NO: 46243 - RNA, 64 nt, hsa
uuauaagucauuuuuuuccugauauuuccaccacuuuucagagucaucuacaaaauuuuucuuu

SEQ ID NO: 46244 - RNA, 64 nt, hsa
guuauucucucuggcuuuccuuucaacccacuuauuuucagaggccucuccccuuagcauccuu

SEQ ID NO: 46245 - RNA, 64 nt, hsa
ggacuguugccuauugagcauuguggaugauguguuuucagauuuccaggugaaguucugaccc

SEQ ID NO: 46246 - RNA, 64 nt, hsa
cauaauauagaaguuaaaauaaguauuagugcaauuuucagauauuuauuuuugcacagaaaac

SEQ ID NO: 46247 - RNA, 64 nt, hsa
ggguuuucuuaaugccagugugaauuugcagauguuuucagaaaaucaagucacaguaacaauu

SEQ ID NO: 46248 - RNA, 64 nt, hsa
aucgcuuaaucuuaaauuuauuagauaugaguuguuuucagacucagacuccauuuguauuaua

SEQ ID NO: 46249 - RNA, 64 nt, hsa
ucuccaucuggcagggugggauggaggagaagaauuuucagaccccagcggcugagucaugauc

SEQ ID NO: 46250 - RNA, 64 nt, hsa
gagggaugcacuauuucacaagguccaagauuuguuuucagauauuuuugaugacuguauugua

SEQ ID NO: 46251 - RNA, 64 nt, hsa
uuacugguaccacagugaggugaauaaaacgggauuuucagaaguuagccugaauuuaacugua

SEQ ID NO: 46252 - RNA, 64 nt, hsa
gaauuguauaaccagaauuguuccugccuuuagcuuuucagaacuugagauguggcagcacugg

SEQ ID NO: 46253 - RNA, 64 nt, hsa
gugcuguacauuuuggcccuuacgaaauacgucuuuuucagaacuguuaaaguuuugauguaca

SEQ ID NO: 46254 - RNA, 64 nt, hsa
guggaaaaaagugaaugagaccucugauaggggguuuucagaaccuuguucacaccaaaaugug

SEQ ID NO: 46255 - RNA, 64 nt, hsa
uguucugugccuucaguuuaaauuauuucaggauuuuucagauguuuaaauaauggugugaauc

SEQ ID NO: 46256 - RNA, 64 nt, hsa
gaaacagucuuccacuaaccuuugugaguuuauauuuucagaauucagacuuaguuguuaaaau

SEQ ID NO: 46257 - RNA, 64 nt, hsa
uuaacuauagccagaacuggcuaaaauuuuuauauuuucagaguugaaguuggugaagacauuc

SEQ ID NO: 46258 - RNA, 64 nt, hsa
ucugguaauuuuagugaucuuauuugauuagacuuuuucagaaguacuaaauaaggaauuuuaa

SEQ ID NO: 46259 - RNA, 64 nt, hsa
aucacaaggggaaauuuaagauuguuaacccuguuuuucagaagggcuacuguuaauugcacau

SEQ ID NO: 46260 - RNA, 64 nt, hsa
ggcuuucauaauauguaacuuuuggguucugccuuuuucagaaaauggaaacuugggccaugug

SEQ ID NO: 46261 - RNA, 64 nt, hsa
agaaauuuuucucugccuuucaguuuuaugaauuuuuucagaaguaacaauauuauuauugacu

SEQ ID NO: 46262 - RNA, 64 nt, hsa
agggaaguagguggugguuaaaauucuuggaaaauuuucagaauacuuuaaaaauaaaguucca

SEQ ID NO: 46263 - RNA, 64 nt, hsa
cauagucuuuuucauaauacguaugaguuuuaccuuuucagaggaauaauuucaagucauuuau

SEQ ID NO: 46264 - RNA, 64 nt, hsa
aaguaucuuuuucagcuuccuguucuauugucuuuuuucagauacaacauuuuugucuauggug

SEQ ID NO: 46265 - RNA, 64 nt, hsa
aauauauuccauauuauuucuuugaaucaauucauuuucagagcacuuuaaagucugauauuuc

SEQ ID NO: 46266 - RNA, 64 nt, hsa
acugggaacagcuggaaugcuucuugauuuuauuuuuucagagaguuguuaguucucuggguuu

SEQ ID NO: 46267 - RNA, 64 nt, hsa
aguaguacaggcuucuugccgauaugaagggaacuuuucagaaagagaccuacucugggucauu

SEQ ID NO: 46268 - RNA, 64 nt, hsa
uaaaucggaaccuuuuucuauguugcacacaugguuuucagaugacccagccaucuacaagauc

SEQ ID NO: 46269 - RNA, 64 nt, hsa
uuuuuagcaauaauucguuaaugauuccacuugauuuucagaauauuguccugguugauuuuga

SEQ ID NO: 46270 - RNA, 64 nt, hsa
gucauucaaccaugccaaggaguuugugccagccuuuucagacucccagaauuggguguuccug

SEQ ID NO: 46271 - RNA, 64 nt, hsa
uuuuauuuaaaaaaaucaaaccucaaaaaagucauuuucagagaacaccuuuaucaaaggcaaa

SEQ ID NO: 46272 - RNA, 64 nt, hsa
aucagacuggaaacgggacuuucuauuaauaucauuuucagaauaaaaaauaggauaauuuaac

SEQ ID NO: 46273 - RNA, 64 nt, hsa
ccaauaacuguggucuauacagagucaauauauuuuuucagagaaaguuauucgcucgauuuuu

SEQ ID NO: 46274 - RNA, 64 nt, hsa
caguuacgaagacuggcaacuuggcuuuacuaaguuuucagacuggcaggaagucaaaccuauu

SEQ ID NO: 46275 - RNA, 64 nt, hsa
cagauacuggggcagcaaauaaaacugaaucuuguuuucagaccuuauacuguguaauuguaag

SEQ ID NO: 46276 - RNA, 64 nt, hsa
uaauuauguuaccuuuucauccccuuuaggagcguuuucagauuuugguugcuaagaccugaau

SEQ ID NO: 46277 - RNA, 64 nt, hsa
uaaauccgaaaacuuccauuguaguggccugugcuuuucagauaguauacucuccuguuuggag

SEQ ID NO: 46278 - RNA, 64 nt, hsa
gaccuggccuuccuguugugcuuuucagacuuuguuuucagaaugcuuuuaucucgagugugcc

SEQ ID NO: 46279 - RNA, 64 nt, hsa
ucagaugcagugagaccuggccuuccuguugugcuuuucagacuuuguuuucagaaugcuuuua

SEQ ID NO: 46280 - RNA, 64 nt, hsa
acaucccuuguaaagcuaaaauaguuacuucaaauuuucagaaaagauguauauagucaaaauu

SEQ ID NO: 46281 - RNA, 64 nt, hsa
guuucuuuucaugugcccagcagguuaaguagcguuuucagaauauacauuauucccauccauu

SEQ ID NO: 46282 - RNA, 64 nt, hsa
gcagccuucaaaagaauuggcacugggauaagauuuuucagaaaaagaaaaacaucggcaaacu

SEQ ID NO: 46283 - RNA, 64 nt, hsa
cauaacuaugaaaaaacuuugcuaauaucuguguuuuucagauuucauuuuuuguaaaaucaga

SEQ ID NO: 46284 - RNA, 64 nt, hsa
ggauagucaaauauaagagauaaauaguuuaauuuuuucagaccuuuuuuggauaguccaauau

SEQ ID NO: 46285 - RNA, 64 nt, hsa
ggauaguccaauauuagagauaaauaguuuaauuuuuucagauauaaugccagucgaugugauc

SEQ ID NO: 46286 - RNA, 64 nt, hsa
gagcagaaagauuauguuagaagugugauuuuuauuuucagaagucauauacauguaagcuaca

SEQ ID NO: 46287 - RNA, 64 nt, hsa
cauaaaaaaaaaaaaaaagauuuccaaaaugccguuuucagaaccuggguuuuaauagcaguau

SEQ ID NO: 46288 - RNA, 64 nt, hsa; identical to SEQ ID NO: 46280

SEQ ID NO: 46289 - RNA, 64 nt, hsa; identical to SEQ ID NO: 46281

SEQ ID NO: 46290 - RNA, 64 nt, hsa
aguuguucuccaccccuucuccaccuccaccagcaaggagaagucaaucuacacuuuuuucuca

SEQ ID NO: 46291 - RNA, 64 nt, hsa
uaacuauuauaaagaguuuaacuuucuggaacugaaggagaaaacaugaaaauguuuauauugc

SEQ ID NO: 46292 - RNA, 64 nt, hsa
aaauaaagccaggaaagucaaaaaaacgaaagagaaggagaagaaaaaggaaaagggcaaauug

SEQ ID NO: 46293 - RNA, 64 nt, hsa
ggagaagaaaaaggaaaagggcaaauugaaagucaaggagaaaaagcgcaaagaggagaaugaa

SEQ ID NO: 46294 - RNA, 64 nt, hsa
gggcagaauggcccuagaguucuuuucccugagaaaggagaaaaagaugggauugccacucacc

SEQ ID NO: 46295 - RNA, 64 nt, hsa
uuguugcuugguugguuuguugcuuuauuuuuaaaaggagaaguuuaacuuugcuauuuauuuu

SEQ ID NO: 46296 - RNA, 55 nt, hsa
aaaacguagugaauucauaaaauggaaggagaagacugggcuagggagaaugcag

SEQ ID NO: 46297 - RNA, 64 nt, hsa
ugacaacagacugaauuuuaaauguucacaacauaaggagaauguaucuccuccuauuuaugaa

SEQ ID NO: 46298 - RNA, 63 nt, hsa
cuucuaacaaaaaauaaauaaauauuuaaauuccaaggagaaguguucuuuguguauuucuag

SEQ ID NO: 46299 - RNA, 64 nt, hsa
uugaaaacagaaggcaggucaaggguagaaguuaaaggagaaucugaaggcaggucagggaaaa

SEQ ID NO: 46300 - RNA, 64 nt, hsa
uguagcuccagcuugucucccuggcuucucuuugaaggagaaaaauguaaaauaugcacugaga

SEQ ID NO: 46301 - RNA, 64 nt, hsa
uuugcagaggggcggggggugaggcuuagcccagaaggagaacugagcaggaaaccaaggcucu

SEQ ID NO: 46302 - RNA, 64 nt, hsa
cagcaaucaacaagcccuuucugccguuaauaagaaggagaauagcugaaggagagagauauuu

SEQ ID NO: 46303 - RNA, 64 nt, hsa
aaggcgaggaaaugguuuguaagaggggaaagaaaaggagaaaggucuaaucaagcucggguug

SEQ ID NO: 46304 - RNA, 64 nt, hsa
aaauguugaucgguagggcagccauauguguaggaaggagaaaacagaauuugguggauaccua

SEQ ID NO: 46305 - RNA, 64 nt, hsa
uucuuuuauaauccuuaaugugaggcuaagguauaaggagaaaggagauugguaaggaagugug

SEQ ID NO: 46306 - RNA, 64 nt, hsa
acaaaguauagaaacauguucauugcacacacccaaggagaagagcucaagcgcuuggaagagg

SEQ ID NO: 46307 - RNA, 64 nt, hsa
gcugucuccaccuccaggauguccagcaggcugcaaggagaaggaugccagccacccauccucc

SEQ ID NO: 46308 - RNA, 64 nt, hsa
cacaucugccuccacacacagcuccuccgcagggaaggagaagcugcucuguaacucauucugg

SEQ ID NO: 46309 - RNA, 64 nt, hsa
cauuagauaucaccuggcaaguuucugccuaauuaaggagaagucuuuuaucauauuuauacug

SEQ ID NO: 46310 - RNA, 64 nt, hsa
augaucauuaaauuuuuagaaauucucggaaguuaaggagaagcacuguuuuuuauaaaaauuu

SEQ ID NO: 46311 - RNA, 64 nt, hsa
uggugacuccaacuauggauagcuuauuuugaaaaaggagaauugcaaauuuuaccaaaagaug

SEQ ID NO: 46312 - RNA, 64 nt, hsa
guaguaaauuauagaauguauaagaaaaaauauaaaggagaaaaucaauuaucaggaaagcuaa

SEQ ID NO: 46313 - RNA, 64 nt, hsa
gggaucuugacuaagauucaugagacauugaauuaaggagaaucaucuucaugccugaaaauuu

SEQ ID NO: 46314 - RNA, 64 nt, hsa
uauuacggauucaaagacuuauuuugaaaguuggaaggagaagggagggaagagagcagaaggg

SEQ ID NO: 46315 - RNA, 64 nt, hsa
aauggcuccucugugacaaaacacaaguuggaccaaggagaaagcccuuuggagaaacuggacc

SEQ ID NO: 46316 - RNA, 64 nt, hsa
gaaauugguauuuauuuuaaauauuaguuauucuaaggagaaaaaaaugcuucugcaagauuuu

SEQ ID NO: 46317 - RNA, 64 nt, hsa
cacaagacaaaacaggagccagaaguaaggacugaaggagaaggggagaauagcuaauagcuau

SEQ ID NO: 46318 - RNA, 64 nt, hsa
ucaucaguuaagaaaucuacuuuaacaaaacaaaaaggagaaaaaguaauaaugugauggcaau

SEQ ID NO: 46319 - RNA, 64 nt, hsa
ccgccaggggagcuguaagcagccggguggugacaaggagaaaagccuucuagggucacuguca

SEQ ID NO: 46320 - RNA, 64 nt, hsa
uuccugguucuguuuucucagccaguugcuguggaaggagaaugcuuucuuuguggccucaucu

SEQ ID NO: 46321 - RNA, 64 nt, hsa
uugaauuucagaaaaaaaaaaugcauuuacuggcaaggagaagagcaaaguuaaggcuugauac

SEQ ID NO: 46322 - RNA, 64 nt, hsa
augucagauugaauguauuuaaauguauguauuuaaggagaaccaugcucuuguucuguuccug

SEQ ID NO: 46323 - RNA, 64 nt, hsa
uuuuuucuaauaagcugagauucccauuucucuuaaggagaagccacccaugagaugucuuuuc

SEQ ID NO: 46324 - RNA, 64 nt, hsa
uucuuagacuggcugccaaaggaugaagcuagugaaggagaaaaagcuuaaauuccaucuugag

SEQ ID NO: 46325 - RNA, 64 nt, hsa
agaugugagggcagaauauacacaacagaugcugaaggagaaggaggguaguguuuugcaaaag

SEQ ID NO: 46326 - RNA, 64 nt, hsa
cugcccguggaagccagggagggauggaccccgaaaggagaaaaguacucccaggaaacagacg

SEQ ID NO: 46327 - RNA, 64 nt, hsa
ucugucucgaaagaaagaaagaaaaaaaggaaggaaggagaaggaaggaaggagaagaaaaggu

SEQ ID NO: 46328 - RNA, 64 nt, hsa
aagaaagaaaaaaaggaaggaaggagaaggaaggaaggagaagaaaagguaccuguucuacgua

SEQ ID NO: 46329 - RNA, 64 nt, hsa
uuaaaauuccaaacccaaagccuuuguuugacugaaggagaagagagggaaguaagcuucuguu

SEQ ID NO: 46330 - RNA, 64 nt, hsa
ugccuguucccaaacuuuuuccauuccaggaacaaaggagaagccacuuuccccaggacgcaag

SEQ ID NO: 46331 - RNA, 64 nt, hsa
aaaagaaagaaagaaaagaagaagaaaagagaagaaggagaaggagaugaaggaggaggaggag

SEQ ID NO: 46332 - RNA, 64 nt, hsa
gaaggagaaggagaugaaggaggaggaggaggagaaggagaagaagaagaagaagaagaccaca

SEQ ID NO: 46333 - RNA, 64 nt, hsa
uaaccauguuuagggaugugccucaguugggagcaaggagaaaaaugggaagaaccaguuuuau

SEQ ID NO: 46334 - RNA, 64 nt, hsa
accugccauucguggaagucgccuggguuuuguaaaggagaauuuuuuggacucaagcugucau

SEQ ID NO: 46335 - RNA, 64 nt, hsa
acccaguuagccaagauguuggaugcguugcuagaaggagaaauagaagaccuugaccugcugg

SEQ ID NO: 46336 - RNA, 64 nt, hsa
auauuguuuggagacuuccagauggcucugcacgaaggagaaccacgcauuuaugaagacaucc

SEQ ID NO: 46337 - RNA, 64 nt, hsa
cucuuccagcaaaggcaaaaagagccggacucaaaaggagaagaaagcugcucgugcucguucc

SEQ ID NO: 46338 - RNA, 64 nt, hsa
ggacacagaccuggcccguuuugaggcugaucucaaggagaaacagauugagucaagugacuau

SEQ ID NO: 46339 - RNA, 64 nt, hsa
aauguaaaacuuuuaagguauaucauuauaacugaaggagaaggugccccaaaaugcaagauuu

SEQ ID NO: 46340 - RNA, 64 nt, hsa
ccuucccuggcuuguaacuccaccaacccaucagaaggagaaggaaggagacucaccucugccu

SEQ ID NO: 46341 - RNA, 64 nt, hsa
aaaaaucagaauugcgucugugggaacaggaauaaaggagaaaccacuauugacugggaagaca

SEQ ID NO: 46342 - RNA, 64 nt, hsa
augccuguaauccuagcuacugggaaggcugaggaaggagaauugcuugaacccagguggugga

SEQ ID NO: 46343 - RNA, 64 nt, hsa
gcuucccugggcucccacugccuucuaaggagccaaggagaauucccugcccacuuucuguucc

SEQ ID NO: 46344 - RNA, 64 nt, hsa
gccagaggggcagccaccuugcaugagggugaggaaggagaagcccagccagccucuacccauc

SEQ ID NO: 46345 - RNA, 64 nt, hsa
ugcccggcuagaaaucaacgugcucaaaaaaaucaaggagaaggacaaagaaaacaaguuguga

SEQ ID NO: 46346 - RNA, 64 nt, hsa
ugagcuccugggcaagaacaccuuugaguuccugaaggagaauaacuuccagccuuacccccua

SEQ ID NO: 46347 - RNA, 64 nt, hsa
uugggaugagaacagcucugacggccgguaugugaaggagaacugcaaaccucugaaggucagu

SEQ ID NO: 46348 - RNA, 64 nt, hsa
uagcauagugguuuuauuuuguuaguuauuuuuaaaggagaagaaauguuacuuuuuaacuuua

SEQ ID NO: 46349 - RNA, 64 nt, hsa
ggacaaaauuaagucuuuaaaauuuaggcacuuuaaggagaacuaauaacuuuuuccauguauc

SEQ ID NO: 46350 - RNA, 64 nt, hsa
acuugcucugaacugcacccaggaggugacugggaaggagaaaaccagcaaaggaagcucugcc

SEQ ID NO: 46351 - RNA, 64 nt, hsa
cacauccccugacgaagcuuguccagauggcaggaaggagaacggaugcuugucuggccaugau

SEQ ID NO: 46352 - RNA, 64 nt, hsa
uguuuagaacucuucaacuucgguaaugaggaagaaggagaaagagcugggggaagggcagaag

SEQ ID NO: 46353 - RNA, 64 nt, hsa
agggcagaagacugguuuaggaggaaaaggaaauaaggagaaaagagaaugggagagugagaga

SEQ ID NO: 46354 - RNA, 64 nt, hsa
ugauaaaauuuacaauagccacgcaauagccaucaaggagaauuucuauuaugauuauaaauuc

SEQ ID NO: 46355 - RNA, 64 nt, hsa
uucuuaacaccuccaccagggggaaggcuggcacaaggagaaaaaaaaagcaagcaucagcgaa

SEQ ID NO: 46356 - RNA, 64 nt, hsa
aagggggaggagaagguucuucguccaaaggaggaaggagaagaaguagaaagugcgaagagcu

SEQ ID NO: 46357 - RNA, 64 nt, hsa
cuccugcccucugcccggcccuacugagauucccaaggagaaggccgagagggggcgcuccagg

SEQ ID NO: 46358 - RNA, 64 nt, hsa
ugaaagcugugcucagaggaggugagaggagaggaaggagaaaacugcaucauaacuuuacaga

SEQ ID NO: 46359 - RNA, 64 nt, hsa
uauuuuuuccuuucaaaucagacgaugagacuagaaggagaaauacuuucugucuuauuaaaau

SEQ ID NO: 46360 - RNA, 64 nt, hsa
agguugaggacagugacugccauuuguauauaaaaaggagaaaaaugguaaguacauaauugug

SEQ ID NO: 46361 - RNA, 64 nt, hsa
cagccuacuccuggguagacaacaaugaauaaauaaggagaacuuggaaaccauuuauguagug

SEQ ID NO: 46362 - RNA, 64 nt, hsa
agauaugccaugggccuuuucacaggggacacaggcuucuuaaaacaacccggcuuccucaccc

SEQ ID NO: 46363 - RNA, 64 nt, hsa
ggguugcuuguuuuucgcuuguaaauuuuuugaagcuucuuauagauucuggauauuagaucuu

SEQ ID NO: 46364 - RNA, 64 nt, hsa
cucucaagugucuuaggguagaaaguaaaaaguugcuucuuaugaguugcuaaaggaaggcuuc

SEQ ID NO: 46365 - RNA, 64 nt, hsa
guccaaagaaucggcaaaugagagugguuagaaggcuucuuagcgcaguuguucagagcccugg

SEQ ID NO: 46366 - RNA, 64 nt, hsa
guccacaucacagcucccuccagaagcugcaagagcuucuuagcaguuccuggucugaacccuc

SEQ ID NO: 46367 - RNA, 64 nt, hsa
accuagaucagcguggcugguccccuuacugccugcuucuuagggcccucucccugccccagcu

SEQ ID NO: 46368 - RNA, 64 nt, hsa
cucuaagugguuaaaaauuaguaugaauuuuuuagcuucuuaaugaauauggauuuaaaacucu

SEQ ID NO: 46369 - RNA, 64 nt, hsa
gccagauaguuucuacuaaccauauacucuuucugcuucuuagcgucguugucacugcuucugu

SEQ ID NO: 46370 - RNA, 64 nt, hsa
ucauuuucuguucucauuuugcagaguugcacaaggagagaacucagcaugggggguugguucu

SEQ ID NO: 46371 - RNA, 64 nt, hsa
caggggccuuucaggaucugggagggggcagucuggagagaaggagggagacgcagguggacuu

SEQ ID NO: 46372 - RNA, 64 nt, hsa
ggugguguugaugguggcggugguaggguggaggggagagaagaagaugcugaugauauugaua

SEQ ID NO: 46373 - RNA, 64 nt, hsa
aggcuguugugugcgcggaugaggggagguggcaggagagaauucuacauuuaggggguuaggc

SEQ ID NO: 46374 - RNA, 64 nt, hsa
ccucuagcggugaagggggaaggggaagaggaaaggagagaaguggucggugucuguuuccuuc

SEQ ID NO: 46375 - RNA, 64 nt, hsa
caaauggcagcuuagcuacaaaugccugucagucggagagaauggggugagcagccaccauucc

SEQ ID NO: 46376 - RNA, 64 nt, hsa
uauguguguguguguuuuugggguggggagggagggagagaagagggggcuaaauuugaugcuu

SEQ ID NO: 46377 - RNA, 64 nt, hsa
aaugguccuuucacaugugcuuuauuagacucugggagagaaaaguaaccaagugcuucagaac

SEQ ID NO: 46378 - RNA, 64 nt, hsa
gcagaucagguaaagcauacauaguagagggaaaggagagaauggaaauaaaacugaauauuau

SEQ ID NO: 46379 - RNA, 64 nt, hsa
gaaggugcuggaggugggagcaggagauugagaaggagagaaagugggugagaugcuggagaag

SEQ ID NO: 46380 - RNA, 64 nt, hsa
cccacgcccuccccuccccugcugcaggggcucuggagagaaacaauaaagagauucacacaca

SEQ ID NO: 46381 - RNA, 64 nt, hsa
agagaagggcgugccacccuugcugugcaacaugggagagaaguucuuauuguuggccaugaag

SEQ ID NO: 46382 - RNA, 64 nt, hsa
cuuggaaaaguucuuagcagcagccucuggacuuggagagaagggcgugccacccuugcugugc

SEQ ID NO: 46383 - RNA, 64 nt, hsa
gagccguguuagagcuuccgagaauagcuccacuggagagaaguggaauccuauauagaaugcu

SEQ ID NO: 46384 - RNA, 64 nt, hsa
ggucaucuagcaaccgccucaaaauguguaagcaggagagaaauuucucaucacagggauuuag

SEQ ID NO: 46385 - RNA, 64 nt, hsa
uuuaacaacaugcuccguagacgaagggagaggaggagagaaggcuuccuggguuugcaacacu

SEQ ID NO: 46386 - RNA, 64 nt, hsa
agcagcaacgagcaacaaucggaaaccaaauacuggagagaaaaccaacguuuccacccacaga

SEQ ID NO: 46387 - RNA, 64 nt, hsa
cucaaaccuugauaaacauaagagaauucauaccggagagaaacuguacaaaugugaagaauau

SEQ ID NO: 46388 - RNA, 64 nt, hsa
ugguccucaaugcuuaauaaauauaauucaugcuggagagaaacuucacaugugaaccgugugg

SEQ ID NO: 46389 - RNA, 64 nt, hsa
cucucaccacacccagaagaggccuuucccaucuggagagaagcuuccagaccagcccuucaca

SEQ ID NO: 46390 - RNA, 64 nt, hsa
cacacaccacagccaggaggggccuuucccaccuggagagaaacuuccagaccagccccucaua

SEQ ID NO: 46391 - RNA, 64 nt, hsa
cucauaccacagccaagaggggccuuucucaccuggagagaaauuuccagaccauccccucuca

SEQ ID NO: 46392 - RNA, 64 nt, hsa
cucacaccacagccaagagaagccuuuccagccuggagagaaacuuccagaccagcccucucac

SEQ ID NO: 46393 - RNA, 64 nt, hsa
cucucaccacagccaggagaggccuuuaccaccuggagagaagcuuccagaccagccccucaca

SEQ ID NO: 46394 - RNA, 64 nt, hsa
cucacaccacagccaggagaggccuuucccaccuggagagaaacuuccagaccagccccucaua

SEQ ID NO: 46395 - RNA, 64 nt, hsa
cucauaccacagccaagaggggccuuucucaccuggagagaaacuuccagaccagccccucaca

SEQ ID NO: 46396 - RNA, 64 nt, hsa
cucacaccaccgccaggagaggccuuucccaccgggagagaaacuuccagaccagccccucaca

SEQ ID NO: 46397 - RNA, 64 nt, hsa
cucacaccacagccaggagaggccuuucccaccgggagagaaacuuccagaccagcccucucac

SEQ ID NO: 46398 - RNA, 64 nt, hsa
cucacaccacagccaggagaggccuuucccgccuggagagaagcuucaggccagcuccucacac

SEQ ID NO: 46399 - RNA, 64 nt, hsa
cucacaccacagccaggagagaccuuuucugccuggagagaaacuuucagaccagccccacaca

SEQ ID NO: 46400 - RNA, 64 nt, hsa
cacacaccacagccaggagaggccguuccugccuggagagaagcuuccagaccagcccuucaca

SEQ ID NO: 46401 - RNA, 64 nt, hsa
uucacaccacagccaggagaggccuuucccaccuggagagaaacuuccagaccagccccucuca

SEQ ID NO: 46402 - RNA, 64 nt, hsa
uccaggaccuucuacccugcagagugugguuuugggagagaagugcaaaaucccacgacaggug

SEQ ID NO: 46403 - RNA, 64 nt, hsa
gaaucucuguaagguuuauuuaucuucacccucuggagagaagauguuuuaccaaagccucuag

SEQ ID NO: 46404 - RNA, 64 nt, hsa
ggggcguagacuugacaacaucccacaguggcacggagagaaggcccauaccuucugguugcuu

SEQ ID NO: 46405 - RNA, 64 nt, hsa
uauuugaaacuguaaauauguuugugccuuaaaaggagagaagaaaguguagauaguuaaaaga

SEQ ID NO: 46406 - RNA, 64 nt, hsa
cuacaagcuuacuacacauaggaaaauucauacuggagagaaacuacaaaugugaagaaugugu

SEQ ID NO: 46407 - RNA, 64 nt, hsa
ucaaaccuuacugaaaguugagaaaauucguacuggagagaauccuacaaaugugaaaaaugug

SEQ ID NO: 46408 - RNA, 64 nt, hsa
aauccucauaccuuacuauacagaaauucauacuggagagaaagccuacaauugugaagaaugu

SEQ ID NO: 46409 - RNA, 64 nt, hsa
uucaacccuuauuacacauaagauaauucauagcggagagaaaccccacaaaugugaagaaugu

SEQ ID NO: 46410 - RNA, 64 nt, hsa
cucaacucuuacugcacauaagaucauucauacuggagagaaaccuuacaaaugugaggaaugu

SEQ ID NO: 46411 - RNA, 64 nt, hsa
cucgaacuuuacuaugcauaagaaaauucaaacuggagagaaacucuacaaaugugaagaaugu

SEQ ID NO: 46412 - RNA, 64 nt, hsa
auccucaaaacuucuuacaccuaaaauucaugcaggagagaaacaccacaaaugugaaaaauuu

SEQ ID NO: 46413 - RNA, 64 nt, hsa
uucaacccuuucugcacauaauauaauucauacuggagagaaaccccacaaauaugaagaaugu

SEQ ID NO: 46414 - RNA, 64 nt, hsa
uucacaucuuauucagcaucaaagaauucacacaggagagaaagcacaugaauguaaugaaugu

SEQ ID NO: 46415 - RNA, 64 nt, hsa
ccacauuucaggcuuuacccaacaucgaaauaauggagagaaaauuguugauuauuuguuuaug

SEQ ID NO: 46416 - RNA, 64 nt, hsa
cucaacccuuacuaaacauaagaugauucauacuggagagaaguuacacaaaugugaugaaugu

SEQ ID NO: 46417 - RNA, 64 nt, hsa
cucaaaacucauugaacacaagaaaauucauacuggagagaaaccuuacaagugugaagaaugu

SEQ ID NO: 46418 - RNA, 64 nt, hsa
uucaacccuuauuggacauaagagaauucauacuggagagaaacccuacaaaugugaagaaugu

SEQ ID NO: 46419 - RNA, 64 nt, hsa
agggagggagggagagaauggcccgagggaggagggagagaaggagggaggcgcuccugggacc

SEQ ID NO: 46420 - RNA, 64 nt, hsa
auaaacacuggaggggagggagggagggagggagggagagaauggcccgagggaggagggagag

SEQ ID NO: 46421 - RNA, 64 nt, hsa
ugcauaagugccauccuuuaaucauagacuuugaggagagaaagcauaaaaauauagcauauaa

SEQ ID NO: 46422 - RNA, 64 nt, hsa
uuacuuguaacagcguaauuaaacacaucauggaggagagaaacuuaaaauuaaaauaguauuu

SEQ ID NO: 46423 - RNA, 64 nt, hsa
uuccaaaacccuucuuuuuaaaaggaaaaaggauggagagaaggauggaaagccuggacuuaaa

SEQ ID NO: 46424 - RNA, 64 nt, hsa
aaagccuggacuuaaaccuuuagaaaaaacuucuggagagaaaucccuuuuaaacaguuacuuu

SEQ ID NO: 46425 - RNA, 64 nt, hsa
gcagaucagguaaagcauacauaguagagggaaaggagagaauggaaauaaaacucaauauuau

SEQ ID NO: 46426 - RNA, 64 nt, hsa
aauggcucuuucacaugugcuuuauuagacucugggagagaaaauuaaccaagugcuucagaac

SEQ ID NO: 46427 - RNA, 64 nt, hsa
ugcuauagagagguuggaaggggugguuggaaggggagagaaacugagauggcccucugugacu

SEQ ID NO: 46428 - RNA, 64 nt, hsa
ugccaugcucugggacgugugggcccuggggagaggagagaaagggcucccaccugccaguccc

SEQ ID NO: 46429 - RNA, 64 nt, hsa
cagugauaaaaacuuccuuuuagggaucaaugaaggagagaaggucuuggaaucaccuucaguc

SEQ ID NO: 46430 - RNA, 64 nt, hsa
cauccugcaagguuccucuuccugcaagcaaaguggagagaaagaagaugcaucugucaccuuc

SEQ ID NO: 46431 - RNA, 64 nt, hsa
gggauagacagucuccaagaaaagugaaguggugggagagaauugcuuuuuucuuuuuuuucuu

SEQ ID NO: 46432 - RNA, 64 nt, hsa
acuuguacccucccugugcccccagaagguucuuggagagaagugcaagaauuugugaacacgg

SEQ ID NO: 46433 - RNA, 64 nt, hsa
ggccgggcuugagaggagagcgcuggccaugccaggagagaacccacgcacaugcacaccacaa

SEQ ID NO: 46434 - RNA, 64 nt, hsa
aagcgugguucuguaagaaaucagagggagaaagggagagaagggggagggagacaacccaaac

SEQ ID NO: 46435 - RNA, 64 nt, hsa
ggucgguggugaaggugcucucacuuuacagaauggagagaacaucgugugugugugugugugu

SEQ ID NO: 46436 - RNA, 64 nt, hsa
cagggacccauuguucucuucagaacccuaucugggagagaaggcgaaccaccuccggguuucc

SEQ ID NO: 46437 - RNA, 64 nt, hsa
auauagcucuuaggcuuccagccucuaccaugcaggagagaacacagaaggacugauguauguu

SEQ ID NO: 46438 - RNA, 64 nt, hsa
agagugaagguggguggaguugaccagagaaaggggagagaauucgggaaagacccaaaguguu

SEQ ID NO: 46439 - RNA, 64 nt, hsa
ggaagugacucauccucuugaagaugcugaaacaggagagaaaggggauguauccaugggggca

SEQ ID NO: 46440 - RNA, 64 nt, hsa
cauggccagcagcuugcguuagaaugaggaggaaggagagaaggggaggagggcggggggcacc

SEQ ID NO: 46441 - RNA, 64 nt, hsa
cccagcccagggcggcggggacuccgagagccccggagagaacguggcccagcccuggagggca

SEQ ID NO: 46442 - RNA, 64 nt, hsa
gagccaauagugguuggggaacucuugaaaaaggggagagaauggcugggugcuggggaguucc

SEQ ID NO: 46443 - RNA, 64 nt, hsa
agacuccugugagaucagcagaccucguguuuaaggagagaaugccugccugcaacacucaugg

SEQ ID NO: 46444 - RNA, 64 nt, hsa
cugcagauacaugcggcacagcaggcacgugccuggagagaacagcuccugagcacagcacccu

SEQ ID NO: 46445 - RNA, 64 nt, hsa
caagucauuucaaauacaugaaaaaucuuacacuggagagaaacccuaugaguguaagcaaugu

SEQ ID NO: 46446 - RNA, 64 nt, hsa
cacuuccuuucgauaucaugaaaggacucacacuggagagaaccccuaugaguguaagcaauuu

SEQ ID NO: 46447 - RNA, 64 nt, hsa
caaaaaucuucgauuucauaaaaggacacacacuggagagaaacccugugaauguaagaaaugu

SEQ ID NO: 46448 - RNA, 64 nt, hsa
cucuucuuugcaaauacaugaaaggaugcacagaggagagaagcucugugaauguaagcauugu

SEQ ID NO: 46449 - RNA, 64 nt, hsa
caagauccuuugaauacaugcaagaacacacaauggagagaaacccuaugaauguaaagaaugc

SEQ ID NO: 46450 - RNA, 64 nt, hsa
cacuucuuuucaauaucaugaaaggacucacaugggagagaaacccuaugaguguaugccaagu

SEQ ID NO: 46451 - RNA, 64 nt, hsa
uaguucccuucaauaucaugaaaggacucacacuggagagaagcccuaugaauauaagcaaugu

SEQ ID NO: 46452 - RNA, 64 nt, hsa
caaguuauuucaaacacaugaaaaaauucacacuggagagaaacccuauaaaugcaagcaaugu

SEQ ID NO: 46453 - RNA, 64 nt, hsa
caagaaccuuucaauuuaugaaaggacacacacuggagagaaacccuaugaauguaagaaaugu

SEQ ID NO: 46454 - RNA, 64 nt, hsa
ccaagaucguuugaauacaugcaaaacacacacuggagagaaaccuaugaauguaaggaaugca

SEQ ID NO: 46455 - RNA, 64 nt, hsa
caagucauuucgaagacaugaaaaaacucacacuggagagaaacccuauaaaugcaugccaugu

SEQ ID NO: 46456 - RNA, 64 nt, hsa
caguuccuuucaguaucaugaaaggacucacacuggagagaaacccuaugaguguaagcaaugu

SEQ ID NO: 46457 - RNA, 64 nt, hsa
gccccacaccuucgaaggcaugguaggacucacuggagagaaacccuaugaguguaaggaaugu

SEQ ID NO: 46458 - RNA, 64 nt, hsa
caguuccuuuugguaccaugaaaggacucacacuggagagaaacccuaugaguguaagcaaugu

SEQ ID NO: 46459 - RNA, 64 nt, hsa
cccacaccuucgaauccaugguagaacucacacuggagagaaacccuaugaguguaaggaaugu

SEQ ID NO: 46460 - RNA, 64 nt, hsa
caagucauuucaaauaccugaaaaaucuuacacuggagagaaacccuaugaguguaagcaaugu

SEQ ID NO: 46461 - RNA, 64 nt, hsa
cacuucuuuucgauaacaugaaaggacucacacuggagagaaacccuaugaguguaagcaaugu

SEQ ID NO: 46462 - RNA, 64 nt, hsa
cuuuacccuuaauacacauaagauaauuaaugcuggagagaaacccuacaaaugugaagaaugu

SEQ ID NO: 46463 - RNA, 64 nt, hsa
cucauaccuuacuaaauauaagauaauucauauuggagagaaauucuacagaugugaagaaugu

SEQ ID NO: 46464 - RNA, 64 nt, hsa
cucauccauuaguaaacauaagauaauucauacuggagagaaaaccuacaaaugugaggaaugu

SEQ ID NO: 46465 - RNA, 64 nt, hsa
ccuccaauuuacugcacauaagauaauuuauacuggagagaagcccuacaaaugugaaaaaugu

SEQ ID NO: 46466 - RNA, 64 nt, hsa
cucaacccuuacuacacauuagauaauucaugcuggagagaaacccuacaaaugugaaaaaugu

SEQ ID NO: 46467 - RNA, 64 nt, hsa
caguccucaacuccuaguaaacauaauuaaugauggagagaaaccauacaacugugaagaaugu

SEQ ID NO: 46468 - RNA, 64 nt, hsa
uccucaaacuuuauugaacaaaauaauucauacaggagagaaacccuacaaaugugaagaaugu

SEQ ID NO: 46469 - RNA, 64 nt, hsa
cucaauuuuuacuaaacauaagaaaauucauacuggagagaaacccuaugauugugaaaaauau

SEQ ID NO: 46470 - RNA, 64 nt, hsa
gucgucccugcuucaacaucacaguauucauacuggagagaaaccuuacgaauguauuaaaugu

SEQ ID NO: 46471 - RNA, 64 nt, hsa
cucgaaucuuacugcccaucaaagaguacauaauggagagaaacccaauagugugguaagugug

SEQ ID NO: 46472 - RNA, 64 nt, hsa
agaaaaucucauuacacaucagaaaauucacacuggagagaaaccuuaugaaugcagugaaugu

SEQ ID NO: 46473 - RNA, 64 nt, hsa
aucaaaccucacugaacaugagaaaauucauacuggagagaaaccuuaucauuguaaucaaugu

SEQ ID NO: 46474 - RNA, 64 nt, hsa
acaaaaucuucuugagcaugaaaaaauucauacuggagagaaaccauucaaauguaaugaaugu

SEQ ID NO: 46475 - RNA, 60 nt, hsa
agccuugcaugucaucauagacuucauacuggagagaaaccuuacaaaugugaagcaugu

SEQ ID NO: 46476 - RNA, 64 nt, hsa
aucacgccuuaaaagacauaggagaauucauacuggagagaaaccuuacaaguguaaugagugu

SEQ ID NO: 46477 - RNA, 64 nt, hsa
uucauaccuugcaguucaucagugaacucauacuggagagaaaccuuacaaaugucaugacugu

SEQ ID NO: 46478 - RNA, 64 nt, hsa
uucauccuaugcaaaacauaggagaauucaugcaggagagaaaugucacaagugugaugagugu

SEQ ID NO: 46479 - RNA, 64 nt, hsa
uucacaccucauuagacaucagagaaucccuacuggagagaaaucuuacaaaugucaucagugu

SEQ ID NO: 46480 - RNA, 64 nt, hsa
gcaggccaggggucccccagcgucacccuguuggggagagaagaaaggggguucagaggccggu

SEQ ID NO: 46481 - RNA, 64 nt, hsa
cuccugcggaugggcaaauaaauugguggaggacggagagaaaccucuuuauuucccuccugag

SEQ ID NO: 46482 - RNA, 64 nt, hsa
cacaaaccuuaauguguguaugugaacucacauuggagagaaacccugcaauuuaaaugguaug

SEQ ID NO: 46483 - RNA, 64 nt, hsa
cucaagccuuaccaaacacaucagaaaucucacuggagagaaacuguaugaauguagagaaucu

SEQ ID NO: 46484 - RNA, 64 nt, hsa
uacaggcuuucgagugcacaugagaaugcacacuggagagaaaccuuauaaauguaaggauugu

SEQ ID NO: 46485 - RNA, 64 nt, hsa
caguuauauucauauacaugaacgaauucauacuggagagaaacccuaugaauguaaagaaugu

SEQ ID NO: 46486 - RNA, 64 nt, hsa
ugcagguuuccagauacaugaaagaacccacacuggagagaaaccuuaugaauguaaacagugu

SEQ ID NO: 46487 - RNA, 64 nt, hsa
cuacucagcucaaagacaugaaaggacucauacuggagagaaacccuacaaauguaaggaaugu

SEQ ID NO: 46488 - RNA, 64 nt, hsa
caacucugcucaaagacaugaaaagacucauacuggagagaaacccuacaaaugcaaggaaugu

SEQ ID NO: 46489 - RNA, 64 nt, hsa
ccaaucugcucaaaaacaugaaaaggcucauacuggagagaaacccuacaaauguaaggaaugu

SEQ ID NO: 46490 - RNA, 64 nt, hsa
caccagacacaaacuguauaagugucaggaauauggagagaagccauauaaauguaagaaaugu

SEQ ID NO: 46491 - RNA, 64 nt, hsa
uggucacuuaaagcaacaugaaaggauucacacuggagagaagccguaugaauguaaggaaugc

SEQ ID NO: 46492 - RNA, 64 nt, hsa
uuauucccuucaaaaucaugagacaacucauaugggagagaagccauaugaauguaaauaaugu

SEQ ID NO: 46493 - RNA, 64 nt, hsa
caguacacugcaaagucaugaaagaacucacacuggagagaagaaacucuaugaaugcaagcag

SEQ ID NO: 46494 - RNA, 64 nt, hsa
caguucuugucuaagacaugaaaaaacucacacuggagagaaacucuguacauguaaacaaugu

SEQ ID NO: 46495 - RNA, 64 nt, hsa
caguuuauuucguaugcaugaaagaacucacucuggagagaaacuauaugaauguaagcagugu

SEQ ID NO: 46496 - RNA, 64 nt, hsa
ugcugggcacaaaccacaugaguaucaggaauauggagagaagcguaauacacguaaacaauuu

SEQ ID NO: 46497 - RNA, 64 nt, hsa
gggcagugccugcccucagcucucacacaugacuggagagaagugagaagacucccagaaucug

SEQ ID NO: 46498 - RNA, 64 nt, hsa
cguaaucuuuuaaagacaccugagaauauauacuggagagaaacuauaaagaaaauucuauauc

SEQ ID NO: 46499 - RNA, 64 nt, hsa
uaguuccuuuuggauguaugagaguacuuacgcuggagagaaauucaaggaauguaaacggugu

SEQ ID NO: 46500 - RNA, 64 nt, hsa
ccuaaaucuuacuaaacauaaaaaaacuuaaacuggagagaaacuacaaagcuggaagacauca

SEQ ID NO: 46501 - RNA, 64 nt, hsa
ucaacuuuuauuaaaacacaagauaauucauacuggagagaaauccuacaaaugugauaaaugu

SEQ ID NO: 46502 - RNA, 64 nt, hsa
cuuaaggcuuacuacauauaagacaacucauacuggagagaaaccaugcaugugugaagaaugu

SEQ ID NO: 46503 - RNA, 64 nt, hsa
cucaaaccuuguggaacauaagagaauucauacuggagagaaacccuacaaaugcgaagaaugu

SEQ ID NO: 46504 - RNA, 64 nt, hsa
cucaaucuuuauuacacauaagaaaauucaugcuggagagaaacacuacaaacgugaagaaugu

SEQ ID NO: 46505 - RNA, 64 nt, hsa
uucucagucuaguaaacauaagaaaauucauacuggagagaaaaucuacaaaggugaagaaugu

SEQ ID NO: 46506 - RNA, 64 nt, hsa
uucauccuaugcaaaacauaggagaauuuauacaggagagaaaccucacaagugugaugauugu

SEQ ID NO: 46507 - RNA, 64 nt, hsa
uucacauauugcaggucaucggugaacucauacuggagagaaaccuuacaaaugucaugacugu

SEQ ID NO: 46508 - RNA, 64 nt, hsa
uucacaccuggaacaacauacuggacuucacacuggagagaaaccuuacaaguguaaugagugu

SEQ ID NO: 46509 - RNA, 64 nt, hsa
aaucacaccuuaaagacauaggagaauuuauacuggagagaaagcuuacaaauguaagguuucu

SEQ ID NO: 46510 - RNA, 64 nt, hsa
uucauccuaugcaaaacauaggagaauucauacaggagagaaaccucacaugugugaugauugu

SEQ ID NO: 46511 - RNA, 64 nt, hsa
uucauacauugcaguucauugacacacucauacuggagagaaaccuuacaaaugucaugacugu

SEQ ID NO: 46512 - RNA, 64 nt, hsa
uucauccuaugcaaaacauaggaggauucauacaggagagaaacucacaagugugaugauugug

SEQ ID NO: 46513 - RNA, 64 nt, hsa
uucauauauugcuauucaucaucgaacucaugcuggagagaaaccuuauaaaugucaugauugu

SEQ ID NO: 46514 - RNA, 64 nt, hsa
uucacaccuggcacaccauacuagaauucacacuggagagaaaccuuacaagugcaaugagugu

SEQ ID NO: 46515 - RNA, 64 nt, hsa
uucauaccuuguaauucaaaaggcaauucguauuggagagaaacccuacaaguguaaugaaugu

SEQ ID NO: 46516 - RNA, 64 nt, hsa
uucauaccuggcaaaacauauuagaauucaaacuggagagaaaccuuacaaaugugaugagugu

SEQ ID NO: 46517 - RNA, 64 nt, hsa
uucaacccuuguaagucacaaagccauucauacuggagagaaacuuuacaaguguaaugaaugu

SEQ ID NO: 46518 - RNA, 64 nt, hsa
gucaaaccuuguauaccaucauagacuucauaguggagagaaaccuuaaaaguguaaugagugu

SEQ ID NO: 46519 - RNA, 64 nt, hsa
uucauccuaugcaaaacauaggaggauucauacaggagagaaaccucacaagugugaugauugu

SEQ ID NO: 46520 - RNA, 64 nt, hsa
uucaugccuugcauuucacuggugaacucaugcuggagagaaaccuuauaaaugucaugauuga

SEQ ID NO: 46521 - RNA, 64 nt, hsa
uucacacguggcaccccauacuagaauucacacuggagagaaaccuuacaagugcaaugagugu

SEQ ID NO: 46522 - RNA, 64 nt, hsa
aaaaggucaaaauucacaccuuguaauucauaguggagagaaaccuuacaagcacaaugaaugu

SEQ ID NO: 46523 - RNA, 64 nt, hsa
ugcauaucuggcaaaacauacuagaauucacacuggagagaaacucauuauaaguguaaugagu

SEQ ID NO: 46524 - RNA, 64 nt, hsa
agcaaccuuugcacaucaccauagacuucauacuggagagaaaccuuacaaaugggaggaaugu

SEQ ID NO: 46525 - RNA, 64 nt, hsa
auucaacccuguaagucauaaggcaauucauacuggagagaaaccuuacaagcauaaugaaugu

SEQ ID NO: 46526 - RNA, 64 nt, hsa
uaaauaaauuaaaagagcgguuuguguagaaauuggagagaacuauguuuuauaugaaucacaa

SEQ ID NO: 46527 - RNA, 64 nt, hsa
auaaacauugcuguauguuacaguaaagcuaucuggagagaacacauaaaugauuuuggcauac

SEQ ID NO: 46528 - RNA, 64 nt, hsa
cuuuacugaaagacuugguuaucaagucuuuuggggagagaaugacauuuuuuuuuugagacag

SEQ ID NO: 46529 - RNA, 64 nt, hsa
ccuuaaaacaccuguucuccagcccuuggacaguggagagaaucuguaaaagugugacccccuc

SEQ ID NO: 46530 - RNA, 50 nt, hsa
ccggaaccgacgaguccugaggagagaaccggugcguccugaggagagaa

SEQ ID NO: 46531 - RNA, 64 nt, hsa
gacgaguccugaggagagaaccggugcguccugaggagagaaccggcgcugggcaacacgggcc

SEQ ID NO: 46532 - RNA, 64 nt, hsa
guaugcaccaaacugugaaugcauccagcuguuggaaaaugauguauaagucuaaguccucuug

SEQ ID NO: 46533 - RNA, 64 nt, hsa
acagaagcuuuugccaugggccccucacaucagggaaaaugaccuucacugcuguuaacaguaa

SEQ ID NO: 46534 - RNA, 64 nt, hsa
acucuacuuaaguauucucuguguuuuaugaagagaaaaugaucugauuuucccuuauacuuca

SEQ ID NO: 46535 - RNA, 64 nt, hsa
gggauauucuguggguuuuggcauauuagauagagaaaaugacagaucuagaugaagggagcuu

SEQ ID NO: 46536 - RNA, 64 nt, hsa
uuuaaaggaaacuuugaaaggauugugaauacuggaaaaugacaaaacuaaagguagaucuauc

SEQ ID NO: 46537 - RNA, 64 nt, hsa
cuuuucugcacuuccauuucugacaccugaaaaugaaaaugauaauccuaacuuauacaccaag

SEQ ID NO: 46538 - RNA, 64 nt, hsa
accuagcuuuucugcacuuccauuucugacaccugaaaaugaaaaugauaauccuaacuuauac

SEQ ID NO: 46539 - RNA, 64 nt, hsa
aauaauagaauaaaggguugaguaacuuagaacugaaaaugaucucuuuuaaaaagaaauuaaa

SEQ ID NO: 46540 - RNA, 64 nt, hsa
uuaauuuaaugcugaggagaguuugacagauuuugaaaaugaguaaaggcaaaaaaaauuuuuu

SEQ ID NO: 46541 - RNA, 64 nt, hsa
auuagucgaaaauaaagguugauuuagaaaugaagaaaaugaauauauuucuuaauacaaaaua

SEQ ID NO: 46542 - RNA, 64 nt, hsa
ggaauacacuaauuuuugcuccucuauaugugaggaaaaugagacuagacagauuuaaguaauu

SEQ ID NO: 46543 - RNA, 64 nt, hsa
gagaagagaugcugccauuuaaccccuugguacugaaaaugagaaaauccccaacuaugcaugc

SEQ ID NO: 46544 - RNA, 64 nt, hsa
ucugcuacuucacugucaucuucaauuuauuacugaaaaugauuccuggacaucaccaguccua

SEQ ID NO: 46545 - RNA, 64 nt, hsa
uaacuucacuucuuuguauauuauguauaaauuagaaaaugaaaaaugugugaauaacauugua

SEQ ID NO: 46546 - RNA, 64 nt, hsa
cucuguuggcacaggcauuaucucugcaauuuuagaaaaugacaaguagagaauacuacauuga

SEQ ID NO: 46547 - RNA, 64 nt, hsa
aaacccuuuaacagugugaaucuuuauaguauuugaaaaugagaagaagcagcagauuguaauu

SEQ ID NO: 46548 - RNA, 64 nt, hsa
ggaggugaaaggcacuucuuacauggcagcaagagaaaaugaggaagaagcaaaaguggaaacc

SEQ ID NO: 46549 - RNA, 64 nt, hsa
uucugugugcugcagccugaguuuuuaaaaaacagaaaaugaggggccagguguggugguggcu

SEQ ID NO: 46550 - RNA, 64 nt, hsa
uuauaaaacauucaaauucugauauacauugcuugaaaaugagugaguaccucagagaaauuug

SEQ ID NO: 46551 - RNA, 64 nt, hsa
gugaauuuugugcucuuguuuguauuuuauuaaggaaaaugaaaauaaucuggcaucaguuuca

SEQ ID NO: 46552 - RNA, 64 nt, hsa
auuuaaaauauagauguguuuuauuuugaagugagaaaaugaacauuaacaggcauguuuguac

SEQ ID NO: 46553 - RNA, 64 nt, hsa
agucgguuaaaauggauuucaugauuuucccucagaaaaugaguaacagaguccacggcgugca

SEQ ID NO: 46554 - RNA, 64 nt, hsa
gucacaggguguucuuuuuuaugaagaaaaauuugaaaaugauaaaagcuaagaugccuucuaa

SEQ ID NO: 46555 - RNA, 64 nt, hsa
aggauuugaaauugcauuacaguucauaaaaauugaaaaugagaaauuaaaccugcaagugaaa

SEQ ID NO: 46556 - RNA, 64 nt, hsa
aguaaaaauagugaagacaugcaucauggaaugagaaaaugagaaaggaaugaguugucuaaca

SEQ ID NO: 46557 - RNA, 64 nt, hsa
ucucugccuuaggcucccaggggaauccaagacagaaaaugaagacacuggcuuccaacagcag

SEQ ID NO: 46558 - RNA, 64 nt, hsa
aauuuuuauaaaugaaaauauuuuaaugguuuaagaaaaugaggacaacaggauaauaucuuug

SEQ ID NO: 46559 - RNA, 64 nt, hsa
cgauucagacucugacacagacaguagucaagaagaaaaugaagugacagaacauaccccuuua

SEQ ID NO: 46560 - RNA, 64 nt, hsa
agacgacaaugaagauacugacaguagugaugcagaaaaugaaauuaaugaacaugaugucgug

SEQ ID NO: 46561 - RNA, 64 nt, hsa
gggaaggauuuaacaccgauauauuguuaccgcugaaaaugaacuuuaugaaccuuuuccaagu

SEQ ID NO: 46562 - RNA, 64 nt, hsa
cuuccccgcacccacgugcccuagauucauggcagaaaaugaccaaauccuguguauuuguuuu

SEQ ID NO: 46563 - RNA, 64 nt, hsa
uaaauguuacuuguuuucaaacuuuguuuucuaugaaaaugauauggaaacuucuaaaauggaa

SEQ ID NO: 46564 - RNA, 64 nt, hsa
auaaaagagaauaggcugcccauauaagucaaaggaaaaugagcccaggccuugcuaugaagca

SEQ ID NO: 46565 - RNA, 64 nt, hsa
ucaauuuuuaaaacuuuuuuuuaauuacuguaaagaaaaugaauuuuuuccugcagcaggaaac

SEQ ID NO: 46566 - RNA, 64 nt, hsa
aaauccauuaaggguccaagaagucuguccauaugaaaaugaggguaaauauaguuuauuuccc

SEQ ID NO: 46567 - RNA, 64 nt, hsa
gaagaugcuuagggaacaauggauaccaaugauagaaaaugauaccuuuacaggggcagaaaaa

SEQ ID NO: 46568 - RNA, 64 nt, hsa
ugcaaaaacuuggauucacaaaugucccugaacagaaaaugaagcucacuucagaacacacacu

SEQ ID NO: 46569 - RNA, 64 nt, hsa
uuaacccuaagguaaaaaugcauuugcaaagggagaaaaugaaggccaaacagaagcaggcucc

SEQ ID NO: 46570 - RNA, 64 nt, hsa
uacuuuggguauccuguaauuuaguuguaacauagaaaaugaaaaaacaguuaaaaaaagugaa

SEQ ID NO: 46571 - RNA, 64 nt, hsa
uguaaagucacaaauuaaugaaaaaaauucgcaugaaaaugacagauaacacuguaguuccuaa

SEQ ID NO: 46572 - RNA, 64 nt, hsa
ccacuccauuuuuuuucuauuuuuaagauuagaggaaaaugaccauuaagaaccagaaaaauaa

SEQ ID NO: 46573 - RNA, 64 nt, hsa
aaaacuguaaaauuauagcacuaacuugauuuuagaaaaugagcauuuuuuacaacugccauuu

SEQ ID NO: 46574 - RNA, 64 nt, hsa
gguucuaaagaaaucuagaugagagaaaguauuugaaaaugauuuuuaaauguuuuuuaaaaga

SEQ ID NO: 46575 - RNA, 64 nt, hsa
gagcauugcuuguaaaauccugaguuuccauaaggaaaaugaaaacuccuuuuaaaaauaaaau

SEQ ID NO: 46576 - RNA, 64 nt, hsa
uugucagcauccagccauguccuaucuagauuaggaaaaugaucagaauauuccagcucaacaa

SEQ ID NO: 46577 - RNA, 64 nt, hsa
ccgauuagaggcuacuuccuguaaacaaguacaggaaaaugaaacuagacgggugggggacacu

SEQ ID NO: 46578 - RNA, 64 nt, hsa
acuaugcaagaaaauguacaguugucgaaguggagaaaaugaggauauauucuugcagacgagc

SEQ ID NO: 46579 - RNA, 64 nt, hsa
aaaguaaacuaaaaugacacagaggaaaguagaggaaaaugaaauaauuucgguacaucuuaug

SEQ ID NO: 46580 - RNA, 64 nt, hsa
uuaucauccuccuagcagaagauaguccuacugagaaaaugagcacuuugaucauucagucuuu

SEQ ID NO: 46581 - RNA, 64 nt, hsa
cuuauguagaccagaagcugcaauauacaaugaugaaaaugaaacgaaaaggaaguccccccau

SEQ ID NO: 46582 - RNA, 64 nt, hsa
ugagggagguuggcauggagacuaaaauucucaggaaaaugagauccguguuagauuagaaguc

SEQ ID NO: 46583 - RNA, 64 nt, hsa
gaagaaaugauauuuauauucucuauaggggacagaaaaugagaagccaucacucuuuuuggau

SEQ ID NO: 46584 - RNA, 64 nt, hsa
cugucacgugcuggaaaauaaagugauacaucuugaaaaugaauccaguguguuggauuccaga

SEQ ID NO: 46585 - RNA, 64 nt, hsa
aaaaaaauaauaaucaaaugccuucaauuucugagaaaaugaggcagagcauggaaaaggaaua

SEQ ID NO: 46586 - RNA, 64 nt, hsa
ucagugauucuuuacuugcaaauucaggggcuuagaaaaugaaagcaaacacaaaaccuugagu

SEQ ID NO: 46587 - RNA, 64 nt, hsa
ggcaaaaagcacuucuuacauggcggcagcaagagaaaaugagaaagaagcaaaaguggaaacc

SEQ ID NO: 46588 - RNA, 64 nt, hsa
ggugaaaagcacuucguacauggugguggcaagagaaaaugaagaagaagcaaaaguggaaacc

SEQ ID NO: 46589 - RNA, 64 nt, hsa
gaaaacaaaaugaggcauuuuguuaaggggguaggaaaaugacugauuguugggcccuuuggca

SEQ ID NO: 46590 - RNA, 64 nt, hsa
ugccuugaauauugcuuccauguauuuuggaaaagaaaaugauuucauuuauaaaugaacauac

SEQ ID NO: 46591 - RNA, 64 nt, hsa
aacuuuauuuuuuucaugcuuauuuguguuuuuugaaaaugaagaaguuagagcuuuauaacua

SEQ ID NO: 46592 - RNA, 64 nt, hsa
auucagaaaaauauauauuaauuuaauucugcaagaaaaugauuuaacagauggguaacuuuau

SEQ ID NO: 46593 - RNA, 64 nt, hsa
cuuuugcaauaccucaauuuugaaauauaggaaagaaaaugauauuuucuaaguaaguuuauuc

SEQ ID NO: 46594 - RNA, 64 nt, hsa
uccaucaaaagguucuuuuuuuauaaucccuuuugaaaaugauaaucaaaggaagagauguggu

SEQ ID NO: 46595 - RNA, 64 nt, hsa
gaaauaguauuaaaugucucaaagcacaugauuagaaaaugagaucuuuuaaaugagcaagaga

SEQ ID NO: 46596 - RNA, 64 nt, hsa
aaggaaugagaaacaauuuugaugaauuuaagcagaaaaugaauuucugggaacuuuuuugggg

SEQ ID NO: 46597 - RNA, 64 nt, hsa
uggacaaaccgagugcaaugaaugaugcuuuucugaaaaugaaauauaacaagugggugaaugu

SEQ ID NO: 46598 - RNA, 64 nt, hsa
uuaugcagaaaaaaaugaggccgaaaauuuagaggaaaaugaagagcccuucguugcccccuua

SEQ ID NO: 46599 - RNA, 64 nt, hsa
cuuugcuccaauaagcuuugcaaucaaggccaaagaaaaugaucugcuuccccuggaaaaaaau

SEQ ID NO: 46600 - RNA, 64 nt, hsa
guaagguuucaagguacaguuauggaggaaagaagaaaaugacacauugauaacacaggucuuu

SEQ ID NO: 46601 - RNA, 64 nt, hsa
agaagcaggcaccuuuuucacagggcggcaggaugaaaaugacugccagcaguggaaaugccag

SEQ ID NO: 46602 - RNA, 64 nt, hsa
gggaggugcaacuggcagggccugaucagaggcagaaaaugacccccacaguggucuuuucccu

SEQ ID NO: 46603 - RNA, 64 nt, hsa
augguuguccacccuggggguuuuuccucugaaggaaaaugaacccaucuuuugccugccauga

SEQ ID NO: 46604 - RNA, 64 nt, hsa
aauuguuuacuggauuuauaagaaguuaauuuuugaaaaugacauauuuuugugugauagaaag

SEQ ID NO: 46605 - RNA, 64 nt, hsa
uuuauuuagcauagacauuaaagauaacucucuggaaaaugacuugacuaaggcucucaugaaa

SEQ ID NO: 46606 - RNA, 64 nt, hsa
uuauuuuaaaaaauuauguuuucaucauucauuugaaaaugaaaaagccccaaagugagaacuu

SEQ ID NO: 46607 - RNA, 64 nt, hsa
uaacaaguguaaugagaaaguucaugugucacaugaaaaugaucauguuuguguugcuacagcu

SEQ ID NO: 46608 - RNA, 64 nt, hsa
aagccauuuaaggguggaccuccgcgacgauucugaaaaugagcucucugccaagguuuuaaga

SEQ ID NO: 46609 - RNA, 64 nt, hsa
aaaaggugaucccucuaagaaagaaaugaagaaagaaaaugaugaaaagaguaguucaagaagu

SEQ ID NO: 46610 - RNA, 64 nt, hsa
gaaucugacaggacagcuuuaagcccaugugcaagaaaaugagggcuugagucgccugaaccaa

SEQ ID NO: 46611 - RNA, 64 nt, hsa
gaaucuggcaggacagcuuuaagcccaaguggaagaaaaugagggcuugagucgccugaacgaa

SEQ ID NO: 46612 - RNA, 64 nt, hsa
ugccagugagaagugcaacauccagugggcagaugaaaaugaugcauggccaaguucaguguuu

SEQ ID NO: 46613 - RNA, 64 nt, hsa
ccuuccccaucaaauccuugauaaggcuuugugggaaaaugaucuaaauuauuguuuuaauuuu

SEQ ID NO: 46614 - RNA, 64 nt, hsa
guuacaggugacggacgccucaagagagagaagagaaaaugaaagcagcugguuuugcagaagu

SEQ ID NO: 46615 - RNA, 64 nt, hsa
ccccuggggucuuaccucacugggaauguguuuugaaaaugaauuugaagacaagccaacaaac

SEQ ID NO: 46616 - RNA, 64 nt, hsa
cacaauuggcaauaaaaccuguguguuugagaaggaaaaugacccaucggugaugcgcucaccu

SEQ ID NO: 46617 - RNA, 64 nt, hsa
auugucuguugcaggucuucguguggacuggcaggaaaaugauuuuucaaaacguaucuuaaau

SEQ ID NO: 46618 - RNA, 64 nt, hsa
ucaauguauuauuuuuguagauagaagcuuuggagaaaaugaaugaagaucacguucagaagaa

SEQ ID NO: 46619 - RNA, 64 nt, hsa
gacauaagucauguaauuuuuguugauauaucaugaaaaugaacagaauucuuuuuccauacuu

SEQ ID NO: 46620 - RNA, 64 nt, hsa
cgucauugauagcaaaagaaagguacaggcuuacgaaaaugaucuuuacaauguaucccagcuu

SEQ ID NO: 46621 - RNA, 64 nt, hsa
uaauagggaaagaagaguuacagaaaaugaaaaagaaaaugaguuacacugagaaugaauaugg

SEQ ID NO: 46622 - RNA, 64 nt, hsa
gaguauguggaguaauagggaaagaagaguuacagaaaaugaaaaagaaaaugaguuacacuga

SEQ ID NO: 46623 - RNA, 64 nt, hsa
aagcaaaagcuggaagcauuccccuugagaacuggaaaaugacagggaugaccacucucaccac

SEQ ID NO: 46624 - RNA, 64 nt, hsa
aggcucuuauccuaagugaauuaaugcaggaacagaaaaugaaauaucccauguucucacuuau

SEQ ID NO: 46625 - RNA, 64 nt, hsa
gccugaaaugccuuaauugugaacugauaugcaggaaaaugaaauaugcaagcacauuggugac

SEQ ID NO: 46626 - RNA, 64 nt, hsa
gcagaauaaacucuuuacaauuaauaacucaguggaaaaugauguucagauggugaaaugugga

SEQ ID NO: 46627 - RNA, 64 nt, hsa; identical to SEQ ID NO: 46626

SEQ ID NO: 46628 - RNA, 64 nt, hsa
gccugaaaugccuuaauugugaacugauacgcaggaaaaugaaauauguaagcacauuggugac

SEQ ID NO: 46629 - RNA, 64 nt, hsa
uguaauucauucaguggugccaaagcuggggguucccuacaauggcuauuuagacuuucccugc

SEQ ID NO: 46630 - RNA, 64 nt, hsa
uuucaucagaaguuuucauuuuuucuaaauccuccccuacaaaauuuucagauuggaaauuacu

SEQ ID NO: 46631 - RNA, 64 nt, hsa
aacuguagauaagaaaauucauacuggaaagaaacccuacaaaugugaagucuguggcaaagcu

SEQ ID NO: 46632 - RNA, 64 nt, hsa
uacuacauguaagaguauuuauacuggaaagaaacccuacaaauguaaaaaacguggcaaugcc

SEQ ID NO: 46633 - RNA, 64 nt, hsa
cacugaacauaaguuaauucauacuggagaaaaacccuacaaauguaaagaauguggaaaagcu

SEQ ID NO: 46634 - RNA, 64 nt, hsa
uauuacacauaagauaauucacaguggagaaaaacccuacaaaugugaagaauguggcaaagcu

SEQ ID NO: 46635 - RNA, 64 nt, hsa
uaugagacauaagaaaauucauaguaaagagaaacccuacaaaugugaacaguguggcaagguc

SEQ ID NO: 46636 - RNA, 64 nt, hsa
uacuaaacacaagaagauucauacuagagagaaacccuacaaaugugaagaauguggcauaucu

SEQ ID NO: 46637 - RNA, 64 nt, hsa
ugcuauacauaagaugauucacacuugaaugaaacccuacaaaugugaacgauguggcaguugu

SEQ ID NO: 46638 - RNA, 64 nt, hsa
cuuaguaaauuugagaguuuauauggaacacaaacccuacaaauauaaagaaugugacaaagcu

SEQ ID NO: 46639 - RNA, 64 nt, hsa
acccuuauuacacauaauucauaccaaacagaagcccuacaagugugaagaauguggcaaaacc

SEQ ID NO: 46640 - RNA, 64 nt, hsa
uaauacacauaagauaauuaaugcuggagagaaacccuacaaaugugaagaauguggcaaagau

SEQ ID NO: 46641 - RNA, 64 nt, hsa
gccuacacguaagauaauucauacuggaaggaaacccuacaaauaugaggaaugucucaaagcu

SEQ ID NO: 46642 - RNA, 64 nt, hsa
uacugcacauaagauaauuuauacuggagagaagcccuacaaaugugaaaaauguggcaaaccu

SEQ ID NO: 46643 - RNA, 64 nt, hsa
uacuacacauuagauaauucaugcuggagagaaacccuacaaaugugaaaaauguggcaaagcu

SEQ ID NO: 46644 - RNA, 64 nt, hsa
uuuauugaacaaaauaauucauacaggagagaaacccuacaaaugugaagaaugugacaaagcc

SEQ ID NO: 46645 - RNA, 60 nt, hsa
uuacuaaacauaauucauaauggagaaaaacccuacaaaugugaagaaugugucaaagcu

SEQ ID NO: 46646 - RNA, 64 nt, hsa
cuuacuaaacauaagggaauucauaauagagaaacccuacaaaugugaagaacguggccuggcu

SEQ ID NO: 46647 - RNA, 64 nt, hsa
ucaaagacaugaaaggacucauacuggagagaaacccuacaaauguaaggaaugugggaaagcc

SEQ ID NO: 46648 - RNA, 64 nt, hsa
ucaaagacaugaaaagacucauacuggagagaaacccuacaaaugcaaggaaugugggaaagcc

SEQ ID NO: 46649 - RNA, 64 nt, hsa
ucaaaaacaugaaaaggcucauacuggagagaaacccuacaaauguaaggaaugugggaaaccc

SEQ ID NO: 46650 - RNA, 64 nt, hsa
uacugaacauaagggaauuuauacaggagggaaacccuacaaaugugaagaauguggcaagccu

SEQ ID NO: 46651 - RNA, 64 nt, hsa
acuacucauaaaagaauucauacuggaggaaaagcccuacaaaugugaaaaacguggcaaagcu

SEQ ID NO: 46652 - RNA, 64 nt, hsa
uguggaacauaagagaauucauacuggagagaaacccuacaaaugcgaagaaugugauaaagac

SEQ ID NO: 46653 - RNA, 64 nt, hsa
uuuccagauggcuaguuuauuaaugauuucccaaaagccauaccuuaaagauaacuuuuuaaau

SEQ ID NO: 46654 - RNA, 64 nt, hsa
aguauuuuggaauuuguauaauaaggauguuuagaagccauauaaguggcuuuuuuuaacagau

SEQ ID NO: 46655 - RNA, 64 nt, hsa
gcauugaccuucaugaccuuacauagcuuuagagaagccauaacguuagacugcaauacuaacg

SEQ ID NO: 46656 - RNA, 64 nt, hsa
agggacgagcagagcgcagcccccacgccgauauaagccauagccccaggcccgcccugcccgc

SEQ ID NO: 46657 - RNA, 64 nt, hsa
gugucuccagguaacuuugcuugauuaaacagcaaagccauauucuaaauucacuguugaaugc

SEQ ID NO: 46658 - RNA, 64 nt, hsa
cgcuuagaaacauguuccuguuccucgggaugaaaagccauaucuagucaauaacucugauuuu

SEQ ID NO: 46659 - RNA, 64 nt, hsa
cagugaccuuugaccucggugaccacucuucuuuaagccauagacccugaggcccugggcuggg

SEQ ID NO: 46660 - RNA, 64 nt, hsa
ccuggacacauuggaaugccuuggaaauagaaagaagccauauaugaccagaagccuuggaacc

SEQ ID NO: 46661 - RNA, 64 nt, hsa
uucauuuugugaauuauagaagcuacuuuuuauaaagccauauuuuuuuagggaaacuaaggag

SEQ ID NO: 46662 - RNA, 64 nt, hsa
aucauuuugaaaggaccaugagcaacuauaagcaaagccauaagaagugguuugaucgauauau

SEQ ID NO: 46663 - RNA, 64 nt, hsa
ugaggccacuuaucagggccuggagcccugauggaagccauaggaacuccagaguugccaagcc

SEQ ID NO: 46664 - RNA, 64 nt, hsa
cccugauggaagccauaggaacuccagaguugccaagccauagcugagaagccuggugguuuuc

SEQ ID NO: 46665 - RNA, 64 nt, hsa
guguccaggcucugggcacagugcugccccuugcaagccauaacgugcccccagaguguagggg

SEQ ID NO: 46666 - RNA, 64 nt, hsa
auaacgugcccccagaguguagggggccuugcggaagccauagggggcugcacgggaugcgugg

SEQ ID NO: 46667 - RNA, 64 nt, hsa
uucuguucucuauuaaauuaagaaaauguuccaaaagccauaagccugaagauuggcccugugc

SEQ ID NO: 46668 - RNA, 64 nt, hsa
ggacccuuaagaauuuuauuuuuaaaggagauugaagccauagaacucauauugacacucagcu

SEQ ID NO: 46669 - RNA, 65 nt, hsa
cuaccacugagcugcuggagguggguccuuauuucaagccauauucaacccacccaacaaaaccu

SEQ ID NO: 46670 - RNA, 65 nt, hsa
acaguuguuaacccacuaggcuccuuugaguagagaagccauaguccuucagccuccaauugaua

SEQ ID NO: 46671 - RNA, 65 nt, hsa
gaugaaaagagcucuaaugccuuucaggcucuuagaagccauagauuuggacaagcccagcaaga

SEQ ID NO: 46672 - RNA, 65 nt, hsa
cccuuuguaauaaaaagcuaguuuccugagugaacaagccauaaccuccccuaaacaccaccuag

SEQ ID NO: 46673 - RNA, 65 nt, hsa
agacaguguacaaacuaagaaggccuaacugaacuaagccauauuuaucacccguggacagcaca

SEQ ID NO: 46674 - RNA, 65 nt, hsa
gucucuuucgggggcagaggcuuucucugggugccaagccauauauauuagggaauaguagauug

SEQ ID NO: 46675 - RNA, 65 nt, hsa
gcucaggaaguuucucugugcaacuagaaaauucaaagccauauuuagggaacauuuuuucugag

SEQ ID NO: 46676 - RNA, 65 nt, hsa
gucuguagaccuuguaaucagcacauugucaccccaagccauagucucucucuuauuuguauccu

SEQ ID NO: 46677 - RNA, 65 nt, hsa
guucacacuucugcuuugagaccaggaugggguguaagccauagaguaagguuaacaaaaagaau

SEQ ID NO: 46678 - RNA, 65 nt, hsa
uaauucuucagauaugagauagugggcuuagaccuaagccauacauauuucuuuucccacauucu

SEQ ID NO: 46679 - RNA, 65 nt, hsa
gaggcaacagcagcaagggcuggucuggacaagaaaagccauagcccggcagccccuaccaugag

SEQ ID NO: 46680 - RNA, 65 nt, hsa
cuuccaagucugagcugugcugggguuugaacuaaaagccauauguggaauauugacauguguaa

SEQ ID NO: 46681 - RNA, 65 nt, hsa
augggcuggccaggcugugucaccuucuccaagcaaagccauauggagcaucuacccagacuccc

SEQ ID NO: 46682 - RNA, 65 nt, hsa
uaagcauaguuuuauccagggagaaaaauaaaaggaagccauagaauugcucuggucaaaaccaa

SEQ ID NO: 46683 - RNA, 65 nt, hsa
gaaguauuugggcaggugagucauguuuuaaccacaagccauaacucaucuguugucuuugcuug

SEQ ID NO: 46684 - RNA, 65 nt, hsa
uggcagugacuucuuuugaguuagguuaauaaaucaagccauagagccccuccugguugauacuu

SEQ ID NO: 46685 - RNA, 65 nt, hsa
aaaauuauguaauacuuguggaacuuugauaaaugaagccauaucugagaauguagcuacucaaa

SEQ ID NO: 46686 - RNA, 65 nt, hsa
uguuuauuugugaaguuaaaaguaaauagcauuuuaagccauaaugucccaaaauagauguucug

SEQ ID NO: 46687 - RNA, 65 nt, hsa
gaucuucagaaucucuaguuuuuguucuauagauaaagccauaagaauccuuuccuaccaguuuu

SEQ ID NO: 46688 - RNA, 65 nt, hsa
aggaauauuuugcagaauauagguuuaacugaaugaagccauauuaauaacugcauuuuccuaac

SEQ ID NO: 46689 - RNA, 65 nt, hsa
caggggauuuuuuuuucuccuuuuuuuuucuuuuuaagccauaauuggugauacugaaaacuuug

SEQ ID NO: 46690 - RNA, 65 nt, hsa
gaggggagauuuaaaggaccagggacaugggaaccaagccauagggaucagagggccuuguccuu

SEQ ID NO: 46691 - RNA, 65 nt, hsa
uaggagucugcgagagccuccuugguuccaucgugaagccauaaacaggaaugccuuuggcaaua

SEQ ID NO: 46692 - RNA, 65 nt, hsa
aagguggggaaaaagacuaaccuguccuacccucaaagccauaugcaaauacugaaaagaaggcc

SEQ ID NO: 46693 - RNA, 65 nt, hsa
gaaucauggagcugagaauuucacagauacuuuauaagccauaguacaugagcuuaauaggcugu

SEQ ID NO: 46694 - RNA, 65 nt, hsa
auacucuuucacuuaauucuuuacaagggauaucaaagccauaauggacuucauuaguuuuaggg

SEQ ID NO: 46695 - RNA, 65 nt, hsa
ucuugauuuucccauuucuaaagaugaauuucacaaagccauaaagcgugaaauuagagcuggac

SEQ ID NO: 46696 - RNA, 65 nt, hsa
auuccuaagaacuuucuaucaaaagcauuggauccaagccauauauugaaauacaagcgugauua

SEQ ID NO: 46697 - RNA, 65 nt, hsa
gacacagaagauugccuuacgcucgugagcgugagaagccauaagagagagaccgaauucugugg

SEQ ID NO: 46698 - RNA, 65 nt, hsa
aauuguuuaauuucaccugaauaucauaaugcuuaaagccauauggaguuggaaauuauuuccaa

SEQ ID NO: 46699 - RNA, 65 nt, hsa
uuuuccagauggcuaguuuauuaaugauuucccaaaagccauaccuuaaagauaacuuuuuaaau

SEQ ID NO: 46700 - RNA, 65 nt, hsa
uaguauuuuggaauuuguauaauaaggauguuuagaagccauauaaguggcuuuuuuuaacagau

SEQ ID NO: 46701 - RNA, 65 nt, hsa
gagaccacuuagagggucucuaugccaaggucaacaagccauaccauccacugguuccagcugac

SEQ ID NO: 46702 - RNA, 65 nt, hsa
gaagacaagugaugcuaaaaccugaaauuccaaugaagccauaugaacagcuguucaguugcacu

SEQ ID NO: 46703 - RNA, 65 nt, hsa
auuacuugcugcaguugcaacuaugcacuuguauaaagccauaauguuggaguuuauaucacuca

SEQ ID NO: 46704 - RNA, 65 nt, hsa
aucgauaguguuuucuucaaugcugcugcugugugaagccauacuuuuucaggauucuuccccua

SEQ ID NO: 46705 - RNA, 65 nt, hsa
agagagaaacaaaaaagugugacauuacagaugagaagccauauaauggcgguuugggggagccu

SEQ ID NO: 46706 - RNA, 65 nt, hsa
uaaaaaagacaacuuuauaaaauggcacuuuaagcaagccauaguuaguuuuauuuuuguaaugc

SEQ ID NO: 46707 - RNA, 65 nt, hsa
ucacauuuuauuuggagauauuuaaaugaaauagaaagccauauaacauagcuauaauuacuacc

SEQ ID NO: 46708 - RNA, 65 nt, hsa
uauaacuauuaccuuaaaaagcacugguuuagaaaaagccauaacuuaaauaguguuauaaaaua

SEQ ID NO: 46709 - RNA, 65 nt, hsa
acagugacuaugcauuagugcugacucuuugguauaagccauaaaauauuuuccuuccuaucaau

SEQ ID NO: 46710 - RNA, 65 nt, hsa
auccacauuuugaaaugcaaagaaagcucccuuguaagccauacuuccuuccccacucccauccu

SEQ ID NO: 46711 - RNA, 65 nt, hsa
acacaauauuauauugcauauugcccaauaagcagaagccauaaggucucacacuuuucuuauaa

SEQ ID NO: 46712 - RNA, 65 nt, hsa
auaauuugaaagcuaugagaauagaugugugggugaagccauagaacauauuugcuugaaauucu

SEQ ID NO: 46713 - RNA, 65 nt, hsa
cccaggcucccuuugcacacagagcagcuacuucuaagccauaucgacuguuuugcagaggauuu

SEQ ID NO: 46714 - RNA, 65 nt, hsa
uuagacuuuuguauaagagaugucaugccucaagaaagccauaaaccugguaggaacagguccca

SEQ ID NO: 46715 - RNA, 65 nt, hsa
uucagggcagacggcaauaaucucuuacaagaaugaagccauauucaaccccagaugagaaaacc

SEQ ID NO: 46716 - RNA, 65 nt, hsa
uguugcuaauauugaggaggcuugccccacccaacaagccauaguggagagaacugaauaaacag

SEQ ID NO: 46717 - RNA, 65 nt, hsa
guaaaaagucuuuaagacauaagaauuccucaaagaagccauacauuuuuuaagguggggauuga

SEQ ID NO: 46718 - RNA, 65 nt, hsa
caagcuaaaccucaaauauaaaaauuggcgaaaagaagccauacgccuuuuuaauuugccaaaaa

SEQ ID NO: 46719 - RNA, 65 nt, hsa
uuauuagccagugaaacacuugcuugccaacugccaagccauacuuauuaaguucgaacauguuu

SEQ ID NO: 46720 - RNA, 65 nt, hsa
aaaucugucucagccuacuuuauuccugcauugggaagccauaucgcagagcuaaaugcaauaga

SEQ ID NO: 46721 - RNA, 65 nt, hsa
gcgggcucagccuuccuggacacacuaggugugggaagccauaggagccuccagaugggggcugg

SEQ ID NO: 46722 - RNA, 65 nt, hsa
uuuuuggucucuuuugguggggugggggugggcuaaagccauaggaagaaaaaugugauguaugu

SEQ ID NO: 46723 - RNA, 65 nt, hsa
uagcuuuuaauucagcugcaugaccugugccuuuuaagccauaaagauaccucaagccuagcacc

SEQ ID NO: 46724 - RNA, 65 nt, hsa
aaccauagaaauguaaaagaugugacaaaaccuuuaagccauacuccaggcuucuuaaacauaau

SEQ ID NO: 46725 - RNA, 65 nt, hsa
ucugugcauacucagcuuuguagaaccaugcugcaaagccauauaccgaugggguuauccaugca

SEQ ID NO: 46726 - RNA, 65 nt, hsa
cugccucuguauagauguugucaguuaggaaacugaagccauaggucaggcagacaucagcucag

SEQ ID NO: 46727 - RNA, 65 nt, hsa
acuuacuggugcauguuguaacauaucuaugauaaaagccauaguuuaccuaaaauggugauuuc

SEQ ID NO: 46728 - RNA, 65 nt, hsa
ggcgcaucauaugcagugauauaugccuauaauauaagccauagguucacaccauuuuguuuaga

SEQ ID NO: 46729 - RNA, 65 nt, hsa
ggcauugaccuucaugaccuuacauagcuuuagagaagccauaacguuagacugcaauacuaacg

SEQ ID NO: 46730 - RNA, 65 nt, hsa
gagggacgagcagagcgcagcccccacgccgauauaagccauagccccaggcccgcccugcccgc

SEQ ID NO: 46731 - RNA, 65 nt, hsa
uuacccugcuugaaauacaguuaguugauaacauaaagccauaguuuucuuggauuuucuuccaa

SEQ ID NO: 46732 - RNA, 65 nt, hsa
cuucuaguauuggaucugaaaauaaagugucauccaagccauaaaaaaaaaagaaaagaaaaaua

SEQ ID NO: 46733 - RNA, 65 nt, hsa
aggaggaaaacauuagggaaaacaaaaaugauauaaagccauaugagguuauauugaaauguauu

SEQ ID NO: 46734 - RNA, 65 nt, hsa
ccucucccaucacuucccuacauggaguauaugucaagccauaauuguucuuaguuugcaguuac

SEQ ID NO: 46735 - RNA, 65 nt, hsa
acaacgaaagcugaauaguguuggaacugaggaggaagccauagcucagggucaucaagaaaaau

SEQ ID NO: 46736 - RNA, 65 nt, hsa
ugugucuccagguaacuuugcuugauuaaacagcaaagccauauucuaaauucacuguugaaugc

SEQ ID NO: 46737 - RNA, 65 nt, hsa
gcgcuuagaaacauguuccuguuccucgggaugaaaagccauaucuagucaauaacucugauuuu

SEQ ID NO: 46738 - RNA, 65 nt, hsa
uaaaaagaacucaaaaggagaacugugcucucccaaagccauaucaccagucuuaccaaacaaua

SEQ ID NO: 46739 - RNA, 65 nt, hsa
caugaaguauugaucauuuucuaucucaaaaguguaagccauaaggcuguuuuacagaauagcac

SEQ ID NO: 46740 - RNA, 65 nt, hsa
uaguuuuguguggcaucacagugauuugucaugaaaagccauauaugggggacaugcuaaaaugg

SEQ ID NO: 46741 - RNA, 65 nt, hsa
uucauaccaaguauuggguacagguuacaauuuugaagccauaugaguuuauauugauuuuuuuu

SEQ ID NO: 46742 - RNA, 65 nt, hsa
aaugguaagaaauugaaguauccuuaaaggccaugaagccauaugucccuaaagccuguguggag

SEQ ID NO: 46743 - RNA, 65 nt, hsa
uagguuugauucuuguuagaggguuuuuguucuggaagccauauuugauaguauacuuugucuuc

SEQ ID NO: 46744 - RNA, 65 nt, hsa
acuccuguggcaccguuucucccuccacagggccaaagccauaguguccggucccaaggacaagg

SEQ ID NO: 46745 - RNA, 65 nt, hsa
agacaugugucuucucuguccguuuccaauagguaaagccauaucaguuagacugcaauacuuua

SEQ ID NO: 46746 - RNA, 65 nt, hsa
gugaugauuaucauaugauaccucagugauuuuaaaagccauagaagaaacuugacuaugccugg

SEQ ID NO: 46747 - RNA, 65 nt, hsa
uuuuuuuucaagagaguuauuuuaaagauucaaggaagccauaagucauacuaaauaauauuaua

SEQ ID NO: 46748 - RNA, 65 nt, hsa
uuguaaaaguaauaauuccccaauaucaucuaaucaagccauauuuaaauuucugaaguuaacuc

SEQ ID NO: 46749 - RNA, 65 nt, hsa
uuuuuuuuuuuuuuuuuaagcucaaggagaaauugaagccauagucgugccuguuugcuuagcau

SEQ ID NO: 46750 - RNA, 65 nt, hsa
uucguuaauuaaaucugcaguuuuauuuuugaaggaagccauaacuauuuaauuuccaaauaauu

SEQ ID NO: 46751 - RNA, 65 nt, hsa
caagcuauuuuaaagauaauggcauuauuauuuccaagccauagcuugggcugaaggacaaauug

SEQ ID NO: 46752 - RNA, 65 nt, hsa
aaaaccauuaguaggaggggugggccauguucauuaagccauaguggucccuaguucauuguuga

SEQ ID NO: 46753 - RNA, 65 nt, hsa
gaaauggcccuuuugaauguugaagauaggaaagaaagccauauauucaaauauguaauuuuccu

SEQ ID NO: 46754 - RNA, 65 nt, hsa
uuccugagguggauuuacugagagaaggugaaauaaagccauauuuaguauaccagagaagguag

SEQ ID NO: 46755 - RNA, 65 nt, hsa
gagcacauuggugacagaccuucggggccugucugaagccauagccuccacggagagcccugugg

SEQ ID NO: 46756 - RNA, 65 nt, hsa
agacuugcuaaccaagcucgaaaaugaacaugaaaaagccauacauguauuauuucuccuaaaac

SEQ ID NO: 46757 - RNA, 65 nt, hsa
cuugguaccaaguccagguauaacauuccuauuggaagccauacuuauauuuucuuguaaagugc

SEQ ID NO: 46758 - RNA, 65 nt, hsa
uaaagacuuuagcugacucguuaagccugauacauaagccauauuuaaaauucuaagaaauaauu

SEQ ID NO: 46759 - RNA, 65 nt, hsa
ggaccaggauggacaacucauuggcccugccucaaaagccauaccucuucuccugcuaugcagaa

SEQ ID NO: 46760 - RNA, 65 nt, hsa
ugauuucccuaguaaccuugcagauauguuuaaccaagccauagcccaugccuuuugagggcuga

SEQ ID NO: 46761 - RNA, 65 nt, hsa
augaacaauuaagaggcucucccccucuugucuuuaagccauauucuccuacauguauuuuauaa

SEQ ID NO: 46762 - RNA, 65 nt, hsa
aagcuucuaacaaaacucugacuuacccaucagagaagccauacuggugaaaaauuguauauuug

SEQ ID NO: 46763 - RNA, 65 nt, hsa
uugaccuuccacuagaccaugagcaccugggcggaaagccauauaucuuauuaagcuuuauaucu

SEQ ID NO: 46764 - RNA, 65 nt, hsa
cugcuuuaagcuguaauguuuugccauguugcaaaaagccauaauaauaaguauaaaaaagcuuu

SEQ ID NO: 46765 - RNA, 65 nt, hsa
gugguauuauggaccgaacugaaaauuuuauguugaagccauaucccccaugauuauauaguuau

SEQ ID NO: 46766 - RNA, 65 nt, hsa
uguggaaaauauauugucuuggaaauuuguuguaaaagccauauuucuaauggaaaaucaggugu

SEQ ID NO: 46767 - RNA, 65 nt, hsa
cuuuuacuaaacauaagguaauucauacuggagaaaagccauacaaaugagaagaauguggcaau

SEQ ID NO: 46768 - RNA, 65 nt, hsa
auggagacuacuucguaguggaguaccgggaccagaagccauacugcaucagccccugugagccu

SEQ ID NO: 46769 - RNA, 65 nt, hsa
ucccaaggccccacuuucaagaaucagacagcaggaagccauagaugcuggcuggguuccagguu

SEQ ID NO: 46770 - RNA, 65 nt, hsa
caaauaaaacccugccuuguaaaauaguaaaagagaagccauauauuggcuuuucuucuuaacuu

SEQ ID NO: 46771 - RNA, 65 nt, hsa
uuggugcugguuuauuuguuguuuucugggggaaaaagccauaucaugcuaaaauucuauagaga

SEQ ID NO: 46772 - RNA, 65 nt, hsa
acuggggugggggcugagcaugcuugugcagaaagaagccauagccagaaaggacagaaucucuc

SEQ ID NO: 46773 - RNA, 65 nt, hsa
aggcuaugcuucaguuuuucuuuguaagccaucacaagccauagugguagguuugcccuuuggua

SEQ ID NO: 46774 - RNA, 62 nt, hsa
acuuguaugauuucuugugaaaacaagcuucaaagccauauggacacugugacaaugacuaa

SEQ ID NO: 46775 - RNA, 65 nt, hsa
uaacaaaucauuucuaaacaguuauuuuccauuaaaagccauauuaaguauuuugcuuguuaaau

SEQ ID NO: 46776 - RNA, 65 nt, hsa
gcaccacagcucaagaaaaccuaaaguuucaauacaagccauaggcucacagaaaaagaaaaaga

SEQ ID NO: 46777 - RNA, 65 nt, hsa
aguuuugagaaauacgagucugucagagcggccauaagccauaaagagucaaucucuuaauuaua

SEQ ID NO: 46778 - RNA, 65 nt, hsa
ggcagagaaagugaaggucgacccagggcuguaggaagccauaggagagugaccacgggauuccc

SEQ ID NO: 46779 - RNA, 65 nt, hsa
agagugacuaagauuugaguccauugcaaaagguuaagccauaugacaauuucaaaaugcaugug

SEQ ID NO: 46780 - RNA, 65 nt, hsa
uuuuagccuaaagugguuuucaaauccaguucuucaagccauaaaugaccaagauccaagcaauc

SEQ ID NO: 46781 - RNA, 65 nt, hsa
uuuucaaggggguucuaaagcauucaagugcuuaaaagccauaaaaaaugacuucuuaauuccug

SEQ ID NO: 46782 - RNA, 65 nt, hsa
cucuggcuuuaaaauuuuaaaacaaacaaacaaaaaagccauagagagcagaacuugccgagggu

SEQ ID NO: 46783 - RNA, 65 nt, hsa
uaauaaucaaucaaucagcauauacauuucagccaaagccauagaagaaaaagcaauaguugcuu

SEQ ID NO: 46784 - RNA, 65 nt, hsa
ccagugaccuuugaccucggugaccacucuucuuuaagccauagacccugaggcccugggcuggg

SEQ ID NO: 46785 - RNA, 65 nt, hsa
uccuggacacauuggaaugccuuggaaauagaaagaagccauauaugaccagaagccuuggaacc

SEQ ID NO: 46786 - RNA, 65 nt, hsa
aauuuaguaauggacuauacaggauguuaauaaugaagccauauguuuaugucuggauuuaaaaa

SEQ ID NO: 46787 - RNA, 65 nt, hsa
cuucauuuugugaauuauagaagcuacuuuuuauaaagccauauuuuuuuagggaaacuaaggag

SEQ ID NO: 46788 - RNA, 65 nt, hsa
caucauuuugaaaggaccaugagcaacuauaagcaaagccauaagaagugguuugaucgauauau

SEQ ID NO: 46789 - RNA, 65 nt, hsa
uuuaaguuauuuaggaacacaaaggacagacaaaaaagccauaugcacaugccucauuuucucuu

SEQ ID NO: 46790 - RNA, 65 nt, hsa
aaauaaauaggggcuuauacaaaaaagaaaauaaaaagccauauauacugcaaaguuccuaacug

SEQ ID NO: 46791 - RNA, 65 nt, hsa
uaucaugcuggcaauguuaauuacccagguguaggaagccauacacugaggcggaagaucgcaag

SEQ ID NO: 46792 - RNA, 65 nt, hsa
gcuuacccaucuucaaaugaaaauuccauuuuuguaagccauaaugaacuguaguacauggacaa

SEQ ID NO: 46793 - RNA, 65 nt, hsa
uugagauuucagcuaugcuagaggcuuuuauuagaaagccauauuuuuuucuguaaaaguuacua

SEQ ID NO: 46794 - RNA, 65 nt, hsa
uucuucugguagcuucaugguaaaugcauccgaauaagccauacuggauugcaguguuuguuucu

SEQ ID NO: 46795 - RNA, 65 nt, hsa
caauugggagauaccuuuggucugcuccugcaccaaagccauauggguggaagucaguuggccuc

SEQ ID NO: 46796 - RNA, 65 nt, hsa
acccugccagccccacagauuuuauuuuugcacauaagccauaaccaauccucaaggcuggcaca

SEQ ID NO: 46797 - RNA, 65 nt, hsa
uugccaccucuggccaaauaugcacuuucccuagaaagccauauuccagcagugaaacuugugcu

SEQ ID NO: 46798 - RNA, 65 nt, hsa
ucugggauuuaugcucaugaacuaaauuuaagcuuaagccauaaaauagauuagauuguuuuuua

SEQ ID NO: 46799 - RNA, 65 nt, hsa
aguuccuuguaagcugaaccaucaauuaucaguugaagccauacuuuuauuuaaauuaauauacg

SEQ ID NO: 46800 - RNA, 65 nt, hsa
cugaggccacuuaucagggccuggagcccugauggaagccauaggaacuccagaguugccaagcc

SEQ ID NO: 46801 - RNA, 65 nt, hsa
gcccugauggaagccauaggaacuccagaguugccaagccauagcugagaagccuggugguuuuc

SEQ ID NO: 46802 - RNA, 65 nt, hsa
uauacaguuuuaacuuacuuagauuuauucuaguuaagccauaaguucaacguguaaacuuguuu

SEQ ID NO: 46803 - RNA, 56 nt, hsa
caugccccgucuccaucuagcaggaaaagccauaucuugcaccagcagcaugaaug

SEQ ID NO: 46804 - RNA, 65 nt, hsa
agaaaaauuauauaaauuuuagaaguuauuucauaaagccauacgguauugacauauuuuuaagg

SEQ ID NO: 46805 - RNA, 65 nt, hsa; identical to SEQ ID NO: 46762

SEQ ID NO: 46806 - RNA, 65 nt, hsa
ucucucugacuuaucuggaaguauuucuuuuugugaagccauauguccuaacaggagcuucauca

SEQ ID NO: 46807 - RNA, 65 nt, hsa
gccagggguccugaaaaccaaaggaggagcagcagaagccauaggcuccccagcuuucuccaggc

SEQ ID NO: 46808 - RNA, 65 nt, hsa
uuguagaaaauguaauaaacacuguuaagacuuaaaagccauauaauuccaccaaccaaaauuaa

SEQ ID NO: 46809 - RNA, 65 nt, hsa
auuuuuaaaucacauuaauuuuaccaagugaaaccaagccauacuguuuuugagccaauuaagaa

SEQ ID NO: 46810 - RNA, 65 nt, hsa
uuugaggcuauacagccacugugcccuguggaauaaagccauauauauaaauguuuuauauguau

SEQ ID NO: 46811 - RNA, 65 nt, hsa
uggggcaggggacuaucugaagcgcuuccauccuaaagccauaaugaaaauaucuuccucucuuc

SEQ ID NO: 46812 - RNA, 65 nt, hsa
ugggcccauuccccuaauaguuuuauuuuuaaagaaagccauacauagaaugcuucaagcuaucu

SEQ ID NO: 46813 - RNA, 65 nt, hsa
ggauuagauaggguuccaacugggccuacaagcucaagccauacauaaaaggaccuugggacaua

SEQ ID NO: 46814 - RNA, 65 nt, hsa
uuuccuccuauuuuuuuuuaaccuguuaaacucuaaagccauagcuuuuguuuuauauugagaca

SEQ ID NO: 46815 - RNA, 65 nt, hsa
uccugcagugauagaaacaggucguucugcauuauaagccauagguggagcauucgguagcguau

SEQ ID NO: 46816 - RNA, 65 nt, hsa
uaauuuuauuuuguucucuacauacaaucaauguaaagccauaucacaaugauacaguaauauug

SEQ ID NO: 46817 - RNA, 65 nt, hsa
uacaucauguuucuucauuggauuuguaaaacuugaagccauaaaaauauuaguuugguguguau

SEQ ID NO: 46818 - RNA, 65 nt, hsa
aggauacccuuuuaacuucuucccuucagccacauaagccauaugaugacacacagugucuuucu

SEQ ID NO: 46819 - RNA, 65 nt, hsa
aaucuguuugaaggaauuuuccugguuuucagaugaagccauaaggcuuuggaguuaaaccacag

SEQ ID NO: 46820 - RNA, 65 nt, hsa
guuauggcaacauuauugaauuuuuuauguacauaaagccauauguuuagggugguuucuaucug

SEQ ID NO: 46821 - RNA, 65 nt, hsa
gucagcgcucaggaaugugcuccggcagagugcugaagccauaauccccaaccauuucccuuggc

SEQ ID NO: 46822 - RNA, 65 nt, hsa
ccaaucuguuuuccauuuccauugcaauacuacuaaagccauacaauaucaagcacccucccucu

SEQ ID NO: 46823 - RNA, 65 nt, hsa
uguguccaggcucugggcacagugcugccccuugcaagccauaacgugcccccagaguguagggg

SEQ ID NO: 46824 - RNA, 65 nt, hsa
cauaacgugcccccagaguguagggggccuugcggaagccauagggggcugcacgggaugcgugg

SEQ ID NO: 46825 - RNA, 65 nt, hsa
ugcuacaucauaguugauaaauugauguuaucguaaagccauauguucuguucaagucuuguuug

SEQ ID NO: 46826 - RNA, 65 nt, hsa
accacugcucaggguccauuccucacuauaagaugaagccauaucugccugccuuuuccuaagga

SEQ ID NO: 46827 - RNA, 65 nt, hsa
gaaaaccagucuguguuuacagacagaagagaaggaagccauagugucacuuccacacaauuauu

SEQ ID NO: 46828 - RNA, 65 nt, hsa
acaagaaucaugcacuuuuuaaaauuauuucuaagaagccauaacaaagcuguguacuaauaaag

SEQ ID NO: 46829 - RNA, 65 nt, hsa
uaagugguggggcugggagaggaggaacagaaggaaagccauagcgcucucuugccccuuggcau

SEQ ID NO: 46830 - RNA, 65 nt, hsa
cucagccuacccacugaagucuuuggguagcucuuaagccauaacuaaggagcagcauuugagua

SEQ ID NO: 46831 - RNA, 65 nt, hsa
cagaguugggaaaaacaacagguuugaguccuauaaagccauaauuuaacuccaguagcugaugu

SEQ ID NO: 46832 - RNA, 65 nt, hsa
acuuccuuagaaauucauauuuauuuguccacuugaagccauauuauuuucugauuuauuuucuu

SEQ ID NO: 46833 - RNA, 65 nt, hsa
gccucugguguuccuggccucagccagcugcccacaagccauaaaccaauaaaacaagaauacug

SEQ ID NO: 46834 - RNA, 65 nt, hsa
gccaggcacugugccgggcacuggggauauacacaaagccauaagcacuggggacugccagguug

SEQ ID NO: 46835 - RNA, 65 nt, hsa
caggagagcucccuauccgccuuuggucagagcugaagccauauacgacuggguguuuguccccc

SEQ ID NO: 46836 - RNA, 65 nt, hsa
ggaaaauaaaaucacuuucuugcuugguaagcaagaagccauaucgauuuuuuuuaacuuacaga

SEQ ID NO: 46837 - RNA, 65 nt, hsa
uuuggucagcauaucuuagguauauaauaacuuugaagccauaacuuuuaacuggagugguuuga

SEQ ID NO: 46838 - RNA, 62 nt, hsa
acuguaugcacacuaacuaaugaaaguccuagaagccauaaaagagacacuuuccugcuggu

SEQ ID NO: 46839 - RNA, 65 nt, hsa
cuugcuguuuuuauugaucuuaugguuuauuucuuaagccauagucaguguaaauacagcccugc

SEQ ID NO: 46840 - RNA, 65 nt, hsa
ugcggucuccaauuuaggacuuuuccauagugccaaagccauacauauucaguagaacaucaaua

SEQ ID NO: 46841 - RNA, 65 nt, hsa
caguaaauguccaaguaauguuuuuauaauaaacuaagccauauuuagacaauaaacauugauaa

SEQ ID NO: 46842 - RNA, 65 nt, hsa
gccuuuuaggaacguaaaguccuuuaagcacucagaagccauaccucaucucucuggcugaucug

SEQ ID NO: 46843 - RNA, 65 nt, hsa
uuuaagauuuacuuaauacucagaaaauucagauaaagccauagaguccuguuugaagcuucacu

SEQ ID NO: 46844 - RNA, 65 nt, hsa
ccaaaccugcaccauccaucauuauguagaugaaaaagccauaggucauagccucuuugcuauuc

SEQ ID NO: 46845 - RNA, 65 nt, hsa
ggaacacuugccccucaguauaguacugucaagggaagccauacacuuuuuguagacauggguac

SEQ ID NO: 46846 - RNA, 65 nt, hsa
uucauucugccauugacuuggcauuuaccuuggguaagccauaagcgaaucuuaauuucuggcuc

SEQ ID NO: 46847 - RNA, 65 nt, hsa
aacuuaccuuaccuuaccuagaaaaacauuaauguaagccauauaacaugggauuuuccucaaug

SEQ ID NO: 46848 - RNA, 65 nt, hsa
ccauucucccucucaaggcaggggucauagauccuaagccauaaaauaaauuuuauuccaaaaua

SEQ ID NO: 46849 - RNA, 65 nt, hsa
auagaaguacaccuaauuguuauugguuaaaaaaaaagccauaugugaaugagguugguuuuugg

SEQ ID NO: 46850 - RNA, 65 nt, hsa
guuguuugacauacagugaugauggcauuauugauaagccauacaugagacugcagauuauauug

SEQ ID NO: 46851 - RNA, 65 nt, hsa
cuuauaaugcuuuuuauagcccagcacagaauuuaaagccauaccaccaaaaguaccugugugug

SEQ ID NO: 46852 - RNA, 65 nt, hsa
ugccgucucugggcaaccaggccccaacugugcuuaagccauaaugccugcugcucucuagacaa

SEQ ID NO: 46853 - RNA, 65 nt, hsa
uucuaaguaguugccaucuugaauccuuuguaauaaagccauacuuuugugugugugugugaugc

SEQ ID NO: 46854 - RNA, 65 nt, hsa
agagaucaaugacuuuuuaggcagcuguguuuuuuaagccauauacaagaguaaguuaaaagggg

SEQ ID NO: 46855 - RNA, 65 nt, hsa
acagacacaagaacaaucuuugcuauaauuguauaaagccauaaauguacauaaauuauguuuaa

SEQ ID NO: 46856 - RNA, 65 nt, hsa
ggugugagaaacagaguuauuaaguaaguugccagaagccauacaaguacaaagugucaagggga

SEQ ID NO: 46857 - RNA, 65 nt, hsa
aaauuugcuuuaaacuguuucagagcuucuucccuaagccauaaacugucucaccuaaacaagau

SEQ ID NO: 46858 - RNA, 65 nt, hsa
uuugauuuuguuuacugaaauuuguuauacuucaaaagccauaacuugaaaaauacugguggcgu

SEQ ID NO: 46859 - RNA, 65 nt, hsa
augaacaccgugucuccuucucuuguguguaccuaaagccauauuuccaagucugugguacucca

SEQ ID NO: 46860 - RNA, 65 nt, hsa
ggauauuuuucuucaauuuugaagagaaaauggugaagccauagaaaaguuacccgagggaaaau

SEQ ID NO: 46861 - RNA, 65 nt, hsa
ucuguaauuuuaguugaguauguuuaugauuuuugaagccauauggugaguaaauguaaauauga

SEQ ID NO: 46862 - RNA, 65 nt, hsa
aaggccagcauugucuuccaugggagaugacucuuaagccauaggggcugguuuuccguacucca

SEQ ID NO: 46863 - RNA, 65 nt, hsa
aguuugguuuauggggccuggauucuggcuugaagaagccauauuuggcaugggugaagugaaag

SEQ ID NO: 46864 - RNA, 65 nt, hsa
auucuguucucuauuaaauuaagaaaauguuccaaaagccauaagccugaagauuggcccugugc

SEQ ID NO: 46865 - RNA, 65 nt, hsa
uggacccuuaagaauuuuauuuuuaaaggagauugaagccauagaacucauauugacacucagcu

SEQ ID NO: 46866 - RNA, 65 nt, hsa
cauauauuaugauguggaaauaauugauaacuuuuaagccauacuauguuuuuaaagauaauuug

SEQ ID NO: 46867 - RNA, 65 nt, hsa
uuaugaauuuuacacuuggcaaauguuaaugacggaagccauagucugcuccuaauacaugucca

SEQ ID NO: 46868 - RNA, 65 nt, hsa
gcugcugcgacacaggcagcgcuuuguaaacugugaagccauauacgugaaacugaagagugcau

SEQ ID NO: 46869 - RNA, 65 nt, hsa
cccucccaaccucccuuccagggggcuuaccagcaaagccauauucggcuaggaauuuggaauuc

SEQ ID NO: 46870 - RNA, 65 nt, hsa
uuuggaaucagaauuggaaucacauucuguuuaucaagccauaauguaaggacagaauaauacaa

SEQ ID NO: 46871 - RNA, 65 nt, hsa
ccgcgccccgcuccccuucucucucuuacucgguuaagccauagcgaggccuccgcucguuucag

SEQ ID NO: 46872 - RNA, 65 nt, hsa
uauucucuugcgugugaaucucuuacccugaaaaaaagccauaaugaauuaagccagacugacca

SEQ ID NO: 46873 - RNA, 65 nt, hsa
gcugcugaacuugaacccagagccuucaggugccaaagccauacucaggcccccaccgacauugu

SEQ ID NO: 46874 - RNA, 65 nt, hsa
uguauugccuuaaguuuucacucauugucuuuugaaagccauaugauaaaaugauuuuauuuaau

SEQ ID NO: 46875 - RNA, 65 nt, hsa
auacaaccucuuauuguauaguuugccuugauuauaagccauaguaaaucgagcuguucgcauuu

SEQ ID NO: 46876 - RNA, 65 nt, hsa
cuaauauuagaauauauuaaccgcuuaaggcauugaagccauaugggauggggaaugcauuucuu

SEQ ID NO: 46877 - RNA, 65 nt, hsa
ccuuaguaccuccgcugcuucacuugcuuuagccaaagccauaaaaaaccugcaacguagagaaa

SEQ ID NO: 46878 - RNA, 65 nt, hsa
ugcccccucaccuuuuuggguagguaaaagacuaaaagccauauggauuuuaacugauaacaaug

SEQ ID NO: 46879 - RNA, 65 nt, hsa
gcuauguuuucaaaccuuuuugagccauaggauccaagccauaaaauucuuuaugcauguugaau

SEQ ID NO: 46880 - RNA, 65 nt, hsa
uuuugucaagagccaguagagcagacagaugcugaaagccauaguuucauggcaggcuuuggcca

SEQ ID NO: 46881 - RNA, 65 nt, hsa
cgagucccggcuucgaguagugauacgcaugaacaaagccauauccuuuugcaguggggucgaga

SEQ ID NO: 46882 - RNA, 65 nt, hsa
aaucugggcugagccaaagucccuuuuggaaauacaagccauaacauucgaaggacaucagcgac

SEQ ID NO: 46883 - RNA, 65 nt, hsa
cucccagcuuccuggcagcaucgucuggucggugaaagccauagcauggacaccccauggggagc

SEQ ID NO: 46884 - RNA, 65 nt, hsa
caaugccuuccuacagcucacuggggugcuuaccaaagccauagcuuuaaaccuucccagucccc

SEQ ID NO: 46885 - RNA, 65 nt, hsa
cgaugucagugagggcgaucauagggcauaagccuaagccauaccaugcagccuuugugccagca

SEQ ID NO: 46886 - RNA, 65 nt, hsa
cuagaaugacaguuaucuauggaggugguagaauuaagccauaccuuuuccuucaucacucuugg

SEQ ID NO: 46887 - RNA, 65 nt, hsa
cgggcuggaggggcugcccagggaccuuggucucgaagccauacgugguugucugcuuuccuaag

SEQ ID NO: 46888 - RNA, 65 nt, hsa
uaaagcacuagguuuuaaaucaguggguaucauaaaagccauauauaaaagauccuuucuuauag

SEQ ID NO: 46889 - RNA, 65 nt, hsa
cuugggcuagaauguacacgucuccuugccugaauaagccauauauaugcucuuaaacaaaaguu

SEQ ID NO: 46890 - RNA, 65 nt, hsa
acuuuauuuauggauuguaauaacaaccacaagaaaagccauacaucuuaaugaacauacgccuu

SEQ ID NO: 46891 - RNA, 65 nt, hsa
uaauuggaacaaagggaaacagauacuugauaugaaagccauaaugacggugacuugugucgugg

SEQ ID NO: 46892 - RNA, 65 nt, hsa
uguucagguccaggguuacauaauugcagaagcacaagccauacaucgcagguaggaaaccacag

SEQ ID NO: 46893 - RNA, 65 nt, hsa
aaaucuguuaaugcacaugcacaauaauuuccugaaagccauaggacaugucuguagucagcacc

SEQ ID NO: 46894 - RNA, 65 nt, hsa
ugccauugcgcugccccggccgccaguccgcccagaagccauagacgagacguagguagccguag

SEQ ID NO: 46895 - RNA, 65 nt, hsa
agaaauggcauuuacguuucucugaugcucccuugaagccauagaauuuaggggcuuuuuuaaaa

SEQ ID NO: 46896 - RNA, 65 nt, hsa
gcuggugugggaugcagccggccgaugagaaaauaaagccauauugaaugaucgccaccaguguu

SEQ ID NO: 46897 - RNA, 65 nt, hsa
aggguguaauauaccauagugauaaauaugaccaaaagccauaaaugacugugagauguaugaga

SEQ ID NO: 46898 - RNA, 65 nt, hsa
aguguguaauauaccauagugauaaauaugaccaaaagccauaaaugacugugagauguaugaga

SEQ ID NO: 46899 - RNA, 65 nt, hsa
gugccuuuuuuaauacaugaaagaauucuagagagaagccauauacauguaaguaacaugggaaa

SEQ ID NO: 46900 - RNA, 65 nt, hsa
ggcugcgcggccccagccugggcacccugauuuuuaagccauagaccuggggucagggcaggaag

SEQ ID NO: 46901 - RNA, 65 nt, hsa
accuuacuguacaucagagaauucauacuggagaaaagccauauaaauguagugagugugggaaa

SEQ ID NO: 46902 - RNA, 65 nt, hsa
guccuggcuccgccucuuccaucaggaccacuauuaagccauaggaguccugggggugcaaaggg

SEQ ID NO: 46903 - RNA, 65 nt, hsa
uccgccccccucagccccuuccuccccagggagcaaagccauaaggggcaggggccaccccacgg

SEQ ID NO: 46904 - RNA, 65 nt, hsa
ccacuccacaugugcuggggacauaggaagaccuuaagccauagcucaucccuuucuagauuuga

SEQ ID NO: 46905 - RNA, 65 nt, hsa
aaaguccacggccugaggccaggcccucugcacagaagccauaugccggccagccgcgccuccuc

SEQ ID NO: 46906 - RNA, 65 nt, hsa
gacacaaacuguauaagugucaggaauauggagagaagccauauaaauguaagaaaugugggaaa

SEQ ID NO: 46907 - RNA, 65 nt, hsa
cccuucaaaaucaugagacaacucauaugggagagaagccauaugaauguaaauaaugugggaaa

SEQ ID NO: 46908 - RNA, 65 nt, hsa
ugacaguucuugcuguguaacagaugcuccauaguaagccauaaguauuccugcuaaaguuagcu

SEQ ID NO: 46909 - RNA, 65 nt, hsa
ccuuggcaaauggacaccaggggcuucuccccucaaagccauaccccgccucugggcgggcaugg

SEQ ID NO: 46910 - RNA, 65 nt, hsa
cucgugacccugcccccucccuggggccccuccugaagccauacccucccccaucugggggcccu

SEQ ID NO: 46911 - RNA, 65 nt, hsa
uccuuuccugcccggaccgugaauucaucuccuugaagccauaacguccgagcugcuggugcggg

SEQ ID NO: 46912 - RNA, 65 nt, hsa
ucagaaaucaagauacacaagugaggaauuguccaaagccauaaccuugauuggagagaacaugg

SEQ ID NO: 46913 - RNA, 65 nt, hsa
agcuucaaauacauaggagaauucacacuggagaaaagccauagaaauguaagguuugugacaag

SEQ ID NO: 46914 - RNA, 65 nt, hsa
acacgagugacagggcuccgggggaagucucagagaagccauagccccccugggaccuccggacu

SEQ ID NO: 46915 - RNA, 65 nt, hsa
cuuuccccuucagaugucagugucugcaugugggaaagccauagcacacaucuuaccuuuccaag

SEQ ID NO: 46916 - RNA, 65 nt, hsa
uugcagggccaucucacccaugcagcauaaggcagaagccauagucacuuuccaucuugccugga

SEQ ID NO: 46917 - RNA, 65 nt, hsa
caguggacgaaaauggggcuguuaauauacucuaaaagccauacuaaaaaugcucugagggaacu

SEQ ID NO: 46918 - RNA, 65 nt, hsa
acuuguacgguacuggcagaaaagucauuuuucaaaagccauaggcuuuuccuugcccuuagcug

SEQ ID NO: 46919 - RNA, 65 nt, hsa
gucuugcuguaacucagacauuccaaggguaugggaagccauauucacaccucacgcucuggaca

SEQ ID NO: 46920 - RNA, 65 nt, hsa
uauuauauauuaaacauucuugcugcugcgcugcaaagccauagcagauuugaggcgcuguugag

SEQ ID NO: 46921 - RNA, 65 nt, hsa
cacauugcuucugcgcugguggcaauagggcaacaaagccauaggccagagggcggggggauguc

SEQ ID NO: 46922 - RNA, 65 nt, hsa
cucgggucuuaaaguguguggacauuuucaucccgaagccauagagacauuugcugucauauugc

SEQ ID NO: 46923 - RNA, 65 nt, hsa
aaccacaagguccacucccugcuccacgaagccuuaagccauaggcccaggauauuucugagagu

SEQ ID NO: 46924 - RNA, 65 nt, hsa
agagccaugacagguccaucagcaugaaguuggccaagccauagggcacagcaccuccuuguaac

SEQ ID NO: 46925 - RNA, 65 nt, hsa
uaacucaucuugauugaguggccuuccugccaaacaagccauauauaaagacugauggaaucguu

SEQ ID NO: 46926 - RNA, 65 nt, hsa
uauucuuugaaacuuguuggguagaaugaaaauuaaagccauaaugguagaagauggcauacuga

SEQ ID NO: 46927 - RNA, 65 nt, hsa
aggggagugggguccaagugacagcuggaugggagaagccauaguuucucccagucagcuaggau

SEQ ID NO: 46928 - RNA, 65 nt, hsa
uaaauauggaagucacgucauaaucuaccuuugcaaagccauacaugaacuuuuauuuacuuugu

SEQ ID NO: 46929 - RNA, 65 nt, hsa
uuuauuuauuuuccaggauucagggaauauuccagaagccauagcuucuuaccgcacggcucuga

SEQ ID NO: 46930 - RNA, 65 nt, hsa
gguaggcuccaugccaaguaacagcagagggaguuaagccauaggaauuuggcuguggaguaaga

SEQ ID NO: 46931 - RNA, 65 nt, hsa
guccauaggauaucugaggaacauucaucaaaaauaagccauagacaugaacaacaccucacuac

SEQ ID NO: 46932 - RNA, 65 nt, hsa
auaccaaacacuaacaagaggaagcagaauaugagaagccauauuuuuacauaggagucagauac

SEQ ID NO: 46933 - RNA, 65 nt, hsa
aacaggcuggggccucgagaaggagucacucagacaagccauauuuuuagaaaguagucuacuga

SEQ ID NO: 46934 - RNA, 65 nt, hsa
agaggguccucuucauuuuugggaacuccuuuccaaagccauauuuuugggaggcagagaggggc

SEQ ID NO: 46935 - RNA, 65 nt, hsa
gcuugcucauggcaugaaugcuauguggacagcccaagccauacccagaaucaccuuaauuccaa

SEQ ID NO: 46936 - RNA, 65 nt, hsa
caaaaguuugcacauauuguucuguguaauuguguaagccauaauuacaguguuuaauucucuuu

SEQ ID NO: 46937 - RNA, 65 nt, hsa
aggaacaacuguacuuuuuuugaucaguuggcaugaagccauagaauuaaauuuuggcuuuagaa

SEQ ID NO: 46938 - RNA, 65 nt, hsa
uuacuuuuuggauuguagccaguucagcuaggcaaaagccauacuuuucacaauuaaaaaaaaaa

SEQ ID NO: 46939 - RNA, 65 nt, hsa
cacacaucaguacuguggagaguuucuguuaggaaaagccauacauuuuuaaaaauguagcaaaa

SEQ ID NO: 46940 - RNA, 64 nt, hsa
aggguggagaaguucccugaaccuuccugucucccagggacauguaugcuuccagggacaagcu

SEQ ID NO: 46941 - RNA, 64 nt, hsa
gaaccuuccugucucccagggacauguaugcuuccagggacaagcuuaggucaugaacaugguc

SEQ ID NO: 46942 - RNA, 64 nt, hsa
caguagaguuggagauucagagauuucuugaagccagggacaugcuccuaacuccuuucccauu

SEQ ID NO: 46943 - RNA, 64 nt, hsa
ccucacagacaggcugacagccccucugccugcacagggacauuggacacuaggugcugcccuc

SEQ ID NO: 46944 - RNA, 64 nt, hsa
acucucccgggccacaauagggacagggcagggacagggacagcccaggucacacgugggguca

SEQ ID NO: 46945 - RNA, 64 nt, hsa
ugcuggacucucccgggccacaauagggacagggcagggacagggacagcccaggucacacgug

SEQ ID NO: 46946 - RNA, 64 nt, hsa
cugcugaggacauaggcagaagcucacucuuuuccagggacagaaguggugguagauggaagga

SEQ ID NO: 46947 - RNA, 64 nt, hsa
cuucuuuccuguaggugggguuagggggggcgaucagggacaggcagccuucugcugaggacau

SEQ ID NO: 46948 - RNA, 64 nt, hsa
uccuuccccuguggucuuggaaguguguggaaggcagggacagagauggaggccgagccaauag

SEQ ID NO: 46949 - RNA, 64 nt, hsa
caaaacagaacaauuaaacagccaaauaaaaccucagggacaacauuuuugguguauuugagcc

SEQ ID NO: 46950 - RNA, 64 nt, hsa
aacuccuguaccccaguccacgguguucuggcagcagggacaccugggccaaugggccaucugg

SEQ ID NO: 46951 - RNA, 64 nt, hsa
ucguccccggaguuggggguacccguugcagagccagggacaugaugcaggcgaagcuugggau

SEQ ID NO: 46952 - RNA, 64 nt, hsa
auauauauauauauuaagccccaggcugaauacucagggacagcaauucacagccugccucugg

SEQ ID NO: 46953 - RNA, 64 nt, hsa
cuagaugacagauugcgggagggccugagagaagcagggacaggagggagccuggggauugugg

SEQ ID NO: 46954 - RNA, 64 nt, hsa
agggacagguucuguugggggugacaagaggagacagggacagguucugucgggggugacacca

SEQ ID NO: 46955 - RNA, 64 nt, hsa
agggacagguucugucaugggugacacgaggacacagggacagguucuaucaugggugacacca

SEQ ID NO: 46956 - RNA, 64 nt, hsa
agggacagguucugucgggggugacaccaggacacagggacagguucugucaugggugacacga

SEQ ID NO: 46957 - RNA, 64 nt, hsa
agggacagguucugucaggggugacaccaggacacagggacagguucugucgggggugacacca

SEQ ID NO: 46958 - RNA, 64 nt, hsa
uggugguggcggcccagagucugaagaaauggcacagggacagugaaugguaguguugccaccc

SEQ ID NO: 46959 - RNA, 60 nt, hsa
aggccaacaugggcuucugaacccuucaggcagggacaguucuauugcugucccuacaau

SEQ ID NO: 46960 - RNA, 64 nt, hsa
agagcaggaagcauucagagagcagcuuuaaacucagggacagagccaugcugggaagacgccu

SEQ ID NO: 46961 - RNA, 64 nt, hsa
uuggaggcgauuuaccuguuuucgcaccuaccaucagggacaggaugaccuggauaacuuaggu

SEQ ID NO: 46962 - RNA, 64 nt, hsa
cccaacugucgcccccuucaggcuaagucucaggcagggacagacccagaaagaacacagucug

SEQ ID NO: 46963 - RNA, 64 nt, hsa
uccauguggaugucaccaaaccccaguguggaggcagggacagucaugggaaugugggggauga

SEQ ID NO: 46964 - RNA, 64 nt, hsa
agcuggggcacacacacaccuggccgggacccggcagggacaaggcgggccguggccuccucca

SEQ ID NO: 46965 - RNA, 64 nt, hsa
ucuaaugacuuccuauuggaaaggcauugacagccagggacaggagccaggguggggguaguuu

SEQ ID NO: 46966 - RNA, 64 nt, hsa
cuugccaagacuucuccacccucuugcauaccuccagggacagagagcuuacuaccucccaagg

SEQ ID NO: 46967 - RNA, 64 nt, hsa
cagcuuccagccuccccucaggcuuuccagucaccagggacacucggagccacagccuagagcc

SEQ ID NO: 46968 - RNA, 64 nt, hsa
aggggagcaugauggggccuuugaggcagggucgcagggacaagcucagcuuuaggcaccaucu

SEQ ID NO: 46969 - RNA, 64 nt, hsa
augugggcaugucguccaccccaggacgagccaucagggacagaccccccacccccaaggcugc

SEQ ID NO: 46970 - RNA, 64 nt, hsa
accugccagguucaguucuuuuaaggugccucuucagggacacagugugucucucugauugggc

SEQ ID NO: 46971 - RNA, 64 nt, hsa
gguaucacaaagcauuugugaauugcuuuaggugcagggacaccacccacucaggacucuuccc

SEQ ID NO: 46972 - RNA, 64 nt, hsa
uaacuucaaaacuuuuaagagcagugaaguuggucagggacauguggccacuuauuauuaccua

SEQ ID NO: 46973 - RNA, 64 nt, hsa
agagaauuugggcccuuacugaccuguccuccuucagggacaugagcauucccuauagauuagg

SEQ ID NO: 46974 - RNA, 64 nt, hsa
cuucucauugcugaagccccucugugucucuucucagggacaggcugguccaguggcuuuggug

SEQ ID NO: 46975 - RNA, 64 nt, hsa
ugaggagaauucuggugaucucuguggagguagucagggacacaaggcuuggcugugagucugg

SEQ ID NO: 46976 - RNA, 64 nt, hsa
ccucuaguuuccuggagccccaacacauuccuggcagggacagcaggguggcaaggacucaggu

SEQ ID NO: 46977 - RNA, 64 nt, hsa
uugcugcugccuccugagcacugccuuccaugaacagggacagaccagaggcccugcaaggacu

SEQ ID NO: 46978 - RNA, 64 nt, hsa
ucccccuacuucuccccaagggccaagaacugcucagggacauuaaaggucaaaaguccagcca

SEQ ID NO: 46979 - RNA, 64 nt, hsa
caagcugagaagcugagagcuggaggacaauauccagggacauggcucuggaaaauaacuuuuu

SEQ ID NO: 46980 - RNA, 64 nt, hsa
acauucccccaguccugccucucccccauccuaucagggacauuuggcuccucuuagcuggcuc

SEQ ID NO: 46981 - RNA, 64 nt, hsa
gauuaacugccucccuuccaauagacacuaucagcagggacagaugugugggagugcagggcug

SEQ ID NO: 46982 - RNA, 64 nt, hsa
aaaauaccuugcaucugagacagacuuccuacaucagggacagguaucugugugucauuauaca

SEQ ID NO: 46983 - RNA, 64 nt, hsa
ucucucucccaaucagagccuguugauauuacaacagggacagauguguuaguugcucacuaga

SEQ ID NO: 46984 - RNA, 64 nt, hsa
cccaggggugauggagacuuuugauggcuuuuggcagggacagacuuggacacaaaaccgaucc

SEQ ID NO: 46985 - RNA, 64 nt, hsa
uguuucuucuaagggaggaggacaugguggagaccagggacaggagagccagcaggguggaugc

SEQ ID NO: 46986 - RNA, 64 nt, hsa
gagcaauuaggcugccugccugugggcugggagacagggacaauggggaaaaguuaaggagcaa

SEQ ID NO: 46987 - RNA, 64 nt, hsa
uuaauugaugaaucaacuucuacagaaacuuuugcagggacaguguugaugaggcaguuuagcu

SEQ ID NO: 46988 - RNA, 64 nt, hsa
ccacagggaaggggcucccacugcuucuggucuccagggacagugcugcuggaaaggcuaguga

SEQ ID NO: 46989 - RNA, 64 nt, hsa
uccacagcagagaaaaagucccgugcuugcuagucagggacaagggaggcccuuuggcugugau

SEQ ID NO: 46990 - RNA, 64 nt, hsa
gaccuccccaccccaguguaauggcccuucauggcagggacagaaagguggacugggggccauu

SEQ ID NO: 46991 - RNA, 64 nt, hsa
ggguccccucuguccucauuucccugugcauauucagggacaugccucgucaggguuuggcaag

SEQ ID NO: 46992 - RNA, 64 nt, hsa
cugcagaggguagccugaggcccaaggagguugucagggacacacagcagggggaggcagccca

SEQ ID NO: 46993 - RNA, 64 nt, hsa
acuggagccauggcucagaggugauucgggcagccagggacaggagccacccuccccaggccca

SEQ ID NO: 46994 - RNA, 64 nt, hsa
gacugaaucugggaccuguguuccccccggcaggcagggacaagauggcauggcaagcaugggg

SEQ ID NO: 46995 - RNA, 64 nt, hsa
gcauuuugguuuccuuaaggcccagcaagacuuccagggacaucucuggugaagccagaaugga

SEQ ID NO: 46996 - RNA, 64 nt, hsa
gaaacagccuuccuggagcguugucuggagguuccagggacagggcagccucccagagccgagc

SEQ ID NO: 46997 - RNA, 64 nt, hsa
aggaugauggaccccucagaggcaagacuaggaucagggacagaucuggaggcccaggacaugg

SEQ ID NO: 46998 - RNA, 64 nt, hsa
caaaggacuugaucugaguugggaguaaggcccccagggacaccccaucauuucacccucacau

SEQ ID NO: 46999 - RNA, 64 nt, hsa
gugcaaugaagcccugcucccagccuuucagagacagggacacagccccuauuuggaacccuga

SEQ ID NO: 47000 - RNA, 64 nt, hsa
uugcccccuaucuccuggggagggugaggcagggcagggacagucuccagggucagucccugga

SEQ ID NO: 47001 - RNA, 64 nt, hsa
agcaaaagccuagaaauaacccagaugcccaugagcaagagaguggacaaguaaacuggaauau

SEQ ID NO: 47002 - RNA, 64 nt, hsa
gcacaggaguuugaggcugcagugagcagccugggcaagagagugagacuccguuuugugccac

SEQ ID NO: 47003 - RNA, 64 nt, hsa
aagauagcgccauugcacuccagcgugggcgacagcaagagacuucauuucgauaaauaaguaa

SEQ ID NO: 47004 - RNA, 64 nt, hsa
gugggaggcaaaaagcacuucuuacauggcggcagcaagagaaaaugagaaagaagcaaaagug

SEQ ID NO: 47005 - RNA, 64 nt, hsa
gcgggaggugaaaagcacuucguacauggugguggcaagagaaaaugaagaagaagcaaaagug

SEQ ID NO: 47006 - RNA, 64 nt, hsa
ucaaauaacuuucaggauguauuuuaaaugagcugcaagagagaaaaaucugacaggagauggg

SEQ ID NO: 47007 - RNA, 58 nt, hsa
caggaagauucucaugcugaacagaagggcaagagagguggaucugugagggaaaaga

SEQ ID NO: 47008 - RNA, 64 nt, hsa
ggaaugaauguucauggaagaggcuccucugagggcaagagaccuguuuuagugcugcauucga

SEQ ID NO: 47009 - RNA, 64 nt, hsa
uaagaugagagaguuuagggacuacucuguuuuagcaagagauauuuugggggucuuuuuguuu

SEQ ID NO: 47010 - RNA, 64 nt, hsa
uguggcugcuguguugggcauggauggagaaucagcaagagaaaugcuguauuaggacuaauaa

SEQ ID NO: 47011 - RNA, 64 nt, hsa
aggcacagcaaauggcacauacaagggccagggagcaagagagaggacagguccucaacaaaug

SEQ ID NO: 47012 - RNA, 64 nt, hsa
ccuaugauaaaauuuaguuuacagauuagacacagcaagagauuuaaaacaauaauaaacauaa

SEQ ID NO: 47013 - RNA, 64 nt, hsa
uuccacucuugaguaugguaguccccuauuuucugcaagagauggacucuaagacccccagugg

SEQ ID NO: 47014 - RNA, 64 nt, hsa
cccugaggggccagucuccucacugguggggaacgcaagagaaucugcguagaugggugacuca

SEQ ID NO: 47015 - RNA, 64 nt, hsa
gggccccucucuuuaccuuuguugggggaaggaggcaagagagaaauuccuucuucccagccag

SEQ ID NO: 47016 - RNA, 64 nt, hsa
aaaauugacgcauguuaaucuaugcaaagagaaaggaaaggaugaggugauguauugacucaag

SEQ ID NO: 47017 - RNA, 64 nt, hsa
aagauauuaaaguaauucaaaucuuccccaaaggggaaaggaagagagugauacugaccuuuuu

SEQ ID NO: 47018 - RNA, 64 nt, hsa
ucacucaagcucccguaaggauauuaccgucucaggaaaggaucaggacuccaugucacagucc

SEQ ID NO: 47019 - RNA, 64 nt, hsa
gauugggagucgucgaaauguuuagauucuuuuaggaaaggaauuauuuuccccccuuuuacag

SEQ ID NO: 47020 - RNA, 64 nt, hsa
uacccuuaacuuagggaugaacagacuauaacuaggaaaggaggaaagguaucagggauuuuua

SEQ ID NO: 47021 - RNA, 64 nt, hsa
ggaaagaggccucugaauggcuaagggaacaucuggaaaggaaggaaaaugagcccuaaagguu

SEQ ID NO: 47022 - RNA, 64 nt, hsa
uuuggcuugcuugaggcugcuggccuuuuuggaaggaaaggaaggggaagacacccuaguucuc

SEQ ID NO: 47023 - RNA, 64 nt, hsa
agacaguggaguucacaagacuacgcauucaagaggaaaggacuuuggcuugcuugaggcugcu

SEQ ID NO: 47024 - RNA, 64 nt, hsa
uagggugguauuuagucuauuagccacaaaauugggaaaggaguagaaaaagcaguaacugaca

SEQ ID NO: 47025 - RNA, 64 nt, hsa
cccaaaguaucaggacgagaaugaggguccuuugggaaaggagaaguuaagcaacaucuagcaa

SEQ ID NO: 47026 - RNA, 64 nt, hsa
cucacagagccacaggaagaucauucagaaacuaggaaaggaggcccccacagcugauccugcc

SEQ ID NO: 47027 - RNA, 64 nt, hsa
uuuauaauuaggcuuuauuaucuuccuaaaucaaggaaaggaaaucauccccagaccauuuaug

SEQ ID NO: 47028 - RNA, 64 nt, hsa
uagagcuguucccaccagggcucugggacagacuggaaaggaccacagaccuggccaucccugg

SEQ ID NO: 47029 - RNA, 64 nt, hsa
acaugagcuguuucucuccuuaaagaagaucccuggaaaggaugcuuuuccucuccuuugccug

SEQ ID NO: 47030 - RNA, 64 nt, hsa
cuuaauaaauauaguugucuuucuuugcugcuguggaaaggauucuaaacagaugucccugaag

SEQ ID NO: 47031 - RNA, 64 nt, hsa
accucaugucauuucucauggauuugguuaugauggaaaggaagaaugcagaggaggagaaaag

SEQ ID NO: 47032 - RNA, 64 nt, hsa
uuguccacuuagucacacaucuuuugugggaaugggaaaggaaggagacagccaaacucugaca

SEQ ID NO: 47033 - RNA, 64 nt, hsa
auaaugucccaugauuuaauauaugugguuugggggaaaggacaagaaaaaacuauaauuccac

SEQ ID NO: 47034 - RNA, 64 nt, hsa
uaaugcugguggaauggaggaguuguuuggggagggaaaggagagagaaggaaaggagugaggu

SEQ ID NO: 47035 - RNA, 64 nt, hsa
ggaggaguuguuuggggagggaaaggagagagaaggaaaggagugagguauuucccgucuaaca

SEQ ID NO: 47036 - RNA, 64 nt, hsa
gcucauguuagagcgacauucaaauggaagguuuggaaaggaaugccucugucuugugaaguag

SEQ ID NO: 47037 - RNA, 64 nt, hsa
uuuggcaguaauugucuguuuaaaaaaauaaaaaggaaaggaagcguucaccgccacaaaucau

SEQ ID NO: 47038 - RNA, 64 nt, hsa
ucguuuauccugacugaaauagacaaaguaagagggaaaggaaaagagguaucaaguaaauacu

SEQ ID NO: 47039 - RNA, 64 nt, hsa
caaauccagaagcaaagagauaguaggacccaagggaaaggaagggaagagugcuccaagacuu

SEQ ID NO: 47040 - RNA, 64 nt, hsa
aaggcagagagaagagacagaacuaaaaauacgaggaaaggagagugaggauuuucauuaaaag

SEQ ID NO: 47041 - RNA, 64 nt, hsa
agcuggaaaccuggcuucuccaugugaggggaugggaaaggaaagaagagaaugaagacuacuu

SEQ ID NO: 47042 - RNA, 64 nt, hsa
cugcagccucuugucugguugaggacuuggggcaggaaaggaaugcugcugaacuugaauuucc

SEQ ID NO: 47043 - RNA, 64 nt, hsa
acuugaauuucccuuuacaaggggaagaaauaaaggaaaggaguugcugccgaccugucacugu

SEQ ID NO: 47044 - RNA, 64 nt, hsa
uagcuuuuccaacaaaucuuugaaaagcaaucuuggaaaggaauucauuaacuaaaugggguaa

SEQ ID NO: 47045 - RNA, 64 nt, hsa
uuuuauacugcacuuuuuaaagcuuuuauguugaggaaaggaaaagggcauuugucuaaacaug

SEQ ID NO: 47046 - RNA, 64 nt, hsa
uugugguguuuguuuccauccccaaggcaaacaaggaaaggaaaggaaagaagaaaaggugccu

SEQ ID NO: 47047 - RNA, 64 nt, hsa
guguuuguuuccauccccaaggcaaacaaggaaaggaaaggaaagaagaaaaggugccuuaguc

SEQ ID NO: 47048 - RNA, 64 nt, hsa
ggggaagucagcugaaacuugucuuguuuugccaggaaaggaaguaguugccuuuggucaucca

SEQ ID NO: 47049 - RNA, 64 nt, hsa
uuuaugagugauugcucuacauuauuucuucaaaggaaaggaaaggaauugaagacuuugcuac

SEQ ID NO: 47050 - RNA, 64 nt, hsa
gagugauugcucuacauuauuucuucaaaggaaaggaaaggaauugaagacuuugcuacucucu

SEQ ID NO: 47051 - RNA, 64 nt, hsa
caagaauaccacauuuugaaacccagaaagaccuggaaaggagcccagcauguccaucuuuuca

SEQ ID NO: 47052 - RNA, 64 nt, hsa
guuuagacaggauauuuucuugaugaagugauaaggaaaggacccauuuuuuugcucaucaccu

SEQ ID NO: 47053 - RNA, 64 nt, hsa
aguuggaguccgcguagucagcacagacagcaguggaaaggacgcucuggguccuguuauuugc

SEQ ID NO: 47054 - RNA, 64 nt, hsa
uagaaagcagcucugggaccaguuaccccauuuaggaaaggaguuugcacuaaacuguuuuucu

SEQ ID NO: 47055 - RNA, 51 nt, hsa
ccucugccagcaccuacugagggaaaggaaaagccccuggaaaugcgugug

SEQ ID NO: 47056 - RNA, 64 nt, hsa
cccagauuuguguugaacgaaaacauugugguuuggaaaggagaauucaacaauuaauaguuga

SEQ ID NO: 47057 - RNA, 64 nt, hsa
gcacaauaagcacugcuauuuuucucuuugucuaggaaaggaagcugaaucuuauaucuuaucu

SEQ ID NO: 47058 - RNA, 64 nt, hsa
caguuuucaagauuuuuuuuuuaucugcuuggcuggaaaggagacuagaguaucuaguuuuuag

SEQ ID NO: 47059 - RNA, 64 nt, hsa
aaggcuaguguacuagauguacuuuuucuaaaaaggaaaggacagaaaaaaaugaagaaaggaa

SEQ ID NO: 47060 - RNA, 64 nt, hsa
ucuaaaaaggaaaggacagaaaaaaaugaagaaaggaaaggaagacaaauguaaagaaauaagg

SEQ ID NO: 47061 - RNA, 64 nt, hsa
aauuaaacaauaaaccagacagcaaggcccugggggaaaggacaacauccugaaauaaaugaug

SEQ ID NO: 47062 - RNA, 64 nt, hsa
augcaagcaaacgggcaacucuggagaaaaauaaggaaaggaaugcugacuuucucuuucuuuc

SEQ ID NO: 47063 - RNA, 64 nt, hsa
gagcacauugauuuuucaaaagccagcucugucaggaaaggaggugcuguuaugagcagcucuu

SEQ ID NO: 47064 - RNA, 64 nt, hsa
uuucuuuuaaugaagaaacaccaaagaaagcuguggaaaggaccugccccacaugaaaaggaua

SEQ ID NO: 47065 - RNA, 64 nt, hsa
aacauuagcuuaugcuucuuuagauggaauaaugggaaaggagggaaaugggaaauggauggaa

SEQ ID NO: 47066 - RNA, 64 nt, hsa
gggaaaggagggaaaugggaaauggauggaaaugggaaaggagggaaaauaauagcccagugag

SEQ ID NO: 47067 - RNA, 64 nt, hsa
ucuucauuccggggaacaaagacggguauuguugggaaaggaacaggcuuggagggaagggaga

SEQ ID NO: 47068 - RNA, 64 nt, hsa
cagcucacugcugcugccucugaaacagaaaguuggaaaggaaaaaagaaaaaagcaauuaggu

SEQ ID NO: 47069 - RNA, 64 nt, hsa
ugauaaagccagcggggagggacugauuuuuauaggaaaggaggaaaaauaauggaaacacauc

SEQ ID NO: 47070 - RNA, 64 nt, hsa
ugaacaucuaaacugggacuauacuaguaggagaggaaaggaaaaaacauuuggaaaauaguaa

SEQ ID NO: 47071 - RNA, 64 nt, hsa
auugcuucaguuguaaaugugaaaaaugggcuggggaaaggagguggugucccuaauuguuuua

SEQ ID NO: 47072 - RNA, 64 nt, hsa
cuuugucugcucucagugucuucccuuugacaugggaaaggaguuguggccaaaauccccaucu

SEQ ID NO: 47073 - RNA, 64 nt, hsa
gccuuucuggcuccugauaggguggagcaaaaguggaaaggaaaggaaagaggccuuuucucac

SEQ ID NO: 47074 - RNA, 64 nt, hsa
ucuggcuccugauaggguggagcaaaaguggaaaggaaaggaaagaggccuuuucucacagcca

SEQ ID NO: 47075 - RNA, 64 nt, hsa
cccuaaaagagcuccugaaggaagcacuaaacauggaaaggaacaacugauaccagccgcugca

SEQ ID NO: 47076 - RNA, 64 nt, hsa
gaccuuugacaaaccugacaaaaacaagcaauggggaaaggauucccuauuuaauaaauggugc

SEQ ID NO: 47077 - RNA, 64 nt, hsa
auggucaaauugauacccuuaauaagaaaggaaaggaaaggaaaacagauccuccccucugcuu

SEQ ID NO: 47078 - RNA, 64 nt, hsa
gucuuauggucaaauugauacccuuaauaagaaaggaaaggaaaggaaaacagauccuccccuc

SEQ ID NO: 47079 - RNA, 64 nt, hsa
cggagaguaguccgcgccaggaagagagcaacgaggaaaggagagggacucuggcgucccggca

SEQ ID NO: 47080 - RNA, 64 nt, hsa
acggaugcugguauuuuaacagauggagagacaaggaaaggaaaggaaaggccuggcaugggca

SEQ ID NO: 47081 - RNA, 64 nt, hsa
ugcugguauuuuaacagauggagagacaaggaaaggaaaggaaaggccuggcaugggcauugug

SEQ ID NO: 47082 - RNA, 64 nt, hsa
cuccuaccuaucugugcauuuuaccggcaccucaggaaaggagggugaccagguugucuuagcu

SEQ ID NO: 47083 - RNA, 64 nt, hsa
gugguagccaucucuuuagacucauguguuuuggggaaaggaagaaguucuuggcugaguacua

SEQ ID NO: 47084 - RNA, 64 nt, hsa
uaaaugaauguacauucuucucacugacuuuggugauuuugaaaccuagaaugauguguuucua

SEQ ID NO: 47085 - RNA, 64 nt, hsa
uaguccacuuuugauuguaauuuuuaugguauaggauuuugaaucuucuauuuuaggcuuguca

SEQ ID NO: 47086 - RNA, 64 nt, hsa
caguggcaaaaaagaacaaaaucugagcagagaugauuuugaaccagauauuuugccauuauca

SEQ ID NO: 47087 - RNA, 64 nt, hsa
auucugauucaguaggucugggaguggcgcgcuggauuuugaucaaaauuguagagcauuuuaa

SEQ ID NO: 47088 - RNA, 64 nt, hsa
cugugucuaaaacaaacaaaaaaauuuuuaauuggauuuugauaugguuuggaucugugucccc

SEQ ID NO: 47089 - RNA, 64 nt, hsa
caguggcuuucaaaguuaugcaauaauaaggaaagauuuugagauggguggcauauguuuugcc

SEQ ID NO: 47090 - RNA, 64 nt, hsa
uauauauauguacuguuuuguuuccugucuugaagauuuugaguuaugguuauugguuucagau

SEQ ID NO: 47091 - RNA, 64 nt, hsa
agaaacaaugacauaucaaaacugcuuuuuacaugauuuugaaauagacuagaaagcuuucccu

SEQ ID NO: 47092 - RNA, 64 nt, hsa
cagaaaaucuucagaaagacaucagguuuguucugauuuugacaaggguaacuucuucuuuauu

SEQ ID NO: 47093 - RNA, 64 nt, hsa
uuuuacaucagaucauuguggaauuuuguaaacggauuuugauguuucucuuuuagugguauua

SEQ ID NO: 47094 - RNA, 64 nt, hsa
auaugggguccuuacuuguauucuuuuaucagcugauuuugaaacauauaauaaugauuuucuu

SEQ ID NO: 47095 - RNA, 64 nt, hsa
uuuucuuguucccuucuuuaacuagcugccuuuagauuuugauaaucacagucuuaaaauacua

SEQ ID NO: 47096 - RNA, 64 nt, hsa
uucaugauuuugaaaccaugaagagauuuuucaugauuuugaaaucaugaagauauuuuuccau

SEQ ID NO: 47097 - RNA, 64 nt, hsa
uuugcccaucccaaaaucauaagauauuuuucaugauuuugaaaccaugaagagauuuuucaug

SEQ ID NO: 47098 - RNA, 64 nt, hsa
aaaugcuggugggucuccguguuuaugagucacagauuuugaaagcuaucaggaaaugacuaga

SEQ ID NO: 47099 - RNA, 64 nt, hsa
uccucccagauccccaagaucugugucacuggucgauuuugaacuuuagguacauguguucuuu

SEQ ID NO: 47100 - RNA, 64 nt, hsa
uccauucucugagucagugguuauuugaaaauuugauuuugauuuuauuuuuucucuguaaacu

SEQ ID NO: 47101 - RNA, 64 nt, hsa
ucgccugaguugcuuuuacuucucuauacaaaaugauuuugaagagauuuuaaagacguucccu

SEQ ID NO: 47102 - RNA, 64 nt, hsa
uaagacugaggucagaaaggugcagagaugaaaagauuuugaaggaccuuaugaaauaugaugg

SEQ ID NO: 47103 - RNA, 64 nt, hsa
cuuuuaguccacauuagcagggaagaauuuggaagauuuugagcaaaaaaacaaugaucugcuu

SEQ ID NO: 47104 - RNA, 64 nt, hsa
uuacugcuaagagggaguaauaguuauuacuaaugauuuugauuggguugcauuuuuguugcaa

SEQ ID NO: 47105 - RNA, 64 nt, hsa
ucauauuuaaguagccuguggcuauuuuuauacugauuuugauaucauguucuuuucauagucg

SEQ ID NO: 47106 - RNA, 64 nt, hsa
uguguauauuccaguuaccuagauauucccuugagauuuugauacaauuugagggaggcagaag

SEQ ID NO: 47107 - RNA, 64 nt, hsa
auuccaucuuuucugaagauuguccuacaauuuggauuuugaucaugacaaagaagauuaaaau

SEQ ID NO: 47108 - RNA, 64 nt, hsa
auagacauuucgucauuuaaguaagggaucgaagacauuucaaauugcuaucuccaucugggcu

SEQ ID NO: 47109 - RNA, 64 nt, hsa
auauacauuucaucauuuaaguaagggaucgaaaacauuucaaauugcucuaucugggcugaua

SEQ ID NO: 47110 - RNA, 64 nt, hsa
uaauggaauauccaauuuacagauaguaugauauacauuucaucauuuaaguaagggaucgaaa

SEQ ID NO: 47111 - RNA, 64 nt, hsa
aaauuaaguacucguuuaaguaugguucuuaauuacauuucauucauuuauauuagaguaaaug

SEQ ID NO: 47112 - RNA, 64 nt, hsa
uauaagguacacuugaaacuagugaguguuugucacauuucacuuucaugguauauaaaaugca

SEQ ID NO: 47113 - RNA, 50 nt, hsa
uagagccucgucgaccauagacauuucaaaugcccaaagcaacaguuugu

SEQ ID NO: 47114 - RNA, 64 nt, hsa
auucuuaaauuugccagcguuaaaguagaaaauaacauuucagaagagcacaauaugcauaaaa

SEQ ID NO: 47115 - RNA, 64 nt, hsa
accuugauuuguaaugagcucuuauaugcagaacacauuucaaaugaguuuugcuaugggcugc

SEQ ID NO: 47116 - RNA, 64 nt, hsa
gucaaugaaugaaacuagaaagcagagauuuucaacauuucaaaaugauuuccucuguaaucua

SEQ ID NO: 47117 - RNA, 64 nt, hsa
ggggccuggggcagaggaggcagcagaaaaccaaacauuucacugagaaagcccccucccugcu

SEQ ID NO: 47118 - RNA, 64 nt, hsa
ggaggaaagaaaagcccuucuccuugccccgcacacauuucacucccacuguacugggcuucca

SEQ ID NO: 47119 - RNA, 64 nt, hsa
ugucacaucaagggcaggaucucauagcuagggaacauuucacaaauaaggugagauuuuguaa

SEQ ID NO: 47120 - RNA, 64 nt, hsa
ccuuagcugcuggguugauugaaauuugaucucuacauuucaaaaucaaacuagugaauacagu

SEQ ID NO: 47121 - RNA, 64 nt, hsa
gugucacuugcaaauaacaaagggacuuugagggacauuucauuaaauauaauuacugauacuu

SEQ ID NO: 47122 - RNA, 64 nt, hsa
uauugacugugaauucauuuacauguaacuucugacauuucacucugugcaaauaaagaacaug

SEQ ID NO: 47123 - RNA, 64 nt, hsa
uaaaacuaguugauuuaaagaguuuuuuugcacaacauuucaauuauauuugugaacuuagaaa

SEQ ID NO: 47124 - RNA, 64 nt, hsa
aaaauaugugauuauauauguuaaaguauagauaacauuucacacuuggauacauaugugcauu

SEQ ID NO: 47125 - RNA, 64 nt, hsa
gacaaaguaugccaucaugcaagcugcaaaggaaacauuucaagagucuauaucuauuuucacg

SEQ ID NO: 47126 - RNA, 64 nt, hsa
caacaguuuagcaguacaagcuucuauugcuaaaacauuucaaaaaacucagagauauuacucu

SEQ ID NO: 47127 - RNA, 64 nt, hsa
aauguacagaaaauagcuuuuauugaguaauauuacauuucauuuauacuguagcaauauauuu

SEQ ID NO: 47128 - RNA, 64 nt, hsa
uucacaagcuaggccaaugaaggcugaaucaaagacauuucauccaccaauaucauguguagau

SEQ ID NO: 47129 - RNA, 64 nt, hsa
aauaauccacacauuucaugcucuaauaauccacacauuucaugcucauuuuuauuguuuuuac

SEQ ID NO: 47130 - RNA, 64 nt, hsa
cauuucacaagugcaugucuuucuaauaauccacacauuucaugcucuaauaauccacacauuu

SEQ ID NO: 47131 - RNA, 64 nt, hsa
uguaucauuuuuauuugaauccaucaugcaguguacauuucagauaauuuccuucagucuccag

SEQ ID NO: 47132 - RNA, 64 nt, hsa
guaguuugauaauaaauagcaguucuaguacuucacauuucacccgugugugcaaugccuuuuu

SEQ ID NO: 47133 - RNA, 64 nt, hsa
aguguccacaagaagggguguuuauucuuccaacacauuucacuuuucuguaaauauacauaaa

SEQ ID NO: 47134 - RNA, 64 nt, hsa
uggagcuccacugccauguacccaguaggguuugacauuucauuagccaugcaacauggauaug

SEQ ID NO: 47135 - RNA, 64 nt, hsa
aucaaauaaaaccagugaagaucugaagaugcaaacauuucaacuaugaagauuuacauuucac

SEQ ID NO: 47136 - RNA, 64 nt, hsa
ucugaagaugcaaacauuucaacuaugaagauuuacauuucacuuucuaauuuauuaaacaucu

SEQ ID NO: 47137 - RNA, 64 nt, hsa
ugagguucaguuugguuggguaaaucuguuguguacauuucaacaaauacuuuuacauuugaca

SEQ ID NO: 47138 - RNA, 64 nt, hsa
augcacucaggugcccuuuguuucaugaacaaauacauuucauuguacauguuuucuguuuaaa

SEQ ID NO: 47139 - RNA, 64 nt, hsa
aagggugcugccacggaguggugagguaccgucuacauuucacauuauucugggcaccacaaaa

SEQ ID NO: 47140 - RNA, 64 nt, hsa
aaucaauuuaaguguuggaaaaaauuugucugaaacauuucauaauuuguuuccagcaugaggu

SEQ ID NO: 47141 - RNA, 64 nt, hsa
gaucuuccuuugaaagagaaugaaagacccugugacauuucacuucaaaaauaagcccuguagc

SEQ ID NO: 47142 - RNA, 64 nt, hsa
uaaaaaaaauauguugucaugaaucuucacaguaacauuucagaaaggugcuuuuuugguacuc

SEQ ID NO: 47143 - RNA, 64 nt, hsa
cguacucacagguuugcaaaugggaaaaaaguuuacauuucaguuuaggggcauaucuaagcua

SEQ ID NO: 47144 - RNA, 64 nt, hsa
ugcuauuauauuuggcaggaacccagaguccagaacauuucaucuaugauggguuagauaaugu

SEQ ID NO: 47145 - RNA, 64 nt, hsa
cucuuuuuauugcuuugucuauguuucauaugaaacauuucagaaauuauuuugauaaguguug

SEQ ID NO: 47146 - RNA, 64 nt, hsa
aaaaacuuauuuuucuaguaaauauuaauguauuacauuucaaauaauggugccugacauauug

SEQ ID NO: 47147 - RNA, 64 nt, hsa
auucucuuccuacuauauuucauaucuaccuacuacauuucauaucauuccuacuacauuucau

SEQ ID NO: 47148 - RNA, 64 nt, hsa
auaucuaccuacuacauuucauaucauuccuacuacauuucauaucuaccuacauuuacaugua

SEQ ID NO: 47149 - RNA, 64 nt, hsa
auaauuuaauuacauuuuacuuuaaaaacuuuacacauuucaguuucuaaaauuuuaaauuaac

SEQ ID NO: 47150 - RNA, 64 nt, hsa
uuuuauuuagaacugugagaccgguauuuuggaaacauuucaaaggaaacauaugaauuuguuu

SEQ ID NO: 47151 - RNA, 64 nt, hsa
aaggcaaagggguaccccaaauccagaggugccuacauuucaggcagccuuggaguauuuuaaa

SEQ ID NO: 47152 - RNA, 64 nt, hsa
augacauucuuauacugcugucucaaauccaaaaacauuucagagcucuugucucagagaugug

SEQ ID NO: 47153 - RNA, 64 nt, hsa
uuaaauuauaauguaaaguugacauuuuccccuuacauuucaaaggcaucacuauuuuuaaaug

SEQ ID NO: 47154 - RNA, 64 nt, hsa
ugaucuaaagauaaugucuuagacaauuaccuuuacauuucaagcucugggauauaaauuacgu

SEQ ID NO: 47155 - RNA, 64 nt, hsa
agcuacagcugcaguagcuuuuaaguauguaucaacauuucauuauaaauuauagcuuccuggu

SEQ ID NO: 47156 - RNA, 51 nt, hsa
aacgcaggcaacagaccuaauacauuucaaaacuugauauuucauuuugcg

SEQ ID NO: 47157 - RNA, 64 nt, hsa
accugcuaauagcaccaucgucacuauuaagcagacauuucaguugguagaauccauguagaag

SEQ ID NO: 47158 - RNA, 64 nt, hsa
ccaagucugugguccaugggcuuucauuucugucacauuucauuucuuggaaaaggccuccuuc

SEQ ID NO: 47159 - RNA, 64 nt, hsa
cuuugauaccaccaucauguucagaccauuuuauacauuucaguggccuuuuuuuuuuuuuaag

SEQ ID NO: 47160 - RNA, 64 nt, hsa
aaccauaauuaaaguugcauaagauaauugcuuuacauuucacauaccuauauuuaucugagug

SEQ ID NO: 47161 - RNA, 64 nt, hsa
gcaucagucuguucucuuugaccacaauuggaauacauuucaagaugguaacagccccaugaag

SEQ ID NO: 47162 - RNA, 64 nt, hsa
auuaaauaaauucauggcaauguuuuuuuaaaagacauuucagcuucuuuacucaguucugcau

SEQ ID NO: 47163 - RNA, 64 nt, hsa
guguaaauacaucuugucuuguuuucauucaaaaacauuucacuuuugggguugcgugucagau

SEQ ID NO: 47164 - RNA, 64 nt, hsa
aaagucgaaauuaauguaguuuucugccuugauaacauuucauaugugguauuaguuuuaaagg

SEQ ID NO: 47165 - RNA, 64 nt, hsa
ccuuuacagagguucggacuaacauuucacaugcacauuucaaaacaagaugugucaugaaaac

SEQ ID NO: 47166 - RNA, 64 nt, hsa
uacgcaaaaacuuccuuuacagagguucggacuaacauuucacaugcacauuucaaaacaagau

SEQ ID NO: 47167 - RNA, 64 nt, hsa
uucugugugcucuuaaauauauuaaaaacaauuuacauuucaggaauucugucuguaauugauu

SEQ ID NO: 47168 - RNA, 64 nt, hsa
agguacauuccagccuguuggcaacuccauaaaaacauuucagauuuuaauccgaauuuagcua

SEQ ID NO: 47169 - RNA, 64 nt, hsa
guggaaggucauagccuggaacccaaguuugaaaacauuucauuguguucaguagugaauuucu

SEQ ID NO: 47170 - RNA, 64 nt, hsa
ucuuugaaagucuaggaguagguggucaucuuguacauuucagcaaagcauccacuaggaaacc

SEQ ID NO: 47171 - RNA, 64 nt, hsa
cuuuggcaggguuuaaaauauuugugagaagcccacauuucaguauacauccucacuggcuucc

SEQ ID NO: 47172 - RNA, 64 nt, hsa
agaagccuaacuuuuuacacagugguuacauuucacauuucacuaauguugauauuuggcugau

SEQ ID NO: 47173 - RNA, 64 nt, hsa
auguuucagaagccuaacuuuuuacacagugguuacauuucacauuucacuaauguugauauuu

SEQ ID NO: 47174 - RNA, 64 nt, hsa
cuggccaugaugauauuauuaaacaccauuauucacauuucaaauaauaacaauacuuuuuguu

SEQ ID NO: 47175 - RNA, 64 nt, hsa
uaauucuaaccuuugauaguaaucagaauguauuacauuucauuucugaauagcuuuugaauuu

SEQ ID NO: 47176 - RNA, 62 nt, hsa
accacccagcuuucucccagccacagccaagauucccaaagucaaggcccaaagauuuccaa

SEQ ID NO: 47177 - RNA, 62 nt, hsa
uucccaaagucaaggcccaaagauuuccaagguucccaaagucaaggccaggccaaggccug

SEQ ID NO: 47178 - RNA, 62 nt, hsa
uaaaagugcuagagaauuuaacuaaaagcugguucccaaaugcauagcuggcauuuuaauuu

SEQ ID NO: 47179 - RNA, 62 nt, hsa
uaaaucaucuaacuggauuuuuccauuggucauucccaaacacaccuaugguccuagaaucc

SEQ ID NO: 47180 - RNA, 62 nt, hsa
ggaaguuguugacccaagaacauagguuauauuucccaaaucuuuaauuauugagugaaaga

SEQ ID NO: 47181 - RNA, 62 nt, hsa
caucccaggaugugagugggucugaagauacauucccaaauaaacgaccuaggcuagaagau

SEQ ID NO: 47182 - RNA, 62 nt, hsa
ugcaaaacaggcugauuucaauuaggcagcacuucccaaagugcacugaggaagguggcccc

SEQ ID NO: 47183 - RNA, 62 nt, hsa
ccugaccucaggcgauccacccccaccucggcuucccaaagugcugagauuacaggugugag

SEQ ID NO: 47184 - RNA, 62 nt, hsa
ucaucugcuuuuucguucugcgauaugcccaguucccaaaucaauuauagguaccuguuuag

SEQ ID NO: 47185 - RNA, 62 nt, hsa
ucaaccccaggaaguaauuauuuacaacgauuuucccaaauuuuguacaaucuguccuggaa

SEQ ID NO: 47186 - RNA, 62 nt, hsa
auagaccuuaaauaaguguccuaagucagugguucccaaaucuggcuggucgggaauaccug

SEQ ID NO: 47187 - RNA, 62 nt, hsa
ccaauugagaggaaaaugagaucaaaugucauuucccaaauuucuuguaggccguuguuuca

SEQ ID NO: 47188 - RNA, 62 nt, hsa
uauacuguagccuuuuaacagcaagucuugcuuucccaaacagaaagccauucugaaacccu

SEQ ID NO: 47189 - RNA, 62 nt, hsa
ucuccacugggggcuuacgggagugagcgguuuucccaaaacaagcccuuccuggcucccac

SEQ ID NO: 47190 - RNA, 62 nt, hsa
ucuaaagaauuuaauucuaaaaguuauagacauucccaaagauauaccugcaagcaucacag

SEQ ID NO: 47191 - RNA, 62 nt, hsa
ugaguuuuguaccuucuauuuuaaaagaggcuuucccaaacugugccauuuaucaauuuauu

SEQ ID NO: 47192 - RNA, 62 nt, hsa
augauuugcacuuuuucacugcaugcuuacaauucccaaaggcaaaaucuguacugagguag

SEQ ID NO: 47193 - RNA, 62 nt, hsa
accugcuugcuuccuaccacagauucuuuauuuucccaaacacuacaaaaaaacuuuuaaaa

SEQ ID NO: 47194 - RNA, 62 nt, hsa
gcuuuaggcggcagaugauauacauaucugacuucccaaaagcuccaggauuugugugcugu

SEQ ID NO: 47195 - RNA, 62 nt, hsa
ggucagcucuuuuuaacuucuugcugcucuuuuucccaaaagguaaaaauauagauugaaaa

SEQ ID NO: 47196 - RNA, 62 nt, hsa
ucuuuaugcauugucucaacacuuucccuuuuuucccaaaaugaguagagaauuaaagccac

SEQ ID NO: 47197 - RNA, 62 nt, hsa
auuuuuucuuuucaccacccuguugagcaauuuucccaaaaaaagggcagcaauuauuaaau

SEQ ID NO: 47198 - RNA, 62 nt, hsa
gcauuuggauguguaaauuacaguaaucccauuucccaaaccuaaaaucuguuuuucucauc

SEQ ID NO: 47199 - RNA, 62 nt, hsa
cucugcaguuuuucccaaguacccugagauacuucccaaagcccuuauguuuaaucagcgau

SEQ ID NO: 47200 - RNA, 62 nt, hsa
uacacaaaucuuuacuucucuaccaauuccuauucccaaaaugaacauauuacuggggaaag

SEQ ID NO: 47201 - RNA, 62 nt, hsa
augcacuuaugcaguaaauuaucuugggauaguucccaaaagauugcugaaaaaguagauug

SEQ ID NO: 47202 - RNA, 62 nt, hsa
ccuaaaucugagucaguaauucucuuacauccuucccaaaaaucagugucuagggacuaguu

SEQ ID NO: 47203 - RNA, 62 nt, hsa
cuaaaucugagucaguaauucucuaaaaauccuucccaaaaaucagugucuagggacugguu

SEQ ID NO: 47204 - RNA, 62 nt, hsa
uauaacauuaaauaauguaacguagguguagauucccaaaugcauuuggauguacagaucga

SEQ ID NO: 47205 - RNA, 62 nt, hsa
gcaguaggcauuacuacaguacauggcuaaucuucccaaaaacuagcucauuaaagaugaaa

SEQ ID NO: 47206 - RNA, 62 nt, hsa
acgagccuugccugaccucuucggugcugaccuucccaaagugaugccuuacugguuuugua

SEQ ID NO: 47207 - RNA, 62 nt, hsa
uguugaguuaccaauggaagccaaaaguucucuucccaaacugccaagaaugauacaggcca

SEQ ID NO: 47208 - RNA, 62 nt, hsa
ugcguccucuguccccggguuucagagacaacuucccaaagcacaaagcaguuuuucccccu

SEQ ID NO: 47209 - RNA, 62 nt, hsa
ccacaccccccuuggggccuccccuccacuccuucccaaaucugucuccccagaagacacag

SEQ ID NO: 47210 - RNA, 62 nt, hsa
agcaucuguccccagaaucaggcagaauccacuucccaaacagagccccacgcagguucacc

SEQ ID NO: 47211 - RNA, 62 nt, hsa
uuuuacuuggcauugguuuugaaaccagcuguuucccaaacucugcuucccaagggcaaccg

SEQ ID NO: 47212 - RNA, 62 nt, hsa
uaacugcagcucagcuuucacuauagcagugcuucccaaacggguucuagacuuggguguuu

SEQ ID NO: 47213 - RNA, 62 nt, hsa
ggggggccugccaagggggggccuuguucuuguucccaaacucugacuuggaagaacucagc

SEQ ID NO: 47214 - RNA, 62 nt, hsa
uguuuaggcauuugugaaggauuccagagccuuucccaaagugagaccauuucugggguauu

SEQ ID NO: 47215 - RNA, 62 nt, hsa
uagcuuugugucaccuuugaaucugaggcaguuucccaaacaaaaaggcuggagccauuuuu

SEQ ID NO: 47216 - RNA, 62 nt, hsa
ggagccauuuuucagaaguugcuuauacccuguucccaaacuaucagccuugauuaauuucu

SEQ ID NO: 47217 - RNA, 62 nt, hsa
uuuuuggaaaaacaaaauuucuacaauuacaguucccaaagucaguuauucauguuuucauu

SEQ ID NO: 47218 - RNA, 62 nt, hsa
uucuuggauaaagaaaauuucuacaauuacaguucccaaagacacaguuguucauguuauuu

SEQ ID NO: 47219 - RNA, 62 nt, hsa
aggaccgacuuuauaacuuuuccaguguuugauucccaaauugggucugguuuuguuuugga

SEQ ID NO: 47220 - RNA, 62 nt, hsa
auugcuucagaugaaaacaaaucacacaccguuucccaaaccaacagucuucacauuucuau

SEQ ID NO: 47221 - RNA, 64 nt, hsa
aacccccagucaguguuugagccuccucguuccccucacgcacccgcucacgcacccucgguga

SEQ ID NO: 47222 - RNA, 64 nt, hsa
guguuugagccuccucguuccccucacgcacccgcucacgcacccucggugaauccuuggugau

SEQ ID NO: 47223 - RNA, 64 nt, hsa
aaaaaaucaaacuguaguuguuuuggcgauaggucucacgcaacacauuuuuguaugugugugu

SEQ ID NO: 47224 - RNA, 64 nt, hsa
aacucccuuucauguuaaucaaacaagugaguagcucacgcagcaacguuuuuaauaggauuuu

SEQ ID NO: 47225 - RNA, 61 nt, hsa
aagccaugggaccuccucccucauucaucuugcaagcaaaucccauuucuugaaaagccuu

SEQ ID NO: 47226 - RNA, 61 nt, hsa
cccaccccagugcacucuucuggcccaggcagcaagcaagcugugaacagcuggccugagc

SEQ ID NO: 47227 - RNA, 61 nt, hsa
ccuuuagcucaauugauagggucagcgucucgcaagcaaaaaaucucaugaccucauauuu

SEQ ID NO: 47228 - RNA, 61 nt, hsa
aagcauuccucagaacugucccauuugaagggcaagcaaaccugggguauuuauccacuga

SEQ ID NO: 47229 - RNA, 61 nt, hsa
aaauuuuaaucaauaaaguaugucuguugaagcaagcaagcaaacaaauccauaacaacca

SEQ ID NO: 47230 - RNA, 61 nt, hsa
uuuaaucaauaaaguaugucuguugaagcaagcaagcaaacaaauccauaacaaccacaac

SEQ ID NO: 47231 - RNA, 61 nt, hsa
ugaauauuuuagcuauauuuaguggcuuucugcaagcaacuagaacagagaaguaaugggu

SEQ ID NO: 47232 - RNA, 61 nt, hsa
gaaugucauaguacauugugugcuaaccauggcaagcaaacauuuacauuuguuuuuuaca

SEQ ID NO: 47233 - RNA, 61 nt, hsa
gaucacggauguuggcucccccucgcccuaugcaagcaaacacacucucaccuccucuccc

SEQ ID NO: 47234 - RNA, 61 nt, hsa
ucccaagguucaauaaggccuuauuuaacaagcaagcaaaaugcaaaccaaaccauuauuc

SEQ ID NO: 47235 - RNA, 61 nt, hsa
gagguagaaguacuucaaauucaacaggccagcaagcaaucggcuuaaaauucccuuucuu

SEQ ID NO: 47236 - RNA, 61 nt, hsa
guacauuuuauaaccauccaggccuugguuugcaagcaacagaccuuaaacauacaggaaa

SEQ ID NO: 47237 - RNA, 61 nt, hsa
ccuuguaaaaggccaggguaaaaugucucaggcaagcaaaagauuguccccuucugcauau

SEQ ID NO: 47238 - RNA, 61 nt, hsa
caaauaauucuuuucuguaauccaauaugcagcaagcaagggugaccuccaguggcccacu

SEQ ID NO: 47239 - RNA, 61 nt, hsa
uucguaaucuucaucaagaaguuuuuaaaaggcaagcaaaaacagaagcaaaucauaucaa

SEQ ID NO: 47240 - RNA, 61 nt, hsa
caacugugggauggcgauggugggaugugucgcaagcaauucacuagacaaucuucacaug

SEQ ID NO: 47241 - RNA, 61 nt, hsa
gcuccaucccuggcuuccccagccugcggccgcaagcaaaaccaagcgcgagaugcagcua

SEQ ID NO: 47242 - RNA, 64 nt, hsa
guaaaggguugauuugcugcaagaguagcugagaauucaaaaacauccuugcagaaugauucaa

SEQ ID NO: 47243 - RNA, 64 nt, hsa
guagcugagaauucaaaaacauccuugcagaaugauucaaaagacaaaagccaggcucaacuua

SEQ ID NO: 47244 - RNA, 64 nt, hsa
agagaaaaaaauucggaaagugaucagagcacuuauucaaaauacagugauagaaguucagaaa

SEQ ID NO: 47245 - RNA, 64 nt, hsa
gaagaaaaauccaagucugaacgggaaugcccucauucaaaaaaaagaacuuugaaagagaauc

SEQ ID NO: 47246 - RNA, 60 nt, hsa
acauuuuuauuaguggauagcguuguuggaauucaaaaaacagacaauauugccauagaa

SEQ ID NO: 47247 - RNA, 64 nt, hsa
aagucuugacuaaugguucccgguuuagcugaagauucaaaaaaaaaaaaaaaagcuuuaugcu

SEQ ID NO: 47248 - RNA, 64 nt, hsa
uaauauuuaugcauacuauacuguauaacauguuauucaaaagggauugccauuucugagacac

SEQ ID NO: 47249 - RNA, 64 nt, hsa
uuucacguuugcuuaaaugcuucaucacagucacauucaaaauagugacucuaaacaaagaaga

SEQ ID NO: 47250 - RNA, 64 nt, hsa
aucacaagugguuuaguugggcagggcuuugaucauucaaaaguaacuaaaguagcuccagaau

SEQ ID NO: 47251 - RNA, 64 nt, hsa
auggaauugugaaaacuaugaaucaggguaugaaauucaaaaccuccaccugcccaugcugcuu

SEQ ID NO: 47252 - RNA, 64 nt, hsa
ucagugugcuuuauugaguguggauuuugcauacauucaaaacauuaaccacaaaauacagcaa

SEQ ID NO: 47253 - RNA, 64 nt, hsa
uuuaaggucaaaauacagaucaucuagaaguuagauucaaaauggaaaaccuauucauggcuca

SEQ ID NO: 47254 - RNA, 64 nt, hsa
uucagaagcaaccuggagaacagcuaucaaucauauucaaaaccaguacaagaacugcugccug

SEQ ID NO: 47255 - RNA, 64 nt, hsa
agaaagaaaaaaaugguguuugacguugauggaaauucaaaaauauauauggaacugaaacauu

SEQ ID NO: 47256 - RNA, 64 nt, hsa
ugacaucacaguagaaaccaaaccuuggauuuagauucaaaaggggggaaaugggucuuuucau

SEQ ID NO: 47257 - RNA, 64 nt, hsa
ccagucgccauugcuuuuucagccauucacaagcauucaaaaccaaaccaaacagcaguucaua

SEQ ID NO: 47258 - RNA, 64 nt, hsa
guccaaccaggggacaggguaucauaaagagauaauucaaaacuuuaagauuggaggguaggug

SEQ ID NO: 47259 - RNA, 64 nt, hsa
aaauaacaauuacagauccugauauauagaaguuauucaaaauuauacaguuuucaaaaaauca

SEQ ID NO: 47260 - RNA, 64 nt, hsa
uguugaaaggaaaaaaagugagccucuaggaauuauucaaaaaaagucugugauacauuccuuu

SEQ ID NO: 47261 - RNA, 64 nt, hsa
acugcaggccaguuccaaagaguguuugcuuaagauucaaaaguggguaaguaaaauggaucag

SEQ ID NO: 47262 - RNA, 64 nt, hsa
cugggcaucauagcaagaccucaucucuacuaaaauucaaaaacaaaauuagccgggcaugaug

SEQ ID NO: 47263 - RNA, 64 nt, hsa
ccaacucccucucugugcauuuucuaagugggacauucaaaaaacucucucccaggaccucgga

SEQ ID NO: 47264 - RNA, 64 nt, hsa
gagcuauaggucauacaugaaugucuagugagacauucaaaauucguauagggugcagaguaau

SEQ ID NO: 47265 - RNA, 64 nt, hsa
gguuauauuuuuuaaaauuuacuuaguaaugcacauucaaaacacacaucaagucuucaggaua

SEQ ID NO: 47266 - RNA, 64 nt, hsa
gaacccacgaaaauacccagcgcagcaucuacacauucaaaagauaagcugaguguucccacca

SEQ ID NO: 47267 - RNA, 64 nt, hsa
aaagaggucacauauugugauuuccagcuguagcauucaaaaaaaaaauugguguucaugacuc

SEQ ID NO: 47268 - RNA, 64 nt, hsa
uuuguauuuuuuuuuguuuguuuuguuuuuaaacauucaaaagcaauuaaugaucagacauagg

SEQ ID NO: 47269 - RNA, 64 nt, hsa
aacccugaauagaaacaaaacuuuugaaugcuggauucaaaaaaaaaaaaaaguuaucuggaca

SEQ ID NO: 47270 - RNA, 64 nt, hsa
ugccacugcacuccagccugagugacagagagagauucaaaaaacaaaaaaaaagcaaaaauau

SEQ ID NO: 47271 - RNA, 64 nt, hsa
cuugucacaacugcaaacaauaccugaguggaguauucaaaaacuugcuuagaaagaaaacucu

SEQ ID NO: 47272 - RNA, 64 nt, hsa
aggaacuucuugagaaaucuucauaauaucuucuauucaaaaucuuuuuuuuauuuuuaaggga

SEQ ID NO: 47273 - RNA, 64 nt, hsa
aacguauuguccuuccguuaacagaaacaucacaauucaaaagugaguuuucuuauuauagugu

SEQ ID NO: 47274 - RNA, 64 nt, hsa
cauguacacagaguaucuggagaauaaaacccaaauucaaaaaaaaaaaugauaauuuauuuuu

SEQ ID NO: 47275 - RNA, 64 nt, hsa
gauaagcacauggguaaaaaugagggugauccuuauucaaaaauaacaucugacuacuauaaaa

SEQ ID NO: 47276 - RNA, 64 nt, hsa
ggacaccucugcugugaauguuuuagagaaggaaauucaaaaaauguuguaacugaaagcacug

SEQ ID NO: 47277 - RNA, 64 nt, hsa
uuaugauguucaucacagugugguaagguugcaaauucaaaacaugucacccaagcucuguuca

SEQ ID NO: 47278 - RNA, 64 nt, hsa
uuuaaaucauauuuuacagauguagaagaaauuuauucaaaagugugggcucaugaaguucacu

SEQ ID NO: 47279 - RNA, 64 nt, hsa
auacacaacaccaagugguacaucugcagagauaauucaaaauuccugcuuuugagagagcaaa

SEQ ID NO: 47280 - RNA, 64 nt, hsa
uuauagggagcuggauuucaaaacgugguccaagauucaaaaauccuauugauaguggccauuu

SEQ ID NO: 47281 - RNA, 64 nt, hsa
cccccagugcaaaagacuguuacuuuauuauuguauucaaaauucauuguguauauuacuacaa

SEQ ID NO: 47282 - RNA, 64 nt, hsa
ccucucuuaguagaaacaaagggagaguuagguuauucaaaaauuaguaugggacaauugaaua

SEQ ID NO: 47283 - RNA, 64 nt, hsa
gacauucugccaugacauacacuuaaccaaaacuauucaaaaugaaaaccggauuucaaauaac

SEQ ID NO: 47284 - RNA, 64 nt, hsa
auguaacauaguuucagugugauuucuagagcuaauucaaaauaguauugauauauuuuaugug

SEQ ID NO: 47285 - RNA, 64 nt, hsa
aauccaaaauuuuaaauuuaacucugccucggccauucaaaagucuaauaacaaaaaauguaaa

SEQ ID NO: 47286 - RNA, 64 nt, hsa
auuuuauuuauuuuugaauccacuaucucuuuccauucaaaauauuuccauucaaaaugugguu

SEQ ID NO: 47287 - RNA, 64 nt, hsa
gaauccacuaucucuuuccauucaaaauauuuccauucaaaaugugguucacagacccgccaca

SEQ ID NO: 47288 - RNA, 64 nt, hsa
ggcuuaauuacuaaaugucaaaccaaacuuuuucucaaaccagggacuaucaucuaagauuaau

SEQ ID NO: 47289 - RNA, 64 nt, hsa
gaaguaucaugcaauaaggcuuaauuacuaaaugucaaaccaaacuuuuucucaaaccagggac

SEQ ID NO: 47290 - RNA, 64 nt, hsa
uuacaguaagugguuguaugaugccaauacugacucaaaccaaccuuuggauagaaaaguguuu

SEQ ID NO: 47291 - RNA, 64 nt, hsa
cagaaggacaaaauauuccuagacgagucuacccucaaaccaguagugucuuuuacaugaagag

SEQ ID NO: 47292 - RNA, 64 nt, hsa
ugguccauuccaggaccuucauuugcauaagguaucaaaccacaucagccucugauuggccaug

SEQ ID NO: 47293 - RNA, 64 nt, hsa
ugguucauuccaggacauucauuugcauaaggagucaaaccacaccagucuuggauuggcugug

SEQ ID NO: 47294 - RNA, 64 nt, hsa
gucugguaacuauggauuuccccucuuacaacuuucaaaccagaguuggagacucagcauuggg

SEQ ID NO: 47295 - RNA, 64 nt, hsa
ugggccuguggcauucauauuucauauucauauuucaaaccacaauauccagcaaaaugucucc

SEQ ID NO: 47296 - RNA, 64 nt, hsa
uaaaucauaauacuagacaaaauugucuucucuuucaaaccagagccauauauaugucuguaua

SEQ ID NO: 47297 - RNA, 64 nt, hsa
caccuaccacuccaugcuuucucuacucccugccucaaaccaccccucccccagaugguacuuc

SEQ ID NO: 47298 - RNA, 64 nt, hsa
ggagccugucaaaaaguagaaucauaaggacuguucaaaccauaaggacuguucaaaucauacc

SEQ ID NO: 47299 - RNA, 64 nt, hsa
ccauaaggacuguucaaaucauaccagugacuguucaaaccaaccauacuuuuuauuagauuug

SEQ ID NO: 47300 - RNA, 64 nt, hsa
ccauuacuuauauacuaacuacauaaugaccuguucaaaccagacucuauuuaaugaacuguga

SEQ ID NO: 47301 - RNA, 64 nt, hsa
ggccccuggccugugugcugacuucuugggguccucaaaccacuguauuuuucuguugagccug

SEQ ID NO: 47302 - RNA, 64 nt, hsa
caauaggaauuuuucaaguccacuauaaaucuuaucaaaccaugguuguauaugcaguugaccg

SEQ ID NO: 47303 - RNA, 64 nt, hsa
ggugcuugguaccagcaugagcuaacuuuauggcucaaaccaauaggacaauuugcugaggucu

SEQ ID NO: 47304 - RNA, 65 nt, hsa
aaagaaaucauuguucaaucuuccauaaggaagagauucuuuaccaggcugugagccaguguuag

SEQ ID NO: 47305 - RNA, 65 nt, hsa
ggaggagagagcuguucucuagugguuaacaugguauucuuuaagaagaaaaaacaaagccaaag

SEQ ID NO: 47306 - RNA, 65 nt, hsa
agccuuugaaugcuaagaaugcauuauugagggucauucuuuauucuuuacuauuaaaauauuuu

SEQ ID NO: 47307 - RNA, 65 nt, hsa
gaaugcuaagaaugcauuauugagggucauucuuuauucuuuacuauuaaaauauuuuggaugca

SEQ ID NO: 47308 - RNA, 65 nt, hsa
ggaaagaauuucauguguuuuaaauugucacuucuauucuuuacagaaccuuguagugccaaaaa

SEQ ID NO: 47309 - RNA, 65 nt, hsa
gaugaauuguauaaagagagaauuuaaaaaauuacauucuuuauuuucuauuagcuguauucaua

SEQ ID NO: 47310 - RNA, 65 nt, hsa
uuguauuaaauguauacagacuuccaagugugcuaauucuuuaccuccuaaacuuuuaguugcaa

SEQ ID NO: 47311 - RNA, 65 nt, hsa
ggcguuuuauagaauaauaugaauuuuauuaagcuauucuuuagaaauucaguucuaaggaaaga

SEQ ID NO: 47312 - RNA, 65 nt, hsa
caaauuaagggcaagcgaaaaaguaauaauuuggcauucuuuaagccuacagaaugugauucuuu

SEQ ID NO: 47313 - RNA, 65 nt, hsa
cgcuuguucacuaguaaccuaaagaggcuauauucauucuuuaugcaaugaggguauuuuugagu

SEQ ID NO: 47314 - RNA, 65 nt, hsa
gaaauacuuaaaguguggcaauacucuuucacuuaauucuuuacaagggauaucaaagccauaau

SEQ ID NO: 47315 - RNA, 65 nt, hsa
uucaaaguuauuuugucuugauguauguaacaguaauucuuuacaucuuuugauuuuucucuucc

SEQ ID NO: 47316 - RNA, 65 nt, hsa
aauuuucuagaauacuaauaaaauacauacuauagauucuuuauuagugaaguaugcacuaauca

SEQ ID NO: 47317 - RNA, 65 nt, hsa
uguaagaguaagcaccuuuagaauauuaaaaauuaauucuuuaucacauguugucauuucuuccc

SEQ ID NO: 47318 - RNA, 65 nt, hsa
auguuuuggaguuauuacuguguauuuuagaaaucauucuuuacaguuuugcauugcugaggaga

SEQ ID NO: 47319 - RNA, 65 nt, hsa
uggguauaacuauguuauaggaaaguagaaauuguauucuuuauuuuccaucuuuguuuucuguu

SEQ ID NO: 47320 - RNA, 65 nt, hsa
ccaguguauaccaacaaucagcuguugaaagcaucauucuuuaauuacuguaccauccauaaugc

SEQ ID NO: 47321 - RNA, 65 nt, hsa
aguguuuaagauauguuuucuguauaaaugaacuaauucuuuauauuaaauuccugucuaugcau

SEQ ID NO: 47322 - RNA, 65 nt, hsa
aacauuucagaauaggaaguaaaugauaaacuuauauucuuuauuauuauuuaguacaaaaauag

SEQ ID NO: 47323 - RNA, 65 nt, hsa
ggacacagauaaccccuucgcuuccagcucuuaaaauucuuuaucuuuuucuuggcaaaaccaga

SEQ ID NO: 47324 - RNA, 65 nt, hsa
caguuuuacugaacaaaaaauguaauuuauuuagcauucuuuauaaaagaauugaugcuagaggu

SEQ ID NO: 47325 - RNA, 65 nt, hsa
ugucuguauuucaaguacaaauguuuuuaaaaaggauucuuuauacauaugugcugaauugauuu

SEQ ID NO: 47326 - RNA, 65 nt, hsa
uuagauaaaguauauucuuccccagggaagacuguauucuuuaaagacaguagaauauuggcuau

SEQ ID NO: 47327 - RNA, 65 nt, hsa
augccaaagaaccauaaacuagcagaggacauugcauucuuuagugaaggacauuuauuuagagu

SEQ ID NO: 47328 - RNA, 65 nt, hsa
aaugucuuuuuaaauguuuuuaaauauaaacaaauauucuuuacuaaaauaaaaacucuguguaa

SEQ ID NO: 47329 - RNA, 65 nt, hsa
ucuuuugaaguguuaaaaggaaacuaguacuuuauauucuuuaucauaucacuuuuuguaagugu

SEQ ID NO: 47330 - RNA, 65 nt, hsa
aucuguguuauuuuguaaaaauaacuguagcuuauauucuuuauuugugcauaccaaugugaaaa

SEQ ID NO: 47331 - RNA, 65 nt, hsa
agcaacguuuauggauaucacaaauaaagaauucaauucuuuacaugauugagugagaguaugua

SEQ ID NO: 47332 - RNA, 65 nt, hsa
uuuuaagggauauuuguuuaagacuuuacguguuaauucuuuauucuugauguguacuuagagaa

SEQ ID NO: 47333 - RNA, 65 nt, hsa
auuuuacauccaguuaccuccacuuucuagaacauauucuuuacuaauguuauugaaaccaauuu

SEQ ID NO: 47334 - RNA, 65 nt, hsa
gauggggaaugggggagauggucccugggcuuaauauucuuuaaagggcaugggaauuuagccuc

SEQ ID NO: 47335 - RNA, 65 nt, hsa
cagccagaaggaaaaaaguuuuccauuuuuauuacauucuuuaggaaaguuaacguuaaagggau

SEQ ID NO: 47336 - RNA, 65 nt, hsa
auuuuuauaaaauguuuaaccaaauguaccuuugcauucuuuaauuaaaauugcuuaaaaaaaaa

SEQ ID NO: 47337 - RNA, 65 nt, hsa
gcaauaccuaguucugcuucugaaacuggaguaucauucuuuacauauuuauauguauguuuuaa

SEQ ID NO: 47338 - RNA, 65 nt, hsa
agccuccuagauguaacauuccugaucaagguacaauucuuuaaaauucacuaaugauugagguc

SEQ ID NO: 47339 - RNA, 65 nt, hsa
uacauacugauaauacauaccucaugaaagauuuuauucuuuauuguguuacagagcaguuucau

SEQ ID NO: 47340 - RNA, 65 nt, hsa
ucuagaugcuuccucuuuuguauaaagucacugacauucuuuagaguggguugggugcauccaaa

SEQ ID NO: 47341 - RNA, 65 nt, hsa
aaugucacaaccucucugaucuugugcucagcaugauucuuuaauagaaguuuuauuuuuucgug

SEQ ID NO: 47342 - RNA, 65 nt, hsa
guccugggggcgagaucgggguagaaaugcauuuuauucuuuaaguucacguaagauacaaguuu

SEQ ID NO: 47343 - RNA, 65 nt, hsa
uuuugccuuguuuauuaaauuuuuacuauagaaaaauucuuuauuuauucuuuaaaauugaacuc

SEQ ID NO: 47344 - RNA, 65 nt, hsa
uuauuaaauuuuuacuauagaaaaauucuuuauuuauucuuuaaaauugaacuccaacccugauu

SEQ ID NO: 47345 - RNA, 65 nt, hsa
uauuaggauacaagcugggaacuucuaaacacuucauucuuuauauauggacagcuuuauuuuaa

SEQ ID NO: 47346 - RNA, 65 nt, hsa
ugauagcaauguaagugccuauaaccauguucuauauucuuuauucucaguaacuuuuaaaaggg

SEQ ID NO: 47347 - RNA, 65 nt, hsa
uuauuuaggcuuccugguggcuucauuuuauugaaauucuuuaaauuguuuaaaguggccauuau

SEQ ID NO: 47348 - RNA, 65 nt, hsa
aaaauuuaaagaaugugucuucaacuaaaaacuuuauucuuuagcauuuauuuauauuucucugu

SEQ ID NO: 47349 - RNA, 65 nt, hsa
ucccuagggggaaaucaaggagcugggcaccccuaauucuuuauggaaguguuuaaaacuauuuu

SEQ ID NO: 47350 - RNA, 65 nt, hsa
acagaagcuugaaaugcuaugaaggcagagcuucuauucuuuaugggaugaaauauuucaaaaga

SEQ ID NO: 47351 - RNA, 65 nt, hsa
uucaauuucuaucuuauuugacuaaguggaaagagauucuuuaaaauguauaaccugccauuaug

SEQ ID NO: 47352 - RNA, 65 nt, hsa
aauacuaucuuuuauagggguuugucuauuuaccuauucuuuacucagacauugauguagacuug

SEQ ID NO: 47353 - RNA, 65 nt, hsa
ucuucuuaguaacuucuuucuguggcaaaaccacaauucuuuaagauuccuauuguucaggcuaa

SEQ ID NO: 47354 - RNA, 65 nt, hsa
aagggaaaugaggcuuuuaaaaauaaaguaccuuaauucuuuauugacuuuuugcccuaaauugc

SEQ ID NO: 47355 - RNA, 65 nt, hsa
agaguaggaauuuugcaaaaucugaauuuaaggaaauucuuuaggauaaccauuucaaaaaauaa

SEQ ID NO: 47356 - RNA, 65 nt, hsa
guucuagaauaaaaguacaaaaaauuagaauaagaauucuuuaacauuuucuuuaaugauuugca

SEQ ID NO: 47357 - RNA, 65 nt, hsa
aguucacaauguauuuucuacuucugcaauuaaauauucuuuagugcuuguuuauuauuacuaaa

SEQ ID NO: 47358 - RNA, 65 nt, hsa
ggagaaaaacaucacacaaauuccaauugagaagcauucuuuaaaauaccuaaccaguacuucuc

SEQ ID NO: 47359 - RNA, 65 nt, hsa
auuuguaaguuaucaugaaaagguuuauauucacuauucuuuauuucaguguagcacuuuuagag

SEQ ID NO: 47360 - RNA, 65 nt, hsa
agagagaagagaaaacucacccaggaaguuuaaaaauucuuuaaacagguauuuugauauuggag

SEQ ID NO: 47361 - RNA, 65 nt, hsa
gaguagguguuuguuuugguucuuggagggaaaagauucuuuauuccaauuuccagagagaagag

SEQ ID NO: 47362 - RNA, 65 nt, hsa
gaaguaugcaugcaggccuauaaaugaaaaacacaauucuuuauguguauagcauguguauuaau

SEQ ID NO: 47363 - RNA, 65 nt, hsa
uuucuuuuugcacaaagaacacaucaccuuccugaauucuuuaaauaugaaauaucauugccagg

SEQ ID NO: 47364 - RNA, 65 nt, hsa
gauuacaggcaugagccaccgugcucagccgcaaaauucuuuaugaauuuuacacuuggcaaaug

SEQ ID NO: 47365 - RNA, 65 nt, hsa
ccaggcuggauggcucaaauauaaaugaaugaggaauucuuuaugaaguaucagucagauuuuau

SEQ ID NO: 47366 - RNA, 65 nt, hsa
aacuuccaaggcucuuccagcuccccuuucucgccauucuuuagcuguagucaugaauagucucc

SEQ ID NO: 47367 - RNA, 65 nt, hsa
cucaguccuggcaaugaggguuuggcaccauucucauucuuuaucccacucaaucaaaggaacuc

SEQ ID NO: 47368 - RNA, 65 nt, hsa
caaaccuuuuugagccauaggauccaagccauaaaauucuuuaugcauguugaauucagucagaa

SEQ ID NO: 47369 - RNA, 65 nt, hsa
uggaggaugcauguaugauacuccauaaauucaacauucuuuacuauagguaaugaaugauuaua

SEQ ID NO: 47370 - RNA, 65 nt, hsa
ggaucaggaccuuaugagugugacaaacgugggauauucuuuaugcagaagucuuguuuuauuac

SEQ ID NO: 47371 - RNA, 65 nt, hsa
aaagaaguccuuacaagugaaaagaaauuugggaaauucuuuagcuaaaccucugugcaucuucu

SEQ ID NO: 47372 - RNA, 65 nt, hsa
uauuuucuuuuuccccauuaaaagaggaccaaacaauucuuuauacaaauggaguagcaacuagu

SEQ ID NO: 47373 - RNA, 65 nt, hsa
auaaaggggaacuaggcuagcaguucuaaugugacauucuuuaagcauaucuuaaaauaguauuu

SEQ ID NO: 47374 - RNA, 65 nt, hsa
gcuagauaguauuagaauaguccaauagaaaauucauucuuuauaggucuuuaaaaauuacuuuu

SEQ ID NO: 47375 - RNA, 65 nt, hsa
aacuuuuaaaaggcauaacuguauuuuauguguuuauucuuuauauagauaguauuuuauauuuu

SEQ ID NO: 47376 - RNA, 65 nt, hsa
caaauagcagacaucugaucauuuuauccauaaauauucuuuauauaucucugaaagcuauggga

SEQ ID NO: 47377 - RNA, 65 nt, hsa
ugauaauuccauuaucgcaagugauauuuacaguaauucuuuaauaucaguaaauauccagugag

SEQ ID NO: 47378 - RNA, 64 nt, hsa
cugcgugugguggcucacaccuguaaucccaacacuuugggacguugaaaugggagaauugcuu

SEQ ID NO: 47379 - RNA, 64 nt, hsa
ccaggcgugguggcucacgccuguaaucccaacacuuugggaggccgaggcgggcggaucacga

SEQ ID NO: 47380 - RNA, 64 nt, hsa
ccgagcguguuggcucacgcuuguaaucccagcacuuugggaggccgaggcggguggaucacga

SEQ ID NO: 47381 - RNA, 64 nt, hsa
cugggcgcgguggcucacgccuguaaucccagcacuuugggaggccaaggugggcggaucacaa

SEQ ID NO: 47382 - RNA, 64 nt, hsa
cgggcacaguggcuuacgccuguuaaugccaguacuuugggaggccgaggcagguggaucaccu

SEQ ID NO: 47383 - RNA, 64 nt, hsa
cugggcgugguggcucaugccuguaaucccaacacuuugggaggccaaggcaggcagaucacuu

SEQ ID NO: 47384 - RNA, 64 nt, hsa
ggguacuuugaucuuagauuugaucuuaaaaucacuuugggacugggaucccuugcugauugac

SEQ ID NO: 47385 - RNA, 64 nt, hsa
guuaaaaaucaacucauugccuguaaucccagcacuuugggaggccgagacggguggaucacga

SEQ ID NO: 47386 - RNA, 64 nt, hsa
uacaaugauuuauauuuccuugggauaugcauuccuuugggaauaaugggauugcugaguugaa

SEQ ID NO: 47387 - RNA, 64 nt, hsa
auuagccugguggcucacgccuguaaucccagcacuuugggaggccgagguggccagaucaccu

SEQ ID NO: 47388 - RNA, 64 nt, hsa
ccgggcaugguggcucacgccuguaaucccagcacuuugggaggcccaggugggcggaucaccu

SEQ ID NO: 47389 - RNA, 64 nt, hsa
cuguguaugguggcccuugccuguagucucagcacuuugggaggcugaggugggagggucgcuu

SEQ ID NO: 47390 - RNA, 64 nt, hsa
acauucugauugucuuguauggaccagaagagagcuuugggacauuuuuucugaacauucuaag

SEQ ID NO: 47391 - RNA, 64 nt, hsa
gggaggcccaggggaauuggugauuacaguagcacuuugggaaguuaaagcccccuuugggcuu

SEQ ID NO: 47392 - RNA, 64 nt, hsa
ccaggcaugguggcucacgccuguaaucucagcacuuugggaggcugaggcgggcggaucacaa

SEQ ID NO: 47393 - RNA, 64 nt, hsa
ccagccgugguggcucacaccuguaaucccagcacuuugggaggcugaggcagguggaucgccu

SEQ ID NO: 47394 - RNA, 64 nt, hsa
cugugaugcuucgaaauaggucugcuccucacagcuuugggaaucugaauggaagaagaaaaga

SEQ ID NO: 47395 - RNA, 64 nt, hsa
cugggcgcaguggcucacgccuguaaucccagcacuuugggaggccaaggcaaacggaucacga

SEQ ID NO: 47396 - RNA, 64 nt, hsa
accaguuuaggcuggguaugguggcucaccagcacuuugggaggcugaggcagguggaucucuu

SEQ ID NO: 47397 - RNA, 64 nt, hsa
gccagcgcaguggcucaugccuguaaucccagcacuuugggaggcugaggcgggcggaucaccu

SEQ ID NO: 47398 - RNA, 64 nt, hsa
ccgggcgcgguggcucacgccuguaaucccaacacuuugggaggccaagguggguggaucacaa

SEQ ID NO: 47399 - RNA, 64 nt, hsa
caauaacacugucuccuuucucuuaugcuuaaggcuuugggaauguuuuuagcugguggcaaua

SEQ ID NO: 47400 - RNA, 64 nt, hsa
ccacguaugguggcucaugucuauaaucccagcacuuugggagguugaggugggaggauugcuu

SEQ ID NO: 47401 - RNA, 64 nt, hsa
ucagcuugccuggaagagggaggucccacuaugccuuugggagacaccuauacuuaggaaaaag

SEQ ID NO: 47402 - RNA, 64 nt, hsa
uggaggcaucagguucugugcacaacuugugugucuuugggagcccugggucuuucccaccugc

SEQ ID NO: 47403 - RNA, 64 nt, hsa
ccaggcguggaggcucacaccuauaaucccaacacuuugggaggccgaggugggaggaucacuu

SEQ ID NO: 47404 - RNA, 64 nt, hsa
ucauacccagccagccuuugccucuacuguaucgcuuugggacuuuaaagaugcagaaguauua

SEQ ID NO: 47405 - RNA, 64 nt, hsa
cuaggcuuaguggcucacgccuguaaucucagcacuuugggaggcugaggcgggcagaucgcuu

SEQ ID NO: 47406 - RNA, 64 nt, hsa
ccgggcaugguggcucacgccuguaaucccaguacuuugggaggccgagucagguggaucaccu

SEQ ID NO: 47407 - RNA, 64 nt, hsa
cugggcaugguggcucacgccuguaaucccagcacuuugggaggccauggcggguggaacauuu

SEQ ID NO: 47408 - RNA, 64 nt, hsa
cugggugcgguggcucacgcuuguaaucccagcacuuugggaggcugaggcaggcggaucacga

SEQ ID NO: 47409 - RNA, 64 nt, hsa
ccggguacaguggcucaugccuauaauuccagcacuuugggaggcagaggugggcggaucacaa

SEQ ID NO: 47410 - RNA, 64 nt, hsa
ccgggagugguggcuuacaccuguaaucccagcacuuugggaggccgaggcagguggaucacuu

SEQ ID NO: 47411 - RNA, 64 nt, hsa
ccgggcgcggugacucacgccuauaaucccagcacuuugggaggccgagaugggugaaucauga

SEQ ID NO: 47412 - RNA, 64 nt, hsa
ccgggugugguggcucacaccuguaaucccagcacuuugggaggccgaaguggguggaucaccu

SEQ ID NO: 47413 - RNA, 64 nt, hsa
ggaacuggagccucuggcugggcacaguggcucacuuugggaggcugaggcaggaaggcugcug

SEQ ID NO: 47414 - RNA, 64 nt, hsa
ccaggacccugcuguaguuggggagcaggaguaccuuugggaggggaggacuuuauuuaaacag

SEQ ID NO: 47415 - RNA, 64 nt, hsa
cugcuuccucauuuuauagauagggaaacugaggcuuugggaggacucacugacauaccuaccu

SEQ ID NO: 47416 - RNA, 64 nt, hsa
ucaguucuggggcuugggaaaagggccccaguggcuuugggaagcacccccagcccagggugaa

SEQ ID NO: 47417 - RNA, 64 nt, hsa
acuuacucaggaucaguggcaccagccaacucagcuuugggacaaacccagccaagugaccagg

SEQ ID NO: 47418 - RNA, 64 nt, hsa
cugagcgcgguggcucacgccuguaaucccagcacuuugggaggccaagguggguggaccacau

SEQ ID NO: 47419 - RNA, 64 nt, hsa
ccaggugugguggcucacgccugugaucccagcacuuugggaggccaagacgggcggaucauga

SEQ ID NO: 47420 - RNA, 64 nt, hsa
aauuacucagauuggccuguuauuugauuuccuccuuugggaaaagaauuauguagauaccaca

SEQ ID NO: 47421 - RNA, 64 nt, hsa
gcuaggugcagugguucaugccuguaauccagcacuuugggaggcuaagaugaguggauugcuu

SEQ ID NO: 47422 - RNA, 64 nt, hsa
cccaggcccuuccucuaucauggaugcugggugacuuugggaagucaccaccucuucccaagcc

SEQ ID NO: 47423 - RNA, 64 nt, hsa
cugggccuaguggcgcacaccugcaaucccaacacuuugggaggccaagagaggaagauugcuu

SEQ ID NO: 47424 - RNA, 64 nt, hsa
ccgggcgcgguggcucacaccuguaaucccagcacuuugggagguggaggcggguggaucacaa

SEQ ID NO: 47425 - RNA, 64 nt, hsa
acauuuuuacuugcuuguagccguuuuuguuugccuuugggauucgggcuuuggcugugcccau

SEQ ID NO: 47426 - RNA, 64 nt, hsa
ucugggaaaucccgcgauacuaaaauccagugagcuuugggagaucauucccuaaagguaugug

SEQ ID NO: 47427 - RNA, 64 nt, hsa
ccgggcgcgguggcucaaaccuguaaucccagcacuuugggaggccgagguggguggaucacga

SEQ ID NO: 47428 - RNA, 64 nt, hsa
ccaggugcaguggcucacaccuguaaucccagcacuuugggaggccaaaguggguggaucacuu

SEQ ID NO: 47429 - RNA, 64 nt, hsa
cacucggcugggcacaguggcucacgucuguaaucuuugggagcacuuugggaggccgaggugg

SEQ ID NO: 47430 - RNA, 64 nt, hsa
gcacaguggcucacgucuguaaucuuugggagcacuuugggaggccgaggugggcggaucacga

SEQ ID NO: 47431 - RNA, 64 nt, hsa
cggguacgguagcucacguccuauagucgcagcacuuugggaggccaaggugggcaguucacgu

SEQ ID NO: 47432 - RNA, 64 nt, hsa
gccggugugguggcucacggcuguaauccuggcacuuugggaggccgaggugggcggaucacaa

SEQ ID NO: 47433 - RNA, 64 nt, hsa
ccagccgcaguggcucacgccuguaauaccagcacuuugggaggcugaggcaggcggaucacuu

SEQ ID NO: 47434 - RNA, 64 nt, hsa
acaccaaagccuuggaccccucccagccugugaccuuugggaccaacuccaccuacgcagcaga

SEQ ID NO: 47435 - RNA, 64 nt, hsa
ucuaauguuccuuaaaucccacggagaggagcagcuuugggaacuguguucagagagauuccga

SEQ ID NO: 47436 - RNA, 64 nt, hsa
ccaggcaugguggcucaugccuguaaucccagcacuuugggaggcugagguagguggaaaaccu

SEQ ID NO: 47437 - RNA, 64 nt, hsa
ccggguacaauggcucacgccuguaauccuaacacuuugggaggccgaggcagacagaucaccu

SEQ ID NO: 47438 - RNA, 64 nt, hsa
ccaggcacaguggcucauaccuguaaugccagcacuuugggaggccaaggcgggcagaucacga

SEQ ID NO: 47439 - RNA, 64 nt, hsa
ccaggcgugguggcucaugccuauaaucccagcacuuugggaggcuaagacaggcagaucaccu

SEQ ID NO: 47440 - RNA, 64 nt, hsa
ccagguguggugacucacaccuauaaucccaauacuuugggaggccaaggcaggaggauugcuu

SEQ ID NO: 47441 - RNA, 64 nt, hsa
cccugugcaauggcucacaccuguaauuccaacacuuugggaggcagaggcgggaggauugcuu

SEQ ID NO: 47442 - RNA, 64 nt, hsa
uugggcgccguggcucacaccuguaauccuagcgcuuugggaggccgcgguggguggaucaccu

SEQ ID NO: 47443 - RNA, 64 nt, hsa
ccggacgcaguagcuuacgccuguuaucccagcacuuugggaggucgaggugggcagaucaccu

SEQ ID NO: 47444 - RNA, 64 nt, hsa
agccacugcucguuguaaaugccaaggcauuuggcuuugggacgugacaacucaauccagaagg

SEQ ID NO: 47445 - RNA, 64 nt, hsa
ccaggugcgguggcucacgccuguaaucccagcacuuugggaggccgaggugagcggaucaccu

SEQ ID NO: 47446 - RNA, 63 nt, hsa
ccgggcgccguggcucacgccuguaaucgcagcacuuugggaggccgaggcaggcggaucacg

SEQ ID NO: 47447 - RNA, 64 nt, hsa
ccagacauggugucucacacguuuaaucccagcacuuugggaggcaggggcggguggaucaccu

SEQ ID NO: 47448 - RNA, 64 nt, hsa
ccgggcacaguggcgcaugccuguaaucccagaacuuugggaggccaagacgggaugauugcuu

SEQ ID NO: 47449 - RNA, 64 nt, hsa
cugggcgugguggcucacgccuguaaucccagcacuuugggaggccgaggcaggcggaucacaa

SEQ ID NO: 47450 - RNA, 64 nt, hsa
ccaggagcgguggcucacacuuguaaucccagcacuuugggaugcuaaggcaggcggaucacuu

SEQ ID NO: 47451 - RNA, 64 nt, hsa
cggggcgugguggcucacacuuguaaucccagcacuuugggaggccaaggugggcggaucauga

SEQ ID NO: 47452 - RNA, 64 nt, hsa
caggcguuguggugcaugcuuguggucccagcuacuuugggagguugaggcaggaggaucgcuu

SEQ ID NO: 47453 - RNA, 64 nt, hsa
ucgggcacaguggcucccgccuguaaucccauuacuuugggaggcccaggugggaggaucgcuu

SEQ ID NO: 47454 - RNA, 64 nt, hsa
aaccauguuucauguggccuguuagggccugucacuuugggagccggaaggaggugcuagucau

SEQ ID NO: 47455 - RNA, 64 nt, hsa
cugggcaugguggcuuacgccuguaaucccagcacuuugggaggccaaggcgggcggaucauga

SEQ ID NO: 47456 - RNA, 64 nt, hsa
ccgggcgcgguggcucacgccuguaaucccagcacuuugggaggcugaggcgggcagaucaccu

SEQ ID NO: 47457 - RNA, 64 nt, hsa
gggcacgguggcucaugccuauaaaauuccagcacuuugggaggccaaggcaggaggaucacuu

SEQ ID NO: 47458 - RNA, 64 nt, hsa
ccgagugugguggcuuaugccuguaaucccugcacuuugggaagccaaggcgggcagcucaccu

SEQ ID NO: 47459 - RNA, 64 nt, hsa
ccgggcgcgguggcuuaugccuguaaucccagcacuuugggaggccgaggcagguggaucacga

SEQ ID NO: 47460 - RNA, 64 nt, hsa
uuggauuauagaauuauuauuuccugcuuucuuucuuugggacuuuugaauuucuuugguuucg

SEQ ID NO: 47461 - RNA, 64 nt, hsa
cuggacgcgguggcucacgccuguaaucccagcacuuugggaggcugaggcgggugaaucacuu

SEQ ID NO: 47462 - RNA, 64 nt, hsa
cugggcgcaguggcucacaccuguaaucccagcacuuugggaggcugaggcggguggaucaccu

SEQ ID NO: 47463 - RNA, 64 nt, hsa
uuuggaacuuuaucuguguuauaguuaugaguugcuuugggagacuuggagcucucuguagcua

SEQ ID NO: 47464 - RNA, 64 nt, hsa
ccaggugugguggcucaugccuauaaucccagcacuuugggaggccaaggcagguggaucaccu

SEQ ID NO: 47465 - RNA, 64 nt, hsa
cugggugugguggcucacgccuguaauccuagcacuuugggaggccgaguugggagguuugcuu

SEQ ID NO: 47466 - RNA, 64 nt, hsa
cuagacccaauggcucaugccuguaaucccaacacuuugggaggccaaggugggaggauggcuu

SEQ ID NO: 47467 - RNA, 64 nt, hsa
uagaaacucugggcugggcacaguggcucacacacuuugggaggccaagcgggggugcagauca

SEQ ID NO: 47468 - RNA, 64 nt, hsa
gcuuuacccccuggggccuggggaaaugucuguacuuugggaagucacagaaauacauuuuugu

SEQ ID NO: 47469 - RNA, 64 nt, hsa
uucugccuccaggcaggacggcaggggugagcagcuuugggagagacaccuggccuuuuucucc

SEQ ID NO: 47470 - RNA, 64 nt, hsa
ccacagaguuuuucaggagagaaaacugccugaccuuugggacuaagcugcggaaucuucuuac

SEQ ID NO: 47471 - RNA, 64 nt, hsa
aaaucuggagcuggcacuguggagaccacacacccuuugggaaagcucuugucucuucuucccc

SEQ ID NO: 47472 - RNA, 64 nt, hsa
ccgggugggguggcacaugccuguaaucccagcacuuugggaggccaaggcugguggaucaccu

SEQ ID NO: 47473 - RNA, 64 nt, hsa
cugggugcaguggcucacgccuguaaucccagcacuuugggaggcuuaggcggcuggaucaccu

SEQ ID NO: 47474 - RNA, 64 nt, hsa
cugggcgcugcggcuugcgccuguaaucucagcacuuugggaggcugagauggguggaucaccu

SEQ ID NO: 47475 - RNA, 64 nt, hsa
accccauguuggcugcugcuguugagauacugugcuuugggaguaaaaaaagaaaguuauuucu

SEQ ID NO: 47476 - RNA, 64 nt, hsa
cugggcacgguggcucaugccuguaaucccagcacuuugggaggccgaggugggcggaucacuu

SEQ ID NO: 47477 - RNA, 64 nt, hsa
uuugcuuauuugaaaguaauucagcaacaggucacuuugggauauaaccugaaccuuuuuuugg

SEQ ID NO: 47478 - RNA, 64 nt, hsa
ccuagugcaguggcucacaccuauaaucccaacacuuugggaggccaggaguuuugagaccagc

SEQ ID NO: 47479 - RNA, 64 nt, hsa
uuuacauacaccauucuacuauuccucaugguggcuuugggagguccagcuccguuuuaaagac

SEQ ID NO: 47480 - RNA, 64 nt, hsa
auaacuucugcucucaccucccuucccucccuggcuuugggaagagcugcugagcucuuugccu

SEQ ID NO: 47481 - RNA, 64 nt, hsa
ccgggcaugguggcucaugccuguaaucccagcacuuugggaggccaggaguucgagaccagcc

SEQ ID NO: 47482 - RNA, 64 nt, hsa
cugggcgcaguggcucacgccuguaaucccagcacuuugggagggauaggugggcggaucaccu

SEQ ID NO: 47483 - RNA, 64 nt, hsa
cagagcagggauugugccgggagagugccucugacuuugggacauuucauccacagaaauuucc

SEQ ID NO: 47484 - RNA, 64 nt, hsa
cagauggaccaugcccuugcuggguuuuccuuuucuuugggacugugaggggaaaugguuuuua

SEQ ID NO: 47485 - RNA, 64 nt, hsa
aauauuaauggaggauauuccucggaaaaacagacuuugggaaugaaggagggacucaggauca

SEQ ID NO: 47486 - RNA, 64 nt, hsa
ucauaagcauuugcccucaccaugguuuauaaaacuuugggaaaacggaauauucagaaauagg

SEQ ID NO: 47487 - RNA, 64 nt, hsa
cugugcacgguagcuuaugccuguaaucucagcacuuugggaggccaaggcaggcagaucauga

SEQ ID NO: 47488 - RNA, 64 nt, hsa
ccggacaugcuggcucauaccuguaaucccagaacuuugggaggccgaggcagguggaucauuu

SEQ ID NO: 47489 - RNA, 64 nt, hsa
cugggcuugguggcucacaucuguaauaccagcgcuuugggaggcugaggcaggaggauugcuu

SEQ ID NO: 47490 - RNA, 64 nt, hsa
cugggcgcaguggcucacgccuguaaucccagcacuuugggaggcugaggcagguggaucacaa

SEQ ID NO: 47491 - RNA, 64 nt, hsa
uauagcccuagcccaguggugacaugaccacucccuuugggaggccugagguagaggggagugg

SEQ ID NO: 47492 - RNA, 64 nt, hsa
guaucagaagccagacuugcucuucggucaugcacuuugggauacagcguauaggugcagcccu

SEQ ID NO: 47493 - RNA, 64 nt, hsa
ucgggcaugguggcucaugccuguaaucucagcacuuugggaggcugaggcagaaggauuaccu

SEQ ID NO: 47494 - RNA, 64 nt, hsa
gugcaguggcucaugccuguaaucccagccagcacuuugggaggcugagaugggaagaucacuu

SEQ ID NO: 47495 - RNA, 64 nt, hsa
ccaggcaccguggcucacgucuguaaucccagcgcuuugggaggccgaggcaggcagaucaccu

SEQ ID NO: 47496 - RNA, 64 nt, hsa
ccaggugugguggcucacaccuguaaucccagcacuuugggagaccaaggcgggcggaucacuu

SEQ ID NO: 47497 - RNA, 64 nt, hsa
ccagguacgguggcuaacgccuguaauccugacacuuugggagucugaggcgggugguucaucu

SEQ ID NO: 47498 - RNA, 64 nt, hsa
ccgggugcgguggcucacgccuaugaucccagcacuuugggaggccgaggcaggcggaucacaa

SEQ ID NO: 47499 - RNA, 64 nt, hsa
auucuuggcauuuuuauucuuguuauuugagguacuuugggaagaugugaauuucaguguuaga

SEQ ID NO: 47500 - RNA, 64 nt, hsa
cugggcacaguggcucacaccuguaauccuagcacuuugggaggccaaggcagguggaucaccu

SEQ ID NO: 47501 - RNA, 64 nt, hsa
cugggcacaguggcucaugccugaaauccuagcacuuugggaagacaaugugggagaauggcuu

SEQ ID NO: 47502 - RNA, 64 nt, hsa
ucaggcacgguggcucaugccuguaaucccagcacuuugggaggcugaggcaggcggaucacuu

SEQ ID NO: 47503 - RNA, 64 nt, hsa
caggagcaguggcucacaccuuguaaucccagcacuuugggaggccaaggugggcggaucaccc

SEQ ID NO: 47504 - RNA, 64 nt, hsa
cugggugugacggcacaugccuguaaucccagcacuuugggaggcugaggugggaggacugcuu

SEQ ID NO: 47505 - RNA, 64 nt, hsa
gccaaacaucuggucuugcauugaaauagcauuucuuugggauugugaauagaauguagcaaaa

SEQ ID NO: 47506 - RNA, 64 nt, hsa
ccgggcgcgguggcaaaugccuguaaucccagcacuuugggaggccgaggcagguggaucacaa

SEQ ID NO: 47507 - RNA, 64 nt, hsa
ccaggcaugguggcucaugccuguaauuccagcacuuugggaggccaaggcggguggaucaccu

SEQ ID NO: 47508 - RNA, 64 nt, hsa
gguagcuucuguguucccguaaggauacagcuuccuuugggaagccccaucuauggcuguagau

SEQ ID NO: 47509 - RNA, 64 nt, hsa
aaaucaaagguaauuuuauuaccuguagaccugucuuugggaaacauuaaaggauguuugaggg

SEQ ID NO: 47510 - RNA, 64 nt, hsa
ccaggcgggauggcucacgccuguaaucccagcacuuugggaggcugaggcgggcagaucacuu

SEQ ID NO: 47511 - RNA, 64 nt, hsa
gcccacacgguggcucacuucuguaaucccaucacuuugggaggcuuaggcagaaggaucaccu

SEQ ID NO: 47512 - RNA, 64 nt, hsa
ccgggcgugguggcuuacgccuguaaucccagcacuuugggaggccaaggugggcggaucacaa

SEQ ID NO: 47513 - RNA, 64 nt, hsa
ccgggugcgguggcucaugccuguaaucccaacgcuuugggacgccgaggcggguggaucauga

SEQ ID NO: 47514 - RNA, 64 nt, hsa
uagacugugauggcucacaccuguaaucccagugcuuugggaggcugaggugggaagauucuuu

SEQ ID NO: 47515 - RNA, 64 nt, hsa
ccgggccugguggcucacaccuguaaucccagcucuuugggaggccgaggcggguggaucacuc

SEQ ID NO: 47516 - RNA, 64 nt, hsa
aaauugggggaggagcccagggccacauaccaagcuuugggacauggugccucaugcucucugg

SEQ ID NO: 47517 - RNA, 64 nt, hsa
ccgggcgugguggcucacgccuguaaucccagcacuuugggaggcugaggcaggcagaucaccu

SEQ ID NO: 47518 - RNA, 64 nt, hsa
ggcuggguauggagguucacugguaaucccagcacuuugggaggcccaggcagaaggaucgcug

SEQ ID NO: 47519 - RNA, 64 nt, hsa
accucgucucuacaaaaaaaaauuaaaaagggggcuuugggaggccaaggcgggcagaucauga

SEQ ID NO: 47520 - RNA, 64 nt, hsa
cggcgcacagugacucacgccuguaaucccagcacuuugggagggcgaggcuagcagaucacuu

SEQ ID NO: 47521 - RNA, 64 nt, hsa
uggaccuagcagcucaugccuguaaucuccagcacuuugggaggcggaggcaggaggaucucuu

SEQ ID NO: 47522 - RNA, 64 nt, hsa
auaguacauugccaucuccaggaagacuugacggcuuugggauuuuguuuaaacuuuuauaaua

SEQ ID NO: 47523 - RNA, 64 nt, hsa
ccgggcgcaguggcucacgccuguaaucccagcacuuugggaggccaagguggguggaucaccu

SEQ ID NO: 47524 - RNA, 64 nt, hsa
ccgggcaugguggcucaugccuguaaucccaacacuuugggaggcuaaggcagcuggaucacuu

SEQ ID NO: 47525 - RNA, 64 nt, hsa
ccgggcaugguggcucacgccuguaaucucagcacuuugggaggccaaggcaggugggucaccu

SEQ ID NO: 47526 - RNA, 64 nt, hsa
ggucucuauuuaaaugccacugucaaucccagcacuuugggaggccuaggcgggcggaucauga

SEQ ID NO: 47527 - RNA, 64 nt, hsa
gacccaccugaaaugcaguaucaucugauuuacucuuugggaucuugaagaagcucuuuugggu

SEQ ID NO: 47528 - RNA, 64 nt, hsa
ccgggcgcgguggcucacgccuguaaucccagcacuuugggaggccaaggcgggcggaucaccu

SEQ ID NO: 47529 - RNA, 64 nt, hsa
uuaagaagagagacucucuugcuucuucaaagagcuuugggaaauuaaauugcuaaauuuguau

SEQ ID NO: 47530 - RNA, 64 nt, hsa
gaggaaugcuugcaaugcucauugaagggauuugcuuugggacuuugucaucuuccagaaagga

SEQ ID NO: 47531 - RNA, 64 nt, hsa
cugggugugguggcucacgccuauaaucccagcacuuugggaggcugagguggguggaccacuu

SEQ ID NO: 47532 - RNA, 64 nt, hsa
ccaggcgagguggcucacaccuguaaucccagcacuuugggaggccaaggcggguggaucacaa

SEQ ID NO: 47533 - RNA, 64 nt, hsa
ccaggcacgguggcucacaccuguaaucccagcacuuugggaggccaaggcgggcggaucagcu

SEQ ID NO: 47534 - RNA, 64 nt, hsa
ccgggugcggcagcucaugccuguaaucccaacacuuugggaggcugaggcaggcggaucacga

SEQ ID NO: 47535 - RNA, 64 nt, hsa
ccgggugcgguggcucaagccuguaaucccagcacuuugggaggccgaggcaggcagaucacga

SEQ ID NO: 47536 - RNA, 64 nt, hsa
ccagguaugguggcucacgccuguaaucccagcacuuugggaggcuaaggugggcggaucaccu

SEQ ID NO: 47537 - RNA, 64 nt, hsa
uggggcgcaguggcucacgccuguaaucccagcacuuugggaggccgaggugggcggaucacga

SEQ ID NO: 47538 - RNA, 64 nt, hsa
ccuggugugguggcucacaccuguaaucccaacacuuugggagcccgaggcggguggaucagcu

SEQ ID NO: 47539 - RNA, 64 nt, hsa
ccaagccugauggcucgugccuguacucccagcacuuugggaggcugaggugggaggguugcuu

SEQ ID NO: 47540 - RNA, 64 nt, hsa
ccaggugcaguggcucacgccuguaaucccagcacuuugggaggcugaggcaggcggaucaccu

SEQ ID NO: 47541 - RNA, 64 nt, hsa
ggcccggcccacggcccugagcggcugcagccugcuuugggacgauggucaggucccauguugu

SEQ ID NO: 47542 - RNA, 64 nt, hsa
gcagcucuuggcuucgggccugccuucugccucccuuugggaucugugucuuccagggaucagc

SEQ ID NO: 47543 - RNA, 64 nt, hsa
uggauauuguuagugacuuuuuguguguguuuugcuuugggaccuuuuuauuuugguguugcaa

SEQ ID NO: 47544 - RNA, 64 nt, hsa
uucuucuuguauuaaaauuuuguuuuuuucucuacuuugggagauguuuauuuacauugucaga

SEQ ID NO: 47545 - RNA, 64 nt, hsa
ccgggcgcaguggcucacgccuguaaucccagcacuuugggaggccgaggcggguggaucauga

SEQ ID NO: 47546 - RNA, 64 nt, hsa
cagacacaggugccucacgccuguaaucccagcacuuugggaggcugagcuggaucacuugagu

SEQ ID NO: 47547 - RNA, 64 nt, hsa
cugggcaugguggcucacgccuguaaucccagcacuuugggaggccgaggucaggaguuagaga

SEQ ID NO: 47548 - RNA, 64 nt, hsa
ccgagugcgguggcucacgccuauaaucccagcacuuugggaggccgaggcgggcggaucacua

SEQ ID NO: 47549 - RNA, 64 nt, hsa
ccgggggcgguggcucacgccuguaaucccaacacuuugggagcccgaggcgggcggaucacaa

SEQ ID NO: 47550 - RNA, 64 nt, hsa
ccaggcacaguggcccaggccuguaaucccaucacuuugggaggugcaggcaggcagauggcuu

SEQ ID NO: 47551 - RNA, 64 nt, hsa
cugggcgugguggcucacgccuguaaucccagcacuuugggaggccgaggcgggcagaucacga

SEQ ID NO: 47552 - RNA, 64 nt, hsa
ccaggugcgguggcucacgcuugcaaucccagugcuuugggagacugaggcaggaggaucacuu

SEQ ID NO: 47553 - RNA, 64 nt, hsa
ccaggccugguggcacaugccuguaauccgagugcuuugggaggcugaggcaggaggaucacuc

SEQ ID NO: 47554 - RNA, 64 nt, hsa
aguuggaaaauauguaacuggaaucucaaaaguucuuugggacaaaacagaaguccauggaguu

SEQ ID NO: 47555 - RNA, 64 nt, hsa
cugagagcaguggcucacgccuguaaucccagaacuuugggaggcuaagguggguggaucaccu

SEQ ID NO: 47556 - RNA, 64 nt, hsa
ccaggcaugguggcucaugcuuguaaaccugaugcuuugggaggacaaggugguucauuggagg

SEQ ID NO: 47557 - RNA, 64 nt, hsa
ucaggcgcaguggcucacaccuguaaucccagcacuuugggaggccgagguggguggauggauc

SEQ ID NO: 47558 - RNA, 64 nt, hsa
uuggcccccagcagccacaguucccccaagggggcuuugggacagggagggcccgggcguccag

SEQ ID NO: 47559 - RNA, 64 nt, hsa
ucaucuguggccaggcacgccuguaaucccagcacuuugggaggccgaggugaaaggaucacuu

SEQ ID NO: 47560 - RNA, 64 nt, hsa
ugggcacgguggcucaugccuguaaucccuaacacuuugggaggccgaggugggcggaucacga

SEQ ID NO: 47561 - RNA, 64 nt, hsa
uaugauuguaaggaauguaggaaguccuucaauucuuugggaaaccuucaaagacacauggcag

SEQ ID NO: 47562 - RNA, 64 nt, hsa
gugggugcaguggcucacaucuguaaccccagcacuuugggaggcugagaugggcagaucacuu

SEQ ID NO: 47563 - RNA, 64 nt, hsa
ccaggugcaguggcucacguauguaaucccagcacuuugggaagccaaggagggaggaucacuu

SEQ ID NO: 47564 - RNA, 64 nt, hsa
ccaggcacaguggcucacgccuauaaucccagcacuuugggaggcugagguggucagaucaccu

SEQ ID NO: 47565 - RNA, 64 nt, hsa
gguauggcacaguucaugcccuguaauccuagcacuuugggagggugaggcaggaggauggcuc

SEQ ID NO: 47566 - RNA, 64 nt, hsa
ccaggcgugguggcucaugccuguaaucucagcacuuugggaggcugagguggguggaucacug

SEQ ID NO: 47567 - RNA, 64 nt, hsa
ccaggcacaguggcucacaccuguaaucccagcacuuugggaggccaagaugggcggaucacga

SEQ ID NO: 47568 - RNA, 64 nt, hsa
ccgagcacaguggcccaugccuauaaucccagcacuuugggaggcugaggcagguggaucaccu

SEQ ID NO: 47569 - RNA, 64 nt, hsa
caaggcauaguggcuuaugccuguaaucccgguacuuugggaggcugaggugggaggacugcuu

SEQ ID NO: 47570 - RNA, 64 nt, hsa
ccaggugcgguggcucaugccuguaaucccagcacuuugggaggccauggcagguggaucaccu

SEQ ID NO: 47571 - RNA, 64 nt, hsa
gccuggcacaggggucacaccuguaaucccagcacuuugggaggacaagguggguggaucacuu

SEQ ID NO: 47572 - RNA, 64 nt, hsa
ucaggcaggguggcucacaccuguaaucccugcacuuugggaggccaaggugggaggaucaguu

SEQ ID NO: 47573 - RNA, 64 nt, hsa
ccaggcacaguggcucaugccuguaaucccagcacuuugggaggcugaggcaggcggaucaccu

SEQ ID NO: 47574 - RNA, 64 nt, hsa
ccaggugcucuggcucaugccuguaaucccagcacuuugggaggccaaggugggcagaucaccu

SEQ ID NO: 47575 - RNA, 64 nt, hsa
acaggugugguggcucacaccuguaaucccagcacuuugggaggccgaggcaagagcaucacga

SEQ ID NO: 47576 - RNA, 64 nt, hsa
ccaggcacgguggcucacaccuguaaucccaguacuuugggaggccaaggcaagcagaucaccu

SEQ ID NO: 47577 - RNA, 64 nt, hsa
ccaggcgcgguggcucacaccuguaaucccagcacuuugggaggcugaggcagguggaucaccu

SEQ ID NO: 47578 - RNA, 64 nt, hsa
cuggguggggugacucacgccuguaaucccagcacuuugggaggccgaggcagguggauugcuu

SEQ ID NO: 47579 - RNA, 64 nt, hsa
ccgggcgcgguggcucaugccuguaauaccagcacuuugggaggcggaggcgggcagaucgcga

SEQ ID NO: 47580 - RNA, 64 nt, hsa
ccagauguggugggucacacuuguaaucccacuacuuugggaggccaaggcaggaagauugcuu

SEQ ID NO: 47581 - RNA, 64 nt, hsa
ugcuuccaugcaccucaguaagaaguggaucugccuuugggaccugcucagugaggaaaucucu

SEQ ID NO: 47582 - RNA, 64 nt, hsa
ccggguauggugacucaugccuguaauccuagcacuuugggaggccgagguggguggaccaccu

SEQ ID NO: 47583 - RNA, 64 nt, hsa
uugccuuugccccggcuugccuguaaucccagcacuuugggaggccgaggugggcggaucacuu

SEQ ID NO: 47584 - RNA, 64 nt, hsa
acuucacuuaaaaaaaugccuuaguuguuaucaucuuugggagaguucauucaaaauguccagc

SEQ ID NO: 47585 - RNA, 64 nt, hsa
cugggugcuguggcucacgccugcaaucccagcacuuugggagacugaggcgggcggaucauga

SEQ ID NO: 47586 - RNA, 64 nt, hsa
ccaggugcggugguucgugccuguaaucccagcucuuugggaggccaaggcagguagaucacaa

SEQ ID NO: 47587 - RNA, 64 nt, hsa
cgagagugacauccaguugcaccuuucucaccuacuuugggaccuuugggggugaguuccccuu

SEQ ID NO: 47588 - RNA, 64 nt, hsa
cugggcauagugguucaugccuguaaucccagcacuuugggaggcugaggaggguggaucacuu

SEQ ID NO: 47589 - RNA, 64 nt, hsa
gcugggcacagcgguuccgccuguaaucccagcacuuugggagguccaggcagguggaucucuu

SEQ ID NO: 47590 - RNA, 64 nt, hsa
ccgggcgugguggcucaagccuguaaucccagcacuuugggaggccgaggugggcggaucacga

SEQ ID NO: 47591 - RNA, 64 nt, hsa
ccaggcacagucgcucauacuuguaaucccagcacuuugggaggccgaggcggguggaucacaa

SEQ ID NO: 47592 - RNA, 64 nt, hsa
cuaggcacaguggcucacacauggaaucccagcacuuugggaggccgaggugggaggaucacuu

SEQ ID NO: 47593 - RNA, 64 nt, hsa
uccccccaaauggaaauuguauuugccuucuccacuuugggaggcucccacuucuugggagggu

SEQ ID NO: 47594 - RNA, 64 nt, hsa
agggcgccuggagaaagaggcccuguuacuauuccuuugggaucucugaggccucagagugcuu

SEQ ID NO: 47595 - RNA, 64 nt, hsa
ccaggcaugguggcucacgccuguaaucccagcacuuugggaggccgaggcagguggaucaccu

SEQ ID NO: 47596 - RNA, 64 nt, hsa
cugggugcgguggugcacuccuguaacccugggacuuugggaagcugaggcaggaagauugagc

SEQ ID NO: 47597 - RNA, 64 nt, hsa
cuggaugcaguggcuuguuccuauagucccagcacuuugggaggcugagguggguggauugcuu

SEQ ID NO: 47598 - RNA, 64 nt, hsa
cugggugcgguggcuccugccuauaaucccaguacuuugggaggccgaggcgggcagaucacuu

SEQ ID NO: 47599 - RNA, 64 nt, hsa
cugggcgcgguggcucaugccuguaacccuagcacuuugggaggcugaggcgggcagaucacuu

SEQ ID NO: 47600 - RNA, 64 nt, hsa
gccgggugugguggcucaucccuauaauccuacacuuugggaggccaaggugggcggaucacuu

SEQ ID NO: 47601 - RNA, 64 nt, hsa
ugggccaggcucacaccuguaauccuaaguaacacuuugggaggcuggggcgagaggauugcuu

SEQ ID NO: 47602 - RNA, 64 nt, hsa
ccuggcagagugugucaugccugcaaucccagcacuuugggaggccaaggcaggcagaucaccu

SEQ ID NO: 47603 - RNA, 64 nt, hsa
uuacugaacugaacuuucugaaaacguaauguagcaguaucaauauacuuuugggcauaaaaau

SEQ ID NO: 47604 - RNA, 64 nt, hsa
uuuuauuuguauucgaucuguguuaccugggauccaguaucaaauauauccacauucuuuauca

SEQ ID NO: 47605 - RNA, 64 nt, hsa
gaaaggacauucuuuaauuacugcccacucaacacauauuuaauaugugcccagauuauucuaa

SEQ ID NO: 47606 - RNA, 64 nt, hsa
auaagucuauuccauuauuauauuuugcgcuuggcauauuuauuccuuuaugcuuuuaaucacu

SEQ ID NO: 47607 - RNA, 64 nt, hsa
uuugcauuuguguaguacuuuauaguuuacaaagcauauuuacaccaauuauuuuauguaaucc

SEQ ID NO: 47608 - RNA, 64 nt, hsa
uuuuuaaucuucauauaucuauucagcaguaugccauauuuaauuugaaguggacuuugaaagu

SEQ ID NO: 47609 - RNA, 64 nt, hsa
gggguaaguuagaguagggggagggauaggaagacauauuuaaaaaccauuaaaacacugucuc

SEQ ID NO: 47610 - RNA, 64 nt, hsa
aaauacauagacauugucuuuuaugaauucugaucauauuuagucauuuugaccaaaugaggga

SEQ ID NO: 47611 - RNA, 64 nt, hsa
auguaagcaacgcuacugguucaccccaaccuuccauauuuaucuguucaaaggagcaagaacu

SEQ ID NO: 47612 - RNA, 64 nt, hsa
guauuuguugagcuccuauuugcccagagauggucauauuuaaacagaaguauacguuuuucag

SEQ ID NO: 47613 - RNA, 64 nt, hsa
aacugaugguaacuguacauuuugugcuaaaaugcauauuuauauguguauaccauauguggag

SEQ ID NO: 47614 - RNA, 64 nt, hsa
caccucacagaguuacuaaaaaaugucuguaaagcauauuuaccucuugggagauaggcacuau

SEQ ID NO: 47615 - RNA, 64 nt, hsa
guuaaaaccaggcuuucuagaaagaauaaacuuacauauuuauuuuuaggacaugaaaauagca

SEQ ID NO: 47616 - RNA, 64 nt, hsa
uugauacaaucauagcauugucuauuuuucucuucauauuuauaugggggggagggcgcuggau

SEQ ID NO: 47617 - RNA, 64 nt, hsa
aacacagaggaauuuauaccucaaacuaucuggccauauuuacuaccuuaucacugcauuauuc

SEQ ID NO: 47618 - RNA, 64 nt, hsa
auguaaagaaaugucuuaauuuuugaaaaaaguacauauuuauuuucuuuugaauuguuuuuau

SEQ ID NO: 47619 - RNA, 64 nt, hsa
auugaaucagauuuaagggcucuguccuguuauacauauuuaaggcagaaaaaaaguuacaugu

SEQ ID NO: 47620 - RNA, 64 nt, hsa
gcugagaaauguguaggggcacuuuuuugguugucauauuuacuaggggcuucuguuggcauuu

SEQ ID NO: 47621 - RNA, 64 nt, hsa
uuggagccaggcauugauguagagguucaccaaacauauuuagggauaauagauaaauucauaa

SEQ ID NO: 47622 - RNA, 64 nt, hsa
ucaaacaauguagcauaaagugguauugaaguaccauauuuaaguugaacugcucugcauuaau

SEQ ID NO: 47623 - RNA, 64 nt, hsa
aaccagucaccaaauguaagacccauaagaaacccauauuuaaaaaucugaauuuuuuagaaga

SEQ ID NO: 47624 - RNA, 64 nt, hsa
cacuguauuggagguuuuuuuuuaauuuacagaucauauuuauuuuacuauuuuuguagaaaau

SEQ ID NO: 47625 - RNA, 64 nt, hsa
aacuggaaaaaauauauauuauguaucuauguaucauauuuaucacaugaccacuuuugauucc

SEQ ID NO: 47626 - RNA, 64 nt, hsa
aagccucacaaauuauuuguaaaauuuaguaguucauauuuaguauaucaguaauauagaagac

SEQ ID NO: 47627 - RNA, 64 nt, hsa
uacugauauuucauuccuuuguuuacuaaagagacauauuuaucaguugcagauagccuauuua

SEQ ID NO: 47628 - RNA, 64 nt, hsa
guaauuaugaggugaaacaauuauuguacacuaacauauuuagaagcugaacuuacugcuuaua

SEQ ID NO: 47629 - RNA, 64 nt, hsa
caaguuucugccuaauuaaggagaagucuuuuaucauauuuauacugcuguccaaucuuuucua

SEQ ID NO: 47630 - RNA, 64 nt, hsa
uccaaucuuuucuauauuuagaaauaauaauguacauauuuaucuaugguuuuauuuucuuaua

SEQ ID NO: 47631 - RNA, 64 nt, hsa
gagguggauuuacugagagaaggugaaauaaagccauauuuaguauaccagagaagguagauuu

SEQ ID NO: 47632 - RNA, 64 nt, hsa
uuuuuuucuguaacugugcuuguugaaugucaaucauauuuaaagggaaugacuuugaaguaaa

SEQ ID NO: 47633 - RNA, 64 nt, hsa
guuuugucuucacuagcucauuuguuuaucaagucauauuuagggucccacacccucuuuuccu

SEQ ID NO: 47634 - RNA, 64 nt, hsa
uguuuuugcaagauaaauggugacuuauaaugggcauauuuauuugccuguauuucauuucccc

SEQ ID NO: 47635 - RNA, 64 nt, hsa
aguucugcuucugaaacuggaguaucauucuuuacauauuuauauguauguuuuaaguaguccu

SEQ ID NO: 47636 - RNA, 64 nt, hsa
uacaauucuuuaaaauucacuaaugauugagguccauauuuagugguacucugaaauuggucac

SEQ ID NO: 47637 - RNA, 64 nt, hsa
ugcuauaugcaugaagcuucuguuuauuguuuuccauauuuaaggaaacaacaucccauaauag

SEQ ID NO: 47638 - RNA, 64 nt, hsa
auguauuuuuauuuuuguuuuguuuuuuacuuuucauauuuauauuagcauacaaggacaauug

SEQ ID NO: 47639 - RNA, 64 nt, hsa
aauacugauuuucuuaaacuuaaauguuguauuucauauuuauuuauauaauacaaauggaaau

SEQ ID NO: 47640 - RNA, 64 nt, hsa
aaauuucacacaauaaaaaacaacauagaguacacauauuuauauguauuuuuaaagauaaaga

SEQ ID NO: 47641 - RNA, 64 nt, hsa
caguggcuacauuugacacuuuagaaaaaauaaacauauuuaauaauuuuuguuucuccuuagg

SEQ ID NO: 47642 - RNA, 64 nt, hsa
augaauuucuuguuggaaauguaaaucuaguguccauauuuaauacucucacagcuuuguguuu

SEQ ID NO: 47643 - RNA, 64 nt, hsa
uucguugaaguuuagaagauaagaaacaugucaucauauuuaaauguuccgguaaugugaugcc

SEQ ID NO: 47644 - RNA, 64 nt, hsa
auacucaugauugcuaaguguuuuuuuauuuuugcauauuuauugaacugucuaauugaauaca

SEQ ID NO: 47645 - RNA, 64 nt, hsa
acaguauagaaaccuccauuuuugccuucgaaugcauauuuaagaguuaacagaaugaaaaaaa

SEQ ID NO: 47646 - RNA, 64 nt, hsa
uugguaguaaagugauuuuuaccaccuguguuugcauauuuauauaugcuguggaugaaaauaa

SEQ ID NO: 47647 - RNA, 64 nt, hsa
auaaaaccucuuauuuuauuuauguggcagguugcauauuuauguggacacauagguugcacug

SEQ ID NO: 47648 - RNA, 64 nt, hsa
cuuaguucuuauuuuaaggcuaaaaaaacuuugucauauuuaagucggcagcuuucuaauuuaa

SEQ ID NO: 47649 - RNA, 64 nt, hsa
auucuucuugcaguucugggaguaaagcucccagcauauuuagauaauagggcaggggaagcac

SEQ ID NO: 47650 - RNA, 64 nt, hsa
guucuccagcacugagguggggcagauaacggggcauauuuaagggggcaucuuuguguaaaag

SEQ ID NO: 47651 - RNA, 64 nt, hsa
aguacauaacagaaaagugggacuuucacauuuucauauuuaggcacguuccaauuuaauucca

SEQ ID NO: 47652 - RNA, 64 nt, hsa
gaguuuggaggccuuuuuaacaugcagacauacccauauuuaaaugaaauggggagauauuuac

SEQ ID NO: 47653 - RNA, 64 nt, hsa
ugauucaaaauauuuaaaaaugucuugcuguugacauauuuaauguuuuaaauguacagacaua

SEQ ID NO: 47654 - RNA, 64 nt, hsa
gcuguugacauauuuaauguuuuaaauguacagacauauuuaacuggugcacuuuguaaauucc

SEQ ID NO: 47655 - RNA, 64 nt, hsa
aaugugaauucuucccagaaauuucaaugcauugcauauuuagccuucggcauauuuuucauga

SEQ ID NO: 47656 - RNA, 64 nt, hsa
aacuuuauuuuaaaaccaaauuuagguguucuuacauauuuaaauacuggaaagucauuauaau

SEQ ID NO: 47657 - RNA, 64 nt, hsa
ugcauucuuuguauucugauuuuuuaaguguuuucauauuuauagccaucacaaaauuuugccc

SEQ ID NO: 47658 - RNA, 64 nt, hsa
uuucacuuaagguggaggaccuuaacuaaaggaccauauuuauucauuauuuuaauauuauaag

SEQ ID NO: 47659 - RNA, 64 nt, hsa
caugucugcagaaucacuguauguaacaaacagccauauuuaagacaugccuggauaaauaaaa

SEQ ID NO: 47660 - RNA, 64 nt, hsa
cuuuaauuguaaugacuuuguuuuauccacauuacauauuuauguauuucacuguuaugucaac

SEQ ID NO: 47661 - RNA, 64 nt, hsa; identical to SEQ ID NO: 47659

SEQ ID NO: 47662 - RNA, 64 nt, hsa
uuuguuuuauccacaguuaagccuuuucucauuacauauuuauguauuucacugucaugucaac

SEQ ID NO: 47663 - RNA, 64 nt, hsa
gaaugaaaguagugguuuuuaaagaguuaaguuacauauuuauuuucucacuuaaguuauuuau

SEQ ID NO: 47664 - RNA, 64 nt, hsa
gaaaaaaaaaaguaaagagucuauuuauggcugacauauuuacggcugacaaacuccuggaaga

SEQ ID NO: 47665 - RNA, 64 nt, hsa
gugccuuugcaaccuauccugggagacccuaaaacauauuuaguuuuagugccuagagauuuuc

SEQ ID NO: 47666 - RNA, 64 nt, hsa
agagaaaaaaaggcuauuuagcauuacaaagaaucauauuuaaaggcugcccaauguagagucu

SEQ ID NO: 47667 - RNA, 64 nt, hsa
ugucaugcuugaauguuuuagauguaaccuuugacauauuuagaacucuccuccuauacaaugu

SEQ ID NO: 47668 - RNA, 64 nt, hsa
ugcuggggaauaugcuuuuuaugguugcuguugccauauuuacugaagguuuauaccuaaaugu

SEQ ID NO: 47669 - RNA, 64 nt, hsa
ggggaggcuguuggaguucucacugacuuaguggcauauuuauucuguacugaagaacugcaug

SEQ ID NO: 47670 - RNA, 64 nt, hsa
aauuauuuucagggauaugcuagaauuacuuccacauauuuaucccuuuuuaaaaaagcuaauc

SEQ ID NO: 47671 - RNA, 64 nt, hsa
auuguauguguuuauucuucauaugguacuuuaccauauuuauauauuguuuuauaccuguagg

SEQ ID NO: 47672 - RNA, 64 nt, hsa
uccuuuuauuauuucucuguauguuguauuugaucauauuuaaaggaaaaaagcaagcuuauaa

SEQ ID NO: 47673 - RNA, 64 nt, hsa
aauuuucagucauaaaagcuuuacuauuuauuuacauauuuauucauguucaugguacucuucu

SEQ ID NO: 47674 - RNA, 64 nt, hsa
cuaaaucuuguauaugcaucuuuguugcuuauuacauauuuacacacacaaccacaaauuuuaa

SEQ ID NO: 47675 - RNA, 64 nt, hsa
uucuguagugugcuaaaaugcucaaguuggcacauaaacccauuccaagauuuuauaguucuug

SEQ ID NO: 47676 - RNA, 64 nt, hsa
ccaguaaaucacuucuucuuucucuuugccuuuuuaaacccaugcuuugauccacuuaucuaug

SEQ ID NO: 47677 - RNA, 64 nt, hsa
gagcuccucagcuugaaauggggcugcaucccuauaaacccaucauaaagucaaaaaauccuaa

SEQ ID NO: 47678 - RNA, 64 nt, hsa
augguccucgauuuacauugugguuaauucccaauaaacccaucauaaguuaaaaaugcauaua

SEQ ID NO: 47679 - RNA, 64 nt, hsa
ugugcuagcauggaagaaucaugggcuuuggaauuaaacccauuugguggaauuaaacccauuu

SEQ ID NO: 47680 - RNA, 64 nt, hsa
caugggcuuuggaauuaaacccauuugguggaauuaaacccauuugguuucaaaucccaguuau

SEQ ID NO: 47681 - RNA, 64 nt, hsa
accccuccauuuaugugauggguuugcauccugauaaacccaucauaaguugaaaauaugauca

SEQ ID NO: 47682 - RNA, 64 nt, hsa
ggcugccugaggucuccuauucuacucugaaccauaaacccagagaagaauuacucauuaacca

SEQ ID NO: 47683 - RNA, 64 nt, hsa
aauaaugcucugaauuuuucgaaagggauucuccuaaacccacccacuucucuugcccaggcug

SEQ ID NO: 47684 - RNA, 64 nt, hsa
uuuaaaguaaacacaauugaagccucucugaaguuaaacccaacuauguuuauuaaaaugugug

SEQ ID NO: 47685 - RNA, 64 nt, hsa
ucaucuaaacccauaaccauaguuucaauguacauaaacccaggcugaaaauauuuuuuaacuc

SEQ ID NO: 47686 - RNA, 64 nt, hsa
gauagaauauucauuuuauggcaaggaaaucaucuaaacccauaaccauaguuucaauguacau

SEQ ID NO: 47687 - RNA, 64 nt, hsa
aaaaaaaaaaaaaaaaaaaagauacauuggucuuuaaacccaaacccccuuuaaggcauguugg

SEQ ID NO: 47688 - RNA, 64 nt, hsa
ccugacagcucagcucugcacgauuucauguuccuaaacccaugucuuagggcagcacagagcc

SEQ ID NO: 47689 - RNA, 64 nt, hsa
gccuuaaucauuccaguuugauuuacguguauaccucauaaacauuuuucuuuuguuucucucu

SEQ ID NO: 47690 - RNA, 64 nt, hsa
ugcaaacaugcaauugagaaacuggauagauacacucauaaaacccccaccccuccccacccca

SEQ ID NO: 47691 - RNA, 64 nt, hsa
gcucaaguaaauccucaauguguauaauuauugccucauaaacucucucuuuguuuuuaaagga

SEQ ID NO: 47692 - RNA, 64 nt, hsa
uuccaucuaccuuuuuauaaauacauaucuaugucucauaaaaauuagaauguacuauuuuaaa

SEQ ID NO: 47693 - RNA, 64 nt, hsa
ggcuuauuguguuaacacuucagaaagauucaaacucauaaacucaguauuuuaacucaaaauu

SEQ ID NO: 47694 - RNA, 64 nt, hsa
auuauugaaugguuuucauuuuaaucugcaaugucucauaaagacucggguaguuuuucuuugg

SEQ ID NO: 47695 - RNA, 64 nt, hsa
gcaugccuaagauaaaauuguauauuuuuuccaucucauaaauauucauuuucuucaaagucuu

SEQ ID NO: 47696 - RNA, 64 nt, hsa
uaaauauucauuuucuucaaagucuuuuuucaaucucauaaaaaagggauagugcaucuuuuaa

SEQ ID NO: 47697 - RNA, 64 nt, hsa
uuaacugugcguuaaauaagcaaauaaacaguggcucauaaaaauaaaagucgcauuccauauc

SEQ ID NO: 47698 - RNA, 64 nt, hsa
uuuggaugggccuuuuagaaaccucauuggccagcucauaaaauggaagcaauugcucauguug

SEQ ID NO: 47699 - RNA, 64 nt, hsa
aaugccacugugugcauccauuuuaaaggguucccucauaaaaaaauguuauuccccauuauca

SEQ ID NO: 47700 - RNA, 64 nt, hsa
aaccuguugaguuucuaaugaauauuuguagaaucucauaaaacaguuuaaauacaagcuuaag

SEQ ID NO: 47701 - RNA, 64 nt, hsa
gcguggcccagauaagaauagguguuccuuugugcucauaaaacagaaugcggcgaugguugcu

SEQ ID NO: 47702 - RNA, 64 nt, hsa
gggcugugcuacacuucccaguuacauucugaagcucauaaauguaugagaagguuugugauuu

SEQ ID NO: 47703 - RNA, 64 nt, hsa
guucuaagaauuccauuugccucuaugaucuuagcucauaaaaauauaauaugacuugauaaag

SEQ ID NO: 47704 - RNA, 64 nt, hsa
cugaaguuauaaguuuaaaacucaauuucagaugcucauaaaaguuacuuagcuaaaauuuuag

SEQ ID NO: 47705 - RNA, 64 nt, hsa
ugcacugcccggccuucagaaagacagaauuucaucacccaaugcagggggagcucuuccugga

SEQ ID NO: 47706 - RNA, 64 nt, hsa
gagcucuuccuggaccaagggaggagccgcucauucacccaacaaaacugugucuuaucugcca

SEQ ID NO: 47707 - RNA, 64 nt, hsa
uugcaugccaaauuguaguucuugucugauuggcucacccaagcaaggccaaaauuaccaaaaa

SEQ ID NO: 47708 - RNA, 64 nt, hsa
cucagcccugacuggugcuauaggcuggagaagcucacccaauaaacauuaagauugaggccug

SEQ ID NO: 47709 - RNA, 64 nt, hsa
caccccugggauagaaagacccuuagaugucuuuucacccaaccccaaacucccuguacagaag

SEQ ID NO: 47710 - RNA, 53 nt, hsa
gaccucgggcccagcgcugagggucacccaaccgccggccuuagugaccccau

SEQ ID NO: 47711 - RNA, 64 nt, hsa
gccauaaugcagacuuucccauuccuucucuuuccacccgcaacuguggggcuaagaauucuua

SEQ ID NO: 47712 - RNA, 64 nt, hsa
cgaccacuagaggucagcgucgcgccgcacucuucacccgcauguccagagggcggccgggaug

SEQ ID NO: 47713 - RNA, 51 nt, hsa
ggccacccaaacauaaauaaccacccgcaguguccagaggcccucagaucg

SEQ ID NO: 47714 - RNA, 64 nt, hsa
aggguccugcauaugcaccuggggaguccccacacacccgcaccaaaggggaaacauucaaagg

SEQ ID NO: 47715 - RNA, 64 nt, hsa
gagucacuaacuggcguguuucugcccauuggagcacccgcacacuacuccaaaucaaaaccac

SEQ ID NO: 47716 - RNA, 64 nt, hsa
guagagaggcccgcccgcccaccgugggcagugccacccgcagaugacacgcgcucuccaccac

SEQ ID NO: 47717 - RNA, 64 nt, hsa
augcggggagaccgacggugcgaaggcccuucuccacccgcaggugggccaagcucugggggca

SEQ ID NO: 47718 - RNA, 64 nt, hsa
aauagaugagcaggucaggcuguggcccuuaccucacccgcaguucucgcccagugcugcagcc

SEQ ID NO: 47719 - RNA, 64 nt, hsa
ccugagucccuggcaguagccuuggggcagagggcacccgcagagucccagagaugaugugggc

SEQ ID NO: 47720 - RNA, 64 nt, hsa
gcuuugcagugagugcugcucauguccuccccuccacccgcacaugggggucgcugcccuucac

SEQ ID NO: 47721 - RNA, 64 nt, hsa
caccugcccagccauggcacacacccuuccugcacacccgcacuaccugcacuucucgcacauc

SEQ ID NO: 47722 - RNA, 64 nt, hsa
ggaggucucacgguguagagaggagcuuugaggccacccgcacaaaauucacccagagggaaau

SEQ ID NO: 47723 - RNA, 64 nt, hsa
guugucauuggauugaauuuacuuuuuuguuucucacccgcaacuugagccaggacagcugguc

SEQ ID NO: 47724 - RNA, 59 nt, hsa
gcaucaagcucugcccuugauuauccugccacccgcaggggccccucugucagcacuug

SEQ ID NO: 47725 - RNA, 64 nt, hsa
aaaaugcaccauguccugaaagauggcacccucccacccgcagagugcuuccugcaagcuggcg

SEQ ID NO: 47726 - RNA, 64 nt, hsa
cucuccgcggucccccacccucaccccggccccccacccgcagccggccacacuggagcagcuc

SEQ ID NO: 47727 - RNA, 64 nt, hsa
cugcagccuccgucagcuauguaauguuugccaucacccgcacccuuacuggcucagcccuggc

SEQ ID NO: 47728 - RNA, 64 nt, hsa
ggauggccgucaccucagacaucacuccagggagcacccgcaggagcugggcccccucacgccu

SEQ ID NO: 47729 - RNA, 64 nt, hsa
ucaucgugucuguccugagaggcuccacaaugcccacccgcaucgccauucuguagucuucagg

SEQ ID NO: 47730 - RNA, 64 nt, hsa
gcugucucgagccaagcugugaaaacccuagacgcacccgcagggaggguggggagagcuggca

SEQ ID NO: 47731 - RNA, 64 nt, hsa
gcgguauacggugcggggccugggaugcccgcgccacccgcagcccccucacucggcggaaacc

SEQ ID NO: 47732 - RNA, 64 nt, hsa
cucugccacugucagggaccagccggccaacgcccacccgcaaaggugucuaaaaacuucagcu

SEQ ID NO: 47733 - RNA, 64 nt, hsa
caucugagggcgccaggcaggcgggcgccaccgccacccgcagcgagggcggagccggccccag

SEQ ID NO: 47734 - RNA, 64 nt, hsa
gccccuaagcaaccggacuugccugccucggccucacccgcacuucucccaaaaggcagaugac

SEQ ID NO: 47735 - RNA, 64 nt, hsa
gagccuugccaccaucccaggacuuugggcaagucacccgcacucccugggccucgguuucccc

SEQ ID NO: 47736 - RNA, 64 nt, hsa
acgcccgcgccgcggaggagccggcgcccaucuccacccgcacggcucgccgguccagagccau

SEQ ID NO: 47737 - RNA, 64 nt, hsa
ccuguucccucccccaacccuaucccuccuaccucacccgcagggggaaggagggaggcugaca

SEQ ID NO: 47738 - RNA, 64 nt, hsa
uggcuuccucuaaaucauuucaccuuucaguccccacccgcacccguccccuagagccauagua

SEQ ID NO: 47739 - RNA, 64 nt, hsa
ggaccuaagccuaggccccagagaucagcccgaacacccgcaucccuuccuccucccauggguc

SEQ ID NO: 47740 - RNA, 64 nt, hsa
ucucugucuugcugccggccuugauaccaccccucacccgcagagucacugcauucccucccag

SEQ ID NO: 47741 - RNA, 64 nt, hsa
uacacaaaggaccuuagaugagaucuggcauaugcacccgcaauagaagggcaccacuuggaug

SEQ ID NO: 47742 - RNA, 64 nt, hsa
cccagccccuccaaaggucugaugucuccacuuucacccgcaggccuuaccgcucuguuuauag

SEQ ID NO: 47743 - RNA, 64 nt, hsa
cggaccaugcaccaggcugcacccuggugucuuccacccgcaggccucccaugcuccaagcagc

SEQ ID NO: 47744 - RNA, 64 nt, hsa
ugucagggguagucccacauacuaaagauugucucacccgcagugccaauaacacuccuaagaa

SEQ ID NO: 47745 - RNA, 64 nt, hsa
gcaaggaacagcaaggaauuauuuuccagaaugacacccgcagcagaauguuggaguggaaaug

SEQ ID NO: 47746 - RNA, 64 nt, hsa
gauuugccgcacuuggaccuccaugcguggcacucacccgcagucuccuggacaggcgcuguau

SEQ ID NO: 47747 - RNA, 64 nt, hsa
caguccccugcuaucccugcagccacucccagcacacccgcacacagccagcaccaccgccccc

SEQ ID NO: 47748 - RNA, 64 nt, hsa
caaaccuggcccuuccccacuccucuagcaucgccacccgcauggcccuggaacucccgcggcg

SEQ ID NO: 47749 - RNA, 64 nt, hsa
gccaggauggucucgaucucuugaccuugugacucacccgcaucggccucccaaagugcuggga

SEQ ID NO: 47750 - RNA, 64 nt, hsa
cgcucaaagcucagacucaggucugaaacccacccacccgcaagccuaccagccuuguggccac

SEQ ID NO: 47751 - RNA, 64 nt, hsa
ggccugacugcgaagcugugccuugccccucucccacccgcaguuucucaccccguucugcucc

SEQ ID NO: 47752 - RNA, 64 nt, hsa
acgggaggauuccagaacagcagcacugagcucccacccgcagagccucuggacggccuuggca

SEQ ID NO: 47753 - RNA, 64 nt, hsa
gccagagccgaggguccucccacacgugcucacccacccgcagccuaggcaggcucugcaugcu

SEQ ID NO: 47754 - RNA, 64 nt, hsa
uggcccaggcgcgguugaccugccccugcuguaacacccgcaagaaggaugcaguccuuaccaa

SEQ ID NO: 47755 - RNA, 64 nt, hsa
ccgcaguggcugugucagccucacccuucgugugcacccgcaugggagggucggagggugcugc

SEQ ID NO: 47756 - RNA, 64 nt, hsa
caaagccauggcccgccgccgagagcccaggccccacccgcaccuccucacccauccagccuga

SEQ ID NO: 47757 - RNA, 64 nt, hsa
gcaugucacgacagcuccgccaccccccauugcccacccgcacuuucccgagcaccgcgccccg

SEQ ID NO: 47758 - RNA, 64 nt, hsa
ucucguccuuggauagauucagcucccacacacacacccgcacugcccaggucccuccucagac

SEQ ID NO: 47759 - RNA, 64 nt, hsa
gcuacuccauccuugcaccccugggggcccagcccacccgcaugcacagagcaggggcuaggug

SEQ ID NO: 47760 - RNA, 64 nt, hsa
gcggcaacaccagaaucuuccagaagcccagcuccacccgcacacgcagcuucccauccagucc

SEQ ID NO: 47761 - RNA, 64 nt, hsa
gaggccccuccuucugcugccuggccaagccccacacccgcagacccuccuucccauccucuga

SEQ ID NO: 47762 - RNA, 64 nt, hsa
cugaaaucaacucucuucggucguauccaccuugcacccgcaagucaagccgccccuuguagaa

SEQ ID NO: 47763 - RNA, 64 nt, hsa
ggaagggacuugagcugggcaaguccuggccuggcacccgcagccgucucccuuccguggccca

SEQ ID NO: 47764 - RNA, 64 nt, hsa
uggcgggcaccgcccuggccuuccgcacccucgucacccgcaucuccaacgaccucgagcucug

SEQ ID NO: 47765 - RNA, 64 nt, hsa
gguccuccggugcagugggagggccggcuugcuccacccgcagccccgggguggcguagggaag

SEQ ID NO: 47766 - RNA, 64 nt, hsa
aacucccugcaugcaaaccccuaguacccucucacacccgcacccgcgccucacgaucccucac

SEQ ID NO: 47767 - RNA, 64 nt, hsa
cuguauaaauaacgggauuuucauggcgccgccccacccgcauuaucacugugugauggucuca

SEQ ID NO: 47768 - RNA, 64 nt, hsa
cucaacuccuggucuccucugcuccuucucacugcacccgcaucucccauguuugcacuggcug

SEQ ID NO: 47769 - RNA, 64 nt, hsa
acccccuccugggaagugcccccucaccucagggcacccgcaaccugggcuccucccugagcgc

SEQ ID NO: 47770 - RNA, 64 nt, hsa
gccgggauccugagccuaggccucccgauguucccacccgcaugaucccuucccgccacacgau

SEQ ID NO: 47771 - RNA, 59 nt, hsa
ccaaucacuacaagaaaugagcccaggcccacccgcagcuggccucacugucccgggug

SEQ ID NO: 47772 - RNA, 64 nt, hsa
uccaccugcacaaacauagacagauguggacaugcacccgcauguacaaaaacacaaauacgga

SEQ ID NO: 47773 - RNA, 64 nt, hsa
uuacagacaugaacugccaggcccggccaaaauaaugcaccacuuuuaacagaacagacagaug

SEQ ID NO: 47774 - RNA, 64 nt, hsa
ucuuuucuaaaugccaaugaguuggccuuuaaaaaugcaccacuuuuuuuuuuuuuuugacagg

SEQ ID NO: 47775 - RNA, 64 nt, hsa
uuccucagccucccaaguagcugggauuacaggcaugcaccaccaugcccagcuaauuuuugua

SEQ ID NO: 47776 - RNA, 64 nt, hsa
ugguuuuguuucuaaaauguuuucuuuuaccgugaugcaccaguaugagauggugcugacacuu

SEQ ID NO: 47777 - RNA, 64 nt, hsa
uuguuuguuuuuuguuuuuuuucuugguaaagccaugcaccacagacuucugggcagagcugag

SEQ ID NO: 47778 - RNA, 64 nt, hsa
uugcugagcaacgagauggugagcaucagugcaaaugcaccauucagcacaucagucauaugcc

SEQ ID NO: 47779 - RNA, 64 nt, hsa
gcccgaucgccagcccgaggacuuaccauccacaaugcaccacggaagaggccguucuaugaaa

SEQ ID NO: 47780 - RNA, 64 nt, hsa
cccuggcauuagcagcuucgaccucauuuuccagaugcaccagcuccuauuaauaaguuagcaa

SEQ ID NO: 47781 - RNA, 64 nt, hsa
aggucaugucugcagcccccagaauguucuggacaugcaccaccagccgguggucccaaugucc

SEQ ID NO: 47782 - RNA, 64 nt, hsa
uuuacaaaugcuuuauucucuucuuuaauaaaaaaugcaccaguauucuaaaagcaaaaauggc

SEQ ID NO: 47783 - RNA, 64 nt, hsa
ugccucagccucccuaguagcugggauuacaggcaugcaccaccauacccagcuaauuucugua

SEQ ID NO: 47784 - RNA, 64 nt, hsa
ugccucagccucccgaguagcugggauugcaggcaugcaccaucacaccuggcuaauuuuguau

SEQ ID NO: 47785 - RNA, 61 nt, hsa
uuaauaugaaagauccucaugaauuaaauaguugaugcaauuuuuaacguuaauugauaua

SEQ ID NO: 47786 - RNA, 61 nt, hsa
ugguggggagggaaggccuccugaauugaguuugaugcagagcuuuuuagccaugaagaau

SEQ ID NO: 47787 - RNA, 61 nt, hsa
uagcucuugagcauuagucacuaccuucagcuugaugcauggucacuucuuuacuauuuaa

SEQ ID NO: 47788 - RNA, 61 nt, hsa
ugguauucuguuuacagauguauuaggaccauugaugcauuacauuuaagaauucucuuua

SEQ ID NO: 47789 - RNA, 61 nt, hsa
augccagucuuauaauuaacauaauuuaaauuugaugcaauuuaaauauaacaggagacuu

SEQ ID NO: 47790 - RNA, 61 nt, hsa
gagaaucuuaagagcuguuagaaaguagcacuugaugcaagggauguuuugaaaagaaaaa

SEQ ID NO: 47791 - RNA, 61 nt, hsa
uuggguugggguucacucuuaccaagaaucuuugaugcagcuuuaagaugguggggaggau

SEQ ID NO: 47792 - RNA, 61 nt, hsa
aagaaguagaaagucauugaacugacaguguuugaugcaacuaaaagaggauuguaagaca

SEQ ID NO: 47793 - RNA, 61 nt, hsa
gcuuucaguauuuugccauuaagcauaguauuugaugcagguuuuuuuugauugaugcagg

SEQ ID NO: 47794 - RNA, 61 nt, hsa
aagcauaguauuugaugcagguuuuuuuugauugaugcaggggaucaaauuuaggaaguuc

SEQ ID NO: 47795 - RNA, 61 nt, hsa
augaaaaucugacuuugcccagcucuuuuccuugaugcaguuucccgguguggaaggaacc

SEQ ID NO: 47796 - RNA, 61 nt, hsa
ucagauucaucuccacugauaaccgguuuccuugaugcagacauaguuuagcuuucuuuga

SEQ ID NO: 47797 - RNA, 61 nt, hsa
uuuuggucaagcuugaggcugaauaaagccuuugaugcacaaaaugggacugcugaagagu

SEQ ID NO: 47798 - RNA, 61 nt, hsa
guguaaaguuaaucagaaagaaaaaauuuuauugaugcagugugucuuuauaaagcuguuc

SEQ ID NO: 47799 - RNA, 61 nt, hsa
agaaaaugagugaauauucuucucacuuuuauugaugcauucagagaauaagcaaugaaau

SEQ ID NO: 47800 - RNA, 61 nt, hsa
uuaauauuucuauugcaaaagucuauccgauuugaugcacuuugaauauugagauauuuug

SEQ ID NO: 47801 - RNA, 61 nt, hsa
uccuuuuguaauaagaaagaagagagagaacuugaugcaaaguccacgaaaaaacaauuuu

SEQ ID NO: 47802 - RNA, 61 nt, hsa
ccagagauaccuguuuugaugaguaccuauuuugaugcaaaggaacggcccugggaccuca

SEQ ID NO: 47803 - RNA, 61 nt, hsa
acgaccggagugcuggcucucacagugaauuuugaugcauuuaaaauaagauucugaugcc

SEQ ID NO: 47804 - RNA, 61 nt, hsa
gcgcugguucugaagcaccgauggaaacagauugaugcagauggaaggaggaagggagacu

SEQ ID NO: 47805 - RNA, 61 nt, hsa
ucugggaagcagauaagcauagaacugauacuugaugcacacucguagugguaacucaucc

SEQ ID NO: 47806 - RNA, 61 nt, hsa
uccaccauaaugcaguuaccuguaggcauaauugaugcacaugauguucacacagugagag

SEQ ID NO: 47807 - RNA, 64 nt, hsa
cgggccuugcucuuguggagcuuagagguugguggggaagaaaauaggcaugcaccaaggaauu

SEQ ID NO: 47808 - RNA, 64 nt, hsa
gaugggagccaagcuugaggacugcuggugaccugggaagaaaccuucuucccauccuguucag

SEQ ID NO: 47809 - RNA, 64 nt, hsa
agucuugguuugacaaggggaacuugauccuucagggaagaaucaucuccaaaaugacucccca

SEQ ID NO: 47810 - RNA, 64 nt, hsa
gccagagucuuauaacaccucccaagaaagauaggggaagaagccagaaccccaccuggccugc

SEQ ID NO: 47811 - RNA, 64 nt, hsa
ucaaagaagaaaagaagaaggggaagaaaagaaggggaagaagaucaaaacccaccaugcccca

SEQ ID NO: 47812 - RNA, 64 nt, hsa
gaaggggaagaagaucaaagaagaaaagaagaaggggaagaaaagaaggggaagaagaucaaaa

SEQ ID NO: 47813 - RNA, 64 nt, hsa
aaauugaaaagaaggggaaggggaagaaaagaaggggaagaagaucaaagaagaaaagaagaag

SEQ ID NO: 47814 - RNA, 64 nt, hsa
ugaauuuauugcagaaauugaaaagaaggggaaggggaagaaaagaaggggaagaagaucaaag

SEQ ID NO: 47815 - RNA, 64 nt, hsa
aaagugagacuuggguggugggaagaaggaaggugggaagaaggaauuagacacucugccugcc

SEQ ID NO: 47816 - RNA, 64 nt, hsa
uuucuuuuaauaaguaaagugagacuuggguggugggaagaaggaaggugggaagaaggaauua

SEQ ID NO: 47817 - RNA, 64 nt, hsa
uuuucacgcugcugauaaagacauacccgagacugggaagaaaaagugguuuaauuggacuuaa

SEQ ID NO: 47818 - RNA, 64 nt, hsa
uauuaaugcugcugauaaagacguacccgagacugggaagaaaaagagguuuacuuggacuuac

SEQ ID NO: 47819 - RNA, 64 nt, hsa
gaugaggauaaaagaaaguuucagauucaacagggggaagaaaauggagauuuaauccuaaaac

SEQ ID NO: 47820 - RNA, 64 nt, hsa
ccagaggagcaagggugccuuagaccgaagccaggggaagaagcaucuucauaaaaaacuuuca

SEQ ID NO: 47821 - RNA, 64 nt, hsa
agaaccauuugcugccgcauagugccauuggauagggaagaacuucagaaaucugugguacucu

SEQ ID NO: 47822 - RNA, 64 nt, hsa
gagcccuaacuuucaggcuuugcauuuuguauaugggaagaaauaugacaauccuagguaauua

SEQ ID NO: 47823 - RNA, 64 nt, hsa
ccucugagugagaugcccaggaggaggagcccuagggaagaagucagggacagggaccaggaua

SEQ ID NO: 47824 - RNA, 64 nt, hsa
ucccuccguucugcuucagcuuccccuaagguuagggaagaaagaaucgggcucacgaaugcca

SEQ ID NO: 47825 - RNA, 64 nt, hsa
cuaauugauuccuugugaccuaauucuagagaaugggaagaaggccuguuauuuuguuguccuu

SEQ ID NO: 47826 - RNA, 64 nt, hsa
uguaggaaggccucaaggauguaauucuagcccagggaagaaaauccuuuucagcagacgcuuc

SEQ ID NO: 47827 - RNA, 64 nt, hsa
agaagcaggcggguugggugggaggaggaagaaagggaagaauuagguuugaauugcuuuuuua

SEQ ID NO: 47828 - RNA, 64 nt, hsa
agaagcaggcggguugggugggaggaggaagaaagggaagaauuagguuugaauugcuuuuuaa

SEQ ID NO: 47829 - RNA, 64 nt, hsa
acaccuguuacccauuaggggugauaacauuaaugggaagaaaugauggcaacuuugaaugcua

SEQ ID NO: 47830 - RNA, 64 nt, hsa
gccaucucugggauuugaaauauccagacuuguagggaagaaaacaaugacuugacgaccuuaa

SEQ ID NO: 47831 - RNA, 64 nt, hsa
gauggagagaauaggaaucuucacuagaagccgugggaagaauuggaaguuacaugcuguauau

SEQ ID NO: 47832 - RNA, 64 nt, hsa
uuuugguagagaaggagcagaaagauguguuuuugggaagaagaagaccucuaggaggagcuag

SEQ ID NO: 47833 - RNA, 64 nt, hsa
cuuggcacuuauugaauauaugaucggccaucaagggaagaacuauugugcucagagacacugu

SEQ ID NO: 47834 - RNA, 64 nt, hsa
cauuugggguaauacuuccagaagugcgggguaggggaagaagagcuaucaggagaaagcuugg

SEQ ID NO: 47835 - RNA, 64 nt, hsa
uuauuaaaaauugagucuuaaauuuaaaugggaagggaagaaaacaccaaauaagaaaaaaauu

SEQ ID NO: 47836 - RNA, 64 nt, hsa
aaggacagcauuuaaauauuugugcuggagugaggggaagaagcuguuacagaaguggaauggu

SEQ ID NO: 47837 - RNA, 64 nt, hsa
gggaugugccucaguugggagcaaggagaaaaaugggaagaaccaguuuuauccaucuuaaaac

SEQ ID NO: 47838 - RNA, 64 nt, hsa
gccaggcaccucuucacaggugguaaacauuuaggggaagaaagcagcccagggugccaugccu

SEQ ID NO: 47839 - RNA, 64 nt, hsa
aacugaggaggggaagaaaguucuacguaauggagggaagaauuucccagccaucuuccgaaga

SEQ ID NO: 47840 - RNA, 64 nt, hsa
cguugugggacaucuaggcaccucaacugaggaggggaagaaaguucuacguaauggagggaag

SEQ ID NO: 47841 - RNA, 64 nt, hsa
ugagcuuuauucaaauuuugacaaucagagcacugggaagaaauaaauuccacaacugccuuua

SEQ ID NO: 47842 - RNA, 64 nt, hsa
cuuggucucgcugucgguuaacuguaaaguuagggggaagaaagaaaaaaaauuaaaaggguag

SEQ ID NO: 47843 - RNA, 64 nt, hsa
acugcucauuguaacuuucaaaaccccgucuuuggggaagaaucaucuagggugacauuccuug

SEQ ID NO: 47844 - RNA, 64 nt, hsa
caggauuccugccagguccccgauguguauccaggggaagaauugguggccugagccgaugggg

SEQ ID NO: 47845 - RNA, 64 nt, hsa
ggaaagcuuguaauagcaaaauuguaaauuacaagggaagaaucuacuuuuuagaaaucgcuuu

SEQ ID NO: 47846 - RNA, 64 nt, hsa
uuuauuucucugucauuuggauggcuggucaauggggaagaauugagugggugauuuaaucaac

SEQ ID NO: 47847 - RNA, 64 nt, hsa
ccuggcugcccaucauguggccccacccaaucaagggaagaaggaggaaugcuggacuggaggc

SEQ ID NO: 47848 - RNA, 64 nt, hsa
ggcuguaacguggcacugguagguugggacaccagggaagaagaucaacgccucacugaaacau

SEQ ID NO: 47849 - RNA, 64 nt, hsa
uucacaccauaacuagguaacaguuugauaacuagggaagaaagcagaacaguuaagcagccgc

SEQ ID NO: 47850 - RNA, 64 nt, hsa
ucaaaaucuguagagcagggcaaguaacauggaagggaagaaaaggugaaaaauuagaaauguu

SEQ ID NO: 47851 - RNA, 55 nt, hsa
caaaggaccggagaaagugagccuggggaagaaggggguuugaagcccaccaaga

SEQ ID NO: 47852 - RNA, 64 nt, hsa
ggaacccccccccccccgaaaaaaaaaucaaagcgggaagaaaaucagagggaagguuaagguu

SEQ ID NO: 47853 - RNA, 64 nt, hsa
uggucccuaucuuccagcagguuagaggccuuuagggaagaaaagccugugugcagggaaagag

SEQ ID NO: 47854 - RNA, 64 nt, hsa
cuuacgaggauuucuggaagcuucuguaacuguagggaagaaagcuguaggggagcaugguuuu

SEQ ID NO: 47855 - RNA, 64 nt, hsa
agucacgcuggcauaucaggaagauguccuuccugggaagaagaagcuccagccaguucugcug

SEQ ID NO: 47856 - RNA, 64 nt, hsa
gucacagugacaccucaggaagauguccuuccuggggaagaagaagcaccagccacaggggcag

SEQ ID NO: 47857 - RNA, 64 nt, hsa
uguuucucacugcuaacguugguguuucuggcgugggaagaaaugcacaggcgugcauggcaug

SEQ ID NO: 47858 - RNA, 64 nt, hsa
ugcauuguaagaguucugucaugcagucugaaaagggaagaaacaggauggcuuucuguagcca

SEQ ID NO: 47859 - RNA, 64 nt, hsa
ccaggucccucugagcagcccugguaacaagggugggaagaagggacagcuguucuccggcccc

SEQ ID NO: 47860 - RNA, 64 nt, hsa
caaagaggccacaaagaagaaaaagaaacaguuugggaagaaaaguaagugcugcaccggugca

SEQ ID NO: 47861 - RNA, 64 nt, hsa
gggagaagaaggaagggaagggcagaaggaaggagggaagaaaagaaagcaaaggaacagaagg

SEQ ID NO: 47862 - RNA, 64 nt, hsa
uuuccugucaguuggaccccucaccuggccuccagggaagaaugcagagaaaagcaaggagaga

SEQ ID NO: 47863 - RNA, 64 nt, hsa
gccagcuccggccagccugggacagcucaucccagccgacuacaccugcuucugguccugucca

SEQ ID NO: 47864 - RNA, 64 nt, hsa
cucaaccacgccgccaguccauucuuaaggaacugccgacuaggacugaugaugcauuuuagcu

SEQ ID NO: 47865 - RNA, 64 nt, hsa
accugccaguggacuggccaucccucuccugucugccgacuauggagucuccaccuuuggacac

SEQ ID NO: 47866 - RNA, 64 nt, hsa
uuuagcaguaucuguuuacaugcgcaaggaucaagccgacuaccugugcugucuacugggacag

SEQ ID NO: 47867 - RNA, 64 nt, hsa
uggccccggccuaagaccugccuaggacucuguggccgacuauaggcgucucccauccccuaca

SEQ ID NO: 47868 - RNA, 62 nt, hsa
cucucaccucacccacuagaccuugugccggagccgacuacuggagaugacagugaugcugc

SEQ ID NO: 47869 - RNA, 64 nt, hsa
ugaaaccccaucucuacuaaaaguacaaauauuagccgacuauguggcgggcaccuguaauccc

SEQ ID NO: 47870 - RNA, 64 nt, hsa
cccaaauguucccagaggguccuccacacccucugccgacuaccacgguguggauucagcuccc

SEQ ID NO: 47871 - RNA, 64 nt, hsa
uagcuccugccaaaucgagacccucugacgacuugccgacuaacuggccaccacaagcugcagu

SEQ ID NO: 47872 - RNA, 64 nt, hsa
gcuacugaagaagugacuuccguugcauaccaaagccgacuacacugaacaguaccuuccuuuc

SEQ ID NO: 47873 - RNA, 64 nt, hsa
uguaucuugcauucacacucaauagucacggaaugccgacuaggugcuagcugcuaugggaaau

SEQ ID NO: 47874 - RNA, 64 nt, hsa
uuuacucugcugcaaaaugaaggcgggccugcaagccgacuacaccuacggaggcuguugagga

SEQ ID NO: 47875 - RNA, 64 nt, hsa
uacaaaaggccacagugaggccaccuugagucaagccgacuaaggccccucaacccugucacua

SEQ ID NO: 47876 - RNA, 64 nt, hsa
auauggaauuuugcaaagauuuaaucugccaagggccgacuaagagaaguuguaaaguauguau

SEQ ID NO: 47877 - RNA, 64 nt, hsa
ccgccaccacacccggcuaauuuuuuguguuuuuacaaaauacaaaaaaguagagacaggauuu

SEQ ID NO: 47878 - RNA, 64 nt, hsa
ucauggugcagagguaggcauucugagcaggggaacaaaauaagggccuagaaacucacccgug

SEQ ID NO: 47879 - RNA, 64 nt, hsa
uuuucuauuugucuuuauuucaaguaccagaauuacaaaauaucuaaguaauauauuuuuguug

SEQ ID NO: 47880 - RNA, 64 nt, hsa
auaaauauguuuuaauugccaaccgugugaaacaacaaaauaucuaaaaacuaaucccgauuug

SEQ ID NO: 47881 - RNA, 64 nt, hsa
cuucugguuuugggaguucauaagagagaauagaacaaaauacaggacaucaaauauuagccau

SEQ ID NO: 47882 - RNA, 64 nt, hsa
auggaauuuuuaaguagguaaauaaaugguuaagacaaaauaguguuauagccuucauucucug

SEQ ID NO: 47883 - RNA, 64 nt, hsa
accuuacuuuuuggaaacaaaucuucuguuauuuacaaaauaauaauuuuuaaaaaacauuuaa

SEQ ID NO: 47884 - RNA, 64 nt, hsa
auauguuccuuuuucaaagaaacuuuauucuagaacaaaauagucuauaugguacuugaucuac

SEQ ID NO: 47885 - RNA, 64 nt, hsa
guuauaauuguuggaccuccuugagauaguaacaacaaaauaaagcaagcuaucugcaccucaa

SEQ ID NO: 47886 - RNA, 64 nt, hsa
agcaaugagccacagcaaaaaguaaagaacaacaacaaaauaaagcuguuguuaaauuuuaaac

SEQ ID NO: 47887 - RNA, 64 nt, hsa
uggggaccacgcgaaaaccuccaagauauuuuucacaaaauagaaacucauauggaacaaaaua

SEQ ID NO: 47888 - RNA, 64 nt, hsa
aagauauuuuucacaaaauagaaacucauauggaacaaaauaagaaaccccagccaugaaaucu

SEQ ID NO: 47889 - RNA, 64 nt, hsa
aauguuuugagucagugcauuucaaggaacagccacaaaauacacaccccuaagaaaaggcaag

SEQ ID NO: 47890 - RNA, 64 nt, hsa
augaaaucaaguuccaguaacccaaaucuuguuuacaaaauauucgugguaucugugaacaugu

SEQ ID NO: 47891 - RNA, 64 nt, hsa
ggcagaacugaugugagguaagugagcaugucaaacaaaauaggagcucacauggauauauuua

SEQ ID NO: 47892 - RNA, 64 nt, hsa
auucuuuucugcuuuuccagaggggaaaaauguuacaaaauauccuuacuuggucaguugccuc

SEQ ID NO: 47893 - RNA, 64 nt, hsa
ccugaauucaccacagcuggaauagcuguggaaaacaaaauaaaacaacaaaauuaauaaugaa

SEQ ID NO: 47894 - RNA, 64 nt, hsa
cuaguaaugcaaacaaauuauuuuuuacaaaaaaacaaaauaaauaaaauuagacuuccuuccc

SEQ ID NO: 47895 - RNA, 64 nt, hsa
gucuauauauuuaugauaaaucuuuuccauuuguacaaaauaaaauuccauuucauugugaccu

SEQ ID NO: 47896 - RNA, 64 nt, hsa
aaccuauauuuauguaacuguauacugaauucugacaaaauaaaaaaagauaccuuauugacga

SEQ ID NO: 47897 - RNA, 64 nt, hsa
uacuuauuugucuucuuuuugcauugugaaaaaaacaaaauaaauuuugugugauaauuuugau

SEQ ID NO: 47898 - RNA, 64 nt, hsa
aaauauuuuuauaaaaaccagaaaacacuguauuacaaaauauuauuuauuaaauguaguucag

SEQ ID NO: 47899 - RNA, 64 nt, hsa
cuaugagcccauaaggguucugugcuuagcauuaacaaaauaagguuuauagguaaagccaaug

SEQ ID NO: 47900 - RNA, 64 nt, hsa
cuuugagugguauuucucuugauugagcagcuagacaaaauaaucugcaaauuuaaauguggcg

SEQ ID NO: 47901 - RNA, 64 nt, hsa
aguguggauuuugcauacauucaaaacauuaaccacaaaauacagcaagugcaccuauauucac

SEQ ID NO: 47902 - RNA, 64 nt, hsa
uuuaaaauauguguauaagucugucaugugcuaaacaaaauaauaugaaagaccuaguuaaaaa

SEQ ID NO: 47903 - RNA, 64 nt, hsa
uggguuuuaaaaauccuuuuuuacagugguauccacaaaauacuucucugcuuauaaauguuau

SEQ ID NO: 47904 - RNA, 64 nt, hsa
ugcuguugcgcugcuuuauuuaaugcacuguggaacaaaauauaaggguacuguugggguguga

SEQ ID NO: 47905 - RNA, 64 nt, hsa
ggcaacauggggaaacuccaucucuacaaaauauacaaaauauuagccagccaucguggugcgu

SEQ ID NO: 47906 - RNA, 64 nt, hsa
accagccugggcaacauggggaaacuccaucucuacaaaauauacaaaauauuagccagccauc

SEQ ID NO: 47907 - RNA, 64 nt, hsa
ugugauagaagauuauucagaacaaaauaaguagacaaaauaacaaaagacaggaaaauaaguc

SEQ ID NO: 47908 - RNA, 64 nt, hsa
auagaaggggaaaugugauagaagauuauucagaacaaaauaaguagacaaaauaacaaaagac

SEQ ID NO: 47909 - RNA, 64 nt, hsa
cuagauguauaaaucuuucuuuugauucuuccuaacaaaauauuuucuggguuaaaaccccagc

SEQ ID NO: 47910 - RNA, 64 nt, hsa
ugaaaguuuucuauaccugucuccuuucucagccacaaaauaaauguugggagaaaugauauau

SEQ ID NO: 47911 - RNA, 64 nt, hsa
uucuuguuuuauuaacucuguucauuuuuauucuacaaaauaugucaugcauucuuucuuauga

SEQ ID NO: 47912 - RNA, 64 nt, hsa
uuugcacuccagaaaacaacauacauguuuaaauacaaaauaauuaugggccaugacgacgauu

SEQ ID NO: 47913 - RNA, 64 nt, hsa
gguaccgucuacauuucacauuauucugggcaccacaaaauauacaaaacuuuaucagggaaac

SEQ ID NO: 47914 - RNA, 64 nt, hsa
uuuaguaaguuaauguauauaaaaauggcuucggacaaaauaucucugaguucuguguauuuuc

SEQ ID NO: 47915 - RNA, 64 nt, hsa
acuagucauuuuaguguuauaaauggcauuuuguacaaaauagucuauucaguucguucauuca

SEQ ID NO: 47916 - RNA, 64 nt, hsa
aaagcucuagguucuucagcacauuucccccaaaacaaaauaaaauugagggcauguugcauau

SEQ ID NO: 47917 - RNA, 64 nt, hsa
gaguuaugggcaaagcuuuuuuccuuaagcaucaacaaaauaggauaaaagguuccaauaggaa

SEQ ID NO: 47918 - RNA, 64 nt, hsa
gucucaagccucuauucaccccuucucaauccucacaaaauaggggguuguucaauauugucuu

SEQ ID NO: 47919 - RNA, 64 nt, hsa
cagcuuuagcuguucuuuaucuugugcacaugauacaaaauauguucccguacaauauggggcu

SEQ ID NO: 47920 - RNA, 64 nt, hsa
aacaacuuugcaggaauaaagcaacccccuaaccacaaaauaucccucuaaauuaguucccuag

SEQ ID NO: 47921 - RNA, 64 nt, hsa
guucacuacuguguaaaguaaaaacuaaaaaaauacaaaauacaaaacacacacacacacacac

SEQ ID NO: 47922 - RNA, 64 nt, hsa
acacacacacacacacacacacacacacacacacacaaaauaaauccgggugugccugaaccuc

SEQ ID NO: 47923 - RNA, 64 nt, hsa
uaaugaaaauaucuuccucucuuccccauucuauacaaaauacuaagugguuuucuugcuccca

SEQ ID NO: 47924 - RNA, 64 nt, hsa
ucuagauaugcaaaugauuuucuuagaaaacuucacaaaauaaaagaucuuguuuuuuuuucca

SEQ ID NO: 47925 - RNA, 64 nt, hsa
ucacuaauaaauucugaguaaauuaguggugaagacaaaauauaacuuguuuuagugagccacu

SEQ ID NO: 47926 - RNA, 64 nt, hsa
cucucaagcuauaguuuguuuucaaaaaggaaaaacaaaauaguuuuuuacuggauuaaaaaug

SEQ ID NO: 47927 - RNA, 64 nt, hsa
aguuguguaauggugaugcuaaagaaaugucuguacaaaauaagauggccugggcagaguuggu

SEQ ID NO: 47928 - RNA, 64 nt, hsa
uaaaaauguuucuacagauauuaauguuaacaagacaaaauaaaugucacgcaacuuauuuuuu

SEQ ID NO: 47929 - RNA, 64 nt, hsa
cucaccaaaagauccagccucauaccuacaucagacaaaauaucgccguuguuccuucuguacu

SEQ ID NO: 47930 - RNA, 64 nt, hsa
aauuuuuuuuucuuuuuaauauuuucuucuggucacaaaauaaagaaauuugggaugcaaagua

SEQ ID NO: 47931 - RNA, 63 nt, hsa
cauuucucauuguuggaaucugaauaaaccaauuacaaaauaacauaugugcacauuguaagu

SEQ ID NO: 47932 - RNA, 64 nt, hsa
gcauuuuugagaaagcaaaucguauaccuuauuaacaaaauagaauauauauauauugcuuauc

SEQ ID NO: 47933 - RNA, 64 nt, hsa
ucuugggcccaagugauacucccaccucugccuuacaaaauacagggauuacuggugugagcca

SEQ ID NO: 47934 - RNA, 64 nt, hsa
caaagaagacaaaauagcauugaaacuaacccauacaaaauauccaacucuggauucugugaau

SEQ ID NO: 47935 - RNA, 64 nt, hsa
ggugaguccuauugcaauaugaccgacaaagaagacaaaauagcauugaaacuaacccauacaa

SEQ ID NO: 47936 - RNA, 64 nt, hsa
uggcccaaagaauaggaacuuagcuagcauguauacaaaauauauuugagguuacuaaaugaau

SEQ ID NO: 47937 - RNA, 64 nt, hsa
aaauguugcuuguuauuugguagagauuaggcucacaaaauauuucuccauuuccagugauuug

SEQ ID NO: 47938 - RNA, 64 nt, hsa
uuaauauagcccaauaaaccuagaguauacauguacaaaauacauauaauuguuaacguguauu

SEQ ID NO: 47939 - RNA, 64 nt, hsa
uaaaaguuuaguuaguauuaaauuuuucacuaauacaaaauaaaaaaauauuguuuuaugaguu

SEQ ID NO: 47940 - RNA, 64 nt, hsa
cauacaguguuuuacauucucuccuuuauagguaacaaaauaauguuuagcucaguaaguacug

SEQ ID NO: 47941 - RNA, 64 nt, hsa
acaugcuuaaugauggaaaugaaauguuaaaucaacaaaauaagauccaguguuucauaacauu

SEQ ID NO: 47942 - RNA, 64 nt, hsa
ugguaaagaauacugagacaaugaaaaaaaaucaacaaaauaugcuuucuggagaacuguaccu

SEQ ID NO: 47943 - RNA, 64 nt, hsa
uucuaauuaaagaauuccuaaauacuuugaaaauacaaaauauuccugaauaguugugccuuac

SEQ ID NO: 47944 - RNA, 64 nt, hsa
acaguuuuuacccuaaagugcaaaagugaaacauacaaaauaagacuaauuuuuaagaguaacu

SEQ ID NO: 47945 - RNA, 64 nt, hsa
aaugaugaauuuaucagcguauuucaggguccaaacaaaauagagcuaagauacugaugacagu

SEQ ID NO: 47946 - RNA, 64 nt, hsa
uuuauuuacaugcugucuguuaucuucaagcagcacaaaauaugcauauaaaagugauggaauu

SEQ ID NO: 47947 - RNA, 64 nt, hsa
aaaaccuguaugccgauuuuccucaagccaucucacaaaauaagaauuucaaauguaaauauug

SEQ ID NO: 47948 - RNA, 64 nt, hsa
cuaaggcuuuuaauacauuuugaauggcaccaaaacaaaauaagucaaaauggacagucauuuu

SEQ ID NO: 47949 - RNA, 64 nt, hsa
aauuaaaacugauuuauuuauguugguacauccaacaaaauaguuggagccacaaggcccuugu

SEQ ID NO: 47950 - RNA, 64 nt, hsa
guuggagccacaaggcccuugucuuuuuaaaaaaacaaaauauuuugaagauggugaaagugac

SEQ ID NO: 47951 - RNA, 64 nt, hsa
acacaaagagaccacccugucugauagauaacuaacaaaauaguuuuaguugggcaaaauuaaa

SEQ ID NO: 47952 - RNA, 64 nt, hsa
aaauuuuuaaaaagacuguuuuuaaaaaggugcuacaaaauaaagugcuaucuuuuucuguuuc

SEQ ID NO: 47953 - RNA, 64 nt, hsa
auauuaacaucuugaugagacagauuuccaggcaacaaaauaauuucuaaaauggauauaugug

SEQ ID NO: 47954 - RNA, 64 nt, hsa
ucaugguggcuguugcaugauaaugauaggauaaacaaaauaccacugucuucaagaaacauua

SEQ ID NO: 47955 - RNA, 64 nt, hsa
auuauuucaugcuuuuuuuuaaaaaaaaaaaaaaacaaaauaacaaucugaagaggcauuuggu

SEQ ID NO: 47956 - RNA, 64 nt, hsa
uuugcgaggcuuaggcagcuagacaucguuuaaaacaaaauauuaacuuauauuacauguguau

SEQ ID NO: 47957 - RNA, 64 nt, hsa
cuucuaauacauauuaaaagacauaacuaucaaaacaaaauaaauuugucuguuuucaaccaaa

SEQ ID NO: 47958 - RNA, 64 nt, hsa
auggacauuaagacuguuuuuagguuuugcuauuacaaaauacuacacaggagcaucacuaugc

SEQ ID NO: 47959 - RNA, 64 nt, hsa
auguuguuuuguacagaugugggccaccauugcaacaaaauacauucuuuuugcucuaaaauau

SEQ ID NO: 47960 - RNA, 64 nt, hsa
acuuguuuuuguaaagaaaaauauuuaauguugaacaaaauaaauuggaguuggaguagaaugu

SEQ ID NO: 47961 - RNA, 64 nt, hsa
gaguaugcuuuauugaguaaagguuauaguuugacuuuaagauaagaaauuuucuagaaucaug

SEQ ID NO: 47962 - RNA, 64 nt, hsa
cccaucacuguucuuuaaagcaugcaucacagaccuuuaagaguaugcuuuauugaguaaaggu

SEQ ID NO: 47963 - RNA, 64 nt, hsa
aaagccugugguauuuuauauaauauuuuuauaacuuuaagagacuguaguaauugaccuaaaa

SEQ ID NO: 47964 - RNA, 64 nt, hsa
uagucaacaguauuuggcuaucaauaaagaaucucuuuaagaucucacccggcuggcauucugu

SEQ ID NO: 47965 - RNA, 64 nt, hsa
auuauuucugaaauauccaucuuuuucuuauggacuuuaagaccuuuauauuuuuaaagauauu

SEQ ID NO: 47966 - RNA, 64 nt, hsa
ucugugguguucuaaggaauuaaaugcacuggagcuuuaagagcucaacguguuucccuuugau

SEQ ID NO: 47967 - RNA, 64 nt, hsa
uauuuucccuguuugcuuugcuacuguauguugacuuuaagaucuuuuuuuaaauacauuugau

SEQ ID NO: 47968 - RNA, 64 nt, hsa
acaaaaaagauuugacuuccgaauagaauguuuucuuuaagaggcaugaaaagcaacuauuguu

SEQ ID NO: 47969 - RNA, 64 nt, hsa
uuugcauuaaguuauggaagaguuguaauauauacuuuaagaaagaagagaagaaaacuaguau

SEQ ID NO: 47970 - RNA, 64 nt, hsa
auauuauucucgcauguaaacaaagauaucuuugcuuuaagaugugagaagaaaugaauuuacu

SEQ ID NO: 47971 - RNA, 64 nt, hsa
auacauaauaaacccuuucaucuuuuuuuuuuuccuuuaagaauuaaaacugggaaauagaaac

SEQ ID NO: 47972 - RNA, 64 nt, hsa
ugcuaccauuauauuuugggguuauguuuugcuucuuuaagauagaaaucccaguucucuaauu

SEQ ID NO: 47973 - RNA, 64 nt, hsa
ugggguucacucuuaccaagaaucuuugaugcagcuuuaagaugguggggaggauggggugaau

SEQ ID NO: 47974 - RNA, 64 nt, hsa
aagagcaugaagcauaucugggaauaucuuuugccuuuaagacgauucauucuugucuagaggg

SEQ ID NO: 47975 - RNA, 53 nt, hsa
gccacagcacaaaguuuuaaugucuuuaagaaaaagaaaucaaucugcagaaa

SEQ ID NO: 47976 - RNA, 64 nt, hsa
uuaagacucucugguucuguccuugcuuuggagacuuuaagacauuuccuaaagcacaaauaaa

SEQ ID NO: 47977 - RNA, 64 nt, hsa
acaugguaagguggagaguaaaugcuugauaaaucuuuaagauaugucuugaaugauaauuagg

SEQ ID NO: 47978 - RNA, 64 nt, hsa
gacaguaaacacacauguaugacccuuacaagugcuuuaagauuuuaaaaaugugauguuuugu

SEQ ID NO: 47979 - RNA, 64 nt, hsa
ggaauauccucauauuuuuaccauauuuuaagaacuuuaagacgauuaauuguaaauaauuuau

SEQ ID NO: 47980 - RNA, 64 nt, hsa
auucugaguuuuuucaaggaauguaauacuggagcuuuaagaacauacuuaguuucucauguga

SEQ ID NO: 47981 - RNA, 64 nt, hsa
acuauuuucaaagcagaaaaauugacauugcugccuuuaagaauaccaugaauguaagaaauug

SEQ ID NO: 47982 - RNA, 64 nt, hsa
augauuugagcaagcucauuuccagaaaaguuuacuuuaagaucaucaauaggauuugcuaauu

SEQ ID NO: 47983 - RNA, 64 nt, hsa
ugacugccuaacuucagagcagggcuucugaucccuuuaagaaauuacagggccagccgggcau

SEQ ID NO: 47984 - RNA, 64 nt, hsa
cacucuccucuagcuauccuugaugagcuucucacuuuaagaauaaauguguuugauauaaggc

SEQ ID NO: 47985 - RNA, 64 nt, hsa
uucuacguauccuuguggagaaaagcuaaauaaccuuuaagaaugugggugguauuggagaaag

SEQ ID NO: 47986 - RNA, 64 nt, hsa
aaauuaugaacauuuuuuucauaaaaauuaaaugcuuuaagaaauggagaaggaaaaauagcuu

SEQ ID NO: 47987 - RNA, 64 nt, hsa
cgagcgugacauuaugcauuacuccacauccacccuuuaagaauugauuuauuacaaaauuaug

SEQ ID NO: 47988 - RNA, 64 nt, hsa
agggaagaaaacaccaaauaagaaaaaaauuugccuuuaagaguuacuuuuguugaauguauuu

SEQ ID NO: 47989 - RNA, 64 nt, hsa
gcgggcagaaccauuucaguuagcaugugccucacuuuaagaaaguccuguaggggaaaaaaaa

SEQ ID NO: 47990 - RNA, 64 nt, hsa
uguguguguguguauguuugcauauuauagcucucuuuaagacagacaucuaaaaagauuuugg

SEQ ID NO: 47991 - RNA, 64 nt, hsa
auacaacucucauuuaauauucaugcuuuugugccuuuaagaaaauauuuuuugucauuuuuug

SEQ ID NO: 47992 - RNA, 64 nt, hsa
cuuaguaacuucuuucuguggcaaaaccacaauucuuuaagauuccuauuguucaggcuaaggc

SEQ ID NO: 47993 - RNA, 64 nt, hsa
uuaagggaguggccucauuucacuagagacaaaucuuuaagaauaguucuaaaauugggcuugu

SEQ ID NO: 47994 - RNA, 64 nt, hsa
uuuuuuuuuuuuuacauguuuccaucauuucugucuuuaagaacuaauucguacauaauaaguu

SEQ ID NO: 47995 - RNA, 64 nt, hsa
cuauuuuauuuuuauuuuuuguaaagccaaguagcuuuaagauaaagugguggucuuuuggaug

SEQ ID NO: 47996 - RNA, 64 nt, hsa
guacuuuuuauuauuauuuuuucuguuugaauuccuuuaagagauuuuguuggguauccauccc

SEQ ID NO: 47997 - RNA, 64 nt, hsa
gucccuuuguccuuccccgugccucccaaaguuacuuuaagauccuuagaauauuucuuuaaau

SEQ ID NO: 47998 - RNA, 64 nt, hsa
auauauugcuuauuuuaaguuccaaaggugaagucuuuaagaauaaaacauuaccaacuccugc

SEQ ID NO: 47999 - RNA, 64 nt, hsa
auucacacuuaggcaagcauacacaggcacauggcuuuaagaaccacacugaugccuugauaau

SEQ ID NO: 48000 - RNA, 64 nt, hsa
cacugaaaacuuagguccuguaucauacuuuuuucuuuaagacuuuuuaagaaauauuacuuaa

SEQ ID NO: 48001 - RNA, 64 nt, hsa
cagguaacaugagaagggcugaucaggagaugcucuuuaagaaguucgcaccccugcugacacc

SEQ ID NO: 48002 - RNA, 64 nt, hsa
ggaucuggguucaucucacccacagagggaggaucuuuaagaggagaaaaaagccaagagggaa

SEQ ID NO: 48003 - RNA, 64 nt, hsa
aaaaaccccacaagugugaaaaacauggcaaagccuuuaagaagcccucaauucuuaacagaca

SEQ ID NO: 48004 - RNA, 64 nt, hsa
aacuaaaguugguagaaaaguuauuuguauagaacuuuaagaggaucagaagguuuuuugcaga

SEQ ID NO: 48005 - RNA, 64 nt, hsa
auauauuuuccaguugaaaacaaacuaagaaguccuuuaagaauuuauaauccguuccccauua

SEQ ID NO: 48006 - RNA, 64 nt, hsa
gcugagccuuacaaaccccugaaggaaagugacccuuuaagagaggaucaucuuuuuuuauauu

SEQ ID NO: 48007 - RNA, 64 nt, hsa
cucagcggaaaacuguacuuuaaucccaaacccccuuuaagacauauuggggcugggcgcagug

SEQ ID NO: 48008 - RNA, 64 nt, hsa
guuuuccucaacaggacacuugaucccaaaaccccuuuaagaccuuagguuuccucagcggaaa

SEQ ID NO: 48009 - RNA, 64 nt, hsa
cauucucucuuugagugauucauacauucuguuucuuuaagaagaugcagucauggucuuucag

SEQ ID NO: 48010 - RNA, 64 nt, hsa
agagugagugguccuuuggucaaugaaaacuuggcuuuaagacuuuuugacuccuuuccaacac

SEQ ID NO: 48011 - RNA, 51 nt, hsa
aaaagcaacggaaaaaauagaaauacuuaaaguguggcaauacucuuucac

SEQ ID NO: 48012 - RNA, 64 nt, hsa
ugccaaucuuugcucauauuaaaaacaacuuacaaauacuuaguuuuuguaucuaaucucugau

SEQ ID NO: 48013 - RNA, 64 nt, hsa
acugaugcgagaugauuuuguuuuuugcauaaucaauacuuaagggugcaaucaacuguuagua

SEQ ID NO: 48014 - RNA, 64 nt, hsa
cagaugccaaauacuguaaccuucucaugauaacaauacuuagguucaagaucacuguucaaac

SEQ ID NO: 48015 - RNA, 64 nt, hsa
cagacaugaugaaaaaaaaaaacuuuuacaaaugaauacuuaccuuagaaauauucaccuuagg

SEQ ID NO: 48016 - RNA, 64 nt, hsa
ccagcauucucaacuauaucaaguuacuguucagaauacuuaauaucuccucucuucauaauua

SEQ ID NO: 48017 - RNA, 64 nt, hsa
ccaugcugaugaaaugaccuaugcccaaagaacaaauacuuaacgugggaguggaaccacauga

SEQ ID NO: 48018 - RNA, 64 nt, hsa
ggcuugcuuugauguauguuuggaaagaugugugaauacuuaauuuuuauccauuuuauggaaa

SEQ ID NO: 48019 - RNA, 64 nt, hsa
ugagccuggaaaaauacaagccagugcaugcauuaauacuuaguuagaccgcagagagcuggca

SEQ ID NO: 48020 - RNA, 64 nt, hsa
ccuguuguuacuuuauauuucauaaucaggcaaaaauacuuacaguuaauaauauagauauaau

SEQ ID NO: 48021 - RNA, 64 nt, hsa
ugguucuaaguacuuuacuuguauuaucccauuuaauacuuagaacaaccccgugagauaagua

SEQ ID NO: 48022 - RNA, 64 nt, hsa
ugcaauaaucacauugccuuuguguuaauagucaaauacuuaccuuuggagaauacuuaccuuu

SEQ ID NO: 48023 - RNA, 64 nt, hsa
cuuuguguuaauagucaaauacuuaccuuuggagaauacuuaccuuuggaggaauguauaaaau

SEQ ID NO: 48024 - RNA, 64 nt, hsa
gauuguuacaaaccaagccuaagacacaucugugaauacuuagauuuguagcuuaaucacauuc

SEQ ID NO: 48025 - RNA, 64 nt, hsa
acugcuaccacuaacagguuguaaauagaagacuaauacuuaauuaaagucaccuuccuaccau

SEQ ID NO: 48026 - RNA, 64 nt, hsa
ccucuuccauugcaaauuaaaguccaaauagagaaauacuuagguuuuagaacacaucagaggu

SEQ ID NO: 48027 - RNA, 64 nt, hsa
cucuuaauuuauuuagaguauuucucuauugcugaauacuuaaguaguuuuaaauuuuauuaug

SEQ ID NO: 48028 - RNA, 64 nt, hsa
cuuucauuccaguggccuuagucaucucugaagaaauacuuacuugauuuuuuuuuuuccaauc

SEQ ID NO: 48029 - RNA, 64 nt, hsa
uaaagucuuguauagcaauaugcuuggagaggagaauacuuaucucuggcgcacaucacuauau

SEQ ID NO: 48030 - RNA, 64 nt, hsa
uugcuuauuuuuaaauuaacuguuuugagcuuugaauacuuaaggcuuuagagggagaacccaa

SEQ ID NO: 48031 - RNA, 64 nt, hsa
uuguucaccuauuuugugcuuuaaaucucaauaaaauacuuacugagggaaaggcuuguuuuga

SEQ ID NO: 48032 - RNA, 64 nt, hsa
cccccaccccuccccugcgucuccuuguaaaguuccaugagaugcucgaggagcaccugcuggu

SEQ ID NO: 48033 - RNA, 64 nt, hsa
gacagcuauaucaugcuugggucguucaugaauuccaugagaauuguugggaaguucaugaguu

SEQ ID NO: 48034 - RNA, 64 nt, hsa
cucaagcuauccaauuuucugacuuugaaaauaaccaugagagaugccacauuucucucuggga

SEQ ID NO: 48035 - RNA, 64 nt, hsa
uuacuauacuauuucuucaaggcaaguaaauugaccaugagaaaagaacacaguuauuaaacac

SEQ ID NO: 48036 - RNA, 64 nt, hsa
guggcauugccauugcccaggaggggcccagucaccaugagagcucccuugccuuaccuggagg

SEQ ID NO: 48037 - RNA, 64 nt, hsa
uuuucacaauagcucugugauguaagugcuaucuccaugagaaaauucauaaaggguguuuugu

SEQ ID NO: 48038 - RNA, 64 nt, hsa
gcugagauucccauuucucuuaaggagaagccacccaugagaugucuuuuccuucuccaucauc

SEQ ID NO: 48039 - RNA, 64 nt, hsa
acagccuguugucuaaagccaaggagucauaaaaccaugagaaauaaauaggaaucaauaguua

SEQ ID NO: 48040 - RNA, 64 nt, hsa
aaggauaaggaggagggguggcuuuuauggacuuccaugagagaaggaaagaaauauuucaggu

SEQ ID NO: 48041 - RNA, 64 nt, hsa
aaggaaggagguucagugaggaaaauaagguuguccaugagauuugaauagauuuuuaguuccc

SEQ ID NO: 48042 - RNA, 64 nt, hsa
augagaggcuguaccccucacccacauccuacauccaugagaauuaccugcagcucuucgaguu

SEQ ID NO: 48043 - RNA, 64 nt, hsa
ccaggugacauuggccccuagacccucucuauagccaugagacuccuuguggccucaagaaauu

SEQ ID NO: 48044 - RNA, 64 nt, hsa
uuuauauauaagccaaaaaaugcuugcuucaaccccaugagacucgauagugguggugaacaga

SEQ ID NO: 48045 - RNA, 64 nt, hsa
uccuucuuccccccgcugucagccauuccuguucccaugagaugaugccaugggcccucucagc

SEQ ID NO: 48046 - RNA, 64 nt, hsa
agugccuugauauuggacuucccagccucccaaaccaugagaaauaaauguuuguugauuaauu

SEQ ID NO: 48047 - RNA, 64 nt, hsa
auaggaaucccuagagagcuagcuuugcccuucaccaugagagggugcagugagaagauagcua

SEQ ID NO: 48048 - RNA, 64 nt, hsa
ggaugaguaaaaacaagaaaauuuggggagggggagaaagaagaaagggauugcugucucccuu

SEQ ID NO: 48049 - RNA, 64 nt, hsa
uagauuuucuuuuaaauugguucuuuguuucugaagaaagaauuuuuuuuaacuucaugguuuu

SEQ ID NO: 48050 - RNA, 64 nt, hsa
ugguagaucaaggcuuuguuucauuugaaaaaaaagaaagaaagaaagaaagaaagaaauccua

SEQ ID NO: 48051 - RNA, 64 nt, hsa
agaucaaggcuuuguuucauuugaaaaaaaagaaagaaagaaagaaagaaagaaauccuacuac

SEQ ID NO: 48052 - RNA, 64 nt, hsa
caaggcuuuguuucauuugaaaaaaaagaaagaaagaaagaaagaaagaaauccuacuacgagc

SEQ ID NO: 48053 - RNA, 64 nt, hsa
gcuuuguuucauuugaaaaaaaagaaagaaagaaagaaagaaagaaauccuacuacgagcgauc

SEQ ID NO: 48054 - RNA, 64 nt, hsa
uguuucauuugaaaaaaaagaaagaaagaaagaaagaaagaaauccuacuacgagcgaucacac

SEQ ID NO: 48055 - RNA, 64 nt, hsa
ccuggguaacagagcaagacuccaucucaaaaaaagaaagaaagaaaaaagaaaguacaaguuu

SEQ ID NO: 48056 - RNA, 64 nt, hsa
gguaacagagcaagacuccaucucaaaaaaagaaagaaagaaaaaagaaaguacaaguuuauaa

SEQ ID NO: 48057 - RNA, 64 nt, hsa
ggcuccauauuucaacuaaaaauauaucuguuggagaaagaaauuaacaauaaagaauuuucau

SEQ ID NO: 48058 - RNA, 64 nt, hsa
gucugggacauuagucguuauauuugacuugaaaagaaagaaaccaagugcgcuuugcaauauu

SEQ ID NO: 48059 - RNA, 64 nt, hsa
cuuaauugcuuuccugccuccuugaaagaaagaaagaaagaagacuguguuuuugccacugauu

SEQ ID NO: 48060 - RNA, 64 nt, hsa
accacuuaauugcuuuccugccuccuugaaagaaagaaagaaagaagacuguguuuuugccacu

SEQ ID NO: 48061 - RNA, 64 nt, hsa
ggugaccacuuaauugcuuuccugccuccuugaaagaaagaaagaaagaagacuguguuuuugc

SEQ ID NO: 48062 - RNA, 64 nt, hsa
uaggauaugacauauaugaaagguuuaucuaagaagaaagaaacagagauaauauauauauaga

SEQ ID NO: 48063 - RNA, 64 nt, hsa
acugaugggggaagauaccuggggugagaagaugagaaagaaaugaugcugagggaccuaguga

SEQ ID NO: 48064 - RNA, 64 nt, hsa
aaaaacugcaaaucagaaagaaugauuugcagaaagaaagaaaaacuaugguguaauuuaaacu

SEQ ID NO: 48065 - RNA, 64 nt, hsa
uggaaaaaacugcaaaucagaaagaaugauuugcagaaagaaagaaaaacuaugguguaauuua

SEQ ID NO: 48066 - RNA, 64 nt, hsa
cuaauauggcucuguuuggaaaaaacugcaaaucagaaagaaugauuugcagaaagaaagaaaa

SEQ ID NO: 48067 - RNA, 64 nt, hsa
cacacaucggaagggcuggaugaccccaaucaaaagaaagaacaaggacucugguuacccuugc

SEQ ID NO: 48068 - RNA, 64 nt, hsa
cuuaaagacaggagcuggcauuuaugacagacaaagaaagaagcccagguguccugguguucuc

SEQ ID NO: 48069 - RNA, 64 nt, hsa
caacaaaaguuuuaccacagucugcacuugcagaagaaagaaaaaaauucaaaccacauguuua

SEQ ID NO: 48070 - RNA, 64 nt, hsa
gaauauauucaugacauuuguaauaaaugucuugagaaagaauuuguuucauggcuucaugguc

SEQ ID NO: 48071 - RNA, 64 nt, hsa
aaguagcuggcgagguuaccuuaacuaucacugaagaaagaaauuuucugacacacugauggca

SEQ ID NO: 48072 - RNA, 64 nt, hsa
acauagauaguacuagguauuaauagauauguaaagaaagaaaucacaccauuaauaaugguaa

SEQ ID NO: 48073 - RNA, 64 nt, hsa
gagaauuguugugcuuugacaguuaacucuagaaagaaagaacacuaccacugcaacauuaaug

SEQ ID NO: 48074 - RNA, 64 nt, hsa
uacugagaauuguugugcuuugacaguuaacucuagaaagaaagaacacuaccacugcaacauu

SEQ ID NO: 48075 - RNA, 64 nt, hsa
uuccagcaucuuaccuucauaugcaguaaaagaaagaaagaaaaaaaaaggaaaaaaaaaaaaa

SEQ ID NO: 48076 - RNA, 64 nt, hsa
uacauuccagcaucuuaccuucauaugcaguaaaagaaagaaagaaaaaaaaaggaaaaaaaaa

SEQ ID NO: 48077 - RNA, 64 nt, hsa
uugcauuuaaaugugacauucuuaaaaaaagaagagaaagaauuuuaagaguagcaguauauau

SEQ ID NO: 48078 - RNA, 64 nt, hsa
ugauuucuugagcauguauuggucagaaagaaaaagaaagaaaaccauucucuauuuuuccaug

SEQ ID NO: 48079 - RNA, 64 nt, hsa
cucagauauuugauuucuugagcauguauuggucagaaagaaaaagaaagaaaaccauucucua

SEQ ID NO: 48080 - RNA, 64 nt, hsa
aaaccccaagacguuugaggccaguaggaaguugagaaagaaagccacaaggauucagcaauuu

SEQ ID NO: 48081 - RNA, 64 nt, hsa
acaguuuguuauuaaguaauaucugaaaugaauuagaaagaaaccauaagccuuaacaauacuc

SEQ ID NO: 48082 - RNA, 64 nt, hsa
auaucuaggagucucuugaugagcauuggucgacagaaagaagucucuucuaaaaauuguuaau

SEQ ID NO: 48083 - RNA, 64 nt, hsa
cacugugguauaguguccaaacugacugucauugagaaagaaagaaaguaguuugcgauugcag

SEQ ID NO: 48084 - RNA, 64 nt, hsa
gugguauaguguccaaacugacugucauugagaaagaaagaaaguaguuugcgauugcaguaga

SEQ ID NO: 48085 - RNA, 64 nt, hsa
gccuacuugaggugggcaucugggaauacaggguagaaagaaauuccugcuuuucagauaaagc

SEQ ID NO: 48086 - RNA, 64 nt, hsa
uuggucuuuaggagaaagcauuaguaaugaaagaagaaagaauuuucacuugguuggacauugg

SEQ ID NO: 48087 - RNA, 64 nt, hsa
gauagguuugcgaauauaccauuuuauauuguugagaaagaacaaaaagggaauuuccagaugu

SEQ ID NO: 48088 - RNA, 64 nt, hsa
uagaacuguaaugggguuguauuuaugggcgccuagaaagaaaacacaaggacuugguaggcca

SEQ ID NO: 48089 - RNA, 64 nt, hsa
aaagaauguaaagcaaccaaaaagaaaaaaaaaaagaaagaaagaggaaaagaaauccauacua

SEQ ID NO: 48090 - RNA, 64 nt, hsa
gguguaguauuaauagguuaaaaccaggcuuucuagaaagaauaaacuuacauauuuauuuuua

SEQ ID NO: 48091 - RNA, 64 nt, hsa
guuuauuucagcaaacuuguugaauuuauuuuuaagaaagaaauacuguauugggaaguuacug

SEQ ID NO: 48092 - RNA, 64 nt, hsa
aagaccgagacuccgccucaaaaaaaaaaaaaaaagaaagaaagaaagaaagaaagaaaucuac

SEQ ID NO: 48093 - RNA, 64 nt, hsa
ccgagacuccgccucaaaaaaaaaaaaaaaagaaagaaagaaagaaagaaagaaaucuaccugu

SEQ ID NO: 48094 - RNA, 64 nt, hsa
gacuccgccucaaaaaaaaaaaaaaaagaaagaaagaaagaaagaaagaaaucuaccugucaag

SEQ ID NO: 48095 - RNA, 64 nt, hsa
ccgccucaaaaaaaaaaaaaaaagaaagaaagaaagaaagaaagaaaucuaccugucaaggaac

SEQ ID NO: 48096 - RNA, 64 nt, hsa
cucaaaaaaaaaaaaaaaagaaagaaagaaagaaagaaagaaaucuaccugucaaggaacuaag

SEQ ID NO: 48097 - RNA, 64 nt, hsa
aucuauuacucuugagagcuggcuguccuuugaaagaaagaaguaauguucuuugaaagaaaga

SEQ ID NO: 48098 - RNA, 64 nt, hsa
uguccuuugaaagaaagaaguaauguucuuugaaagaaagaaaaaucucuugcugugucaaacc

SEQ ID NO: 48099 - RNA, 64 nt, hsa
ucucaauaauugauaauaacaguccaaagaaagcagaaagaaggaaagccuagaacagaaauaa

SEQ ID NO: 48100 - RNA, 64 nt, hsa
uuuuauuaccaaacuuauagaaauaaaaauuauuagaaagaaauacuaugaacaauugaaugcc

SEQ ID NO: 48101 - RNA, 64 nt, hsa
gaucuaaauauaagagcugaaacuauaaaaucuuagaaagaaacauaggcauagaucuuuguaa

SEQ ID NO: 48102 - RNA, 64 nt, hsa
aacgaaguuaaauaauuccauuuauaauaccaucagaaagaauaaaauaggaaucaacuuaaca

SEQ ID NO: 48103 - RNA, 64 nt, hsa
ugugcagccaaaucugagaggccccauuuaaaaaagaaagaacaugggugguacauugaggagu

SEQ ID NO: 48104 - RNA, 64 nt, hsa
uccacccuuuaaaucuuaggaugacaaguuauaaagaaagaagaucuuugucugggacccccaa

SEQ ID NO: 48105 - RNA, 64 nt, hsa
gaacagauaagugauggaaaucagaagggaauauagaaagaacucuggauguggagaaaugccg

SEQ ID NO: 48106 - RNA, 64 nt, hsa
guuaccugacaugccguagggugagcuuagaggaagaaagaaaacaauuuuuauuuggccaaaa

SEQ ID NO: 48107 - RNA, 64 nt, hsa
aagagggcggcugcugggacuagauaguggaugaagaaagaaggacgaggaagccguggggcag

SEQ ID NO: 48108 - RNA, 64 nt, hsa
guaacuguugccaggacacauggccauaaauaauagaaagaaagcuacaaccacaggcuguuug

SEQ ID NO: 48109 - RNA, 64 nt, hsa
gugagagcacaaagauaacgcaggagagagagagagaaagaaugagaaagaaaaggaaugcaag

SEQ ID NO: 48110 - RNA, 64 nt, hsa
aaagauaacgcaggagagagagagagaaagaaugagaaagaaaaggaaugcaagagaaggagau

SEQ ID NO: 48111 - RNA, 64 nt, hsa
uuuuaguaucgaugccacucaucugcagcagaagagaaagaaguccucuuggggcuuuuuaguu

SEQ ID NO: 48112 - RNA, 64 nt, hsa
aaugagugcuguagcuuuagaaguggcccucuauagaaagaagucaaaagaugaggccccuucu

SEQ ID NO: 48113 - RNA, 64 nt, hsa
ucacggugggcggugggcaagaagccagcauggaagaaagaagggagaaaacuuuggugacugc

SEQ ID NO: 48114 - RNA, 64 nt, hsa
acuaaguggaaaaauauaaaacauaugaauauaaagaaagaaagagacaagucaaauguaguaa

SEQ ID NO: 48115 - RNA, 64 nt, hsa
aaaauguucuaagauaaaaaaacucgagcuacaaagaaagaaugaacuaauucuuuacaaaugu

SEQ ID NO: 48116 - RNA, 64 nt, hsa
auguaguccaaauuugucauuaaaaaaaaaucaaagaaagaaggccacguauguugggguaauu

SEQ ID NO: 48117 - RNA, 64 nt, hsa
ugcaaagaucuauugcuagcuaauauaugaguuaagaaagaaaauuagaaaaucuguucauuga

SEQ ID NO: 48118 - RNA, 64 nt, hsa
gccaacuugcuaucuggugggugacuuggggacuagaaagaauaaagccuuuucuaaauuuguu

SEQ ID NO: 48119 - RNA, 64 nt, hsa
uggagccuucgcucuguagaacuuggaaaaauccagaaagaaaaaauaauugauuucaagaccu

SEQ ID NO: 48120 - RNA, 64 nt, hsa
agugagagggcaugcgcacaaggcugaccaagagagaaagaaguaggcaugagggaucacaggg

SEQ ID NO: 48121 - RNA, 64 nt, hsa
caagguuuuaaagcauugccaaaaaaaagaaaacagaaagaaaaaauguaucaucuaaaggacu

SEQ ID NO: 48122 - RNA, 64 nt, hsa
gcuuagcuuccucaacuacuguuuuucagaaggaagaaagaaucaaauggaagaagaaucaagu

SEQ ID NO: 48123 - RNA, 64 nt, hsa
uguuaaccguccuuccccuagcaaauuuaaaaacagaaagaaaauguuguaccaguuaccauuc

SEQ ID NO: 48124 - RNA, 64 nt, hsa
uugccaaaugucacuaaaggguuuaguuuuaaggagaaagaaaaggaaaaaaaaaaaaaacaaa

SEQ ID NO: 48125 - RNA, 64 nt, hsa
ugucucaauaugaauagggggugaguagcuucauagaaagaauggggaacucccuuggccucaa

SEQ ID NO: 48126 - RNA, 64 nt, hsa
cuagguuaugaaaacuaucuuagaaggugcuuuuagaaagaaccaggagaacaaccaaagcagc

SEQ ID NO: 48127 - RNA, 64 nt, hsa
ugauuccaaaaaaaaaaaaaaaaagaagaaagagagaaagaaagaaacagaaaaaccuaaaaga

SEQ ID NO: 48128 - RNA, 64 nt, hsa
uccaaaaaaaaaaaaaaaaagaagaaagagagaaagaaagaaacagaaaaaccuaaaagaaagc

SEQ ID NO: 48129 - RNA, 64 nt, hsa
uauuuuuuauugcucuuuaguaaagaaaggcacaagaaagaaaauauccagcucucuuguguua

SEQ ID NO: 48130 - RNA, 64 nt, hsa
uuagcaauauauucaguggcacucuuauaucagaagaaagaaguuucuacuggcauucugauug

SEQ ID NO: 48131 - RNA, 64 nt, hsa
cugaugcaggaauuaaguuuaaacacaacucuauagaaagaaaggagauuauuacccagaauuc

SEQ ID NO: 48132 - RNA, 59 nt, hsa
aaacugacucauccaacuagacauucuacagaaagaaaaaugcauuauugacgaacugg

SEQ ID NO: 48133 - RNA, 64 nt, hsa
aguaagaagucaccgacgguagcgucauaugagaagaaagaaauccccaccaccucaaccucug

SEQ ID NO: 48134 - RNA, 64 nt, hsa
cuuuacuuagaauuguccaccuagucagagcccaagaaagaauuuucaguggaaaaaucaauau

SEQ ID NO: 48135 - RNA, 64 nt, hsa
ugcccucugcugccauaaucacacaaauuuaaaaagaaagaaaacagucuuccauagauuuuua

SEQ ID NO: 48136 - RNA, 64 nt, hsa
acuuuuaacagauuguuuauagagugauuuuacuagaaagaauuuaauaaacucgaaguuuagg

SEQ ID NO: 48137 - RNA, 64 nt, hsa
uuauagacuuuuuaaaauguacauaaagaauuuaagaaagaauauauuugucaaauaaaaucau

SEQ ID NO: 48138 - RNA, 64 nt, hsa
ugacuagcaaaacuccaucucaaaaaaaaaaaaaagaaagaaagaaacugaaaagugaggugug

SEQ ID NO: 48139 - RNA, 64 nt, hsa
uagcaaaacuccaucucaaaaaaaaaaaaaagaaagaaagaaacugaaaagugagguguggaac

SEQ ID NO: 48140 - RNA, 64 nt, hsa
ugguggaugacaaaagaaaaucugcucuguggaaagaaagaacugucucuaccagggucaagag

SEQ ID NO: 48141 - RNA, 64 nt, hsa
ucucuaccagggucaagagcaugaacgcaucaauagaaagaacucggggaaacaucccaucaac

SEQ ID NO: 48142 - RNA, 64 nt, hsa
cgagcccuggcugugaaaagaaucucaacauagaagaaagaagaaacaauaaauauucugcaga

SEQ ID NO: 48143 - RNA, 64 nt, hsa
gaaacaauaaauauucugcagauuaaugcagcaaagaaagaagguugguagugaaacacaaagc

SEQ ID NO: 48144 - RNA, 64 nt, hsa
auagaacuccaagccuuuucuccacuacuauacaagaaagaauucagcaagcugcuucuccaau

SEQ ID NO: 48145 - RNA, 64 nt, hsa
cucuguagggacacuguguuaucaaccauuaagaagaaagaaccacaagccucccaaguauuug

SEQ ID NO: 48146 - RNA, 64 nt, hsa
uuaauagcccauuucuguuaaccucuuaucacuaagaaagaaaggaaagaaggagaugaauaga

SEQ ID NO: 48147 - RNA, 64 nt, hsa
acuaagaaagaaaggaaagaaggagaugaauagaagaaagaaaauggaaagaaggaaaaaagga

SEQ ID NO: 48148 - RNA, 64 nt, hsa
aagaaggaaaaaaggaggauagaaaaaggauggaagaaagaagcauugaaaacaaagacauucu

SEQ ID NO: 48149 - RNA, 64 nt, hsa
cacuuuauugaaaauugccuuccauuaacacacaagaaagaaagcaggauuuucuccuguaucu

SEQ ID NO: 48150 - RNA, 64 nt, hsa
acuaagguaacuucucagaaagauaucaaaucucagaaagaaugucaaaucagaugaaguuaua

SEQ ID NO: 48151 - RNA, 64 nt, hsa
caguggaucaugaaaagugcuguuuuguccuuugagaaagaaauaauuguuugagcgcagagua

SEQ ID NO: 48152 - RNA, 64 nt, hsa
aacucacucuuaugaaaugggcuuuaacaaaacaagaaagaaacguacuuaacugugugaagaa

SEQ ID NO: 48153 - RNA, 64 nt, hsa
caucaagagggaucaacuguggagaagcuacuucagaaagaagagaucacaaacauaugaguac

SEQ ID NO: 48154 - RNA, 64 nt, hsa
uuagacacuaauauuuucauagaaauuaggcuggagaaagaaggaagaaaugguuuucuuaaau

SEQ ID NO: 48155 - RNA, 64 nt, hsa
cuuuguuauuuuucuaaaaaaauaaaauuuaaaaagaaagaaaacuaaggaagaacaagaagcu

SEQ ID NO: 48156 - RNA, 64 nt, hsa
gcuauguacgaccauuuguauguguaucuaugucagaaagaaucuuuauuaaaauauuuugauc

SEQ ID NO: 48157 - RNA, 64 nt, hsa
uauauguaucuacaauacauauaucuacacauacagaaagaagcaguucucacaauguugcuag

SEQ ID NO: 48158 - RNA, 64 nt, hsa
ggaucguaaaaaaauagaaaaaaagaaaaaaaaaagaaagaaagagggaaaaagagcugguggu

SEQ ID NO: 48159 - RNA, 64 nt, hsa
ggcaacgggcgagacucugucucaaaaaaaagaaagaaagaaaagguacauguauauauuuguc

SEQ ID NO: 48160 - RNA, 64 nt, hsa
ccugggcaacgggcgagacucugucucaaaaaaaagaaagaaagaaaagguacauguauauauu

SEQ ID NO: 48161 - RNA, 64 nt, hsa
ucuguuguacugauguguugugacuaaauaaaaaagaaagaacaaaguauucugugguguaugu

SEQ ID NO: 48162 - RNA, 64 nt, hsa
aagcguugacaaaucagaugaucagcuuuauccaagaaagaagacuaguaaauugucugccucc

SEQ ID NO: 48163 - RNA, 64 nt, hsa
cugcuauuuuuccauaggaagaaaaggaguuaggagaaagaagagcagcugaacuuacuugccu

SEQ ID NO: 48164 - RNA, 64 nt, hsa
auugucacaccuggaagcuuggugaauaauuggaagaaagaauuucaaaaauggcuaggaagug

SEQ ID NO: 48165 - RNA, 64 nt, hsa
gauccuuaccuuguauaucaucuucgaccacaucagaaagaaggaaucauauuccuuuaugaau

SEQ ID NO: 48166 - RNA, 64 nt, hsa
uuugcauauuguaaaagcagugucacagcuaaaaagaaagaaaucguuucuaacaguaaauuau

SEQ ID NO: 48167 - RNA, 64 nt, hsa
aucugaauaaauaaaauguugccaaauucaauguagaaagaaugugacaacacaccuuggguag

SEQ ID NO: 48168 - RNA, 64 nt, hsa
gaaaugaagacuauauauauggaauggaggugacagaaagaaagaaauucuuuguuugagggag

SEQ ID NO: 48169 - RNA, 64 nt, hsa
ugaagacuauauauauggaauggaggugacagaaagaaagaaauucuuuguuugagggagacuu

SEQ ID NO: 48170 - RNA, 64 nt, hsa
ucaggaagguagagagagaaaaagggagggaaggagaaagaaugggaauaaaauaaggagguaa

SEQ ID NO: 48171 - RNA, 64 nt, hsa
uuucuggaugagaaaauuuucaauucuggccaugagaaagaaaaaaaaauaaacagccuucuuu

SEQ ID NO: 48172 - RNA, 64 nt, hsa
cuuucccaagcuccuagccaacacuauccuugggagaaagaaauuugcagaaacugcuaagacc

SEQ ID NO: 48173 - RNA, 64 nt, hsa
ccuugcuguugcucugaggagauauaauucugggagaaagaaucuuuuauaagaacaguacaga

SEQ ID NO: 48174 - RNA, 64 nt, hsa
gucaauuuguuguuauaggucuuaccugugugaaagaaagaaaaagaaagaaagaaagaaagag

SEQ ID NO: 48175 - RNA, 64 nt, hsa
uguuauaggucuuaccugugugaaagaaagaaaaagaaagaaagaaagaaagagaaaggaaauu

SEQ ID NO: 48176 - RNA, 64 nt, hsa
auaggucuuaccugugugaaagaaagaaaaagaaagaaagaaagaaagagaaaggaaauuauaa

SEQ ID NO: 48177 - RNA, 64 nt, hsa
gucuuaccugugugaaagaaagaaaaagaaagaaagaaagaaagagaaaggaaauuauaagguc

SEQ ID NO: 48178 - RNA, 64 nt, hsa
accuguuagcauucacugccaccauauuuuaaggagaaagaacucuauuggugucgucugagca

SEQ ID NO: 48179 - RNA, 64 nt, hsa
uuguggaacauggugagacacuauauaaaauuccagaaagaaagcaacuggauuuacagauuua

SEQ ID NO: 48180 - RNA, 64 nt, hsa
gaaagaaagugagcuugaacauaggaugagcuuuagaaagaaaauugaucaagcagauguuuaa

SEQ ID NO: 48181 - RNA, 64 nt, hsa
gaaaacuagagccuuuaaaugauuucaauuccacagaaagaaagugagcuugaacauaggauga

SEQ ID NO: 48182 - RNA, 64 nt, hsa
ccccagcaugaaugugccuuuuaauuagugaucuagaaagaaguucagccgaacccacacccca

SEQ ID NO: 48183 - RNA, 64 nt, hsa
guuuuuuuuuaaauaguaguuuguaguauuuuaaagaaagaacagaucgaguucuaauuaugau

SEQ ID NO: 48184 - RNA, 64 nt, hsa
ugaauuuuugaaagacuauugcagguguuuaaaaagaaagaaaaguuguuuuaucuaauacugu

SEQ ID NO: 48185 - RNA, 64 nt, hsa
cuugcuaacuuguaaaaagucaucuuucccucacagaaagaaacgaaagaaagcaaagcaaagu

SEQ ID NO: 48186 - RNA, 64 nt, hsa
ugcaagcaaggaaguauguucacuuuaaaguuugagaaagaauaguguggaagcacgucucaaa

SEQ ID NO: 48187 - RNA, 64 nt, hsa
cauaauucuauguguauuuuuauuuugaauaaacagaaagaaauuuuggguuuuuaauuuuuuu

SEQ ID NO: 48188 - RNA, 64 nt, hsa
uugggucaagugcauuggaccuagggaaagagaaagaaagaauaaaagcuggagagagagugaa

SEQ ID NO: 48189 - RNA, 64 nt, hsa
ugaguugggucaagugcauuggaccuagggaaagagaaagaaagaauaaaagcuggagagagag

SEQ ID NO: 48190 - RNA, 64 nt, hsa
cucaaauauuuugccucauuauucuuguuuuaaaagaaagaaaacaggccgggcacaguggcuc

SEQ ID NO: 48191 - RNA, 64 nt, hsa
cagccugggugacagagggagacucugucucgaaagaaagaaagaaaaaaaggaaggaaggaga

SEQ ID NO: 48192 - RNA, 64 nt, hsa
cugggugacagagggagacucugucucgaaagaaagaaagaaaaaaaggaaggaaggagaagga

SEQ ID NO: 48193 - RNA, 64 nt, hsa
uucagggaagcugccaaagaaugucgacgucgaaagaaagaauauguaaaaugucuggagagcc

SEQ ID NO: 48194 - RNA, 64 nt, hsa
aaguaaaccacaaaaaaauaccucaggaaagaauagaaagaaagucuaucuaaugacaugccua

SEQ ID NO: 48195 - RNA, 64 nt, hsa
agcgagacucugucuccccccgcaaaaaaaaaaaagaaagaaagaaagagaaaagaaaagaaaa

SEQ ID NO: 48196 - RNA, 64 nt, hsa
agacucugucuccccccgcaaaaaaaaaaaagaaagaaagaaagagaaaagaaaagaaaagcaa

SEQ ID NO: 48197 - RNA, 64 nt, hsa
ugaugauauucagacgaagcauugauguuauggaagaaagaaagaaacaaacaaaauauauaua

SEQ ID NO: 48198 - RNA, 64 nt, hsa
gauauucagacgaagcauugauguuauggaagaaagaaagaaacaaacaaaauauauauauaua

SEQ ID NO: 48199 - RNA, 64 nt, hsa
ugaucgucacaacccucaggaaccaccgacagaaagaaagaaacacaaaaacaugaaacacagu

SEQ ID NO: 48200 - RNA, 64 nt, hsa
gcccugaucgucacaacccucaggaaccaccgacagaaagaaagaaacacaaaaacaugaaaca

SEQ ID NO: 48201 - RNA, 64 nt, hsa
caagauaaagaaauaaaagugauccagaucauaaagaaagaaguaaaacuauaucugcacauga

SEQ ID NO: 48202 - RNA, 64 nt, hsa
uugucucaaauccuguccacaaggcaacuccagaagaaagaagcccuuuacauuuccauaaaac

SEQ ID NO: 48203 - RNA, 64 nt, hsa
caaaacuuugccucaaaacaaauuuuaaaaagaaagaaagaaggaaagaggguauguuuuucac

SEQ ID NO: 48204 - RNA, 64 nt, hsa
ggagcaaaacuuugccucaaaacaaauuuuaaaaagaaagaaagaaggaaagaggguauguuuu

SEQ ID NO: 48205 - RNA, 64 nt, hsa
uaacuuugagcugagugaggggagagggguaaagagaaagaaacuuaaguuuucuuucacagaa

SEQ ID NO: 48206 - RNA, 64 nt, hsa
gccucucagucuuaggggacauggcagagaugaaagaaagaaagaguggguuucagaaguguca

SEQ ID NO: 48207 - RNA, 64 nt, hsa
uccugauguccaugacuucauguaguucaggcacagaaagaauagcaaagcugcugucagaagu

SEQ ID NO: 48208 - RNA, 64 nt, hsa
uauggacugggcaaagcccacuauaaacuauaggagaaagaaguucugauaaaccucuuaguau

SEQ ID NO: 48209 - RNA, 64 nt, hsa
uguauuguauugauaauuggacaaagagagagaaagaaagaaggaaggaaggaaaaacuuguua

SEQ ID NO: 48210 - RNA, 64 nt, hsa
caauuguauuguauugauaauuggacaaagagagagaaagaaagaaggaaggaaggaaaaacuu

SEQ ID NO: 48211 - RNA, 64 nt, hsa
gagcaagacuccaucucaaaaauaaaauaaaaaaagaaagaaagaaaagaagaagaaaagagaa

SEQ ID NO: 48212 - RNA, 64 nt, hsa
aagacuccaucucaaaaauaaaauaaaaaaagaaagaaagaaaagaagaagaaaagagaagaag

SEQ ID NO: 48213 - RNA, 64 nt, hsa
gcagcagagagcuuuuugcacuuuaaaaaaaaaaagaaagaaagaaaggucggaauuucuuuug

SEQ ID NO: 48214 - RNA, 64 nt, hsa
cagagagcuuuuugcacuuuaaaaaaaaaaagaaagaaagaaaggucggaauuucuuuuggguc

SEQ ID NO: 48215 - RNA, 64 nt, hsa
ugcuugcguuugaaacuacaacuugauaaccccuagaaagaagaggacaugaaaggaugcuggc

SEQ ID NO: 48216 - RNA, 64 nt, hsa
auuugcauuuaaauugcaauccagcacacgugugagaaagaagaggcacuagucuaaaaggcug

SEQ ID NO: 48217 - RNA, 64 nt, hsa
ccugagcuaugccuguugaggcaucuggagacugagaaagaaucaaaggcagagaagaccagcc

SEQ ID NO: 48218 - RNA, 64 nt, hsa
auggccaggggagggggucuguggaagauucaggagaaagaaaggagaggcuaggguggugugg

SEQ ID NO: 48219 - RNA, 64 nt, hsa
aucuuuuuucuucccucauuuucugggauucucaagaaagaaaaaguaacccauuaucacucug

SEQ ID NO: 48220 - RNA, 64 nt, hsa
cuaaagagcacuuuauuucuuugaagccuuucuaagaaagaaaugggggugcgaguggcuugaa

SEQ ID NO: 48221 - RNA, 64 nt, hsa
aaagagaaaaaaauaaaaaucaaaaaaaaaaaaaagaaagaaagaaaccuccagcguauuuuau

SEQ ID NO: 48222 - RNA, 64 nt, hsa
agaaaaaaauaaaaaucaaaaaaaaaaaaaagaaagaaagaaaccuccagcguauuuuaucacu

SEQ ID NO: 48223 - RNA, 64 nt, hsa
aaagaaaccuccagcguauuuuaucacuaccuauagaaagaaauccugcuuugagaguauuugu

SEQ ID NO: 48224 - RNA, 64 nt, hsa
cuuauuuggguaguuaaauuuugagauuaugcauagaaagaauccaugcuauagguuuauuucc

SEQ ID NO: 48225 - RNA, 64 nt, hsa
aauaccauuuugagugagaaaguacuuuuaaacaagaaagaaauuguacauuaugacuaaaguu

SEQ ID NO: 48226 - RNA, 64 nt, hsa
gcuuauuaugaguuuaagaagcaguucuuccuccagaaagaagggggcgauagcaugcagguac

SEQ ID NO: 48227 - RNA, 64 nt, hsa
ucgagcaaaagcaaagauccaccgagagaagaagagaaagaaaagaaaaagaaaaagcacaaaa

SEQ ID NO: 48228 - RNA, 64 nt, hsa
aaaggagaaucaaagauugauuguccuggggcuaagaaagaagauaauuuuuaaagaaugggag

SEQ ID NO: 48229 - RNA, 64 nt, hsa
aacacuaguguccaauuucauuuuuaaaagauguagaaagaagaaucaagcaucaauuaauuau

SEQ ID NO: 48230 - RNA, 64 nt, hsa
accucugucucaaaaaaaaaaaaagaaaaaagaaagaaagaaaaaaggcagaagcccuggauuc

SEQ ID NO: 48231 - RNA, 64 nt, hsa
gcgaaccucugucucaaaaaaaaaaaaagaaaaaagaaagaaagaaaaaaggcagaagcccugg

SEQ ID NO: 48232 - RNA, 64 nt, hsa
uugcaaagcacucagcucaauuaucuucuuagaaagaaagaaaaaguaugaauggucaaaauga

SEQ ID NO: 48233 - RNA, 64 nt, hsa
ucauuugcaaagcacucagcucaauuaucuucuuagaaagaaagaaaaaguaugaauggucaaa

SEQ ID NO: 48234 - RNA, 64 nt, hsa
uauggaggagguugugauggugguaagccuucaaagaaagaaaggccuuucaagaaucaaacuu

SEQ ID NO: 48235 - RNA, 64 nt, hsa
cucaggaaaagacuaguauuugggcaauauuugaagaaagaauuuaacaggcacugauggggag

SEQ ID NO: 48236 - RNA, 64 nt, hsa
uauuuauaugauuccuaacauaauaucauuugguagaaagaaaaccaacuguggucauccagag

SEQ ID NO: 48237 - RNA, 64 nt, hsa
agccucagaugauuuccccccuccgccuccaggaagaaagaauguuacugccuuaauaaaaaau

SEQ ID NO: 48238 - RNA, 64 nt, hsa
ugauuuauuugcuucuucgaaaaucuagaggaaaagaaagaaguuauuuuccagguacccuucu

SEQ ID NO: 48239 - RNA, 64 nt, hsa
cagguaaaaggugaucccucuaagaaagaaaugaagaaagaaaaugaugaaaagaguaguucaa

SEQ ID NO: 48240 - RNA, 64 nt, hsa
guucgaaccuuucagguaaaaggugaucccucuaagaaagaaaugaagaaagaaaaugaugaaa

SEQ ID NO: 48241 - RNA, 64 nt, hsa
cucuuuguaacccagccaccaccaaaaagcaaacagaaagaaggaaggaugguuaagccauugg

SEQ ID NO: 48242 - RNA, 64 nt, hsa
cuuucugggcuaacauaguccucacacagggcugagaaagaaagugucuccuuuccuggaaagc

SEQ ID NO: 48243 - RNA, 64 nt, hsa
ggcugccccuuggaucaagcagaaaacaagagaaagaaagaacguucccuuuggggauagucug

SEQ ID NO: 48244 - RNA, 64 nt, hsa
gcgaggcugccccuuggaucaagcagaaaacaagagaaagaaagaacguucccuuuggggauag

SEQ ID NO: 48245 - RNA, 64 nt, hsa
agauugagaaauuggaugguugccgugucuguguagaaagaaguagacaugggagacuuuucau

SEQ ID NO: 48246 - RNA, 64 nt, hsa
aggccagugcuuuuuccucuuaggguuucuuugcagaaagaaaccuccagcaagggaagagagg

SEQ ID NO: 48247 - RNA, 64 nt, hsa
agagcgagacuccgucucaaaaaaaaaaaaagaaagaaagaaaaggaaacccaagagcugccug

SEQ ID NO: 48248 - RNA, 64 nt, hsa
caacagagcgagacuccgucucaaaaaaaaaaaaagaaagaaagaaaaggaaacccaagagcug

SEQ ID NO: 48249 - RNA, 64 nt, hsa
aaagaaagaaagaaagagagagagagagaaagaaagaaagaaaggcugccuuugcaaaaauccu

SEQ ID NO: 48250 - RNA, 64 nt, hsa
uuggaaagaaagaaagaaagagagagagagagaaagaaagaaagaaaggcugccuuugcaaaaa

SEQ ID NO: 48251 - RNA, 64 nt, hsa
uuauuuggaaagaaagaaagaaagagagagagagagaaagaaagaaagaaaggcugccuuugca

SEQ ID NO: 48252 - RNA, 64 nt, hsa
gcaccauaaugaggaaaaaguuauuuggaaagaaagaaagaaagagagagagagagaaagaaag

SEQ ID NO: 48253 - RNA, 64 nt, hsa
uaaagcaccauaaugaggaaaaaguuauuuggaaagaaagaaagaaagagagagagagagaaag

SEQ ID NO: 48254 - RNA, 64 nt, hsa
gagacauugugaaaaggcaaauuuguauauguagagaaagaauaguaguaacuguuucauagca

SEQ ID NO: 48255 - RNA, 64 nt, hsa
uuauuguagaauaagucauuguauuuuuaacaccagaaagaaccuugccgaucaccaggcauaa

SEQ ID NO: 48256 - RNA, 64 nt, hsa
auuuuucauuucucuuguaccaauguccaaaacaagaaagaaugcaaugcuuuugagccucugg

SEQ ID NO: 48257 - RNA, 64 nt, hsa
gugggugugaagggguagaugaaagcuuuaauuuagaaagaaaguucaaguaaaggaaauuauu

SEQ ID NO: 48258 - RNA, 64 nt, hsa
gucauuucuuuuuccuuaaaacauaugaguauauagaaagaaaaguuacaguacucugugggaa

SEQ ID NO: 48259 - RNA, 64 nt, hsa
augggagauuguuuucaggaauucagggaugaaaagaaagaauaauuuccauuaaguagaauuc

SEQ ID NO: 48260 - RNA, 64 nt, hsa
gucaacuuuugggacuuggggugcauuuucucacagaaagaauaguaguuagguucccuaacac

SEQ ID NO: 48261 - RNA, 64 nt, hsa
gauaguccuguaguguuauuuuuguauauuguugagaaagaaacacuaacaaaaggaacaacga

SEQ ID NO: 48262 - RNA, 64 nt, hsa
ucucucucucaaaaaaaaaaaaaaaaaaaaggaaagaaagaaagaaaagaaaagaaaauccuuu

SEQ ID NO: 48263 - RNA, 64 nt, hsa
ucucucaaaaaaaaaaaaaaaaaaaaggaaagaaagaaagaaaagaaaagaaaauccuuuuugc

SEQ ID NO: 48264 - RNA, 64 nt, hsa
cgggacagagugagacccugucugaaagaaagagagaaagaaagaaagaaagagagagaaagaa

SEQ ID NO: 48265 - RNA, 64 nt, hsa
acagagugagacccugucugaaagaaagagagaaagaaagaaagaaagagagagaaagaaagaa

SEQ ID NO: 48266 - RNA, 64 nt, hsa
agugagacccugucugaaagaaagagagaaagaaagaaagaaagagagagaaagaaagaaagaa

SEQ ID NO: 48267 - RNA, 64 nt, hsa
ugaaagaaagagagaaagaaagaaagaaagagagagaaagaaagaaagaaagaaagggaaagau

SEQ ID NO: 48268 - RNA, 64 nt, hsa
agaaagagagaaagaaagaaagaaagagagagaaagaaagaaagaaagaaagggaaagauggaa

SEQ ID NO: 48269 - RNA, 64 nt, hsa
agagagaaagaaagaaagaaagagagagaaagaaagaaagaaagaaagggaaagauggaaggaa

SEQ ID NO: 48270 - RNA, 64 nt, hsa
agaaagaaagaaagaaagagagagaaagaaagaaagaaagaaagggaaagauggaaggaaggaa

SEQ ID NO: 48271 - RNA, 64 nt, hsa
aaggaaggaaaaagaaagagaaagagagagagagagaaagaaaaagaaagaaaaguaagaaaga

SEQ ID NO: 48272 - RNA, 64 nt, hsa
aaagaaagagaaagagagagagagagaaagaaaaagaaagaaaaguaagaaagaaaaaagaaaa

SEQ ID NO: 48273 - RNA, 64 nt, hsa
gagagagagagagaaagaaaaagaaagaaaaguaagaaagaaaaaagaaaaagaaagaaaagua

SEQ ID NO: 48274 - RNA, 64 nt, hsa
aaaaagaaagaaaaguaagaaagaaaaaagaaaaagaaagaaaaguaagaaagaaaaaaagaaa

SEQ ID NO: 48275 - RNA, 64 nt, hsa
cccccucaaaaaaaaaaaaaaaaaaaaaaaaaacagaaagaaagaaaaagaaaacugcagauaa

SEQ ID NO: 48276 - RNA, 64 nt, hsa
cucaaaaaaaaaaaaaaaaaaaaaaaaaacagaaagaaagaaaaagaaaacugcagauaacccu

SEQ ID NO: 48277 - RNA, 64 nt, hsa
uggggggcccuaauggagagguguggguuuggcaagaaagaagcaacacagaugucguccccaa

SEQ ID NO: 48278 - RNA, 64 nt, hsa
cuugggccucaguuucccgacuugcaaaauaagcagaaagaaccagaugcucuccagggucuuu

SEQ ID NO: 48279 - RNA, 64 nt, hsa
gauuguauuaauuuaaccaggacuauguagaaguagaaagaaaagaaaaagaaaaucuuuuuua

SEQ ID NO: 48280 - RNA, 64 nt, hsa
gaaagaauacuuuucuggcaaaaaaaaaaaaaaaagaaagaaaggaaaacaaaaagcacuuuuu

SEQ ID NO: 48281 - RNA, 64 nt, hsa
uggagccgccacacccagccaaugugccgaagaaagaaagaaaaacaugcucauccuuugaguc

SEQ ID NO: 48282 - RNA, 64 nt, hsa
ggcauggagccgccacacccagccaaugugccgaagaaagaaagaaaaacaugcucauccuuug

SEQ ID NO: 48283 - RNA, 64 nt, hsa
cugagcagcagagcgggaccucgucucuaagaauagaaagaaagaaagagaaacgguguccucc

SEQ ID NO: 48284 - RNA, 64 nt, hsa
gcagcagagcgggaccucgucucuaagaauagaaagaaagaaagagaaacgguguccuccgcac

SEQ ID NO: 48285 - RNA, 64 nt, hsa
uagauaauuucaagaaacugaguaggacaaagggagaaagaaauacauguucuuuuuccugcaa

SEQ ID NO: 48286 - RNA, 64 nt, hsa
gcuuauaaaauauacuacuagcuuuuaaguuuuaagaaagaagaacguaaguuguacaaagaua

SEQ ID NO: 48287 - RNA, 64 nt, hsa
aaaauuguauguuaaugcuggaaagaaaaaaagaagaaagaaagaaaccaucccuguccuucag

SEQ ID NO: 48288 - RNA, 64 nt, hsa
uuguauguuaaugcuggaaagaaaaaaagaagaaagaaagaaaccaucccuguccuucaguuua

SEQ ID NO: 48289 - RNA, 64 nt, hsa
gaguucucaacugagugagcaucauggagggagaagaaagaaagaaguucagccugggugugug

SEQ ID NO: 48290 - RNA, 64 nt, hsa
ucucaacugagugagcaucauggagggagaagaaagaaagaaguucagccugggugugugaagc

SEQ ID NO: 48291 - RNA, 64 nt, hsa
cuacucuaucacaaggccaguaccacacucaugaagaaagaacacaggaguagcugagaggcua

SEQ ID NO: 48292 - RNA, 64 nt, hsa
uacucuuucuaaaaauaauaauaauaaugcuaacagaaagaagagaaccguucguuugcaaucu

SEQ ID NO: 48293 - RNA, 64 nt, hsa
ugcgaguaguuccacacagguuuguaaguaaguaagaaagaaggcaaauugauucaaauguuac

SEQ ID NO: 48294 - RNA, 64 nt, hsa
uuccauuuuuuaaauguucaugucacauccuaauagaaagaaauuacuucuagucagucaucca

SEQ ID NO: 48295 - RNA, 64 nt, hsa
cuaaaacaguauguucugguuuuggcccucuugcagaaagaagcauuagaaaaauuacuuuaaa

SEQ ID NO: 48296 - RNA, 64 nt, hsa
aaaauugaggaucucuguuuuuccuggggcaaacagaaagaaaucugcaugaguugcuuuugua

SEQ ID NO: 48297 - RNA, 64 nt, hsa
aaacugaauccauguaagaaaaaauaauuguugaagaaagaaguugauagaauucaaaaaggcc

SEQ ID NO: 48298 - RNA, 64 nt, hsa
acuuuucuuuucccccuguaccuaugggacuuccagaaagaaguuaaauugaguaaaaucauca

SEQ ID NO: 48299 - RNA, 64 nt, hsa
aacugguugcauguaaaauuccuuccagccagaaagaaagaaagacaaggaguaagggggauuu

SEQ ID NO: 48300 - RNA, 64 nt, hsa
aaauaacugguugcauguaaaauuccuuccagccagaaagaaagaaagacaaggaguaaggggg

SEQ ID NO: 48301 - RNA, 64 nt, hsa
cuacugcucagcaauguaaaagagacaaauaaggagaaagaaaaucuccaaaccaggaauguuu

SEQ ID NO: 48302 - RNA, 64 nt, hsa
auaggcuuuuacacagcacaugaagcaguaauccagaaagaaggaaaugcagaauuuuauuauc

SEQ ID NO: 48303 - RNA, 64 nt, hsa
guaaaaauaggucagcagagauuucaguuucccagggcuuaaccagaaccgccaccucaaugca

SEQ ID NO: 48304 - RNA, 64 nt, hsa
guaaaaauagguuggcagagauuucaguuucccagggcuuaaccagaaccgccaccucaaugca

SEQ ID NO: 48305 - RNA, 64 nt, hsa
ugcagauacauucaugaggggagaggcgcccucccuuccugaggagcuguuggccugggugggc

SEQ ID NO: 48306 - RNA, 64 nt, hsa
auguaggccccuggucugcccugggcucaucagccuuccugaccuccuccugcccuccccuuca

SEQ ID NO: 48307 - RNA, 64 nt, hsa
accccugcacagugccugucaaacagaugcaaaccuuccugaauaaagccuuggagaccagcgc

SEQ ID NO: 48308 - RNA, 64 nt, hsa
augugguggaugccagggcgugcuccaggcaccucuuccugaagucucugcauuuggagauucg

SEQ ID NO: 48309 - RNA, 64 nt, hsa
aguggagauuggaucauuuaacaauauaacaaaacuuccugauuugauuuuacguaucuucuau

SEQ ID NO: 48310 - RNA, 64 nt, hsa
aacuucacagagacucuguccuuccaugcaaaggcuuccugaaauagggagacugacugaguag

SEQ ID NO: 48311 - RNA, 64 nt, hsa
ccuugucccucuuuuaugaucagggugaaauguacuuccugauguaaugaaccuaauuugauuu

SEQ ID NO: 48312 - RNA, 64 nt, hsa
auguccaggaagaagcccauuuguugaggcugaccuuccugaucauacacacacacagcccagc

SEQ ID NO: 48313 - RNA, 64 nt, hsa
gcggggccuucugaugcccaaucagcacggcugccuuccugacccagucaaggccucugucuga

SEQ ID NO: 48314 - RNA, 64 nt, hsa
augaauguccguguacgucagcguguguguccaccuuccugagugauguguucgcuuguagggu

SEQ ID NO: 48315 - RNA, 64 nt, hsa
aaaaaucucuguagaguuagucuucuccuuuucucuuccugagaaguucuccugccugcauaac

SEQ ID NO: 48316 - RNA, 64 nt, hsa
aaauuauaggcaagauacaauuauaugcguuccucuuccugaaauuauaacauuucuaaacuua

SEQ ID NO: 48317 - RNA, 64 nt, hsa
aucucagaaaaggagagcuuguugugaaacacugcuuccugaaacuuccugcuauugccuaaag

SEQ ID NO: 48318 - RNA, 64 nt, hsa
aaacuccugggcucaagcaauccuccugccucagcuuccugaguagcuggaaccacaggugugu

SEQ ID NO: 48319 - RNA, 64 nt, hsa
ggucuuguucaagcagcgaguguuggguccucugcuuccugagcuguccccuggagaagguccc

SEQ ID NO: 48320 - RNA, 64 nt, hsa
cccaggccaccugucuucucucccacgugcacagcuuccugagucaccccucuguccagccagc

SEQ ID NO: 48321 - RNA, 64 nt, hsa
uaaucuggguggcucagcuaaccucucuucuucccuuccugaagugacaaaggaaacucagucu

SEQ ID NO: 48322 - RNA, 64 nt, hsa
guggcccccgaacccaagccucacuuuucugugccuuccugaggggguugggccggggaggaaa

SEQ ID NO: 48323 - RNA, 64 nt, hsa
gauuuugguuccacaagcaguguuuggguguugccuuccugaaggugaccaagcuuccaaagcu

SEQ ID NO: 48324 - RNA, 64 nt, hsa
gauguaguggcaaguguggcgauguuuacucucccuuccugaaccgcucuggucugcuccucag

SEQ ID NO: 48325 - RNA, 64 nt, hsa
cugucugcccaguuucaccgggagaagucggccucuuccugaugggcaaccacaccacugccug

SEQ ID NO: 48326 - RNA, 64 nt, hsa
cuccugcccaggggcuugucaccuuccccuccuccuuccugagucacuccuucaguagaaggcc

SEQ ID NO: 48327 - RNA, 64 nt, hsa
ugaccucauucucuguccagaauguggacucccucuuccugagcaucuuauggaaauuacccca

SEQ ID NO: 48328 - RNA, 64 nt, hsa
agaaaccuucaucuaaagcaagucacugugccaucuuccugaccacuacccucuuuccuagggc

SEQ ID NO: 48329 - RNA, 64 nt, hsa
aaggauuuuacauaaaugccauauuuaugguuuccuuccugagaacaaucuugcucuugccaug

SEQ ID NO: 48330 - RNA, 51 nt, hsa
ccaccagcaggagggccugaccuuccugaggccaugugcgguuucugaggc

SEQ ID NO: 48331 - RNA, 64 nt, hsa
ggaucuucggauaaauucugccauuuucauuucacuuccugaaagucaggguuggcuugugaaa

SEQ ID NO: 48332 - RNA, 64 nt, hsa
cuucuccuauuuugccuucuaccaugaguaaaagcuuccugaggcuuccccagaagcagaugcc

SEQ ID NO: 48333 - RNA, 64 nt, hsa
cacaaauggaaugguuaauggucacaugccaucucuuccugacagccccuuuacagguuacauc

SEQ ID NO: 48334 - RNA, 64 nt, hsa
caacaaagaagcuggaucucuggaggcuuccacccuuccugauuauucaccuuaagcgauuuca

SEQ ID NO: 48335 - RNA, 64 nt, hsa
aauuuaaauuccuuuuaugaauagauuucccuuucuuccugaccccaaggucagaggagacuau

SEQ ID NO: 48336 - RNA, 64 nt, hsa
uacgaguccuuuuucuuguagagguaaguaaaaucuuccugacaagguaguccucuuuucaugg

SEQ ID NO: 48337 - RNA, 64 nt, hsa
accccagggaucccccagcucccccagccccuggcuuccugacccugcgccucacccucagacu

SEQ ID NO: 48338 - RNA, 64 nt, hsa
cagcccuucagggcuucugguuccuucugccgcccuuccugagaccuuagaaaccagaagagcc

SEQ ID NO: 48339 - RNA, 64 nt, hsa
accccucucucuugccuuccuucccuuucccuuucuuccugacuagccccaagucccuucauuu

SEQ ID NO: 48340 - RNA, 64 nt, hsa
uacuagaugauuuuuccgguuguccuuaacaccccuuccugagguucccuucaccccucucucu

SEQ ID NO: 48341 - RNA, 64 nt, hsa
augagguuuauggagccuccagaacagaugccaucuuccugaauguugacaugccagugggugu

SEQ ID NO: 48342 - RNA, 64 nt, hsa
ugcagauuucggaaauuggcaagcuacgggauuccuuccugaaagaucaacugugucuuaaggc

SEQ ID NO: 48343 - RNA, 64 nt, hsa
cucggguucuggcccccaaggucagagcaagcaucuuccugacagcauuuugucaucuaaaguc

SEQ ID NO: 48344 - RNA, 64 nt, hsa
ucaaccagauucuagaaacugcggucauccaguucuuccugacaccggaugggugcuugggaac

SEQ ID NO: 48345 - RNA, 64 nt, hsa
aggaggggguccgccagcagcuggagcugggccgcuuccugaggagccgcuacgaggccuuccu

SEQ ID NO: 48346 - RNA, 64 nt, hsa
agcugggccgcuuccugaggagccgcuacgaggccuuccugaguccggaguaccggcgggagga

SEQ ID NO: 48347 - RNA, 64 nt, hsa
ccgaguaccaggaggcccuggagggcuggacgggcuuccugagucgccuggagaacuucacggg

SEQ ID NO: 48348 - RNA, 64 nt, hsa
cauugccucuugccuggauuauagccggggucuccuuccugaccacuuccugccuuuauucucu

SEQ ID NO: 48349 - RNA, 64 nt, hsa
uggaaagcucuccaacccaucuucuacagcacagcuuccugaacaggguauaaguaugcugaga

SEQ ID NO: 48350 - RNA, 64 nt, hsa
uuuuuugaugaaaugagucacagagaaguuacaugacaaagauaaaaucacaggguuggaaaga

SEQ ID NO: 48351 - RNA, 64 nt, hsa
aauagaguaaaauaucugcugcauaaaaaacuaagacaaagaccagaggaaauaucuucccuuu

SEQ ID NO: 48352 - RNA, 64 nt, hsa
aucccuaaaaaaaugaucauuacagauguuuagugacaaagaaucaauauguaaaaaguauaau

SEQ ID NO: 48353 - RNA, 64 nt, hsa
uauagaaaaaaauagauuuuuaaaauucagaauggacaaagagaauauucauuuucuuauuaau

SEQ ID NO: 48354 - RNA, 64 nt, hsa
ggcuucugcaagcugcacagaacugggguaagaagacaaagaguagccaccgggagaggcuucc

SEQ ID NO: 48355 - RNA, 64 nt, hsa
uauuuuuacacuggaaacguugauuguuuuaaaugacaaagacauaugugauguucuaugugga

SEQ ID NO: 48356 - RNA, 64 nt, hsa
gugcagagagugucaguuucccaaguucugagguaacucucagcccagaugugaaaugggagcc

SEQ ID NO: 48357 - RNA, 64 nt, hsa
cauuuaaaaauccaggccagauccuauuauaaccaacucucaggauuuacagccuucaguugua

SEQ ID NO: 48358 - RNA, 64 nt, hsa
uugguuuucuuacgauacagggccauuuuuuuaaaacucucaggacugaacagaagagaaaaau

SEQ ID NO: 48359 - RNA, 64 nt, hsa
caggcguccaauccuagaaaccaauggucuccagaacucucacacaaguguuuuucugauucua

SEQ ID NO: 48360 - RNA, 64 nt, hsa
aaugggauuguguguuuuauuuuggagggauuaaaggucauaguuugguccucaguauaaaauc

SEQ ID NO: 48361 - RNA, 64 nt, hsa
acauugcacacugugauuauuuuucagcuaugguaggucauauuuuguuuuauaccagagcugu

SEQ ID NO: 48362 - RNA, 64 nt, hsa
cuaaagcauaaguuagucuuuuccugauucuuaaaggucauacuugaaauccugccaauuuucc

SEQ ID NO: 48363 - RNA, 64 nt, hsa
acugauuuuggaggaaauuuuucuagaagaacaaaggucauauuugaggcaagcuaaaaacuua

SEQ ID NO: 48364 - RNA, 64 nt, hsa
guggguacccagcugcuguggaacggguauggacaggucauaaaccuagagucaguguccuguu

SEQ ID NO: 48365 - RNA, 64 nt, hsa
ucagaaccagauuccugccggcuccuuugaaaacaggucauauugugcucuucuguuuacaaga

SEQ ID NO: 48366 - RNA, 64 nt, hsa
ugggugguuucacaucagugguucugaguguccgaggucauaagcaauuggaaaagggaaagac

SEQ ID NO: 48367 - RNA, 64 nt, hsa
aucacccuuuucagcccucccaugaagaauuucuaggucauaaacaugaauaauacucaguaua

SEQ ID NO: 48368 - RNA, 64 nt, hsa
acccugaauagaauaggaagaacaauguucuuacaggucauaauguauuucacaauuaaaaaac

SEQ ID NO: 48369 - RNA, 64 nt, hsa
caccaggggugcucaccucugccccuauugggagaggucauaaaaugucucgaguccuaaggcc

SEQ ID NO: 48370 - RNA, 64 nt, hsa
cuaaagauuuuuauucugauuuuuucauaaucaaaggucauaugauacuguauagacaagcuuu

SEQ ID NO: 48371 - RNA, 64 nt, hsa
augugcuuucuuaaagaaugccaaaaguguaauaaggucauaacugcauuuaucaugaacacua

SEQ ID NO: 48372 - RNA, 64 nt, hsa
cacugcgccuggccuugaugugugaauauuugagaggucauaagcagugguuuuggccauaccg

SEQ ID NO: 48373 - RNA, 64 nt, hsa
auugugauuccuccuuuuagucuaauaucuuuccaggucauacuuguuuuuaaucauuaaauau

SEQ ID NO: 48374 - RNA, 64 nt, hsa
agaagaccaaaacuuggugaauagucccagugcuaggucauauaggaaacagaaagcaugacag

SEQ ID NO: 48375 - RNA, 64 nt, hsa
uaauguauauauugugaguauuuauuagauucguaggucauauuacuuaucaacugagccaaau

SEQ ID NO: 48376 - RNA, 64 nt, hsa
ccucuuagccagugagcuaaauauggcuaagcacaggucauaagagcaccuaaggccagcauau

SEQ ID NO: 48377 - RNA, 64 nt, hsa
aauucagucuuuuaggggcaccaaguaaagcauaaggucauauauacuauacaauauguuuauu

SEQ ID NO: 48378 - RNA, 64 nt, hsa
aaggucauuugcuaacuagcuuggaaacuggaugaggucauagcagugcuugauugcguggaau

SEQ ID NO: 48379 - RNA, 64 nt, hsa
cuuuuuaaguguauauuuuggaggacgggugaagaggucauaacgaaagcaagcgagugaauua

SEQ ID NO: 48380 - RNA, 64 nt, hsa
agaauaaucuccuuugacuccaggucucacauccaggucauacugaugcaagaaguggguuccc

SEQ ID NO: 48381 - RNA, 64 nt, hsa
acuccuccugcugguggauugcagaugcauuauuaggucauacuggcuagaaugcagcuuuucu

SEQ ID NO: 48382 - RNA, 64 nt, hsa
uauuaugggauguuggcaaucuuacauuuuauagaggucauaugcauaguuuucauagguguuu

SEQ ID NO: 48383 - RNA, 64 nt, hsa
cuugaacccaggaggcagagguugcagugagccaaggucauaccagugcacuccaggcggguga

SEQ ID NO: 48384 - RNA, 64 nt, hsa
auguuuauauguuugacugcauaaguauuauuuuaggucauaaagguuauaacaaaauacauuu

SEQ ID NO: 48385 - RNA, 64 nt, hsa
ugcggcaucauaguuaugucaauaaaguuuauuuaggucauagaauauccuaaaguaucacaua

SEQ ID NO: 48386 - RNA, 64 nt, hsa
aacaauaagaacaaguuuuggcagccaugauaauaggucauauguuguguuugguucaauuuuu

SEQ ID NO: 48387 - RNA, 64 nt, hsa
uccaaggucccauuuucccccuguguuuucacgcaggucauauugucaguccuacaaaaauaaa

SEQ ID NO: 48388 - RNA, 64 nt, hsa
gucuggacacugccacauggagccacugucaugcaggucauaucagaucugagugccccacaga

SEQ ID NO: 48389 - RNA, 64 nt, hsa
cauucauuccauguccauaugcaucuacuuggcaaggucauagacaauuccuccagagacacug

SEQ ID NO: 48390 - RNA, 64 nt, hsa
ggcacuuaaauuuuuucuuuauaaagcuuuuugaaggucauaaacaaagaccauaauugaugau

SEQ ID NO: 48391 - RNA, 64 nt, hsa
cauaguauuccucaguaucuauuccaagauacugaggucauaaucagaagcuaagcugggugca

SEQ ID NO: 48392 - RNA, 64 nt, hsa
gugguucuuuuucucugaauuacaggauggaaaaaggucauauccuuugucaggaaauauaaac

SEQ ID NO: 48393 - RNA, 64 nt, hsa
gcggggggaggugggugugaagaacgugcuucuuaggucauaacgcuuuugcagggucaauggu

SEQ ID NO: 48394 - RNA, 64 nt, hsa
aucuuggacugacauuuagcguagcuaagugaaaaggucauagcugagauuccugguucgggug

SEQ ID NO: 48395 - RNA, 64 nt, hsa
uuuccuuguagagguuuuuuuccuccuugucuuaaggucauaaaaauauuguuaugugggacca

SEQ ID NO: 48396 - RNA, 64 nt, hsa
ccaaauuguauauuggauugcauuuugggguccuaggucauacguucuucaaaauuauuaugau

SEQ ID NO: 48397 - RNA, 64 nt, hsa
ugaauugaaugaagacaucucaguacacucuuuuaggucauaguaguugccauuuuguaaaauu

SEQ ID NO: 48398 - RNA, 64 nt, hsa
aaaguuguauuuucccacaaauauaguaugaaugaggucauauuaaagaacagcaacuguuaau

SEQ ID NO: 48399 - RNA, 64 nt, hsa
ccuggugcacagugcuuagaaguaagcaauucccaggucauagcucaagaauuguuagcaaaug

SEQ ID NO: 48400 - RNA, 64 nt, hsa
ucacauuuuguaucaguauuauguagcauaacaaaggucauaaugcuuucagcaauugauguca

SEQ ID NO: 48401 - RNA, 64 nt, hsa
ucacgauaaaaguuaaacaaagaaagcuguaugcaggucauauaugcaugagaauucaacuauu

SEQ ID NO: 48402 - RNA, 64 nt, hsa
acauuauuuccacucugguggauaaguucaauaaaggucauaucccaaacuaguuguguauuaa

SEQ ID NO: 48403 - RNA, 64 nt, hsa
aggcacguauaguuaagagaguuuuauuuuaauaaggucauauuguuuuuacuauguuuaaaaa

SEQ ID NO: 48404 - RNA, 64 nt, hsa
uguuuauugugagauauuucaggugggaucaaagaggucauaagaauuuauuuucuuuuguggg

SEQ ID NO: 48405 - RNA, 64 nt, hsa
uuuauuuuuuguagcaguggccgaaaguccugcaaggucauaaaucuuucagagugacaucacc

SEQ ID NO: 48406 - RNA, 64 nt, hsa
uguugguucuugaaaccuuagcuagaagaauuucaggucauaccaacauguggauaggcuauag

SEQ ID NO: 48407 - RNA, 64 nt, hsa
caaacgaaagcacaggcuacucagacuuggccacaggucauaggucagagaauuuuuucuucaa

SEQ ID NO: 48408 - RNA, 64 nt, hsa
uaugaguauuacuaguugauaaucaguuuugucuaggucauaacauaccauuuguaaguuuguu

SEQ ID NO: 48409 - RNA, 64 nt, hsa
caucaaaucaguuuccaugcaucaguaauauugaaggucauaaucagugauuuuuguuauauga

SEQ ID NO: 48410 - RNA, 64 nt, hsa
agacugaaauuucagugaaagcaguguauuugcuaggucauaccagaaaucaucaauugaggua

SEQ ID NO: 48411 - RNA, 64 nt, hsa
uuugagagcucuuguuagcugauauucauguuugaggucauaaaauugucucuggucugaccaa

SEQ ID NO: 48412 - RNA, 64 nt, hsa
agaugcauauaaaggguggaaugggagccauggcaggucauagaguccucucaaugggaaccug

SEQ ID NO: 48413 - RNA, 64 nt, hsa
uaaaaugaacuuuuaacacuuggcucaaaccucuaggucauacugccaaucuuuagacaaaugg

SEQ ID NO: 48414 - RNA, 64 nt, hsa
aauguuaaguuucaagaaaguuuaccuuugcuuuaggucauaaguuccuuauuugauugcugua

SEQ ID NO: 48415 - RNA, 64 nt, hsa
gauaaccuaagagcauuaagcucugaguccagugaggucauagcaguguaugcuccuugcccuu

SEQ ID NO: 48416 - RNA, 64 nt, hsa
cacaucugcuaagugaucauuuucugccauaccaaggucauaauuccuuccgugagaaauauuu

SEQ ID NO: 48417 - RNA, 64 nt, hsa
augauugaaagugagaacaaauauauuuaaucucaggucauagacugugauucagaugaagcca

SEQ ID NO: 48418 - RNA, 64 nt, hsa
aacugagacccagagagcuuaagugacuuccucgaggucauaguuacuuacugccuuaguccca

SEQ ID NO: 48419 - RNA, 64 nt, hsa
guuguauuuuguacauuuuggauuucuuuauauaaggucauagauucuugagcuguugugguuu

SEQ ID NO: 48420 - RNA, 64 nt, hsa
uucuucccugccuuggaagcccuggccugggaggaggucauaccccaccguuggagcccagcug

SEQ ID NO: 48421 - RNA, 64 nt, hsa
aacaugggggugagacugaagccugaggaauuaaaggucauaugacagggcuguuaccucaaag

SEQ ID NO: 48422 - RNA, 64 nt, hsa
auauauacuuuuagacccacagugaaaccacagaaggucauauuuuguaccuuaaaccaguagc

SEQ ID NO: 48423 - RNA, 64 nt, hsa
ccggucaccaguccucuugcugcccaugguucauaggucauagaaggcagcaaugcacugacug

SEQ ID NO: 48424 - RNA, 64 nt, hsa
ggucaccaaacuaguaacuaguggggcuuaaugaaggucauaaguuucugagaugggagagcaa

SEQ ID NO: 48425 - RNA, 64 nt, hsa
aagccuacuuauuagaaacaaugaaguucacaauaggucauaaggucucuuccuuuucuaaaau

SEQ ID NO: 48426 - RNA, 64 nt, hsa
guuacuggccaaggcuauuuuucagaacuguuaaaggucauaugcacguuaaaaguugaccaau

SEQ ID NO: 48427 - RNA, 64 nt, hsa
uuaaggccuguucucagcacaaugucucaaaaauaggucauauccugccacucccgucgcagag

SEQ ID NO: 48428 - RNA, 64 nt, hsa
guggcgccacuguuuugaaucucauaauuuauacaggucauauuaauauauuuccauuaaaaaa

SEQ ID NO: 48429 - RNA, 64 nt, hsa
agaaaaugaggauauauucuugcagacgagcuauaggucauacaugaaugucuagugagacauu

SEQ ID NO: 48430 - RNA, 64 nt, hsa
gauguuaaacgucacagcaguacuugcucaauaaaggucauauuggaaacauagucaauugcug

SEQ ID NO: 48431 - RNA, 64 nt, hsa
ugaucaucuugaugucuaugauagauaauaaacaaggucauacauaccuuacuaaacaauuuug

SEQ ID NO: 48432 - RNA, 64 nt, hsa
acaaaaaagaaaaaaaaggaaaauguuuuuaaaaaggucauauauuuuuugcuacuuuugcugu

SEQ ID NO: 48433 - RNA, 64 nt, hsa
gucaaagauuaacaaugcuauacuauagaguaauaggucauauauagccucaauugaguuuuuu

SEQ ID NO: 48434 - RNA, 64 nt, hsa
guguuuaagaaagcaagcaagucccuuagcagucaggucauaacagggcacauuucugaccgaa

SEQ ID NO: 48435 - RNA, 64 nt, hsa
ugugugaucccaccccacccccauaguuguauaaaggucauagugaagaagcugggggaagacu

SEQ ID NO: 48436 - RNA, 64 nt, hsa
caagguauuauaucagccccuugcuugaggcuugaggucauaauaucccucuaggacuuaccug

SEQ ID NO: 48437 - RNA, 64 nt, hsa
aaauuugccaucaccuuuugugugguggccuggcaggucauauacuuuuuuuuggcauauaccu

SEQ ID NO: 48438 - RNA, 64 nt, hsa
auuuacacaacaaaaugacauguucgaaugugaaaggucauaauagcuuucccaucaugaauca

SEQ ID NO: 48439 - RNA, 64 nt, hsa
gucauaaugcaggcaugaaggguggagugaagucaggucauaaguuucauguuugcuuuuguuu

SEQ ID NO: 48440 - RNA, 64 nt, hsa
acaucauccuaacuuacuuccccaagauauugagaggucauaucuguuuuucuuuaucauucau

SEQ ID NO: 48441 - RNA, 64 nt, hsa
aaagugaugaccuuacaccacaaccagcuucuccaggucauaugugccuuaccuccagagaguc

SEQ ID NO: 48442 - RNA, 64 nt, hsa
ggugaacaugccaucaguaaaagcccuggaaacaaggucauacuagagauugguugugccuugu

SEQ ID NO: 48443 - RNA, 64 nt, hsa
ugcuccccugcucccuguuguguuagggauguuuaggucauacuaggagcaauuaggagccaua

SEQ ID NO: 48444 - RNA, 64 nt, hsa
cuuagaauccacguauuccccuucccacuagccuaggucauaaagaggcguugcuuucacucuc

SEQ ID NO: 48445 - RNA, 64 nt, hsa
ugagaaucaguggaaaauaaggguauaauuuuguaggucauaugauugaagaaaauauuauuuu

SEQ ID NO: 48446 - RNA, 64 nt, hsa
aaaaacccaucuucauuccuuuuuauggggcuccaggucauaaggaugagauauauuuggggua

SEQ ID NO: 48447 - RNA, 64 nt, hsa
aauacugugguugugguuguaaguagcuaagaugaggucauacuggagcagggcaggcccuuaa

SEQ ID NO: 48448 - RNA, 64 nt, hsa
guucacuggagagaaaagguaguguuuuuguacaaggucauaccgccagaagccccaaauccua

SEQ ID NO: 48449 - RNA, 64 nt, hsa
gcccgugggcagggcuguggucagccaagaauagaggucauauaguugggccauggggcaauug

SEQ ID NO: 48450 - RNA, 64 nt, hsa
uucaugaaagcuauagauccuuuuuuguucucugaggucauaauuuccucggagaccuguuuaa

SEQ ID NO: 48451 - RNA, 64 nt, hsa
acucugugcuacacaggaguggauccaggccugaaggucauacaauucuggggacucucuuuaa

SEQ ID NO: 48452 - RNA, 64 nt, hsa
ugacacuggcuaugugcuccacaguuucagucccaggucauacucuccaacaguuuucagagcu

SEQ ID NO: 48453 - RNA, 64 nt, hsa
cuccgugcagcccuugggaacagugagagguugaaggucauaacgagagugggaacucaaccca

SEQ ID NO: 48454 - RNA, 64 nt, hsa
gcuuucagaucagguauucugcacauucauuccaaggucauagauuuuuaaaaggaccuggauu

SEQ ID NO: 48455 - RNA, 64 nt, hsa
ccagacaccgacacccugaggacguguggagcuaaggucauaucaucugaccaggucuggaggc

SEQ ID NO: 48456 - RNA, 64 nt, hsa
acugugggacugagaguccuauuccccuaguaauaggucauauuccccuaguaauaugaguucu

SEQ ID NO: 48457 - RNA, 64 nt, hsa
gcaccauccaucauuauguagaugaaaaagccauaggucauagccucuuugcuauucuauugga

SEQ ID NO: 48458 - RNA, 64 nt, hsa
ccgaggugcucagaaaggcucgguaaugagucccaggucauacggcuagcgaguggcgggccug

SEQ ID NO: 48459 - RNA, 64 nt, hsa
caggugggaucggcacucagggggucuggaaagaaggucauaagggagcaugauaggauuuggg

SEQ ID NO: 48460 - RNA, 64 nt, hsa
ucaagauaaggaagcaacacugauacugagagagaggucauauguccaauaguugccuuucuuc

SEQ ID NO: 48461 - RNA, 64 nt, hsa
augggaacgcaaggcagcaacucucuaauuaaccaggucauaaaaacgauucgucuucuaugua

SEQ ID NO: 48462 - RNA, 64 nt, hsa
gugcuuuagcaucuaugccacaugcguugauggaaggucauagcacccacucacuuagaugcua

SEQ ID NO: 48463 - RNA, 64 nt, hsa
ucaaacaaaacuaaguugugaaggaagggagggaaggucauagccuucuuaagcagagguguuc

SEQ ID NO: 48464 - RNA, 64 nt, hsa
guuaauacuaagauguucaaacuuagacaugauuaggucauacauucucagggguucaaauuuc

SEQ ID NO: 48465 - RNA, 64 nt, hsa
agagauauuuauguacucucuaagaagacaaaugaggucauaaacacugcauaaagcaaggcaa

SEQ ID NO: 48466 - RNA, 64 nt, hsa
aucaaaauauguugucacagaaagaauagguggaaggucauagccuggaacccaaguuugaaaa

SEQ ID NO: 48467 - RNA, 64 nt, hsa
ucugucaaucucuagaaaccacaagaugauggagaggucauaaaaacugugguaguaugcuuag

SEQ ID NO: 48468 - RNA, 64 nt, hsa
agggcugagguuuuaagccagggcuggagggcaaaggucauaaccucaccagccaccucugagg

SEQ ID NO: 48469 - RNA, 64 nt, hsa
aacacggggacucugccguaacuggaaucuucauaggucauauugaaaucuucaaggugaccau

SEQ ID NO: 48470 - RNA, 64 nt, hsa
cucaguaaauguacaacugcaccugucaucauggaggucauacaugcauacaaagagguguaca

SEQ ID NO: 48471 - RNA, 64 nt, hsa
auggagggucccagaaaagggaaggaggagccccaggucauacagggcagagucagaacuaaac

SEQ ID NO: 48472 - RNA, 64 nt, hsa
ggcguacgcuuaccagcgacucuauagucucucuaggucauagcuuucauguccauugaagaau

SEQ ID NO: 48473 - RNA, 64 nt, hsa
agaaaggaguuugccaagaagugaucuguuuuaaaggucauauuuggagaaagggcaaggaauu

SEQ ID NO: 48474 - RNA, 64 nt, hsa
ccuccgcucagagaugcugcuucauuuacccaggaggucauauucuuuauauauauuuuuuguu

SEQ ID NO: 48475 - RNA, 64 nt, hsa
ucuuacaacugacugacuuagcaggaauuuaauuaggucauauuuggugaugagacuuauggag

SEQ ID NO: 48476 - RNA, 64 nt, hsa
agacucucuagcuccaucuccccugugccacccuaggucauaugaccuuggccaccuuggagua

SEQ ID NO: 48477 - RNA, 64 nt, hsa
uacuguuaaaggaaaaaaaagaggggggaagaucaggucauacuaucuacucuccucaucucua

SEQ ID NO: 48478 - RNA, 64 nt, hsa
agaaaugauccauuugcuguuucuuguuuuccaaaggucauacauuguguuugguuauuguuac

SEQ ID NO: 48479 - RNA, 64 nt, hsa
cuugccaggcuuccuuauuccuuacuaugggaagaggucauaucccuucccugccccucgcugu

SEQ ID NO: 48480 - RNA, 64 nt, hsa
gcuggggcucuguaaugaauuaguuuaaaagccaaggucauaacaugaauugauggucaauuuc

SEQ ID NO: 48481 - RNA, 64 nt, hsa
caccaauucugaaggcacuuuauguacuacauggaggucauaucugguuuuguuuuuauuuuuu

SEQ ID NO: 48482 - RNA, 64 nt, hsa
acauccuaaaauggugaaguugccaugacaauaaaggucauagaaccugguagugucaaauuua

SEQ ID NO: 48483 - RNA, 64 nt, hsa
cuagaguagcuuaaaaaguugucauaguuucaguaggucauagggagaugaguuuguaugcugu

SEQ ID NO: 48484 - RNA, 64 nt, hsa
ucucucaaagagcaucccuuucuauacauaagagaggucauacaggugagagacaccaaguaua

SEQ ID NO: 48485 - RNA, 64 nt, hsa
ucacaggaugagacaggagguccguacaagauacaggucauaaagacuuugcugauaaaacaga

SEQ ID NO: 48486 - RNA, 64 nt, hsa
auacaugagaaauguaccuugcagcugaauggcuaggucauauggugaucuaguauguaacugg

SEQ ID NO: 48487 - RNA, 64 nt, hsa
gucuuuguccuuuuucuugcacuauaaaauuauaaggucauaaauguuuugguacuuguagaug

SEQ ID NO: 48488 - RNA, 64 nt, hsa
aggaagcagaagacgggaggggaggcauugacauaggucauaaagcauuggaguuucaaauccc

SEQ ID NO: 48489 - RNA, 64 nt, hsa
aucuaaauuuagugcaauaucuugucuuuuguauaggucauaugaauucauaaaauuauuuaug

SEQ ID NO: 48490 - RNA, 64 nt, hsa
cucaucaauagaucgcccuuaaagacccauuguaaggucauaaaaaaccucggccaccugcaca

SEQ ID NO: 48491 - RNA, 64 nt, hsa
cccaaaggcccaaagagggccguggggccugaggaggucauaaucucuucugagugggggcagg

SEQ ID NO: 48492 - RNA, 64 nt, hsa
cucccagcuccuauuaggcccggggugggaccagaggucauaggugcccaacggcagccaaacc

SEQ ID NO: 48493 - RNA, 64 nt, hsa
uuuucuuuuugggggugaaauuggcagaugccugaggucauagcuguguccugggucacugugg

SEQ ID NO: 48494 - RNA, 64 nt, hsa
ugaauuuuaaacuggugaacuaaaggaaaucuugaggucauauacugaaauaugaauaaauuaa

SEQ ID NO: 48495 - RNA, 64 nt, hsa
agcuuucaguauuagugaugucaucugucacuauaggucauacaauccauucuuaaaguacuug

SEQ ID NO: 48496 - RNA, 64 nt, hsa
aaauuuucaaagauuaaaacuauuauacauauacaggucauauaaaauuaccuggauucacuaa

SEQ ID NO: 48497 - RNA, 64 nt, hsa
ucaccaauggugaguaaagauacagcucuuuuaaaggucauaaggauaauauauuuuccccauc

SEQ ID NO: 48498 - RNA, 64 nt, hsa
ucucuucagaaaacaauacugcugaccaucaagcaggucauaaacagaaacaucagaagagaaa

SEQ ID NO: 48499 - RNA, 64 nt, hsa
augaguugaaaaaaaauugaaauaaacuauaucauauuacuaggacuuaauauaguggcauacc

SEQ ID NO: 48500 - RNA, 64 nt, hsa
aagacuagccaaaggacuuuauaauacaauauuauauuacuaaagaaugaguuaaguuugagau

SEQ ID NO: 48501 - RNA, 64 nt, hsa
acucuccacacuucuguggcucagugauuacugcuauuacuauauuuacuugcauaugucagaa

SEQ ID NO: 48502 - RNA, 64 nt, hsa
cacagcccucuguagugguugaaucauuuuacacuauuacuacauuaugggaagauuccaguug

SEQ ID NO: 48503 - RNA, 64 nt, hsa
uugcuaguacuaguacuauugcuauuacuaguacuauuacuaguacuaguacuaugacacuguu

SEQ ID NO: 48504 - RNA, 64 nt, hsa
auaauaguacuauugcuaguacuaguacuauugcuauuacuaguacuauuacuaguacuaguac

SEQ ID NO: 48505 - RNA, 64 nt, hsa
uuaguauuauuaacacuaauaauaguacuauuacuauuacuauuuuuauuuuaaaauaaaauuu

SEQ ID NO: 48506 - RNA, 64 nt, hsa
uaacuauuaguauuauuaacacuaauaauaguacuauuacuauuacuauuuuuauuuuaaaaua

SEQ ID NO: 48507 - RNA, 64 nt, hsa
aauuuaaaagaaaucucuuaccaaccuacauauuuauuacuauaauuugcuaugacuucagguu

SEQ ID NO: 48508 - RNA, 64 nt, hsa
auguaaaauaaaugugacauuuuuauaauuuauuuauuacuaaucaaagaguuuuuuaucuuuu

SEQ ID NO: 48509 - RNA, 64 nt, hsa
agcuagagcaauguaggcuuuuuuuaauuuaaauuauuacuacacuuuauuacuacacuugcag

SEQ ID NO: 48510 - RNA, 64 nt, hsa
uaggcuuuuuuuaauuuaaauuauuacuacacuuuauuacuacacuugcagaaaagaaacaugu

SEQ ID NO: 48511 - RNA, 64 nt, hsa
cugggcugagguuggagaaggggcagccgggggcacugcugaggguuugccgugcacgccucgg

SEQ ID NO: 48512 - RNA, 64 nt, hsa
gucauggucauuucauuccuacucuucaggagacacugcugaacagaggaaugauucuguuccu

SEQ ID NO: 48513 - RNA, 64 nt, hsa
ggcuuuuccugaguccccagacagcagaguaugaacugcugacacccagauuccauuaaaaauu

SEQ ID NO: 48514 - RNA, 64 nt, hsa
ugcccacauauucuucuugcacaccccuuccauuacugcugaauaggacauugcaugggaagag

SEQ ID NO: 48515 - RNA, 64 nt, hsa
aaaucccauugacaaauguugaugcacuguagucacugcugaguuaauagcgcuuuuuaaagac

SEQ ID NO: 48516 - RNA, 64 nt, hsa
uaaauagaaaggaaaauauauucuaguagguaagacugcugacucuuugaaaaucugagguauu

SEQ ID NO: 48517 - RNA, 64 nt, hsa
acguggaguuccucuaaccgugggccccagcagaacugcugagcuuuacaugguauccaugaca

SEQ ID NO: 48518 - RNA, 64 nt, hsa
cagaacugcugagcuuuacaugguauccaugacaacugcugauuccagugucgaggccauuucu

SEQ ID NO: 48519 - RNA, 64 nt, hsa
acauuucugcuuuuuucuagucauucaauuuaucacugcugaauugcaucagaucauggaugca

SEQ ID NO: 48520 - RNA, 64 nt, hsa
ugaaaaaaagaaggaaaaaagaauaagaaugaaaacugcugacguauuacaaaacagaaaaaua

SEQ ID NO: 48521 - RNA, 64 nt, hsa
aacacuggcgagcaggugccccagcucggacuauacugcugaguucuggucuguugcugccacu

SEQ ID NO: 48522 - RNA, 64 nt, hsa
ugcauggacaucuacccagauaaacaaauuguugacugcugaauuaaugugauuuuggucucua

SEQ ID NO: 48523 - RNA, 64 nt, hsa
ucucgccuacaucccgaaucauugcaguggcaagacugcugaccuugacuucuuccgucgagug

SEQ ID NO: 48524 - RNA, 64 nt, hsa
ggauccacucccccagcuccuuuagagaauggcuacugcugaguccuuugggguugagggagau

SEQ ID NO: 48525 - RNA, 64 nt, hsa
gaagagaacugcugaggaggauuuuccuaaaguuacugcugaccuugaagcauuguuaaagacu

SEQ ID NO: 48526 - RNA, 64 nt, hsa
ccaacuguaccacgggcaugaggagcugaagagaacugcugaggaggauuuuccuaaaguuacu

SEQ ID NO: 48527 - RNA, 64 nt, hsa
cagaggaccuuggguucccaauacaaaaauaccuacugcugagagggcugcugaccauuugguc

SEQ ID NO: 48528 - RNA, 64 nt, hsa
gccucagaaggacccuguugaggguccucaguccacugcugaggacacucaguguccaguugca

SEQ ID NO: 48529 - RNA, 64 nt, hsa
cucacccgugcauauguugaccuuugcaaaaugaccuggugacauggcaagucaguggggacag

SEQ ID NO: 48530 - RNA, 64 nt, hsa
gggaaaaaaagaaauuuuacuuucucucaccuuaccuggugauaaguuccaaauauguuaaggg

SEQ ID NO: 48531 - RNA, 64 nt, hsa
cagcagcugaacauuccuggugagcaaagguuucccuggugaauuuuucaccacugcguuuuag

SEQ ID NO: 48532 - RNA, 64 nt, hsa
guggcucuagaucacuguucagcagcugaacauuccuggugagcaaagguuucccuggugaauu

SEQ ID NO: 48533 - RNA, 64 nt, hsa
caggaaacuuaauucccuggugacuagagcuuugccuggugaugaggaguauuuuguggcauaa

SEQ ID NO: 48534 - RNA, 64 nt, hsa
ggugggggcugucuguguccaggaaacuuaauucccuggugacuagagcuuugccuggugauga

SEQ ID NO: 48535 - RNA, 64 nt, hsa
ggaaggagagaaugauuuugcugacuucccaagcccuggugaccagaccaaggcagggcccagc

SEQ ID NO: 48536 - RNA, 64 nt, hsa
cucccuucaggcccgcugcccuaggauaugcccuccuggugacucgggggcugucucagacgac

SEQ ID NO: 48537 - RNA, 64 nt, hsa
ugagaguaauucaucugugaaucugcuuuaauuaccuggugaguaacuuagaaaagugguguaa

SEQ ID NO: 48538 - RNA, 64 nt, hsa
cuuacugacaccagggguccgcugccccauguguccuggugagaaaauauaugccuggcacagc

SEQ ID NO: 48539 - RNA, 64 nt, hsa
ccugguagaggggccggcuguuuccugacagaugccuggugagcaggggaagcaggacccagug

SEQ ID NO: 48540 - RNA, 64 nt, hsa
agccccaggccagcugcggccaggccugcgggccccuggugaugggguuacguggggugcggga

SEQ ID NO: 48541 - RNA, 64 nt, hsa
guuuuagaaaaugaggccuguuuggggaagguacccuggugauguuuuugcuagacauuagcug

SEQ ID NO: 48542 - RNA, 64 nt, hsa
ugagcagaggagggagggggagaaagggaggaagccuggugauuguggcaaagacuccuguccc

SEQ ID NO: 48543 - RNA, 64 nt, hsa
aggccauggcguugccagccucccugugacagagccuggugaacagugagccuggcucccacgc

SEQ ID NO: 48544 - RNA, 64 nt, hsa
cauaggagcgaacacugcugcucucucgcuggccccuggugaggacaggaagccugaacccggg

SEQ ID NO: 48545 - RNA, 64 nt, hsa
caggauguuaauggagcuggaaguucagaaaaagccuggugaagugacccuuggccuuucacuu

SEQ ID NO: 48546 - RNA, 64 nt, hsa
cuguuccuacugaaggccuagcaccugcucuuggccuggugagccccuccaccuuccaggcuua

SEQ ID NO: 48547 - RNA, 64 nt, hsa
gaauacguuagaaaaugacagaugguagagacuuccauagaauuaagaggguucucauggaggg

SEQ ID NO: 48548 - RNA, 64 nt, hsa
agucaccauucaagcuccuuccccaaaguguguuccauagaacacugggaccaugagaugcucu

SEQ ID NO: 48549 - RNA, 64 nt, hsa
guaagugacuaaccaagauuauuucauuuuaaaaccauagaauaaaaaugacaccugagcuucu

SEQ ID NO: 48550 - RNA, 64 nt, hsa
ugcuaaaacaugaugauuaagugcacaccgugugccauagaauggcacaugucauugcccacuu

SEQ ID NO: 48551 - RNA, 64 nt, hsa
ccacugagcaccuugugacccccgccccugccugccauagaacaacccccuuugauuguaauuu

SEQ ID NO: 48552 - RNA, 64 nt, hsa
cuguuauuuuuaggcauaagaugacuuaggaggcccauagaaacauucucguuuaaacaacaac

SEQ ID NO: 48553 - RNA, 64 nt, hsa
cgugaaagguuaguugagacugaaguguucacuuccauagaagaacaucacuuuuaaccuugcu

SEQ ID NO: 48554 - RNA, 64 nt, hsa
guuuuaaaggaugaacauuggauuucaugccaucccauagaaaaccuguuuuaaaauuuuaggg

SEQ ID NO: 48555 - RNA, 64 nt, hsa
cauaguuuuauccagggagaaaaauaaaaggaagccauagaauugcucuggucaaaaccaagca

SEQ ID NO: 48556 - RNA, 64 nt, hsa
ucucaugauggaaaaucagccaaggacuaagcuuccauagaaauacacuuuguaucuggaccuc

SEQ ID NO: 48557 - RNA, 64 nt, hsa
augccagccauuuuauaugaugaagucucuuauuccauagaaaacuguagaaagauaucuguau

SEQ ID NO: 48558 - RNA, 64 nt, hsa
agggucgcuuaaggaaucugccccacagcuucccccauagaaggauuucaugagcagaucagga

SEQ ID NO: 48559 - RNA, 64 nt, hsa
gggauagggaagauagcaggaagaaaaguaaacuccauagaagugucauuccacuggguuuuga

SEQ ID NO: 48560 - RNA, 64 nt, hsa
gaggagcuuaaaacucaaccacucuggaauuuacccauagaagacgggaagaaagagguaugaa

SEQ ID NO: 48561 - RNA, 64 nt, hsa
aggauggggcauaaugugacuguaaaggggccugccauagaaaagucacaugccugagggagac

SEQ ID NO: 48562 - RNA, 64 nt, hsa
ggaaagugagaugaauuaagacaaagaacaggugccauagaaguagauuucuaggaaugaagug

SEQ ID NO: 48563 - RNA, 64 nt, hsa
uacaagguugaaucugaggaaaauaauccuugugccauagaaguauuuacgaaauugcauuuca

SEQ ID NO: 48564 - RNA, 64 nt, hsa
uaugccuaccccuggccagucugaggucuccuagccauagaacugacuccuggaagccuggaga

SEQ ID NO: 48565 - RNA, 64 nt, hsa
cuuugaaacaggccucaucccacuuccaccagcaccauagaagaauaauucugggcagaagucu

SEQ ID NO: 48566 - RNA, 64 nt, hsa
acauuuuuggguuaaaaaauguaauuuaaagccaccauagaaaguauuuucugauuuacugucc

SEQ ID NO: 48567 - RNA, 64 nt, hsa
uccugacauccuccccagcucaagucuauucuuaccauagaacccagggcagggagagaagaac

SEQ ID NO: 48568 - RNA, 64 nt, hsa
uucaguauggguggagcaugguacagucuuggugccauagaaggaguaguugcauagucacaca

SEQ ID NO: 48569 - RNA, 64 nt, hsa
aacaaacuggaaaggaaacuucacacgucaaaauccauagaagcgccuggacgaggcuuaaagu

SEQ ID NO: 48570 - RNA, 64 nt, hsa
uccgugcuuugccucacucguaguaaaugaccauccauagaauaugugaaucuuuggugagcuu

SEQ ID NO: 48571 - RNA, 64 nt, hsa
cuauccugucccuggaucugaggccuuucccuugccauagaaaugguugcugguagcaguagag

SEQ ID NO: 48572 - RNA, 64 nt, hsa
agcuuaauaaauauugguaauugauguaauaaaaccauagaacuaugaaaauaucaagauuauu

SEQ ID NO: 48573 - RNA, 64 nt, hsa
aucugcaaucugggagcuuaagagcaaaugaugaccauagaaagcuauguucuuacuuugugug

SEQ ID NO: 48574 - RNA, 64 nt, hsa
uuuguacuaagcugugccugccuuguugugauccccauagaaacauaauaaauauacaaguugu

SEQ ID NO: 48575 - RNA, 64 nt, hsa
augcucccuccucuaucucucucuguguaauuuaccauagaauuaggaugauuagauugaaaca

SEQ ID NO: 48576 - RNA, 64 nt, hsa
uuaggggcuugguaguuuggaaaguucuuaggcaccauagaagaacagcagauggcggugauca

SEQ ID NO: 48577 - RNA, 64 nt, hsa
uuugaaagcuaugagaauagaugugugggugaagccauagaacauauuugcuugaaauucuuga

SEQ ID NO: 48578 - RNA, 64 nt, hsa
uagcuugaaaucugcggcaauuggaguauuuacaccauagaaaugcuauaagugaagaccuacc

SEQ ID NO: 48579 - RNA, 64 nt, hsa
agcguuguuggaauucaaaaaacagacaauauugccauagaaaugugugaagaauuugcauuac

SEQ ID NO: 48580 - RNA, 64 nt, hsa
aucccauucuaguuuucagaauaggaccagaugcccauagaagcacaguacagacugaaguaaa

SEQ ID NO: 48581 - RNA, 64 nt, hsa
uuauaaaugucugugcacuauauuaauuagaagaccauagaacaugccagcagguuggcuaaug

SEQ ID NO: 48582 - RNA, 64 nt, hsa
ccagcauuacagaaccuugguuauuguuuuuuagccauagaaucuucuaguaaaaaauaucugc

SEQ ID NO: 48583 - RNA, 64 nt, hsa
uuucauauaacauauauauuuauuuauuucccccccauagaaggcaaaauggcuuucagcaaug

SEQ ID NO: 48584 - RNA, 64 nt, hsa
ccaaacuuguucauuuagauaauuugaaaaaguuccauagaaaaggcgugcaguacuaagggaa

SEQ ID NO: 48585 - RNA, 64 nt, hsa
ugguaauauucugugugaugggauaugaaaugguccauagaaaaaaaccggaaaaauacgccaa

SEQ ID NO: 48586 - RNA, 64 nt, hsa
ucugauuugcacaauuuguugaaaaaucacaaacccauagaaaaguaaguaggcuaaguugggg

SEQ ID NO: 48587 - RNA, 64 nt, hsa
caauaugacagagcacccacugcccaagacucagccauagaagaugccgccccaccuucuacuu

SEQ ID NO: 48588 - RNA, 64 nt, hsa
aagaugaauauaagaauucauccuagauauaaaaccauagaaauguaaaagaugugacaaaacc

SEQ ID NO: 48589 - RNA, 64 nt, hsa
uaaaguuacuacuggugucuaugcaaauuggauuccauagaaguuuuagcuauguuauuuacaa

SEQ ID NO: 48590 - RNA, 64 nt, hsa
aauaacuuucuuaccauuaacauuuuuuacccuuccauagaagggagggaauaaaucaugacuu

SEQ ID NO: 48591 - RNA, 64 nt, hsa
cucuuugguacuauaugccauggaugugaauuucccauagaagcuggugacauguuccuggaag

SEQ ID NO: 48592 - RNA, 64 nt, hsa
guauuuuaaauaauuaaaacauuaaauggcaacaccauagaauauagguguucucuggaccuau

SEQ ID NO: 48593 - RNA, 64 nt, hsa
ugauuauaugacaauccugaagaaaccacagguuccauagaacuaauauccugucucucucucu

SEQ ID NO: 48594 - RNA, 64 nt, hsa
ugagaaaucauucuuggcugucuuucuagguauuccauagaaucaacacauuuuaaggcugaaa

SEQ ID NO: 48595 - RNA, 64 nt, hsa
uaagccuuaagucuuuuuuuuuuccuaaaaauucccauagaauaaaauucucucuaguuuacuu

SEQ ID NO: 48596 - RNA, 64 nt, hsa
gggguucccagcauugugggugcuacuugcaaggccauagaaucuagauggcccugucuugacc

SEQ ID NO: 48597 - RNA, 64 nt, hsa
auuaaugcaugguuauuuggaccagaaaaaagugccauagaagaccaauaacuguuuaguugag

SEQ ID NO: 48598 - RNA, 64 nt, hsa
auauauuugagcccauacaguguauuagguugaaccauagaaacugcuauucucguaggucaaa

SEQ ID NO: 48599 - RNA, 64 nt, hsa
auggaccaaugaggugguaucaaugaauauaguuccauagaacauuuuccagaaguucuucugu

SEQ ID NO: 48600 - RNA, 64 nt, hsa
uggaauuuauauucaccaauuucaggaaaaccaaccauagaacuuuauaauaggacaguuauaa

SEQ ID NO: 48601 - RNA, 64 nt, hsa
ucaauguucauuaaaaauauccaagauuuaaaugccauagaaauguagguccucagaaagugua

SEQ ID NO: 48602 - RNA, 64 nt, hsa
ucaaggaagaauaauuuuaacagacauguauacuccauagaaacuaaacuaaaauaguuuaaaa

SEQ ID NO: 48603 - RNA, 64 nt, hsa
ugauuaucauaugauaccucagugauuuuaaaagccauagaagaaacuugacuaugccugguca

SEQ ID NO: 48604 - RNA, 64 nt, hsa
ggacagacggaaaugaaauugucaaaauuguuuaccauagaaagaugacaaaagaaaauuuucc

SEQ ID NO: 48605 - RNA, 64 nt, hsa
acuuaauuuagaggaagaaaaaaaaucaacccauccauagaaauaguuugauaaacaggucacu

SEQ ID NO: 48606 - RNA, 64 nt, hsa
gacugucauauuguagagacuuugguaugugauaccauagaauacugauuggauagccauccua

SEQ ID NO: 48607 - RNA, 64 nt, hsa
gacugcaguuucggaaguuugaucugagaaccaaccauagaauguuucaguucuaggaaauaaa

SEQ ID NO: 48608 - RNA, 55 nt, hsa
acaaggccaaaggcaaauaaugucuccauagaaucacuuuccaauacaacggcuc

SEQ ID NO: 48609 - RNA, 64 nt, hsa
cucugcaauccauauauauccuggucuugggaguccauagaauacuguuuccuucuaauaaagg

SEQ ID NO: 48610 - RNA, 64 nt, hsa
cuacuggaagcuagaaagaaauaggaauuuaaguccauagaaugaagguaguuauuccugccug

SEQ ID NO: 48611 - RNA, 64 nt, hsa
aauucuccccacuugauuuuucuucuauaaaaucccauagaacaauguuuaugcuauagccauu

SEQ ID NO: 48612 - RNA, 64 nt, hsa
guucagaaaaaaagccccugaacugauuuuguuaccauagaauuuaaaaaaaaaaaaagcuuua

SEQ ID NO: 48613 - RNA, 64 nt, hsa
gcugggauuacagacgugagccaccacucccggcccauagaagguuuuuugcuggauaauuugu

SEQ ID NO: 48614 - RNA, 64 nt, hsa
gccugaugggaauuagugcagagaagccaugucaccauagaaggcaacuccuacuugugugugg

SEQ ID NO: 48615 - RNA, 64 nt, hsa
uacguagacuccaaaauguacacaggcucaaauaccauagaaauuuuuguucgagagccaaagg

SEQ ID NO: 48616 - RNA, 64 nt, hsa
ucuauauaagcagucuugcaauaacuaaucaccaccauagaagaaagaaacagacugcaaggaa

SEQ ID NO: 48617 - RNA, 64 nt, hsa
uguucucuuuacucuucucacagaucagaucacuccauagaagccuguggguuucgaugguuuc

SEQ ID NO: 48618 - RNA, 64 nt, hsa
ccauagugcccacaggguauuccucacauuuucuccauagaagaugcuuuuucccaaggcuaga

SEQ ID NO: 48619 - RNA, 64 nt, hsa
ccacuuaguuuuuucuuauucccaccuuucuaucccauagaacacucuuuuuuaucuucccuga

SEQ ID NO: 48620 - RNA, 64 nt, hsa
aauuaguagaaucaugcucucuaaauuuauucugccauagaagguagaaauauuuuuaagcucc

SEQ ID NO: 48621 - RNA, 64 nt, hsa
cuuguauuacccacaggaaugagggcagcuaaacccauagaaggaguuggaccaaggcgaauua

SEQ ID NO: 48622 - RNA, 64 nt, hsa
aggcagaacugaggucucaaguuugcacucuuggccauagaacuaaaaaugaaaccugagauug

SEQ ID NO: 48623 - RNA, 64 nt, hsa
ccacuuaguuuuuugucauucccaccuuucuaucccauagaacacucuuuuuuaucuucccuga

SEQ ID NO: 48624 - RNA, 64 nt, hsa
acugugagcucuaacagaccgauuugcacccaugccauagaaacugaggccauuauuucaaccg

SEQ ID NO: 48625 - RNA, 64 nt, hsa
agucccaaagcugugaccucugugccacuguuguccauagaagagcaucgacugugucacuuaa

SEQ ID NO: 48626 - RNA, 64 nt, hsa
auauaaacaucacacuuuaauuuggagcauaguaccauagaaauuugggguucuaaauauacaa

SEQ ID NO: 48627 - RNA, 64 nt, hsa
uuuaaaaaaagggucagacuuuuaaacacucugaccauagaaauguuuuucaaaauggcaacaa

SEQ ID NO: 48628 - RNA, 64 nt, hsa
gauuucuaggcuaguuacuugagauaugaauuuuccauagaauaugcacugauacaauauuacc

SEQ ID NO: 48629 - RNA, 64 nt, hsa
cguaccagguguuuacagauuuaaaugcauguuaccauagaaacuauuaaaguaacuagaacug

SEQ ID NO: 48630 - RNA, 64 nt, hsa
ugagaaacuuguaaccuaugugccucaauauauuccauagaaaguaggucccccugccuucucc

SEQ ID NO: 48631 - RNA, 64 nt, hsa
uuaacauaagccucaccuuucauuuuaaagguuuccauagaauuuaguuauuuuaucuuucagc

SEQ ID NO: 48632 - RNA, 64 nt, hsa
aaucaaucaaucagcauauacauuucagccaaagccauagaagaaaaagcaauaguugcuugaa

SEQ ID NO: 48633 - RNA, 64 nt, hsa
uaaauaaucccaaauagaccagaauuggcccauaccauagaagaaagaauuggcagucaaaaaa

SEQ ID NO: 48634 - RNA, 64 nt, hsa
gugcaguuacuuauauauuaaauaucuauuguauccauagaauaggcagcauuauuucaaacau

SEQ ID NO: 48635 - RNA, 64 nt, hsa
uguauaacaagccaaacauucuuauuuuagacaaccauagaacugucccacaaaauauuucuaa

SEQ ID NO: 48636 - RNA, 64 nt, hsa
aggaaacccaagaggcugagaauucuuuugucuaccauagaauuauuauccagacuggaauuuu

SEQ ID NO: 48637 - RNA, 64 nt, hsa
cuccugaucugaaugaauuugucucuuaaugcauccauagaaaaguguuaauuguggguucaaa

SEQ ID NO: 48638 - RNA, 64 nt, hsa
gggaucgaaagccugaaauaaauauucauacuuuccauagaacugagcacuugguugcuauuua

SEQ ID NO: 48639 - RNA, 64 nt, hsa
aaauagaacauacugaaaauaaucuaaguuccaaccauagaagaagcugcagaagaaaugaaga

SEQ ID NO: 48640 - RNA, 64 nt, hsa
aagauuuuuaaagcuuuuauguuauaccauggagccauagaaaggcuauggauuguuuaagaac

SEQ ID NO: 48641 - RNA, 64 nt, hsa
gugacgggaagauggaagggcaugaugaacucugccauagaaaacuuccuccagccugaagaga

SEQ ID NO: 48642 - RNA, 64 nt, hsa
ucccagggcagagccucuccuuguacuuuggcagccauagaaagcgugcucauuuucuguuuuc

SEQ ID NO: 48643 - RNA, 64 nt, hsa
caccuauuuauucacaggaucugugaauauugcuccauagaaaacaaauuguuaugauugagug

SEQ ID NO: 48644 - RNA, 64 nt, hsa
aauaccagcaauucauaaaaacugcuuacuuaugccauagaaaauuaaacacaaaguguauaca

SEQ ID NO: 48645 - RNA, 64 nt, hsa
aacauaagcuaaaucauauuaguauuaauacuacccauagaaaacuugacauguagcuucuucu

SEQ ID NO: 48646 - RNA, 64 nt, hsa
uuuaacugggauaaauguuuuuguaaaaauacaaccauagaaaggccucuuuguuacaaaauga

SEQ ID NO: 48647 - RNA, 64 nt, hsa
ugcuuuccuucuccucaugcccaagagaucugugccauagaacaagauaccaggcacuuaaagc

SEQ ID NO: 48648 - RNA, 64 nt, hsa
gagcugccucgggcuggguugcuuggucauagagccauagaaggaagcugucagcccggagugc

SEQ ID NO: 48649 - RNA, 64 nt, hsa
agccaacauuaguaaaaggaaucccaacuucuucccauagaauuagaaacaugugaaaguacaa

SEQ ID NO: 48650 - RNA, 64 nt, hsa
ccuggccaaagauaggaggaagaaagagaacucuccauagaauguaauuuauagaugcguguau

SEQ ID NO: 48651 - RNA, 64 nt, hsa
ggaggcaugccucugauaugggacugagccuggcccauagaaacaugacacugaccuuggagag

SEQ ID NO: 48652 - RNA, 64 nt, hsa
cuccuacccccugcggcacacuuaucuucaaauaccauagaauucuaaucucuggaggcuggca

SEQ ID NO: 48653 - RNA, 64 nt, hsa
ccccucccuuuuuccuucuccugcuuuucuuuccccauagaaaguaccuugaaguagcacagcc

SEQ ID NO: 48654 - RNA, 64 nt, hsa
gacugagcugcugggggacaugugagccucaaauccauagaaagacaaacggccaccuugggug

SEQ ID NO: 48655 - RNA, 64 nt, hsa
cuuuuauuaauaacacuacuaaauuuugguuccuccauagaauuaguuuugaaacacuugaugu

SEQ ID NO: 48656 - RNA, 64 nt, hsa
uuuucauaauguaucccagaauuuuaaaucuugaccauagaaaaauacagucauucauuggcaa

SEQ ID NO: 48657 - RNA, 64 nt, hsa
auacuuuagauuuuaaauuauuaaagucaaaaauccauagaaaaguaucccuuuuuuuuuuuuu

SEQ ID NO: 48658 - RNA, 64 nt, hsa
agacauguugaugcuagccacaauuuggauuucuccauagaauaaucauuuauuuuugcagauc

SEQ ID NO: 48659 - RNA, 64 nt, hsa
ucaagaaguagcuaaugguuucaucugaaagcugccauagaaauucugugaaccagaaugagac

SEQ ID NO: 48660 - RNA, 64 nt, hsa
uguuauuuuucuauaucugaaauaaaugcuucuaccauagaaauaaauuugccuauacuaucug

SEQ ID NO: 48661 - RNA, 64 nt, hsa
gcuuggcccucuuuccucuguggcaaagcgugucccauagaaaauuggguguguauacuuguau

SEQ ID NO: 48662 - RNA, 64 nt, hsa
uaauaagcucuucuuauucauguguaagggagguccauagaauuuagguggucugucaacuauu

SEQ ID NO: 48663 - RNA, 64 nt, hsa
cugaagaaagcaccaagucuuaauggaacaaagaccauagaaugaauuauuuuaucuccuccca

SEQ ID NO: 48664 - RNA, 64 nt, hsa
uagugaaaauaauuagacauuuuaagaaccagagccauagaauuauuuuaaauuaguagaaaag

SEQ ID NO: 48665 - RNA, 64 nt, hsa
ccuauuuauucccuaauguaccugaacacuaguaccauagaacugaaccaccaucuguaucagc

SEQ ID NO: 48666 - RNA, 64 nt, hsa
gguugaagaagcuaucuuugucuauuugggcuaaccauagaauuucauuuauuuuccucacaau

SEQ ID NO: 48667 - RNA, 64 nt, hsa
gacugucagauuucuuagacuccacaggaccaaaccauagaacaauuucacugcaaacaugcau

SEQ ID NO: 48668 - RNA, 64 nt, hsa
gauguuuuauuuucugauguacaaagcuugauuaccauagaaaaccaugauuuucaggguuaau

SEQ ID NO: 48669 - RNA, 64 nt, hsa
uaucauuguuuucuugucccaaacuuauccagggccauagaaguaugaaucuaauuaaaacaga

SEQ ID NO: 48670 - RNA, 64 nt, hsa
gaaaugagguaaaguacuucaguuccucaaugugccauagaaagaugggguuguuuuccaaagu

SEQ ID NO: 48671 - RNA, 64 nt, hsa
augaagcucaugagcuccucaaauaagguauuugccauagaacuaaauauucugguggucuguc

SEQ ID NO: 48672 - RNA, 64 nt, hsa
cucuuugaagaaauugcugaaaggaaguaaaaccccauagaagaaacaugggaauacagaauau

SEQ ID NO: 48673 - RNA, 64 nt, hsa
uaggaaaaugcacauauuccaugaauuuuaagacccauagaaaaguugaagaaugcuuaauuuu

SEQ ID NO: 48674 - RNA, 64 nt, hsa
aguggaaugagugugagcaucgggcuuugcagucccauagaacagaaaugggaugcuagcgugc

SEQ ID NO: 48675 - RNA, 64 nt, hsa
ccuuggaacugaaucaguggaaagagaaugcuucccauagaaagcccgacauggugcuaguuuc

SEQ ID NO: 48676 - RNA, 64 nt, hsa
uccggggagccauaaucugcaacuucauuuucccccauagaagagaaaaaagagcaccaccauu

SEQ ID NO: 48677 - RNA, 64 nt, hsa
uuauuaagaugucuuucauguguauaugccucugccauagaauacucagucuuguggucaagag

SEQ ID NO: 48678 - RNA, 64 nt, hsa
gcuuuccagaaguaaaagucccagugauguauucccauagaaauauuuuucaguuguuuauguc

SEQ ID NO: 48679 - RNA, 64 nt, hsa
cccuccagugaguguccugcagcccuuauucccuccauagaaagcauccucagagcaccuuccc

SEQ ID NO: 48680 - RNA, 64 nt, hsa
acacaccaaacaagauguuucacuggguacucugccauagaaauggcagauuaagaagauugac

SEQ ID NO: 48681 - RNA, 64 nt, hsa
auuuuucuucaauuuugaagagaaaauggugaagccauagaaaaguuacccgagggaaaauaaa

SEQ ID NO: 48682 - RNA, 64 nt, hsa
guuaauuuuguucauauuuaucgggaugacaaauccauagaauauauucuuuuauguuaaauua

SEQ ID NO: 48683 - RNA, 64 nt, hsa
uccuuuaacacuaagguaacaugacauaaucauaccauagaagggaacacagguuaccauauug

SEQ ID NO: 48684 - RNA, 64 nt, hsa
cauugucaaccuuuucugcacaucuaguuuccuaccauagaaucccacuggaauaccacauagc

SEQ ID NO: 48685 - RNA, 64 nt, hsa
cccuuaagaauuuuauuuuuaaaggagauugaagccauagaacucauauugacacucagcuguu

SEQ ID NO: 48686 - RNA, 64 nt, hsa
guaaauagugauaugauuaacaucuuaaucacauccauagaaaaugacuuauuuccagaagaua

SEQ ID NO: 48687 - RNA, 64 nt, hsa
aagauacagaucugcacugaagacauuagacuggccauagaaaaguaagcuugaacucccaauu

SEQ ID NO: 48688 - RNA, 64 nt, hsa
ggcuggugggugacuuagucugaugguuuguggaccauagaagucuucaccucugguuugaggu

SEQ ID NO: 48689 - RNA, 64 nt, hsa
auaagcuuuuuucauaauucaggaauaaaguaguccauagaaauguuucuguuucauaucauuu

SEQ ID NO: 48690 - RNA, 64 nt, hsa
aaaaagaacacccaucguauaaggaaauccagccccauagaaaacaaucugcccaccgaccccc

SEQ ID NO: 48691 - RNA, 64 nt, hsa
uacauaugggagagacucagugagccagcaaaggccauagaaacaacaauuuauuaaauguauu

SEQ ID NO: 48692 - RNA, 64 nt, hsa
aacuucacauuauucaaguuacaaaucacuguguccauagaaaaacugugcugguauuugcugg

SEQ ID NO: 48693 - RNA, 64 nt, hsa
ugggggaggcccucugugaaugggucucuccuggccauagaaugauggaaagggaaggucagca

SEQ ID NO: 48694 - RNA, 64 nt, hsa
ugagaacacaggccccgccccuucccuuguagagccauagaaauauucuggcuuggggcagcag

SEQ ID NO: 48695 - RNA, 64 nt, hsa
cauuugauacacaagugaacuggaaagucacuucccauagaagcaaaaguacuuauuuucuacc

SEQ ID NO: 48696 - RNA, 64 nt, hsa
guacauugugagcucugguuauuuuucucuuguaccauagaaaaauguauaaaaauuaucaaaa

SEQ ID NO: 48697 - RNA, 64 nt, hsa
uucaucccuaaagaaggcuccuuucccuaaggaaccauagaagagaggaagaaaacaaagggca

SEQ ID NO: 48698 - RNA, 64 nt, hsa
aauguaaauagaggucuguaaagaaaaauaauugccauagaaaguauaauuucagugcaguaau

SEQ ID NO: 48699 - RNA, 64 nt, hsa
ucuuugcccucugggucuugacccauuaagagccccauagaacucuugauuuuuccuguccauc

SEQ ID NO: 48700 - RNA, 64 nt, hsa
agggaugguggaccacagaaggcuauaaaggccaccauagaaagcugaagagccauuuaauuga

SEQ ID NO: 48701 - RNA, 64 nt, hsa
acgugacacauauacaccauggaauacuaugcagccauagaaaaggaugaguucauauucuuca

SEQ ID NO: 48702 - RNA, 64 nt, hsa
uuuuggcagggacagacuuggacacaaaaccgauccauagaagggcuucccaaaccuuguuuug

SEQ ID NO: 48703 - RNA, 64 nt, hsa
ucgagguuguuuucuuucaagauacucuaaucagccauagaauuuaguguaaauauuuuuuuuu

SEQ ID NO: 48704 - RNA, 64 nt, hsa
ccagucuccuggcccccaggccagggucuguccaccauagaaugucuuccucuacuggggucgu

SEQ ID NO: 48705 - RNA, 64 nt, hsa
uguuucuuagugcaaaucuguagaguaaaaauguccauagaacuuuuacuuaaaaacaauccca

SEQ ID NO: 48706 - RNA, 64 nt, hsa
auggcauuuacguuucucugaugcucccuugaagccauagaauuuaggggcuuuuuuaaaaaaa

SEQ ID NO: 48707 - RNA, 64 nt, hsa
uuuguaaauacagaacauuguuuaaaagacauaaccauagaacauagcuuccuguuuguggauu

SEQ ID NO: 48708 - RNA, 64 nt, hsa
uuccacaaaaguugugauuuguccucauucuaauccauagaaggcaacauuucuaacagguuuc

SEQ ID NO: 48709 - RNA, 64 nt, hsa
gaggacuucgcuuuugcucugagugaggugggagccauagaagcuucuaagcagaagagggacu

SEQ ID NO: 48710 - RNA, 64 nt, hsa
uuuuccaugagauucucuacacaggcaagaagcuccauagaaguggcauuugaaggguguggca

SEQ ID NO: 48711 - RNA, 64 nt, hsa
ugccccugaacccaagagugauguacagucuauuccauagaaucacagaacaauccugaaccag

SEQ ID NO: 48712 - RNA, 64 nt, hsa
ucaaauacauaggagaauucacacuggagaaaagccauagaaauguaagguuugugacaaggcu

SEQ ID NO: 48713 - RNA, 64 nt, hsa
cuuggcaaucuuggcucaccuugguaacaaaaggccauagaagucuguuuuucugggucaguuu

SEQ ID NO: 48714 - RNA, 64 nt, hsa
ugucaacugaauucacacacacacaaauauaguaccauagaaaaaguuuguuuucucgaaauaa

SEQ ID NO: 48715 - RNA, 64 nt, hsa
acuaaauugugcaguuuggggcuuuucccccuuaccauagaagugcagaggaguucaguaucuc

SEQ ID NO: 48716 - RNA, 64 nt, hsa
uuuagaucuuuuaugauuuaauuauuauuguuucccauagaaguucccucccuuugaaauuaau

SEQ ID NO: 48717 - RNA, 64 nt, hsa
uaauuaguaauaaaacccagcauguacaaaaguaccauagaacagaacugcuaaauacuguaca

SEQ ID NO: 48718 - RNA, 64 nt, hsa
acagauguaggaagucaucuaccuuugauauuagccauagaacuugaacacuaacuauauccua

SEQ ID NO: 48719 - RNA, 64 nt, hsa
gacucccaccuugguagggugcugccucagggagccauagaagucggcuguguuuugagacggc

SEQ ID NO: 48720 - RNA, 64 nt, hsa
gauggcccuggccugaauccagccuccgcuguggccauagaaggaauggagaacagggcugggc

SEQ ID NO: 48721 - RNA, 64 nt, hsa
caguaucugcagccucgaccuggucacuuuauuuccauagaagacaauaagguucugggaacac

SEQ ID NO: 48722 - RNA, 64 nt, hsa
ccaccugggugccaguuacagguguuuccagagaccauagaaauguguuuuccugagaguucgu

SEQ ID NO: 48723 - RNA, 64 nt, hsa
ggucugugguccauccuccaggcauccauguccaccauagaauuugguuacuugguaagugacc

SEQ ID NO: 48724 - RNA, 64 nt, hsa
ugcuacgguuuuaaucauccagggugccauuccaccauagaagagcaauccuuuuaggaaaaaa

SEQ ID NO: 48725 - RNA, 64 nt, hsa
cagaggcaucuuuugagccauacgaauuccugacccauagaaacugcaagacaauaaauguugu

SEQ ID NO: 48726 - RNA, 64 nt, hsa
uaccucagaaaacaaguauugucagguauucucuccauagaacagcacuacccuccucucuccc

SEQ ID NO: 48727 - RNA, 64 nt, hsa
uacgucagaaaacaaguauugucagguauucucuccauagaacagcacuauccucaucucuccc

SEQ ID NO: 48728 - RNA, 64 nt, hsa
uuaucuguguuacccuguuuuucuaccuggaacuccauagaaugauguuugcaaaccaacaugu

SEQ ID NO: 48729 - RNA, 64 nt, hsa
uaccucagaaaacaaguauagucagguauucucuccauagaacagcacuaccuuccucucuccc

SEQ ID NO: 48730 - RNA, 64 nt, hsa; identical to SEQ ID NO: 48726

SEQ ID NO: 48731 - RNA, 64 nt, hsa
uaccucagaaagcaaguauagucagguauucucuccauagaacagcacuacccuccucucuccc

SEQ ID NO: 48732 - RNA, 64 nt, hsa
acaacuguacuuuuuuugaucaguuggcaugaagccauagaauuaaauuuuggcuuuagaauac

SEQ ID NO: 48733 - RNA, 64 nt, hsa
uaaagugguaacacaaccauucuggaaauguaucccauagaagcugauguuuaacauaugaaaa

SEQ ID NO: 48734 - RNA, 64 nt, hsa
cagguacuccagucuucaccccaaccucagcugauuguaguacaccugcuagcucuguugcccc

SEQ ID NO: 48735 - RNA, 64 nt, hsa
uaucuagagagcuugguuaaucuuuccauauuauuuguaguauuggucacaaaugcuguucccu

SEQ ID NO: 48736 - RNA, 64 nt, hsa
ucccucuuuccaauccugguuuccuaaccuccucuuguaguaauucucaacucaacucaaaguc

SEQ ID NO: 48737 - RNA, 64 nt, hsa
ccucauuuuccuaaauauguuuuuaaagcaauuauuguaguaauuucauuugaguuaaauuuac

SEQ ID NO: 48738 - RNA, 64 nt, hsa
uuuauaauucugcuauuuuaaaagaaauguagucuuguaguaugaaauaauuaaaaauuguuaa

SEQ ID NO: 48739 - RNA, 64 nt, hsa
aaccuuuucucauugcugaguuaaucuguuguaauuguaguauuguuuuuguaauuuaacaaua

SEQ ID NO: 48740 - RNA, 64 nt, hsa
aauacacuauuggccauguccaucacgagaguguuuguaguaauuaauuaccuuguacaggacc

SEQ ID NO: 48741 - RNA, 64 nt, hsa
agccugauuucuagaagagguuauagugugagacuuguaguauucaaguaagauaagugaccua

SEQ ID NO: 48742 - RNA, 64 nt, hsa
caaugcugauauauuucuaguucagugaaauaauuuguaguaaccuuacucugagguuuuacgg

SEQ ID NO: 48743 - RNA, 64 nt, hsa
aauuacauggaaaauacuagcaaugugaaugcuuuuguaguaaccaucuuguaguaccugugaa

SEQ ID NO: 48744 - RNA, 64 nt, hsa
uacuagcaaugugaaugcuuuuguaguaaccaucuuguaguaccugugaaaucuauaacucaga

SEQ ID NO: 48745 - RNA, 64 nt, hsa
uucugugaagucauuuuuuuucuugucauuccuuuuguaguaguugcuguuuggauaaaaguug

SEQ ID NO: 48746 - RNA, 64 nt, hsa
augccaguugcuuggcuagaauaugaucaacgacuuguaguagacucaaguuuuuaaaaaacac

SEQ ID NO: 48747 - RNA, 64 nt, hsa
acacuaugugcauuuauaauagcuauuuuauauauuguaguaucaacauuuuuaaauuaaaugu

SEQ ID NO: 48748 - RNA, 64 nt, hsa
agagagcuuaagugaaggcaguuuuuauggcguuuuguaguaaauucuguaaaauacuuugguu

SEQ ID NO: 48749 - RNA, 64 nt, hsa
acucacucuccuuauuacacaagcacagccgcccagugugcacaucaugugcagacaccuugga

SEQ ID NO: 48750 - RNA, 64 nt, hsa
cacccuagaccccucuuccucucucccccaccauagugugcaauaaagugucuguucuuaccaa

SEQ ID NO: 48751 - RNA, 64 nt, hsa
gugguuauguaaaagaccugaagaauuacuaucuagugugcagucugugauaucugaauguuca

SEQ ID NO: 48752 - RNA, 64 nt, hsa
auuuguucauccauguauucuaacauuucuauguagugugcaacucuaaugucaugcuuuugaa

SEQ ID NO: 48753 - RNA, 64 nt, hsa
aggugugugugacccacuggaugggagggcaaugagugugcacauacaaauggggcagugugca

SEQ ID NO: 48754 - RNA, 64 nt, hsa
gggagggcaaugagugugcacauacaaauggggcagugugcaugcaacacacuuaggggaggag

SEQ ID NO: 48755 - RNA, 64 nt, hsa
uggggguuccgggaaugaugcaacugguuuuacuagugugcaaguguguucauccccaaguucu

SEQ ID NO: 48756 - RNA, 64 nt, hsa
ccugagugugaacagguuugccuacguuggugcaagugugcauggcuggggacuucucacuucc

SEQ ID NO: 48757 - RNA, 64 nt, hsa
guaaaaacaaaaugaugcauuuugagaagaacaaagugugcacucagcggcuggaaaggaaaua

SEQ ID NO: 48758 - RNA, 64 nt, hsa
auuucugcaaagaucaagauaagcuggaugaaguagugugcauuuguaauacuauugcaagacu

SEQ ID NO: 48759 - RNA, 64 nt, hsa
aucuuaaaaauaccaaauaacagaagaucgcauugcagaugauaucaggaugugguuuccagcu

SEQ ID NO: 48760 - RNA, 64 nt, hsa
uuaacauuucaaaaguuuuucguauuuuuuuauggcagaugauuugucauuuauuuauauuagg

SEQ ID NO: 48761 - RNA, 64 nt, hsa
guuuacacauggagagaugccccauggugggcaggcagaugaugaaguacuggcagguaggcag

SEQ ID NO: 48762 - RNA, 64 nt, hsa
cacccuucucuccuuuccucauccuaagugccuggcagaugaaggaguuuucaggagcuuuuga

SEQ ID NO: 48763 - RNA, 64 nt, hsa
gcgggccggagcugaucgcucucacuggccugcugcagaugagccagggggagccuaggcccag

SEQ ID NO: 48764 - RNA, 64 nt, hsa
agcguguuccccuguaccuguccaaggccccccagcagaugaugggcucccugaaacugcugcc

SEQ ID NO: 48765 - RNA, 64 nt, hsa
ccuuucuuaaagacaggcugaaaccccuucaaaggcagaugaggagguacagacacgugaccuu

SEQ ID NO: 48766 - RNA, 64 nt, hsa
aaguugaguaccugugaucuaaaauguccuggaggcagaugacaucuaaaauaugugcuuucca

SEQ ID NO: 48767 - RNA, 64 nt, hsa
uuacauugauuaaugaauuaucacccagacaugugcagaugaaaugucaauauaagaaaaauca

SEQ ID NO: 48768 - RNA, 64 nt, hsa
uguuuagcaaauggcucugacaggguggccaugagcagaugagaccagcucuugcuugguugga

SEQ ID NO: 48769 - RNA, 64 nt, hsa
ucauaugcagauuuuauucucaccugggccauuugcagaugagacuguaguuugcagaugagac

SEQ ID NO: 48770 - RNA, 64 nt, hsa
ucaccugggccauuugcagaugagacuguaguuugcagaugagacuguaguuugcagauggcgu

SEQ ID NO: 48771 - RNA, 64 nt, hsa
ugaggagaaggaaagccgauucuuuggaaguucagcagaugaaagcccaggccagggaggagaa

SEQ ID NO: 48772 - RNA, 64 nt, hsa
cgcagauggagcggcagcgccucgcucgagagaagcagaugagggaggaggcugaacgcacgag

SEQ ID NO: 48773 - RNA, 64 nt, hsa
aacgcacgagggaugaguuggagaggaggcugcugcagaugaaagaagaagcaacaauggccaa

SEQ ID NO: 48774 - RNA, 63 nt, hsa
aaggcaaaaagauugucaaaauaaaaacaauaauucaaguaacaaugcccggaauauacgucc

SEQ ID NO: 48775 - RNA, 63 nt, hsa
uucuaaaaucaaggugaaauuugaacagaaugguucaaguaaaaauucucaucuggucucccc

SEQ ID NO: 48776 - RNA, 63 nt, hsa
cuccuuugagaaggagaccuuagcuuccccggcuucaaguagaacagaagcccguuuccuucc

SEQ ID NO: 48777 - RNA, 63 nt, hsa
uagacgcuggguagaugcaaagcagccuaacucuucaaguaccgacauuucucaccucugauu

SEQ ID NO: 48778 - RNA, 63 nt, hsa
uucuaccauuugugaagaaaugaauuuuccaguuucaaguaccuauucaaaauuuuauuaaaa

SEQ ID NO: 48779 - RNA, 63 nt, hsa
agcucacugccuauuugauggcuguaacaagucuucaaguauauacuuuuauaauaaguugaa

SEQ ID NO: 48780 - RNA, 63 nt, hsa
ugucucuaaaauuauuuuaaagauuaauauuuguucaaguagagaaugaagauaaaaaaggaa

SEQ ID NO: 48781 - RNA, 63 nt, hsa
cauuugguacaugauuuuuuuucaaaucauaucuucaaguacuauaguauucucuuacagaag

SEQ ID NO: 48782 - RNA, 63 nt, hsa
uuauuuucauauugaaucauguuacuuuuguaauucaaguaagcggcuggguuaauucaugau

SEQ ID NO: 48783 - RNA, 63 nt, hsa
gguggaaguagagaguaacucauauucuaucaauucaaguauucuuacuaugguugcuuuccc

SEQ ID NO: 48784 - RNA, 63 nt, hsa
cccuuucaucuuacuaaauuuugcauuguucuuuucaaguauguuucguauuuacugucuuuu

SEQ ID NO: 48785 - RNA, 63 nt, hsa
cccggaagaaagaccuauaugaugcgguuuggauucaaguauccugguuagcaagaccacucc

SEQ ID NO: 48786 - RNA, 63 nt, hsa
ccucccaguggaggcaucuuacauuuaggcuacuucaaguauccucagaaauguauucugcac

SEQ ID NO: 48787 - RNA, 63 nt, hsa
uagcuuagugccauuaugucauuuugauuuguauucaaguacucuucaaguaucuuuguaaug

SEQ ID NO: 48788 - RNA, 63 nt, hsa
cauuaugucauuuugauuuguauucaaguacucuucaaguaucuuuguaaugaagguuuggcu

SEQ ID NO: 48789 - RNA, 64 nt, hsa
gauaugaaaaacaaauuuucucacugucauaaaaggcucuaauuaugguuacuuuccuugugau

SEQ ID NO: 48790 - RNA, 64 nt, hsa
aaguguccuugucaugaaaacacuugccuuacaaggcucuaauuaugauuucccuagucagugc

SEQ ID NO: 48791 - RNA, 64 nt, hsa
ucccccguagaaaucccccuuucucuaauagcgaggcucuaaccacacagccuacaaugcugcg

SEQ ID NO: 48792 - RNA, 64 nt, hsa
augacuucccaacugcaagucacaaaggaauggaggcucuaauugaauuuucaagcaucuccug

SEQ ID NO: 48793 - RNA, 64 nt, hsa
ccugcgaaagcugucaacuuuugugguuguagcaaguauuaauaaauauuuauaaauccucuaa

SEQ ID NO: 48794 - RNA, 64 nt, hsa
ucuagcuaccuauccaauacuaaauaccccuuaaaguauuaaaugcacuaucugcuguaaaaga

SEQ ID NO: 48795 - RNA, 64 nt, hsa
gccuuucuuuuccuauuucuuuuuuuuaaggguuaguauuaacaaauggcaaugaguagaaaag

SEQ ID NO: 48796 - RNA, 64 nt, hsa
uuggcagggaaaaagggcaauguugauuaaucucaguauuaaaccacauuaaucuguaucccau

SEQ ID NO: 48797 - RNA, 64 nt, hsa
gaagaccuuuuaaagcauuguuuuagaaugucugaguauuaagauacagauuaauugggaauau

SEQ ID NO: 48798 - RNA, 64 nt, hsa
gaguauuaagauacagauuaauugggaauaucugaguauuaaguacuuucuucagaguauaaga

SEQ ID NO: 48799 - RNA, 64 nt, hsa
auuacauucuuagaguagagcagaguuuuuaguuaguauuaauuuauuuuccuccauucaugua

SEQ ID NO: 48800 - RNA, 64 nt, hsa
ucauuaacacuuacauuuccauaaagaaaacucaaguauuaauaaaagagacuuuacuggcuua

SEQ ID NO: 48801 - RNA, 64 nt, hsa
uaugcuguguuuaucauguguauaucguccagaaaguauuaaggcuuuagguagaugcaacugg

SEQ ID NO: 48802 - RNA, 64 nt, hsa
cuuuugcagaauguucaaggaaguauucuguguuaguauuaaugccaaaaaguuguuuuuaaag

SEQ ID NO: 48803 - RNA, 64 nt, hsa
cccuguccuuugccucuauuaagcagaggauggaaguauuaaggauuuuguaacaccuuuuaug

SEQ ID NO: 48804 - RNA, 64 nt, hsa
uaauagcucuaacaugcaauauaaaauucauaggaguauuaauagcccauuuacacaucuauaa

SEQ ID NO: 48805 - RNA, 64 nt, hsa
uugucaauaguauuaacuauuaguguuaacuguuaguauuaacuauuaguauuauuaacacuaa

SEQ ID NO: 48806 - RNA, 64 nt, hsa
ggaugucugaaaucagugccuauggguugucaauaguauuaacuauuaguguuaacuguuagua

SEQ ID NO: 48807 - RNA, 64 nt, hsa
aagcugcuaauuguaaacaaaacaguuacccuccaguauuaauaugacucauuagugugagcca

SEQ ID NO: 48808 - RNA, 64 nt, hsa
caaguaugauuaugacccuuggacuuccugauguaguauuaaauuucaacucugguuauccauu

SEQ ID NO: 48809 - RNA, 64 nt, hsa
agucuuauuuucuauguuuuauucauagaaauggaguauuaauuuuuaauauuuucaccauaug

SEQ ID NO: 48810 - RNA, 64 nt, hsa
caaaggaucuuucaugaauguccaaggguaagucaguauuaauuaaugcuguauuacaaggcaa

SEQ ID NO: 48811 - RNA, 64 nt, hsa
uuugcguugcuuucuacauagagacuuguauaauaguauuaauaguagcucauucucucuaaaa

SEQ ID NO: 48812 - RNA, 64 nt, hsa
ugagcucuugauuacaauuuaauacauuguaaaaaguauuaaauccuuugaaacaucuuuuguu

SEQ ID NO: 48813 - RNA, 64 nt, hsa
uuaacaguagaaugcgaucuuugccacugacuguaguauuaauaagguuuuaaugugagauauu

SEQ ID NO: 48814 - RNA, 64 nt, hsa
aaguucuucaguuuuuaagugaggauaucgugacaguauuaaaacaucgcaauaauguuccugu

SEQ ID NO: 48815 - RNA, 64 nt, hsa
acuugccaaacagucuuuuaugaaggaaaguuacaguauuaauuuuugaaaagguuuuuuuuau

SEQ ID NO: 48816 - RNA, 64 nt, hsa
acccuacaacugcccugggacauuucacuguaccaguauuaacugcaaacagcaauaauuguca

SEQ ID NO: 48817 - RNA, 64 nt, hsa
cccuuaugagaagugaagguuuuguaaacuuuccaguauuaauuugggcggguauuccccgcuu

SEQ ID NO: 48818 - RNA, 64 nt, hsa
gauauuaagaucaaagggaggaagggaagacagcaguauuaauucacccuagauuacucaauuu

SEQ ID NO: 48819 - RNA, 64 nt, hsa
aaaugaaaagcuguggagaaaauguccucauuaaaguauuaaagugugggcagaauuacaauua

SEQ ID NO: 48820 - RNA, 64 nt, hsa
aaauugguaucuauuauuuuaccaauuuuuuuuuaguauuaaguccauuuagaacuaaccauau

SEQ ID NO: 48821 - RNA, 64 nt, hsa
aauccucacgcaaguagauacauguucauccaaaaguauuaauagaaauucucuaucagcuauu

SEQ ID NO: 48822 - RNA, 64 nt, hsa
uuguucuuuuuucagcaaaauacuucaaaugaauaguauuaacuuacaaaaagucacaaaaacu

SEQ ID NO: 48823 - RNA, 64 nt, hsa
ucaaggauuuucauguugaugacucgaaacugacaguauuaaggguaggauguugcuucugaau

SEQ ID NO: 48824 - RNA, 64 nt, hsa
gggauuuauaaaccagcugugauuaacaauguaaaguauuaauuauugaacuuugaaccagauu

SEQ ID NO: 48825 - RNA, 64 nt, hsa
uaaugaaugauuauaaacaagaugcaucuuagauaguauuaauauacugagccuuggauuauau

SEQ ID NO: 48826 - RNA, 64 nt, hsa
agccauaagaaaauaucugcuauacaggaaaaccaguauuaagcaaauaccaccauccuuaaca

SEQ ID NO: 48827 - RNA, 64 nt, hsa
uauagacauaucauuauuucauggucaagccuguaguauuaaaaugauuuuuuuaaaagaugua

SEQ ID NO: 48828 - RNA, 64 nt, hsa
aucgcaauuaccuuauguaaagcagaacuaaugcugacuggauguuuaaugggaugagcauuaa

SEQ ID NO: 48829 - RNA, 64 nt, hsa
agacacuaaagcguuacacuuuaucccgucucuaugacuggaucauagucauuauaaucacagg

SEQ ID NO: 48830 - RNA, 64 nt, hsa
gggacagccuuauucccaaaugucucuauccuuuugacuggagcaucuucugcacaaccuuggg

SEQ ID NO: 48831 - RNA, 64 nt, hsa
ucugggguuauagauucccccacugccccagcucugacuggaccccaaguggcugcuauguaaa

SEQ ID NO: 48832 - RNA, 64 nt, hsa
ugaauauuccuggacuuacaaaaugccaagggggugacuggaaguuguggauaucaggguauaa

SEQ ID NO: 48833 - RNA, 64 nt, hsa
caaaagacaaaaaucaaagaacagauggggucugugacuggaucuucuaucauuccaauucuaa

SEQ ID NO: 48834 - RNA, 64 nt, hsa
aaauuuuaacuguagguaugaucucuucugguguugacuggacugcuuggggugggggacgauc

SEQ ID NO: 48835 - RNA, 64 nt, hsa
cuuccucagcugccuccugcgcccugugcccgacugacuggaggaggccugucccaauucugcc

SEQ ID NO: 48836 - RNA, 64 nt, hsa
ugauuccagucacccuguaguuacugacagaaauugacuggacugucauugugugaagucuagg

SEQ ID NO: 48837 - RNA, 64 nt, hsa
gccuggccuuauguaaagcucuugaccuagcaucugacuggaaacaagcgggaauugcauuggg

SEQ ID NO: 48838 - RNA, 64 nt, hsa
cacuucccagcuaggagugcacuuuaugggacugugacuggacucuuccguucuggcuccagcc

SEQ ID NO: 48839 - RNA, 64 nt, hsa
ccagucaucauuaauacaauguguugggauucugugacuggaaaaggugacaaguuggugacuu

SEQ ID NO: 48840 - RNA, 64 nt, hsa
acaaaagugcaugggggggauuaauuaaaccuucugacuggaaguucuaucacacaagaggcaa

SEQ ID NO: 48841 - RNA, 64 nt, hsa
cgcaaaaucuuacacccugguauaacagacagcaugacuggacagcgguuguaaauacaauuca

SEQ ID NO: 48842 - RNA, 64 nt, hsa
gcccauuagcacuuugguucaaggggcccaccaagucuuggacgggaaggcgcuacugguuuua

SEQ ID NO: 48843 - RNA, 64 nt, hsa
ucaagacucucugaaugcugcuccacugucuuuugucuuggaggucacucagcagguuccuugc

SEQ ID NO: 48844 - RNA, 64 nt, hsa
agcgaggcagaauggugggcuccagaguaggugggucuuggauugguaccagagccuauggaaa

SEQ ID NO: 48845 - RNA, 64 nt, hsa
uugggguagagaggacaguuuaggacccaagguggucuuggagaggagguguggaguggagggg

SEQ ID NO: 48846 - RNA, 64 nt, hsa
ucuguguauauauagaagguagaaaugaaaagugagaaaauauuugaaagggauuauauuaauu

SEQ ID NO: 48847 - RNA, 64 nt, hsa
aaaugucacguuuccauaucuccugcuggaaaucagaaaauauaauaaaauugcacaaaaaaaa

SEQ ID NO: 48848 - RNA, 64 nt, hsa
auuguauauaauaguauagucaccaucaagauguagaaaauagaaaauaggcuaggcacagugg

SEQ ID NO: 48849 - RNA, 64 nt, hsa
auaauaguauagucaccaucaagauguagaaaauagaaaauaggcuaggcacaguggcucacgc

SEQ ID NO: 48850 - RNA, 64 nt, hsa
cauuuugaaucccucuuccucacuuuuuuuucuaagaaaauaaacauuuuacuguuuuuaugga

SEQ ID NO: 48851 - RNA, 64 nt, hsa
caaauauugucacaaguaaauagcaaucaaaaggagaaaauaacuuuuguauuuuuuuaaugug

SEQ ID NO: 48852 - RNA, 64 nt, hsa
uuaaaggaagaaauauuuucaaauucuuaauccaagaaaauacugaguuggaaucuuagacuuc

SEQ ID NO: 48853 - RNA, 64 nt, hsa
cugaaagauuggauuuucuauaacaccuuguguaagaaaauaaaaaacuugaucuaacugaaaa

SEQ ID NO: 48854 - RNA, 64 nt, hsa
uggauuuuaagcccagacuucaguggacccagauagaaaauauaaagucucugaucuauaggcc

SEQ ID NO: 48855 - RNA, 64 nt, hsa
augcuguuacugagaauaaugaaaaucauauuucagaaaauauuaccauguaaauauguacaua

SEQ ID NO: 48856 - RNA, 64 nt, hsa
aaaaggcaagauacaugugaauaaggcaaaagccagaaaauagcccuuauucaugaugcuguua

SEQ ID NO: 48857 - RNA, 64 nt, hsa
uugggaauuuuacagagucaaaguaggcagaauaagaaaauaguucuucaggagggccgaccuu

SEQ ID NO: 48858 - RNA, 64 nt, hsa
caggccacuuugucguguuuguuuuaacuucuaaagaaaauauguuucagcauuauaagaaagg

SEQ ID NO: 48859 - RNA, 64 nt, hsa
uauucuggugaugggguuuagcaacuuugauggaagaaaauauuaggcuauaaauguccuaagg

SEQ ID NO: 48860 - RNA, 64 nt, hsa
acagaguggagacucuguuucaaaaaaacagaaaagaaaauauaguuugauucuucauuuuuuu

SEQ ID NO: 48861 - RNA, 64 nt, hsa
gugucaugauuaauguguauuuacuguacuaauuagaaaauauaguuugaggccgggcacggug

SEQ ID NO: 48862 - RNA, 64 nt, hsa
uuauuguguuuauauguauaaaaauaggagcaaaagaaaauacucugggaauagucauacugac

SEQ ID NO: 48863 - RNA, 64 nt, hsa
uuauuauuagcaugucauuuguacauaaacuaguagaaaauagcaguuuuaaaaguuuucuauu

SEQ ID NO: 48864 - RNA, 64 nt, hsa
uuuuuaaaaaccgaauuucaucauuuaucuaaagagaaaauaugcagaauaacuggucuuguua

SEQ ID NO: 48865 - RNA, 64 nt, hsa
auucuuaaaauuuuuucccaccaagguauuccaaagaaaauauuaaggucuccccuuuuucuau

SEQ ID NO: 48866 - RNA, 64 nt, hsa
guugggagcucuccaaagaaacugguugguuuuaagaaaauaguuucaagaaguucaacuauau

SEQ ID NO: 48867 - RNA, 64 nt, hsa
uaauacuucauuguguuguacuggaugcaaagcuagaaaauauugcaauaaaugagaccgauga

SEQ ID NO: 48868 - RNA, 64 nt, hsa
ugauugcugcuauucuggaauguguccauugaaaagaaaauaggcgcuuugucuccuacaaucu

SEQ ID NO: 48869 - RNA, 64 nt, hsa
acuguaugaaaacaggaaaauaaaagagaaauuuagaaaauacagcucauuacaauaaaauugu

SEQ ID NO: 48870 - RNA, 64 nt, hsa
accuuucaaacugguuuguauuuauuucaaaggaagaaaauauauugauucuuagaaaauaaac

SEQ ID NO: 48871 - RNA, 64 nt, hsa
auuuauuucaaaggaagaaaauauauugauucuuagaaaauaaacugucaauuuagaauucuuu

SEQ ID NO: 48872 - RNA, 64 nt, hsa
uuuuugacagacuauuugcuaauguauaaugugcagaaaauauuuaauaucaaaagaaaauuga

SEQ ID NO: 48873 - RNA, 64 nt, hsa
gcuuugauaauuguguaccuuaagauauugaaggagaaaauagauaauuuacaagauauuauua

SEQ ID NO: 48874 - RNA, 64 nt, hsa
ucacagaugacugcaaguucagggagcguuuucaagaaaauagcuauaauaccuaugccucagc

SEQ ID NO: 48875 - RNA, 64 nt, hsa
uugguggcugggauaugauggguuagaagcaaggagaaaauauaaggacuuuuugauggaauua

SEQ ID NO: 48876 - RNA, 64 nt, hsa
aauuucaaaauuuaaagccaugcuaaaauuaaaaagaaaauauuaaauuacacaauuacacuug

SEQ ID NO: 48877 - RNA, 64 nt, hsa
ucaaacaaaacagauaugcuuacucuaguuaaaaagaaaauaaaucucaugucagacccagaaa

SEQ ID NO: 48878 - RNA, 64 nt, hsa
auagaaacaaugguuccuuaguuuugcacugggaagaaaauauuuuguaaaagaauguuuauuu

SEQ ID NO: 48879 - RNA, 64 nt, hsa
cagaauugaccuuaauuuguuuuccagaaucaaaagaaaauaaaauauaaauuuugaaacuaug

SEQ ID NO: 48880 - RNA, 64 nt, hsa
ccugucucaaaaaaaaaaaaaaaaaaaggagagaagaaaauaaagaaggcuaauauauaauuuu

SEQ ID NO: 48881 - RNA, 64 nt, hsa
ggugacuuucuuuuuuuguaaagcaaauuacuuaagaaaauacaauucacuugaauuugacaaa

SEQ ID NO: 48882 - RNA, 64 nt, hsa
aaaugugugcuuuauaguguuuacuaaagugacaagaaaauauaccauuugacacacuauagau

SEQ ID NO: 48883 - RNA, 64 nt, hsa
agaaaugugaaaggaccuuuugucacagcacuucagaaaauacacaacagccccuucugccccc

SEQ ID NO: 48884 - RNA, 64 nt, hsa
guauuuugucuuuguaauuuacagaaguuauuggagaaaauaaacuuguuucauuuugcauuuc

SEQ ID NO: 48885 - RNA, 64 nt, hsa
gugugacuguggguuuuauuuuguauucugguuaagaaaauaauguauugaguuacugucaagu

SEQ ID NO: 48886 - RNA, 64 nt, hsa
uaaaguuuaugugugugaugugacuuaacuaugcagaaaauauuuaaguuggauguacuuguuu

SEQ ID NO: 48887 - RNA, 64 nt, hsa
acaugcauacacacacacacacagccacacacacagaaaauauacuguaaagaaagagagaaaa

SEQ ID NO: 48888 - RNA, 64 nt, hsa
ccacacacacagaaaauauacuguaaagaaagagagaaaauaaaaaguuaaaaaguuaaaaaaa

SEQ ID NO: 48889 - RNA, 64 nt, hsa
uagcauuaaauauaaaauacauaaaagaauguacagaaaauagcuuuuauugaguaauauuaca

SEQ ID NO: 48890 - RNA, 64 nt, hsa
ucauccaccaauaucauguguagauauuauguauagaaaauaaaauaaauuauggcucuaacuu

SEQ ID NO: 48891 - RNA, 64 nt, hsa
cguguucuuacaaaugaaccuucggaucuaugaaagaaaauauaguagggggacuaaggaacau

SEQ ID NO: 48892 - RNA, 64 nt, hsa
uuuggaguguaaaucuucaugauguuguaauucaagaaaauaggcacuuucucugaaagaccug

SEQ ID NO: 48893 - RNA, 64 nt, hsa
uccguaggcagagugcucacuuugaauugcuaauagaaaauaaugcacaguguccucaggauau

SEQ ID NO: 48894 - RNA, 64 nt, hsa
uacagcaggaaaucaaaggaguggguggaaugagagaaaauaugcaaagagaucauuuuuaagu

SEQ ID NO: 48895 - RNA, 64 nt, hsa
agaguugauuucaagauuauaaauacucaugaucagaaaauaguacuuauuagcaauuaaaggg

SEQ ID NO: 48896 - RNA, 64 nt, hsa
uaccuccaugugcccuuuuuagggaagcuguuggagaaaauacuccagcaaaaugaaggaguac

SEQ ID NO: 48897 - RNA, 64 nt, hsa
uuucagaugccuuugagaaaugaaugaaguagagagaaaauaaaagaaaaaccagccaggcaca

SEQ ID NO: 48898 - RNA, 64 nt, hsa
ugucuauacucaacuggauauguguauguaaauuagaaaauacauaccuauccagacauaaaug

SEQ ID NO: 48899 - RNA, 64 nt, hsa
uaaaauuuuugaaaucacuacuguuaccuguuauagaaaauaguguuggcuuagucuagucucu

SEQ ID NO: 48900 - RNA, 64 nt, hsa
uuacaagugugcaaauuaugacugcgugagccuuagaaaauaaaauguauaaagggcaacacau

SEQ ID NO: 48901 - RNA, 64 nt, hsa
auugcaguauuuaaagcuuaagcuuucaggaaaaagaaaauaagaauucagugugugcaugaca

SEQ ID NO: 48902 - RNA, 64 nt, hsa
caguuuagcuuuguguuguaugcuaguuuaaaaaagaaaauauguaauauaauguaaaaaaaaa

SEQ ID NO: 48903 - RNA, 64 nt, hsa
uugaugguaaaguugguaaaaggcaacuuucagaagaaaauaaugugcuuuagaaaaaaaauuc

SEQ ID NO: 48904 - RNA, 64 nt, hsa
acuccaauaugcuaaaaguuaaauaugguauuuaagaaaauagucauguaugcaauugagaaag

SEQ ID NO: 48905 - RNA, 64 nt, hsa
acacacccaguuauggaauguccagaguucucgaagaaaauaaaugacuuuaggaagagguaua

SEQ ID NO: 48906 - RNA, 64 nt, hsa
cugcuggaaagugggacccucugaguggguggucagaaaauacccaugcugaugaaaugaccua

SEQ ID NO: 48907 - RNA, 64 nt, hsa
gguguacaaauuggucaaguugcaauuauuuaugagaaaauaaugauaaauguaaaauaucuaa

SEQ ID NO: 48908 - RNA, 64 nt, hsa
caugaaucuaagagcacgcaauauauaauuuuaaagaaaauauucuauuugguagaauacaaau

SEQ ID NO: 48909 - RNA, 64 nt, hsa
gucucaugaggaacacuacuuaaugcagugggaaagaaaauauuucagaggagaauuuuuucuu

SEQ ID NO: 48910 - RNA, 64 nt, hsa
gccauucagucuggacuucaaaucacuugucuucagaaaauaaaagauuuguuccacccgggug

SEQ ID NO: 48911 - RNA, 64 nt, hsa
agagggaagggaaaaaagugugaaaggaugaugaagaaaauaauuuuacuauuucuuuuaaaag

SEQ ID NO: 48912 - RNA, 64 nt, hsa
auguccuguucacugaauauuccggguaauugaaagaaaauauaauggaugggcuccauuaaaa

SEQ ID NO: 48913 - RNA, 64 nt, hsa
gaagauaaaaagacauucuuccaaaaagauuuucagaaaauauuauguguuuccauauuuuaua

SEQ ID NO: 48914 - RNA, 64 nt, hsa
uauuuuuccaaaauaauuuuaagaaaucaaagagagaaaauaaagaccuugcuuaugauugcag

SEQ ID NO: 48915 - RNA, 64 nt, hsa
auuguuuuucuaauacuuuauagggcccaacuucagaaaauacuucgcuuuuuucuuuuuaugc

SEQ ID NO: 48916 - RNA, 64 nt, hsa
ucuuuuccuguuaacaagcuggcagcaaagcuucagaaaauauauaugcaagcacaacuugaag

SEQ ID NO: 48917 - RNA, 64 nt, hsa
cuuuaauauugauuauauuuuuaacaggaauuuaagaaaauauuacuggaauuaaaaauauaua

SEQ ID NO: 48918 - RNA, 64 nt, hsa
ggauuucuccaaaucugggagaauuuucaaaauaagaaaauaaccuuuauaugauauacuauga

SEQ ID NO: 48919 - RNA, 64 nt, hsa
uuuauuuuuuucccuuuagcauugcaugugaauaagaaaauaauguuuaaagaaaaaaaaaaaa

SEQ ID NO: 48920 - RNA, 64 nt, hsa
cacuauaguauaagaaucuauuuuggagaaaaaaagaaaauaugagggucucgaagcaugauuu

SEQ ID NO: 48921 - RNA, 64 nt, hsa
uuucuuucugguuaaaaaaaggaaaaaccaucuaagaaaauauauauguauguauguguguaua

SEQ ID NO: 48922 - RNA, 64 nt, hsa
cauuauaaaugcaauuuuugucaagagaucuuucagaaaauauaagccuuuaaagugaagaaga

SEQ ID NO: 48923 - RNA, 64 nt, hsa
auuugugaaaacauuuuuuaaaaaacuacagcuuagaaaauaccagaggccucauacuaaaaua

SEQ ID NO: 48924 - RNA, 64 nt, hsa
acauugcugaguauagaaucagaaugcugaguauagaaaauaauuuaaaacuaaaguugguagg

SEQ ID NO: 48925 - RNA, 64 nt, hsa
ucacaaguaauggcacaauucuucggaugacugcagaaaauaguguuuuguaguucaacaacuc

SEQ ID NO: 48926 - RNA, 64 nt, hsa
cuucaagugaccuguacugcuuggggacuauuggagaaaauaagguggaguccuacuuguuuaa

SEQ ID NO: 48927 - RNA, 64 nt, hsa
uuaguauagaaacuacagaauauuuacccuggaaagaaaauauuggaauguuauuauaaacucu

SEQ ID NO: 48928 - RNA, 64 nt, hsa
uuaggauuuucaaagaauggagguugcugcacucagaaaauaauucagaucauguuuaugcauu

SEQ ID NO: 48929 - RNA, 64 nt, hsa
ccuuguagaauauguauuaaucauucuacauuaaagaaaauaaugguucuuacuggaaugucua

SEQ ID NO: 48930 - RNA, 64 nt, hsa
aacuuuucaugauuuuuaugagcacagacuuucaagaaaauacuugaaaauaaauuacauugcc

SEQ ID NO: 48931 - RNA, 64 nt, hsa
gaagcaauagucuccaagucaauauaaauucuacagaaaauaguguucuuuuucuccagaaaaa

SEQ ID NO: 48932 - RNA, 64 nt, hsa
auaaaguacuaauuaaaugcuaacauaggaaguuagaaaauacuaauaacuuuuauuacucagc

SEQ ID NO: 48933 - RNA, 64 nt, hsa
auuugugucaaauuauaauuauaaaagguacagcagaaaauauaccauguuuuuauauagguuc

SEQ ID NO: 48934 - RNA, 64 nt, hsa
aaacaauuuguugauuaagugaucaacaaccugaagaaaauaucaauuuuuaauugacaaagac

SEQ ID NO: 48935 - RNA, 64 nt, hsa
uuuguaaacccuauaauuaugaagcgauugcuugagaaaauaacauauaaacauagaauagaau

SEQ ID NO: 48936 - RNA, 64 nt, hsa
uacagugcccuaaaaugguguucuuaugaccugcagaaaauauuuacacauauuuccaaauauu

SEQ ID NO: 48937 - RNA, 64 nt, hsa
cauucuuuucaguuggagagaauugggcuaagauagaaaauaacaugauuuguuccuuauuaaa

SEQ ID NO: 48938 - RNA, 64 nt, hsa
auucauauugcugugaaugcuuuaucuuggagauagaaaauauaaugauaaauucaucaugugu

SEQ ID NO: 48939 - RNA, 64 nt, hsa
auaugaaaauuacacauuuuauaauuuuuagaugagaaaauaccacuagcagaauagcuuugug

SEQ ID NO: 48940 - RNA, 64 nt, hsa
gcagaaguaauaauuggagguaaaguuuccuuagagaaaauaauuuuauucugcuuuguccaau

SEQ ID NO: 48941 - RNA, 64 nt, hsa
ugaaaucucacagauguaaggacucaaguguagaagaaaauauccccuucuuacaaaaagaaau

SEQ ID NO: 48942 - RNA, 64 nt, hsa
aaacaguuccugguuccucuuguguuugacacuaagaaaauagcaagagugugaaaucucagau

SEQ ID NO: 48943 - RNA, 64 nt, hsa
guggaugaagguggguauuggggguggcugugaaagaaaauaauggagaaucacuuuucuagac

SEQ ID NO: 48944 - RNA, 64 nt, hsa
ugcccaacuaaacccagaacucaaacuuaacauuagaaaauaagguccagggccggacacagug

SEQ ID NO: 48945 - RNA, 64 nt, hsa
ugaacuugccaaucaaaaaaugacaaucaauuugagaaaauagaaauagauauuuuuaaauaaa

SEQ ID NO: 48946 - RNA, 64 nt, hsa
gacagccaacagaaacaaaaccuagcauagggauagaaaauaccaugcacgugugcagccccac

SEQ ID NO: 48947 - RNA, 64 nt, hsa
gguuuuguguuuuuuucuggaacuacuucaagugagaaaauaaaaaaaaauggugacaaagcug

SEQ ID NO: 48948 - RNA, 64 nt, hsa
uuaaguuaugaagcaaauuaaaauggaaaauacaagaaaauagaaccaauuagguugaaaaugc

SEQ ID NO: 48949 - RNA, 64 nt, hsa
ugaccagucaacucuaagaagacuagauauuccuagaaaauaaagaagcaaaucucuuuaccgg

SEQ ID NO: 48950 - RNA, 64 nt, hsa
agaauggacccauugaggauaacuauaaaauuacagaaaauauuuaaaugcaacuuauugcuau

SEQ ID NO: 48951 - RNA, 64 nt, hsa
gaugagccugaaucaucucauguaccugacaguaagaaaauacucuggcuggucucaguggcuc

SEQ ID NO: 48952 - RNA, 64 nt, hsa
ucauuauuauuaaagcacaaaauaaccuauuguuagaaaauauguguuuuuauaaaugaaugua

SEQ ID NO: 48953 - RNA, 64 nt, hsa
aaaauaauuaaaugaauugugaaauggauguuuaagaaaauauaggcuuaaaaaguaaaucuau

SEQ ID NO: 48954 - RNA, 64 nt, hsa
uaagcaagagaaagacaacuguucugcggguuggagaaaauacaauuuuuuuuuuuuuuuuuga

SEQ ID NO: 48955 - RNA, 64 nt, hsa
gggauuacaggcguuagccacugcgcccggcccgagaaaauacaguuuuaaaaagagaaagcuu

SEQ ID NO: 48956 - RNA, 64 nt, hsa
aauaaggguauaauuuuguaggucauaugauugaagaaaauauuauuuuaacaauguaaagcaa

SEQ ID NO: 48957 - RNA, 64 nt, hsa
aaguauaagguuuaaguaauuugguuuaauaaucagaaaauauucaauacaguguuggauauuc

SEQ ID NO: 48958 - RNA, 64 nt, hsa
uagucuuuagucaaaucucugcauuguuucaugcagaaaauaaagauacaauuaaggcugacau

SEQ ID NO: 48959 - RNA, 58 nt, hsa
aauccacuggagcgucuugaaagguuuuagaaaauauuuggcuguagucucaaauuuu

SEQ ID NO: 48960 - RNA, 64 nt, hsa
aauggccagaaaauauuguauugcuuggcagaaaagaaaauaaggucuaaaggaaaguagcaca

SEQ ID NO: 48961 - RNA, 64 nt, hsa
auggacauuaucgcauuaucuuggcauaauggccagaaaauauuguauugcuuggcagaaaaga

SEQ ID NO: 48962 - RNA, 64 nt, hsa
uugaacaaauauuuuaaaggugcaaaauaccauuagaaaauacuauuugaaauggacauuaucg

SEQ ID NO: 48963 - RNA, 64 nt, hsa
gugcugugggucaccaacaggcuguuuacaaagcagaaaauaucaucaccaucauaaccuuucu

SEQ ID NO: 48964 - RNA, 64 nt, hsa
cucuagcauuuuaaauuauuuuuauuuauuagaaagaaaauauauuuuuucuuuucauugucaa

SEQ ID NO: 48965 - RNA, 64 nt, hsa
acugguggaaacguuaggauaagcaagaauugccagaaaauaaaguagacagaucuuucucuuu

SEQ ID NO: 48966 - RNA, 64 nt, hsa
guggcguugaauagauguguauuuccuccccugcagaaaauaagcacagaaaauuauaauguag

SEQ ID NO: 48967 - RNA, 64 nt, hsa
cuguuaaauuucacaaagucaugaggguaaauggagaaaauauuucugggauuacaaugaaugu

SEQ ID NO: 48968 - RNA, 64 nt, hsa
cugcaaagagcugcugcuuugccaaccuaagcaaagaaaauacggcuucucuugcauuauuuuc

SEQ ID NO: 48969 - RNA, 64 nt, hsa
ucucucucugcagagcccuguuucuaauugugguagaaaauauugagacagagcauuugccaug

SEQ ID NO: 48970 - RNA, 64 nt, hsa
cuuguaaaacaugucaagauuuuuccaccaagcuagaaaauaaaaaacuuaguucuaccacauc

SEQ ID NO: 48971 - RNA, 64 nt, hsa
gaaauggauuauuugucagcccgauuauuugcaaagaaaauauacaauuaucaagcagagacca

SEQ ID NO: 48972 - RNA, 64 nt, hsa
aagaauaaaauuuucuacaucaaaguaagacuugagaaaauaaacuuauguguauauauguuua

SEQ ID NO: 48973 - RNA, 64 nt, hsa
uuaacauuuauaggaggaaaaaaaucacuuugggagaaaauaaaauucaacucaagcauaaagc

SEQ ID NO: 48974 - RNA, 64 nt, hsa
aagggucagcaacaacaaagaaaaagacaauuacagaaaauaagcaagauuuggaaaggaagua

SEQ ID NO: 48975 - RNA, 64 nt, hsa
uagagcagaaauaaaaaggaagaaaauguagauuagaaaauaagacuucugagaaaaaguucaa

SEQ ID NO: 48976 - RNA, 64 nt, hsa
gauugcaugacuauuauuuaucuucuuuuaguguagaaaauaauuuuuuacaaaaagucacuuu

SEQ ID NO: 48977 - RNA, 64 nt, hsa
gccaggacccgguaggccugagccucaacucuucagaaaauaguguuuuuaauauuccucuuca

SEQ ID NO: 48978 - RNA, 64 nt, hsa
ucuucagaaaauaguguuuuuaauauuccucuucagaaaauaguguuuuuaauauuccgagcua

SEQ ID NO: 48979 - RNA, 64 nt, hsa
uaauguaguuugagauagugauuaagugcuaugaagaaaauaaacuagggugaugauuuuagug

SEQ ID NO: 48980 - RNA, 64 nt, hsa
augucgagcuuuaaaguccauaauuguuaucuucagaaaauauuauuugaccuacaguaugucc

SEQ ID NO: 48981 - RNA, 64 nt, hsa
uauauauaucaagauuuggguacuuuauuuuaguagaaaauauauaucuuuuacauauguaugu

SEQ ID NO: 48982 - RNA, 64 nt, hsa
acuacaaauaauuuucuuaaaagucuaagauagcagaaaauacaguaaaaacacaggagaagaa

SEQ ID NO: 48983 - RNA, 64 nt, hsa
gggcuauaauagcaauaaaaguuagacgaaguguagaaaauaaaauaaauuucauaauguuagu

SEQ ID NO: 48984 - RNA, 64 nt, hsa
agcauuaaggaaguauaugaucugacuuuucagaagaaaauaaacaaaugcauuauguaagguc

SEQ ID NO: 48985 - RNA, 64 nt, hsa
gagagaaaauauguaaccacaucuuaguggcccaagaaaauacaggccugaagggauaagauug

SEQ ID NO: 48986 - RNA, 64 nt, hsa
ggaauuguuuugcaaacguucuaggagaugugagagaaaauauguaaccacaucuuaguggccc

SEQ ID NO: 48987 - RNA, 64 nt, hsa
caaaugguaucuaauuaauaacuagucugacaucagaaaauaaaauugaggcugauuuuuaaaa

SEQ ID NO: 48988 - RNA, 64 nt, hsa
ggugugaaaacaagugucaaaauuccucauauagagaaaauaauuuugaguuuagaguauuauc

SEQ ID NO: 48989 - RNA, 64 nt, hsa
uagaaugacuauucuaaauauuaauguauuaaaaagaaaauacaacaaaauguauauuuagaca

SEQ ID NO: 48990 - RNA, 64 nt, hsa
aggaaagugugacacaguuuuuaaauuuagauguagaaaauaaugaauuaaugagauuggugaa

SEQ ID NO: 48991 - RNA, 64 nt, hsa
aauauuuuaucauauguucuaaaagagaaggaagagaaaauacuacuuucucaaaauggaagcc

SEQ ID NO: 48992 - RNA, 64 nt, hsa
uaggauccauuauuuccccugaaggcuucuuguuagaaaauaguacaguuacaaccaauaggaa

SEQ ID NO: 48993 - RNA, 64 nt, hsa
uauggacaguggaggcagcuggaauggcaagugcagaaaauaggaacaguucuauacagugcuc

SEQ ID NO: 48994 - RNA, 64 nt, hsa
ucacauucugaaaaauaacauucucagaauccacagaaaauauacuuaguuacuacugaagaua

SEQ ID NO: 48995 - RNA, 64 nt, hsa
guugcucucuagucucugaaaagcaaaaaaagugagaaaauaauuucuucagagauaacuucaa

SEQ ID NO: 48996 - RNA, 64 nt, hsa
gauuauacaggcuaugaaaaccauuuuaaaggaaagaaaauauguaaauucuauugagcaaaau

SEQ ID NO: 48997 - RNA, 64 nt, hsa
auuucauuuuucuaaaggggcagaggccucuuuuagaaaauaauaaaaugcaaugugugugauu

SEQ ID NO: 48998 - RNA, 64 nt, hsa
uagcaugaagcaugaauuauuuucauauaaauauagaaaauagagaaaaggcuaugccuguaau

SEQ ID NO: 48999 - RNA, 64 nt, hsa
gaucaucuugaaguauuauuucacauugaaaagaagaaaauauauugauaacuauagauguuau

SEQ ID NO: 49000 - RNA, 64 nt, hsa
auaauucagguuugaucaaggugugaauaacugaagaaaauaacuugcuggcuauauaggaaaa

SEQ ID NO: 49001 - RNA, 64 nt, hsa
auuuuaaaguuagaauauauuugaaugcauggguagaaaauaucauauuuuaaaacuauguaua

SEQ ID NO: 49002 - RNA, 64 nt, hsa
uucagugugaauucacugaauguuuauagacaaaagaaaauacacacuaaaacuaaucuucauu

SEQ ID NO: 49003 - RNA, 64 nt, hsa
uuucuccuauuuuuaaauuuauuaugcaaauuuuagaaaauaaaauuugcucuaguuacacacc

SEQ ID NO: 49004 - RNA, 64 nt, hsa
ggaaacuuguuuuuuuaacgucagccagauauuuagaaaauaaccucaaaaguguuuauauggu

SEQ ID NO: 49005 - RNA, 64 nt, hsa
cuagagagaucccaucucuaaaaaauaaaauauaagaaaauaaaacuuaggggauauacagauu

SEQ ID NO: 49006 - RNA, 64 nt, hsa
uuuguauuuaauaucaauggacugagucugauucagaaaauaauuguaauguucauauucaaua

SEQ ID NO: 49007 - RNA, 64 nt, hsa
ggggagcccagguaugagaaagaaaaaaccacuaagaaaauaccucccugggaggaugagcugg

SEQ ID NO: 49008 - RNA, 64 nt, hsa
aauuaaccaguaaacacucuguaguaaccauuacagaaaauacuucugccuuaaaaaauaugau

SEQ ID NO: 49009 - RNA, 64 nt, hsa
uaauaaugcuaaaaaaggccuaauaaaaugcccaagaaaauauucagugcauuuauagagaagg

SEQ ID NO: 49010 - RNA, 64 nt, hsa
uagggacccugccaaguggcaccugauuuacucuagaaaauaaaaguagaaaauacugagucca

SEQ ID NO: 49011 - RNA, 64 nt, hsa
aaguggcaccugauuuacucuagaaaauaaaaguagaaaauacugaguccagcuguguuguuug

SEQ ID NO: 49012 - RNA, 63 nt, hsa
uuucagaugaugaagaaagaggaacgggcuuggaagaaaauaaucaagaagagcaaagcaugg

SEQ ID NO: 49013 - RNA, 64 nt, hsa
cuaaaugagguagaugaauauucugguucuucagagaaaauagacuuacuggccagugauccuc

SEQ ID NO: 49014 - RNA, 64 nt, hsa
uuuguacauacaaaauucuuccaaaagagagaggagaaaauacagcucugauggcaucaaacgg

SEQ ID NO: 49015 - RNA, 64 nt, hsa
agaaacaaaagucucauucauaagaggucuuagaagaaaauaaccaguuaaccugauuucaauu

SEQ ID NO: 49016 - RNA, 64 nt, hsa
ugggagauuauaaucaguuuguuuucaagauaauagaaaauaagguccaugagaauagaaguua

SEQ ID NO: 49017 - RNA, 64 nt, hsa
auuuauucauacuaggauagaaaauuuuggaaucagaaaauagauccaguguuuagcuacauac

SEQ ID NO: 49018 - RNA, 64 nt, hsa
ugauuaauuauguacacaaaaauauuuuccuuguagaaaauaguuuuccagacacuuagccuuc

SEQ ID NO: 49019 - RNA, 64 nt, hsa
caugcaaaaauagaaaauuauuuguuaaauucagagaaaauaugugaaguuuacaaaggaacca

SEQ ID NO: 49020 - RNA, 64 nt, hsa
caugauaagugcaauuacugccaaaagaucuuucagaaaauauuauccuuuaaagugaaggaga

SEQ ID NO: 49021 - RNA, 64 nt, hsa
uucgaauauucuacuaaaugagaguucugaguauagaaaauaaaacuaaaguugguagaaaaau

SEQ ID NO: 49022 - RNA, 64 nt, hsa
aaaauugcugggaauauuugacucuccguauuggagaaaauaaaauuacaacauuacgacauac

SEQ ID NO: 49023 - RNA, 64 nt, hsa
ggaauuugaaaagccaaacugugaaaccauugggagaaaauagaugauauugucuaugacguug

SEQ ID NO: 49024 - RNA, 64 nt, hsa
auggaauuguuuaauuauuuguacuuuucaugccagaaaauaaaaguucagaaucuuaaggccu

SEQ ID NO: 49025 - RNA, 64 nt, hsa
aaaaaaaaacacaaaaaaagacaaaaaaaaaaaaagaaaauauuuuggcagguuauguuuacca

SEQ ID NO: 49026 - RNA, 64 nt, hsa
uucagguauuuuacuaaaucagagugcugaguauagaaaauaaucuaaaacuaaaauugguaaa

SEQ ID NO: 49027 - RNA, 64 nt, hsa
aaacauaagugcaacuacugucaaaauaucuuuaagaaaauauaagcuuuuaaagugaagagua

SEQ ID NO: 49028 - RNA, 64 nt, hsa
gucacaguucugaaggaaguuagggaggaagccaagaaaauaucuauugugauuaaagguagca

SEQ ID NO: 49029 - RNA, 64 nt, hsa
guuaauuauuugaugggccugccaugugaaaaccagaaaauaaccucguacucacaagccagug

SEQ ID NO: 49030 - RNA, 64 nt, hsa
uuagguggcaaagugagacccugucuccaaaaaaagaaaauagagcuuuauaagcagagagaag

SEQ ID NO: 49031 - RNA, 64 nt, hsa
aaaaaaagaaaauagagcuuuauaagcagagagaagaaaauaaucaucuaagaccaucucucca

SEQ ID NO: 49032 - RNA, 64 nt, hsa
agcuucugcuggaauuugcaaucacugaagucauagaaaauagguaacuaucuaauuagagaaa

SEQ ID NO: 49033 - RNA, 64 nt, hsa
auucauuacugcauccccaguaaugaaaguacuuagaaaauaauuauugaaugaaugaaaucua

SEQ ID NO: 49034 - RNA, 64 nt, hsa
aaaacacaaauuucaaucaaauacuuuuguguauagaaaauauguauaguagguagauagaaaa

SEQ ID NO: 49035 - RNA, 64 nt, hsa
uguuuccuuuaagaaaaaccacagggaccaagaaagaaaauauaacaguuugauuucugucaua

SEQ ID NO: 49036 - RNA, 64 nt, hsa
auguauuuaugcccuuauaucccaaaaaugucuuagaaaauaaaaauucugggccuuacuuguu

SEQ ID NO: 49037 - RNA, 64 nt, hsa
aauuaaucaauggauauccuucaguagugaaugcagaaaauaaaaauacacagguaauuuagua

SEQ ID NO: 49038 - RNA, 64 nt, hsa
ggaagagaaggaauaaauuugucaaaacuaggugagaaaauagagcauugugggaaaaacugag

SEQ ID NO: 49039 - RNA, 64 nt, hsa
ucucaaguuaugaaauaaaacugagagauaauggagaaaauaauuuuuauggguuuuuuugguu

SEQ ID NO: 49040 - RNA, 64 nt, hsa
uuaauggugggguuuucugcuuuguuuuuauuuaagaaaauaaacacgacauauuuaaagaagg

SEQ ID NO: 49041 - RNA, 64 nt, hsa
gggauuggaugaaagucaaagguugucuacuuuaagaaaauaaaauacccugaauggagcccag

SEQ ID NO: 49042 - RNA, 64 nt, hsa
aucaccaacuuaauuuucuuccauagcaaaacugagaaaauaccuuguuucaguauaacacuaa

SEQ ID NO: 49043 - RNA, 64 nt, hsa
uuaacauuuuacuuuuaauuauguaaauuugguuagaaaauaauaauaaaugguuagugcuauu

SEQ ID NO: 49044 - RNA, 64 nt, hsa
uugaguuuugcaacaguaccuguguuguuauuucagaaaauauuauuucucucuuuuuaacuac

SEQ ID NO: 49045 - RNA, 64 nt, hsa
aauaguuccucauucauuuuuauauugaccacuaagaaaauaauucaucagcauuaucucauag

SEQ ID NO: 49046 - RNA, 64 nt, hsa
ggacgagaaaacaauaacgauaaaagacagugaaagaaaauaacgauaaaagacagugaaagaa

SEQ ID NO: 49047 - RNA, 64 nt, hsa
acagugaaagaaaauaacgauaaaagacagugaaagaaaauaacaauaaaagacaaggaaaaaa

SEQ ID NO: 49048 - RNA, 64 nt, hsa
gauguaaagaaaucagauacaaacuacugcaauuagaaaauaaaauaugaacaacuuucaacaa

SEQ ID NO: 49049 - RNA, 64 nt, hsa
ugauuccuauaauacagugcuauaagcuaugcacagaaaauaaaauguuugaaauccaagaaua

SEQ ID NO: 49050 - RNA, 64 nt, hsa
aaaauacauucuuuuugcucuaaaauauuuaugaagaaaauacuuaaauguuauguauauggug

SEQ ID NO: 49051 - RNA, 64 nt, hsa
uuccuauuucagaaguuuaaauauuaagcaugacagaaaauauguauuaacacuacucaaagca

SEQ ID NO: 49052 - RNA, 64 nt, hsa
auuucuuuuagaauaugggaguaagaugagcuagagaaaauaaccuggucucacugugguugcc

SEQ ID NO: 49053 - RNA, 64 nt, hsa
ugaguauuuccuugauugcgguauauguacuacuagaaaauaccaaauggauauauuuucuuua

SEQ ID NO: 49054 - RNA, 64 nt, hsa
aucaccaacuugauuuucuuccauagcaaaacugagaaaauaccuuguuucaguauaacacuaa

SEQ ID NO: 49055 - RNA, 64 nt, hsa; identical to SEQ ID NO: 49043

SEQ ID NO: 49056 - RNA, 63 nt, hsa
agaugaagagccaacuugaugaaugugcuauucauaagcuagaaacuacaguuuuuccaaacu

SEQ ID NO: 49057 - RNA, 63 nt, hsa
guaauauaccaauuaguuuuauauaauauccucauaagcuauucuaauuuuugagagaaacac

SEQ ID NO: 49058 - RNA, 63 nt, hsa
gaauucaagguugguucaacaucuaaaaaucaaauaagcuaauauacagucaguucucauuau

SEQ ID NO: 49059 - RNA, 63 nt, hsa
gaauucaagguuuguucaacaucuaaaaaucaaauaagcuaauaaagaaaagagguuuauacu

SEQ ID NO: 49060 - RNA, 63 nt, hsa
uguauacacauuugcauauacccacauggggacauaagcuaauuuuuuuacaggacacagaau

SEQ ID NO: 49061 - RNA, 63 nt, hsa
aaagcgaugucagagggcgguuuugagcuuucuauaagcuauagcuuuguuuauuucacccgu

SEQ ID NO: 49062 - RNA, 63 nt, hsa
uaaaaacaaacaaacaaaaaaaaaaucuguuagauaagcuaucaaaaugcagcuguuguuuug

SEQ ID NO: 49063 - RNA, 63 nt, hsa
aacagagucucaagacccccgcucuggacugucauaagcuagcacccgugguaagcgggacga

SEQ ID NO: 49064 - RNA, 63 nt, hsa
uggugaguuuaguugugcaugccuuuguuguauauaagcuaaauucuagugacccauguguca

SEQ ID NO: 49065 - RNA, 63 nt, hsa
acucauuuuauucucggcaacaucuggagaagcauaagcuaauuaagggcgaugauuauuauu

SEQ ID NO: 49066 - RNA, 64 nt, hsa
aguuuguggggaggaaagacaucuguguaucacuucaaaauauugauuuacugcuaaacaucac

SEQ ID NO: 49067 - RNA, 64 nt, hsa
cagagagaaaaauguuucgacagccaaguuuucuucaaaauauuaugugacagaauacgacuca

SEQ ID NO: 49068 - RNA, 64 nt, hsa
uggaguuucauaugcagcauuaauuaagcucacaucaaaauagaccagccauuugcacauaguu

SEQ ID NO: 49069 - RNA, 64 nt, hsa
uauuggacaagugacagaaacugaucauccauauucaaaauauuuacagaaaaaagugucagug

SEQ ID NO: 49070 - RNA, 64 nt, hsa
cacagaguuauauguguguguaucaaaaguggucucaaaauauuuuuuuaagaaaaaaagcaaa

SEQ ID NO: 49071 - RNA, 64 nt, hsa
uauucuuuucaaauauuuguaggacaacuuugaaucaaaauaaauuauguuccuucuccaauuu

SEQ ID NO: 49072 - RNA, 64 nt, hsa
uaaaauaugaauuuugcucuauuguaaacaugguucaaaauauuaauauguuuuuaucacaguc

SEQ ID NO: 49073 - RNA, 64 nt, hsa
uauaaacuauuauaaguacuauuuuuguuauaauucaaaauagauauuuaguauaaaguuuuug

SEQ ID NO: 49074 - RNA, 64 nt, hsa
uccugcaauuauguugaaaagaguaguacuuucuucaaaauauaaaaugccaagcacuucaggc

SEQ ID NO: 49075 - RNA, 64 nt, hsa
gguuuuguucuuguauugcuuucuuucaacaguuucaaaauaaaauaucauauaaauauugagg

SEQ ID NO: 49076 - RNA, 64 nt, hsa
cauauaaauauugagggaaauguuuucauauuuuucaaaauagguuuuuauuguugaauguaca

SEQ ID NO: 49077 - RNA, 64 nt, hsa
ucacguuugcuuaaaugcuucaucacagucacauucaaaauagugacucuaaacaaagaagaaa

SEQ ID NO: 49078 - RNA, 64 nt, hsa
agacuuguuuuauuagauuuuaccaaugaauuuuucaaaauacaaaaaaaaguaguuuuuccuu

SEQ ID NO: 49079 - RNA, 64 nt, hsa
guuuguugcauuucaguaaaagcagaauaaccuuucaaaauaauaacaggcugggugcaauggc

SEQ ID NO: 49080 - RNA, 64 nt, hsa
cagccuggccugggcaacagagcaagacccugucucaaaauaauaauaauauauaauuuuacac

SEQ ID NO: 49081 - RNA, 64 nt, hsa
ggugggaaauagcagugaauuuuagucauuaacuucaaaauauauauauauauauaauuuaaag

SEQ ID NO: 49082 - RNA, 64 nt, hsa
uaaguuuaguaaauauuaauaaauggauacacauucaaaauacuuuuaaaaaaaagaaaauguu

SEQ ID NO: 49083 - RNA, 64 nt, hsa
aguuaguaacuaggugguucacaaaauuacaacaucaaaauaguuacaucuugugaaaauauau

SEQ ID NO: 49084 - RNA, 64 nt, hsa
acuuugaugucaguacaacuucagcaauugguuuucaaaauagaugagaauaugguacagauug

SEQ ID NO: 49085 - RNA, 64 nt, hsa
gugaaggacauuuauuuagagucugacaacauauucaaaauauuuuucagccucuacugauagu

SEQ ID NO: 49086 - RNA, 64 nt, hsa
guaaauuauauuuauacaucuucugaaauauauuucaaaauauguguguacguguguauaugug

SEQ ID NO: 49087 - RNA, 64 nt, hsa
ggcacuccagccugggugacagagugagacugucucaaaauaaaauaaaaauaacauauuggug

SEQ ID NO: 49088 - RNA, 64 nt, hsa
acacauauggagguuugcugccauauauauugcaucaaaauaucauuaauuaauauaaaaauau

SEQ ID NO: 49089 - RNA, 64 nt, hsa
gguugagacuaaauuacucaucgucaaaauaaugucaaaauaguuuuggggaucaccacuauau

SEQ ID NO: 49090 - RNA, 64 nt, hsa
aaaaagauuuugguugagacuaaauuacucaucgucaaaauaaugucaaaauaguuuuggggau

SEQ ID NO: 49091 - RNA, 64 nt, hsa
ugucaucguuauccucucuuaugaacaacuguagucaaaauaagguggcacaauuuaauuguuu

SEQ ID NO: 49092 - RNA, 64 nt, hsa
ucucuaagaguuuuuuuccuucugagcuuccuuuucaaaauaaaagugacaauuguagcauuga

SEQ ID NO: 49093 - RNA, 64 nt, hsa
aaaguggggaggaagggaggaaaaauaauuacagucaaaauauuugcaaucuaucuacucauuu

SEQ ID NO: 49094 - RNA, 64 nt, hsa
auaaaagguguuguggaaacuuaaaauucuuaauucaaaauauucgguccuguccacuguuuau

SEQ ID NO: 49095 - RNA, 64 nt, hsa
cacuccagccugggugacaaagcaagacugugucucaaaauaaauaaauaaaauaaaauaaaau

SEQ ID NO: 49096 - RNA, 64 nt, hsa
guagauagcagagcaugguauuagugaaaaagguucaaaauacacaaguaacauacacucugaa

SEQ ID NO: 49097 - RNA, 64 nt, hsa
aacaugaaaagggcuuuauuuucaaaaauuaacuucaaaauaaguguauaaaaugcaacuguug

SEQ ID NO: 49098 - RNA, 64 nt, hsa
uaucaaaguaauaacacaaaugaagugucauuauucaaaauaguccacugacuccucacaucug

SEQ ID NO: 49099 - RNA, 64 nt, hsa
uggaagaauauuuauaggcaauacagucaaaguuucaaaauagcaucacacaaaacauguuuau

SEQ ID NO: 49100 - RNA, 64 nt, hsa
uagauguuuuguguguauuuuuuuaaaugaaaacucaaaauaagacaaguaauuuguugauaaa

SEQ ID NO: 49101 - RNA, 64 nt, hsa
uggcauuauacugaacuauacauugagaaaucaaucaaaauaaaaauuuuuacuuucacaaguu

SEQ ID NO: 49102 - RNA, 64 nt, hsa
aaaaauauuuuagcuuagacuaagcuaccugccuucaaaauaguuuagggaccaccaccauauu

SEQ ID NO: 49103 - RNA, 64 nt, hsa
uguauuauuugauacuaaauuuucaauuauuacuucaaaauaagagucugaggauuucuucuua

SEQ ID NO: 49104 - RNA, 64 nt, hsa
cugaaaacuaaucaaauauagugccuauuuagucucaaaauaagguaacuauuaacuugauuau

SEQ ID NO: 49105 - RNA, 64 nt, hsa
acacuacugaauuauaaaaauucaaucauaaaagucaaaauauauuacauaauauaguuuaaug

SEQ ID NO: 49106 - RNA, 64 nt, hsa
uuuuaacuguuuuugcuacuccauauauugucauucaaaauauauuuuaacccaaaauaaguua

SEQ ID NO: 49107 - RNA, 64 nt, hsa
cagagcuaauguuuauccauuuaaaagguauaaaucaaaauaacaaauuaucuaaaaaaaaucu

SEQ ID NO: 49108 - RNA, 64 nt, hsa
ucaauauuuccauugaacacagaugcagaaauccucaaaauauuagcaaaucaggaaugcaagg

SEQ ID NO: 49109 - RNA, 64 nt, hsa
uuggaacauuaucuacaauuuuacucucaaauagucaaaauaaaaacaucucaauuucuaauac

SEQ ID NO: 49110 - RNA, 64 nt, hsa
auguauucauucacuuucaagauuuguuuuggugucaaaauaacaugaaaagguagauggaguu

SEQ ID NO: 49111 - RNA, 64 nt, hsa
augaucugauuacacuggacacucuuaggaaguaucaaaauagaacaguucaauuugcagcuac

SEQ ID NO: 49112 - RNA, 64 nt, hsa
gucucagaugauuauuccaguuuucaaugauuuuucaaaauaaaagucaaucagcauuguuauu

SEQ ID NO: 49113 - RNA, 64 nt, hsa
gaugugaaguauucaugagaaucuguagauuccaucaaaauaaguaggaacucauacuaaaauu

SEQ ID NO: 49114 - RNA, 64 nt, hsa
aggcugaugcuugaaguaacuguggagggaguguucaaaauacuacugacgcaggcaccuucuu

SEQ ID NO: 49115 - RNA, 64 nt, hsa
uaaaaaagcacuaugaacuacagguguuugacuuucaaaauauauuuuguauuguuaauaucuu

SEQ ID NO: 49116 - RNA, 64 nt, hsa
uauuguaaauuauauuugugcuauaguauuugauucaaaauauuuaaaaaugucuugcuguuga

SEQ ID NO: 49117 - RNA, 64 nt, hsa
cacaagugccgcaaauuguaccuuuuuuguuuuuucaaaauagaaaaguuauuagugguuuauc

SEQ ID NO: 49118 - RNA, 64 nt, hsa
ccucaggccuguaacuucuggaaaagaugauuauucaaaauaauguuuugggguaaccagugga

SEQ ID NO: 49119 - RNA, 64 nt, hsa
ugguauccuguuacagccuuggcucuuaaacaacucaaaauauugggauaggcugucaguaugu

SEQ ID NO: 49120 - RNA, 64 nt, hsa
gagauuuaaaguucuaagggauugucaauagauaucaaaauauuaaucauuggacaaaggcuuu

SEQ ID NO: 49121 - RNA, 64 nt, hsa
cacuccagccuggacgacagagugagauucugucucaaaauaaauacauacauacauacaauaa

SEQ ID NO: 49122 - RNA, 64 nt, hsa
agaaguagaucaaaauagaacacaauagagaacuucaaaauaaaacaggugugagaauugugug

SEQ ID NO: 49123 - RNA, 64 nt, hsa
augacccaggaauagcuaaugacacagaaguagaucaaaauagaacacaauagagaacuucaaa

SEQ ID NO: 49124 - RNA, 64 nt, hsa
uuagaucuuguuucaaacuuuacaauagcauucuucaaaauauuaaguuauauauuuuauaggc

SEQ ID NO: 49125 - RNA, 64 nt, hsa
agaguuaauuuuaauccuucccuauaauuauacuucaaaauauuugacaucugcuauuaugccu

SEQ ID NO: 49126 - RNA, 64 nt, hsa
ccagaaucaucaaaauagugaaagacugaucuguucaaaauauuugcuauaugcacuggguaua

SEQ ID NO: 49127 - RNA, 64 nt, hsa
ccaagacuguaacagggagaaaugcccagaaucaucaaaauagugaaagacugaucuguucaaa

SEQ ID NO: 49128 - RNA, 64 nt, hsa
augguguuggagacuauuagcuauuagauuuuucucaaaauaugaguuuuguacaauggaauga

SEQ ID NO: 49129 - RNA, 64 nt, hsa
augaaugcuguggagaggcaucuggaacagaaauucaaaauaaagccuugacauuaaauacccc

SEQ ID NO: 49130 - RNA, 64 nt, hsa
uuuccauuuauacccuacugugucaguucaagcaucaaaauaccuugcaucugagacagacuuc

SEQ ID NO: 49131 - RNA, 64 nt, hsa
ccagaauuaaaaccaaucauaaguagaacccacuucaaaauaaaaaaacagcauuacuauuucu

SEQ ID NO: 49132 - RNA, 64 nt, hsa
cuacaucaccgccuugguaaacaguauuauaaaaucaaaauauggguaaaaguaaauauuuacc

SEQ ID NO: 49133 - RNA, 64 nt, hsa
aauaagacuaauuuuuaagaguaacucaguaauuucaaaauacagauuugaauagcagcauuag

SEQ ID NO: 49134 - RNA, 64 nt, hsa
acuaauuuuucuuacacacuaaauggguauuuguucaaaauaaugaaguuauggcuucacauuc

SEQ ID NO: 49135 - RNA, 64 nt, hsa
uucuuaauaggccuaaaauagugagcauauauaaucaaaauaauacuucauacaacauauacuu

SEQ ID NO: 49136 - RNA, 64 nt, hsa
cuaucauuuggcuggaugggggugaaguaugucuucaaaauauauugaaguaaguucaucaaac

SEQ ID NO: 49137 - RNA, 64 nt, hsa
acugacacagcauucaugauguuaccuucacuuuucaaaauauuguagaaggauuuuucucaug

SEQ ID NO: 49138 - RNA, 64 nt, hsa
auuugagagcaugaagauauucaugcuuuugaacucaaaauauugaagauacucucaagccugu

SEQ ID NO: 49139 - RNA, 64 nt, hsa
aacaaccaagaacaaagccccgggacuguuuucuuuuuaauaaagccacaggcaggcaucguag

SEQ ID NO: 49140 - RNA, 64 nt, hsa
augaaugagucaccuugugauuuuuaaauuuuuauuuuaauaaagcuaaucaauuucuacaacc

SEQ ID NO: 49141 - RNA, 64 nt, hsa
gaugcauauagugaaauuuuuuaaauggauauacuuuuaauaaaguuuuauaacucacugacaa

SEQ ID NO: 49142 - RNA, 64 nt, hsa
guuguauuaauucaguauuugucauuaugcaguauuuuaauaccuacauaagucuauuccauua

SEQ ID NO: 49143 - RNA, 64 nt, hsa
agauacuauuuuggauguguaucaguauuuuuguuuuuaauaaugauugauuuguggagcauug

SEQ ID NO: 49144 - RNA, 64 nt, hsa
ucacuggcacuucucuccucaacuguaauucuauuuuuaauaauaaaaauggcauacuguaggg

SEQ ID NO: 49145 - RNA, 64 nt, hsa
aaccuuaacuguuccuuaaggauuuuagccaguauuuuaauagaacaugauuaaugaaagugac

SEQ ID NO: 49146 - RNA, 64 nt, hsa
uaugguagcuuuguuguauauuauuguaaaauuauuuuaauaagucauggggaugacaauuuga

SEQ ID NO: 49147 - RNA, 64 nt, hsa
auuaagaccucaagcccuuuauucuuaaaaggguuuuuaauaaagucuuucucaaaugagguag

SEQ ID NO: 49148 - RNA, 64 nt, hsa
aucaccuuaucaaauuaaaaugggaagaaaguaauuuuaauaauuuuuaauaaucauaugucag

SEQ ID NO: 49149 - RNA, 64 nt, hsa
caaauuaaaaugggaagaaaguaauuuuaauaauuuuuaauaaucauaugucagcauucugacu

SEQ ID NO: 49150 - RNA, 64 nt, hsa
uuaaaaauauuuuagaaguuuuguaauggugguguuuuaauauuuuacauaauuaaauauguac

SEQ ID NO: 49151 - RNA, 64 nt, hsa
cugggcucauagggacacuuggucacuccagaguuuuuaauagcucccaggaggugauauuauu

SEQ ID NO: 49152 - RNA, 64 nt, hsa
aacuucuagaauaacccagaugcgcuuuaauuuuuuuuaauauguuuugaucacagaacuucua

SEQ ID NO: 49153 - RNA, 64 nt, hsa
acuucuagaauaacccagaugcucuuucauauucuuuuaauacaucuugaucacagcuggggga

SEQ ID NO: 49154 - RNA, 64 nt, hsa
gauugagccaauauacaaauaccucaucuguucuuuuuaauauuuuaucucuguuuguagagag

SEQ ID NO: 49155 - RNA, 64 nt, hsa
cauauucaaucauugaauccuuauagaauuugucuuuuaauagacagaaaaauuaaugaaacuu

SEQ ID NO: 49156 - RNA, 64 nt, hsa
gauuuuaaaaaccagaauuuuaguugcaauacaauuuuaauaucacccuacauauuauuuauaa

SEQ ID NO: 49157 - RNA, 64 nt, hsa
gugcaaacaaguauucauuuucauacaggaauuuuuuuaauauguuauuuuuuuaaaaguucau

SEQ ID NO: 49158 - RNA, 64 nt, hsa
auuucauuucuggaggaugaccuugagggaagcuuuuuaauauuaguuucaagcuuuccuuacc

SEQ ID NO: 49159 - RNA, 64 nt, hsa
auuaaccucaccaaaugaagcuuuuucuauccauuuuuaauauuguccuuacauaauauugucc

SEQ ID NO: 49160 - RNA, 64 nt, hsa
uugcacauguauugggggaggcgcuucauuuuuauuuuaauacacauguauuuccuccuugcac

SEQ ID NO: 49161 - RNA, 64 nt, hsa
guacaaagccuuggauacaguuugcuuguaauauuuuuaauaaugugaggaguacaguguuuuc

SEQ ID NO: 49162 - RNA, 64 nt, hsa
guacacacacuugauuguucuggaugaaugucuuuuuuaauacuccgaaaauuucaucaucuaa

SEQ ID NO: 49163 - RNA, 64 nt, hsa
uccuaccaacuauugacagaauacagaguugauuuuuuaauaaaaaguuauauauaauuauccc

SEQ ID NO: 49164 - RNA, 64 nt, hsa
aagagcuauaauuuuuaaaaaaaaaaaucuuuuauuuuaauacauuguaggaaaucuucauaau

SEQ ID NO: 49165 - RNA, 64 nt, hsa
guguggaauacuaacuauauguauuuuaacuuaguuuuaauauuuucauuuuuggggaaaaauc

SEQ ID NO: 49166 - RNA, 64 nt, hsa
auuacaaacugguuuuaaauauuggacauacugguuuuaauaccugcuuugcauauucacacau

SEQ ID NO: 49167 - RNA, 64 nt, hsa
uaggauugggaaagaaguugcuaagugugcuuaguuuuaauaaguaauuccuucucuuuuuuca

SEQ ID NO: 49168 - RNA, 64 nt, hsa
aguagguucuguuuuguuuuguuuuaaucuuagcuuuuaauagugucauaaagauuauaauaug

SEQ ID NO: 49169 - RNA, 64 nt, hsa
gcucuugagauuacuugcacaauguggcuauaaguuuuaauauuuuguggagcagagggauggu

SEQ ID NO: 49170 - RNA, 64 nt, hsa
aucugaaaacugaauguccuaugugaguauuagauuuuaauagcaugcuuuaaagacugaugag

SEQ ID NO: 49171 - RNA, 64 nt, hsa
auuaucaaauuauaaugauaguauaauuaucccuuuuuaauauuggggaaagaaaaaugaaaau

SEQ ID NO: 49172 - RNA, 64 nt, hsa
uccauaucagaagaaauaacuuuauaacaauuuuuuuuaauaaugaaaaauauuuucgugacaa

SEQ ID NO: 49173 - RNA, 64 nt, hsa
ucuuguaaaaaguauguauuuggaauuuucuucguuuuaauagaauauuauaaacucaaaauau

SEQ ID NO: 49174 - RNA, 64 nt, hsa
aaaacaagggaaauuuaaaucuccaaauaaggcauuuuaauagacuguacugcuucuuaaacca

SEQ ID NO: 49175 - RNA, 64 nt, hsa
ugagaaaaugaaauagaaacuuucuggaaaaauauuuuaauagugauaauaacaucagauuuua

SEQ ID NO: 49176 - RNA, 64 nt, hsa
ggaaaaauauuuuaauagugauaauaacaucagauuuuaauauaacauuccagagaauugugga

SEQ ID NO: 49177 - RNA, 64 nt, hsa
uguugugaauguaaaggagggagcauucuuugcuuuuuaauauacaaaccaugguuuuuuggag

SEQ ID NO: 49178 - RNA, 64 nt, hsa
cccuacuauugccucucugaccuuuuuaaauuauuuuuaauaccaaaagaguucuuuugaaaug

SEQ ID NO: 49179 - RNA, 64 nt, hsa
aaauaguaacaccaaacaugauuauacaggaauauuuuaauaaguguaucaccaugcagaugua

SEQ ID NO: 49180 - RNA, 64 nt, hsa
aaagccuaacauucuaauaaaggcacaaauuucuuuuuaauacuuguuucagccucuuuaaucu

SEQ ID NO: 49181 - RNA, 64 nt, hsa
uuuuguaaugugcucaauacaaauacuugugaacuuuuaauauguugagugcuuucauuuugau

SEQ ID NO: 49182 - RNA, 64 nt, hsa
gaguuguuuccuuuaaagaauuuuacacuacauauuuuaauaguaaacagggaucacuuuuccu

SEQ ID NO: 49183 - RNA, 64 nt, hsa
gcuacuguauaauugggggugauaauaccaggaauuuuaauaagauuuuguaaagaauauccag

SEQ ID NO: 49184 - RNA, 64 nt, hsa
acgaguaugauuuagcauucauacuaguugaaauuuuuaauagaaucaaggcacaaaagucuua

SEQ ID NO: 49185 - RNA, 64 nt, hsa
cuuuugaucuguaaugcuuuuauacaaaaguuuauuuuaauaauaaaauguuuguucuaacuug

SEQ ID NO: 49186 - RNA, 64 nt, hsa
acagaacaagaccccgucucaaaaaaaauuuuuuuuuuaauaaaacaaaauuuguuugaaaucu

SEQ ID NO: 49187 - RNA, 64 nt, hsa
cuuuaaaauuuaaguaucuuuuuucaaaaacauuuuuuaauagaauaaaauauaauuugaucuu

SEQ ID NO: 49188 - RNA, 64 nt, hsa
guguuagagcuuaugcauuuguuuuuaugagagauuuuaauaaauuuaauuauuugcuugucca

SEQ ID NO: 49189 - RNA, 64 nt, hsa
uacaucuagcuaaaagugugguuuaucuaaaccguuuuaauaagcaagaugacugggaaaucuc

SEQ ID NO: 49190 - RNA, 64 nt, hsa
gaaaagaaccuaacauuauuuacaguagaugugguuuuaauacaauuacugcccuaaaaugucu

SEQ ID NO: 49191 - RNA, 64 nt, hsa
aaaaauaguuuuuaaaggaaaaaguacaguauucuuuuaauaaacuggcucacagucugguagg

SEQ ID NO: 49192 - RNA, 64 nt, hsa
gucuauuugaaauaugcaaaagguaugaggaauguuuuaauaccuccaaauuuuuaagaaaagc

SEQ ID NO: 49193 - RNA, 64 nt, hsa
cagaguuggagugccuucauccaaguaugaccacuuuuaauacacuuuuuugagugguuccuca

SEQ ID NO: 49194 - RNA, 64 nt, hsa
aaaugcauugaaaauuugaaagguaaaaaucuuauuuuaauagcguauuuuguguuggcuauua

SEQ ID NO: 49195 - RNA, 64 nt, hsa
aagauugaauaaacuuuauuggaaaaugcuaaaauuuuaauauaguuacacucaguuccuuugu

SEQ ID NO: 49196 - RNA, 64 nt, hsa
uacaaaccaugcuuucaauguuggcuuccaaguuuuuuaauaagaaacuuuuuguauuuacuug

SEQ ID NO: 49197 - RNA, 64 nt, hsa
uuuugcacuguuucaaugcugguaauugaaaccauuuuaauauauuugguuguauucacuuuau

SEQ ID NO: 49198 - RNA, 64 nt, hsa
augguuucugcaaugagaggaaguguaaugauuauuuuaauauuucuauuaaaacuguauauuu

SEQ ID NO: 49199 - RNA, 64 nt, hsa
aacuguguuguucuuaaaucaaaaauuggauaauuuuuaauauuuauguauuaaucacacagug

SEQ ID NO: 49200 - RNA, 64 nt, hsa
aaucuuaaugcagaaauuauauagucuccucagauuuuaauauuuuuauuucuuuccuggcaca

SEQ ID NO: 49201 - RNA, 64 nt, hsa
cuaaauuuacacuuaaaguuggaguguauaaacauuuuaauauauguuaauguugccagaauga

SEQ ID NO: 49202 - RNA, 64 nt, hsa
aaaaaauuacuaaccacugauguucaagauuuucuuuuaauagcacuauccuugagaaccaaaa

SEQ ID NO: 49203 - RNA, 64 nt, hsa
uauuuaggauaagaaucauuuuuaauuauaauacuuuuaauacuuucauauauuuuacaacagu

SEQ ID NO: 49204 - RNA, 64 nt, hsa
aauacagaauuauuuuaaguguuuugaacuuaauuuuuaauaacaugcaugggucccucucacu

SEQ ID NO: 49205 - RNA, 64 nt, hsa
uccugguaccuguauuuaaaauguacauuccacauuuuaauaaauuaaccacaagaaaauaauc

SEQ ID NO: 49206 - RNA, 64 nt, hsa
uauuuggcauuuagacuaacuucuagauguauauuuuuaauaauagauucauaauguuacauuu

SEQ ID NO: 49207 - RNA, 64 nt, hsa
uaauuuuaaaacuaaacucauacuuuugcuaucuuuuuaauauuuaucucguuugggaguauac

SEQ ID NO: 49208 - RNA, 64 nt, hsa
ucagggcgaaagacaggugauguagcacuucuguuuuuaauaauuauugcuuaaaauaccuauu

SEQ ID NO: 49209 - RNA, 64 nt, hsa
gauugugaaaauaucaaaauauaaaugaaucaaguuuuaauauacuguaugauggguggaugag

SEQ ID NO: 49210 - RNA, 64 nt, hsa
caugcguuuaaucauugucucuucauuuuaagacuuuuaauacaaaugucauuuuuaaagaaac

SEQ ID NO: 49211 - RNA, 64 nt, hsa
accucuuuauagucuaggauggcagagcagaagauuuuaauaugcuuuuauuaagugauguaaa

SEQ ID NO: 49212 - RNA, 64 nt, hsa
auguuauuucaaaaggguuauuuuuguccuccuuuuuuaauagcuucaggaaaguuaaagguau

SEQ ID NO: 49213 - RNA, 64 nt, hsa
caacaaaacuagagguaugaauuaaugcuacacauuuuaauacacacauuuauucagauacucc

SEQ ID NO: 49214 - RNA, 64 nt, hsa
auuuaaaucaaaauguguacuuuaaucuaaaauguuuuaauaaucuguauuucuuauaauuuua

SEQ ID NO: 49215 - RNA, 64 nt, hsa
uccucuucuauuccuauauucuuuucuggauuuuuuuuaauaauuagugauauaagcauuguuu

SEQ ID NO: 49216 - RNA, 64 nt, hsa
aaauguccuguuugauacuacuguagaacacuauuuuuaauacagaaaaagcucccuauaaugc

SEQ ID NO: 49217 - RNA, 64 nt, hsa
ugauugagaguuggcuguauuuagauuuaucacuuuuuaauagggugagcuugagaguuuucuu

SEQ ID NO: 49218 - RNA, 64 nt, hsa
uauaguaaaauuuuuuauaaacuaaaguuguaccuuuuaauauguaguaaacucucauuuauuu

SEQ ID NO: 49219 - RNA, 64 nt, hsa
aacuuuuagaauuugggcuggugagauuaauuuuuuuuaauaucccagcuagagauauggccuu

SEQ ID NO: 49220 - RNA, 64 nt, hsa
uguuuuucuuucuuccuuuccuuuucucugagaguuuuaauacuuucaaggacuuuaaaaaaau

SEQ ID NO: 49221 - RNA, 64 nt, hsa
gugccauaagacauuuuagcauguuaaauagcacuuuuaauagcaaaaaaaggcacaucaacug

SEQ ID NO: 49222 - RNA, 64 nt, hsa
guuuguuuauguuacauuuauuucaccagaacuauuuuaauauaucaaagggguuuacuaugcc

SEQ ID NO: 49223 - RNA, 64 nt, hsa
aaacagagagagagaauauuggagauguccugaauuuuaauaggguacgcgccauuagggcuuu

SEQ ID NO: 49224 - RNA, 64 nt, hsa
uuguaaagcugauaguuggagcauuuuuuuauuuuuuuaauaaaaaugaguuggaaaaaaaaua

SEQ ID NO: 49225 - RNA, 64 nt, hsa
uuaucagugacagaguucacuauaaaugguguuuuuuuaauagaauauaauuaucggaagcagu

SEQ ID NO: 49226 - RNA, 64 nt, hsa
aucuugguacuacuagaugucuuuaggcagcagcuuuuaauacaggguagauaaccuguacuuc

SEQ ID NO: 49227 - RNA, 64 nt, hsa
uacauauuguauauuuuaagaauucuuuauacaauuuuaauauacugcaauacugcaguuuuug

SEQ ID NO: 49228 - RNA, 64 nt, hsa
uauaugaauuuuugcauucauuauugaauaacucuuuuaauauuuuugagcaaugauuauacug

SEQ ID NO: 49229 - RNA, 64 nt, hsa
gcugaagguaaaucaauggaaaaaugaaauuuauuuuuaauauuacuacuauaugaauuaucuu

SEQ ID NO: 49230 - RNA, 64 nt, hsa
ugacuucauuauuuggaaggaaaauuaguauuuuuuuuaauauuauauggaccaucugauuaua

SEQ ID NO: 49231 - RNA, 64 nt, hsa
uauaaaaugcauaguaaaccacuaacguuagcuguuuuaauaaaaguuuucaguuauaaguuua

SEQ ID NO: 49232 - RNA, 64 nt, hsa
uuuauauguauguacguauuucagguccuugaaauuuuaauaaauauuacaguuaaauccugau

SEQ ID NO: 49233 - RNA, 64 nt, hsa
uuaucagauaucagcauaugccuaauaaaacuuauuuuaauaagcauuuaauuuuccauaauau

SEQ ID NO: 49234 - RNA, 64 nt, hsa
uugacacugaagcauauuaugcaaacaagcuuuguuuuaauauaaagcaauccccaaaagauuu

SEQ ID NO: 49235 - RNA, 64 nt, hsa
guauggucugguuaaaguuccuuuguuccuuuuguuuuaauaaaaugugucacugauuuuuuag

SEQ ID NO: 49236 - RNA, 64 nt, hsa
caguuauuggaugagugaaagauaaucauguugguuuuaauagugucaauuuuuguaaaauaaa

SEQ ID NO: 49237 - RNA, 64 nt, hsa
cuauauauucauuuacagauuauucauacauucauuuuaauaacauugaguacugauggauguu

SEQ ID NO: 49238 - RNA, 64 nt, hsa
aaguucuaugauucauguuuuaaagauggaauaauuuuaauacauauuuuguuuaaauauaauc

SEQ ID NO: 49239 - RNA, 64 nt, hsa
aacaucccuuauuggcuuacaugauuuuauugccuuuuaauagauauuuugucauuuuggccaa

SEQ ID NO: 49240 - RNA, 64 nt, hsa
uuucuaagauucccauuaguuuucccuuuuuccuuuuuaauaugaguaaugcuuuauaaaaaug

SEQ ID NO: 49241 - RNA, 64 nt, hsa
gggaaugacuuaaugucaauuuguuuguugguuguuuuaauaauacuuccuuauguagccauua

SEQ ID NO: 49242 - RNA, 64 nt, hsa
gacagugucaugauguaguagugucuuacugguuuuuuaauaaauccuuuuguauaaaaaugua

SEQ ID NO: 49243 - RNA, 64 nt, hsa
ugacccaaaugccaagguaauuuuaaauuuacauuuuuaauaaaagcaacauguugaaacaaga

SEQ ID NO: 49244 - RNA, 64 nt, hsa
ugcauauuuucaggcaugguaacagaaauuuaccuuuuaauaaauuaaaaaaucuaaauuuuaa

SEQ ID NO: 49245 - RNA, 64 nt, hsa
aacaagaugugcaaaccggacaugcaggugaauauuuuaauagguuacuauaagguucucaauu

SEQ ID NO: 49246 - RNA, 64 nt, hsa
augccugcaaguguggauuugguucucccauacauuuuaauauguauuauauuuaaaucaaaca

SEQ ID NO: 49247 - RNA, 64 nt, hsa
auuacauacauguuuauacauaagcauuacauuuuuuuaauaaaaauguauacagguggggcac

SEQ ID NO: 49248 - RNA, 64 nt, hsa
uuuucagaauggaaauuuauaauauaaauauauguuuuaauaccacaaacacuguggggcacuu

SEQ ID NO: 49249 - RNA, 64 nt, hsa
uuaccuuugcccuaccuucuguuuguaaggaugauuuuaauauuaauuccaggaacacauguuu

SEQ ID NO: 49250 - RNA, 64 nt, hsa
cuauggaugaucuuuaggaaaagcagcccuuuacuuuuaauacaggcuuuaaugaacuauaccu

SEQ ID NO: 49251 - RNA, 64 nt, hsa
cuuuuauuacugagagaucuucauauacuucauuuuuuaauauaaauaauuuuaauaaauuuua

SEQ ID NO: 49252 - RNA, 64 nt, hsa
gaucuucauauacuucauuuuuuaauauaaauaauuuuaauaaauuuuauuuucuuauauucug

SEQ ID NO: 49253 - RNA, 64 nt, hsa
aaaaugcagacauuuuuggugaauguuuagccauuuuuaauauuaauaaauugauguuaagugu

SEQ ID NO: 49254 - RNA, 64 nt, hsa
aucaucuuaaugugaaagauauuugaaguauuaauuuuaauauauuaaauaugauuucuguuau

SEQ ID NO: 49255 - RNA, 64 nt, hsa
cauugauuaaauaaugauuaaugcauucuccacauuuuaauauugcaaaggcccauuggaguuu

SEQ ID NO: 49256 - RNA, 64 nt, hsa
uggagcuuuuucuuuugaaaauauauauucacaauuuuaauauuuuaauuuauuuuuuacuauu

SEQ ID NO: 49257 - RNA, 64 nt, hsa
caguucucaauauuuuuaauuagaugucauauuuuuuuaauauaguaaaaccuugggauauaga

SEQ ID NO: 49258 - RNA, 64 nt, hsa
cuugggaaaaaaucagcaucuagguaaauuauuauuuuaauaacaacucuuaaauugccaaccu

SEQ ID NO: 49259 - RNA, 64 nt, hsa
agcaucuugaaauucaguuuuacucuaaauguacuuuuaauacuugcagauucuaagauuacau

SEQ ID NO: 49260 - RNA, 64 nt, hsa
uuucugaaagauugggcuuuaaaauaaaauaauauuuuaauauugaaccauuuuuuaacuucuu

SEQ ID NO: 49261 - RNA, 64 nt, hsa
aagcauauguacaaaaaucauuuuuacguuuuauuuuuaauaaaucauuguguuugaccguaca

SEQ ID NO: 49262 - RNA, 64 nt, hsa
agauuauuuuauagcuuauuuuggauauuuuuucuuuuaauaaacuaauaugaucauuugaauu

SEQ ID NO: 49263 - RNA, 64 nt, hsa
cugaugcacacugccaugcuggccuuacgaaauguuuuaauaggcauuucacuaauagggaucu

SEQ ID NO: 49264 - RNA, 64 nt, hsa
gguggccuuauuuuugcuauguuaagguuguguuuuuuaauacuuggauuuauuuucauauacu

SEQ ID NO: 49265 - RNA, 64 nt, hsa
gaugauggaaaauaguuauauaaaugaagaacauuuuuaauauggcauguaaagcuuuuaaagu

SEQ ID NO: 49266 - RNA, 64 nt, hsa
ggaccacugccuugaaagcaagugugauuuuuauuuuuaauauuauuuuauuugugucugugua

SEQ ID NO: 49267 - RNA, 64 nt, hsa
auaaauuuuaugaaacccaagcauagugcuuauuuuuuaauaaaacaacugacuuaacacauug

SEQ ID NO: 49268 - RNA, 64 nt, hsa
auauuagccaccaugccuguccuauuuucuuauguuuuaauauauuuuaauauauuacaugugc

SEQ ID NO: 49269 - RNA, 64 nt, hsa
ccaugccuguccuauuuucuuauguuuuaauauauuuuaauauauuacaugugcaguaauuaga

SEQ ID NO: 49270 - RNA, 64 nt, hsa
auacauuacaaauuauuaaguuagcuuuucagaguuuuaauauagaaguuacuagcacugacac

SEQ ID NO: 49271 - RNA, 64 nt, hsa
uucaaaaugaguagauaugauuagauccuuuaccuuuuaauaucuaguuuuuccaaaaaugaua

SEQ ID NO: 49272 - RNA, 64 nt, hsa
gaaagaaaaauguuauuacugucauuagguugucuuuuaauacuuuaaguuauuuugacgaaaa

SEQ ID NO: 49273 - RNA, 64 nt, hsa
uacuaguuuauauuaauauaguuuuuuucucccuuuuuaauaaaauaauuacagucaucccuca

SEQ ID NO: 49274 - RNA, 64 nt, hsa
gcacaaaugagagugugagagaaaguaccuucuauuuuaauaauaauauuauuauaaaaauaau

SEQ ID NO: 49275 - RNA, 64 nt, hsa
uguauaaacaauggcacugugaaaauacuguuaguuuuaauacaagagaaugcauuuguaaaua

SEQ ID NO: 49276 - RNA, 64 nt, hsa
acugccaggccugauaggaaaaaucugcucuuccuuuuaauaacagugaugaauugucaggacc

SEQ ID NO: 49277 - RNA, 64 nt, hsa
cuguguaucuauaaauaaagcauccuauaugaguuuuuaauaauaaacaagggauuuguccuua

SEQ ID NO: 49278 - RNA, 64 nt, hsa
uacaucgcugucugaaauuuuaguuauuuuuuguuuuuaauaaagacuaacacaaacuuaauga

SEQ ID NO: 49279 - RNA, 64 nt, hsa
ucuauauugcaaugauuuuuuuagcauuuuaauauuuuaauauauauuguaaaauuuagacuga

SEQ ID NO: 49280 - RNA, 64 nt, hsa
caguguauucuauauugcaaugauuuuuuuagcauuuuaauauuuuaauauauauuguaaaauu

SEQ ID NO: 49281 - RNA, 64 nt, hsa
ucacuuuucauguggcaggaaacuggaauaucgcuuuuaauaaaauggaaaaauaugcuucuac

SEQ ID NO: 49282 - RNA, 64 nt, hsa
cuacaaagaugauaaagcagucacuucuggcgcauuuuaauaauuuaaagauuuuuagugcaau

SEQ ID NO: 49283 - RNA, 64 nt, hsa
uuugggaaacauuuuaauaacgaauuaauaaacauuuuaauaucaaaacuaaaguguuuuucuu

SEQ ID NO: 49284 - RNA, 64 nt, hsa
aaaauggagacggcuuucauauguuugggaaacauuuuaauaacgaauuaauaaacauuuuaau

SEQ ID NO: 49285 - RNA, 64 nt, hsa
aaccaggagauguuuaaugugccugauuuaauguuuuuaauaaucacagcaaaugaaagguggu

SEQ ID NO: 49286 - RNA, 64 nt, hsa
ccuccuugaaacaagccauucuacugugcuaauguuuuaauaucacaucucacaaauaacaggg

SEQ ID NO: 49287 - RNA, 64 nt, hsa
aucauuugugaccucagacacucucuggcuaauauuuuaauaagcucacagcagauaauucuga

SEQ ID NO: 49288 - RNA, 64 nt, hsa
cugcauacuuuuugucuagcuguuugauuucauuuuuuaauauaguaugccaauuuugugacug

SEQ ID NO: 49289 - RNA, 64 nt, hsa
aaaaauguuauuuguacaaacauugcacagacuauuuuaauaacaugauuuguucuuuaaauuu

SEQ ID NO: 49290 - RNA, 64 nt, hsa
cacuuaguuuuuauucacuuguuuucacucugaauuuuaauauuuggcugauaugaaugcauug

SEQ ID NO: 49291 - RNA, 64 nt, hsa
uuguacuuucuaacugagcccucuauuuucuuuauuuuaauaauauuucuccccacuugagaau

SEQ ID NO: 49292 - RNA, 64 nt, hsa
aaagggcuucaagaauauauccaauuuuuaaauauuuuaauauaucuccuaucugauaacuuaa

SEQ ID NO: 49293 - RNA, 64 nt, hsa
aaauauaagaaauuuauuucagguaaggguaauauuuuaauaguagucaauaaucuagcuuaag

SEQ ID NO: 49294 - RNA, 64 nt, hsa
aaaaguaugagaucugguuccauccaguaagacauuuuaauagagaagaucaaaauguuaccug

SEQ ID NO: 49295 - RNA, 64 nt, hsa
auuuuauuuauagaacucauuuaagcuguuuuuauuuuaauaugcccuauaaacauuuuuauau

SEQ ID NO: 49296 - RNA, 64 nt, hsa
uguauaguuguuuauccauuaccacauuuuuguauuuuaauagucuacaggcuauauaaaagaa

SEQ ID NO: 49297 - RNA, 64 nt, hsa
ccuucuacguacacacuguucuacuguuugaauuuuuuaauaugagcccaaauuguauaaucuu

SEQ ID NO: 49298 - RNA, 64 nt, hsa
auuuuuuaauaugagcccaaauuguauaaucuuuuuuuaauaaaggggagaaaaaucacuuaca

SEQ ID NO: 49299 - RNA, 64 nt, hsa
gugaucaguaugcuguuuuaauaauuaugugccauuuuaauaaaaugaaagggucaacggcccu

SEQ ID NO: 49300 - RNA, 64 nt, hsa
gggcuagcagaaguauaaagugaucaguaugcuguuuuaauaauuaugugccauuuuaauaaaa

SEQ ID NO: 49301 - RNA, 64 nt, hsa
agguguuucacuauaaggaacagcuaaggaauaauuuuaauaaaagugaaccagaacaaaucac

SEQ ID NO: 49302 - RNA, 64 nt, hsa
cuuaauaaauacuuuaauaagauaugggaaaauauuuuaauaaaacaaggaaaacauaaugaug

SEQ ID NO: 49303 - RNA, 64 nt, hsa
ugauuaaaugccuaugcauguacuuuuagcuaguuuuuaauauuuuauaaaacuucauuuaaau

SEQ ID NO: 49304 - RNA, 64 nt, hsa
caaaccugccuaugugccaucucacaaaagaaacuuuuaauaccuacaauaaaucaaaagaaua

SEQ ID NO: 49305 - RNA, 64 nt, hsa
guggaagucagagggauuccccuuuuucaucucauuuuaauaggaaaauuccuuaugguuaaca

SEQ ID NO: 49306 - RNA, 64 nt, hsa
cuucauagaugcugucacauuucuuaaagcaaccuuuuaauaugcagauaauaccccccaacuu

SEQ ID NO: 49307 - RNA, 64 nt, hsa
cugaaaacagaaaaugugcagguuaauaauauuuuuuuaauagugugggaggacagaguuagag

SEQ ID NO: 49308 - RNA, 64 nt, hsa
cgauauuagugccaaucaaauggaaaaaagguaguuuuaauaaacaagacacaacguuuuuaua

SEQ ID NO: 49309 - RNA, 64 nt, hsa
auuuaagaguauuuuaagaagacauacugcuugauuuuaauacauugaucaggccauccaggac

SEQ ID NO: 49310 - RNA, 64 nt, hsa
uuuccuucaaugugcauaaugauaaaauaaauaauuuuaauauucuuuuguuuccaugguuacc

SEQ ID NO: 49311 - RNA, 64 nt, hsa
uguaucuuauauaaaccucaaguuggauuuuauauuuuaauaaggaaguuaagaccuucauuua

SEQ ID NO: 49312 - RNA, 64 nt, hsa
aaugugcuaaauauaucuuguaugauuuuuuauuuuuuaauaacauuggaaauauauucaagag

SEQ ID NO: 49313 - RNA, 64 nt, hsa
uuccagguccagagagguuggcagacaagugccauuuuaauaaaaaauguauuuaaaaaaagaa

SEQ ID NO: 49314 - RNA, 64 nt, hsa
auuuuuaauuuauuuggucauucaauuuacuuguuuuuaauacaugauucucuaugaaauugau

SEQ ID NO: 49315 - RNA, 64 nt, hsa
acaccuaaagagggaacaaaaguuaguuuuauuuuuuuaauaaacaacagaguuuguuuuguga

SEQ ID NO: 49316 - RNA, 64 nt, hsa
acuuuuccaagccaaucuuauuugucacuuuuuguuuuaauaucuugcucucugacaggaaaga

SEQ ID NO: 49317 - RNA, 64 nt, hsa
uuuugccagauaaauauuuugauauuauuuuccuuuuuaauauaaaggauagguuugaauugua

SEQ ID NO: 49318 - RNA, 64 nt, hsa
uucaugagaucuacuugguuuacccaagucauguuuuuaauagacugcuaauaucaaaggagaa

SEQ ID NO: 49319 - RNA, 64 nt, hsa
uuuccccuaaucugcauaaaugaauuagaacugauuuuaauaaaaauauucuguguaaaaagua

SEQ ID NO: 49320 - RNA, 64 nt, hsa
agccaauuaaacuaugaaauaguuauaaaauuauuuuuaauauuuaaggccuugaaauuauauu

SEQ ID NO: 49321 - RNA, 64 nt, hsa
ucuuaucuaccacacauccccauagauuuaaggauuuuaauagaaagacaugauguauguauuu

SEQ ID NO: 49322 - RNA, 64 nt, hsa
uuuuaauuuaaugaaauuguuaaugaggaaaaauuuuuaauauagucuuaucuaccacacaucc

SEQ ID NO: 49323 - RNA, 64 nt, hsa
auauguugauugaucccuuuuuuauuuugugguuuuuuaauauaguauaaaaauccuuuuaaaa

SEQ ID NO: 49324 - RNA, 64 nt, hsa
gguuauauuaaauuauucuuuguuuuucuuuuucuuuuaauaaagccugcaaguuacuaaauug

SEQ ID NO: 49325 - RNA, 64 nt, hsa
auaucaaaauauguguucaaaauugguauuuuaauuuuaauauuuuuguaaguugauuuaaauu

SEQ ID NO: 49326 - RNA, 64 nt, hsa
uaucaaguagaggauaaguguaguuuaacuuaguuuuuaauauaacccauaaucaagaacauga

SEQ ID NO: 49327 - RNA, 64 nt, hsa
uuauauuaccacaucagcauuauauuaaaaguguuuuuaauaguugauuguauuuugccaacua

SEQ ID NO: 49328 - RNA, 64 nt, hsa
auauuuacaaucauauagaauauauagaguuacauuuuaauagcaacuguguacaugucacgaa

SEQ ID NO: 49329 - RNA, 64 nt, hsa
agacacauaucuauccaaaauaccuauuuuaaauuuuuaauacaauauuuuauuuuaauauaaa

SEQ ID NO: 49330 - RNA, 64 nt, hsa
aauaccuauuuuaaauuuuuaauacaauauuuuauuuuaauauaaacaucugucaguuauagac

SEQ ID NO: 49331 - RNA, 64 nt, hsa
gucuugcuaucugugacuaguuuuauuuuugugcuuuuaauaguccgagcagucuuaccuuguu

SEQ ID NO: 49332 - RNA, 64 nt, hsa
uuacuauuuauaggauuccguuuuuucacaagacuuuuaauaaaaagaaauuguagaaauaaac

SEQ ID NO: 49333 - RNA, 64 nt, hsa
guguuucuauauacuccguccaauauagauaauguuuuaauaacaacugugggauaaaaguuau

SEQ ID NO: 49334 - RNA, 64 nt, hsa
uuuuuguuaaauuuuuaaguuauagcuuuaaagguuuuaauaggaccuucuugaacgacuuuuc

SEQ ID NO: 49335 - RNA, 64 nt, hsa
ucacuguaaaaaaaauggccaaaauguguuuuuuuuuuaauaaguaacuugacuauaaaauaaa

SEQ ID NO: 49336 - RNA, 64 nt, hsa
aaccuuguauaucuuguuuuggugguuuuagugauuuuaauaauauauuuuaaauauuuuuucu

SEQ ID NO: 49337 - RNA, 64 nt, hsa
agcagcaguaguagucaugcuaauuauauaauauuuuuaauauauacuaugaggcccuaucuuu

SEQ ID NO: 49338 - RNA, 64 nt, hsa
gcuuguguaauuggcuuuguuuauaauuuuuauuuuuuaauaugggucagacuuuuggauuaaa

SEQ ID NO: 49339 - RNA, 64 nt, hsa
uauuuuuaauugcuacuaagugguaacuuuuguauuuuaauaucuugcaagggcaaagaaggca

SEQ ID NO: 49340 - RNA, 64 nt, hsa
guguuaaauaugaaccauauucucauugugagaauuuuaauacuaauggaauguuucaaagguu

SEQ ID NO: 49341 - RNA, 64 nt, hsa
aucugggugugagugugucuuguucuguuuuucuuuuuaauaaaacuuuuaaaccauauauuua

SEQ ID NO: 49342 - RNA, 64 nt, hsa
gaguagacaccugccaauauuguuugaaaccuuuuuuuaauaugacauccucucuugucauucu

SEQ ID NO: 49343 - RNA, 64 nt, hsa
ggaaggaagaccagaucuguaugauuuguuccauuuuuaauaacaaaaauauccacacccuuuu

SEQ ID NO: 49344 - RNA, 64 nt, hsa
uguuccauuuuuaauaacaaaaauauccacacccuuuuaauaaugcucaguucuguaggcucuc

SEQ ID NO: 49345 - RNA, 64 nt, hsa
cuuguguuaaccaucuuaaaugauguuuuguauauuuuaauagacugauaggaugagaaagauu

SEQ ID NO: 49346 - RNA, 64 nt, hsa
agugccagacacuaaggaauauuauuguuuauuauuuuaauacauauaaaaagggauuaaucug

SEQ ID NO: 49347 - RNA, 64 nt, hsa
uauaaaaguucauuuguugaaaaauaaggauccuuuuuaauaccacagcauuuguacuguuccu

SEQ ID NO: 49348 - RNA, 64 nt, hsa
uccuuuuuaauaccacagcauuuguacuguuccuuuuuaauauacugaaaauauaaaaggaagg

SEQ ID NO: 49349 - RNA, 64 nt, hsa
cucuaauggaacuguuuaaaaaauuuuuuuuucuuuuuaauauuuucuucuggucacaaaauaa

SEQ ID NO: 49350 - RNA, 64 nt, hsa
ugauuauugaccuaauggauggcuuuuuaaaauguuuuaauaaaaagcagaauagauguuuguu

SEQ ID NO: 49351 - RNA, 64 nt, hsa
uuacagucuuaucuuuuuuuuucuuuuuucuuuuuuuuaauaaaaucuaccaguaauuuaaaug

SEQ ID NO: 49352 - RNA, 64 nt, hsa
gucauaaaguuguuauagauuuuuuaaaaugcuuuuuuaauauuaaaauguacuuuuacauucu

SEQ ID NO: 49353 - RNA, 64 nt, hsa
uuauauacuauuucaauauuacuaucugcauuuguuuuaauauaaaaauguuugcugccuaccu

SEQ ID NO: 49354 - RNA, 64 nt, hsa
gagaauguugauuucuauacaguguggcgcgcuuuuuuaauaaucauuuaaucuugggaaaauu

SEQ ID NO: 49355 - RNA, 64 nt, hsa
aagcauugaaguguguucauaguccagguuuuuuuuuuaauaaacacaauuuugcugccaaaaa

SEQ ID NO: 49356 - RNA, 64 nt, hsa
uauguauuuuuaagaaaguaaccaguuauacugcuuuuaauauugauuggucuuuuuauuuggc

SEQ ID NO: 49357 - RNA, 64 nt, hsa
auuugaagcauagaagaaaauaguugcugagguuuuuuaauaaccauuccuacuaucuguguuc

SEQ ID NO: 49358 - RNA, 64 nt, hsa
gguacagagaaaccaucuacauuccauggaauguuuuuaauaaguaggcaagaaaaaugccacu

SEQ ID NO: 49359 - RNA, 64 nt, hsa
cuaugcagcagguguaaaaauuaauaaauauauuuuuuaauaaacauguuuguaugugugaagc

SEQ ID NO: 49360 - RNA, 64 nt, hsa
uuuaacuuuaaacauauugugacucaucuagaccuuuuaauaagacggucaacuucacacuuag

SEQ ID NO: 49361 - RNA, 64 nt, hsa
uccccuucaguuucuauuuaggaggugaagaaucuuuuaauaagguagaaaguugcuuuauuua

SEQ ID NO: 49362 - RNA, 64 nt, hsa
auaauuucucaaagucuauuguuugaucuaguuauuuuaauaaaggaacucuagaaguuucaag

SEQ ID NO: 49363 - RNA, 64 nt, hsa
uaggccugagccucaacucuucagaaaauaguguuuuuaauauuccucuucagaaaauaguguu

SEQ ID NO: 49364 - RNA, 64 nt, hsa
aguguuuuuaauauuccucuucagaaaauaguguuuuuaauauuccgagcuagagcucuucuuc

SEQ ID NO: 49365 - RNA, 64 nt, hsa
ucuuucauucacuuuuuuacauuuggauuuauguuuuuaauaaaagggguguuacacuauuuga

SEQ ID NO: 49366 - RNA, 64 nt, hsa
uuuuuagaauaacuuuaaagcuuaacagguuuccuuuuaauauccuuuuuuugugugcucuuua

SEQ ID NO: 49367 - RNA, 64 nt, hsa
guauuaaaaauuugggggaauccauauauaucuuuuuuaauaaccaaguaaauacuuuucauuu

SEQ ID NO: 49368 - RNA, 64 nt, hsa
ucaagauuuguuaguaacaaucuugaagagcuaauuuuaauaaaaauaagaaaaauuaauacua

SEQ ID NO: 49369 - RNA, 64 nt, hsa
cuugaaaguuguuauuguuaaccuuuucggcagcuuuuaauaggaaaguuaaacguuuuaaaca

SEQ ID NO: 49370 - RNA, 64 nt, hsa
ugccauaguuuggacaguaccuuucaaugauuaauuuuaauagccugugaguccaaguaaauga

SEQ ID NO: 49371 - RNA, 64 nt, hsa
aaauaaacuuuggacagaaaauagcaauguauuuuuuuaauauaauuucauuauucacaaauga

SEQ ID NO: 49372 - RNA, 64 nt, hsa
acaacuucagaguaauauuacacuaacauuagauuuuuaauaaauguacuuaauagaggucuug

SEQ ID NO: 49373 - RNA, 64 nt, hsa
guguuaauuaacuugagggauuucuuuuuuaaguuuuuaauaucaaaaauugcuauuguauagu

SEQ ID NO: 49374 - RNA, 64 nt, hsa
aguaagcggcuggguuaauucaugauguuugcccuuuuaauaaaauauaaggguagaguucauu

SEQ ID NO: 49375 - RNA, 64 nt, hsa
uccaagcacuugcaacugauguuacugucuucaauuuuaauaauuacacauauuuguauauuuc

SEQ ID NO: 49376 - RNA, 64 nt, hsa
aauaauuacacauauuuguauauuucagagaaguuuuuaauauuucucuguccacuuuuuauaa

SEQ ID NO: 49377 - RNA, 64 nt, hsa
gguugucuaaaagucuuuuuaauuaauagaaagauuuuaauauccaagaguagucaaauuaagg

SEQ ID NO: 49378 - RNA, 64 nt, hsa
auccuguuuucagucucuauguguacagcaguauuuuuaauaaagaauuacagagauaaauuug

SEQ ID NO: 49379 - RNA, 64 nt, hsa
ugaauugagaucaggguuucuuuuccagggugcauuuuaauauacguaugaaaugaaauauuug

SEQ ID NO: 49380 - RNA, 64 nt, hsa
uguuguuauagccaugcauugaccauuaaaugcauuuuaauaucucggcaaaaugagauuugaa

SEQ ID NO: 49381 - RNA, 64 nt, hsa
auauccaguuuuguguauuauauguacauuugauuuuuaauagccuuuccaaagaaaugagggc

SEQ ID NO: 49382 - RNA, 64 nt, hsa
aaaugcuuuauauuauuuggcuagaaauugcuguuuuuaauaaaugugaauuuuuuaaaaauaa

SEQ ID NO: 49383 - RNA, 64 nt, hsa
uuuaacuauuuagagaaugauuuccaccuuuauguuuuaauauccuaggcaucugcuguaauaa

SEQ ID NO: 49384 - RNA, 64 nt, hsa
aucacagauuuuuucuuuaaauaaaaauaagucauuuuaauaacuaaaccagauucuuugugga

SEQ ID NO: 49385 - RNA, 64 nt, hsa
acuaugccacagucuggauguguuuacugaaacauuuuaauaaggaaguuuauuuuugauaaag

SEQ ID NO: 49386 - RNA, 64 nt, hsa
cuguguauuuuucacuuguuucuaagaucaaacauuuuaauaugugcauguuauauauaaauau

SEQ ID NO: 49387 - RNA, 64 nt, hsa
auccaauaauucaagccaagcaaguauauagguguuuuaauaguuuuuguuugcaguccucugu

SEQ ID NO: 49388 - RNA, 64 nt, hsa
uuucuuaaauauucuaaaauguaagucaaauauguuuuaauaacaaagacuuaaauggcuuuuc

SEQ ID NO: 49389 - RNA, 64 nt, hsa
acucaguacugucuggcuuggauucauuucauguuuuuaauauaagaaugaucuaauauuuuuu

SEQ ID NO: 49390 - RNA, 64 nt, hsa
acuaacaauucuuugaaaggaccugcagaagcauuuuuaauaccucauucugucuaugcaagau

SEQ ID NO: 49391 - RNA, 64 nt, hsa
auuacaggugugauccaccgcaccuggcccuaacuuuuaauauacaacacacacacacacacac

SEQ ID NO: 49392 - RNA, 64 nt, hsa
uucuucauggauaaugacauaguaauugugauucuuuuaauaccaguuaagcaguauuuggcaa

SEQ ID NO: 49393 - RNA, 64 nt, hsa
uguucuggaauauguauuauuuauuuuaacacuuuuuuaauaaaaucuuuauuauaaaccauga

SEQ ID NO: 49394 - RNA, 64 nt, hsa
aaguaugucaaaagacugcagacuauagauuuuuuuuuaauauaggauuauaaaucagcuagug

SEQ ID NO: 49395 - RNA, 64 nt, hsa
uuuauuuuauuuuauuuuuuucagggggucuuuuuuuuaauacauauccaauaaugccuuccau

SEQ ID NO: 49396 - RNA, 64 nt, hsa
ugaguuauaaauauuuuuuucuuucuuuguuuuauuuuaauagccugucauagguuuuaaaucu

SEQ ID NO: 49397 - RNA, 64 nt, hsa
uggauuugggguguuacaguagccuuauucaccuuuuuaauaaaaauacacaugaaaacaagaa

SEQ ID NO: 49398 - RNA, 64 nt, hsa
uaauguguacuuauaaauucacauugucaguauuuuuuaauauugggucugaauaauuaucuga

SEQ ID NO: 49399 - RNA, 64 nt, hsa
uuuauuaaaaaucuagaauauuaaagauuuauacuuuuaauauugaauauaguuucguagaaaa

SEQ ID NO: 49400 - RNA, 64 nt, hsa
augggaacaugggaaugauaauauauauuuuuucuuuuaauauuuuauuuuucuuuuuaugcca

SEQ ID NO: 49401 - RNA, 64 nt, hsa
ggugagcugucuaacccuuuguacacauugacauuuuuaauaucguaacugauuucuugaugcu

SEQ ID NO: 49402 - RNA, 64 nt, hsa
guuaagugcaauaaaguuuuugccuugcuuuauuuuuuaauacauaaaacuuacauucucauaa

SEQ ID NO: 49403 - RNA, 64 nt, hsa
aauaugccacucuguuaauuucuuguuccagacauuuuaauagagauugcuugagccauguugu

SEQ ID NO: 49404 - RNA, 64 nt, hsa
agcacaauuaauuuuauagagagguuuuuuauuuuuuuaauauuucuauugcaaaagucuaucc

SEQ ID NO: 49405 - RNA, 64 nt, hsa
cucuaaaguugcaguuagaaacuaaaauaauguuuuuuaauauguaauaugcuccucuuggcua

SEQ ID NO: 49406 - RNA, 64 nt, hsa
caaacaugccuuuuguuuucuauauacccugaccuuuuaauaaaguuucaguguauuuaucauu

SEQ ID NO: 49407 - RNA, 64 nt, hsa
ccaaggcauaggaagagaucuugcaggucuaguauuuuaauaaugcacuauuacccagggcaga

SEQ ID NO: 49408 - RNA, 64 nt, hsa
uaaauuauucccaagauuugaauuuauuuuaaaauuuuaauagccaccaagaauguggacauau

SEQ ID NO: 49409 - RNA, 64 nt, hsa
acauuuaauacccaauuucuuccauaauagauauuuuuaauagcaggacagauggcacugauua

SEQ ID NO: 49410 - RNA, 64 nt, hsa
caguccuuuauuuuauucuauucuauuuauuuuauuuuaauaaguacuuagccucuucugacuu

SEQ ID NO: 49411 - RNA, 64 nt, hsa
acuaaacuuuauacuucauuuuuaauauccaauuuuuuaauagaaaaauaugaagccaugucuc

SEQ ID NO: 49412 - RNA, 64 nt, hsa
gggaaaaagaaggagacuaaacuuuauacuucauuuuuaauauccaauuuuuuaauagaaaaau

SEQ ID NO: 49413 - RNA, 64 nt, hsa
ggcacccaccaccaugcccagcuaauuuuuguauuuuuaauagagagcuaauaauuguauauuu

SEQ ID NO: 49414 - RNA, 64 nt, hsa
augaaucaaaaaauaccccuaguaaugcuuuauauuuuaauacugcaaaagcuuuacaaaugga

SEQ ID NO: 49415 - RNA, 64 nt, hsa
caggggcccugaauuuaugugguuuuuauacauuuuuuaauaagaugcacuuuaugucauuuuu

SEQ ID NO: 49416 - RNA, 64 nt, hsa
auacauuuuuuaauaagaugcacuuuaugucauuuuuuaauaaagucugaagaauuacuguuua

SEQ ID NO: 49417 - RNA, 64 nt, hsa
gcucccuuccaggagcauuuuaauaaaagauuuuuuuuaauaacagaauuuuaguuugcuugca

SEQ ID NO: 49418 - RNA, 64 nt, hsa
acuaugcaauaccaccugcucccuuccaggagcauuuuaauaaaagauuuuuuuuaauaacaga

SEQ ID NO: 49419 - RNA, 64 nt, hsa
auucuguugcaccacucuaguuuuaguauuucuauuuuaauacauuuguuuaccacuuguuuau

SEQ ID NO: 49420 - RNA, 64 nt, hsa
uuaguauggccuuauggcaaagaacacuguauuauuuuaauaaucacacaauugugacggaauu

SEQ ID NO: 49421 - RNA, 64 nt, hsa
gucugcauguucacaauaccaagcauuaaauguauuuuaauaacuaaacuuuucugaaagaagg

SEQ ID NO: 49422 - RNA, 64 nt, hsa
ggaguugguuuuuuucuuuuuucuucuucuuuuuuuuuaauaugaaaaguacuuagcugggagu

SEQ ID NO: 49423 - RNA, 64 nt, hsa
uuuacaugguggugauguccaaaagauacccaaauuuuaauauuccagaagaacaacuuuagca

SEQ ID NO: 49424 - RNA, 64 nt, hsa
uugugggcaugagcugcugugcccagccuccauguuuuaauaucaacucucacuccugaauuca

SEQ ID NO: 49425 - RNA, 64 nt, hsa
uaauacuguaauuugauuugagccauaaaacacauuuuaauauuagcuuguauuauaguuauua

SEQ ID NO: 49426 - RNA, 64 nt, hsa
cuugccagauguagcuacuuaaggaaaaaaggguuuuuaauagaaaugaacuuuugauuaguau

SEQ ID NO: 49427 - RNA, 64 nt, hsa
gugugggguuuuuuguuguuuuuuggguuuuguuuuuuaauacuuuaggguccugauuuguggg

SEQ ID NO: 49428 - RNA, 64 nt, hsa
uuggagcuaccgugggacuauauacuguuaaugauuuuaauauauauggcuuaugacauacucu

SEQ ID NO: 49429 - RNA, 64 nt, hsa
gggcaaaugguauuuguuuuuguuuuaauuuuuuuuuuaauagacggaagucuugcucugucau

SEQ ID NO: 49430 - RNA, 64 nt, hsa
ggcaugagccaccacgacuggccagaggacaaaauuuuaauaaaggucuuagcuuaagcaguaa

SEQ ID NO: 49431 - RNA, 64 nt, hsa
ggugagcacuaccacgcccggcuaauuuuuguauuuuuaauagagacgggguuucaccauguug

SEQ ID NO: 49432 - RNA, 64 nt, hsa
acgugccaccaugucuggcuaauuuuuuguauuuuuuuaauagauaugggguuucgccauguug

SEQ ID NO: 49433 - RNA, 64 nt, hsa
ccugguuuuggauguaaguuuuaaagaaugguauuuuuaauauuuguacacauucuuugagcac

SEQ ID NO: 49434 - RNA, 64 nt, hsa
gaaucagaacgcuggcuuuuauuuauuuuuuuauuuuuaauauuaaaugugcagauaugcuucg

SEQ ID NO: 49435 - RNA, 64 nt, hsa
cuggaugccuguuguuuuacuguguauauuuuauuuuuaauauauuaacuuuguggauucauuu

SEQ ID NO: 49436 - RNA, 64 nt, hsa
uaguugcuuuguugauuaaucucucuuguugguguuuuaauaaaugaaauaggcuugccuuuag

SEQ ID NO: 49437 - RNA, 64 nt, hsa
aguaauucaaagcaugccucugccccuuuaauauuuuuaauaaccugcauuguugcugucugcc

SEQ ID NO: 49438 - RNA, 64 nt, hsa
gcuuaugcuacagugauguacaaaagacuugcuguuuuaauaucuuuuuguguuuuugauguuu

SEQ ID NO: 49439 - RNA, 64 nt, hsa
uuaucuguaaauuguacaguuuucuuuuugaaaguuuuaauauugucuuccuuuuuaauaacuu

SEQ ID NO: 49440 - RNA, 64 nt, hsa
guuuucuuuuugaaaguuuuaauauugucuuccuuuuuaauaacuuauuuuauacauauugugc

SEQ ID NO: 49441 - RNA, 64 nt, hsa
cuuugaaugaaaauucugaaauuguaaaugucuauuuuaauauucaccuaugaaagaaucugug

SEQ ID NO: 49442 - RNA, 64 nt, hsa
ggaacauuaaaagcuaauuuauaaaagcaauacuuuuuaauaugaaaacuuacugcaaaguuug

SEQ ID NO: 49443 - RNA, 64 nt, hsa
uauauugaaguuuugguaaaaauucuuuuuucuuuuuuaauaaaaaauuagguuauuacuuuuu

SEQ ID NO: 49444 - RNA, 64 nt, hsa
uuuuucuuugguugucccuauuaacaaaaaaguauuuuaauaaaaaauugaaaugagugaguca

SEQ ID NO: 49445 - RNA, 64 nt, hsa
aauucauaaauaaagaauuguucuuucuuugugguuuuaauaagaguucaagaauuguucagag

SEQ ID NO: 49446 - RNA, 64 nt, hsa
aguucaagaauuguucagagucuuguaaauguuauuuuaauaaucccuuuaaauuuuaucuguu

SEQ ID NO: 49447 - RNA, 64 nt, hsa
ugcugaucaggcaaaaauaguuuuccaaaguuauuuuuaauaaaguauauacaaaauucuuaua

SEQ ID NO: 49448 - RNA, 64 nt, hsa
ggcuagucauaucuguguguuuguaaaguuauuuuuuuaauauuuuaagauuacaauuuuaaca

SEQ ID NO: 49449 - RNA, 64 nt, hsa
uagcacuuacguaaaacauuuguuucccccacaguuuuaauaagaacagaucaggaauucuaaa

SEQ ID NO: 49450 - RNA, 64 nt, hsa
guaagaaaaaaaauguacccgagcacauagagcuuuuuaauagcacuaaccaaugccuuuuuag

SEQ ID NO: 49451 - RNA, 64 nt, hsa
gaguguugugacugauggucaacccaggcgggcauuuuaauaaauggccugugauucuuuuuug

SEQ ID NO: 49452 - RNA, 64 nt, hsa
uauugaaacccagucuucauuuaguugcuaaggcuuuuaauacauuuugaauggcaccaaaaca

SEQ ID NO: 49453 - RNA, 64 nt, hsa
uggcugccuuuugcugugggguuuuguuaccugguuuuaauaacaguaaaugugcccagccucu

SEQ ID NO: 49454 - RNA, 64 nt, hsa
cugcuuuagaaguaacaaugaagaacguggacguuuuuaauauaaagccuguuuugucuuuugu

SEQ ID NO: 49455 - RNA, 64 nt, hsa
cucaugacucauuaaaaaauaauaaacgaugcuauuuuaauauuuucaaauaaauaaucugagg

SEQ ID NO: 49456 - RNA, 64 nt, hsa
uggggugucuguguacauauauguauauuuccuuuuuuaauacaggauaauaauauggggucuu

SEQ ID NO: 49457 - RNA, 64 nt, hsa
aagauuuugaauuauagacagugcucuuaauaguuuuuaauaaguugauauuuuuuucugugua

SEQ ID NO: 49458 - RNA, 64 nt, hsa
uauuuuuuuuauauuuucuuaaaucauuaaaccauuuuaauauauguuaacuacuaauaaaugg

SEQ ID NO: 49459 - RNA, 64 nt, hsa
guauuucgaguuccauuauacugaaguacucauguuuuaauagugccucuccaaaggccucacc

SEQ ID NO: 49460 - RNA, 64 nt, hsa
cucuucugucauuaugugaugucauuuuuuugccuuuuaauagucuugucaauacuuuaccuga

SEQ ID NO: 49461 - RNA, 64 nt, hsa
cuagucuuccuauagguuacuucaccuuuuuuuuuuuuaauaauuugauuugauacauauguag

SEQ ID NO: 49462 - RNA, 64 nt, hsa
uauagacaaucauaaaugaaugaucauggcuauguuuuaauaaaacuuuauggacacugagcuu

SEQ ID NO: 49463 - RNA, 64 nt, hsa
uauagacaaucauaaaugaaugaucauggcuauguuuuaauaaaacuuuacagacacugaacuu

SEQ ID NO: 49464 - RNA, 64 nt, hsa
agaaacccuaucaguguaaagaaugugggaagguuuuuaauaauuauccaacucuuacucaaca

SEQ ID NO: 49465 - RNA, 64 nt, hsa
augaaugugggaaugccuucauuuguuuuuuugauuuuaauagacaucagagaauucacaaagg

SEQ ID NO: 49466 - RNA, 64 nt, hsa
ggggcacuuggcagcgcggggagcccgucgguaauuuuaauauuuuauuauauauauauaucua

SEQ ID NO: 49467 - RNA, 64 nt, hsa
ugggaaucuuuuccguuucaagcauuaagaacacuuuuaauaaacuuuuuuuugagaaugguua

SEQ ID NO: 49468 - RNA, 64 nt, hsa
uuuccugaguagcagugauuguuaugccuugcuauuuuaauaaagauucuauuuucguauaaca

SEQ ID NO: 49469 - RNA, 64 nt, hsa
accauugugauuauuguuacuauuauuugcuauauuuuaauauuguuguuuaccaaauauucuc

SEQ ID NO: 49470 - RNA, 64 nt, hsa
gcugugcaauugcuggguuguccccccaaacauauuuuaauauguuauuuaaaaugauuuuacc

SEQ ID NO: 49471 - RNA, 64 nt, hsa
aauucaaagaacaaggauagcuuucuucgguaucuuuuaauauaagaacacugaauuuuggcuu

SEQ ID NO: 49472 - RNA, 64 nt, hsa
cucuucuuaguuggugacuguuuggggccugguauuuuaauagaugaacacuacuuuuuuaauu

SEQ ID NO: 49473 - RNA, 64 nt, hsa
uaauuaaaguaucugauguaaaauuauuuugaguuuuuaauauuuugauaaacguguauuccug

SEQ ID NO: 49474 - RNA, 64 nt, hsa
cuccuacucugcuucucuuacuauacucauacauuuuuaauaugguuuaucaaugauucauguu

SEQ ID NO: 49475 - RNA, 64 nt, hsa
aagcucaugagaguuuauuuuuauuauaagauguuuuuaauauaaaagaauuauguaacugauc

SEQ ID NO: 49476 - RNA, 64 nt, hsa
ggauauuuuacuggaaauuaagaacuugcugcuguuuuaauaagauguaguauauuuucugacu

SEQ ID NO: 49477 - RNA, 64 nt, hsa
uuuuagcacuuuaagaaguuuaauuuuuuguaauuuuuaauaugcucuuucaguguaucucagc

SEQ ID NO: 49478 - RNA, 64 nt, hsa
cuuuuuuaugcaguuguggaaagaauguaaaauguuuuaauauauucuuuguuaaucugagaac

SEQ ID NO: 49479 - RNA, 64 nt, hsa
uguacaauauauacauagacuguaacuacuuugcuuuuaauaauuuuaugaaauggcaaagguu

SEQ ID NO: 49480 - RNA, 64 nt, hsa
uaaaauuuuguacuuauauuauuaaaaaucacauuuuuaauauuuguaguccagucucagcugu

SEQ ID NO: 49481 - RNA, 64 nt, hsa
guuuuuacuaaugcuaaaacuuuuaaaguuuauuuuuuaauaaauuguugaguauuacaucauu

SEQ ID NO: 49482 - RNA, 64 nt, hsa
guaguuuuaaucagcuuaaaagcuauuuaacccauuuuaauaagcuugcaguuuuguuucucug

SEQ ID NO: 49483 - RNA, 64 nt, hsa
augauuauuugaauaaauuacacauuguuuaguuuuuuaauacaacugcuauaugacucuucug

SEQ ID NO: 49484 - RNA, 64 nt, hsa
aacuccuauacacguguacuguagaaugaguauuuuuuaauaccuuaagguaggcgucaaauuc

SEQ ID NO: 49485 - RNA, 64 nt, hsa
auuuccucauauacguaguguguagaaucaagucuuuuaauaauucauuuuuucuucauaauau

SEQ ID NO: 49486 - RNA, 64 nt, hsa
cacacauacacauguaaacauuggaaugcauaaguuuuaauauuuuagcgcuaucaguuucuaa

SEQ ID NO: 49487 - RNA, 64 nt, hsa
guuauguccacuuauucacuagguaaauuuucaguuuuaauacuuuucuccuuaccccuuccuu

SEQ ID NO: 49488 - RNA, 64 nt, hsa
caauuguauuacuccuuguaauauuuguguuuauuuuuaauauuugaauuauuacuuagcacau

SEQ ID NO: 49489 - RNA, 64 nt, hsa
caaaccaacaugugcucuuuucagucauucacuguuuuaauaugacaugguagagaagauaagg

SEQ ID NO: 49490 - RNA, 64 nt, hsa
ugggcuaauaaaaaacauguguuucucuuauggauuuuaauaagcuccaguauuauucaaauga

SEQ ID NO: 49491 - RNA, 64 nt, hsa
aaaaaaaucuaaagcagcucuuaugggcuucuaauuuuaauauaaauaaauaauuuaaauuuua

SEQ ID NO: 49492 - RNA, 64 nt, hsa
cuuggagaaaugaaaauuauuucuuggggaugccuuuuaauauuugauccuauuaugugagaga

SEQ ID NO: 49493 - RNA, 64 nt, hsa
uagcuugaaggcagugagggagccaugaaaugguuuuuaauagggggacuccagaucagaugug

SEQ ID NO: 49494 - RNA, 64 nt, hsa
gaauugcaaagucauaggauauuuauauauugguuuuuaauaauacuuccaaauugcccuccug

SEQ ID NO: 49495 - RNA, 64 nt, hsa
acuuuagguauagauaaccuaauucagguugcaguuuuaauauucauugggggcaguggaauug

SEQ ID NO: 49496 - RNA, 64 nt, hsa
cuuguuuuauuauuacuuucauuauuauuugccuuuuuaauaccuauacacacuaaguccaucu

SEQ ID NO: 49497 - RNA, 64 nt, hsa
uaagacgacccugcaguccaccuguuuguaacuuuuuuaauaaaauagacaucuguauuacuga

SEQ ID NO: 49498 - RNA, 64 nt, hsa
aguucuuauugauggcuaauauacaaggguuaauuuuuaauauuuuaauugauuucuuuaauca

SEQ ID NO: 49499 - RNA, 64 nt, hsa
cuacaaccauugaauuugccauauuuuguaucagugcuguuaauuugcuguugccucaagaaaa

SEQ ID NO: 49500 - RNA, 64 nt, hsa
auuaauauagcauggcaccucauuuucuuuugccugcuguuaaagauugaagcuauugucaaau

SEQ ID NO: 49501 - RNA, 64 nt, hsa
uuuucauccuaaagaacaaaguaaugacagaacaugcuguuauuuagguauuuuucuuuaacca

SEQ ID NO: 49502 - RNA, 64 nt, hsa
cuucccuccccucuaguuuuuucuuccuuuucacugcuguuauauuucaucaugauaauucagc

SEQ ID NO: 49503 - RNA, 64 nt, hsa
aauaaacaucuauguuaaauccaaauucagcauuugcuguuagcuauucagcaucaggcacucu

SEQ ID NO: 49504 - RNA, 64 nt, hsa
ucuuauugauucaugaggaacauuacugcuaaucugcuguuaagugaacgguuuuucauuuuac

SEQ ID NO: 49505 - RNA, 64 nt, hsa
ucagcauuagagaaaugaauuauaacuagacaucugcuguuaucaccauaguuuuguuuaauuu

SEQ ID NO: 49506 - RNA, 64 nt, hsa
aaacuguucuuuugcaauaauaauaaauuaaacaugcuguuaccagagccucuuugcuggaguc

SEQ ID NO: 49507 - RNA, 64 nt, hsa
aaguuuucacaacuauuuaugcugguaaaacaaaugcuguuaaaucaccuuaugcgucguuuuc

SEQ ID NO: 49508 - RNA, 64 nt, hsa
gguuuuucguuuuucauuguuauuauugugagaaugcuguuauugggguugugugugagugccc

SEQ ID NO: 49509 - RNA, 64 nt, hsa
cuaacugcuguuaaaauuaauauaucauuaucuuugcuguuauugacagcgauauaauuuuauu

SEQ ID NO: 49510 - RNA, 64 nt, hsa
uucuguauaacagccuuuuccuucugguucuaacugcuguuaaaauuaauauaucauuaucuuu

SEQ ID NO: 49511 - RNA, 64 nt, hsa
uaauuugcuugugucaacucuuaacuuguaaaacugcuguuaacucgguuuaaauuuuuaaauu

SEQ ID NO: 49512 - RNA, 64 nt, hsa
cuaagugaguuguugauuuuaggaguuugcuuugugcuguuaccuaaaaucagagacuggugua

SEQ ID NO: 49513 - RNA, 64 nt, hsa
uaaaugaagauuugguuuuuguauaaaaaaauaaugcuguuaaacaggaguugaccuucauuua

SEQ ID NO: 49514 - RNA, 64 nt, hsa
ucucaucgaaacccugguuucaggauggaucaagugcuguuacagcucauguuccuuagaccug

SEQ ID NO: 49515 - RNA, 64 nt, hsa
uuuucucaugaauucuuaaaggauuaugcuuuaaugcuguuaucuauuuuauuguucuugaaaa

SEQ ID NO: 49516 - RNA, 64 nt, hsa
agagcuaguggauguguuugucuacaaguaugauugcuguuacauaacaccccaaauuaacucc

SEQ ID NO: 49517 - RNA, 64 nt, hsa
gugaucaucagcugagggguggccuuugagaagcugcuguuaacguauuugccaguuacgaagu

SEQ ID NO: 49518 - RNA, 64 nt, hsa
ccuccauccuugaucuuguuagcaaugcuguuuuugcuguuagucggguuagaguuggcucuac

SEQ ID NO: 49519 - RNA, 55 nt, hsa
agauuauugauagagaguaguuagaugcuguuaaaagaggaggaaacuacuugag

SEQ ID NO: 49520 - RNA, 64 nt, hsa
gugugaauguacaaagaaaacaaaccauugcuuaugcuguuauauacuagagaaauuuuguuuu

SEQ ID NO: 49521 - RNA, 64 nt, hsa
aaaaagcaaacaaacacaggcugaaaacccaugcugcuguuauacacaauggcaguauuaacaa

SEQ ID NO: 49522 - RNA, 64 nt, hsa
uaaaaaaaaaauacuauuguauggauuuuuguauugcuguuaaguauuguuuugugugugugug

SEQ ID NO: 49523 - RNA, 64 nt, hsa
uaaaauguaugauucaggauaaaacguaaacacgugcuguuaguaauuucuuguggauuucauu

SEQ ID NO: 49524 - RNA, 64 nt, hsa
uaaguugauauuuuuuuucuggaauguagccauuugcuguuaucugggaaacaagauucuaaca

SEQ ID NO: 49525 - RNA, 64 nt, hsa
accaaacuuucuuccuugugagcagaagguuggcugcuguuagcaggaucccacagugauaacc

SEQ ID NO: 49526 - RNA, 64 nt, hsa
gaaaagagcuggcauugugggaauuuucuuuuuaugcuguuagcuguuuaccuucuuagaagac

SEQ ID NO: 49527 - RNA, 64 nt, hsa
augucauaguuaaaaacguacagccaggcccgugugcuguuaauagugugaaauugucauguua

SEQ ID NO: 49528 - RNA, 64 nt, hsa
augugcucaucccacucuccgcuaagcgggaggcugcuguuagagcaggcugcuuccugccuaa

SEQ ID NO: 49529 - RNA, 64 nt, hsa
ucaggauggugggaugugauuuagacagugcacaugcuguuagggcugucacuagggaguggcc

SEQ ID NO: 49530 - RNA, 64 nt, hsa
caacccuagacaaagccuuuggccaagagggaggugcuguuaguugggcagcccuucuggguuu

SEQ ID NO: 49531 - RNA, 64 nt, hsa
augugccugccgccugcccuccacacaucccuguccccccaacccgggaaccccugcccuccuc

SEQ ID NO: 49532 - RNA, 64 nt, hsa
ccccccuucucaccuucccuucuccccgaccccaccccccaaaaaagcuacuucuucauuccgu

SEQ ID NO: 49533 - RNA, 53 nt, hsa
aagagggggcugaggacugaggcccccccaacucuuccuccccucucaucccc

SEQ ID NO: 49534 - RNA, 64 nt, hsa
gaagagucuuccaaggccagaaggagggggacaaccccccaagaccaucccugaagacgagcau

SEQ ID NO: 49535 - RNA, 64 nt, hsa
guacccccaggccaaagcaaguaagcgguuagcaccccccaaucccagaggcaacaauagagac

SEQ ID NO: 49536 - RNA, 64 nt, hsa
gucccccuggcugagccccuguccuccccucuguccccccaaccgcccccccugcaugcagcca

SEQ ID NO: 49537 - RNA, 64 nt, hsa
cuuccuuuuuaucauaacgcggccucuaauuccaccccccaagugaaacgguuugagagacgca

SEQ ID NO: 49538 - RNA, 64 nt, hsa
ugagauugucuuccaagccgggcauccuugcgagccccccaagcuggccacagaugccacuacu

SEQ ID NO: 49539 - RNA, 64 nt, hsa
aaccaaaagauuuucuguccagaagccuccccgaccccccaagcuauuugcucacauuaacaaa

SEQ ID NO: 49540 - RNA, 64 nt, hsa
agguuauggugaauaaaaccauagggagcuucuuccccccaaccccuggcuauuuuauauuaau

SEQ ID NO: 49541 - RNA, 64 nt, hsa
caguuucuaucuuuagcccaucaucauuuucugcccccccaaaaucuguugaaaugauucacug

SEQ ID NO: 49542 - RNA, 64 nt, hsa
gccugccccccaacccugaggaugccccugccauccccccaaccuccucauauugccucugaac

SEQ ID NO: 49543 - RNA, 64 nt, hsa
aaagcuguccuuugccaucucaucccuuggccugccccccaacccugaggaugccccugccauc

SEQ ID NO: 49544 - RNA, 64 nt, hsa
cauuugucucaccccugauauugguuccugaugcccccccaacaaaaauaaauaaauaaauuau

SEQ ID NO: 49545 - RNA, 64 nt, hsa
gcuauacaaacauuuugcuaagucugcccaaagcccccccaaugcauuccuucaacaaaauaca

SEQ ID NO: 49546 - RNA, 64 nt, hsa
aauaagguuuuauuuugauuguguucguuuccccccccccaauaguaaaauuucuccuccuuua

SEQ ID NO: 49547 - RNA, 64 nt, hsa
aauaguaaaauuucuccuccuuuaacuccuccuaccccccaagguaagaaacaaaaaacaaaca

SEQ ID NO: 49548 - RNA, 64 nt, hsa
acugacuguaauccagggggacugggaccugccuccccccaaccucuggcucccacaaggcccg

SEQ ID NO: 49549 - RNA, 64 nt, hsa
cuuccagccggagcaccccgauccccauccggcaccccccaaucccccaacacgccugucccuc

SEQ ID NO: 49550 - RNA, 64 nt, hsa
gagacagagagagagaaaaaaaaucacccaccacccccccaaaaacacaaaaaaagaaaaucua

SEQ ID NO: 49551 - RNA, 64 nt, hsa
gcaucccugcaaaagggaacagaagaggccaaguccccccaagccacggcccgggguucaaggc

SEQ ID NO: 49552 - RNA, 64 nt, hsa
ccccaagcccaagucuuuccucccagcagcguuuccccccaacuccuuaauuuuauucuccgcu

SEQ ID NO: 49553 - RNA, 64 nt, hsa
ugcuuuuauacauuuuucugcagcuguaggcauaccccccaagucugcuuuuagcuucccuauu

SEQ ID NO: 49554 - RNA, 64 nt, hsa
uugauuuaggggcuuuggagaacuuugaaugcuaccccccaaguaaccauuguuggcaaccugg

SEQ ID NO: 49555 - RNA, 64 nt, hsa
ggcaaacugcucugugcuuucaaaccaaaguguuccccccaaccccaaauuugucuaagcacug

SEQ ID NO: 49556 - RNA, 64 nt, hsa
uuuuuccuuuuuucuuuuuuuuuuuuuaauuuuuccccccaaccaucgugauuugucuuuucau

SEQ ID NO: 49557 - RNA, 64 nt, hsa
ugcgguucaggaaaauugaaugcaaaccauagcacaggcuaauuuuuuguuguuucuuaaauaa

SEQ ID NO: 49558 - RNA, 64 nt, hsa
gaguagcugggacuacaggcacgcaccaccaugccaggcuaauuuuuuuguauuuuagcagaga

SEQ ID NO: 49559 - RNA, 64 nt, hsa
uggagaagggaccagggauugcaggccccaucuccaggcuaaggggaggagagcaucaucacuu

SEQ ID NO: 49560 - RNA, 64 nt, hsa
uuguaaaggcaauucuuuugagagcaggauucuccaggcuaaaucaaaggcagcuaauccuguc

SEQ ID NO: 49561 - RNA, 64 nt, hsa
gcagccccagagggagaccucagugauaggggaucaggcuaagaaagugggggaagggagaugc

SEQ ID NO: 49562 - RNA, 64 nt, hsa
cagguuccuacacacccacgccugagggucauagcaggcuaaggguggauaccagcgacucccu

SEQ ID NO: 49563 - RNA, 64 nt, hsa
cauugucaguguagccccucgccccuauauucauccaggauacuuggaagugcuaaaauaggaa

SEQ ID NO: 49564 - RNA, 64 nt, hsa
accagagcugguucucauggccuucgucacgauaccaggauacggaggggagcccagggccauc

SEQ ID NO: 49565 - RNA, 64 nt, hsa
agcaaauaucaaauacugcaaaaauccccuugucccaggauacccuaaaauagaagugcuuaaa

SEQ ID NO: 49566 - RNA, 64 nt, hsa
uuguuguuuguaaauagaauugaauuuaaauacaccaggauaaaucuuauuuaaaggaagccug

SEQ ID NO: 49567 - RNA, 64 nt, hsa
uuuugcaggcccgcuucucaaugaaugagauacaccaggauaugcacgugcaucugagaaccgc

SEQ ID NO: 49568 - RNA, 64 nt, hsa
uuacaaauauacaagcaaauaauauaauauuaugccaggauagaaaugaacaugccaugguuga

SEQ ID NO: 49569 - RNA, 64 nt, hsa
uuagcaugggguugugguugaaauaucuugguauccaggauaaggguauguggaaaaacaggcu

SEQ ID NO: 49570 - RNA, 64 nt, hsa
uuauaccuuccauuuccaucguauucuccaguuuccaggauagacguugcucaucgucuuuacc

SEQ ID NO: 49571 - RNA, 64 nt, hsa
aauguucguggaagggccaggaguuccugugaaaccaggauacugcagcuuuauuaaaguuaaa

SEQ ID NO: 49572 - RNA, 64 nt, hsa
uuuuuaaaauuuaauuuuuaaguaaaggaauuugccaggauaucugcaucaagaguacuguagc

SEQ ID NO: 49573 - RNA, 64 nt, hsa
cacucccugcuccacgaagccuuaagccauaggcccaggauauuucugagagugaaaccaugac

SEQ ID NO: 49574 - RNA, 64 nt, hsa
uaaucaccaugggaaacuguugugggcgcugcuuccaggauaaggagacugaggcuuagagaga

SEQ ID NO: 49575 - RNA, 64 nt, hsa; identical to SEQ ID NO: 49557

SEQ ID NO: 49576 - RNA, 64 nt, hsa; identical to SEQ ID NO: 49558

SEQ ID NO: 49577 - RNA, 64 nt, hsa; identical to SEQ ID NO: 49559

SEQ ID NO: 49578 - RNA, 64 nt, hsa; identical to SEQ ID NO: 49560

SEQ ID NO: 49579 - RNA, 64 nt, hsa; identical to SEQ ID NO: 49561

SEQ ID NO: 49580 - RNA, 64 nt, hsa; identical to SEQ ID NO: 49562

SEQ ID NO: 49581 - RNA, 64 nt, hsa; identical to SEQ ID NO: 49563

SEQ ID NO: 49582 - RNA, 64 nt, hsa; identical to SEQ ID NO: 49564

SEQ ID NO: 49583 - RNA, 64 nt, hsa; identical to SEQ ID NO: 49565

SEQ ID NO: 49584 - RNA, 64 nt, hsa; identical to SEQ ID NO: 49566

SEQ ID NO: 49585 - RNA, 64 nt, hsa; identical to SEQ ID NO: 49567

SEQ ID NO: 49586 - RNA, 64 nt, hsa; identical to SEQ ID NO: 49568

SEQ ID NO: 49587 - RNA, 64 nt, hsa; identical to SEQ ID NO: 49569

SEQ ID NO: 49588 - RNA, 64 nt, hsa; identical to SEQ ID NO: 49570

SEQ ID NO: 49589 - RNA, 64 nt, hsa; identical to SEQ ID NO: 49571

SEQ ID NO: 49590 - RNA, 64 nt, hsa; identical to SEQ ID NO: 49572

SEQ ID NO: 49591 - RNA, 64 nt, hsa; identical to SEQ ID NO: 49573

SEQ ID NO: 49592 - RNA, 64 nt, hsa; identical to SEQ ID NO: 49574

SEQ ID NO: 49593 - RNA, 64 nt, hsa
accagauauuuuguucccaucaguuuagcccagagauagacaguagaaugcaaauaccucccuc

SEQ ID NO: 49594 - RNA, 64 nt, hsa
cacgaacaugcaguuauugaagauuaggaucaaggauagacaagguauaguaguuaucuuaaaa

SEQ ID NO: 49595 - RNA, 64 nt, hsa
acucuauauggcugaggaaggagcuagggaaagagauagacacaauggggugaaaacaauuuug

SEQ ID NO: 49596 - RNA, 64 nt, hsa
aacaaauuguaccacauuguuaaggacauauaaugauagacacuagaacucagaccucugcaug

SEQ ID NO: 49597 - RNA, 64 nt, hsa
cuacaggaagcaugaccuauccacaucuuuccaagauagacacuaacaugucaugucccaaaca

SEQ ID NO: 49598 - RNA, 64 nt, hsa
augaaucuuccccccaacccccaccaugcagauggauagacagaaucuuuccugacuagucauu

SEQ ID NO: 49599 - RNA, 64 nt, hsa
uccccauuaacagauggaaaaacugaggcuuagagauagacaaucacuacaagucagcuccagc

SEQ ID NO: 49600 - RNA, 64 nt, hsa
uaaguguccuuccaugcaaggucccacucuaggugauagacagggaccccuucuacugaaccuu

SEQ ID NO: 49601 - RNA, 64 nt, hsa
guuuaacugucugcaacaguugguuuauguuaaugauagacaaauacccaguguuuguuacuuu

SEQ ID NO: 49602 - RNA, 64 nt, hsa
aguuaacaagccuuuggaucagggcuugacucaugauagacaaaguauaugccugcuggaugga

SEQ ID NO: 49603 - RNA, 64 nt, hsa
cuuuucaugcuuccaagugucagggccuugcccagauagacagggcuggcucugcugccccaac

SEQ ID NO: 49604 - RNA, 64 nt, hsa
ccccauuauggugcuucugaauaaaucuugccaagauagacaaacaaugaugaaacucagaugg

SEQ ID NO: 49605 - RNA, 64 nt, hsa
gaucgaaaacauuucaaauugcucuaucugggcugauagacauuucgucauuuaaguaagggau

SEQ ID NO: 49606 - RNA, 64 nt, hsa
uuaugugcagguccuagccugggggaggaaaguagauagacagaaaaucauuagguaauuuaag

SEQ ID NO: 49607 - RNA, 64 nt, hsa
aagugugcaaacaaguuagagcuggcagcugaaugauagacaaauagugcaaauuugccagcuu

SEQ ID NO: 49608 - RNA, 64 nt, hsa
auugcugccgucuggccucuggccucagucuucagauagacaguaagaagaaagcagccucauu

SEQ ID NO: 49609 - RNA, 64 nt, hsa
caaaucaaccaaccaacucaguauccuguguuuugauagacaagaguuuacuaaauauauugau

SEQ ID NO: 49610 - RNA, 64 nt, hsa
auccugacaggaaauguuuucuucuacauggaaagauagacagcagccaacccugaucuggaag

SEQ ID NO: 49611 - RNA, 64 nt, hsa
agauugccaggcccuuuucuccuaugcacaccaggauagacaaggcaggggauacuggcagccu

SEQ ID NO: 49612 - RNA, 64 nt, hsa
uauucacaaguuuuggagggcuuuuuguuccucugauagacaugacugacuuuuagcugucaua

SEQ ID NO: 49613 - RNA, 64 nt, hsa
gcagagaagacuacccagccagugaagugcagaggauagacauaggaaaacauuccaggcauuu

SEQ ID NO: 49614 - RNA, 64 nt, hsa
uuaucacaagggaggggaggccgagagucagacugauagacaccauaggagccgacucuuugau

SEQ ID NO: 49615 - RNA, 64 nt, hsa
ucuugcagaaucagcuacacuuaauuauguugcugauagacaagcauccacgcuucagcuggca

SEQ ID NO: 49616 - RNA, 64 nt, hsa
ccuauaauauccuugaaaagaaacuauuaaaaaggauagacauuucugauguaaguaaaacccc

SEQ ID NO: 49617 - RNA, 64 nt, hsa
agcucuaaaaaaccaucucauggacugaaagguagauagacagauggaccacaaugggaaauag

SEQ ID NO: 49618 - RNA, 64 nt, hsa
acucuuuuauuuuuagaucacaaaauuuguccaggauagacauagagcuagaagaaacagacuu

SEQ ID NO: 49619 - RNA, 64 nt, hsa
aaagguaaucagcucaguguguuacugguuuaaggauagacauacggagcagaauaaagaguac

SEQ ID NO: 49620 - RNA, 64 nt, hsa
aaguauuucauguaggaggacuuuuauccuuuuugauagacaguuucauauaucuugaacucaa

SEQ ID NO: 49621 - RNA, 64 nt, hsa
agccucucaaauauugagcuuuaguacaaucauggauagacauucuggugaugauuuaggggcu

SEQ ID NO: 49622 - RNA, 64 nt, hsa
ggacauguugaaauuagaaucuauucuuguauuugauagacaaaauaugugggaaagauuuuuu

SEQ ID NO: 49623 - RNA, 64 nt, hsa
ggguggguuuuaaacagaaugccuauguagcagugauagacauauuccccuccuuugaaaccua

SEQ ID NO: 49624 - RNA, 64 nt, hsa
uucuuuacaggagaggaaaggucuaaaucacaaggauagacauuuaucaaagaaguuaaaaugg

SEQ ID NO: 49625 - RNA, 64 nt, hsa
aagagaguuguuagcuaaacugaucugucugcaugauagacaguuuaaaaauucaucccaguuc

SEQ ID NO: 49626 - RNA, 64 nt, hsa
aagagaugauuuacaccuaauagacauugaauaugauagacauacauguauauauguaucaguu

SEQ ID NO: 49627 - RNA, 64 nt, hsa
cuuuacaaucugcuuguuuuuuuuguaauuauuagauagacagccuagagugagaaguuaaagg

SEQ ID NO: 49628 - RNA, 64 nt, hsa
gagccacugcgccuggcugguuuucaugaaucuugauagacaucuauaacguuauuauuuucag

SEQ ID NO: 49629 - RNA, 64 nt, hsa
cuaucugugcuagguuaaaugguuggcccccaaagauagacagguccugauuucuagaacccgu

SEQ ID NO: 49630 - RNA, 64 nt, hsa
uuuucaagcuucucagugcuggaaaaaauacugagauagacauguuuaguugaaguuauuucau

SEQ ID NO: 49631 - RNA, 64 nt, hsa
aagcagcuuugucuauaguuaacaaaguuuuaaggauagacaagaauguguuuucuuuaauaaa

SEQ ID NO: 49632 - RNA, 64 nt, hsa
aaugacuuaguuaugacuggacaucuuaaaagcugauagacaagccaaauggcuggcagaugau

SEQ ID NO: 49633 - RNA, 64 nt, hsa
ucacauucucaauaguuccagcucaggaugaaaggauagacacaaaauuguuugaaaaacauuu

SEQ ID NO: 49634 - RNA, 64 nt, hsa
gaguucaguaugguguccaagagugcccuguguggauagacaugugcacuccuuccaggagugg

SEQ ID NO: 49635 - RNA, 64 nt, hsa
gccaucccuuggggaaggguggggagaaauauaggauagacacuggacauggcccauuggagca

SEQ ID NO: 49636 - RNA, 64 nt, hsa
ccauaccucuuccuuucccaucccacccacauaugauagacagccccucuguugagauauggag

SEQ ID NO: 49637 - RNA, 64 nt, hsa
gaagcaguugauauaauggguuuauacuuuaaaagauagacauggugccaugaaguuggggagu

SEQ ID NO: 49638 - RNA, 64 nt, hsa
aaguggcacauccaguggagcggugguagauccugauagacauggggcuccugggaguagagag

SEQ ID NO: 49639 - RNA, 64 nt, hsa
auccugaccaaaggaaggcacccuugacuguugggauagacagauggaccuauggggugggagg

SEQ ID NO: 49640 - RNA, 64 nt, hsa
gaaaacucuccugggguggaggagaccagggcaggauagacagaccucugcaguaagagagugg

SEQ ID NO: 49641 - RNA, 64 nt, hsa
auuuggauuggggucccucuaaaauuuaaugcaugauagacacauaugagggggaauagucuag

SEQ ID NO: 49642 - RNA, 64 nt, hsa
cccuggccuccucacauaggaaucuagcagaaaugauagacacaguccaccuuucggccggcca

SEQ ID NO: 49643 - RNA, 64 nt, hsa
auuggaaguaagaucagggcugauauucaccugggauagacaguauuggugaacuacucauuua

SEQ ID NO: 49644 - RNA, 64 nt, hsa
ccucaggagagagucuaagauaaaagcuuaggcugauagacaaguaguuaagagcuaagagcag

SEQ ID NO: 49645 - RNA, 64 nt, hsa
gucgcuacuaaaagaaugaaggaaauaauaaagugauagacagggaaggauagaaaagacuuaa

SEQ ID NO: 49646 - RNA, 64 nt, hsa
ucagguggauuuuuaccuuuguuccuuuugcucugauagacaaaaucaguuuaggacuauuaaa

SEQ ID NO: 49647 - RNA, 64 nt, hsa
uccugagguuuuuuuccccccagaagauaaagaggauagacaaccucuuaaaauauuuuuacaa

SEQ ID NO: 49648 - RNA, 64 nt, hsa
gccuaggcuguggccacuaagacguggguggggggauagacaggagugagagggagagugggug

SEQ ID NO: 49649 - RNA, 64 nt, hsa
aaaagaaaaaagaaaaaucucauuauuucaaaaugauagacauauaccaaaaacaagucuauaa

SEQ ID NO: 49650 - RNA, 64 nt, hsa
aaucaccucacuuguguagguagguuggaaucaggauagacacugugaucaaggcugaggccac

SEQ ID NO: 49651 - RNA, 64 nt, hsa
ucacaguucccuuuauuucacauaagcccaaacugauagacaguaacgguguuuaguuuuauac

SEQ ID NO: 49652 - RNA, 64 nt, hsa
agauuuaaagauuuuauuuuuacaaaucacagcugauagacagcgaagccuuccccauagagac

SEQ ID NO: 49653 - RNA, 64 nt, hsa
cuagcaugaggcuuuuuauaucuaaaugcuacgugauagacaauuucagcuagccacauauugu

SEQ ID NO: 49654 - RNA, 64 nt, hsa
uauuuaggaaguugacuuauaguacaugauaaaugauagacaauugagguaaguuuuuugaaau

SEQ ID NO: 49655 - RNA, 64 nt, hsa
guucucgcaaucuguauaaaugcauuuuagaacugauagacaguaaacuugaauuuaucuuuga

SEQ ID NO: 49656 - RNA, 64 nt, hsa
acuggauccagaacacaauuuuccccucagaacagauagacagacugaagccacugaacucugc

SEQ ID NO: 49657 - RNA, 64 nt, hsa
gcaagcccccagaggcugugucucuggacagacggauagacauacggaagcgaggccuggacca

SEQ ID NO: 49658 - RNA, 64 nt, hsa
cccuugaccagccaggccugaaggaagaccugcggauagacaggagcgggcaggcccgcacaua

SEQ ID NO: 49659 - RNA, 64 nt, hsa
gacugaagacaaaguguuucauuuagcuguuacugauagacaccuuuacaaagguuacuaaugu

SEQ ID NO: 49660 - RNA, 64 nt, hsa
agauggaggccugcccagacuaggaggcagcggggauagacagggaauggggagaagaaagacc

SEQ ID NO: 49661 - RNA, 64 nt, hsa
aaaaagagacaaauuuaacuguuacauaauuuuagauagacaaaaaacaugagugagucgugua

SEQ ID NO: 49662 - RNA, 64 nt, hsa
uuucuaccuguugcaccgauauucaaauaaaaaugauagacacagaaagguuugguaacuuugg

SEQ ID NO: 49663 - RNA, 64 nt, hsa
ggguacuaauuagcuuuuuucgacuuugucuugggauagacaguggcuaugggaggauuggacu

SEQ ID NO: 49664 - RNA, 64 nt, hsa
gguggggcccaguguacugaaauaaagucguuccgauagacacgucagcugggccucuaucugu

SEQ ID NO: 49665 - RNA, 64 nt, hsa
uuuucuaucuuguuggauuuuuuacaguguuuaagauagacacuuaaguguugccguaguauca

SEQ ID NO: 49666 - RNA, 64 nt, hsa
uaguucauauguucugaaaacuguuuuggagaaagauagacagaaaaaugucaucauauugaaa

SEQ ID NO: 49667 - RNA, 64 nt, hsa
cgggggagagacgaaaaagaaaaggaaagagcaagauagacaaaagccaaucagcuuaaaaaga

SEQ ID NO: 49668 - RNA, 64 nt, hsa
gcauagagagacagagagagagacaagaaacagagauagacagaaaauguucgggguggcaggc

SEQ ID NO: 49669 - RNA, 64 nt, hsa
gacaaugcuggcaacugggcucuaaucuccuaaagauagacagcucaaaugaauugguaagugu

SEQ ID NO: 49670 - RNA, 64 nt, hsa
ggaugacugaagagcuaagaagccuagggguagagauagacacguuuuuagauggugcauucaa

SEQ ID NO: 49671 - RNA, 64 nt, hsa
uaaauaguuggccagaauuaagcaaccaauacaugauagacagggcuaaaacugggcuacagaa

SEQ ID NO: 49672 - RNA, 64 nt, hsa
cuaggaaaugggggugauaauugugccuaccucagauagacagugccagaauuaagugagucaa

SEQ ID NO: 49673 - RNA, 64 nt, hsa
aggggguagcaaaguguuacagaaaagcggacuggauagacaaaacugcagaagguguauguug

SEQ ID NO: 49674 - RNA, 64 nt, hsa
cguuauuuucuacauaggcaaagagaauucgagggauagacagucuccaagaaaagugaagugg

SEQ ID NO: 49675 - RNA, 64 nt, hsa
ucuuuuuuuaaggaaucaaugaauaauaaauguagauagacaauuuucuucuggugagcugucu

SEQ ID NO: 49676 - RNA, 64 nt, hsa
ucuugcagccuugccucauaacaguggaauuucugauagacaaaccacaggacuuugauuuuaa

SEQ ID NO: 49677 - RNA, 64 nt, hsa
augugggugccgcugagaucaggcaguccuugaggauagacagauauacacaccacacacacac

SEQ ID NO: 49678 - RNA, 64 nt, hsa
guggguccuuaaguuugguugugaauaaucucuugauagacaauuuauacccaugaaaguucag

SEQ ID NO: 49679 - RNA, 64 nt, hsa
gagcacauuucuuucaucucucuuguccauaccugauagacacauuccucucugccaccuuccu

SEQ ID NO: 49680 - RNA, 64 nt, hsa
ugagggucaaggauaccaggggucccaagucacagauagacauuccaguuuguauucuuaggaa

SEQ ID NO: 49681 - RNA, 64 nt, hsa
gacgucacagucuaagaugggaaacugugguacagauagacaugaagagagcuuagcagugauu

SEQ ID NO: 49682 - RNA, 64 nt, hsa
uuuuucuguugagcuaugcagucgucaaaacagcgauagacagcauaggagguuugaagcagaa

SEQ ID NO: 49683 - RNA, 64 nt, hsa
cagccgggcacccccaaccucauggucauggacagauagacagugcugcccugcgaaguggcuc

SEQ ID NO: 49684 - RNA, 64 nt, hsa
accauacuacuggacuggacucaggcuggaggcagauagacacaguauagggggaaugggcuug

SEQ ID NO: 49685 - RNA, 64 nt, hsa
uuuagggcagagacagaccacugacaaauacacagauagacaaggaauuucccaugguaaaaag

SEQ ID NO: 49686 - RNA, 64 nt, hsa
gauuguuuuuaaauguuuuacuuuugguacaguugauagacaucauaaacgauaucaagcuuac

SEQ ID NO: 49687 - RNA, 64 nt, hsa
ucuugucacugugauuggaugcuggaugccgccugauagacaugcuggccuggcugagaaaccc

SEQ ID NO: 49688 - RNA, 64 nt, hsa
acaaaucuauuauuucuagauuuuuguauaacaugauagacauaaaauugguuuaucuccucca

SEQ ID NO: 49689 - RNA, 64 nt, hsa
uaagaugcagagggggaggggaagggaugguagagauagacagcucuccccuacuagguugggu

SEQ ID NO: 49690 - RNA, 64 nt, hsa
cuguaauuuaugauuuuucaaaaucauguuacaagauagacauauucuacuuagacguuaaacu

SEQ ID NO: 49691 - RNA, 64 nt, hsa
gcuccccccuacaccuagcucaucauuuucuauggauagacaauccgcucuucauccagaaaac

SEQ ID NO: 49692 - RNA, 64 nt, hsa
ggacugguuggccaaacucagacacguggacagggauagacagaaagagacagaagcuggggcu

SEQ ID NO: 49693 - RNA, 64 nt, hsa
aucguaugauaugagauacauacuaugaaaugaagauagacacauuuggauuaaaauauucuag

SEQ ID NO: 49694 - RNA, 64 nt, hsa
cugacagcuagguaucuagcuagcuagaaaggcagauagacagauauauagaugauagauagau

SEQ ID NO: 49695 - RNA, 64 nt, hsa
ucagagggagccaggaaucuacauggguagaugagauagacacagaccugcuccccgcagccuu

SEQ ID NO: 49696 - RNA, 64 nt, hsa
uuggggagacauauauuaaaauuuuagccaagaugauagacaugucucaauuauauaugugugu

SEQ ID NO: 49697 - RNA, 64 nt, hsa
uccccuacagucaguuuauaagggcuucaguagugauagacauuguuauaaaaacuuguaccau

SEQ ID NO: 49698 - RNA, 64 nt, hsa
caaacauaaauauuuacggauagauugcuagguagauagacacacacacaugcacacacacaca

SEQ ID NO: 49699 - RNA, 64 nt, hsa
agaauuacucugacaaggagucccugucguucaugauagacacaaugaaauccacccucaaaga

SEQ ID NO: 49700 - RNA, 64 nt, hsa
ugaagaggugaacacuugagugguuagagcuguagauagacauuguggggaagugugccagggu

SEQ ID NO: 49701 - RNA, 64 nt, hsa
caaggccagaaagugaucacaaaaagaggcagaugauagacacugggguagggucauaccacag

SEQ ID NO: 49702 - RNA, 64 nt, hsa
uaugaaguaccagguuuagucuuacuuuagcaaugauagacaaaagcgaauaaauacaucacag

SEQ ID NO: 49703 - RNA, 64 nt, hsa
uucucucucccugcuaccccuuucucugcagauagauagacacuggcauuaucccuuuaggaag

SEQ ID NO: 49704 - RNA, 64 nt, hsa
aacuccugaccucaggugauccgcccaccucagccucccaaagugcugggaugacaggugugag

SEQ ID NO: 49705 - RNA, 64 nt, hsa
aacuccugaccucaggugaucugcccgccucggucucccaaagugcugggauuacaggcaugag

SEQ ID NO: 49706 - RNA, 64 nt, hsa
guaugguaggggguuugaagaauccccuguccaccucccaaauccaggcccggcccccucuggc

SEQ ID NO: 49707 - RNA, 64 nt, hsa
caaucuccugaccucgugauccacccaccucgaccucccaaagugcugagauuacaggcgugag

SEQ ID NO: 49708 - RNA, 64 nt, hsa
aacuccugaccucaagugaucugcccgccucggccucccaaagugcuggaaccacaggccugag

SEQ ID NO: 49709 - RNA, 64 nt, hsa
ggaucucuuggccucaugaucagccugccucggccucccaaagugcugggauuacaggugugag

SEQ ID NO: 49710 - RNA, 64 nt, hsa
cuccuccucuugcagggcauggggccaggcuccacucccaaaugagacuggcccccuccauggu

SEQ ID NO: 49711 - RNA, 64 nt, hsa
aacuccugaccucaggugauccgccggccucacccucccaaagugcugggauuacaggcaugag

SEQ ID NO: 49712 - RNA, 64 nt, hsa
cgauauccugaucucgugauccgccugccucugccucccaaagugcugggauuacaggugugac

SEQ ID NO: 49713 - RNA, 64 nt, hsa
aacuccuaaccucgggugauccacccaccuuggccucccaaaguguuaggauuacaggcaugag

SEQ ID NO: 49714 - RNA, 64 nt, hsa
ugaucucuugaccucgugauccguccaccucagccucccaaagugcugggauuacaggugugag

SEQ ID NO: 49715 - RNA, 64 nt, hsa
gacuccugaccucaggucauccuccugccucggccucccaaagugcugagacuacaggugugag

SEQ ID NO: 49716 - RNA, 64 nt, hsa
aacuccuggccucaggugauccucuugucucagccucccaaagugcugggauuacaggcaugag

SEQ ID NO: 49717 - RNA, 64 nt, hsa
aacuccugaccucaaguaaucugcccaccucggccucccaaagugcuaggauuacaggagugag

SEQ ID NO: 49718 - RNA, 64 nt, hsa
gccuccugggcucaagcaauccucccacuucagccucccaaauagcuggggcuaccaugguauu

SEQ ID NO: 49719 - RNA, 64 nt, hsa
aacuccuggccucaugugaucugcccaccucagccucccaaaguacagggauuagaguugugag

SEQ ID NO: 49720 - RNA, 64 nt, hsa
aacuucugaccucaggugauccacccacuuugaccucccaaagugcugggauuacuagacguaa

SEQ ID NO: 49721 - RNA, 64 nt, hsa
aacuccuggccucaagugguccuccugccucagccucccaaaguguggggauuacaggugcgag

SEQ ID NO: 49722 - RNA, 64 nt, hsa
aacuccuaaccucaagugauccacccgccucagccucccaaagugcugggauuacaggugugag

SEQ ID NO: 49723 - RNA, 64 nt, hsa
aacuccugaccucagguaaucgaccugccucggccucccaaagugcugggauuacaggugugag

SEQ ID NO: 49724 - RNA, 64 nt, hsa
aacuccugaccuuaggugauccacucgccuucaucucccaaagugcugggauuacaggcgugag

SEQ ID NO: 49725 - RNA, 64 nt, hsa
cgaucucuugaccucgugaucugccugccuuggccucccaaagugcugggauuacaggcgugag

SEQ ID NO: 49726 - RNA, 64 nt, hsa
aucacuccccacuucuuucugcugugcugcuucccucccaaacuccauuucugucacccuuuuu

SEQ ID NO: 49727 - RNA, 64 nt, hsa
guucuaguucuagucuguugaucugccuuuuguucucccaaaauguacaguaauuccauuuguu

SEQ ID NO: 49728 - RNA, 64 nt, hsa
aacuccugaccucaggugauccgccugccucggccucccaaagugcugggauuacaggcauaag

SEQ ID NO: 49729 - RNA, 64 nt, hsa
aacuccuggccucaagcaauccucucuccucagccucccaaagugcugggauuacaagugugag

SEQ ID NO: 49730 - RNA, 64 nt, hsa
aacuccuggguucaagcaauccucccaccucggccucccaaagugcugggauugcaggcaugag

SEQ ID NO: 49731 - RNA, 64 nt, hsa
agguuguggaauuucuuucuucuccccuucuucccucccaaaagcuuagcuauguauaaagugc

SEQ ID NO: 49732 - RNA, 64 nt, hsa
auuaugaucugacuggaaaacaauccuguauccccucccaaagaaucaugggcuuuuuuuuuga

SEQ ID NO: 49733 - RNA, 64 nt, hsa
aaucuuuuuaagauuaaaaaugaauaccuuaaaucucccaaaagagauaaccaguaucugaagg

SEQ ID NO: 49734 - RNA, 64 nt, hsa
aacuccugaccgcaagugauccacacgccuuggucucccaaagugcugggauuacgguguuagc

SEQ ID NO: 49735 - RNA, 64 nt, hsa
cgaacuccugaccucaugagccgcccgccuuggccucccaaagugcugggacgugacaggagug

SEQ ID NO: 49736 - RNA, 64 nt, hsa
acucucccacuucuguggucaacucccugcagaacucccaaacugccguucuuuucgauagcuc

SEQ ID NO: 49737 - RNA, 64 nt, hsa
cuggccuggcugccuggccguggcuucucuuuggcucccaaagagaaggacaguguugggagua

SEQ ID NO: 49738 - RNA, 64 nt, hsa
aguguugggaguaucugccguggcuucucuuuggcucccaaagagaaggacaguguugggagua

SEQ ID NO: 49739 - RNA, 64 nt, hsa
aacuccugggcucaagugaucccccugccuuggccucccaaacuggugagauuacaggcaugag

SEQ ID NO: 49740 - RNA, 64 nt, hsa
uggcucacugaagucuugaccccgcugccucagccucccaaauaacuggggccacaggugugca

SEQ ID NO: 49741 - RNA, 64 nt, hsa
cgaucucuugaccuugggauccacccgccuuggccucccaaagugcugggauuacaggugugag

SEQ ID NO: 49742 - RNA, 64 nt, hsa
aaacccuuggcucaagcaauuugccugccucagccucccaaagugcugggauuacaggcgugag

SEQ ID NO: 49743 - RNA, 64 nt, hsa
aacuccugaccuccagugauccgccugccuugaccucccaaagugcugggauuacagacaugag

SEQ ID NO: 49744 - RNA, 64 nt, hsa
acuccuggacuuaacgccauccaccugccacagccucccaaagugcuaggaauacaggagugca

SEQ ID NO: 49745 - RNA, 64 nt, hsa
aacuccugagcucaagugauccucccgucucagccucccaaagggcugagauuacaggugugag

SEQ ID NO: 49746 - RNA, 64 nt, hsa
aacuccugagcucaaaugauccuccugccuuggccucccaaagugcuggaauuacaggcaugag

SEQ ID NO: 49747 - RNA, 64 nt, hsa
aacuccuggacucaagggauccuccugucuugggcucccaaaguguugggauuacaggcgugag

SEQ ID NO: 49748 - RNA, 64 nt, hsa
gaacuccuggccuaggugauccacccgccucgaccucccaaagugcugggauuacaggcaugag

SEQ ID NO: 49749 - RNA, 64 nt, hsa
caaacuccugacuuugugauccacccgccucggccucccaaagugcugggauuacaggcaugag

SEQ ID NO: 49750 - RNA, 64 nt, hsa
cgaucuccugacgucgugauccacccgccucggccucccaaaaugcugggauuacaggugugag

SEQ ID NO: 49751 - RNA, 64 nt, hsa
aacuccugggcucaagcaauccacccaccucugccucccaaagugcugggauuacaggcgugag

SEQ ID NO: 49752 - RNA, 64 nt, hsa
accuccugggcucaagcaauccuccugccucggccucccaaagugcugggauuacagaugugag

SEQ ID NO: 49753 - RNA, 64 nt, hsa
gccuccugggcucaagcaauucucccaccucagccucccaaauagcugggaucacuggcacaaa

SEQ ID NO: 49754 - RNA, 64 nt, hsa
aacuccugaccucaagugauccaccugccucagccucccaaagugcugggauuauagucgugag

SEQ ID NO: 49755 - RNA, 64 nt, hsa
ugaucucuugaccucgugaucugccugccucggccucccaaagugcuggcauuacaggcaugag

SEQ ID NO: 49756 - RNA, 64 nt, hsa
cucccagccaucuguauaaacacaauccuuuguucucccaaaucugaaucgaauuacucuuuug

SEQ ID NO: 49757 - RNA, 64 nt, hsa
aacuccugaccucagguaauccgccugccuuggccucccaaagugcugggauuacagacaugaa

SEQ ID NO: 49758 - RNA, 64 nt, hsa
aacuccugggcucaagugauccuccugccuuggccucccaaaaugcugggauuacaggcaugag

SEQ ID NO: 49759 - RNA, 64 nt, hsa
aacuccugaccucaggugauccacccgccucagccucccaaagugcugggauuacaggcaaaag

SEQ ID NO: 49760 - RNA, 64 nt, hsa
cgaacuccugaccuugugaugcucccaccucggccucccaaagugcugggauuaaagcugugag

SEQ ID NO: 49761 - RNA, 64 nt, hsa
cgaucuccugaccucaugauccucccgccucagccucccaaaaugcugggauuacaggcgugag

SEQ ID NO: 49762 - RNA, 64 nt, hsa
uaaacucuugaccucauguuccacccgccacggccucccaaagugcugugauuaccggugugag

SEQ ID NO: 49763 - RNA, 64 nt, hsa
aacuucugagcucaagagaugcacuccccucagccucccaaagugcugggauuacaggcggcca

SEQ ID NO: 49764 - RNA, 64 nt, hsa
gacuccugguuucaagugauccucucaucuuggccucccaaagugcugggauuacagggacgag

SEQ ID NO: 49765 - RNA, 64 nt, hsa
ucucgaacucgaccucgugauccgccgccucggccucccaaagugcuaggauuacaggcgugag

SEQ ID NO: 49766 - RNA, 64 nt, hsa
aacuccuggucucgagugaucuuccuaucucagccucccaaagugcugggacuacaggcaugag

SEQ ID NO: 49767 - RNA, 64 nt, hsa
aacuccugaccucaagugaucuuccggccucagccucccaaagugcuggauuacaggcgugagc

SEQ ID NO: 49768 - RNA, 64 nt, hsa
guuuguguucuuaaggguuugcaaaauaauuuggcucccaaacucuuguugggguguaguguuu

SEQ ID NO: 49769 - RNA, 64 nt, hsa
aacuccugaccucaagugauucaccugccucggccucccaaagugcugggauuacaggcgugag

SEQ ID NO: 49770 - RNA, 64 nt, hsa
acuuccugaccucagguuauccacccaccucagccucccaaagugcugggauuacaggugugag

SEQ ID NO: 49771 - RNA, 64 nt, hsa
caaucuccugaccucgugauccacccgccuuggccucccaaagugcugggauuacaggcgugag

SEQ ID NO: 49772 - RNA, 64 nt, hsa
aacuccugaccucaggugauccacuugccucggccucccaaagugcugagauuacaagugugag

SEQ ID NO: 49773 - RNA, 64 nt, hsa
aacucccgaccucaggugauccacccaccccggccucccaaaaugcugggaucacaggcgugag

SEQ ID NO: 49774 - RNA, 64 nt, hsa
aauuccugaccucaagugauccaccugccuuagccucccaaagugcugggauuacaggcaugag

SEQ ID NO: 49775 - RNA, 64 nt, hsa
cgaucucuugaccuuguguuccacccgccuuggccucccaaagugcuggaauuacaggcaugag

SEQ ID NO: 49776 - RNA, 64 nt, hsa
aacuccuggccucaagcgauccgccuaccucagccucccaaagugcuaggauuacaggcauaag

SEQ ID NO: 49777 - RNA, 64 nt, hsa
cgaucuccugaccucgugauccacccgccucggccucccaaagugcugggauuacaggcuugag

SEQ ID NO: 49778 - RNA, 64 nt, hsa
cgaucuccugaccuugugaucugcccgccucggccucccaaagugcugggauuacaggcgugag

SEQ ID NO: 49779 - RNA, 64 nt, hsa
cgaucuccuaaccuggugauccgcccgccucggccucccaaaguauugggauuacccgcgugag

SEQ ID NO: 49780 - RNA, 64 nt, hsa
aauuccugaccucaggugaucugcccaccucagccucccaaagugcugggauuacaggcgugag

SEQ ID NO: 49781 - RNA, 64 nt, hsa
aacuccugaccacagguaaucagcccgccucggccucccaaagugcugggauuacaggcgugag

SEQ ID NO: 49782 - RNA, 64 nt, hsa
ucuugaacugaccucaugauccaccugccucagccucccaaaaugcugggauuacaggcuugag

SEQ ID NO: 49783 - RNA, 64 nt, hsa
cgaucucuugaccucaugauccacccgccucgaccucccaaagugcugugauuacaggugugag

SEQ ID NO: 49784 - RNA, 64 nt, hsa
ucaaugcccaguuuugacuuuuguuagccugacacucccaaacaguuguagaauccgauagaug

SEQ ID NO: 49785 - RNA, 64 nt, hsa
aacuccugaccucaggugguccuucugccuuggccucccaaagugcugggauuacaggcgugag

SEQ ID NO: 49786 - RNA, 64 nt, hsa
cgaucuccugaccucgugaucugcccgccucagccucccaaagugcugggauuacaggagugag

SEQ ID NO: 49787 - RNA, 64 nt, hsa
uuuuuuuuauuuugagcaauucuccugccucagccucccaaauagcugggauuacaggugcaug

SEQ ID NO: 49788 - RNA, 64 nt, hsa
aacuccugaccucagaugauccgccugccuuggccucccaaagugcugggauuacagguguggg

SEQ ID NO: 49789 - RNA, 64 nt, hsa
aacuccugaccucaggugauacacccaucucggccucccaaagugcugggauuacaggcuugag

SEQ ID NO: 49790 - RNA, 64 nt, hsa
acaggcuggccucaagugauccucuuaccuuggccucccaaacaccgggauuauaggcgugagc

SEQ ID NO: 49791 - RNA, 64 nt, hsa
ggugagacaguccacccagagcucucccaagucucucccaaauaccuuagaguagggacacugg

SEQ ID NO: 49792 - RNA, 64 nt, hsa
aacucuugaccucaggugaucugcccaccucggccucccaaagugcugggauuacagaugugag

SEQ ID NO: 49793 - RNA, 64 nt, hsa
aacucccgacgucaggugaucuaccugccucggccucccaaagugcugggauuacaggcgugag

SEQ ID NO: 49794 - RNA, 64 nt, hsa
uggacuccugaccucgugauccacccaccuuggccucccaaaguucuaggauuacaggugugag

SEQ ID NO: 49795 - RNA, 64 nt, hsa
aggaguccuucuacagaauaggucagaucuuggccucccaaaccccuuauuuuuaaaauacuuu

SEQ ID NO: 49796 - RNA, 64 nt, hsa
aacuccugagcucaggcaaucugcccgccuuggccucccaaagugcuaggauuacagguaugag

SEQ ID NO: 49797 - RNA, 64 nt, hsa
uccugggcuccagggauccacagucccccuuggccucccaaaguguugggauuacaugcaugag

SEQ ID NO: 49798 - RNA, 64 nt, hsa
ugaacuccugagcucaugauccacccgccucagccucccaaagugcugggauuacaggccccuu

SEQ ID NO: 49799 - RNA, 64 nt, hsa
aacuccugaccucaagugauccacucaccucggccucccaaagugcugggauuacaggugugag

SEQ ID NO: 49800 - RNA, 64 nt, hsa
aaccccuaggcucaaaugaugugcccaacucggccucccaaagugcugggauuacaggcaugaa

SEQ ID NO: 49801 - RNA, 64 nt, hsa
aagauagcaccauuguuuaaauaccgccuauguacucccaaaugaauaaaacauaauucuuguc

SEQ ID NO: 49802 - RNA, 64 nt, hsa
caaucuccugaccuugugauccgccugccuuggccucccaaagugcugggauuacaggcgugag

SEQ ID NO: 49803 - RNA, 64 nt, hsa
aacuccugaccucaggugauccgcccgccucagccucccaaagugcugagauuacaggugugag

SEQ ID NO: 49804 - RNA, 64 nt, hsa
accuccuggguuccagcgauucuccugccucagccucccaaauagcugugauuacaggcgugca

SEQ ID NO: 49805 - RNA, 64 nt, hsa
uucagaaacauuauacauugggccauuuuucuuucucccaaagaagauucauggauagucagac

SEQ ID NO: 49806 - RNA, 64 nt, hsa
ccaacaggcagagcaggguugaaaaaaauaucagcucccaaagggcccaugugucuacaucauc

SEQ ID NO: 49807 - RNA, 64 nt, hsa
aacuccugaccucaggugauccgccugucucggccucccaaagugcugggauuaaaggugugau

SEQ ID NO: 49808 - RNA, 64 nt, hsa
ugcuuaucuuguggucugaacaugacucuucaaacucccaaaacaauugaaauauuucuuuuuu

SEQ ID NO: 49809 - RNA, 64 nt, hsa
cgaucuccugaccucaugaucuacccgccucggccucccaaagugcugggauuacaggcgugag

SEQ ID NO: 49810 - RNA, 64 nt, hsa
aauuccuggccucaggugauccaccugccucagccucccaaagugcugggauuacaggcaugag

SEQ ID NO: 49811 - RNA, 64 nt, hsa
ucucaaucugaccuugugaucugcccaccucggccucccaaagugcuaggauuacuggcgugag

SEQ ID NO: 49812 - RNA, 64 nt, hsa
ugaucuccugaccucgugauccgcccgccuuggccucccaaaagugcugggauuauaggcguga

SEQ ID NO: 49813 - RNA, 64 nt, hsa
aaugcccaaacuugguuggagcauagccccugcucucccaaaguugcacuuucacugggaagau

SEQ ID NO: 49814 - RNA, 64 nt, hsa
aacuccugaccucaggugauccaccugccucagccucccaaagugcugggauuacaggcgugag

SEQ ID NO: 49815 - RNA, 64 nt, hsa
caaacuucugaccucauaauccacccaccuuggccucccaaagugcuaggauuacaggcaugag

SEQ ID NO: 49816 - RNA, 64 nt, hsa
cgaucuccugaccucgugauucgcccgccucggccucccaaagugcuggaauuacuggcgugag

SEQ ID NO: 49817 - RNA, 64 nt, hsa
cugcagccugaaacuccuuggcuuccaccucagccucccaaagcauuaggauuauaggcgugag

SEQ ID NO: 49818 - RNA, 64 nt, hsa
cgaacuccugaccuugugaucugcccgccucagccucccaaaguacugggauuauaggcaugag

SEQ ID NO: 49819 - RNA, 64 nt, hsa
caaucuccugaccucgugaaucgccccccucggucucccaaagugcugggauuacaggcgugag

SEQ ID NO: 49820 - RNA, 64 nt, hsa
caaacuccuaaccucgugauccgccugccucgaccucccaaagugcugggauuacaggcaugag

SEQ ID NO: 49821 - RNA, 64 nt, hsa
aaauugggcagcuaaauuuuucaguuccaugugccucccaaauaaaaaacagaaaauaaguagu

SEQ ID NO: 49822 - RNA, 64 nt, hsa
cgaucucuugaccucaugaucuacccgccuuggccucccaaagugcugagauuacaggcgugag

SEQ ID NO: 49823 - RNA, 64 nt, hsa
aacucuuggccucaaguaauccuccugccucagccucccaaaguguugggauugcagauaugag

SEQ ID NO: 49824 - RNA, 64 nt, hsa
uugaucuccugacuugugauccgccugccucggccucccaaagugcuuggauuacagguguaag

SEQ ID NO: 49825 - RNA, 64 nt, hsa
agcuccugaccucaggugauccgccugccuuggccucccaaaguggugggaucacaggcgugag

SEQ ID NO: 49826 - RNA, 64 nt, hsa
aacuucugaccucagaugaucugcccgccucagccucccaaagugcugggauuacaggcaugag

SEQ ID NO: 49827 - RNA, 64 nt, hsa
aacucccgaccucagguaauccgcccgccucggccucccaaaaugcugggauuagaggugugag

SEQ ID NO: 49828 - RNA, 64 nt, hsa
aacuccugaccucaagcgauccacccaccuaggccucccaaagugcugggauuacaggcaugaa

SEQ ID NO: 49829 - RNA, 64 nt, hsa
aacucccgaccucaggugauccgcccgccugggccucccaaagugcugggauuacaggcgugag

SEQ ID NO: 49830 - RNA, 64 nt, hsa
aguuuuacccauaaguaauauuuaaagauuauagcucccaaaagaauggaccaaccacuuucgu

SEQ ID NO: 49831 - RNA, 64 nt, hsa
agguaccauggccauucagcacagccuugauuuccucccaaaguaggugagcuauagugaagaa

SEQ ID NO: 49832 - RNA, 64 nt, hsa
cuaccaacuccaccuccacccccucauuccccuucucccaaaguacuacugcuguugcaugaca

SEQ ID NO: 49833 - RNA, 64 nt, hsa
cgaacuccugaccucgugauccgccugccucagccucccaaagugcugggauuacaggugugag

SEQ ID NO: 49834 - RNA, 64 nt, hsa
aacuccugaccucaggugauccuccugccucggccucccaaagugcugggauuacaggcaugag

SEQ ID NO: 49835 - RNA, 64 nt, hsa
aacucuugaccucaggugauccacccaccucagccucccaaagugcugggauuacaagcgugag

SEQ ID NO: 49836 - RNA, 64 nt, hsa
aacuccuggccucaagugauucuccugccucagccucccaaagugcugggauuacaggugugaa

SEQ ID NO: 49837 - RNA, 64 nt, hsa
aacuccuguccucagguaauccgcccaccucagccucccaaagugcugggauuacaggcgugag

SEQ ID NO: 49838 - RNA, 64 nt, hsa
aacuccugaccucaagugauccaccuuccuugugcucccaaagugcugagauuacaggcgugag

SEQ ID NO: 49839 - RNA, 64 nt, hsa
aacuccugggcucaagcgauccuccuggcucagccucccaaagugcugggauuacaggcgugag

SEQ ID NO: 49840 - RNA, 64 nt, hsa
aacuccugaccucaggugaugcacccaccucagccucccaaagugcagggauuacaggcaugag

SEQ ID NO: 49841 - RNA, 64 nt, hsa
aacuccugaccucaggugauccacccgccucagccucccaaagugcugggauuacaggcaugag

SEQ ID NO: 49842 - RNA, 64 nt, hsa
aaugccugaccucaggugauccacccgccuuggccucccaaagugcuggaauuacaggugugag

SEQ ID NO: 49843 - RNA, 64 nt, hsa
aacuccuagccuugauugauccuccugccuuggccucccaaagugcugggacuacaggugcaug

SEQ ID NO: 49844 - RNA, 64 nt, hsa
ccaucucuugaccuugugauccacccaccucagccucccaaagugcugggauuacaggcaugag

SEQ ID NO: 49845 - RNA, 64 nt, hsa
aacuccugaccuaaagugaucugcccgccuuggccucccaaagugcugggauuacagacaugag

SEQ ID NO: 49846 - RNA, 64 nt, hsa
ucucccgcucuccaggagcuuaucuucgccccaucucccaaauaagugggcccuugugcuguga

SEQ ID NO: 49847 - RNA, 64 nt, hsa
aauuccugagcucaagcaaccugccggccucggccucccaaaguacugggauuacacgcagaag

SEQ ID NO: 49848 - RNA, 64 nt, hsa
aacucuugaccucaggugaucugcccgccuuggccucccaaagugcugggauuacaggugugag

SEQ ID NO: 49849 - RNA, 64 nt, hsa
aacuccugaccucaggugauccgcccaccucggccucccaaagugcugggauuacaggugugag

SEQ ID NO: 49850 - RNA, 64 nt, hsa
aacuccugaccucaggugauccaccugccucggccucccaaagugcuaggauuacaggcgugag

SEQ ID NO: 49851 - RNA, 64 nt, hsa
aacuccugaccucaggugauccgcccaccuuggccucccaaagugcugggauuacacgcgugag

SEQ ID NO: 49852 - RNA, 64 nt, hsa
gccucccguguucaagcaguucuccugccucagccucccaaauagcugggauuacaguugccug

SEQ ID NO: 49853 - RNA, 64 nt, hsa
aacuccugaccucaagugauccacccgccuuggccucccaaagugcugggauaauaggugucag

SEQ ID NO: 49854 - RNA, 64 nt, hsa
ugaucuccugaccuugugauccaccagccucagccucccaaagugcugggauuacaggcgugag

SEQ ID NO: 49855 - RNA, 64 nt, hsa
aacuccuggccuccagugauccuccauccucggccucccaaagugcuggaaucacaggggugag

SEQ ID NO: 49856 - RNA, 64 nt, hsa
cgaucucuugaccucgugauucgcccgccgcguccucccaaagugcugggauuacaggccugag

SEQ ID NO: 49857 - RNA, 64 nt, hsa
aacucccgaccucagaugaucugcccgccucggccucccaaaauugcugggauuacagguguga

SEQ ID NO: 49858 - RNA, 64 nt, hsa
ccaucuccugaguuugugaucugcccgccuuggccucccaaagugcugggauuacaggugugag

SEQ ID NO: 49859 - RNA, 64 nt, hsa
ccugaccucaggugauccacccgcccgccuuggccucccaaagugcuaggauuccaggcgugag

SEQ ID NO: 49860 - RNA, 64 nt, hsa
ugaucuccugaccucgugauccgcccuccucggccucccaaagugcugggauuauaggcgugag

SEQ ID NO: 49861 - RNA, 64 nt, hsa
aacuccugaccucagguaauccaccugccuuggccucccaaagugcugggauuacaggcgugag

SEQ ID NO: 49862 - RNA, 64 nt, hsa
aacucuugaccucaaaugauccacccaccuuggccucccaaauuguucguuuuacuuuuuuuuu

SEQ ID NO: 49863 - RNA, 64 nt, hsa
aacuccugaccucaggugaucugccugccucggccucccaaagugcugggauuacaggugugag

SEQ ID NO: 49864 - RNA, 64 nt, hsa
aacuccugggcucaagugauccacccaucuccaccucccaaagugcuaggauuacaggcgugag

SEQ ID NO: 49865 - RNA, 64 nt, hsa
aacuccugaccucaagugauccaccugccuuggccucccaaaguguugggauuauaggcgugag

SEQ ID NO: 49866 - RNA, 64 nt, hsa
aaauccugaccucaaaugauccacccaccucagccucccaaagugcugggauuacaggcaugag

SEQ ID NO: 49867 - RNA, 64 nt, hsa
gcccccugggaucaagcgauucuccuaccucagccucccaaauagcugggacuacaaggugccc

SEQ ID NO: 49868 - RNA, 64 nt, hsa
cgauuuccugaccuugugaucccccugccucggccucccaaagugcugggauuacaggcaugag

SEQ ID NO: 49869 - RNA, 64 nt, hsa
aacucccgaccucaggugauccacccgccucagccucccaaagugcugggauuacaggcaugag

SEQ ID NO: 49870 - RNA, 64 nt, hsa
agagguacagcugcugaaagugucggagaugaaacucccaaaggugccagagauggcugugccg

SEQ ID NO: 49871 - RNA, 64 nt, hsa
agagguagagcugcccaaagugucagagaugaaacucccaaaggugccagagauggcugugccg

SEQ ID NO: 49872 - RNA, 64 nt, hsa
agagguggagcuccccaaggugucagagaugaaacucccaaaggugccagagauggcugugccg

SEQ ID NO: 49873 - RNA, 64 nt, hsa
aacuccugagcucaagugauccacccgccucagccucccaaagugcugggauuacaggggugag

SEQ ID NO: 49874 - RNA, 64 nt, hsa
aacucuugggcucaagugauccucccgccucagccucccaaaguguugggauuacaggugugag

SEQ ID NO: 49875 - RNA, 64 nt, hsa
gauauuuauuuaaccuugaauauucaagaacauucucccaaaucuaaauggcuacugugcauuc

SEQ ID NO: 49876 - RNA, 64 nt, hsa
aucguggguucccugagcccagccagccugggaccucccaaaguggguggcuuaccagaccacc

SEQ ID NO: 49877 - RNA, 64 nt, hsa
cgaacuccugaccucgugauuugccugccugggccucccaaagugcuaggauuacaggcaugag

SEQ ID NO: 49878 - RNA, 64 nt, hsa
ugaucuccugagcucgugaucugcccgccucggccucccaaagugcugggauuacaggugugag

SEQ ID NO: 49879 - RNA, 64 nt, hsa
aaauccugggcucaagugauccuccugcuuuggccucccaaaaugcugggauuauaggcaugag

SEQ ID NO: 49880 - RNA, 64 nt, hsa
ucuuccucucucgcccaaguucucaugccucagccucccaaauagcugggacuacaggcacagg

SEQ ID NO: 49881 - RNA, 64 nt, hsa
aacuccuagacucaagugauccuccugucuuggccucccaaagugcugagauuacaggugugag

SEQ ID NO: 49882 - RNA, 64 nt, hsa
ugaacuccugaccucgugacccacccgccuuggccucccaaagugcugggauuacaggugugag

SEQ ID NO: 49883 - RNA, 64 nt, hsa
aacuccugaccucaggugauccgccuaucucagccucccaaagugcugggauuacaggcgugag

SEQ ID NO: 49884 - RNA, 64 nt, hsa
cagggaggaaaagcagucaggccacacaccauugcucccaaaauggacuucucugcaagccuga

SEQ ID NO: 49885 - RNA, 64 nt, hsa
ggaacacggaucuaaacucagguguguccaaguccucccaaaggacagcagugauggagaggac

SEQ ID NO: 49886 - RNA, 64 nt, hsa
uuccucccagcugcccuccccuacuucucccuugcucccaaagcuuuccuuggagaagggcccu

SEQ ID NO: 49887 - RNA, 64 nt, hsa
cgaacaccugaccucgugguccacccgccucggccucccaaagcacugggauuacaggcgugag

SEQ ID NO: 49888 - RNA, 64 nt, hsa
acucuugaccucaggugauccacucgccccuuggcucccaaagugcuggaauuacaggcauuag

SEQ ID NO: 49889 - RNA, 64 nt, hsa
aacucuugaccucaagugauccacucgcuucggccucccaaagugcugggauuauaggcgugag

SEQ ID NO: 49890 - RNA, 64 nt, hsa
cgaacuccugaccucaugauccuccugccucggccucccaaagugcugggauuauaggcaugaa

SEQ ID NO: 49891 - RNA, 64 nt, hsa
gccuccugacuucaagcaauucuccugccucagccucccaaagugcugggauuacaggugugag

SEQ ID NO: 49892 - RNA, 64 nt, hsa
aacuccugaccucaguugauccacccgccucagccucccaaagugcuaggauuacaggcaugaa

SEQ ID NO: 49893 - RNA, 64 nt, hsa
ugaacuccugaccucgugaucugcccgccuuggccucccaaaguacugggauuacaggcgugag

SEQ ID NO: 49894 - RNA, 64 nt, hsa
gggacccucccuauuccauccaagggaagcagaacugccaaagacucaagucuuuucauauuua

SEQ ID NO: 49895 - RNA, 64 nt, hsa
gacccagugccaggagcuggaagacaagguguuucugccaaacggggaccuccauccagagaaa

SEQ ID NO: 49896 - RNA, 64 nt, hsa
aggauaccuucaguuugaaucugcauaauguucacugccaaacuccuucucauuuaaugcuuau

SEQ ID NO: 49897 - RNA, 64 nt, hsa
auaauuaaaugaauuauuuauucauuucucuccucugccaaaucuacuuagccccacaaaaaug

SEQ ID NO: 49898 - RNA, 64 nt, hsa
uaggaggagggugcacauaacccuuacccuaccucugccaaaaagugggggcuguacuggggac

SEQ ID NO: 49899 - RNA, 64 nt, hsa
guugugccuuauugucccaucugugggccucauucugccaaagcuggaccaaggcuaaccuuuc

SEQ ID NO: 49900 - RNA, 64 nt, hsa
augcuauauuuaaaaacacugauuuuuuuuuaaccugccaaaaauaaaaaaaagcucauuuuau

SEQ ID NO: 49901 - RNA, 64 nt, hsa
gauaagaaaacugaggcaaggggagauuaacuuacugccaaauuucaaacaguuaguaguauuu

SEQ ID NO: 49902 - RNA, 64 nt, hsa
uuguaggaagccacucuucuccccuaaacaacuucugccaaacaauaauaaagccaacuggaaa

SEQ ID NO: 49903 - RNA, 64 nt, hsa
cauuccuugaaucaaggagcacuacuggauucaacugccaaaauuuuuuaaagguuuuaggacu

SEQ ID NO: 49904 - RNA, 64 nt, hsa
cuccagaauugacuuagcccuaguaauaaaagcacugccaaaacaucucagagacuucuuuuau

SEQ ID NO: 49905 - RNA, 64 nt, hsa
uaacuuaccuggcuuaauguaauuucacaguuaccugccaaacuacuagucacuuuacauccuc

SEQ ID NO: 49906 - RNA, 64 nt, hsa
uucugguaaagaucaugguuaaguauaaucauuacugccaaacuggaauuuucaaguuauuaua

SEQ ID NO: 49907 - RNA, 64 nt, hsa
uugguagaugcaaggucuaucucucccaucagggcugccaaagcugggcuuuguuuuucccagc

SEQ ID NO: 49908 - RNA, 64 nt, hsa
aaacuaaccaucucggagcugggcuccucauuuacugccaaacccucagcuuauguagcuagaa

SEQ ID NO: 49909 - RNA, 64 nt, hsa
ggauggugggucugggaccccaauucauucuuaucugccaaagaauuaucuagaagcacaucaa

SEQ ID NO: 49910 - RNA, 64 nt, hsa
gagacucagcuguugucacacccaaagggaugcucugccaaagguuuaaacacccaggagacca

SEQ ID NO: 49911 - RNA, 64 nt, hsa
augcccuacacacccccacagucuaccccaaagucugccaaaggcagugcaaagaaggaaggcu

SEQ ID NO: 49912 - RNA, 64 nt, hsa
gaugaggauguuuuugucugugaaucacgguauucugccaaaaccaaaucuuuuaagaaaauua

SEQ ID NO: 49913 - RNA, 64 nt, hsa
aucaguuugcuguuuuuaccacuuauuucaugcccugccaaauucaaguuacacagacuuccau

SEQ ID NO: 49914 - RNA, 64 nt, hsa
acaagcuaagaugaaauucugacauaguacaucucugccaaaaaccacacacccucuguggaua

SEQ ID NO: 49915 - RNA, 64 nt, hsa
agucacgcccucucugugccuccguuuucugcaucugccaaagggguuaaacacuucugcccca

SEQ ID NO: 49916 - RNA, 64 nt, hsa
gucugauauguuggccccuucuauggaaacaacgcugccaaauccuggagcaaaaccugaagug

SEQ ID NO: 49917 - RNA, 64 nt, hsa
gaacaguaaaguuaaaacggaugucuccauugaucugccaaaucguuauagagagcaauuuguc

SEQ ID NO: 49918 - RNA, 64 nt, hsa
ugugucauuuauaacuucuguacaguaagaccaccugccaaaagcuggaggaaccauugugcug

SEQ ID NO: 49919 - RNA, 64 nt, hsa
aagacaaauuuugcauauucucuauuuuacuuuucugccaaaauaaaccuguucuuccuuuuuu

SEQ ID NO: 49920 - RNA, 64 nt, hsa
ugaacaaagacauuuauauggguuuauuuucauucugccaaaguaaaacaauacaucaacaaga

SEQ ID NO: 49921 - RNA, 64 nt, hsa
aaauugaggcauuuuaaucugcacaguuuaucuucugccaaaauaaaaauuuacuauuuccuuu

SEQ ID NO: 49922 - RNA, 52 nt, hsa
gagacugugauaugucuuaaaacugccaaagcauuucauugagaauuaugau

SEQ ID NO: 49923 - RNA, 64 nt, hsa
gcccaagguaaacaguuugaaaagacaaaugggccugccaaacuguacaguuucuuccccaaga

SEQ ID NO: 49924 - RNA, 64 nt, hsa
gugcuuuucugguugagaucaugucauugaugaacugccaaagucaggggaggagggcagagac

SEQ ID NO: 49925 - RNA, 64 nt, hsa
accuuacggcgcuaaugcauuaaguugaagucgacugccaaagaggcccagcagagggcagcac

SEQ ID NO: 49926 - RNA, 64 nt, hsa
accaccuuucccaucaguucucaccggaaauaugcugccaaaaagaaaaucagcuuuucuaaga

SEQ ID NO: 49927 - RNA, 64 nt, hsa
auuggaauagcaaguuuaaaccuuuguuguccaucugccaaaugaacuagugauugucagacug

SEQ ID NO: 49928 - RNA, 64 nt, hsa
ucuuaauuaucaucugcaaguuucaagaaguauucugccaaaaguauuuacaaguauggacuca

SEQ ID NO: 49929 - RNA, 64 nt, hsa
augaauauggaauauccaauccugugcugcuauccugccaaaaucauuuuaauggagucaguuu

SEQ ID NO: 49930 - RNA, 64 nt, hsa
cagucuucaggcaaaacgucgaaucagcuauuuacugccaaagggaaauaucauuuauuuuuua

SEQ ID NO: 49931 - RNA, 64 nt, hsa
guucccuuucauacagaggguuuucuauggaucacugccaaacauugggaucaucuccucuguc

SEQ ID NO: 49932 - RNA, 64 nt, hsa
uccagccugguuuccugggcugggcucaggaaagcugccaaauucaguccuauguuggguccaa

SEQ ID NO: 49933 - RNA, 64 nt, hsa
cuaagaugaauccaaaugugaaagaugcauguuacugccaaaaccaaauugagcucagcuuccu

SEQ ID NO: 49934 - RNA, 64 nt, hsa
uuucgcaaauguugcucuagucaguccagcucaucugccaaaauguagggcuaccgucuuggau

SEQ ID NO: 49935 - RNA, 64 nt, hsa
cuguggucuccauccugacucuugaacuuacccacaauaagaauaaauucugccucaucuuugc

SEQ ID NO: 49936 - RNA, 64 nt, hsa
gagugcacagccuauugaacuaccucauuuuugccaauaagagcuggcuuuucugccauagugu

SEQ ID NO: 49937 - RNA, 64 nt, hsa
uagucauccaacaagaagaaauaugaaauuccagcaauaagaaaugaacaaaagauuggagcug

SEQ ID NO: 49938 - RNA, 64 nt, hsa
cuccauccuguucgugucuuucugcaguuuucggcaauaagaaguagaagauuugcuguccugc

SEQ ID NO: 49939 - RNA, 64 nt, hsa
gaauugacaauguuuaaguaaugguggaaucugucaauaagacuucccagaguguuaauauaua

SEQ ID NO: 49940 - RNA, 64 nt, hsa
gguuuccauaugguaauuacauuggaaaguucugcaauaagauucuaguucucucuuuucuuua

SEQ ID NO: 49941 - RNA, 64 nt, hsa
ccuuggggcuucucugaccacaugugcccaacuucaauaagagaaccaagggacccucauuuuc

SEQ ID NO: 49942 - RNA, 64 nt, hsa
cugcauuaaaauggguuucacugugaaugcgugacaauaagauauucccuuguuccuaaaacuu

SEQ ID NO: 49943 - RNA, 64 nt, hsa
cggucagacuggaggucgaagcaaucagcaaacacaauaagagucuccuucucuucucuucuuu

SEQ ID NO: 49944 - RNA, 64 nt, hsa
uuuuuuucuuuuaaaauauuuaacaguucaaucucaauaagaccucgcauuauguaugaauguu

SEQ ID NO: 49945 - RNA, 64 nt, hsa
ucuaccuggggaccccugucugcacaccagggaucaauaagagccaaagugggacaccuccuag

SEQ ID NO: 49946 - RNA, 64 nt, hsa
aguugccaaagaagauguauuaugaacaauucagcaauaagacaauugucaacacaguugagaa

SEQ ID NO: 49947 - RNA, 64 nt, hsa
guaguggaaaugagugaacuacagcuauaccucacaauaagaaugaaucucagaaaauauuaag

SEQ ID NO: 49948 - RNA, 64 nt, hsa
guguuuuuccuuugaggggauaggggaaguaagccaauaagaaccuuuuaaacaaaucguccug

SEQ ID NO: 49949 - RNA, 64 nt, hsa
cagccaaugauccuuccuucuuucauaaucaaugcaauaagauugcagacagaaauuccaguga

SEQ ID NO: 49950 - RNA, 64 nt, hsa
ggagcuuugggaacagucuguccuuacagagcugcaauaagaaauaaccaaagaugaagcuggu

SEQ ID NO: 49951 - RNA, 64 nt, hsa
uaaggcugcaauacaagcauucaguucccuguuucaauaagagucaauccacauuuacaaagau

SEQ ID NO: 49952 - RNA, 64 nt, hsa
gggaaucugcaagaaccuccccuuuccccucccacaauaagaccauuuaagugugugcuaaaca

SEQ ID NO: 49953 - RNA, 64 nt, hsa
gggguauccucugcaacacuugcagaacaaaggucaauaagauccuugccuaugaauaccccuc

SEQ ID NO: 49954 - RNA, 64 nt, hsa
ucugcauaagacaaagaagagacaucgaaucaaccaauaagaagagcccaaauaagcauccuca

SEQ ID NO: 49955 - RNA, 64 nt, hsa
gugcuguauggugaugcuuucuuaguauucuacacaauaagaaaagacaaaguccucgagauuc

SEQ ID NO: 49956 - RNA, 64 nt, hsa
auaaauuuuuugaccuauuuuaggguucuaaaugcaauaagauuuaguugaguuauuccacaaa

SEQ ID NO: 49957 - RNA, 64 nt, hsa
caguaguuuuauuuccacagccacauuaccauagcaauaagaaaggaggcauaguacauaguug

SEQ ID NO: 49958 - RNA, 64 nt, hsa
uuuuuuacugaggagcaacucauuccagcaucaacaauaagauaaccuuuaaguauggcacacu

SEQ ID NO: 49959 - RNA, 64 nt, hsa
gaggguaguaggagcaguucacccugggagcagacaauaagaggaagaaugaagccaacuaaaa

SEQ ID NO: 49960 - RNA, 64 nt, hsa
gcuaaugauguguucaguguaacucgcagauuggcaauaagauacccgcuacaaacugugauug

SEQ ID NO: 49961 - RNA, 64 nt, hsa
ccuuagaccucaguucaagugccccuauuuauuucaauaagaacgcacauaucccagcuguuuu

SEQ ID NO: 49962 - RNA, 64 nt, hsa
aaaauagucauuuuuagcacuggggaaaaauaaacaauaagacaugcuuacuuuuuaauuuuua

SEQ ID NO: 49963 - RNA, 64 nt, hsa
uaguuguuguuauacuguauuguuuagggaauaacaauaagaaaaacagucuguacauguucac

SEQ ID NO: 49964 - RNA, 64 nt, hsa
aaguuguuaccacauaggcacugguacgaauucucaauaagaaugcaguggaacaguuaaguag

SEQ ID NO: 49965 - RNA, 64 nt, hsa
aaccaagucaauaugagguaccuuuacagauuugcaauaagauggucugugacaauguauaugc

SEQ ID NO: 49966 - RNA, 64 nt, hsa
aauauuguucgguuauguucaugugguuauggagcaauaagaauauauaccauuaauuuuuagg

SEQ ID NO: 49967 - RNA, 64 nt, hsa
uuuugaaaaguagcaauuauggaaaaaaaauauucaauaagagauuaggagccuaaaagcuauu

SEQ ID NO: 49968 - RNA, 64 nt, hsa
ucucauccaaaagugaccagcauaccaguucuugcaauaagauauuacccucagaauauuaagc

SEQ ID NO: 49969 - RNA, 64 nt, hsa
caaaauucuuucugguuguuuuuaaacaauaaagcaauaagaacaaauacaauacauaggaagu

SEQ ID NO: 49970 - RNA, 64 nt, hsa
auaauucuggagauacugguggaaguuccaaguccaauaagacacucaaauaugaguacaaaug

SEQ ID NO: 49971 - RNA, 64 nt, hsa
cuaaggauuuaguuuaccacaacaauucugacuacaauaagacauuuugaggaggauauuuggc

SEQ ID NO: 49972 - RNA, 64 nt, hsa
aucucaaguaaaacaaaugaaauuuaauuacaaacaauaagaacaaguuuuggcagccaugaua

SEQ ID NO: 49973 - RNA, 64 nt, hsa
cuuggcuaguaauaaacacuuacugaagaagaagcaauaagagaaagauauuuguaaucucucc

SEQ ID NO: 49974 - RNA, 64 nt, hsa
aaggaaccauuucuugaagaaacugaaguaauagcaauaagauuugaugugugaguagcuuuga

SEQ ID NO: 49975 - RNA, 64 nt, hsa
aauggggccagcugggccgacagcagaauaaaggcaauaagaugauucucuugccccuucuuau

SEQ ID NO: 49976 - RNA, 64 nt, hsa
cuuguccuccugugugccugagcuccucccuuuucaauaagauuauuagucgugcaugucugug

SEQ ID NO: 49977 - RNA, 64 nt, hsa
auucaucuugaaucccauuguccuauaguccuagcaauaagagaaauuuccucaaguuuccaug

SEQ ID NO: 49978 - RNA, 64 nt, hsa
cuuguuuccagaauguuauuuuacauuuuauguucaauaagaacacuuuuuaaaagacguauau

SEQ ID NO: 49979 - RNA, 64 nt, hsa
uuguuguuguuacuguaaagucuauucuguuuaacaauaagaaauaagaaauaauuuuuuucaa

SEQ ID NO: 49980 - RNA, 64 nt, hsa
ugcauguugucaucuucaauuacauaacagaaaucaauaagauaugugcccucaucauaaauau

SEQ ID NO: 49981 - RNA, 64 nt, hsa
guacuguguauguguuuccuauauuguuauauuucaauaagaagcuuaaaauguuuaaaaauaa

SEQ ID NO: 49982 - RNA, 64 nt, hsa
ugcugaugugccacgaugcugcuccaauagacagcaauaagauugucucuaauuugagcaguaa

SEQ ID NO: 49983 - RNA, 64 nt, hsa
gaauaugcuuuuacauuugggcuuaucuaauuugcaauaagagagccucucucuaucaacacca

SEQ ID NO: 49984 - RNA, 64 nt, hsa
auguggaacaucuauagagauaaauagaaauuuucaauaagauguaguaacacugugauuuauc

SEQ ID NO: 49985 - RNA, 64 nt, hsa
acucagaguagagaguaagaugucagcaaauagacaauaagaugucagcaaaagugccucaaau

SEQ ID NO: 49986 - RNA, 64 nt, hsa
uugccuuacaguggaucauucuaguaggaaaggacaauaagauuuuuuaucaaaaugugucaug

SEQ ID NO: 49987 - RNA, 64 nt, hsa
uauuucagauauguauguaaaacuguuuccugaacaauaagauguaugaacggagcagaaauaa

SEQ ID NO: 49988 - RNA, 64 nt, hsa
gaauggcugacuguugccuuugcucuuauaaaaucaauaagagaacucuccucuuuuuuuaaaa

SEQ ID NO: 49989 - RNA, 64 nt, hsa
augcuccuuuauauuauaaguaagggaauagaaucaauaagacaguuucugcccaaagucaugu

SEQ ID NO: 49990 - RNA, 64 nt, hsa
ucgaugauuaaaauccuucaacacuucucauucacaauaagaauaaaaucuacaucccuuacca

SEQ ID NO: 49991 - RNA, 64 nt, hsa
uuuuuaugacaggauguuugcucagcuucuccaacaauaagaagcacgugguaaaacacuugcg

SEQ ID NO: 49992 - RNA, 64 nt, hsa
acugccucuuacaguaggaaacaacugaacccaucaauaagaaaaaggaucgaaagggaccaag

SEQ ID NO: 49993 - RNA, 64 nt, hsa
caguuuugcuuauuguguguugauuguauaaaugcaauaagaaaauguaaagguuuuugucuau

SEQ ID NO: 49994 - RNA, 64 nt, hsa
guuuuuaacuuccuccauacauaagcuucaaggacaauaagauguuaaaaaggaggaaauaauu

SEQ ID NO: 49995 - RNA, 64 nt, hsa
guaauacaacccaucuaucuuauuagucuugugccaauaagagaaguaaauaucaaacauuaaa

SEQ ID NO: 49996 - RNA, 64 nt, hsa
uuggaaagucagugaaacugucaaaauguuaucucaauaagauacuuauaugagaacuacaauc

SEQ ID NO: 49997 - RNA, 58 nt, hsa
augugaaauuuaugcuauaacauuuuuacaauaagauguacaauuuauuaccuauaug

SEQ ID NO: 49998 - RNA, 50 nt, hsa
aagccaaagccauugccuagcaauaagauuguugccguuaagaagaccuu

SEQ ID NO: 49999 - RNA, 64 nt, hsa
auaauaagaaacuuauuucucauaucaacuuagucaauaagaaaauauauucuuucaaaggaac

SEQ ID NO: 50000 - RNA, 64 nt, hsa
acaugcagcauuccaggaacuugauuguuaaauucaauaagaaauuugcuuuauuaaugaaacu

SEQ ID NO: 50001 - RNA, 64 nt, hsa
uguagcucaaucagugucucuuuaacugcauaagcaauaagaucuuaauaaagucuucuaggcu

SEQ ID NO: 50002 - RNA, 64 nt, hsa
gagccgagauugcaccauuguacuccagccugggcaauaagagcaaaacuccaucaaaauaaaa

SEQ ID NO: 50003 - RNA, 64 nt, hsa
ugccuuccauucugugagauuugacagauggugacaauaagaaaaugagcugauuguaauuacu

SEQ ID NO: 50004 - RNA, 64 nt, hsa
ucugauacuuaucuugggacuucaguuuuuccgucaauaagaugagggauuaggugagaucuga

SEQ ID NO: 50005 - RNA, 64 nt, hsa
guuuguacagcuccaccuuuuagaggucuuacugcaauaagaaguaaugccugggggacgguaa

SEQ ID NO: 50006 - RNA, 64 nt, hsa
cuggggagauguggucggauuagggagguagaaucaauaagacucagugaagaaucggaugugg

SEQ ID NO: 50007 - RNA, 64 nt, hsa
uacauguucggaaaaacuuucaguugcucaagggcaauaagaaaauuugaggccggguguggug

SEQ ID NO: 50008 - RNA, 64 nt, hsa
gagcugagaugacgccauugcacuccagccuaggcaauaagagcaaaacucugccucaaaaaaa

SEQ ID NO: 50009 - RNA, 64 nt, hsa
gauaauauuagcauggccacuuaugcuaaauacacaauaagauacauuuagaaauccuuaaugu

SEQ ID NO: 50010 - RNA, 64 nt, hsa
cagcaaacgcaggaccuguaccaauuuuaggagacaauaagacaggguuguuucaggauucucu

SEQ ID NO: 50011 - RNA, 64 nt, hsa
uaugcaaauaaaacugaccucauuuucugcuaugcaauaagaauacuuaauucuaguucccgac

SEQ ID NO: 50012 - RNA, 64 nt, hsa
aagcugcuguugcugcuuugugaugacgugagaucaauaagaagaaccuagucuagagacaaug

SEQ ID NO: 50013 - RNA, 64 nt, hsa
aguagguccuaucagugccccccagaguagagagcaauaagagcccagcccagugcagucccgg

SEQ ID NO: 50014 - RNA, 64 nt, hsa
uucuuugucccccaguacccccagcccagccagccaauaagaggacacaaaugaggacacgugg

SEQ ID NO: 50015 - RNA, 64 nt, hsa
aucuacaucuauccuacuuaugcagaaaaauaggcaauaagaacuucauuuuacaauuuaguuu

SEQ ID NO: 50016 - RNA, 64 nt, hsa
uucuaugcauauauggauuagcuauaaaaaaugucaauaagauuguacaaggaaaauuagagaa

SEQ ID NO: 50017 - RNA, 64 nt, hsa
auagugacuuagagacacuguguaucaguuuugccaauaagacuguggacuucaugauuguugu

SEQ ID NO: 50018 - RNA, 64 nt, hsa
ugggguuccaggcaugguuuaggcccuguuccagcaauaagaaccaaucugcuguacaaucuga

SEQ ID NO: 50019 - RNA, 64 nt, hsa
aguauuugaucuacaauuuaauaaauaguaaauccaauaagaacccuuaaaaaaaaacaacuuc

SEQ ID NO: 50020 - RNA, 64 nt, hsa
ggcaccaugaaguagcggcaauguuugagcggcacaauaagauaggaagagucuggaucucuga

SEQ ID NO: 50021 - RNA, 64 nt, hsa
acauagauaaaaacauguuugcugccaaaguucccaauaagaugcuuccuguguuuuuuggccu

SEQ ID NO: 50022 - RNA, 64 nt, hsa
aaaaagauacaacucaucuuaccaagaccaaauucaauaagaagcccaaacacuaaaauauuuc

SEQ ID NO: 50023 - RNA, 64 nt, hsa
auggauaugauagauuacacaguuuauuggaggacaauaagaguuauggcaaaaagcaaaagga

SEQ ID NO: 50024 - RNA, 64 nt, hsa
ucaagauacaaaaaugaauggcuaugcauaauaacaauaagaauguauuccccaaacaaaucuu

SEQ ID NO: 50025 - RNA, 64 nt, hsa
agcaucaauacaacggccggaguuucuguuuuugcaauaagaagauguugguauuuuauguagg

SEQ ID NO: 50026 - RNA, 64 nt, hsa
aauucucacuuaacuaauuuuguaagccugagaucaauaagaaauguucaggagagaggaaaga

SEQ ID NO: 50027 - RNA, 64 nt, hsa
gugaacuuuaucaauaguauggaucuuuuuaaaucaauaagaugcuuuguaaaguugaaauaag

SEQ ID NO: 50028 - RNA, 64 nt, hsa
ucuguuguaauaucaguuacaguggcaguauugacaauaagaaacaguuuaacagaaaaaugaa

SEQ ID NO: 50029 - RNA, 64 nt, hsa
agacagcagcucuguguucuuuuuuugccgcagccaauaagauaauagcagaauuagccaaucc

SEQ ID NO: 50030 - RNA, 64 nt, hsa
gguuuuauuucagguaagcaguuuauaugacuuccaauaagauuuguaaaucaugggcuugacc

SEQ ID NO: 50031 - RNA, 64 nt, hsa
cagacccaauagcucuaauuuuaacauuucuacccaauaagaggcucuguuuuccacugaagcu

SEQ ID NO: 50032 - RNA, 64 nt, hsa
caugaucaguacuauugugacauuaaaacaacaacaauaagaucuuccuaucuggaggguacag

SEQ ID NO: 50033 - RNA, 64 nt, hsa
uuugguuucguuuacuugccuacagugcuguacgcaauaagaugaugaucccaaaauaugguaa

SEQ ID NO: 50034 - RNA, 64 nt, hsa
uaguugauguaacauuguagaagcagcauaggaacaauaagaacaauagguaaagcuauaauua

SEQ ID NO: 50035 - RNA, 64 nt, hsa
auguauacauugucccuuuuacauuguaagcauucaauaagaacuagcugcggauguaauuuuu

SEQ ID NO: 50036 - RNA, 64 nt, hsa
ugccacgaccagauaagaaucaccaguggguauucaauaagaacuguuucccucuuguggaugu

SEQ ID NO: 50037 - RNA, 64 nt, hsa
aaauguaaaaacagccuauuuauauauguugaaacaauaagauuuuaugguuucacuggcccuu

SEQ ID NO: 50038 - RNA, 64 nt, hsa
auugccugaauaaguuuagguaugguuucggguacaauaagaaagagauaaaauggaaugcuuu

SEQ ID NO: 50039 - RNA, 64 nt, hsa
uucauguaauauuucugauuuuucagaauauuugcaauaagagucuggauuuuaaaaaacacau

SEQ ID NO: 50040 - RNA, 64 nt, hsa
cauaccuuuaucuggaaaaugccuucucuccagacaauaagacaguucacaucuggagacauca

SEQ ID NO: 50041 - RNA, 64 nt, hsa
ccacuggucuaccugauaugacugguucugucuacaauaagacacaggugagggacaaaggugg

SEQ ID NO: 50042 - RNA, 64 nt, hsa
aauuauuuuuuucuuuaaauuaaaagaaccuagccaauaagauagagaaugggcaucuaaggca

SEQ ID NO: 50043 - RNA, 64 nt, hsa
auagcaggcaccaaagcaagugcccgguaaauaccaauaagaaauuaaggaaagaaacaaacca

SEQ ID NO: 50044 - RNA, 64 nt, hsa
ugcacugugagaucuguguaugguguguuaauaacaauaagaaacuuagggaagcaggcugugg

SEQ ID NO: 50045 - RNA, 64 nt, hsa
gccaaaacagcaauaugauaucucagauuuaguucaauaagaacagugaaacuuuugguucacu

SEQ ID NO: 50046 - RNA, 64 nt, hsa
agaaaagccaugcccaccccagccccagagaaaccaauaagaauccucuauuauuuucacuauu

SEQ ID NO: 50047 - RNA, 64 nt, hsa
cuaagucugcaugggauaugggaauggaaaagggcaauaagaaauuaauacccuuaugcaguug

SEQ ID NO: 50048 - RNA, 64 nt, hsa
gacuagcguuuuaagaacuugagaguaaaagcaacaauaagauuuuuucaccucuuccugcuuc

SEQ ID NO: 50049 - RNA, 64 nt, hsa
uugguagaugucccuagacgggcugagccaugugcaauaagaacauagauccuaaaggauccuc

SEQ ID NO: 50050 - RNA, 64 nt, hsa
cacuaaaugguagauuuuacuguuaaagacccuacaauaagauuguuuuaucuguacauuuuuu

SEQ ID NO: 50051 - RNA, 64 nt, hsa
gccccuagaaaccaccuggguucagccucucccacaauaagaguucuugcccuucauacccucu

SEQ ID NO: 50052 - RNA, 64 nt, hsa
gauggaugauggacccuuuccuaaugagccuccucaauaagagagaaguucucauugugggaau

SEQ ID NO: 50053 - RNA, 64 nt, hsa
caaaaacaauauggaagugccuuuugaugucuuacaauaagagaagaagccaauggaaaugaaa

SEQ ID NO: 50054 - RNA, 64 nt, hsa
cuuucccugaugccgacgccccugcccccugcagcaauaagaugcucggauucacucugugacc

SEQ ID NO: 50055 - RNA, 64 nt, hsa
uacucaggucucccuacuccugccuuagauuccucaauaagaugcuguaacuagcauuuuuuga

SEQ ID NO: 50056 - RNA, 64 nt, hsa
auccagcaauuguguggucaguggcucuuuuacccaauaagauacaucacagucacaugcuuga

SEQ ID NO: 50057 - RNA, 64 nt, hsa
auguccuuacaacgccccuggcccccagguugagcaauaagaaaccagaaccuugcggcccagu

SEQ ID NO: 50058 - RNA, 64 nt, hsa
uugccacucacuugagaacagaauaggauuucaacaauaagagaauaaaauaagaacauguaua

SEQ ID NO: 50059 - RNA, 64 nt, hsa
ugcuuauucuuauaaauuaccuucaguaacuauucaauaagacauuuaaauacacaaucacuaa

SEQ ID NO: 50060 - RNA, 64 nt, hsa
caagaagcuuuuaaacuuuuuggacuuuaaccuacaauaagaaauccauuuuacauguucacau

SEQ ID NO: 50061 - RNA, 64 nt, hsa
guauaaauaaugagcguuaacacaguaaaauauucaauaagaagucaaacuacuaggguuacuu

SEQ ID NO: 50062 - RNA, 64 nt, hsa
uucaggcugcacaacacagaaggaaacuugauuucaauaagacccaauucuuaacagucuuuuc

SEQ ID NO: 50063 - RNA, 64 nt, hsa
gccugccuucagguuuucuucuuaccccaccccucaauaagauuuggugaauuguaauucuagu

SEQ ID NO: 50064 - RNA, 64 nt, hsa
ccuauuccccaccccauggccacagggcaucuggcaauaagacuaguauacauugaccucccgu

SEQ ID NO: 50065 - RNA, 64 nt, hsa
gaguagaagauuugaugcuggagagguuaaggugcaauaagaauuuagggagaaauguuguuca

SEQ ID NO: 50066 - RNA, 64 nt, hsa
ucuaggcccagccaggcuuuucugacuaaauaagcaauaagaggcucuaagcugacugaguugc

SEQ ID NO: 50067 - RNA, 64 nt, hsa
ccaaguacauugauuuuacaguuauuuugaaauacaauaagaacugcuagaaauauguuuauaa

SEQ ID NO: 50068 - RNA, 64 nt, hsa
uaaccaguauuuuacuucaaaagccaaaaagaggcaauaagaaaagacacuuugugguggccuu

SEQ ID NO: 50069 - RNA, 64 nt, hsa
gcgaggccagcgagggugugcuugcaaauucaagcaauaagagggggguuccugggggcuucca

SEQ ID NO: 50070 - RNA, 64 nt, hsa
ccaugcuuuuucaacacauuacaugugggagguacaauaagaacaugucagaaguuccuaauuc

SEQ ID NO: 50071 - RNA, 64 nt, hsa
aaagucauaaaauguaucuuccaugcuacauguacaauaagaacuucuauaauuguauauaugc

SEQ ID NO: 50072 - RNA, 64 nt, hsa
augauauauucgggcaggacuguugugguacuggcaauaagauacacagcuccgagcuguagga

SEQ ID NO: 50073 - RNA, 64 nt, hsa
aauaguucucuaauuuuugaaaaaucgugccaagcaauaagauuuauguauauuuguuuaauaa

SEQ ID NO: 50074 - RNA, 64 nt, hsa
gccuuugagccuacucuugauucaugcagagugccaauaagauaaaucaaccaaguuuuggggc

SEQ ID NO: 50075 - RNA, 64 nt, hsa
ugauguugaauauuuaccuuaaaaaccuauacaacaauaagaggagugcgcccuucagcagcau

SEQ ID NO: 50076 - RNA, 64 nt, hsa
acauuuguagauuaagcuggaauuauaaugagagcaauaagaacaaauuuauuuugcuuaccac

SEQ ID NO: 50077 - RNA, 64 nt, hsa
ggugcugaccaaaaaugucucaaagucaacagcccaauaagaaugaagaauggaaauggaaaag

SEQ ID NO: 50078 - RNA, 64 nt, hsa
cccuugacaguugcagccucuugaccucggauaacaauaagagagcucaucucauuuuuacuuu

SEQ ID NO: 50079 - RNA, 64 nt, hsa
uucauaagugaucuacuucaguuagucucuaugacaauaagaaaacuaaggcucagagaaaaag

SEQ ID NO: 50080 - RNA, 64 nt, hsa
uuuugcuuaugauuuguaaaagccgucauggggucaauaagaaaauaggggugauggaggggga

SEQ ID NO: 50081 - RNA, 64 nt, hsa
aacuuuuaguuaaugucuuacaaggaaaaagacacaauaagaagaguuuaauuuuuuuuuuuuu

SEQ ID NO: 50082 - RNA, 64 nt, hsa
guuuccaaagugcagcagugucucuuucagucuacaauaagauuccuagggcagcuuuaucaaa

SEQ ID NO: 50083 - RNA, 64 nt, hsa
auugguguccuuuuaaaaaauauuuacuguaguccaauaagauagcagcuguacaaaaugacua

SEQ ID NO: 50084 - RNA, 64 nt, hsa
ggugggcccacugcuuuggaggugaugggacuaucaauaagaacucuguucacgcaagcugcug

SEQ ID NO: 50085 - RNA, 64 nt, hsa
uuuuguuggggguuaauuuuaugaaaauuaugcucaauaagaguuguauauuuaauauauuugc

SEQ ID NO: 50086 - RNA, 64 nt, hsa
ucacccccaccccaccccuaaguagucaucaaugcaauaagauugcgccugagauacaaggccc

SEQ ID NO: 50087 - RNA, 64 nt, hsa
uuaccacccgccugaauccugggauucuaguaugcaauaagagaugcccuguacugaugcaaaa

SEQ ID NO: 50088 - RNA, 64 nt, hsa
agcagccaaugaaaacggccgccugaacccacagcaauaagaaugaaugaggaugccuugaaug

SEQ ID NO: 50089 - RNA, 64 nt, hsa
acaguguuuuuauugcucgcccagacaccaugugcaauaagauugguguucguuuccaucaugu

SEQ ID NO: 50090 - RNA, 64 nt, hsa
ucugcauuugggcugugacgucucccaccugccccaauaagaucugcucugucugcgacaccaa

SEQ ID NO: 50091 - RNA, 64 nt, hsa
ugugcauagccuugugaaaaaguaucuuucuaugcaauaagaugaauuuuccucccagaauauu

SEQ ID NO: 50092 - RNA, 64 nt, hsa
ggauauggggaauccucuuuaugaaacaaacuuacaauaagaaagaauauguuugugggagcuc

SEQ ID NO: 50093 - RNA, 63 nt, hsa
aaauuaagaaggugugcuccagagccaagaggagcaauaagaaaccucgugugccagcuucug

SEQ ID NO: 50094 - RNA, 64 nt, hsa
gcucaggaacaguucaggagcuaaauuuccgcagcaauaagaauguuuggggauauuucagugu

SEQ ID NO: 50095 - RNA, 64 nt, hsa
uguguuuguauacagccuuguuuaauguuuugagcaauaagauaugcacacacagguauuuugu

SEQ ID NO: 50096 - RNA, 64 nt, hsa
ugguggucucccccugcucgagcggccccucggccaauaagacaguggacaucaugacgaggac

SEQ ID NO: 50097 - RNA, 64 nt, hsa
accauuuagucuaaacuuagucauuuauuugugacaauaagauguguucaggggcucccuguuu

SEQ ID NO: 50098 - RNA, 64 nt, hsa
acuucauauucuaauggauguggcaaaagaauugcaauaagaagcagugaacauuuggaacccc

SEQ ID NO: 50099 - RNA, 64 nt, hsa
ugaaacugggauugacccaucaagaugcuuggcucaauaagaaaaccacguuaggagcaaccuu

SEQ ID NO: 50100 - RNA, 64 nt, hsa
cuccauucauaacccagucucaaugcccucguaucaauaagaccgggguaagggggacaggaua

SEQ ID NO: 50101 - RNA, 64 nt, hsa
aagaucauuuauaauacuguuuuaaaaugugaggcaauaagaauuacuuuguguuggaucugag

SEQ ID NO: 50102 - RNA, 64 nt, hsa
auucuccuuuuaagcuaaaaucucaucaaggcuucaauaagaagauggauauggauauauagua

SEQ ID NO: 50103 - RNA, 64 nt, hsa
gagcugagaucuucccacugcacuccagccuggccaauaagaccugucuccagcaagacccugu

SEQ ID NO: 50104 - RNA, 64 nt, hsa
uaugaccuuccuccauuuaacaguguugguuaugcaauaagacacccaauuuuucaugggaguu

SEQ ID NO: 50105 - RNA, 64 nt, hsa
cccucaacaaauuacacauugagggaacauacuucaauaagaaccaucuaugcuggacucacag

SEQ ID NO: 50106 - RNA, 64 nt, hsa
aaaucauauacugagguugcuaagaucuacaugacaauaagauauuuugggagagagauacguu

SEQ ID NO: 50107 - RNA, 64 nt, hsa
uucaggcaugggggguggggggagcgucccaaaucaauaagaagguagaaugaguuaugaguua

SEQ ID NO: 50108 - RNA, 64 nt, hsa
cauuuguacagaaacauuuuugaaaaauucuuuucaauaagaugcaaaaucuuccaacuuuuca

SEQ ID NO: 50109 - RNA, 64 nt, hsa
guugucuccuagccuagaaaaccaguguuuggagcaauaagaugauuauuuuugcuugaaucuu

SEQ ID NO: 50110 - RNA, 64 nt, hsa
gaaagugcacacacuucauggagggacuccuuuucaauaagaauuaggaagaugagaaaguaau

SEQ ID NO: 50111 - RNA, 64 nt, hsa
cagaaaguccuggaaaaguaaauuguuuauuuuacaauaagaaagugauuacauauuuuuuuuu

SEQ ID NO: 50112 - RNA, 64 nt, hsa
cuaaggaaaaacuagcacccuucuguccacucagcaauaagagggaucucuucccaccuacccu

SEQ ID NO: 50113 - RNA, 64 nt, hsa
ggcuagucuaggggcaagagugcgagcuggcugacaauaagaacguggccaccugcccagcuuc

SEQ ID NO: 50114 - RNA, 64 nt, hsa
aacaguccaggccaaagaggaagcauuucauguucaauaagaaacccagccauuccgcauggcu

SEQ ID NO: 50115 - RNA, 64 nt, hsa
uuuuuuaaaauacauauugacuugaauugugaggcaauaagauaccuucuauauguaaugauca

SEQ ID NO: 50116 - RNA, 64 nt, hsa
acugaagauagaagaaaaaagaaugucagaaaaacaauaagagcguuugcccaaaucugccuau

SEQ ID NO: 50117 - RNA, 64 nt, hsa
ugcuuuaucaauaaguguaguuguaaugucaaaucaauaagauauucacacuccucaauaacau

SEQ ID NO: 50118 - RNA, 64 nt, hsa
aagaaauguuagugaucaaaagcuuuuacuguugcaauaagagagauaucuuuuuauuuuacag

SEQ ID NO: 50119 - RNA, 64 nt, hsa
gaugauuuuuaacaugcauuuugcaugcaucccccaauaagaagagaugagacucggccggaga

SEQ ID NO: 50120 - RNA, 64 nt, hsa
uacccagaaacuuuuuuaauaccugugccauucucaauaagaauuuaugagaugccagcggcau

SEQ ID NO: 50121 - RNA, 64 nt, hsa
gggaaucugcaagaaccuccccuuucccuucccccaauaagaccauuuaaguguguguuaaaca

SEQ ID NO: 50122 - RNA, 64 nt, hsa
agccugugcccuuccccaccuuugcccucccagugguugguaugugggaagcccaucucaguuc

SEQ ID NO: 50123 - RNA, 64 nt, hsa
gggaggugaggacuucaucucaacaucggcuggugguugguaggggagcuuuuucuuuucuuuc

SEQ ID NO: 50124 - RNA, 64 nt, hsa
agagauguccuuguaauauucccuuuuaggugaggguugguaagggguugguaucucaggucug

SEQ ID NO: 50125 - RNA, 64 nt, hsa
uguaauauucccuuuuaggugaggguugguaagggguugguaucucaggucugaaucuucacca

SEQ ID NO: 50126 - RNA, 64 nt, hsa
ugcagugagccaugaucgcaccacugcacuccagcuuaggcaauacagcgagaccuugucucaa

SEQ ID NO: 50127 - RNA, 64 nt, hsa
cggccugggacccucaguguaggguuuucugacucuuaggcaacuuccuagggugcuguacuuc

SEQ ID NO: 50128 - RNA, 64 nt, hsa
ggguaauaaccaagauggagucccuuuggcaaaacuuaggcaugcacagcuguaguaccccaag

SEQ ID NO: 50129 - RNA, 64 nt, hsa
uagcauugugguuuuagcacccccauggguuuugcuuaggcacucauggguaauaaccaagaug

SEQ ID NO: 50130 - RNA, 64 nt, hsa
ccuuagcccaccugguuugcaggugcagggggaccuuaggcacgccccaagcaccaggcaccag

SEQ ID NO: 50131 - RNA, 64 nt, hsa
aaaaaaaaaauccuuguacuuaucaauuuugccccuuaggcagucaguuuuguugagaacugug

SEQ ID NO: 50132 - RNA, 64 nt, hsa
ccucaggcauuugaauuagagcuacuuugagccucuuaggcagaaaaccuaccacauucacuac

SEQ ID NO: 50133 - RNA, 64 nt, hsa
cugucuaaaaaugauucucuaaacuuucccuauacuuaggcauagucuucuuucuuagauucuc

SEQ ID NO: 50134 - RNA, 64 nt, hsa
cuuagauccuuugaaauaaaaauuaugucuuuauaacucugaucuuuuacauaaagcagaagag

SEQ ID NO: 50135 - RNA, 64 nt, hsa
acaaguggaaaaucaaacguuuaagaagaauuacaacucugaaaagcauuuauauguggaacuu

SEQ ID NO: 50136 - RNA, 64 nt, hsa
ugccauguucaugccugugggccucucuggcaggaacucugaugcaccgcgaggcccauguacu

SEQ ID NO: 50137 - RNA, 64 nt, hsa
cccucgugauuguauagggcucuucuccuguaugaacucugagaucagugagcucugaucucca

SEQ ID NO: 50138 - RNA, 64 nt, hsa
agccgagggcagaggccuuuguacgcagcugccgaacucugacucuaguucugcggaagaaaag

SEQ ID NO: 50139 - RNA, 64 nt, hsa
acauuaggcuagaggggucuuguucaaagcauccaacucugacuucggaggcauucccagccgg

SEQ ID NO: 50140 - RNA, 64 nt, hsa
aguauuucccuuccaaagagggauguuuggaaaaaacucugaaggagaggaggaauuaguuggg

SEQ ID NO: 50141 - RNA, 64 nt, hsa
caagaauaauuuuggaauaauuucuauuaauaucaacucugaagcuaauuguacuaaucugaga

SEQ ID NO: 50142 - RNA, 64 nt, hsa
guacuuuuuuucacauccuuguucuuuauuuagcaacucugauucauuuaaauauguuuuuuau

SEQ ID NO: 50143 - RNA, 64 nt, hsa
caguguggcugagaaagugcggaacuccacuaaaaacucugaaacuucaguauaaauguaaaua

SEQ ID NO: 50144 - RNA, 64 nt, hsa
cagaucuuuuuguagacauuuucuucuagaggaaaacucugaagcaguugaucaaacuuuguuc

SEQ ID NO: 50145 - RNA, 64 nt, hsa
cagauuuuuugaaaauugaauaaugucaucauucaacucugaaauuauuuccuguuguuucuuc

SEQ ID NO: 50146 - RNA, 64 nt, hsa
cuuccuuguguccuuaccaaaugauagcucauaaaacucugauaauguaacaaaucacuuucaa

SEQ ID NO: 50147 - RNA, 56 nt, hsa
ugcagagagaguggagauaauucucaaacucugagaaaaaguguucaucaaaaagu

SEQ ID NO: 50148 - RNA, 64 nt, hsa
uuggaaagucauugaauccaggcccauuuccuuuucucuaaaaugagggucaucauaccuaagg

SEQ ID NO: 50149 - RNA, 64 nt, hsa
uggccagggucuccaauuuaggcuuucaacauuaucucuaaagaagguuauacauuaugucggc

SEQ ID NO: 50150 - RNA, 64 nt, hsa
ccacugucucuuaaaauauagcacuuuucaauucucucuaaagaaauacuuauguacuacuauc

SEQ ID NO: 50151 - RNA, 64 nt, hsa
uagcugcaucuuuugaaauaucaaauaugaauuuucucuaaaauauucugaaauagguuaaauc

SEQ ID NO: 50152 - RNA, 64 nt, hsa
uggagaggccaaauggucuuagccucagucucugucucuaaauauuccaccauaaaacagcuga

SEQ ID NO: 50153 - RNA, 64 nt, hsa
agauaggcccccuaggaaacugagguaagagcagucucuaaaaacuacccacagcagcauuggu

SEQ ID NO: 50154 - RNA, 64 nt, hsa
uuuucacauuacuuugucaccauauccuuuguguucucuaaauacauugcccacuuccaaaaau

SEQ ID NO: 50155 - RNA, 64 nt, hsa
ugaauauauuauuuugcuauuaaugugaaaguugucucuaaauauuuuuuaauuuucaaacuca

SEQ ID NO: 50156 - RNA, 64 nt, hsa
ugcacuccagccugggcaacagagcgagacuccaucucuaaauaaauaaauaaauaaauaaaua

SEQ ID NO: 50157 - RNA, 64 nt, hsa
uuucauaccaugcucucuccuacucaguuugaucucucuaaaauuguaguuugguuugauuuaa

SEQ ID NO: 50158 - RNA, 64 nt, hsa
acacuuuuauuuuuaaacgauuuaucaaaauucaucucuaaauuuuacauguagaaacauaaaa

SEQ ID NO: 50159 - RNA, 64 nt, hsa
uaugugucauuucacaagaaaaaaggaauaauauucucuaaaccaugaugugaaacugacaauc

SEQ ID NO: 50160 - RNA, 64 nt, hsa
ccuuuaaaauccuuccucuuucuuccuccucuauucucuaaauaaugauggggcuaaguuauac

SEQ ID NO: 50161 - RNA, 64 nt, hsa
gcuuuucauguaaauuagucuugguucugaaacuucucuaaaggaaauuguacauuuuuugaaa

SEQ ID NO: 50162 - RNA, 64 nt, hsa
agacuuguauaauaguauuaauaguagcucauucucucuaaaaauuuacugcccacugauagga

SEQ ID NO: 50163 - RNA, 64 nt, hsa
ucugaggauuucuucuuacuggcguucuuaaaggucucuaaaauuaaagaacaagaugugguuu

SEQ ID NO: 50164 - RNA, 64 nt, hsa
auaaaauaguuagauaaugagaaguuguuaauuaucucuaaaauuggaauuaggaagcauauca

SEQ ID NO: 50165 - RNA, 64 nt, hsa
aauuuuggugcaaaagcaaacaguuccagcaggcucucuaaagaaaaacucauuguaacuuauu

SEQ ID NO: 50166 - RNA, 64 nt, hsa
cacuaaauuuuucuuaacauuccaagauuucagaucucuaaaucacaaagagaaaucuuggcau

SEQ ID NO: 50167 - RNA, 64 nt, hsa
ucauaugauucacccuaauagauaccuccauuauucucuaaaugaaauagaagacuuuggagua

SEQ ID NO: 50168 - RNA, 64 nt, hsa
agaaagacgggaaugaugucccauacuucccagcucucuaaaguguuaugcuguacaauuaaaa

SEQ ID NO: 50169 - RNA, 64 nt, hsa
agaacuaugcaagcuauaagacaauggaguauuaucucuaaauuccuuaaugaaauaaacaaca

SEQ ID NO: 50170 - RNA, 64 nt, hsa
ccuuuuccccuacaaacuguuguugaacagugcuucucuaaaaugcaauaauaaugggccaggu

SEQ ID NO: 50171 - RNA, 64 nt, hsa
cugcacuccagcuuggugacagagugagauccugucucuaaauaaauaaauaaaaugcgggcca

SEQ ID NO: 50172 - RNA, 64 nt, hsa
ugcaccccagcccaggcaacaaagugagccccugucucuaaauaaauaaagagacaauaagcca

SEQ ID NO: 50173 - RNA, 64 nt, hsa
aaaugaccagccugggcagcauagcaagacccugucucuaaaaaaaauaauaaaaacuuagcug

SEQ ID NO: 50174 - RNA, 64 nt, hsa
cccaacagaggaggccagugaggcagagacagagcucucccacucucagacccucuuuugucuu

SEQ ID NO: 50175 - RNA, 64 nt, hsa
ucccacucucagacccucuuuugucuucauuuuccucucccacuuagcacaugugugcuugagg

SEQ ID NO: 50176 - RNA, 64 nt, hsa
cucaaauauauuuauuuuuuuaccauaccaacuucucucccaucucuagguggcucaguccaug

SEQ ID NO: 50177 - RNA, 64 nt, hsa
ugcaggccccagagcgagcuuccccuccucccugcucucccaggccccugccacagccucuuuc

SEQ ID NO: 50178 - RNA, 64 nt, hsa
uccacagcccuccucucccaagaaauccaggcuccucucccaagaaauccaggugcuuuccaga

SEQ ID NO: 50179 - RNA, 64 nt, hsa
cgaagaagaacugauuggggcuuccacagcccuccucucccaagaaauccaggcuccucuccca

SEQ ID NO: 50180 - RNA, 64 nt, hsa
aaaauaaaacgguagaauaugaaaagcucaggaucucucccaaggcuaccuacugcaggagggc

SEQ ID NO: 50181 - RNA, 64 nt, hsa
ggagcuuuguuuccuguucaccagcaaaaaaugucucucccauuuuucugaaaguggcugaugu

SEQ ID NO: 50182 - RNA, 64 nt, hsa
gcccuucuuccuccagcagcgggaacugccacugcucucccaggcccuguucuggaggcuaacc

SEQ ID NO: 50183 - RNA, 64 nt, hsa
guccacugaaaacaaagccaagccucugcccugccucucccagcucccacaaggguuccaggaa

SEQ ID NO: 50184 - RNA, 64 nt, hsa
caugcccacgugagcaccugucucccacucaaaccucucccaucucccaacaacugcacuuuag

SEQ ID NO: 50185 - RNA, 64 nt, hsa
uucauccuugccacugucuugcuuuuauuuuuuacucucccacugagcaagcgucugugguccu

SEQ ID NO: 50186 - RNA, 64 nt, hsa
auaagcugccaguguugcuuuucuguugguagagcucucccauuuggugacauggaaaauaccu

SEQ ID NO: 50187 - RNA, 64 nt, hsa
ugguacuaaauccaguagaugggcuguguagcaacucucccagggaacacacuaggguacuuag

SEQ ID NO: 50188 - RNA, 64 nt, hsa
gcccugggcguguaguguaacuggaaucuuuugccucucccagccaccuccucccagcccccca

SEQ ID NO: 50189 - RNA, 64 nt, hsa
ugguguuuuuuugggugguggcuggaaacagccccucucccacguggcagaggcucagccuggc

SEQ ID NO: 50190 - RNA, 64 nt, hsa
agggugagacaguccacccagagcucucccaagucucucccaaauaccuuagaguagggacacu

SEQ ID NO: 50191 - RNA, 64 nt, hsa
ggcauuugaacagggugagacaguccacccagagcucucccaagucucucccaaauaccuuaga

SEQ ID NO: 50192 - RNA, 64 nt, hsa
cugugcauuuucuaagugggacauucaaaaaacucucucccaggaccucggaugaccauacuca

SEQ ID NO: 50193 - RNA, 64 nt, hsa
uguuuuuuuuuuuaaguuucacucacauagccaacucucccaaagggcacaccccuggggcuga

SEQ ID NO: 50194 - RNA, 64 nt, hsa
caucuucuuguggcacaggaaagcugcccucucccucucccaccacacuccugacuaauggccu

SEQ ID NO: 50195 - RNA, 64 nt, hsa
cagaggucagcacugggggaaacuugcugguggucucucccacaaccuugcccagaguccuuuc

SEQ ID NO: 50196 - RNA, 64 nt, hsa
ggggggugaccuuucuggucuuugcacuuccauccucucccacuuccaucuggcaucccacgcg

SEQ ID NO: 50197 - RNA, 64 nt, hsa
gccacaauugucacaugaccgguacuggaagaaacucucccauccaacaucacccaguggaugg

SEQ ID NO: 50198 - RNA, 64 nt, hsa
uuuuuaauuguuaugaaaauggaucuuuucuugacucucccacaugcucuguuaugggagagaa

SEQ ID NO: 50199 - RNA, 64 nt, hsa
gggcucgccucucccgccucgauccugcaccuuccucucccaggucgcugcugcagccaaccca

SEQ ID NO: 50200 - RNA, 64 nt, hsa
uggagccccacacuggggugccgccugcccgucucucucccauggagccccagcccccuuuggg

SEQ ID NO: 50201 - RNA, 64 nt, hsa
ggccuugcuggggacggggggccccagucagccucucucccagucuacccagagaagccccuuc

SEQ ID NO: 50202 - RNA, 64 nt, hsa
cguccugggcaggcugcagccucaugccaugucucucucccacuaccugaugggcacauggaca

SEQ ID NO: 50203 - RNA, 64 nt, hsa
ucgguccucucagcccugccugcccuggccugggcucucccagccucccagcccucugcccccu

SEQ ID NO: 50204 - RNA, 64 nt, hsa
ggcucgugggaaacagcaaaacacuaagccugaccucucccaaauugggaagaccagaggagaa

SEQ ID NO: 50205 - RNA, 64 nt, hsa
auuuccugcaucuuuccuuaagggaagccccauccucucccaggaccaggaguuuaugaccagg

SEQ ID NO: 50206 - RNA, 64 nt, hsa
acugguccagucaucccagugggcuucucuuugucucucccagauuagaccuuugggugagauu

SEQ ID NO: 50207 - RNA, 64 nt, hsa
agggcuccuuuuccccuucccucccaccagauugcucucccaccuuucauuucuuccuccaggc

SEQ ID NO: 50208 - RNA, 64 nt, hsa
ccugggcuccaaauuccucuugugaucuccucaccucucccacuccauugauaccaacucuuuc

SEQ ID NO: 50209 - RNA, 64 nt, hsa
auuucauuuuuuuggucacccuuuaaguguccuucucucccaggaugagugaggagcugugcug

SEQ ID NO: 50210 - RNA, 64 nt, hsa
agcccugucccaucugcagccacacuacucgcuccucucccaacaacucccuucguggggacaa

SEQ ID NO: 50211 - RNA, 64 nt, hsa
gguggggcagcuuucuuuggggcuucagugagaacucucccaguugcccuuggugggguuucca

SEQ ID NO: 50212 - RNA, 64 nt, hsa
cucuuggcaggacggcuacgagcagcuuaggcagcucucccagcacgccaugaagggggucauc

SEQ ID NO: 50213 - RNA, 64 nt, hsa
cccuguuuguggucuguguugacagccacccacccucucccaccucaugcuccugcaccugcac

SEQ ID NO: 50214 - RNA, 64 nt, hsa
gagcccccaccaccaccgacucucccaacccagacucucccacuccagaauguagaagccuguc

SEQ ID NO: 50215 - RNA, 64 nt, hsa
cuuuuagauaaagaugagcccccaccaccaccgacucucccaacccagacucucccacuccaga

SEQ ID NO: 50216 - RNA, 64 nt, hsa
ugcaaagguggggagaagggauccuaaucccuuccucucccauucacccuguguaacaggaccc

SEQ ID NO: 50217 - RNA, 64 nt, hsa
auuuggcaggaucggcuuccucaggggcacagaccucucccacccacaagaacuccucccaccc

SEQ ID NO: 50218 - RNA, 64 nt, hsa
ucggcuucaucacauugggagguucagagcauuacucucccacugugccugccauccaggcagc

SEQ ID NO: 50219 - RNA, 64 nt, hsa
ucccggcccauagacaaguggcgcugggguuucccucucccagaaccgcugccaccaccgccac

SEQ ID NO: 50220 - RNA, 64 nt, hsa
acucaucugucccugaccucuaaccuuucucugccucucccacacucucccagagcucacugau

SEQ ID NO: 50221 - RNA, 64 nt, hsa
cccugaccucuaaccuuucucugccucucccacacucucccagagcucacugauuagacagcac

SEQ ID NO: 50222 - RNA, 64 nt, hsa
ggugugguuggaggucuguggagucaaggucccccucucccaggcaggcucucugagggcauuc

SEQ ID NO: 50223 - RNA, 64 nt, hsa
ugacuccacaucuucugccccaguguguccccaccucucccagccuguauacccagauuacuuu

SEQ ID NO: 50224 - RNA, 64 nt, hsa
uuuaucacuucccucacugcccuacccaggcuuucucucccacuucccugacucugggaauaac

SEQ ID NO: 50225 - RNA, 64 nt, hsa
agcauccuggggauccagcggauggacagcuuggcucucccagagaggugaaggagcaccuggc

SEQ ID NO: 50226 - RNA, 64 nt, hsa
ucuccuguuuuccuuccucugcuaucucucacaccucucccagacuaugucaucuuguucuccu

SEQ ID NO: 50227 - RNA, 64 nt, hsa
ggcugcucuaguguucugucucccagucaccucgcucucccagcaccagugcccuucuccugcu

SEQ ID NO: 50228 - RNA, 64 nt, hsa
cuugcuuugacucaugccuuacuccauggccacccucucccaaagagggggcucgcuuccccca

SEQ ID NO: 50229 - RNA, 64 nt, hsa
acuuucccugcuuggaagcguggggucucccuggcucucccaggauaccaugcuguccucuuag

SEQ ID NO: 50230 - RNA, 64 nt, hsa
ucaacagcugcagggggaccccagugccaacuuccucucccacuagggcccugccuucagcugg

SEQ ID NO: 50231 - RNA, 64 nt, hsa
aggcauaucagcuuucacacuuuccccaugcacucucucccacccccuuccagggccucugcuc

SEQ ID NO: 50232 - RNA, 64 nt, hsa
ggccuugaagacucccugaucccagaccugucgucucucccacccccuccccaaagccacugga

SEQ ID NO: 50233 - RNA, 64 nt, hsa
acuggcuuggcuuuacuuugagcccccaaccccccucucccagcccugguaggguuccccaacc

SEQ ID NO: 50234 - RNA, 64 nt, hsa
ccugccaccacucccuuagucuuucccaggcuuacucucccaauaaaugugcuagagcucugcc

SEQ ID NO: 50235 - RNA, 64 nt, hsa
gccaacuagaacacccaacaccaaacuguacagacucucccaccccaaccuccccagacucugc

SEQ ID NO: 50236 - RNA, 64 nt, hsa
gccugggaccugcaucugaugcuggggccagggacucucccacgcacgagcuagugaguggcac

SEQ ID NO: 50237 - RNA, 64 nt, hsa
accaaauuuaagagggugggacaguccccugcuccucucccagagggcacugcuuggaaauugu

SEQ ID NO: 50238 - RNA, 64 nt, hsa
cuuugggacaucuucagcccuuuuauuaccacuccucucccauuuguggcaguuugcguuuacu

SEQ ID NO: 50239 - RNA, 64 nt, hsa
gagaaccuuccccacacucagcuccaaacgccuccucucccaggucaucugccugcccacacgc

SEQ ID NO: 50240 - RNA, 64 nt, hsa
cauuccagccugggugacagaguuagauuccacccucucccaccccggcaaaaaaaaaaaaaaa

SEQ ID NO: 50241 - RNA, 64 nt, hsa
ccauuguccaggggagccuggcggcgcaucccuccucucccaccuccuggcacuuccagcuggg

SEQ ID NO: 50242 - RNA, 64 nt, hsa
ccauccccaggccuugccugaggggucaggcugccucucccaacacacacucagauagcacaaa

SEQ ID NO: 50243 - RNA, 64 nt, hsa
gccuccuugcccuagcacacugggacuggccccacucucccagcuggacuccugcaugcuccuc

SEQ ID NO: 50244 - RNA, 64 nt, hsa
ggccagaacuaagaaugccaagguuuuauauauguguguauauauauauauauauauauauaua

SEQ ID NO: 50245 - RNA, 64 nt, hsa
uauauauauauauauauauauauauauguuuguguguguauauauauauauauauauauauguu

SEQ ID NO: 50246 - RNA, 64 nt, hsa
uguguauauauauauauauauauauauguuuguguguguauauauauguuuguguauauauaua

SEQ ID NO: 50247 - RNA, 64 nt, hsa
uauauauauauguuuguguguguauauauauguuuguguauauauauacacauaugcauacaua

SEQ ID NO: 50248 - RNA, 64 nt, hsa
gauaaaaacuguugaauacuauugauguagagaauguguauauguguauauuugcauugauuaa

SEQ ID NO: 50249 - RNA, 64 nt, hsa
cuguugaauacuauugauguagagaauguguauauguguauauuugcauugauuaaauuauugg

SEQ ID NO: 50250 - RNA, 64 nt, hsa
guugagcuaugauaugugcuuguguguaugucuauguguauauauuauauauacauuagacaca

SEQ ID NO: 50251 - RNA, 64 nt, hsa
acacacauauacauuauuucuguauauagaugucuguguauacauauguaugugugaguguaug

SEQ ID NO: 50252 - RNA, 64 nt, hsa
cuguguacaaacacauuuucuaugcaugugucucuguguauauggcauauaccuaguaaguaug

SEQ ID NO: 50253 - RNA, 64 nt, hsa
ugccacaagcaugagugugauuguaugugcacuguguguauauauauaaauauauguauaugua

SEQ ID NO: 50254 - RNA, 64 nt, hsa
aaugaacuuuuuugcaagcacacuuguaaccauauguguauaauuaacaaaccuguguaugcuu

SEQ ID NO: 50255 - RNA, 64 nt, hsa
uuguaacacuacacgguguacauuuccagagccuuguguauauuuccaaugaacuuuuuugcaa

SEQ ID NO: 50256 - RNA, 64 nt, hsa
ucucaguuccagaaguuauaccuuuauuuugagcuguguauagguagaauaaaaaauuccuuuc

SEQ ID NO: 50257 - RNA, 64 nt, hsa
gagagggguguuuguguguauauauauaugccuuuguguauacacuuaucaaagcuauuuucuu

SEQ ID NO: 50258 - RNA, 64 nt, hsa
agccuguauaguauauaagagagagggguguuuguguguauauauauaugccuuuguguauaca

SEQ ID NO: 50259 - RNA, 64 nt, hsa
agcaggcugagugcagguauacguguguauagaguguguauacuuugcuuuuguuuuauaacau

SEQ ID NO: 50260 - RNA, 64 nt, hsa
uuuaaauacucagcaggcugagugcagguauacguguguauagaguguguauacuuugcuuuug

SEQ ID NO: 50261 - RNA, 64 nt, hsa
aaaaaaaaaaauagaauguguaugcauauauuuguguguauauguauauaugugugugugucua

SEQ ID NO: 50262 - RNA, 64 nt, hsa
uuccucauaaggcaugaaguuguaaaaacuugaauguguauaguuagauauuuaaaugguugcu

SEQ ID NO: 50263 - RNA, 64 nt, hsa
aacaucaguggucuaaugcuugggucuguuuauauguguauauaugcagagagagagcuuauau

SEQ ID NO: 50264 - RNA, 64 nt, hsa
acacacauauguauaucuauacacacauguguguuguguauaugcaugugugugugugcgugug

SEQ ID NO: 50265 - RNA, 64 nt, hsa
guguguuguguauaugcaugugugugugugcguguguguauaguuuuagcuccaagccaagcaa

SEQ ID NO: 50266 - RNA, 64 nt, hsa
uuugccuaugaaaauauuuuggaaaaaaacuugcuguguauauucaguuucugaaagauaaaga

SEQ ID NO: 50267 - RNA, 64 nt, hsa
ccaacaaucuuuuuaaggcaaaauugugaccauauguguauaauuaaaaucguuuuuaauccuu

SEQ ID NO: 50268 - RNA, 64 nt, hsa
uuuauucauccauuuguaaauuuuuuaagguucuuguguauauuuggggggugggggaugaauu

SEQ ID NO: 50269 - RNA, 64 nt, hsa
uaaaauuccaguuugauguuugucucuaguugucuguguauaauauuuccaaagcuccuuugua

SEQ ID NO: 50270 - RNA, 64 nt, hsa
gucugguggguuauguuuugcuucaauucagcaauguguauaaaaguuccuacacugauuuuga

SEQ ID NO: 50271 - RNA, 64 nt, hsa
uguguguauauauguauacauauauguauguguauguguauauagagagagagcugagaguuau

SEQ ID NO: 50272 - RNA, 64 nt, hsa
guguacacgugcauguacacacagcuguacaguguguguauauauguauacauauauguaugug

SEQ ID NO: 50273 - RNA, 64 nt, hsa
ccuaaaucaccuagagguaccguuuacaugguuuuguguauauagaguuggcuugcauuuuagg

SEQ ID NO: 50274 - RNA, 64 nt, hsa
guuacugaccauugaguguuuacuauguacccaauguguauauuuuucuuuuuaaucuucccaa

SEQ ID NO: 50275 - RNA, 64 nt, hsa
caacugugauuuccuuuuccucagcaagcuccuauguguauauuuuccugaauuucucaucuca

SEQ ID NO: 50276 - RNA, 64 nt, hsa
auccuugagauuucacuaccuuuauguuaaaaguuguguauaauuguuaaaaucugugaaagaa

SEQ ID NO: 50277 - RNA, 64 nt, hsa
uacacauguauacguauguacgugucuguagguguguguauauauauauauauuuaugcaucua

SEQ ID NO: 50278 - RNA, 64 nt, hsa
cucucucgacauucucucuacauacguauauguguguguauaucgaugugugcauauauacaca

SEQ ID NO: 50279 - RNA, 64 nt, hsa
uauguguguacauaauuauauauagagauagacuuguguauacaccuuccacaaacacauccuc

SEQ ID NO: 50280 - RNA, 64 nt, hsa
aaaaacuguuaaaauuuaaaaaaaauuuaaaucauguguauacaauuuuuugccagauaaaaau

SEQ ID NO: 50281 - RNA, 64 nt, hsa
uuaugucaaucaagacaaaugaaauauauauguauguguauauauauacauguauguaugaaau

SEQ ID NO: 50282 - RNA, 64 nt, hsa
auguauguaugaaauauauauaugugcguguguguguguauauauauauauauauauauauauu

SEQ ID NO: 50283 - RNA, 64 nt, hsa
aauauauuucaaaauauguguguacguguguauauguguauauauauacacauauauauacaca

SEQ ID NO: 50284 - RNA, 64 nt, hsa
ucuucugaaauauauuucaaaauauguguguacguguguauauguguauauauauacacauaua

SEQ ID NO: 50285 - RNA, 64 nt, hsa
uauauauauauauguguguguguguguguguguguguguauauauauauauauauauauauaua

SEQ ID NO: 50286 - RNA, 64 nt, hsa
uauauauauauauauauauauauauauauauguguguguauauauauauauauguguauauaua

SEQ ID NO: 50287 - RNA, 64 nt, hsa
uauauauauauauguguguguauauauauauauauguguauauauauauguauauacauauaug

SEQ ID NO: 50288 - RNA, 64 nt, hsa
uauauagaaauuccauguuugauuuuuuaaaauauguguauaagucugucaugugcuaaacaaa

SEQ ID NO: 50289 - RNA, 64 nt, hsa
auugcuguuuuauguacugaugaaaguaccuauuuguguauauuggauuuuucacuugguuagc

SEQ ID NO: 50290 - RNA, 64 nt, hsa
ucaagggauuuaugucuacauauuuguguguguguguguauauauauguaauaugcauacacag

SEQ ID NO: 50291 - RNA, 64 nt, hsa
guauauauauguaauaugcauacacagaugcauauguguauauauaaugaaauuuauguugcug

SEQ ID NO: 50292 - RNA, 64 nt, hsa
guacacacaaaaauguguguauacauuuggguuguguguauacaucuugccauauacaauauac

SEQ ID NO: 50293 - RNA, 64 nt, hsa
uauaccaaauagcauacauguacacacaaaaauguguguauacauuuggguuguguguauacau

SEQ ID NO: 50294 - RNA, 64 nt, hsa
acacccguucuguggagagucgauuuacauaagcuguguauacacacacacacacacacacaca

SEQ ID NO: 50295 - RNA, 64 nt, hsa
ucuucugauucugcugcucacugucauagccuuuuguguauagugaugugucuguaucuuuaau

SEQ ID NO: 50296 - RNA, 64 nt, hsa
uugccuauguaauaggauauauccuaaguggggauguguauauuucaggaacuuuaauucacaa

SEQ ID NO: 50297 - RNA, 64 nt, hsa
acuuuaauucacaaguauauauugauaucugauguguguauaguacaucuguugguuauguaca

SEQ ID NO: 50298 - RNA, 64 nt, hsa
uauauacacauauacacaucuauguauggauauguguguauacacauauacacaucucugucca

SEQ ID NO: 50299 - RNA, 64 nt, hsa
ugcguguguauguauguguauguauaugcaugcauguguauaaagaugcacaugcguacauaua

SEQ ID NO: 50300 - RNA, 64 nt, hsa
gccaugagauuuuguuuggcaacaugaacagauuuguguauaacugcaauggccuuuuuuucca

SEQ ID NO: 50301 - RNA, 64 nt, hsa
gguuucucuugguuugugcuuacauguauggauguguguauauguacagugaaaauguugucuc

SEQ ID NO: 50302 - RNA, 64 nt, hsa
gacaagcaugugccuguguguguguguguguguguguguauaugugugugugugcacgcacaug

SEQ ID NO: 50303 - RNA, 64 nt, hsa
uguguguauaugugugugugugcacgcacaugcguguguauaagcccaccugaguggggcucgu

SEQ ID NO: 50304 - RNA, 64 nt, hsa
gcagagcaugacuuuuauaugugugggauaucaauguguauauuuauauuuaaaguguauuuau

SEQ ID NO: 50305 - RNA, 64 nt, hsa
gacacauccuggaauucauaccccacaaggacaguguguauacaaaguauuugcagagcaugac

SEQ ID NO: 50306 - RNA, 64 nt, hsa
gggacucacccagggaccaugaccugcugguguguguguauauuuacaaaaacaaaacaaacaa

SEQ ID NO: 50307 - RNA, 64 nt, hsa
uaaaauuugaaggaaucgaacuaacaauacauucuguguauauuauuuuaaugaagaaaauaaa

SEQ ID NO: 50308 - RNA, 64 nt, hsa
gcauuucucacaaaguguaccauguagcauguuuuguguauauaaaagggaggguuuuuuuaaa

SEQ ID NO: 50309 - RNA, 64 nt, hsa
auauacauguguaugagccucccuugugcacguauguguauaccacauauauaugcauuuagau

SEQ ID NO: 50310 - RNA, 64 nt, hsa
gagaaccugcugucaaauauuuacagcacaucacuguguauauaugaaaacguauuuggcaaua

SEQ ID NO: 50311 - RNA, 64 nt, hsa
gacauaauuauauauguguauguacauauguuuguguguauauguaaauauauuucuacacaca

SEQ ID NO: 50312 - RNA, 64 nt, hsa
auuauauauguguguauauauauaauauaauauauguguauauauauauuauauauauaauaua

SEQ ID NO: 50313 - RNA, 64 nt, hsa
aaaggauuguuucuccauauauauauuauauauguguguauauauauaauauaauauaugugua

SEQ ID NO: 50314 - RNA, 64 nt, hsa
auggcuauugcauuuugggauucuucgcauuuuguguguauauuuuuacagugagguacauugu

SEQ ID NO: 50315 - RNA, 64 nt, hsa
uaaggauuuuuuaaggagggaauauauauguguguguguauauaagcucccacauagauacaug

SEQ ID NO: 50316 - RNA, 64 nt, hsa
aauaagcuuuccauuuuauucauaaucuaauguguguguauauauguauguguguaugugugug

SEQ ID NO: 50317 - RNA, 64 nt, hsa
cuaauguguguguauauauguauguguguauguguguguauauauagauguauauauauacaca

SEQ ID NO: 50318 - RNA, 64 nt, hsa
cgaccaagaucccucccugcaagacagaugggaauguguauaauaacuagguauuugagaaguu

SEQ ID NO: 50319 - RNA, 64 nt, hsa
ucucucucucucucuccauauauauauguguguguguguauauauauauauaugugugugugug

SEQ ID NO: 50320 - RNA, 64 nt, hsa
uguguguauauauauauauauguguguguguguguguguauacauauauacacauauauacaca

SEQ ID NO: 50321 - RNA, 64 nt, hsa
uauacacauauauacacacacacauacauauacauguguauauauauaccaucccauauauaug

SEQ ID NO: 50322 - RNA, 64 nt, hsa
ucauugucagacucccccuggucuaccgcguugauguguauacacugaucuuucaagucuggga

SEQ ID NO: 50323 - RNA, 64 nt, hsa
ccagaugauacuuuccuuuaaaucugugucucuguguguauaacaaagaggaagauggaaacaa

SEQ ID NO: 50324 - RNA, 64 nt, hsa
auuugaaugaguuuuuaauagucuagaauguuauuguguauagauauuuccucuugaacguuau

SEQ ID NO: 50325 - RNA, 64 nt, hsa
uuuggagagccacauacuuuacaguaaaauuaaguguguauaaaacauuaauugcuaacaauug

SEQ ID NO: 50326 - RNA, 64 nt, hsa
uugauaaguauguugcauuuuaagagcuuauaauuguguauaauuuguuaacacuagaaaccua

SEQ ID NO: 50327 - RNA, 64 nt, hsa
uuuucuugaucuguuuuguucucuauacuuugcuuguguauauuugucagagguguuucuagug

SEQ ID NO: 50328 - RNA, 64 nt, hsa
auaauuaugcaaaugaaugcgacuauguugacaauguguauauguaaauaauauguguuuuacc

SEQ ID NO: 50329 - RNA, 64 nt, hsa
uuuauauuuauaugacagcuugaacugacaacauuguguauauagaucaucuugaaguauuauu

SEQ ID NO: 50330 - RNA, 64 nt, hsa
gcuggcuauauaggaaaaugcuguggaaaugaacuguguauauacuucugggaggaacaaauuu

SEQ ID NO: 50331 - RNA, 64 nt, hsa
guauagauuaauaucuaaaaccaaaaaaugaacauguguauagugaugcugaaaaaugugcauu

SEQ ID NO: 50332 - RNA, 64 nt, hsa
uuauauguauaugcacacauacauacauauauguuguguauaaauguacacuuuuuuagacaug

SEQ ID NO: 50333 - RNA, 64 nt, hsa
cucaauaauuuuauacuguaauaagcucuuugaauguguauauuauuauuuuuuacaaucauuu

SEQ ID NO: 50334 - RNA, 64 nt, hsa
ugugugcacuuauguguauggguccauauguacguguguauauaauauauauuguaugugauaa

SEQ ID NO: 50335 - RNA, 64 nt, hsa
uuuuauuacuccguggggagcauguacagagcucuguguauacacagcuucacacccaccagau

SEQ ID NO: 50336 - RNA, 64 nt, hsa
ugagagaaaagucaaaggugcuucagccuuguacuguguauauauauuaaaaaaaaaacaaagu

SEQ ID NO: 50337 - RNA, 64 nt, hsa
gcauuaugcacgugucuggguaucuuuguauauauguguauauaugugugcccuggacuguuuc

SEQ ID NO: 50338 - RNA, 64 nt, hsa
gcugugugucugcuuguaugcuuuuauaggccuguguguauagcuguguguguguucaagugcg

SEQ ID NO: 50339 - RNA, 64 nt, hsa
gggcauguguggggugugugugggauguggguuguguguauaucuggcaugugucccagucacu

SEQ ID NO: 50340 - RNA, 64 nt, hsa
augcguguguauaagggggugugugugggaugcguguguauaaggggguguguguagugugugu

SEQ ID NO: 50341 - RNA, 64 nt, hsa
cuagucacuuggagaagggugugugugggaugcguguguauaagggggugugugugggaugcgu

SEQ ID NO: 50342 - RNA, 64 nt, hsa
gaaacuacaugaagucaccguuacaguaacuugauguguauauuaauaaaaguaauucagucau

SEQ ID NO: 50343 - RNA, 64 nt, hsa
caaagcuaaagauguauauauacauauacuuuuguguguauauauacacauauguguguaugca

SEQ ID NO: 50344 - RNA, 64 nt, hsa
auauggaacaacugcuuuuaggagaaaguguauuuguguauauguguguauacauauguuuauc

SEQ ID NO: 50345 - RNA, 64 nt, hsa
acugcuuuuaggagaaaguguauuuguguauauguguguauacauauguuuaucucacacacau

SEQ ID NO: 50346 - RNA, 64 nt, hsa
cuaggaauuuaauauuguuguguauauuuauguguguguauaaaacuccugugggaaagaaaca

SEQ ID NO: 50347 - RNA, 64 nt, hsa
aaaagaaauuaaccaccuaggaauuuaauauuguuguguauauuuauguguguguauaaaacuc

SEQ ID NO: 50348 - RNA, 64 nt, hsa
uauuccauauauauauuccauauguauauguguguguguauaaaauauauauuugccuuaaaug

SEQ ID NO: 50349 - RNA, 64 nt, hsa
uguguauauaguccccauauguauacauuccacguguguauauauuccacauauguauacauuc

SEQ ID NO: 50350 - RNA, 64 nt, hsa
cauguauauauuccacauauguauacauuccacguguguauauaguccccauauguauacauuc

SEQ ID NO: 50351 - RNA, 64 nt, hsa
auuccacauguguguauguggaauauauuccacauguguauauauuccacguguauguauucca

SEQ ID NO: 50352 - RNA, 64 nt, hsa
gcugcuggugaaagucgugugaaauccuguacacuguguauagaauaauguaauuuuauguuaa

SEQ ID NO: 50353 - RNA, 64 nt, hsa
aauguaacagugcagaucuuguuagacacaugaauguguauaaucauguuaaaugcaaauaaaa

SEQ ID NO: 50354 - RNA, 64 nt, hsa
cuaaaaauaaaccaaaggacauuaugugugcauguguguauaagugcacacagaaauauauaua

SEQ ID NO: 50355 - RNA, 64 nt, hsa
agaaauauauauacauauguagacuauauacauguguguauauauguguauauauacauacacu

SEQ ID NO: 50356 - RNA, 64 nt, hsa
auacauauguagacuauauacauguguguauauauguguauauauacauacacuuguauaaaug

SEQ ID NO: 50357 - RNA, 64 nt, hsa
gagacagcgcuugguggugugauacuuuuggugcuguguauaguauuguaugucgguacacgga

SEQ ID NO: 50358 - RNA, 64 nt, hsa
cugaaaugucuuacauuaagaauaucuugaauguuguguauauauuuuaaaaagcacuuugcaa

SEQ ID NO: 50359 - RNA, 64 nt, hsa
uauugugcauaacagauuguuccucuuauauuuguguguauacaggcaauucauguuuuaaugu

SEQ ID NO: 50360 - RNA, 64 nt, hsa
uuuucacucaaaccacugacuuaacagauacugcuguguauaacauguacuaaauauuacaguu

SEQ ID NO: 50361 - RNA, 64 nt, hsa
ugcuguuaaaacacaaauuucaaucaaauacuuuuguguauagaaaauauguauaguagguaga

SEQ ID NO: 50362 - RNA, 64 nt, hsa
cgcauguagagcuacagauccagauacacacacuuguguauauauguacauacagacauacuga

SEQ ID NO: 50363 - RNA, 64 nt, hsa
augauacacacacaugcacagguucucaaccacguguguauauauguaugugugcauaugucug

SEQ ID NO: 50364 - RNA, 64 nt, hsa
uauuuuuaaaucuugcuuuucagaaauuaccgaauguguauaaacaaauaaagaaaaauaauuu

SEQ ID NO: 50365 - RNA, 64 nt, hsa
cguuccuuccugucacacccuccuuuggcgucucuguguauauccuugcuuuauuuucuuggaa

SEQ ID NO: 50366 - RNA, 64 nt, hsa
ugacacugugaacaauguaguuggaaaauagguauguguauaugcauuauuuauacucauuguu

SEQ ID NO: 50367 - RNA, 64 nt, hsa
aaaauguaucagaaaaguuugauuaccuagaaaguguguauagaaacugcaaauaaacgugacu

SEQ ID NO: 50368 - RNA, 64 nt, hsa
uauauauauauauauauauguguguguguguguguguguauauguguuuauagagauacacaca

SEQ ID NO: 50369 - RNA, 64 nt, hsa
uauguguuuauagagauacacacacauauauauguguguauauauauacacauacauauauaua

SEQ ID NO: 50370 - RNA, 64 nt, hsa
uguguguguguguguguguguguguguaugccuguguguauauauagaagucauuauggcagau

SEQ ID NO: 50371 - RNA, 64 nt, hsa
ggcauaaggacaucuccacuuuucucuguaccuguguguauagaaauagauuagagcacaguug

SEQ ID NO: 50372 - RNA, 64 nt, hsa
ggccugaggacauuuccaguuuucucuguaccuguguguauagaaauagaucagagcacaguug

SEQ ID NO: 50373 - RNA, 64 nt, hsa
uugauuauaaccacaaauuguguguguguguguguguguauauauagaagucauuauggcagau

SEQ ID NO: 50374 - RNA, 64 nt, hsa
cuggauguggguaaacuaagguaaaggggaugauauuccacaaacuaauuaugcacacagaaaa

SEQ ID NO: 50375 - RNA, 64 nt, hsa
agucucuuuucuuacucuggcaaaccugugagugauuccacaaagauacaguauuacuuagcua

SEQ ID NO: 50376 - RNA, 64 nt, hsa
uuggugguuucuguguuagaucucguuagucugcauuccacagcuucucaguugccauuugauu

SEQ ID NO: 50377 - RNA, 64 nt, hsa
gacuaguccucacuucaggcucuuuucaucaaaaauuccacacccucagguaccaucuguggug

SEQ ID NO: 50378 - RNA, 64 nt, hsa
aguauaauuacauccuccaauguaccguuuccuuauuccacagauaucuuuuucauuauuguga

SEQ ID NO: 50379 - RNA, 64 nt, hsa
gacuuaucaacacuauaauuguucccuaugaaagauuccacagagauguuuauggugagguuua

SEQ ID NO: 50380 - RNA, 64 nt, hsa
gauugcaaacuaggaugcuacauaggauucugguauuccacauccaauauggauuucuagaaug

SEQ ID NO: 50381 - RNA, 64 nt, hsa
accugccacccacugauucagaaauggaaaucacauuccacaaucuauggcuuccaccagcuag

SEQ ID NO: 50382 - RNA, 64 nt, hsa
gaacagacaaacuguuuuccacagcaguugaaccauuccacauucccaccagcaauguaugaga

SEQ ID NO: 50383 - RNA, 64 nt, hsa
aaucccauaggauggcaagcaaaguucuucuagaauuccacaugcaauucacucuggcgacccu

SEQ ID NO: 50384 - RNA, 64 nt, hsa
aggugauacauauguuaauuaguucaacugauccauuccacaauguauacauauuucaaacuau

SEQ ID NO: 50385 - RNA, 64 nt, hsa
gggaucaugaaaaggucuggucagcuacaguuuaauuccacacuguuacagaaaagcauuucuu

SEQ ID NO: 50386 - RNA, 64 nt, hsa
augaugauguuaguaguuuggaagaagaacaagaauuccacaugagaaguaaaaacaguuuaca

SEQ ID NO: 50387 - RNA, 64 nt, hsa
aaggguacuguauguaaaacucuguauuaaaacuauuccacauauccuaaaauuucagcuugcc

SEQ ID NO: 50388 - RNA, 64 nt, hsa
gccuuuuuuuuccuauuuauuucuucccgcacaaauuccacauagaggccuucccauccagcuc

SEQ ID NO: 50389 - RNA, 64 nt, hsa
uggauuuguauuacacacaguuuuaaaaaaaacaauuccacacuauucucugccuuuuuuuucc

SEQ ID NO: 50390 - RNA, 64 nt, hsa
uguuacaauauuaggugaauauggaaguaaaggcauuccacaggaucaucauuuaaaaaaaaag

SEQ ID NO: 50391 - RNA, 64 nt, hsa
guguaugguaucauguaucucucuguggugguucauuccacaggacgaaugcauauucaacaca

SEQ ID NO: 50392 - RNA, 64 nt, hsa
gaccuuuagaguuaagccuuuguauuuccauguuauuccacaauaugcaauauuucucugagua

SEQ ID NO: 50393 - RNA, 64 nt, hsa
aggcuaaaaauauugcagggcaucggguguuucuauuccacagaguauuguuaauguacaacac

SEQ ID NO: 50394 - RNA, 64 nt, hsa
ggcucuugaauuaauaaaauuauagucucuaagaauuccacauuuuauggaaaguuagagcaaa

SEQ ID NO: 50395 - RNA, 64 nt, hsa
cugaguuuucaucggucuucacaugcugcuauauauuccacagaguuccuugcauguacugagc

SEQ ID NO: 50396 - RNA, 64 nt, hsa
auauguauauauuccauauaccauauauguauauauuccacauauguauuccauauauauauuc

SEQ ID NO: 50397 - RNA, 64 nt, hsa
aguccccauauguauacauuccacguguguauauauuccacauauguauacauuccauguaugu

SEQ ID NO: 50398 - RNA, 64 nt, hsa
auauauuccacguguauguauuccacauguauauauuccacauauguauacauuccacgugugu

SEQ ID NO: 50399 - RNA, 64 nt, hsa
auauuccacauguguauauauuccacguguauguauuccacauguauauauuccacauauguau

SEQ ID NO: 50400 - RNA, 64 nt, hsa
auacauauauuccacauguguguauguggaauauauuccacauguguauauauuccacguguau

SEQ ID NO: 50401 - RNA, 64 nt, hsa
auacauauauuccacauguguguauguggaauauauuccacauguguguauguggaauauauuc

SEQ ID NO: 50402 - RNA, 64 nt, hsa
augauggccaagguaguuccauauauauacauauauuccacauguguguauguggaauauauac

SEQ ID NO: 50403 - RNA, 64 nt, hsa
aauuaaacugggcaauagccuaagaaggggggaauauuguaacacaaauuuaaacccacuacgc

SEQ ID NO: 50404 - RNA, 64 nt, hsa
uaguuaugaagaaaacaaugucauuugcugcuauuauuguaagagucuuauaauuaaugguacu

SEQ ID NO: 50405 - RNA, 64 nt, hsa
ccugccaaacuacuagucacuuuacauccucagguauuguaaccacugggccuuccaacuuugc

SEQ ID NO: 50406 - RNA, 64 nt, hsa
uacauccaucaauaccauuccauuuaaaaugggcuauuguaauuuacccacauuaucacauuuu

SEQ ID NO: 50407 - RNA, 64 nt, hsa
augucuuucaauuuaaauucacuucaguuuuuguuauuguaauauauuuacuuuuacaugguua

SEQ ID NO: 50408 - RNA, 64 nt, hsa
uucccucuuuggggcaaauucuuauaaaaauguuuauuguaaaguuauauauuuugucuacgau

SEQ ID NO: 50409 - RNA, 64 nt, hsa
gaguugcuucugagguacauuuugaaugacagcauauuguaagaaaaaaaaaggugaauaaaau

SEQ ID NO: 50410 - RNA, 64 nt, hsa
uacuuuaaaugccaauuacagugcaaucuuuauuuauuguaaaauuuuuuaaguguacuuaugu

SEQ ID NO: 50411 - RNA, 64 nt, hsa
aacucuaggagaaaaagaaaaucauguuuuccuguauuguaaauuuuagacuauuucauauaca

SEQ ID NO: 50412 - RNA, 64 nt, hsa
uuuuaaggcucuguuagaaauuacacacacaguauauuguaaauucuuaucucuguauacugua

SEQ ID NO: 50413 - RNA, 64 nt, hsa
auugcuguggaauaaaagaugaaaugcuccugauuauuguaaauacaaaauugcaugcgggauu

SEQ ID NO: 50414 - RNA, 64 nt, hsa
uauguuuuauagaccuacacuagugccaggucacuauuguaagauguuaaaaucucaagaaaau

SEQ ID NO: 50415 - RNA, 64 nt, hsa
acaaaaauugaauugcauuuugugcucaguuguuuauuguaauuuuauuuuuguuacauuaaua

SEQ ID NO: 50416 - RNA, 64 nt, hsa
uuucccuuguauuuuuauaauuaaaucagcaaaauauuguaauaaagaaaucuuuccugugaag

SEQ ID NO: 50417 - RNA, 64 nt, hsa
uugaaauaccuagaugaaguuuagauuuucuuccuauuguaaacuuuugagucugguuucauug

SEQ ID NO: 50418 - RNA, 64 nt, hsa
aggaacaaauaaagacaaacaacauuaagggccauauuguaagauuuccauguuaaugaucuaa

SEQ ID NO: 50419 - RNA, 64 nt, hsa
aacucaagcccucaaggcccaacuucucugucuauauuguaauauagaauuucgaagagacauu

SEQ ID NO: 50420 - RNA, 64 nt, hsa
auuuagggguucugggcacagacaucuaaccugguauuguaaggcagaggcucccauuggaaug

SEQ ID NO: 50421 - RNA, 64 nt, hsa
uaggucuguaauuuauagagaucucuagaauucuuauuguaauuuuccuacuucuuugauaaaa

SEQ ID NO: 50422 - RNA, 64 nt, hsa
auuuagaaaucacuuuaagauaaaugaacaaaauuauuguaagucuucuaaacuugguuuauug

SEQ ID NO: 50423 - RNA, 64 nt, hsa
cuuaguuuagaucuccaucaucaauuccacuuacuauuguaauaccuucagcuggagccugugu

SEQ ID NO: 50424 - RNA, 64 nt, hsa
ggccaaaaugcauuuuaugagcuuuuuuuuuugcuauuguaaauauuagugguuuacaaugcgc

SEQ ID NO: 50425 - RNA, 64 nt, hsa
caacuuuuuucuuuuuuuuuuuuuaauugccuuguauuguaaguauucuucccugcaguccaag

SEQ ID NO: 50426 - RNA, 64 nt, hsa
cuguguauuaauaaauugucacuuucauugucuuuauuguaacuccauugaucccguaucuuaa

SEQ ID NO: 50427 - RNA, 64 nt, hsa
acacucaggugcucacaaauagagcagauugucauauuguaacaugcgugugccagacaccggg

SEQ ID NO: 50428 - RNA, 64 nt, hsa
auaaaggacaggcuggugcuaacauaaaauccaauauuguaauccuagcacuuugggaggccaa

SEQ ID NO: 50429 - RNA, 64 nt, hsa
augaguuguagacacugaucugcuagugcuguaauauuguaaauacuggacucaggaacuuuug

SEQ ID NO: 50430 - RNA, 64 nt, hsa
cauuuugguuucaggaggacaugaauaguguguuuauuguaacuccucauacacuuuuaaaacc

SEQ ID NO: 50431 - RNA, 64 nt, hsa
auauaacaaaaaugaauuuuguuugauagauuuauauuguaaccuuuuucuaguucuugaauaa

SEQ ID NO: 50432 - RNA, 64 nt, hsa
uuugugguaauuuggcaacuugagcucucccaauuauuguaauauaaggacagacauaauagua

SEQ ID NO: 50433 - RNA, 64 nt, hsa
gcugcuuuuucccuuugauauaguugaaagaauguauuguaaauuggcauacaauacugccuuu

SEQ ID NO: 50434 - RNA, 64 nt, hsa
ugaacuaaucaaauacaauagauuauaaauuguguauuguaaauaaaaguucacucugugagug

SEQ ID NO: 50435 - RNA, 64 nt, hsa
uauuacacaaaauuacuuugugguaaacagacaguauuguaaucccaucaaaagaugaaagaaa

SEQ ID NO: 50436 - RNA, 64 nt, hsa
cucaguggauagcacucaauuuauuccguagugauauuguaacaauacugccauucccuucuac

SEQ ID NO: 50437 - RNA, 64 nt, hsa
ucuaugguugacaauggaguuuugugauccugcuuauuguaacugacaacuguuuucaacucca

SEQ ID NO: 50438 - RNA, 64 nt, hsa
gcacuguuauuuugagaugucauacuguacacuguauuguaaaaauaaaaaguaaaauuauauu

SEQ ID NO: 50439 - RNA, 64 nt, hsa
cuuaaagagugaaaaccauguaaacuauugaaacuauuguaauccauuaaugcuuuuuuagaau

SEQ ID NO: 50440 - RNA, 64 nt, hsa
guuuuaugauuuaaagcaucugguuugcauauuguauuguaauacugauacaguuuggcugugu

SEQ ID NO: 50441 - RNA, 64 nt, hsa
gccuuuuuaagcuguuucauauugaaagguggaauauuguaaaaauuuugucaaagauguacug

SEQ ID NO: 50442 - RNA, 64 nt, hsa
aacaugauuugaugcuauaaaguaggcauuuuaauauuguaaacauauacuuuggcuguauuga

SEQ ID NO: 50443 - RNA, 64 nt, hsa
auaaugguagccuaaacuuaauauuuuuauaaaguauuguaauauuguuuuguggauaauugaa

SEQ ID NO: 50444 - RNA, 64 nt, hsa
augagauuuuuuaagggcuuuaugugaacuaugauauuguaauuuuucuaagcauauucaaaag

SEQ ID NO: 50445 - RNA, 64 nt, hsa; identical to SEQ ID NO: 45461

SEQ ID NO: 50446 - RNA, 64 nt, hsa; identical to SEQ ID NO: 45462

SEQ ID NO: 50447 - RNA, 63 nt, hsa
gguuuuucccaccccagcugccccagcacgcgggacccauagcacaccccuuagcgcuugccu

SEQ ID NO: 50448 - RNA, 63 nt, hsa
aggaaggaagcacaaaagacaagcauugggucagacccauaaaccaccucccaaaggcuguca

SEQ ID NO: 50449 - RNA, 63 nt, hsa
ggggauuguuugcuuuuuaaguaaaacacuucugacccauagcucaguaugucugaauuccag

SEQ ID NO: 50450 - RNA, 63 nt, hsa
uuacaaagucuacuuuuuguucaaggauaugcugacccauauaguuuacucuuaaaauugugu

SEQ ID NO: 50451 - RNA, 63 nt, hsa
uuucuuucucucuugccagaauguauucauguugacccauaagacauuaucauuuuuauaagu

SEQ ID NO: 50452 - RNA, 63 nt, hsa
cuacccuagggcacuuucucuuugagguggagagacccauaaagccuugaccacaucacucca

SEQ ID NO: 50453 - RNA, 57 nt, hsa
agaaugccauucuacaauaaauucaaagacccauaaaaggcuuuuaaggauucucug

SEQ ID NO: 50454 - RNA, 63 nt, hsa
ccaaaaacaucuauuugugaccuuaaacauguggacccauaggugcaguuagaaaaagacaac

SEQ ID NO: 50455 - RNA, 63 nt, hsa
aauaaauuaugaagcauacuaaugaguaccuaugacccauaacacauauacauuaaaacauuu

SEQ ID NO: 50456 - RNA, 63 nt, hsa
guugugaagccauuaauauaaaucuuugguaaugacccauaucucuauauguauguguuccca

SEQ ID NO: 50457 - RNA, 63 nt, hsa
auaauauauccuaugcugauuuucccaaaacaugacccauaguauuaaauacauaucauuuuu

SEQ ID NO: 50458 - RNA, 63 nt, hsa
caaguucaaauaaaauuuuuauaaucggauucagacccauaaccaaacuauguugguaguaga

SEQ ID NO: 50459 - RNA, 63 nt, hsa
aaaauaauuucaucagguuuuuuguauguuacugacccauauggauuuuaguaacaucuugcu

SEQ ID NO: 50460 - RNA, 63 nt, hsa
gccucaauauuugucugaagacacuuaaauucugacccauaaaggaaaguucuagaagcaaua

SEQ ID NO: 50461 - RNA, 63 nt, hsa
aaaaacucuugcuaccuguauuacuugaucucagacccauaccugaugguucagucuguccuu

SEQ ID NO: 50462 - RNA, 63 nt, hsa
aaugucauucucaaugcccagauccugagauuggacccauacccugucuccaacccugccuug

SEQ ID NO: 50463 - RNA, 63 nt, hsa
ccaacccugacugcccacuccuccacaaaccgugacccauagccgcccccaccccauaccuug

SEQ ID NO: 50464 - RNA, 63 nt, hsa
cuagucagggaggggauggcgguccuuugauaagacccauaggcaaacuucgagcccaucagc

SEQ ID NO: 50465 - RNA, 63 nt, hsa
ccuguugaccuucccacacaaucccuguacucugacccauagcacucuuguuugcuuugaaaa

SEQ ID NO: 50466 - RNA, 63 nt, hsa
uauccacguguggauuauccaccaugccaggaagacccauaacugguuuuaacacuaacuaga

SEQ ID NO: 50467 - RNA, 63 nt, hsa
gccagcacacugcuaaccagucaccaaauguaagacccauaagaaacccauauuuaaaaaucu

SEQ ID NO: 50468 - RNA, 63 nt, hsa
uucaaaaacaaaucagaagcagaugcugauugggacccauauaccacguugcugacucacguu

SEQ ID NO: 50469 - RNA, 63 nt, hsa
acaucuacaaguaaguacagcugaaauucagaggacccauaagaguucacaugaaaaaaauca

SEQ ID NO: 50470 - RNA, 63 nt, hsa
ugugucccagacagauccccuaggccuaucugagacccauacaggcccacaccugagcuccug

SEQ ID NO: 50471 - RNA, 63 nt, hsa
gauuacguguauguuucuucuuucuuuuaagcagacccauaccuuuccagggucaaaguacag

SEQ ID NO: 50472 - RNA, 63 nt, hsa
ccuaaccauuucuacuacaguuuuuuccuuauggacccauacuagguuguacaaaccuuaagg

SEQ ID NO: 50473 - RNA, 63 nt, hsa
aucuaccuugguaggagggagucaguacuguuggacccauagguagccucaucccugccacug

SEQ ID NO: 50474 - RNA, 63 nt, hsa
caauggugagcagacugcaaaucugccugauaggacccauauucccacagcacuaauucaaca

SEQ ID NO: 50475 - RNA, 63 nt, hsa
aaauaaguugucuuuacugaaaaaugaagugaagacccauauaugcaguuaaaaaaaaguuaa

SEQ ID NO: 50476 - RNA, 63 nt, hsa
uccuccuccucuuccccucccucuuucauuggugacccauaaccccaagucccagcccagaac

SEQ ID NO: 50477 - RNA, 63 nt, hsa
auuuaugugauguggauugcugguguccagcaugacccauaaacaggucagaagaaugaugga

SEQ ID NO: 50478 - RNA, 63 nt, hsa
aggaacagaaacaacuuugcauugcauuggcuugacccauaaacuaaguuauauccgugggca

SEQ ID NO: 50479 - RNA, 63 nt, hsa
cuuuaaaacaucuacccuaaaccaucugcuauggacccauaauaagaggccuguuguauauga

SEQ ID NO: 50480 - RNA, 63 nt, hsa
auccccuugucgaaaacuagaaaaaaaggaguugacccauauaaauuaucucuaacgucuuug

SEQ ID NO: 50481 - RNA, 63 nt, hsa
cgucugcucaggaaguggggccagcuccacugggacccauaguuuuacuuccuugucauuuga

SEQ ID NO: 50482 - RNA, 63 nt, hsa
uagacaaaggcucuacacauacugcaugcucaggacccauagaugaacuauuagacaugaaau

SEQ ID NO: 50483 - RNA, 63 nt, hsa
ucuucauucuccuucuucuccuucuuccacaaagacccauaucuggagaagguguacaacuuu

SEQ ID NO: 50484 - RNA, 63 nt, hsa
agguucuuucauucaagaucaucauucuugacagacccauaaauauuuccuauaaagacugua

SEQ ID NO: 50485 - RNA, 63 nt, hsa
ugagaaccaggagacacguguggcgggcagugggacccauagaucuucugaaaugaaacaaau

SEQ ID NO: 50486 - RNA, 63 nt, hsa
ugagugucauuaguuacuuuauugaagguuuuagacccauagcagcuuugucucugucacauc

SEQ ID NO: 50487 - RNA, 63 nt, hsa
aacgcgcggccggggcgggagagacucagcaacgacccauaccucagacccgacggcccggag

SEQ ID NO: 50488 - RNA, 63 nt, hsa
cagaaugauuuccaaaauugcaaaccacgccaugacccauauacgccaaguaagauuuuaaaa

SEQ ID NO: 50489 - RNA, 63 nt, hsa
uuuuuucucccgucuucaaugaccucccauuuggacccauaguuuauuuauagagagcacaca

SEQ ID NO: 50490 - RNA, 63 nt, hsa
uguguaaacauagggugccuaccuauuucaccugacccauacucguuucugauucagaaucag

SEQ ID NO: 50491 - RNA, 63 nt, hsa
ggcuucucaccuguggccaacuucacuuuguaagacccauauuuuuaacucuucccagggaaa

SEQ ID NO: 50492 - RNA, 63 nt, hsa
ggcuugaagacaaauggucuuagaauucauugagacccauagcuucauauggcugcuccagcc

SEQ ID NO: 50493 - RNA, 63 nt, hsa
uacuuuuauuaauauuuaacauaauuaaagauggacccauaagagugacgccuguggagcgcg

SEQ ID NO: 50494 - RNA, 63 nt, hsa
cucuuacuguacugucuaucugcaguaauugaggacccauaaaauuuagauaacuacaugucu

SEQ ID NO: 50495 - RNA, 63 nt, hsa
agaaaccccaaacucaggccgaaugaucaaggggacccauaggaaaucuuguccagagacaag

SEQ ID NO: 50496 - RNA, 63 nt, hsa
cucguucccuacccuaaaauucuaaggggaagggacccauagaggcuugccuguuuccgcuac

SEQ ID NO: 50497 - RNA, 63 nt, hsa
ggugcccuguagaacucuguuacacauauuuuugacccauauuauuuacaaugucuugauaau

SEQ ID NO: 50498 - RNA, 63 nt, hsa
ccucuugcuugaaugugauuucuuucucccugagacccauaagguucaucuuaugggaccuua

SEQ ID NO: 50499 - RNA, 63 nt, hsa
cuguaauaguuucaguuccuauuuucuuccauugacccauauuuauaccuuucagguacugaa

SEQ ID NO: 50500 - RNA, 63 nt, hsa
cucuccuacucucaguggucagaggcuguguuggacccauaguagaauuuuccaggucacaga

SEQ ID NO: 50501 - RNA, 63 nt, hsa
auuaggaaaaugcacauauuccaugaauuuuaagacccauagaaaaguugaagaaugcuuaau

SEQ ID NO: 50502 - RNA, 63 nt, hsa
gccaaagucucccuucuguuucuucagcacauugacccauagcacacacauacacaccaccac

SEQ ID NO: 50503 - RNA, 63 nt, hsa
ccgugugacgguggccuuggaggacccagcacugacccauagagggcuccucucagaugggca

SEQ ID NO: 50504 - RNA, 63 nt, hsa
guuggguagagaagccagcagggggcagcgugggacccauaucccagccccaggcggaccaga

SEQ ID NO: 50505 - RNA, 63 nt, hsa
uuaauaggaaaaugcuaaggaggccucauaaaugacccauaauuaccaacguagaauuuuuca

SEQ ID NO: 50506 - RNA, 63 nt, hsa
aucagagaugggaaaaccauuggggaggacuaggacccauaugggaauuauuaccucucaggg

SEQ ID NO: 50507 - RNA, 63 nt, hsa
cccugcuaccuuaguucugcaugagaaucagcugacccauacagacuugaaaccagagaacau

SEQ ID NO: 50508 - RNA, 63 nt, hsa
ggcggcccuucucagccccucccuccauggagggacccauagggcuagacacuuugaggcaag

SEQ ID NO: 50509 - RNA, 63 nt, hsa
uuccgagagcguucaguguuucacugaagacaggacccauagccuucauuucuggcucugugu

SEQ ID NO: 50510 - RNA, 63 nt, hsa
ugaacucuguugauaauaccacaccauguucuggacccauagcucuggcauccucagggguug

SEQ ID NO: 50511 - RNA, 63 nt, hsa
ucugggaguuuuucuguguggggaggagacagagacccauaacuaaauaugcucuguguaaag

SEQ ID NO: 50512 - RNA, 63 nt, hsa
uguucucaggccccccugcuuuugucucaccaggacccauaccuuucaccuuguucccuucca

SEQ ID NO: 50513 - RNA, 63 nt, hsa
ucuuaucauuuugaaaugggcucuugauuaauagacccauauuuuuuaguggcuucuauguug

SEQ ID NO: 50514 - RNA, 63 nt, hsa
gcugcugcuuuuucuugguccuuggggcuggcagacccauagaccauggccuguuaggaggcg

SEQ ID NO: 50515 - RNA, 63 nt, hsa
aacuagugagagugccaagugcuuuuuagaaaggacccauauguuaucaaacuuugaaauuga

SEQ ID NO: 50516 - RNA, 63 nt, hsa
uacagaaguuggguauugucugaaaucccagaggacccauaagugccggugacaagcugucug

SEQ ID NO: 50517 - RNA, 63 nt, hsa
uccacgggaaagaggucgauggauuuaccccuggacccauaagucuguucauccugcugaagu

SEQ ID NO: 50518 - RNA, 63 nt, hsa
ccccaacuucccaaagagcagcaucccucccccgacccauagccauguuuuaaagucaccuuc

SEQ ID NO: 50519 - RNA, 63 nt, hsa
ggggaugggauccuagguagggccaggggaggagacccauaaauguucccuuggggguguuga

SEQ ID NO: 50520 - RNA, 63 nt, hsa
ggucuuaauccuaucuauggauguguuuugugugacccauacaguguuguaaaaaacacuuag

SEQ ID NO: 50521 - RNA, 63 nt, hsa
aggugcagcgggucacccuguggcccguccugugacccauauuuagccguguuugggacuccg

SEQ ID NO: 50522 - RNA, 63 nt, hsa
gaggaaguaagucagggcgggcuuugagaaggggacccauauccuacaggcaaaaagcaggcu

SEQ ID NO: 50523 - RNA, 63 nt, hsa
uaaagguugaauuauauuuucccccauauuauugacccauagugacaccaguuuugggagaug

SEQ ID NO: 50524 - RNA, 63 nt, hsa
cguucccaaagauccacccaaauaucaaacacggacccauagacagcccugggggagccucuu

SEQ ID NO: 50525 - RNA, 63 nt, hsa
uuaaauaaggaagaggcccagauugugaagacggacccauauaucccuaccucccaccaccua

SEQ ID NO: 50526 - RNA, 63 nt, hsa
gugcugggauuacaggugugagccaccacaccugacccauaggucuucaauaaauauuuaaug

SEQ ID NO: 50527 - RNA, 63 nt, hsa
gagguaaagcuguugggggaagaagaguuuuuggacccauagauguuuggaugaugucucuaa

SEQ ID NO: 50528 - RNA, 63 nt, hsa
gguuuuagcaggggaggggaccugcuaagcugagacccauaguccugcucagaguuaucccaa

SEQ ID NO: 50529 - RNA, 63 nt, hsa
cacacgccugccagaagcuggaggggugcuggagacccauagagcugaugggagcagcuggug

SEQ ID NO: 50530 - RNA, 63 nt, hsa
aacuccagugggaaagaaagagcuuuauuuacagacccauaaaaaucccaucagugucguccc

SEQ ID NO: 50531 - RNA, 63 nt, hsa
gaagcccuaauaucuauaauuugaacuguacuggacccauaguuuuaacugaaaagggccaaa

SEQ ID NO: 50532 - RNA, 63 nt, hsa
gccagaggcaucuuuugagccauacgaauuccugacccauagaaacugcaagacaauaaaugu

SEQ ID NO: 50533 - RNA, 63 nt, hsa
uguuuauaguauccauccugaaccauucguuuugacccauaauaauagugauaguauaauggc

SEQ ID NO: 50534 - RNA, 63 nt, hsa
uggaaacugucgacggccauccacuuauuaauggacccauaacuaaggaaacaucaccugucc

SEQ ID NO: 50535 - RNA, 63 nt, hsa
acugucggaguucuaucacuugcuugaccccuggacccauaaaccaguccacuguuauacccg

SEQ ID NO: 50536 - RNA, 64 nt, hsa; identical to SEQ ID NO: 50134

SEQ ID NO: 50537 - RNA, 64 nt, hsa; identical to SEQ ID NO: 50135

SEQ ID NO: 50538 - RNA, 64 nt, hsa; identical to SEQ ID NO: 50136

SEQ ID NO: 50539 - RNA, 64 nt, hsa; identical to SEQ ID NO: 50137

SEQ ID NO: 50540 - RNA, 64 nt, hsa; identical to SEQ ID NO: 50138

SEQ ID NO: 50541 - RNA, 64 nt, hsa; identical to SEQ ID NO: 50139

SEQ ID NO: 50542 - RNA, 64 nt, hsa; identical to SEQ ID NO: 50140

SEQ ID NO: 50543 - RNA, 64 nt, hsa; identical to SEQ ID NO: 50141

SEQ ID NO: 50544 - RNA, 64 nt, hsa; identical to SEQ ID NO: 50142

SEQ ID NO: 50545 - RNA, 64 nt, hsa; identical to SEQ ID NO: 50143

SEQ ID NO: 50546 - RNA, 64 nt, hsa; identical to SEQ ID NO: 50144

SEQ ID NO: 50547 - RNA, 64 nt, hsa; identical to SEQ ID NO: 50145

SEQ ID NO: 50548 - RNA, 64 nt, hsa; identical to SEQ ID NO: 50146

SEQ ID NO: 50549 - RNA, 56 nt, hsa; identical to SEQ ID NO: 50147

SEQ ID NO: 50550 - RNA, 64 nt, hsa
uuccuuuuauaagauuuaauuguaauugucucaaagcaucaaauaauacaucuuuaucauuaaa

SEQ ID NO: 50551 - RNA, 64 nt, hsa
uggacugcaauaucaacaacaaguuguuucaaacagcaucaaaauacaacuucauugcuacacu

SEQ ID NO: 50552 - RNA, 64 nt, hsa
ccuuaaaaccacagauugcaaagcauagcauuuuagcaucaacuacaaucaaaagagcgauuug

SEQ ID NO: 50553 - RNA, 64 nt, hsa
aaaacugaacacgauaacacuuacucuuaaaucaagcaucaacacuuuuucccuguuagaauuc

SEQ ID NO: 50554 - RNA, 64 nt, hsa
ggccucauggaauggaaugucuccacuucacuccagcaucaacaaguggggaauucugauggau

SEQ ID NO: 50555 - RNA, 64 nt, hsa
ucaguuuauaccuugccuguaguccagucucuccagcaucaauuccaucagcacaaagacauaa

SEQ ID NO: 50556 - RNA, 64 nt, hsa
ccguuugagugucugcgccccgccuccccauacuuccugggaugaugugugaaaccugacaccu

SEQ ID NO: 50557 - RNA, 64 nt, hsa
gcaaguuucaucagcccuagggaaaacacggcccuccugggaaccuccuuaccuggaguaaccg

SEQ ID NO: 50558 - RNA, 64 nt, hsa
ccaaacucacggaccacucgaggccugcaaaccuuccugggaggacaggcaggccagauggccc

SEQ ID NO: 50559 - RNA, 64 nt, hsa
agaagcugauguuuugguguauugucagccaucguccugggacucggagacuauggccucgccu

SEQ ID NO: 50560 - RNA, 64 nt, hsa
ggguccagccaagcugugccccaucccccaagccuccugggaggauccagccaaaucuugcgac

SEQ ID NO: 50561 - RNA, 64 nt, hsa
ccagcuaugcccagugcugcaugggacccaugucuccugggacagaggccaucucucuuccaga

SEQ ID NO: 50562 - RNA, 64 nt, hsa
acaacuccuccuccuccuccuccucuccugcugcuccugggauaccaggucagugauguagucu

SEQ ID NO: 50563 - RNA, 64 nt, hsa
gagauaguaacugagcaggggcuacaaagaggucuccugggaacccugucugccccuucccacc

SEQ ID NO: 50564 - RNA, 64 nt, hsa
aggcuugguuccauuucucaccugaacagaugaguccugggagagacccucagagauccgccca

SEQ ID NO: 50565 - RNA, 64 nt, hsa
ugccucuggcagcugugcuaacagcucagugcuguccugggaguccucugacucagaacccucg

SEQ ID NO: 50566 - RNA, 64 nt, hsa
gggggccugggguucugguuaggaauucucuugauccugggauuaugcuuuauaggaugugguc

SEQ ID NO: 50567 - RNA, 64 nt, hsa
ccugacugaugcaguuuccauagcaacccauguuuccugggaaacccgaaaaagguugucaugg

SEQ ID NO: 50568 - RNA, 64 nt, hsa
cuaguacacgcccuauuuaaaaaagagcaguacauccugggaggaaaugaaacuaaagaacagu

SEQ ID NO: 50569 - RNA, 64 nt, hsa
cccaguuccacaagauccaaccaagaauucuguauccugggacagucagauucuucuaaaucag

SEQ ID NO: 50570 - RNA, 64 nt, hsa
ccacccccagcaaccccaucccagaauccuauuuuccugggaaguccuuaaagccccuaaccau

SEQ ID NO: 50571 - RNA, 64 nt, hsa
uggguacccaggaaacugcaagcauugccuguguuccugggaagaguucuaagaagcuugcauu

SEQ ID NO: 50572 - RNA, 64 nt, hsa
aaaagaaugagugggagaaauggaggggacaaucuccugggagcuaugcgcaguaaccuaacuu

SEQ ID NO: 50573 - RNA, 64 nt, hsa
cugugacugaaaggacccaggagucugggaccccuccugggauccccagcacauucuccugcuc

SEQ ID NO: 50574 - RNA, 64 nt, hsa
gaccccuccugggauccccagcacauucuccugcuccugggagaggccugggggcggugcucac

SEQ ID NO: 50575 - RNA, 64 nt, hsa
gccaauuucagcacccaacugagauccgaggagcuccugggaagcccugggugcaggacacugg

SEQ ID NO: 50576 - RNA, 64 nt, hsa
ggaagacuccccugccuccccagggccucugcucuccugggagacaaagcaauaauaaaaggaa

SEQ ID NO: 50577 - RNA, 64 nt, hsa
ugcuaaaggccucugcuucuuacuggaucuucuuuccugggacauggugucguugggaagcuua

SEQ ID NO: 50578 - RNA, 64 nt, hsa
agacucagaaauucgucuuugucuugccucugguuccugggauccagugaucucuacuggccca

SEQ ID NO: 50579 - RNA, 64 nt, hsa
gagacacugguggggagcuggcaaugaaacccuguccugggacauggguuucauguucuuguac

SEQ ID NO: 50580 - RNA, 64 nt, hsa
cacgggagcucuaggugggcacaaccaaccccucuccugggaggccccugccccacuggggaua

SEQ ID NO: 50581 - RNA, 64 nt, hsa
cugugaauccucaggcugugacgcccucagguacuccugggaaaaggagguacacagccaucau

SEQ ID NO: 50582 - RNA, 64 nt, hsa
caaagguuuaaacacccaggagaccaucagccucuccugggagcacaguuggcuacaggccucu

SEQ ID NO: 50583 - RNA, 64 nt, hsa
uuacggaagugaugggugccuguccucuccugccuccugggauucagacggugaagacugacuu

SEQ ID NO: 50584 - RNA, 64 nt, hsa
ugaguuguugcuggaagaucuaauaagcuguguuuccugggaaguggugcuuuacuuagcccug

SEQ ID NO: 50585 - RNA, 64 nt, hsa
ggaggucacugguucaggcucccuuugggcgaaauccugggagugaugcucuaaaaauccaccu

SEQ ID NO: 50586 - RNA, 64 nt, hsa
gcaggcugaguuuggagcaggguccauccggcaguccugggacggcuucccucugcuggugccc

SEQ ID NO: 50587 - RNA, 64 nt, hsa
guauaaaggggcaagagcagcuccuuuggacuauuccugggaggacucugaugcagggcgucug

SEQ ID NO: 50588 - RNA, 64 nt, hsa
gaagcagggagcaaaucccaccuuuaccccaccuuccugggaaaggccuccaaagcaaaggauc

SEQ ID NO: 50589 - RNA, 64 nt, hsa
ggaggcuuaauuacugggagucugucuaaugaaguccugggacuauuguaauggaauaugauuu

SEQ ID NO: 50590 - RNA, 64 nt, hsa
uauuauuaaauuuucaugagaauucuaaaaugaauccugggaaaugcacguuuggugauguugc

SEQ ID NO: 50591 - RNA, 64 nt, hsa
acagagcggguggcuguggcuucagccgugguccuccugggaccgguagccuucaagcuugucc

SEQ ID NO: 50592 - RNA, 64 nt, hsa
ccccaauuccccaccagccaauccaagcauuuucuccugggacccgcuccauguucagggucua

SEQ ID NO: 50593 - RNA, 64 nt, hsa
cugcgguuugcagugccagcugcacguuggagucuccugggaagcuucuaguguugaucucccu

SEQ ID NO: 50594 - RNA, 64 nt, hsa
cugcccugcacaccaccacauuggaccugugcuguccugggaggugguguuggaggccccauga

SEQ ID NO: 50595 - RNA, 64 nt, hsa
guuuucucauugaaugggggugggggcucguguguccugggaaaccccaucagucccuucauuu

SEQ ID NO: 50596 - RNA, 64 nt, hsa
accccaucagucccuucauuucuugagacucaacuccugggaggagagggucucaagaguuguc

SEQ ID NO: 50597 - RNA, 64 nt, hsa
ugccaggccucugcccaugccccuuccuuccuucuccugggacuggugaagcuaggcaucugga

SEQ ID NO: 50598 - RNA, 64 nt, hsa
gccacugggaccaggccuccuguuguggagggacuccugggacaguccuccacccuguccugug

SEQ ID NO: 50599 - RNA, 64 nt, hsa
ggggcuuccgagggucucccucgacccucugucguccugggauggcugucgggagcuguaucac

SEQ ID NO: 50600 - RNA, 64 nt, hsa
ccccaggaauggaccccccaaucacuccccacucuccugggauaaugggguccugucccaagga

SEQ ID NO: 50601 - RNA, 64 nt, hsa
aacagcuccucuuccagagcugccucugccuuuauccugggagauggggaggaagccccaucuc

SEQ ID NO: 50602 - RNA, 64 nt, hsa
ggccaaggcuuucuccaaaagugagcccggauccuccugggagcugcuccaggcaugugggaag

SEQ ID NO: 50603 - RNA, 64 nt, hsa
ccucagcuuucccuccucgcuggccugggcacccuccugggagcaggccuuccucccucccacc

SEQ ID NO: 50604 - RNA, 64 nt, hsa
cuccccacacagcugggacuggccuggauggcuguccugggagccccugcccacccugacagag

SEQ ID NO: 50605 - RNA, 64 nt, hsa
ucuggccuuuuaauuccuccucugccaggguggguccugggaccucuaaugugggcaugucguc

SEQ ID NO: 50606 - RNA, 64 nt, hsa
ccagguggacugccucucucauucccaguagcuguccugggacuuugggauuucuucucagcuu

SEQ ID NO: 50607 - RNA, 64 nt, hsa
gcagaugccagcggcccagguggcgccauugcuguccugggauggaucguggguuuugguggau

SEQ ID NO: 50608 - RNA, 64 nt, hsa
accuccuuucguugauggccaaagcaaaggagaguccugggagcccacaagauccaggcagaag

SEQ ID NO: 50609 - RNA, 64 nt, hsa
ucccaugauuuuuccacugagacaaauccuaggcuccugggaggcccuggcagaagccagaaca

SEQ ID NO: 50610 - RNA, 64 nt, hsa
uugcaguucgugaccagcugcuccagacccccgcuccugggauucgccuaccucaagccuccau

SEQ ID NO: 50611 - RNA, 64 nt, hsa
ugccagggaccuucagcucccagaggcagugugguccugggaaugugaccaacaugccagguga

SEQ ID NO: 50612 - RNA, 64 nt, hsa
aggcugaggaauuuccuggcuuccccagauaguguccugggacaugguaugcuuuggggcuggg

SEQ ID NO: 50613 - RNA, 64 nt, hsa
gguucagggcugagcccuucuuuucccucuuuuuuccugggaauauuuuguacaauauuuugua

SEQ ID NO: 50614 - RNA, 64 nt, hsa
uauuuaaaaaaaaaaaaaaaaaacucacccguuuuccugggauuuguuguaaggaguuuucacu

SEQ ID NO: 50615 - RNA, 64 nt, hsa
gugcagagugaacucugaugcaguaucagucuuguccugggagccggguccugcugcucacaag

SEQ ID NO: 50616 - RNA, 64 nt, hsa
uuuccaggaagagccagcuuuucucggagcgcaguccugggacucuccgcagccccgccccgcc

SEQ ID NO: 50617 - RNA, 64 nt, hsa
gcucaggccuggucauugccuccucagcacucccuccugggaggccuuagcucuagagugaggg

SEQ ID NO: 50618 - RNA, 64 nt, hsa
uaggaauugcagccacugggcaguugggguggcuuccugggagaugagccgcgaccagguccug

SEQ ID NO: 50619 - RNA, 64 nt, hsa
gggguggcuuccugggagaugagccgcgaccagguccugggaaggacuauggacucuuguugug

SEQ ID NO: 50620 - RNA, 64 nt, hsa
gacauuccaaauaaagaauaggccccugccuggcuccugggagauaaccucuaagccauuagaa

SEQ ID NO: 50621 - RNA, 64 nt, hsa
aaguuuccagagggaggugcuguuaucucguaccuccugggauggcgaucccuacugaacgcuu

SEQ ID NO: 50622 - RNA, 64 nt, hsa
gacuuccaggagcgugaaagcaucuuugcucaacuccugggacugaaccauauagacauggaca

SEQ ID NO: 50623 - RNA, 64 nt, hsa
agggugggagauucuccuccaguccugucucaucuccugggagaggcagacgagugaguuucac

SEQ ID NO: 50624 - RNA, 64 nt, hsa
uacucuggagauagauggagaaguguuuucagauuccugggaacagacaccagugcuccagcuc

SEQ ID NO: 50625 - RNA, 64 nt, hsa
ccucuccucuccugccgagaguggaacacgcguguccugggagcugcaucuuguguagggucca

SEQ ID NO: 50626 - RNA, 64 nt, hsa
ugcacugcguggcugcccagccagcugccuccuguccugggaggaggccuccuggguguccuca

SEQ ID NO: 50627 - RNA, 64 nt, hsa
ggcaccccagacccucuucagcuacagccacagguccugggaaagaagugggaucuagggcccu

SEQ ID NO: 50628 - RNA, 64 nt, hsa
ggcugacaguggauauucuuguacccuucuuggguccugggaucucuugaaauccccaauaaag

SEQ ID NO: 50629 - RNA, 64 nt, hsa
uguggauuuacuuuuuuuuuuuuuuuuuaaguuuuccugggauagggaugauaguguaauuguu

SEQ ID NO: 50630 - RNA, 64 nt, hsa
gggaugauaguguaauuguucaugcccacaguaauccugggaaucuuaguuuuuuccuaugauu

SEQ ID NO: 50631 - RNA, 64 nt, hsa
gggucccugcucuguugcccgagagcagucugcauccugggaccagaaugcuuuccuggaaaaa

SEQ ID NO: 50632 - RNA, 64 nt, hsa
uccugcucacucagucccgggcucugccgagugguccugggaauggcggcgggcccguccagcg

SEQ ID NO: 50633 - RNA, 64 nt, hsa
gcuccgggcaaaagcgggggcgaguguagagcgauccugggaaauccuuugauccgggagcccu

SEQ ID NO: 50634 - RNA, 64 nt, hsa
gggacaggaucccugcugcaccuuccccacccccuccugggaagugcccccucaccucagggca

SEQ ID NO: 50635 - RNA, 64 nt, hsa
gcaagagccccuuccaaagcucagcacaguuuccuccugggaugaggagaggaaucagaaaccc

SEQ ID NO: 50636 - RNA, 64 nt, hsa
agguauuuaaaauaauaauaauaaaguguuauuuuccugggauucaugauauuugauauauucg

SEQ ID NO: 50637 - RNA, 64 nt, hsa
aaaauucccaguuuugccacucucuggagccagauccugggagcugucagcaaggagcagguaa

SEQ ID NO: 50638 - RNA, 64 nt, hsa
gcugccuuagauuccgugggucaugagccaugaguccugggacaucugaggauugggauucuuu

SEQ ID NO: 50639 - RNA, 64 nt, hsa
gccgucauccccauuucaaagcagggagcugagguccugggaggggaaagugcuugccugaggu

SEQ ID NO: 50640 - RNA, 64 nt, hsa
agacgcccccuuuacccaggaggucuucagaguuuccugggaccgcgguggguggaaucccaag

SEQ ID NO: 50641 - RNA, 64 nt, hsa
ccuguguuuggucugcccuggaggugcugggcccuccugggauggguggcucagccucgaaucc

SEQ ID NO: 50642 - RNA, 64 nt, hsa
agucucugggcccugggaagagggaaggugcacguccugggaugguugcggggcccuguuuugg

SEQ ID NO: 50643 - RNA, 64 nt, hsa
aacauguagggcaagaggaugaaggaaggggcuauccugggaccuccccagcccaggaaaaacu

SEQ ID NO: 50644 - RNA, 64 nt, hsa
gacccuguccccuagggacuguccuagccaggucuccugggaaagggagaugucaggauguugc

SEQ ID NO: 50645 - RNA, 64 nt, hsa
uuguuguuccuuagaguuuucguguuacaucaccuaaagagauuucuuuuaaaaacuuucuaga

SEQ ID NO: 50646 - RNA, 64 nt, hsa
aauauccucuacacuuaguuauugauaaacuucuuaaagagaucuguuauuuucagguagugcc

SEQ ID NO: 50647 - RNA, 64 nt, hsa
augcagagguugagaggaggacuugguugauguuuaaagagaaguucccagccaagggccucgg

SEQ ID NO: 50648 - RNA, 64 nt, hsa
ugguacuauagcauuuugcuaucuuuuuuaguguuaaagagauaaagaauaauaauuaaccaac

SEQ ID NO: 50649 - RNA, 64 nt, hsa
aaccaagucugaggaaauauuuggcuucauaaaguaaagagacgguuuggcauuuauuauuacu

SEQ ID NO: 50650 - RNA, 64 nt, hsa
aauaauuuuggccucucauaguuuucucucucuuuaaagagaauaaauagagggccaggugugg

SEQ ID NO: 50651 - RNA, 64 nt, hsa
acagugaauagugcucauaaauugguagcguauauaaagagaaguuccugucacauuauauucc

SEQ ID NO: 50652 - RNA, 64 nt, hsa
acaaacagauccauguuaggacauuucugaauaauaaagagaaaagguguuucguuggguauug

SEQ ID NO: 50653 - RNA, 64 nt, hsa
aagacaaaaauuuauguuuggagccuguguucuguaaagagaagguugauuugucuuuuagcua

SEQ ID NO: 50654 - RNA, 64 nt, hsa
aaacagauaguuaugacucaaggcuuugagaauguaaagagaccaccuucacuuguugagaaau

SEQ ID NO: 50655 - RNA, 64 nt, hsa; identical to SEQ ID NO: 50653

SEQ ID NO: 50656 - RNA, 64 nt, hsa
aaacagauaguuaugacucaaggcuuugagaauguaaagagacgcccuucacauguugagaaau

SEQ ID NO: 50657 - RNA, 64 nt, hsa
acaguaguuuuuuuauugaaacuuguauuauuuuuaaagagaucuauacuauaaauauggugau

SEQ ID NO: 50658 - RNA, 64 nt, hsa
aucuuauguaaaugaaauuuugucauguuucaaauaaagagaacugaaguagaaaauagaaaug

SEQ ID NO: 50659 - RNA, 64 nt, hsa
cuguuaccuucuacagaauuuaagucugaagauguaaagagagaacaggccuuguguaacagaa

SEQ ID NO: 50660 - RNA, 64 nt, hsa
ucuuguguucccuguggucucugacccauuaggcuaaagagagacaagagaagcccccaaccug

SEQ ID NO: 50661 - RNA, 64 nt, hsa
uucuuuugaaaguaugaaaaugauuuuuacaauguaaagagagucugagaaaugcaauugcuau

SEQ ID NO: 50662 - RNA, 64 nt, hsa
aucauuuuucuuuucuucuugcauuuugugaacuuaaagagaaggaauauuuguguaggugaau

SEQ ID NO: 50663 - RNA, 64 nt, hsa
ugaaccaacccaaccccuagcucaccuccuacuguaaagagaaugcacugguccugacaauuuu

SEQ ID NO: 50664 - RNA, 64 nt, hsa
augguaaauuuuugaguuguuuguuucuguuuuguaaagagaauccuuauuggacaccagugaa

SEQ ID NO: 50665 - RNA, 64 nt, hsa
ugcugcauuuugaugaauuuuuucuagccauuuuuaaagagaaaacuaggaauugaguauuuug

SEQ ID NO: 50666 - RNA, 64 nt, hsa
aggccaccugucccacuccuacgauacgcuacuauaaagagaagacgaaauagugacauaauau

SEQ ID NO: 50667 - RNA, 64 nt, hsa
uuauuguuuuguuaauuacaccauaaugcuaauuuaaagagacuccaaaucucaaugaagccag

SEQ ID NO: 50668 - RNA, 64 nt, hsa
uaaaaauaaacugauuuaauuugcucuauaguccuaaagagaauuauauccucucauagaccaa

SEQ ID NO: 50669 - RNA, 64 nt, hsa
uuaucuuuaaagucaucugggaggugcagguaaguaaagagaaacaauuuuugucacaaaguag

SEQ ID NO: 50670 - RNA, 64 nt, hsa
ucuuuuuguuuuaacuauugucaggagauugggcuaaagagaagacgacgagaguaaggaaaua

SEQ ID NO: 50671 - RNA, 64 nt, hsa
acagucuugcacauaagugcagauuuggcucaaguaaagagaauuuccucaacacuaacuucac

SEQ ID NO: 50672 - RNA, 64 nt, hsa
ccagaagggguggcgaaggcacagcucagagacauaaagagaagaugccaaggcccccuccucc

SEQ ID NO: 50673 - RNA, 53 nt, hsa
ugaagcccuacucaauauaauaauaaagagacaaaagaggccagccacccacc

SEQ ID NO: 50674 - RNA, 64 nt, hsa
aucccuuugucaaaccuuguuucccaaauucaauuaaagagaggagagaauugaauggcguuua

SEQ ID NO: 50675 - RNA, 64 nt, hsa
agagaaagaucaacucaccugcaguuaaaccaucuaaagagaagaaagaccacuggagaccuag

SEQ ID NO: 50676 - RNA, 64 nt, hsa
acgauugcccugcauuucuaccaaguccugugaauaaagagaugggagauuugauuccgucaga

SEQ ID NO: 50677 - RNA, 64 nt, hsa
gguguauguguuugagacaagcugguuuuguugauaaagagauguuaaauaauugugaagccag

SEQ ID NO: 50678 - RNA, 64 nt, hsa
caggcaacaaagugagccccugucucuaaauaaauaaagagacaauaagccacucauucauucu

SEQ ID NO: 50679 - RNA, 64 nt, hsa
ugagaacgggaagcaaaggaauacacgugggaacuaaagagaaaaaugaccagccugggcagca

SEQ ID NO: 50680 - RNA, 64 nt, hsa
uuuucucaauuuuacugaguaggcacagaagaaaaguacagauaggcugaugguuauugccuua

SEQ ID NO: 50681 - RNA, 64 nt, hsa
agugaaugcuuagaaccuucucaaagcagucacaaguacagacacuucacuuagccuagggggc

SEQ ID NO: 50682 - RNA, 64 nt, hsa
ucuuuuaagcagacccauaccuuuccagggucaaaguacagaauagaauacauugauacaaagu

SEQ ID NO: 50683 - RNA, 64 nt, hsa
gggucaaaguacagaauagaauacauugauacaaaguacagaaaaauacuuugauuuuuaucca

SEQ ID NO: 50684 - RNA, 64 nt, hsa
acuuuacucccuccuuuuucagacuuguuuguaaaguacagaaucugaauuuagccuuuaugau

SEQ ID NO: 50685 - RNA, 64 nt, hsa
gcaccguuuuuucagugaagcucucagaauguccaguacagauguugcagauaauuccaagaac

SEQ ID NO: 50686 - RNA, 64 nt, hsa
gcucguuugaggugacaguggcuguuuaccaacuaguacagagcgauucagcguuuucaugaau

SEQ ID NO: 50687 - RNA, 64 nt, hsa
agccaggccucaucugggguagggccaagaggaaaguacagagugcccgugggggagaaguccc

SEQ ID NO: 50688 - RNA, 64 nt, hsa
cuguugggaaaaguuuauaauuuuaugaaaauuaaguacagaggcugcgaucuuagaaauaaug

SEQ ID NO: 50689 - RNA, 64 nt, hsa
gaggggaaaaaaaucuaagcugucugccacauugaguacagaaaaguuguagauuucaaauuuu

SEQ ID NO: 50690 - RNA, 64 nt, hsa
acuccgucucaaaaaauauauuuaaaaaaaaaaaaguacagaugugaugugcagaacauauugu

SEQ ID NO: 50691 - RNA, 64 nt, hsa
aaauuccuauguacuguaaagcuguacccuuaaaaguacagauguggccgggcacaguggcuca

SEQ ID NO: 50692 - RNA, 64 nt, hsa
gcucacggugaaauaagcuugccaggaggcuggcaguacagagugcagcagcgagcaaauccug

SEQ ID NO: 50693 - RNA, 64 nt, hsa
guccuguuaauucuagaucagagagcaagaaaaaaguacagaacauauccucuacgguuauuuc

SEQ ID NO: 50694 - RNA, 62 nt, hsa
uaaaacuaaccgugaccacuacuccaaacaaaacacaauaugccuaggggcacggaugaacg

SEQ ID NO: 50695 - RNA, 62 nt, hsa
cuaauguaguuagaaguuucauugucugauggacacaauaugcccuuccgguucuauucaaa

SEQ ID NO: 50696 - RNA, 62 nt, hsa
uugauaaugcuuuuccaaagugaaaauaagauacacaauaaucauugcucugugugauuaca

SEQ ID NO: 50697 - RNA, 62 nt, hsa
uuaauuguauuuuguguuuauacagguauuucacacaauaauuuguucuuaaugcagccacu

SEQ ID NO: 50698 - RNA, 62 nt, hsa
uaaaucuuaauagauuuaaugcaauuuuacagacacaauaccuucaugaauuucaaaauuca

SEQ ID NO: 50699 - RNA, 62 nt, hsa
acuugugcacugaaagcuaacagggagagguuacacaauauuuuacaguuucuuaaacauaa

SEQ ID NO: 50700 - RNA, 62 nt, hsa
uuuuucuguaauguaaauaaacuauuuauaucacacaauauaguuuuuucuuucccauguau

SEQ ID NO: 50701 - RNA, 62 nt, hsa
ucacaguggcuggacuaccgagagcuuggacuacacaauacaguauuauagacaaaagaaua

SEQ ID NO: 50702 - RNA, 62 nt, hsa
uaggguauuugauacaaucauuaauggaucauacacaauagguuuuuaaaaauuaauaacuu

SEQ ID NO: 50703 - RNA, 62 nt, hsa
uacaugaucugauacaaccauuaaugaaucauacacaauagguuuuuuaaaauuaauauuaa

SEQ ID NO: 50704 - RNA, 64 nt, hsa
aagaaaguuuaaaaauuuguguuggacuucaugcgggccacagguuggacaagcuugcccuagg

SEQ ID NO: 50705 - RNA, 64 nt, hsa
uagcuucccuggaccgcauuggaagaauuuucuugggccacauguaaaacacacuaacacuaac

SEQ ID NO: 50706 - RNA, 64 nt, hsa
uuagggcucuggaggugcuuucacucaaccaagggggccacagcacuggggagugaaacugccc

SEQ ID NO: 50707 - RNA, 64 nt, hsa
ccgugcuugucucuagacgaggggaaugggggaagggccacaaccucuguuucugugacccagc

SEQ ID NO: 50708 - RNA, 64 nt, hsa
acucaggauggucaucuuggagggaccaaggggugggccacagccauggugggaguggccugga

SEQ ID NO: 50709 - RNA, 64 nt, hsa
cacagccauggugggaguggccuggaccugcccugggccacacugacccugauacaggcauggc

SEQ ID NO: 50710 - RNA, 64 nt, hsa
gcccucacaccuccucgagugcccugggaccacugggccacagauggucaucaggggaagccac

SEQ ID NO: 50711 - RNA, 64 nt, hsa
accugcuccauagcuccgggcgcugcgucccgaggggccacagucuccauuucagcgucuugca

SEQ ID NO: 50712 - RNA, 64 nt, hsa
cgugagagagcccccaccguggacaccggcucuagggccacaggaaaaggaacguuuccaggca

SEQ ID NO: 50713 - RNA, 64 nt, hsa
acccuggaacauccccagagugaaagauggagcugggccacaucagaauaaggccuuggcccca

SEQ ID NO: 50714 - RNA, 64 nt, hsa
guaaaucacagguguccaaacuuuuggcuucccugggccacauuugaagaagaauuuucuuggg

SEQ ID NO: 50715 - RNA, 64 nt, hsa
cuucccugggccacauuugaagaagaauuuucuugggccacauaaaauacacuaacgauagcug

SEQ ID NO: 50716 - RNA, 64 nt, hsa
gcacguggccccuggguugcaccuggagcuucgggggccacagcugugggcccggcgcaugggc

SEQ ID NO: 50717 - RNA, 64 nt, hsa
acguuccuauacggccccccagacccagcuguccgggccacagacccccagcagguagcauucc

SEQ ID NO: 50718 - RNA, 64 nt, hsa
aaucagaguucccagggccagacaggcucuuccugggccacagaggggaggcaucaggaaagcu

SEQ ID NO: 50719 - RNA, 64 nt, hsa
ucucagcucccagcgaagccuccacaacagaauggggccacagggcagccgggacucccugucu

SEQ ID NO: 50720 - RNA, 64 nt, hsa
ugcagcuggugcaaaagcuguggcugccaggucugggccacauggcagcccagggggcaggaga

SEQ ID NO: 50721 - RNA, 64 nt, hsa
gggugaggcucagagagcuaaggacacuuguuuggggccacacagccgggguagaucugagccc

SEQ ID NO: 50722 - RNA, 64 nt, hsa
cccaggcuauggggacaaaggccuucaccagcaagggccacaguuggaacaguccccugggugu

SEQ ID NO: 50723 - RNA, 64 nt, hsa
ccagaggguccaggcaucccaaguccagcgugaagggccacagccccucuuggcugccaagcac

SEQ ID NO: 50724 - RNA, 64 nt, hsa
agcgcaggggccagccagggacauagccagggaggggccacaucacuucccacuggaaaucucu

SEQ ID NO: 50725 - RNA, 64 nt, hsa
uuauagcuccaaaaacaaaaauauacuuguauaugucacagagaaaaaaaaugcaaaauuuaua

SEQ ID NO: 50726 - RNA, 64 nt, hsa
gguacucguacugauaagggauuauuggaagucagucacagaauuuggaaauaaauucuagucu

SEQ ID NO: 50727 - RNA, 64 nt, hsa
uuccucuaccacuuugcuggaaagcuucacaauugucacagacaaagauuuuuguuccaauacu

SEQ ID NO: 50728 - RNA, 64 nt, hsa
auucuacuggugaaaaacaugcaaagaagaggaagucacagaaacaugucucaauucccaugug

SEQ ID NO: 50729 - RNA, 64 nt, hsa
agagaguagagucacacuuuuuuugaugaaaugagucacagagaaguuacaugacaaagauaaa

SEQ ID NO: 50730 - RNA, 64 nt, hsa
acuuaauagauuaacugucgcaaauuugaucagagucacagaguagaauuugaucagaaucaca

SEQ ID NO: 50731 - RNA, 64 nt, hsa
cuggaaauauuggauucuuggagaaaacuguucagucacagauauauucuugccuagcagugaa

SEQ ID NO: 50732 - RNA, 64 nt, hsa
auguuugggcaaagccuuugucuucaagcagaaugucacagaaggcagcuacuuuauaagcccc

SEQ ID NO: 50733 - RNA, 64 nt, hsa
caccgagguccagaggaaaagacaccugucaaaugucacagaucugggaggggacuuaagaccu

SEQ ID NO: 50734 - RNA, 64 nt, hsa
ccugcccuggcagcauggcucagacugcaugacagucacagacucgccucugcuccuguggucc

SEQ ID NO: 50735 - RNA, 51 nt, hsa
uaccgcugccaugggacuaacgucacagauuucuuuucugagaguugauga

SEQ ID NO: 50736 - RNA, 64 nt, hsa
aucuauaguugcauuguugcaaucaaaauauguugucacagaaagaauagguggaaggucauag

SEQ ID NO: 50737 - RNA, 64 nt, hsa
ggugcuuccgcugcuugaagguuuguccacauucgucacagauauaguuccgcaccucugagag

SEQ ID NO: 50738 - RNA, 64 nt, hsa
gguggguucgggcuucaccgccuggcccucuguggucacagaggggcucgguggcccagguggu

SEQ ID NO: 50739 - RNA, 64 nt, hsa
ggcucacacuuggcucugagggacagguguggcgagaccugauuucuccugcguguucucagag

SEQ ID NO: 50740 - RNA, 64 nt, hsa
agaugauuuaaugguagaacggauaccugcugcuagaccugauggaauguuaccuguccguguu

SEQ ID NO: 50741 - RNA, 64 nt, hsa
caucucuacaggcucaaaacuccucuuugauaucagaccugauguuauuuuccuucuuuuggag

SEQ ID NO: 50742 - RNA, 64 nt, hsa
uaugaugaugaucaugaucuuacuggugaauuacagaccugaugaauuuauagaaugugaagac

SEQ ID NO: 50743 - RNA, 64 nt, hsa
uuaaacauuuaaauuuagcucugauaguguguuaagaccugaauaucuuuccuaguaaaaauag

SEQ ID NO: 50744 - RNA, 64 nt, hsa
guucacaccuggucucacugccuuuccuucccacagaccugagugugaaagacugagaguugag

SEQ ID NO: 50745 - RNA, 64 nt, hsa
gcauuuggauggugucuuagaacccucauugcucagaccugaaggcuacuucuaggagcaugaa

SEQ ID NO: 50746 - RNA, 64 nt, hsa
aucaucucaguuggccaccuuccuggcaggcuguagaccugacauuuugagacaagccuagagg

SEQ ID NO: 50747 - RNA, 64 nt, hsa
caaguggacagggaaggccucugacauuuauccaagaccugaaagaugggcaaaagacgggaag

SEQ ID NO: 50748 - RNA, 64 nt, hsa
gaggcuccgcggcaggaggagccggugcucuggaagaccugaaagaagcccagguggccacagg

SEQ ID NO: 50749 - RNA, 64 nt, hsa
acaauaacacucaaugaaggauguauuaaaauuuuugacuuaauuuugaaaucguauauaugag

SEQ ID NO: 50750 - RNA, 64 nt, hsa
gccuagcauagagaaaauacuuaauacacauuuguugacuuaaauuuaauucaaggauugaaaa

SEQ ID NO: 50751 - RNA, 64 nt, hsa
auuguuaacuguagcuucagcgcgugccaagcaguugacuuaauaggaucaucuugugaauuug

SEQ ID NO: 50752 - RNA, 64 nt, hsa
cugguggaaauucaaaguuaucacugaagaacaguugacuuaaaauuggaccaagacuaugagg

SEQ ID NO: 50753 - RNA, 64 nt, hsa
caguaagcccuccugggaugucugugccaugugauugacuuacaagugaaacugucuuauaaua

SEQ ID NO: 50754 - RNA, 64 nt, hsa
cugagcauugugcaggacugauagcucuucuuuauugacuuaaagaagauucuugugaaguuuc

SEQ ID NO: 50755 - RNA, 64 nt, hsa
gaaggaacagcucaaagcaccuucacaaguugccuugacuuacccuaggugggugugaaagagc

SEQ ID NO: 50756 - RNA, 64 nt, hsa
guagccacuuuaauuuacaauuaagagccuuaguuugacuuaacacuuuuguaggcuuuucauu

SEQ ID NO: 50757 - RNA, 64 nt, hsa
ugaaaagcugcauuuaaaucaagucccaaauucauugacuuaggggaguucaguauuuaaugaa

SEQ ID NO: 50758 - RNA, 64 nt, hsa
uuaaugauaccauaaaucaauauuagaaagcuaguugacuuaaagccugaaauaaugggaguuu

SEQ ID NO: 50759 - RNA, 64 nt, hsa
acuucaucacaucuuauagguaguguguggccaauugacuuaaaaaauacaaauaacauuuagg

SEQ ID NO: 50760 - RNA, 64 nt, hsa
gaugcucccauggaauuuauaccaguuauaugaauugacuuaaguaucuugaaaaagaaacuuu

SEQ ID NO: 50761 - RNA, 64 nt, hsa
uuuccuauugggccuuccccacaauuagaauauuuugacuuaguguccugucccccuuggacgu

SEQ ID NO: 50762 - RNA, 64 nt, hsa
gacuuaguguccugucccccuuggacguuccaacuugacuuaguguccagugccccuuggacau

SEQ ID NO: 50763 - RNA, 57 nt, hsa
gcuucaaacagcgcagauaaaugcaggcaagaaaagaugccgccguugcugccguca

SEQ ID NO: 50764 - RNA, 64 nt, hsa
cuauuuuuguuuguuuauacaaauaucugauuugcaagaaaaagugcaugggagggguuuuagu

SEQ ID NO: 50765 - RNA, 64 nt, hsa
gacuugaaaaucuuaaaaaaaaaaaacaaaaaaacaagaaaaggcaacaucucauuuuaaauag

SEQ ID NO: 50766 - RNA, 64 nt, hsa
guauucauagacaaauuuuuuucaauauauuuugcaagaaaaaucuuugaauaagacuaacugc

SEQ ID NO: 50767 - RNA, 64 nt, hsa
cuuuggccauugugggaagucauuauucuggagacaagaaaaucaucacucuggugccuuggug

SEQ ID NO: 50768 - RNA, 64 nt, hsa
ugaauauuggggaaggaagaugauacuucuuucucaagaaaagaaaauuggauuauuaggaaua

SEQ ID NO: 50769 - RNA, 64 nt, hsa
ucccaaugggagcccacggaacuaaguagggucccaagaaaaaaaacgggagcuauuucacaga

SEQ ID NO: 50770 - RNA, 64 nt, hsa
gggguuccugguggauuucuuacuaccuaacgcccaagaaaaccaacuaaggacucucaaacca

SEQ ID NO: 50771 - RNA, 64 nt, hsa
gguuugaggguuugccuucuaaagucugcaacuucaagaaaaaaaaucgacacuguggauugac

SEQ ID NO: 50772 - RNA, 64 nt, hsa
uaauuaaucacauuugcaggaaauucagaugaggcaagaaaauuuuauuggccuggguaagacu

SEQ ID NO: 50773 - RNA, 64 nt, hsa
ugggcauuaaauuauacaaacugaaaauguguuacaagaaaaauaugagaguuuuaacuagaug

SEQ ID NO: 50774 - RNA, 64 nt, hsa
ucuaguuucucaaguccucagaacaguuucaaaucaagaaaacuaugugucucuguuuacugaa

SEQ ID NO: 50775 - RNA, 64 nt, hsa
auuuuguaucagugcuguuaauuugcuguugccucaagaaaaagugcuuuuucuccauggauga

SEQ ID NO: 50776 - RNA, 64 nt, hsa
uaaguuuggaaguccuugcuauucaacagaauaacaagaaaacuucagaauguaucacucuccu

SEQ ID NO: 50777 - RNA, 64 nt, hsa
ggaacucuagaauaucaagggagcaagaggaagccaagaaaacuuggguaaauaucugucuucu

SEQ ID NO: 50778 - RNA, 64 nt, hsa
uuuucuuacucuaaaauaugugguagauaguaugcaagaaaagccgggugcgguggcucaggcc

SEQ ID NO: 50779 - RNA, 64 nt, hsa
gguuguaguaaagaaauuuaaaagacacuguuuacaagaaaaaaugaauuuuguuuggacuucu

SEQ ID NO: 50780 - RNA, 64 nt, hsa
auggguagagaaacacuaaagcauucaauuuauucaagaaaaguaagcccuugaagauaucuug

SEQ ID NO: 50781 - RNA, 64 nt, hsa
agagaacaaaagcuauaccaaaagggccauguuucaagaaaauggauuuaaacauauuucccug

SEQ ID NO: 50782 - RNA, 64 nt, hsa
cugaagugaacuaugaaguaagcaacaaggaugacaagaaaaacauggggaaacagaugccuca

SEQ ID NO: 50783 - RNA, 64 nt, hsa
ggcuguucuggaaguucuagacauggcaauaaggcaagaaaaagagauuaaaugcauacagauc

SEQ ID NO: 50784 - RNA, 64 nt, hsa
caaugagaugcacgucaucauuggcucuuacagacaagaaaacuagacucagaggggcugaguc

SEQ ID NO: 50785 - RNA, 64 nt, hsa
aagucugggcaccgaaagagagcaucaaaaucaccaagaaaaacagcuucucaguuaagugaaa

SEQ ID NO: 50786 - RNA, 64 nt, hsa
gaagcagggccaaauggaaagaacacauaauaaacaagaaaaaaacagaggugaagaaaaaucc

SEQ ID NO: 50787 - RNA, 64 nt, hsa
ucaccuguucagccggcacugagaagaacgaacacaagaaaaagauaagaaauacuagaguaaa

SEQ ID NO: 50788 - RNA, 64 nt, hsa
agaccauacugacucaacauggagucucacuggccaagaaaauugccuuuaaaacucgaaaaua

SEQ ID NO: 50789 - RNA, 64 nt, hsa
auauugugaagggcaaagguuacagaaacggucccaagaaaaucuaacacccaaauuuuccuuu

SEQ ID NO: 50790 - RNA, 64 nt, hsa
gcacuccagccugggccacagagcaagacugucucaagaaaaaaaauuuuuuaaauaaguuuaa

SEQ ID NO: 50791 - RNA, 64 nt, hsa
cucauccuggagcguauucaagaucuucccaauacaagaaaauuaauaaaaaauuuauauauag

SEQ ID NO: 50792 - RNA, 64 nt, hsa
auaauuauuauuuggcaauaaugggggugggaaccaagaaaaauauuuauuuuguggaucuuug

SEQ ID NO: 50793 - RNA, 64 nt, hsa
ccuauaaaauauauagccaggaaccauuuaucaucaagaaaaguguaagaaauuauuuuugaga

SEQ ID NO: 50794 - RNA, 64 nt, hsa
agauucugcacucaaaaucuuccuuuguguaggacaagaaaauugaaccaaagcuugcuuguug

SEQ ID NO: 50795 - RNA, 64 nt, hsa
uagcaugauuuaaaaaaugaaaaaugcuaacacccaagaaaagaagauauuaagugcuuuuuaa

SEQ ID NO: 50796 - RNA, 64 nt, hsa
aagucuggauuuuaauuggcauguuauuggguaucaagaaaauuaaugcacaaaaccacuuauu

SEQ ID NO: 50797 - RNA, 64 nt, hsa
cuguaugcacacaguaugcuuaugugucauuucacaagaaaaaaggaauaauauucucuaaacc

SEQ ID NO: 50798 - RNA, 64 nt, hsa
agaggauauucuugccucauaaagaagaaaggaccaagaaaaccaaaacggaagaggagaaacu

SEQ ID NO: 50799 - RNA, 64 nt, hsa
ucaaacgaaacguaagagaagucaacaauaaaaccaagaaaagugaguauuuuuauaccaaaca

SEQ ID NO: 50800 - RNA, 64 nt, hsa
aggagcuucuaccuauggcuuauucacaacugggcaagaaaacaucauugguaagaacugcuga

SEQ ID NO: 50801 - RNA, 64 nt, hsa
ccugauauuauuucuauuuaauacucuuuucucucaagaaaaaaaaaaaaguuuguuuuuucuu

SEQ ID NO: 50802 - RNA, 64 nt, hsa
uauuccuaauaauagggauaaugcuguuuauugucaagaaaaaguaaaaucguucucuucaauu

SEQ ID NO: 50803 - RNA, 64 nt, hsa
acaacuguuuauagaauuuuauuguagauauauacaagaaaagagcgguacuuuacaugauuac

SEQ ID NO: 50804 - RNA, 64 nt, hsa
ucauguaaacauuuucucucucaccauguuuuggcaagaaaagguagaaagagaagacccagag

SEQ ID NO: 50805 - RNA, 64 nt, hsa
guuaauauucaagugaucagacuuugagugacaucaagaaaagaugauaucagguucauuuuuc

SEQ ID NO: 50806 - RNA, 64 nt, hsa
aaacuucaguuacugaccagucaagagaauuucucaagaaaaaucccagcaacguucccucuuu

SEQ ID NO: 50807 - RNA, 64 nt, hsa
cuccagccugggcgacagagcaagauuccguucccaagaaaaaaaaauuguucaacaauaaggg

SEQ ID NO: 50808 - RNA, 64 nt, hsa
auguuuaggaauuguccuuauagcauugcauacacaagaaaaacagagaaaagccugaucccug

SEQ ID NO: 50809 - RNA, 64 nt, hsa
guacugcauugcaccaugagcaagaacugcucugcaagaaaaauaucugucccuguggucugaa

SEQ ID NO: 50810 - RNA, 64 nt, hsa
gguuuuauucaaaccacaaauuauagaauccacccaagaaaauuuucuuagcauucuggaauuc

SEQ ID NO: 50811 - RNA, 64 nt, hsa
cauacuaauuuugaccuugaaagaugaauuccuucaagaaaaauaaaauaaugcuuaagauaau

SEQ ID NO: 50812 - RNA, 64 nt, hsa
uuagaaagaaaugcguuauagaaacaaguaauagcaagaaaauugauguauauuuuaaugauac

SEQ ID NO: 50813 - RNA, 64 nt, hsa
uaagcacauuucauugaccuugucucucauacuucaagaaaaggacaguacauugcuacauuac

SEQ ID NO: 50814 - RNA, 64 nt, hsa
aauuuaaggcuuuguaaaaugaagaguagaauuccaagaaaaaugagaaauaauuuuguaaaac

SEQ ID NO: 50815 - RNA, 64 nt, hsa
ccaggccaggauguuuuauuucucacaucauguccaagaaaaagaauaaauuauguucagcuua

SEQ ID NO: 50816 - RNA, 64 nt, hsa
aaguaacuuggucgagaccacucagccuugagaucaagaaaaccuaaucuucugacucccaggc

SEQ ID NO: 50817 - RNA, 64 nt, hsa
aagauaagcaaaaaaauucuucaacuccuuuuggcaagaaaacuguaacagaaaauaaauuuug

SEQ ID NO: 50818 - RNA, 64 nt, hsa
cucauaugaucuucuucaagccauuauuuuaacucaagaaaacucuagagaagaaaagugaaga

SEQ ID NO: 50819 - RNA, 64 nt, hsa
uaauacuaucauaguaauauuauuauugucaucccaagaaaaaauauauuaaaaagauauuuga

SEQ ID NO: 50820 - RNA, 64 nt, hsa
uaauacuaucauguuaauacuauuauugucaucccaagaaaaaagauauuuuaaaaauuuauuu

SEQ ID NO: 50821 - RNA, 64 nt, hsa
agauuuuuguuuuguuuuguucuuaagaacauaccaagaaaauaccagugaauuguuggauaug

SEQ ID NO: 50822 - RNA, 64 nt, hsa
uuuaaaaugauuuucucugccuugagauuugcaucaagaaaaagcaccucucuucaccugaaag

SEQ ID NO: 50823 - RNA, 64 nt, hsa
acauaaauaaccuuccuuaaguacaauuuaacuucaagaaaacaaaauuugacaacauaguuuc

SEQ ID NO: 50824 - RNA, 64 nt, hsa
gacucauagaguuuuuucugcaaugauugcaguacaagaaaaggauuauugugaggauggucug

SEQ ID NO: 50825 - RNA, 64 nt, hsa
guaauaaucgagaaugccugggcauuuuacaaaacaagaaaaaaaauacccuuuucuuuuccuu

SEQ ID NO: 50826 - RNA, 64 nt, hsa
uuuugaaaugaaaagacuuuuuaaaaaaguaaaacaagaaaaguacauucuuuagaaacuaaca

SEQ ID NO: 50827 - RNA, 64 nt, hsa
uaacuuucagguaaccagacccaucucaaagaaccaagaaaaggcuuuagcaugaaauaucuuu

SEQ ID NO: 50828 - RNA, 64 nt, hsa
ggaagguugcucuccaaaaauacacagugcagugcaagaaaaugcuaucucauuggccuacucu

SEQ ID NO: 50829 - RNA, 64 nt, hsa
cuguuguauaucauauuguaaaguaucauacugccaagaaaauaacuccuagaaaggcauuauc

SEQ ID NO: 50830 - RNA, 64 nt, hsa
ccaauuauauucuuggccaauuuuguccaacggacaagaaaaaagcaaagucaacgacaccauu

SEQ ID NO: 50831 - RNA, 64 nt, hsa
aacuuuguuuauugaaaaaaaaagaaaaagaaagcaagaaaaaaagauacuauggggucaagug

SEQ ID NO: 50832 - RNA, 64 nt, hsa
uccagugacaguguccugugacugcaaaaggggacaagaaaaucccucuuccuccaugggaugg

SEQ ID NO: 50833 - RNA, 64 nt, hsa
gaggcuuuggggccccuuaguugucccgaaaccccaagaaaaaucagaaugaggagagucaagg

SEQ ID NO: 50834 - RNA, 64 nt, hsa
cuucugcuagaaaaugcugacucacuuuuauauacaagaaaaaccuuuccacugaaaaaucccu

SEQ ID NO: 50835 - RNA, 64 nt, hsa
cuuaaaacucuggagugagaggaugccagaggaucaagaaaaggaucacaguuucuugaagaag

SEQ ID NO: 50836 - RNA, 64 nt, hsa
guaucuuuucauuuuuauauauauuuuacaguuucaagaaaacuuaguacuacuaguaucugcc

SEQ ID NO: 50837 - RNA, 64 nt, hsa
accauauuguuuaugcauauugcaugaguauuaccaagaaaaaucuuaaaaguugugaugugac

SEQ ID NO: 50838 - RNA, 64 nt, hsa
ccuuuuuguggguguugcaugcaaaucaaguggacaagaaaaaauaacaaaacaaaaaacaaga

SEQ ID NO: 50839 - RNA, 64 nt, hsa
ucaaguggacaagaaaaaauaacaaaacaaaaaacaagaaaaaaaaaacacaaaaccccguaaa

SEQ ID NO: 50840 - RNA, 64 nt, hsa
cucuggaaauccagcaguagaggaagggaccacccaagaaaacuaaaaaccaaggcaccuuacc

SEQ ID NO: 50841 - RNA, 64 nt, hsa
augcaguccacaguggccagguggccagauuuuucaagaaaagcuggauggauguuucugaguc

SEQ ID NO: 50842 - RNA, 64 nt, hsa
uguccauggucucaaacaaggggcuguuacauaacaagaaaaucaaagcugaggacagggugug

SEQ ID NO: 50843 - RNA, 64 nt, hsa
uguugcaaaggucuuuuuaaaccaguuuagauuucaagaaaaaauaaauggaaaucaucgaaaa

SEQ ID NO: 50844 - RNA, 64 nt, hsa
gaacacaagaacuuaagagaaaaagaaaccuacucaagaaaagacagaagagacagugauuugg

SEQ ID NO: 50845 - RNA, 64 nt, hsa
cccagaaaaaccaguacccuugagccuuaaucagcaagaaaauaacucuggcucauacagugua

SEQ ID NO: 50846 - RNA, 64 nt, hsa
auuguauguuagaauaauuuuauuagaauaauuucauacugaaauuauuuucuccaaauaaaaa

SEQ ID NO: 50847 - RNA, 64 nt, hsa
gauucuuccuuuuauuaaaaccagucucagauaucauacugauuuuuaagucaacacuauauau

SEQ ID NO: 50848 - RNA, 64 nt, hsa
gcagaguggaugaaggaguaagucugcccuuugccauacugaacagcuguggaccccgauuggu

SEQ ID NO: 50849 - RNA, 64 nt, hsa
uucauguauuuuaacacugggguuuucuuucuuucauacugagauuuuuuuucaguauguaucc

SEQ ID NO: 50850 - RNA, 64 nt, hsa
cccguccugaauucuuacuaaacauaagaacauucauacugaagaggaacccuaugagugugaa

SEQ ID NO: 50851 - RNA, 64 nt, hsa
cacuccaucucagaaaaaaaaaaaaaagauaauucauacugaaaagaaacucuacaaacuugaa

SEQ ID NO: 50852 - RNA, 64 nt, hsa
augguugucacacuucauuauagguaagauaguucauacugaagaaaacuucuacaagugugaa

SEQ ID NO: 50853 - RNA, 64 nt, hsa
ugaauuggugcugucaaaauauaguaauuuuuaaauuuguuaauaaugaaaacccuuaagcaug

SEQ ID NO: 50854 - RNA, 64 nt, hsa
aaugaaaguguaagaaugcuuucugauucaacaaauuuguuaucaaacuguuuccuuauccucu

SEQ ID NO: 50855 - RNA, 64 nt, hsa
uuguuacaaagaagaaaagauacagauuuggugaauuuguuacugugagguacagucaguacac

SEQ ID NO: 50856 - RNA, 64 nt, hsa
ccuaugaauuuguaguagacuuucaaaaugagugauuuguuagcuugguacuuuuaaguuugug

SEQ ID NO: 50857 - RNA, 64 nt, hsa
acuuagagaacaaagggccaaauagaguuuuuauauuuguuaugauaaaaggaaguagauguga

SEQ ID NO: 50858 - RNA, 64 nt, hsa
cauguucugagcuauaacauuugcugaauaugcaauuuguuauucuuuuauuaauggcauguaa

SEQ ID NO: 50859 - RNA, 64 nt, hsa
aacaguuuuaaggauaugauuugguuaaaaaauaauuuguuauaaaaauucuguuugcaaauua

SEQ ID NO: 50860 - RNA, 64 nt, hsa
agaacauuauaacugauuguugugaauggggugaauuuguuaaaaugaguaacuuugauaaagu

SEQ ID NO: 50861 - RNA, 64 nt, hsa
cuugagacuuguaaaccuggauauguugaaggguauuuguuaauuuuacuuuucaaagauacuu

SEQ ID NO: 50862 - RNA, 64 nt, hsa
gauuuuuaacccuuaaaaaaguggagauguauacauuuguuaacaaugccaugaaagcauuuuc

SEQ ID NO: 50863 - RNA, 64 nt, hsa
gaacuagccuuuugugaauuuuuuguacauaaguauuuguuacaaauauuuuagcaaaugcuuu

SEQ ID NO: 50864 - RNA, 64 nt, hsa
uccugugcuuucuccuuugagagauugacaaagcauuuguuaacguccuauuauuuaccuuaau

SEQ ID NO: 50865 - RNA, 64 nt, hsa
ugaaaaaauauauauuuuuuauuggaaaauucuaauuuguuaggccuugaaaguuuugugacaa

SEQ ID NO: 50866 - RNA, 64 nt, hsa
gaacaaacuccuggguuggcagcaugcacugcauauuuguuacugcugcccaccucaccuuucc

SEQ ID NO: 50867 - RNA, 64 nt, hsa
gagcuuuuuacuaauuuauuugucaguguucccuauuuguuacuuaaccaugauccuccagauu

SEQ ID NO: 50868 - RNA, 64 nt, hsa
accuuaacccugccaaaccuugauccauuuugacauuuguuaugcacuauuuuuauaucucugu

SEQ ID NO: 50869 - RNA, 64 nt, hsa
gucaggaauuaauauacuggaauaccuaccuucuauuuguuauucagaucagaucuggccuauu

SEQ ID NO: 50870 - RNA, 64 nt, hsa
acuuuggggaggagggaaggugcugauaccuucaauuuguuacuuuucaagauuuuuaaaaaua

SEQ ID NO: 50871 - RNA, 64 nt, hsa
ucauuucacaugaaagaagaaguauauuuuagaaauuuguuaaugagaguaaaagaaaauaaau

SEQ ID NO: 50872 - RNA, 64 nt, hsa
uaagaaaaguaauuuuuacucugaugugcaauacauuuguuauuaaauuuauuauuuaagaugg

SEQ ID NO: 50873 - RNA, 64 nt, hsa
uuuaguuacaggacaauaaugaaauggaguuuauauuuguuauuucuauuuuguuauauuuaau

SEQ ID NO: 50874 - RNA, 64 nt, hsa
uucaguuucuucauuuuuaaauugugauuuuuagauuuguuagucuauggaguauuuucaauuc

SEQ ID NO: 50875 - RNA, 64 nt, hsa
uaaaaguguaacauuuuuauuuaguuguguacuuauuuguuaauaauacagacauuguauguua

SEQ ID NO: 50876 - RNA, 64 nt, hsa
ugggaaagcugcagcaaagggagacuagagagagauuuguuaaaggauacaaaguuacagcuug

SEQ ID NO: 50877 - RNA, 64 nt, hsa
ccagagcauuccuuuuuauugaaaaauaaaauuaauuuguuaucagguuguuucaguuguauug

SEQ ID NO: 50878 - RNA, 64 nt, hsa
aaaaaacagaaaaagaaaaaaaagaacguugcaaauuuguuaaaaugccaaaaaggacaguuua

SEQ ID NO: 50879 - RNA, 64 nt, hsa
ggauuuggggagaguagaaggagagauuugcuugauuuguuaacuucuaccuccaacccacaaa

SEQ ID NO: 50880 - RNA, 64 nt, hsa
ugcuggcugaguggauuuuaagagaaauaauuguauuuguuaacagugucuuuuuuuaaaaagu

SEQ ID NO: 50881 - RNA, 64 nt, hsa
gaagcgggagaggaggagcacuuacucauguuguauuuguuaauggaggaugucaucuuuucau

SEQ ID NO: 50882 - RNA, 64 nt, hsa
agguuugagcuuuacacaaaaugucuucaucuguauuuguuauugucuacaauauauuugaauu

SEQ ID NO: 50883 - RNA, 64 nt, hsa
gcaguaguagaaguuuuguauaaaauuuguccuuauuuguuaauuguauauaaauguuaauuau

SEQ ID NO: 50884 - RNA, 64 nt, hsa
ucaagaaaauuaaugcacaaaaccacuuauuaucauuuguuaugaaaucccaauuaucuuuaca

SEQ ID NO: 50885 - RNA, 64 nt, hsa
augcuacuggaaguggaacuugagauagggccuaauuuguuauacauauuagccaacauguugg

SEQ ID NO: 50886 - RNA, 64 nt, hsa
augaugucagcauuuuaguaaacuuuuagacaaaauuuguuagggucauucaugaaaacuuuaa

SEQ ID NO: 50887 - RNA, 64 nt, hsa
uagcuaacugaauuuguucaguguuuuaaccuguauuuguuaaaaaagaaaaaaaaacacacau

SEQ ID NO: 50888 - RNA, 64 nt, hsa
uuuuucuuuuuuuuuuuuuugaggaaaagcaugaauuuguuaacagauuuugagucucaaccaa

SEQ ID NO: 50889 - RNA, 64 nt, hsa
caaacugcaccauagguguuuuuagacucauauaauuuguuauuuuucaaacaauagugaauaa

SEQ ID NO: 50890 - RNA, 64 nt, hsa
uugaacuucauccauagaucauacucuguacaaaauuuguuagcuaacauccuaucucauaauu

SEQ ID NO: 50891 - RNA, 64 nt, hsa
aacuauguuguuuuaagacauuuaaaaacgugaaauuuguuaucuuuguaaaaugacaaucaug

SEQ ID NO: 50892 - RNA, 64 nt, hsa
uacagcauagguuuuucauauaaaaauauucugaauuuguuaagcacugccauaauaucauuau

SEQ ID NO: 50893 - RNA, 64 nt, hsa
ucaucuaucaauuuauuaagcaggucuaucuuuaauuuguuaucucaaaccagucugcugguua

SEQ ID NO: 50894 - RNA, 64 nt, hsa
aggacuuuuuuggucuuuuaguauugaacaugaaauuuguuaucauuuaucaggauucauugau

SEQ ID NO: 50895 - RNA, 64 nt, hsa
acguuuuuucucacaucuaucugcuaguccaggaauuuguuacuaaauagauuuucuuggauau

SEQ ID NO: 50896 - RNA, 64 nt, hsa
uuucuuggauauuugguugccucaaagugcuuacauuuguuaacagauuguaaaccacauuuau

SEQ ID NO: 50897 - RNA, 64 nt, hsa
cuuuaaauucucaggucagaacauaacauuucucauuuguuaaaagcagcaagaagccugguaa

SEQ ID NO: 50898 - RNA, 64 nt, hsa
ucuuuguguguagugcagcaacaguuuggucugcauuuguuagaaguuuaacuccuaacaaccc

SEQ ID NO: 50899 - RNA, 64 nt, hsa
gcuguuucaucagcagccuaauauauacuguuaaauuuguuaaggauuucacuuugaaggauac

SEQ ID NO: 50900 - RNA, 64 nt, hsa
acacauaaucuguaccagguaugcauuaaaauauauuuguuaauuuaauauuuaaaccugagag

SEQ ID NO: 50901 - RNA, 64 nt, hsa
uuugccauauuaaaucuuccucauuuauacuauuauuuguuacguucaaucagaauccccgaaa

SEQ ID NO: 50902 - RNA, 64 nt, hsa
gagcugugggagugauuuuggccacacugucaacauuuguuagaaccagucuuuugaaagaaaa

SEQ ID NO: 50903 - RNA, 64 nt, hsa
cuauuaaaucuuaaucuuguggcaucagggaaauauuuguuacauaguaggcaauuuuuaucca

SEQ ID NO: 50904 - RNA, 64 nt, hsa
agaaaauauuauuuuaacaauguaaagcaauaugauuuguuacuauaauuaaccuguauaaaag

SEQ ID NO: 50905 - RNA, 64 nt, hsa
auuugaguuuuacauaaaauagaaauuuguuagaauuuguuagauuuuauugcaaugaugccua

SEQ ID NO: 50906 - RNA, 64 nt, hsa
acaauccauaauuugaguuuuacauaaaauagaaauuuguuagaauuuguuagauuuuauugca

SEQ ID NO: 50907 - RNA, 64 nt, hsa
aacagguuauguaaaaauauagucuggcuuuagaauuuguuaauucaccugcuuugccacagaa

SEQ ID NO: 50908 - RNA, 64 nt, hsa
ucaagauauaugauuucucuauggaaauaaaaauauuuguuagugaauugguugaguuuugauu

SEQ ID NO: 50909 - RNA, 64 nt, hsa
auuuguuagcaguuauuauccaagccagaguaggauuuguuaccaguuguuauccaaaccuaau

SEQ ID NO: 50910 - RNA, 64 nt, hsa
uagcuauugaauucaugaaaacuuuuaaguuagcauuuguuagcaguuauuauccaagccagag

SEQ ID NO: 50911 - RNA, 64 nt, hsa
uaauuauuuuaaauguguuaauacugugccuuugauuuguuagcuuuaaaguuaguuuaagacu

SEQ ID NO: 50912 - RNA, 64 nt, hsa
ucuugugacuaauuucuauaacuuaugguucggaauuuguuacuauuuacagacaccauuggaa

SEQ ID NO: 50913 - RNA, 64 nt, hsa
augaauuuauaaauuauuaaucuugauacuaaggauuuguuacuuuuuugcauauuagguuaau

SEQ ID NO: 50914 - RNA, 64 nt, hsa
uaccaguccacaugcaauuagacauauucagcauauuuguuauuuuaaaagggaggguugggag

SEQ ID NO: 50915 - RNA, 64 nt, hsa
uccuguaauugucuuuuaaaauacugauauuuuuauuuguuaauaauacuuugcccucagaaag

SEQ ID NO: 50916 - RNA, 64 nt, hsa
uggcauuuuuacuguuugugaaaguaugaaacagauuuguuaacugaacucuuaauuauguuuu

SEQ ID NO: 50917 - RNA, 64 nt, hsa
cauaucguauaccaccacuuuuucccaucaagucauuuguuaaaacuaaauguaagaaaaaucu

SEQ ID NO: 50918 - RNA, 64 nt, hsa
uaagccauguaacugaaaaucuaauuauaggagcauuuguuacugagccacagauaauacaaga

SEQ ID NO: 50919 - RNA, 64 nt, hsa
caguuaugugcugaggugauaauucauccaacauauuuguuagcauaaauauuaugcuucaguu

SEQ ID NO: 50920 - RNA, 64 nt, hsa
caggauggauucugaaauauaaauucuaaauuauauuuguuauaacuauauuuuauguuguaug

SEQ ID NO: 50921 - RNA, 64 nt, hsa
acccucuucccccugcgggcucccgggucuguccauuuguuacugugcugugcuggggauuggc

SEQ ID NO: 50922 - RNA, 64 nt, hsa
caccccaugaaacucgagcaggucucuggaagccauuuguuaaaaaaaaaaaaaaaaguuuuaa

SEQ ID NO: 50923 - RNA, 64 nt, hsa
ugaaucagugaucuaguauuuuccuuucggcaagauuuguuagguuuuuaccccuucuaaaaua

SEQ ID NO: 50924 - RNA, 64 nt, hsa
uaaauauucuggauaggaacuacuugaaauaguaauuuguuaaaagauaugacaaaaugaaaau

SEQ ID NO: 50925 - RNA, 64 nt, hsa
uguaaaauuuuugaacuuacugugucuaaucaucauuuguuagucuguaguuaaugucaacagu

SEQ ID NO: 50926 - RNA, 64 nt, hsa
cccuuucguggcagcuuugacuguuggcauagccauuuguuauguagugguagcgacuuuccug

SEQ ID NO: 50927 - RNA, 64 nt, hsa
auggaguuugacuaauuuuuucuauucaauuuguauuuguuaaacucaagccaggguugaaaga

SEQ ID NO: 50928 - RNA, 64 nt, hsa
auagaguuugacuaguuuuuucgauuagauuuguauuuguuauaaacuuguuuauggaguuuga

SEQ ID NO: 50929 - RNA, 64 nt, hsa
acagaacuuuucuacuuucagacagacugcuugcuaguuuuaugaauucagcacacgaauuaug

SEQ ID NO: 50930 - RNA, 64 nt, hsa
uauauauggaucccuuauauuuagauuuaacucguaguuuuauuugaaaguagaaaagaacucu

SEQ ID NO: 50931 - RNA, 64 nt, hsa
cuuauuguugguaggcacaucgugucaagugaaguaguuuuauagguauggguuuuuucucccc

SEQ ID NO: 50932 - RNA, 64 nt, hsa
gcuguguggaauacuaacuauauguauuuuaacuuaguuuuaauauuuucauuuuuggggaaaa

SEQ ID NO: 50933 - RNA, 64 nt, hsa
uaguauuaaugucagugacuaaaaaacuuagaguuaguuuuagggcacuuuuuauuuugagagc

SEQ ID NO: 50934 - RNA, 64 nt, hsa
uuaaaauguguaauauaccacagguugguauauuuaguuuuaaauacuuaccauaaagucuuuc

SEQ ID NO: 50935 - RNA, 64 nt, hsa
ccagucuauuaaagguguuuguuuaaaauggauauaguuuuagauuugugguaaugcuuuggua

SEQ ID NO: 50936 - RNA, 64 nt, hsa
aaaaguauaaacuggccuuaaaauuguccaauuauaguuuuauaaccagucuauuaaagguguu

SEQ ID NO: 50937 - RNA, 64 nt, hsa
aggggaaggaaaauaaaagggugugaagaaggaauaguuuuauaaucucggaagaugauaccaa

SEQ ID NO: 50938 - RNA, 64 nt, hsa
aacucaguggccauucuucugccuucccagaccuuaguuuuauaaagcauugucuguuccagag

SEQ ID NO: 50939 - RNA, 64 nt, hsa
auccuuaauaaugauagcaagugaucuuucuuuuuaguuuuagccuuccuuuuucaauaguaau

SEQ ID NO: 50940 - RNA, 64 nt, hsa
gcaauuaaaagucuuuagcuguuagcaaaccuguuaguuuuacuucugcauugaaccagccuca

SEQ ID NO: 50941 - RNA, 64 nt, hsa
uaagauuuccuuugguuguauuuagaaacacaaauaguuuuauaaucaggauugcauuugugcu

SEQ ID NO: 50942 - RNA, 64 nt, hsa
ggaggcauagugcugacauauauucagaguguuguaguuuuaagguuagcgugacuucaguuuu

SEQ ID NO: 50943 - RNA, 64 nt, hsa
uaugccagucuuggcugaaauguuuuauuuaccauaguuuuauaucugugugguguuuuguacc

SEQ ID NO: 50944 - RNA, 64 nt, hsa
caguccuaauuugaggggaaauuacugucaccacuaguuuuaauauaguacaaugaaaaaauaa

SEQ ID NO: 50945 - RNA, 64 nt, hsa
uuuaaaaguagcuuuacauaggaaggaaguggcauaguuuuaucaauaucugucaaauuaaacu

SEQ ID NO: 50946 - RNA, 64 nt, hsa
gacaccaccacaaaucaugguuaauaaaagagaguaguuuuaacuuuauuuuuauuuguuuaga

SEQ ID NO: 50947 - RNA, 64 nt, hsa
uauuuucccauugacuacuuuucauucuucacuguaguuuuaaagaagaacuguaaaugacggu

SEQ ID NO: 50948 - RNA, 64 nt, hsa
ggacauuuuuuucugccauuuucuuuugcaauuguaguuuuauguacuguuaaagaauuguauu

SEQ ID NO: 50949 - RNA, 64 nt, hsa
gacuauuuaaaaguuucauuuucuuuugcaauuuuaguuuuauguacuguuaaagaauuguacu

SEQ ID NO: 50950 - RNA, 64 nt, hsa
aaaugcaggcagcacaauauggccuaaacugccauaguuuuagaaugugaaaaaaaugcauguu

SEQ ID NO: 50951 - RNA, 64 nt, hsa
aaaaaaucgucuuacauguguacaauaugcaaauuaguuuuagauuagagagugcagccauuuu

SEQ ID NO: 50952 - RNA, 64 nt, hsa
uagacuuugucaugaccaaaaagagaaauguaaauaguuuuauaaaauacagucgaaucaccag

SEQ ID NO: 50953 - RNA, 64 nt, hsa
ugucccucuggaccgaaucucuuuaacugcuggauaguuuuagaggaauucuccugcuacuuag

SEQ ID NO: 50954 - RNA, 64 nt, hsa
aguuucuauggccuucccaccuucuguuagaaauuaguuuuaucuggcauuuuuaaacauuuaa

SEQ ID NO: 50955 - RNA, 64 nt, hsa
cugugaauauucaaaaguaauagaaucuggcauauaguuuuauugguuccuuagccaugggauu

SEQ ID NO: 50956 - RNA, 64 nt, hsa
uggugacugccuuagagggaucaguuaauuuguauaguuuuauauuuuuuguauauguuugcua

SEQ ID NO: 50957 - RNA, 64 nt, hsa
aagcaacgaguucaccuaaguaaggcucagauccuaguuuuaaaaaccauuucccauuaaaaug

SEQ ID NO: 50958 - RNA, 64 nt, hsa
acuuugagugccauugcaagcagcaucauuuaaguaguuuuauaaagaaaagaagucugauauc

SEQ ID NO: 50959 - RNA, 64 nt, hsa
uaauuaugcagcauuauccauaguaugaaaccuguaguuuuaaugguuuagaaaucuaugucuc

SEQ ID NO: 50960 - RNA, 64 nt, hsa
ucaaagaucaccagggcauaauuauaaucaaaauuaguuuuauugaugcuugcugcagcaagag

SEQ ID NO: 50961 - RNA, 64 nt, hsa
auagcuguuuuucucccaugaguaugcaaaucaauaguuuuaaccauuguuaaaaugcaaucau

SEQ ID NO: 50962 - RNA, 64 nt, hsa
uuaaucuuaaaagauuauugcuuuuuaaaguguguaguuuuaugcauguguguuuaugguuugc

SEQ ID NO: 50963 - RNA, 64 nt, hsa
aaacuaauaauacaaugucacuuuaucagaauacuaguuuuaaaagcugaauguuaauagggga

SEQ ID NO: 50964 - RNA, 64 nt, hsa
aaaagccauauuaaguauuuugcuuguuaaauucuaguuuuauguuuuaaaucucuuagugguu

SEQ ID NO: 50965 - RNA, 64 nt, hsa
cuuuucaaguaguuuuauaauagaaaaauuguaauaguuuuaaucaagauguucagggguauua

SEQ ID NO: 50966 - RNA, 64 nt, hsa
cuucaauaccaggaaguuaugccaacuuuucaaguaguuuuauaauagaaaaauuguaauaguu

SEQ ID NO: 50967 - RNA, 64 nt, hsa
accgguauaagagauucuguugugauuauuugaauaguuuuauauuaauaaaagaagacaaaau

SEQ ID NO: 50968 - RNA, 64 nt, hsa
uuuuuuuuccauagcagguauuuucuacuagaaguaguuuuacuacuuuucauuuagaacagag

SEQ ID NO: 50969 - RNA, 64 nt, hsa
ucucaaaucauauuccauuguaucaguuaacauauaguuuuaaauguauguauuauaaauaucu

SEQ ID NO: 50970 - RNA, 64 nt, hsa
uccuauauaccagcauguaccaagaauguguguguaguuuuaauuaugcugcaauguauaaucu

SEQ ID NO: 50971 - RNA, 64 nt, hsa
auuuuccccauaccacuucagacuuuagccuguuuaguuuuaaggacugaaaaugguagguuug

SEQ ID NO: 50972 - RNA, 64 nt, hsa
acagagagaauaguucuuugaaacugaaauacuuuaguuuuacugaccuuguguaaagauaaua

SEQ ID NO: 50973 - RNA, 64 nt, hsa
ucaguguuuccuguguuugggcagaagugcaaaguaguuuuaauuucucacguuguagaaaaag

SEQ ID NO: 50974 - RNA, 64 nt, hsa
gguuucauuacauauucuccuuuauugugaagaguaguuuuaccuguaaauauuagcagggacu

SEQ ID NO: 50975 - RNA, 64 nt, hsa
cugcauaaguaauuaaaauauacuuaaaaauuaauaguuuuaucuggguacaaauaaacaggug

SEQ ID NO: 50976 - RNA, 64 nt, hsa
uuuaaaucuuuucuucaacuugagucuuugaagauaguuuuaauucugcuugugacauuaaaag

SEQ ID NO: 50977 - RNA, 64 nt, hsa
aauaaggaguaagccaccuuuuauaggcacccuguaguuuuauaguucuuaaucuaaacauuuu

SEQ ID NO: 50978 - RNA, 64 nt, hsa
uauaggugcccgccaccagacccggcuaauuuuuuaguuuuaguagagacgggguuucaccacg

SEQ ID NO: 50979 - RNA, 64 nt, hsa
auucuuuagcuguacuguaauuucuuugaguugauaguuuuacaaauucuuaauagguucaaaa

SEQ ID NO: 50980 - RNA, 64 nt, hsa
uuuugcugcuacuucuguggaaguagcuuugaacuaguuuuacuuugaacuuucacgcugaaac

SEQ ID NO: 50981 - RNA, 64 nt, hsa
uugacuuucuuuuuaaagccaaagaccauaguuuuaguuuuaagccacuagguagauauuuagg

SEQ ID NO: 50982 - RNA, 64 nt, hsa
aauuuuuugacuuucuuuuuaaagccaaagaccauaguuuuaguuuuaagccacuagguagaua

SEQ ID NO: 50983 - RNA, 64 nt, hsa
uagccgacugucuugaaacuauucauuuugcuucuaguuuuauuuuacagagguagcauuggug

SEQ ID NO: 50984 - RNA, 64 nt, hsa
guucuauacuauucagguaucuuuuuauuucugauaguuuuauauuauaauagaaagccagcca

SEQ ID NO: 50985 - RNA, 64 nt, hsa
auacuuuaugcauauuacugauuuaauuugaauauaguuuuacagccuccuugacaccuauaau

SEQ ID NO: 50986 - RNA, 64 nt, hsa
gugucaugugacuuuggcacccuauagacauacuuaguuuuaacuuuucaaaguuuggccuccu

SEQ ID NO: 50987 - RNA, 64 nt, hsa
agggaauuauuugauaaccagcuuaucuuaucaguaguuuuauugcugaucaggcaaaaauagu

SEQ ID NO: 50988 - RNA, 64 nt, hsa
gcauugacuauuacaauuucauuuugguggaguuuaguuuuagguuuuauuguauauaaaaucc

SEQ ID NO: 50989 - RNA, 64 nt, hsa
ugccaguuaucuauuaaccaaaaccuuugauuuguaguuuuaaagauuaacccucaaaguucuc

SEQ ID NO: 50990 - RNA, 64 nt, hsa
ucuccacagacuggguagcaaaaaaaucaccuuuuaguuuuaguuuuuaaucuaaagauguuag

SEQ ID NO: 50991 - RNA, 64 nt, hsa
uuaccuuucaaggcauuaguaaauuacuugcaaauaguuuuaaaaggaaaauacgaccuuuguu

SEQ ID NO: 50992 - RNA, 64 nt, hsa
ccucuuacggccuagagaguugacaaguugcuuguaguuuuaaaaaaauaauaaaguauacccu

SEQ ID NO: 50993 - RNA, 64 nt, hsa
aguuaguagaucacuaugguauuucaauuuucuuuaguuuuaauugaaaauguuugcuuuuaaa

SEQ ID NO: 50994 - RNA, 64 nt, hsa
uguagaaaauaaaaaauuccucuccaaacauggguaguuuuaugucaaaauauuggcuuuucaa

SEQ ID NO: 50995 - RNA, 64 nt, hsa
aauauagauaagaaaagguggggcuauacuagcaacaaaaaaagaaugcuguuccugcaccugc

SEQ ID NO: 50996 - RNA, 64 nt, hsa
gcaaagcauuaguggcuauggucuguaaaaugaaacaaaaaaacuuuauuucacuauaagagua

SEQ ID NO: 50997 - RNA, 64 nt, hsa
uccugcuggaaaucagaaaauauaauaaaauugcacaaaaaaaaaaaugaaaaagaugcagacu

SEQ ID NO: 50998 - RNA, 64 nt, hsa
uauuuguuuuugagauggagucucuacuaaaaauacaaaaaauuagccaggcauggugccgcau

SEQ ID NO: 50999 - RNA, 64 nt, hsa
gccaauauggugaaaccccaucucuacuaagaauacaaaaaauuagcugagcaugguggugggc

SEQ ID NO: 51000 - RNA, 64 nt, hsa
aaauguguucagaggaaauagaauguaaaacaucacaaaaaaaauugcaguacauaaaauuucu

SEQ ID NO: 51001 - RNA, 64 nt, hsa
ucaugacuuuuuuuuuuaaauaaagugaguuucaacaaaaaaaaaacugaaaauucuacauugc

SEQ ID NO: 51002 - RNA, 64 nt, hsa
acuguuuuuaaugguaaaaaaaaaaaaaaaaaauacaaaaaaaaauucugaaggacaaaaaagg

SEQ ID NO: 51003 - RNA, 64 nt, hsa
aaaaaaaaaaaaauacaaaaaaaaauucugaaggacaaaaaaggugacugcugaacugugugug

SEQ ID NO: 51004 - RNA, 64 nt, hsa
caucaccaucguguuugcaaagguuaaaacaaaaacaaaaaaccacaaaaauaaaaaacaaaaa

SEQ ID NO: 51005 - RNA, 64 nt, hsa
uuaaaacaaaaacaaaaaaccacaaaaauaaaaaacaaaaaaaacaaaaaacccaagaaaaaaa

SEQ ID NO: 51006 - RNA, 64 nt, hsa
aaacaaaaaaccacaaaaauaaaaaacaaaaaaaacaaaaaacccaagaaaaaaaaaaagaguc

SEQ ID NO: 51007 - RNA, 64 nt, hsa
accagccgggccaacauggugaaaccccaucucuacaaaaaauacaaaaauuagccuggcauau

SEQ ID NO: 51008 - RNA, 64 nt, hsa
cgacugagcgagacucuaucucaaaacaaucaaaacaaaaaagaccuguggacucuaguagauu

SEQ ID NO: 51009 - RNA, 64 nt, hsa
uauuucaucuuuugaugugacuuuucacuaguuuacaaaaaaaagguugguggucaacaaaaaa

SEQ ID NO: 51010 - RNA, 64 nt, hsa
uuucacuaguuuacaaaaaaaagguugguggucaacaaaaaaagcaagucauagcaguucagug

SEQ ID NO: 51011 - RNA, 64 nt, hsa
gagaugcgccugggcaacauagaaaccugugucuacaaaaaauuuaaaaauuagccaaguaugg

SEQ ID NO: 51012 - RNA, 64 nt, hsa
gcuaacacggugaaacuccaucucuacuaaaaauacaaaaaauuggccgggcgcagcggcucac

SEQ ID NO: 51013 - RNA, 64 nt, hsa
cugucucaaaaaaacaaaacaaacaaacaaaaauacaaaaaauuagccgggcgugguggcaccu

SEQ ID NO: 51014 - RNA, 64 nt, hsa
uuguuguuuucguuuugaacuuauccuuccucccacaaaaaaagaaaagaagaaaaaauuccaa

SEQ ID NO: 51015 - RNA, 64 nt, hsa
ccaccagaagacuugaaaaucuuaaaaaaaaaaaacaaaaaaacaagaaaaggcaacaucucau

SEQ ID NO: 51016 - RNA, 64 nt, hsa
ggcaacauggugaaacccccgucucuacuaaaauacaaaaaaauuagccaggcauaguggcgcg

SEQ ID NO: 51017 - RNA, 64 nt, hsa
uaauccucaguuccacgagacugcccacccacagacaaaaaaauauauauauuccuaaagucgg

SEQ ID NO: 51018 - RNA, 64 nt, hsa
aaauacaaccuagggugccuuaaaaauaacaacaacaaaaaaccugugugcaucuggcugacac

SEQ ID NO: 51019 - RNA, 64 nt, hsa
cacacccggcuaauuuuuuguguuuuuacaaaauacaaaaaaguagagacaggauuucacugug

SEQ ID NO: 51020 - RNA, 64 nt, hsa
ggcuaacacagugaaacguguuuuuacuaaaaguacaaaaaacuagcugggcgugguggcagga

SEQ ID NO: 51021 - RNA, 64 nt, hsa
gcuaacauggugaaacccugucucuacuaaaaauacaaaaaaaauuagccagccaugguggcgg

SEQ ID NO: 51022 - RNA, 64 nt, hsa
aacacggugaaaccccgucucuacuaaaaaaaauacaaaaaaauuagccaggcguggucguggg

SEQ ID NO: 51023 - RNA, 64 nt, hsa
uaguccugagcaaaaaaaaaaaaaaaacaaaaaaacaaaaaaaaaacaaaacaguuuuuaaaac

SEQ ID NO: 51024 - RNA, 64 nt, hsa
aaagcaaauaguccugagcaaaaaaaaaaaaaaaacaaaaaaacaaaaaaaaaacaaaacaguu

SEQ ID NO: 51025 - RNA, 64 nt, hsa
cccaccuccucauuuuaguaaaaaacaaacaaaaacaaaaaaaccugagaaguuugaauuguag

SEQ ID NO: 51026 - RNA, 64 nt, hsa
uucacauguggaaacuuucagggugguugguuuaacaaaaaaaaaaagcuuuaaaaaaaaaaga

SEQ ID NO: 51027 - RNA, 64 nt, hsa
caccugggcacuuuuagauaaaaaaaaaaaaaaaacaaaaaacaacaccaaaaaaacagcagug

SEQ ID NO: 51028 - RNA, 64 nt, hsa
ucaaccacucuccuaaugauuggaacaaaagcaaacaaaaaagaaaucucucuauaaaaugaau

SEQ ID NO: 51029 - RNA, 64 nt, hsa
auucuuuggaaaaaaacaaaaaacaaaaaaaacaacaaaaaaagcuaaguuauaagugaacugu

SEQ ID NO: 51030 - RNA, 64 nt, hsa
uuuuaaggaacuauucuuuggaaaaaaacaaaaaacaaaaaaaacaacaaaaaaagcuaaguua

SEQ ID NO: 51031 - RNA, 64 nt, hsa
gcauccauuuuaaggaacuauucuuuggaaaaaaacaaaaaacaaaaaaaacaacaaaaaaagc

SEQ ID NO: 51032 - RNA, 64 nt, hsa
uggugaaaccccaucucuacaguuuuguaaaaauacaaaaaauuaccugggccugguggcacac

SEQ ID NO: 51033 - RNA, 64 nt, hsa
agccugggcgacagagcaagacgccaucucaaaaacaaaaaaacaaaauucauguuacuaaaag

SEQ ID NO: 51034 - RNA, 64 nt, hsa
uuucauaaggaaaaccacuguuugaauaagccgcacaaaaaauaaaguuaagucugagacucua

SEQ ID NO: 51035 - RNA, 64 nt, hsa
cuagaaacagauguuuucaguguugcugagagaaacaaaaaauuuccuaaugcaucugagagau

SEQ ID NO: 51036 - RNA, 64 nt, hsa
aggacccgguuucuuuuacugauuuaaaaacaaaacaaaaaaaaauaaaaaaguugugccugaa

SEQ ID NO: 51037 - RNA, 64 nt, hsa
agcagugugauaauuuaaacauauuuaaacaaaaacaaaaaaaaugaaugcacaaacuugcugc

SEQ ID NO: 51038 - RNA, 64 nt, hsa
ccuuauucuuaagaauagugcuuguuuauucaguacaaaaaaaaugcugaaaggcagcguuuuu

SEQ ID NO: 51039 - RNA, 64 nt, hsa
aaaucccaucaacaaaaugcugugaacaacaacaacaaaaaauaaaucaagaaggcauagcugu

SEQ ID NO: 51040 - RNA, 64 nt, hsa
acagaacaagaacccaucucaaacaaacaaacaaacaaaaaaaaaaaacucuugucuccuuagg

SEQ ID NO: 51041 - RNA, 64 nt, hsa
gggcaacacgaugaaacuccgucucuacuaaaauacaaaaaauuauccaggcaugguggcguac

SEQ ID NO: 51042 - RNA, 64 nt, hsa
ucacuugccuagucuugaagaaaaaaaacaaaaaacaaaaaaaaaccuuguuccuuuauagguu

SEQ ID NO: 51043 - RNA, 64 nt, hsa
cacugcuucacuugccuagucuugaagaaaaaaaacaaaaaacaaaaaaaaaccuuguuccuuu

SEQ ID NO: 51044 - RNA, 64 nt, hsa
ugcacuuuuaugaaguuuuuaaaaauaaaggaaaacaaaaaacuuuacugaguguuauaaguau

SEQ ID NO: 51045 - RNA, 64 nt, hsa
aagaaguuaauucuuaaaacuauaacauuauauaacaaaaaagguuucccaaaacaaucuauuu

SEQ ID NO: 51046 - RNA, 64 nt, hsa
aaaaagacaaaaaaaaaccaaaaaaaaaaaaccuacaaaaaaaacuuuguugcuaggauuaagg

SEQ ID NO: 51047 - RNA, 64 nt, hsa
gaauagcccaaauguuuuaaacgcaaaaaaaaagacaaaaaaaaaccaaaaaaaaaaaaccuac

SEQ ID NO: 51048 - RNA, 64 nt, hsa
cgagacucuaucucaaaaaaaaacaaaaaaaaaaacaaaaaacaaagaugagucgcacaucugc

SEQ ID NO: 51049 - RNA, 64 nt, hsa
ugggcaacagagcgagacucuaucucaaaaaaaaacaaaaaaaaaaacaaaaaacaaagaugag

SEQ ID NO: 51050 - RNA, 64 nt, hsa
gccaacauggugaaaccccgucucuacuaaagauacaaaaaauuagccgggcgugguggugcau

SEQ ID NO: 51051 - RNA, 64 nt, hsa
uaagagaacuuaaagaacuggugauuuuuuuuuaacaaaaaaagggaccauugcaacuuuuguu

SEQ ID NO: 51052 - RNA, 64 nt, hsa
ggagcuugaaaaaaugcagacuguacaaacgcuuacaaaaaaaaaaacugugaacugacuuaag

SEQ ID NO: 51053 - RNA, 64 nt, hsa
uggaaugucaggucuuaaggcauuuaauugagggacaaaaaaaaaaaaagccgauauaguagcu

SEQ ID NO: 51054 - RNA, 64 nt, hsa
acuagccugggcaacauagugagacaccggaucuacaaaaaaauaaaaagccagacugguggua

SEQ ID NO: 51055 - RNA, 64 nt, hsa
aguucuagacuagccugggcgagacuucaucucuacaaaaaaagcaacaacgacaaaaaaaauu

SEQ ID NO: 51056 - RNA, 64 nt, hsa
gcgagacuucaucucuacaaaaaaagcaacaacgacaaaaaaaauuagccaagcauaguggcac

SEQ ID NO: 51057 - RNA, 64 nt, hsa
uccaaucugggcaacauggggaaaccccagcucuacaaaaaaaauuagccuggugugguggcac

SEQ ID NO: 51058 - RNA, 64 nt, hsa
gccaacaugacgaaaccccaucucuacuaaaaagacaaaaaauuagcugggcaugguggcauau

SEQ ID NO: 51059 - RNA, 64 nt, hsa
aacagagcaagacugucucaaaaaacaaaacgaaacaaaaaaagaaaguuauucuuaguaagga

SEQ ID NO: 51060 - RNA, 64 nt, hsa
ugaaacaagaagguuauugcagcaaaaaucaguaacaaaaaauaguaacaauaccuugcagagg

SEQ ID NO: 51061 - RNA, 64 nt, hsa
aaacugagguagcgacacaaaguuaaacaaacaaacaaaaaacacaaaacauaauaaaacacca

SEQ ID NO: 51062 - RNA, 64 nt, hsa
aaggcacaacacaaaaaccaacacaaaacauaacacaaaaaagaagcuaccuaugauccuggau

SEQ ID NO: 51063 - RNA, 64 nt, hsa
caugcucuuguuucucaaaaaagaaaaacaaaaaacaaaaaacaggggccaauaaauucccuaa

SEQ ID NO: 51064 - RNA, 64 nt, hsa
aguaucucaugcucuuguuucucaaaaaagaaaaacaaaaaacaaaaaacaggggccaauaaau

SEQ ID NO: 51065 - RNA, 64 nt, hsa
gagaaaaggguguuuuaaauuuaaaaaaauaaaaacaaaaaaguuugauugagacaaugaagag

SEQ ID NO: 51066 - RNA, 64 nt, hsa
ugagaaugugcuuuguaagauccacccccugcccacaaaaaauugcuccuaacuccaccgccua

SEQ ID NO: 51067 - RNA, 64 nt, hsa
gccaacauggugaaaccccauuucuacuaaaaauacaaaaaauuagccaagugugguggcauau

SEQ ID NO: 51068 - RNA, 64 nt, hsa
uagcaaaugaguuuuagcggggacaaaaaaucaaacaaaaaagugaaugcuuagaaccuucuca

SEQ ID NO: 51069 - RNA, 64 nt, hsa
gaaagaaugagcuagcaaaugaguuuuagcggggacaaaaaaucaaacaaaaaagugaaugcuu

SEQ ID NO: 51070 - RNA, 64 nt, hsa
aaagaaaaaauuuccagaagaggaaaaaaaaacuacaaaaaacaaaacauugaagguugauauu

SEQ ID NO: 51071 - RNA, 64 nt, hsa
uaggagcuuauggucaaaaagugcaaaaaaaaaaacaaaaaaaaagcaauagauagagaaauug

SEQ ID NO: 51072 - RNA, 64 nt, hsa
aaacaaacaaacaaaaacaaauuuuaagaacacaacaaaaaagauuugacuuccgaauagaaug

SEQ ID NO: 51073 - RNA, 64 nt, hsa
uuugacaaaaauguguacuguguaagccuugcaaacaaaaaacaacaaaaaagaagcagcagca

SEQ ID NO: 51074 - RNA, 64 nt, hsa
auguguacuguguaagccuugcaaacaaaaaacaacaaaaaagaagcagcagcagcagccugcu

SEQ ID NO: 51075 - RNA, 52 nt, hsa
auuuauuguaucccauguaaaaacaaaaaaacaaaaaacaaagaaaagaaag

SEQ ID NO: 51076 - RNA, 60 nt, hsa
auuuauuguaucccauguaaaaacaaaaaaacaaaaaacaaagaaaagaaagagauuuua

SEQ ID NO: 51077 - RNA, 64 nt, hsa
acuaacauggugaaaucccgucucuacuaaaaauacaaaaaaaaaaaaaaaaaaaagccaggca

SEQ ID NO: 51078 - RNA, 64 nt, hsa
ucucaaugaaaaauguaaaaguaccuagaaauucacaaaaaaauuaauaccucuguggagaaaa

SEQ ID NO: 51079 - RNA, 64 nt, hsa
gccaacauggugaaauccugccucuacuaaaaauacaaaaaaaaaaaaaaauuagcugggcaug

SEQ ID NO: 51080 - RNA, 64 nt, hsa
cacagucugagcaacauggcaaaacccugugucuacaaaaaauaaaaaauuagcugggcaugac

SEQ ID NO: 51081 - RNA, 64 nt, hsa
gaagaaaagcaauuauuucauuucagauagaaauacaaaaaaaaaaaaaauacuuuucuuagaa

SEQ ID NO: 51082 - RNA, 64 nt, hsa
accagccugggcaacauagugagacuccgucucuacaaaaaauaaauuuagcugggcauggugg

SEQ ID NO: 51083 - RNA, 64 nt, hsa
auucaaaagggauugccauuucugagacacaguaacaaaaaaaugaggaaauuauuuugcuucu

SEQ ID NO: 51084 - RNA, 64 nt, hsa
uuuuauuagauuuuaccaaugaauuuuucaaaauacaaaaaaaaguaguuuuuccuucauaaca

SEQ ID NO: 51085 - RNA, 64 nt, hsa
cauuuuucaaaacuacugcauguuuaaaacuucaacaaaaaaagagagaaagaacuauacuaag

SEQ ID NO: 51086 - RNA, 64 nt, hsa
aucaguuucugccaauuucagugguuuauuguucacaaaaaaaucuucaaaacaaguauugacu

SEQ ID NO: 51087 - RNA, 64 nt, hsa
guucaaauuauaucuaaacaaaaaagaauaagaaacaaaaaacacauuaaaauuuuaaguugua

SEQ ID NO: 51088 - RNA, 64 nt, hsa
aaaagaaaagaaacaugguucaaauuauaucuaaacaaaaaagaauaagaaacaaaaaacacau

SEQ ID NO: 51089 - RNA, 64 nt, hsa
gccaacauggcgaaaccccauuucuacuaaaaauacaaaaaaauuagcugggagugguggcaua

SEQ ID NO: 51090 - RNA, 64 nt, hsa
gucucugacgguggguccaggaccagaccucucuacaaaaaauugccccaacuacaguuugcaa

SEQ ID NO: 51091 - RNA, 64 nt, hsa
aacagcuuggacaucaugacgaaaccccaucuccacaaaaaaauucaaaaaauuagccaggugu

SEQ ID NO: 51092 - RNA, 64 nt, hsa
gccagcauggcgaaaccccaucucuacuaaaaauacaaaaaauuagcugggcaugguggcaguu

SEQ ID NO: 51093 - RNA, 64 nt, hsa
aaaccuuuuaaggaugccaagaaugcauuauuccacaaaaaaacagcagaccaacauauagagu

SEQ ID NO: 51094 - RNA, 64 nt, hsa
aaaggggaauucucuuuuccuauauauguuccuuacaaaaaaaaaaaaaaaagaaaucaagcag

SEQ ID NO: 51095 - RNA, 64 nt, hsa
cuucaucuuauucuucauguaaucccaccuucuaacaaaaaauaaauaaauauuuaaauuccaa

SEQ ID NO: 51096 - RNA, 64 nt, hsa
gaggcucgaggaagcugacuucuuaggcuaaaggacaaaaaaaucucuuuaccuccuuggccau

SEQ ID NO: 51097 - RNA, 64 nt, hsa
ucuagcuacuggccucuaaauacaacccuucuuuacaaaaaaaucuuuuaaaaaaaaguaaaaa

SEQ ID NO: 51098 - RNA, 64 nt, hsa
ugaacaaaacaaaacaacaacaaaaaacaaacaaacaaaaaagcuauggcacuagaauuuaaga

SEQ ID NO: 51099 - RNA, 64 nt, hsa
uuucucucuuucuuaugaacaaaacaaaacaacaacaaaaaacaaacaaacaaaaaagcuaugg

SEQ ID NO: 51100 - RNA, 64 nt, hsa
guccccauuacuaaaaaacccaaaaggccaaaaaacaaaaaaguuagaguucgaggaauuacca

SEQ ID NO: 51101 - RNA, 64 nt, hsa
aucagccugggaaacauagugagaccccgucucuacaaaaaauauaaaaauuaguuaggugugg

SEQ ID NO: 51102 - RNA, 64 nt, hsa
gggugaccgagugagacuguuucuaaaaauaaaaacaaaaaauaaauuucuucuugaggugggg

SEQ ID NO: 51103 - RNA, 64 nt, hsa
ccagccugggcaacauagcgagacccccauugcuacaaaaaauuuaaaaaugaaacaagugugg

SEQ ID NO: 51104 - RNA, 64 nt, hsa
aggcuugcugcuacucauuaacccaaauauuuguacaaaaaacuaaagagucucauugaacgaa

SEQ ID NO: 51105 - RNA, 64 nt, hsa
uuaauuauagcuuugaaagauaaaaaaaaaaaaaacaaaaaaaaacucaguaugaaaaaauaca

SEQ ID NO: 51106 - RNA, 64 nt, hsa
aguuuuccguuguuaaaaagcaaacaaaaaaccaacaaaaaauccaagugugccuugaauugua

SEQ ID NO: 51107 - RNA, 64 nt, hsa
aauggaguauaaguuuuccguuguuaaaaagcaaacaaaaaaccaacaaaaaauccaagugugc

SEQ ID NO: 51108 - RNA, 64 nt, hsa
accagccugggcaacauagcaaaacccugucucuacaaaaaauacuuuccguacauuagugguu

SEQ ID NO: 51109 - RNA, 64 nt, hsa
uguaauuccauguggauaucaguuaccaaacauuacaaaaaaauuuuauggcccaaaaugacca

SEQ ID NO: 51110 - RNA, 64 nt, hsa
auacguuuugguguugcuuuucaaauguuugaaaacaaaaaaaauguuaagaaauggguuucuu

SEQ ID NO: 51111 - RNA, 64 nt, hsa
aucugaaguaugguauuacaaaacaaacaaacaaacaaaaaacccauguguuaaaauacucagu

SEQ ID NO: 51112 - RNA, 64 nt, hsa
gagagguuuuuuuuuuuaauuuuucccccuuuauacaaaaaaaaaagaacauuuccaaaacuaa

SEQ ID NO: 51113 - RNA, 64 nt, hsa
acuccgucccaaaaaaacaaacaaacaaaacaaaacaaaaaaaaacagaaguuacaaaugaaua

SEQ ID NO: 51114 - RNA, 64 nt, hsa
gaguucaagaccaaccuggugaaaccccgucucuacaaaaaaacacaaaaaauagccaggcaug

SEQ ID NO: 51115 - RNA, 64 nt, hsa
ccaaccuggugaaaccccgucucuacaaaaaaacacaaaaaauagccaggcaugguggcgugua

SEQ ID NO: 51116 - RNA, 64 nt, hsa
uuuagaaaaaaaagacaaaaaaguaaaaauaaaaacaaaaaaguuggaaggcagaaaccauuaa

SEQ ID NO: 51117 - RNA, 64 nt, hsa
ucaaccaacuuagugacuuguuuagaaaaaaaagacaaaaaaguaaaaauaaaaacaaaaaagu

SEQ ID NO: 51118 - RNA, 64 nt, hsa
uagucacaguccggaagagaugauagaugcauagacaaaaaauuaugggauguaacuaaugcuu

SEQ ID NO: 51119 - RNA, 64 nt, hsa
guauauauguauauauuuaauaaagaguacuuguacaaaaaagcuuaucauaaauuauuucaug

SEQ ID NO: 51120 - RNA, 64 nt, hsa
cugucucuaaaaagcauauugagacucugucucuacaaaaaaauuuuaaaaaguaaaaauuagc

SEQ ID NO: 51121 - RNA, 64 nt, hsa
ucucauccuaauuaaggugacuauuuucaaaaagacaaaaaauaugacagccguggugguucau

SEQ ID NO: 51122 - RNA, 64 nt, hsa
agggauggaccagacugccacagcagcucauagcacaaaaaaagguuaagaaguccuaguugac

SEQ ID NO: 51123 - RNA, 64 nt, hsa
gauaccauuauauuuauaugagcuauguacugccacaaaaaaagaugaaauguaauuucuaaau

SEQ ID NO: 51124 - RNA, 64 nt, hsa
guguggaaagccacaucacaaaaaaagccacaucacaaaaaaaagccagugccuauugaguaua

SEQ ID NO: 51125 - RNA, 64 nt, hsa
ucuggacuucuacaauaguguggaaagccacaucacaaaaaaagccacaucacaaaaaaaagcc

SEQ ID NO: 51126 - RNA, 64 nt, hsa
aaugcaguuuuauuuuuaucauucugguaaaaaaacaaaaaauagaagcaaaacacauuguauu

SEQ ID NO: 51127 - RNA, 64 nt, hsa
auuugcuugauuuguuaacuucuaccuccaacccacaaaaaagauauuugaucugaguuucuau

SEQ ID NO: 51128 - RNA, 64 nt, hsa
auuuguaguaaaacuuaaaaagcaaaaacaaaaaacaaaaaagaccuuccugugauacuuuauu

SEQ ID NO: 51129 - RNA, 64 nt, hsa
gucacucauuuguaguaaaacuuaaaaagcaaaaacaaaaaacaaaaaagaccuuccugugaua

SEQ ID NO: 51130 - RNA, 64 nt, hsa
uaagguauaaggaucuuuuguaaaugagacacauacaaaaaaaaucuuuaaugguuaauaggau

SEQ ID NO: 51131 - RNA, 64 nt, hsa
uggggcauuaauauucuuuuguuauuaaaaaaacacaaaaaaauaauaaaaaaauauauacaga

SEQ ID NO: 51132 - RNA, 64 nt, hsa
caacacaccacucauuggaaaauggaaaaaaaaaacaaaaaaaaaacaaaaaaauguacaaugg

SEQ ID NO: 51133 - RNA, 64 nt, hsa
ucauuggaaaauggaaaaaaaaaacaaaaaaaaaacaaaaaaauguacaauggaugcauugaaa

SEQ ID NO: 51134 - RNA, 64 nt, hsa
caucuuucuuuggaugggacuagagcuuucuuucacaaaaaagaaguaggggaagacaugcagc

SEQ ID NO: 51135 - RNA, 64 nt, hsa
augcacauauauauauguauuuaaaaaaaucaaaacaaaaaaaaacucauuuauaccuguguau

SEQ ID NO: 51136 - RNA, 64 nt, hsa
gucuacauggugaaaccccaucucaacuaaaaauacaaaaaauacaaaaaauuagccgggcgcg

SEQ ID NO: 51137 - RNA, 64 nt, hsa
gugaaaccccaucucaacuaaaaauacaaaaaauacaaaaaauuagccgggcgcgguggcucac

SEQ ID NO: 51138 - RNA, 64 nt, hsa
accagccuggccaauauggugaaacccugucucuacaaaaaauacaaaaauuagcugggcaugg

SEQ ID NO: 51139 - RNA, 64 nt, hsa
gugugguaguauuuuguuggaagagaauguuuauacaaaaaaugaaauucuuccaacagcagag

SEQ ID NO: 51140 - RNA, 64 nt, hsa
gcuaacacugugaaaccccgucucuacuaaaaauacaaaaaauuagcggggcaugguggcacgc

SEQ ID NO: 51141 - RNA, 64 nt, hsa
ggugacagagcgagacuccgucucaaacaaacaaacaaaaaacuguuuucauuugcucucuuga

SEQ ID NO: 51142 - RNA, 64 nt, hsa
cuuuacuaugugcuaggauaucauauuuaaaaggacaaaaaaauguaaaauacuugaaugagcu

SEQ ID NO: 51143 - RNA, 64 nt, hsa
uguaauuugugguaauuaugcuuuucuuuuuaauacaaaaaaauguauaaaaauaaacacuuga

SEQ ID NO: 51144 - RNA, 64 nt, hsa
gcuaacauggugaaacccugccucuacuaaaaauacaaaaaaaaacaaaauuagccgggcgugg

SEQ ID NO: 51145 - RNA, 64 nt, hsa
cugggcgacagagugagacuccaucucaaaacaaacaaaaaaaggauggggcugggcuggagag

SEQ ID NO: 51146 - RNA, 64 nt, hsa
accagccuggucaacaugucaaaacccuguaccuacaaaaaaauacaaaaguuaaccaagccua

SEQ ID NO: 51147 - RNA, 64 nt, hsa
auugaaaauaucccuuaggaaaaaaaaaaaacacacaaaaaaccacaagagccccagccaguuu

SEQ ID NO: 51148 - RNA, 64 nt, hsa
aaaaaagaaaauauguaauauaauguaaaaaaaaacaaaaaaaagcuuuuaugauggauuuugu

SEQ ID NO: 51149 - RNA, 64 nt, hsa
auacugugagccagagagaaaguaaaagcacuucacaaaaaaaugaaaauucuaaggacauaca

SEQ ID NO: 51150 - RNA, 64 nt, hsa
ugagaguuuuuacagcucaucauucaaauaacgcacaaaaaacaaaagccgcuaugaccggcgu

SEQ ID NO: 51151 - RNA, 64 nt, hsa
gcuaacacggugaaaccccgucucuacuaaaaauacaaaaaaaauuagucggaugugguggcag

SEQ ID NO: 51152 - RNA, 64 nt, hsa
uuucccugagaaagggaauuaugaaauuuuuaauacaaaaaauaauccauuuaggugcugaguu

SEQ ID NO: 51153 - RNA, 64 nt, hsa
accaauauggugaaaccccaucucuacuaaaauuacaaaaaaaauuauccaggcgugguggugc

SEQ ID NO: 51154 - RNA, 64 nt, hsa
gcgacugaggcuggaagaugauauggauuggaacacaaaaaaucuuuuuuuaaucuuuuuaaaa

SEQ ID NO: 51155 - RNA, 64 nt, hsa
uucuccucucccugacuggugucagauucaucaaacaaaaaauaaaucucgaagaaaaaaaaug

SEQ ID NO: 51156 - RNA, 64 nt, hsa
gauauacugugggaugaguaucucaggguaaguaacaaaaaaacaaacaaaaaaaaucacugaa

SEQ ID NO: 51157 - RNA, 64 nt, hsa
gaugaguaucucaggguaaguaacaaaaaaacaaacaaaaaaaaucacugaaauuuuucccuca

SEQ ID NO: 51158 - RNA, 64 nt, hsa
aaccuuuguucugggauuuacuguuaaaaaacaaacaaaaaacaacaaaaaagcggugacagga

SEQ ID NO: 51159 - RNA, 64 nt, hsa
cugggauuuacuguuaaaaaacaaacaaaaaacaacaaaaaagcggugacaggaaacaguuaag

SEQ ID NO: 51160 - RNA, 64 nt, hsa
gccaacauggugaaaccccaucucuacuaaaaauacaaaaaauuagcugggcaugcacuuguaa

SEQ ID NO: 51161 - RNA, 64 nt, hsa
ggcaugguggaauaaccaaaauguguaucauucuacaaaaaaauaggccuggacuauuuaagga

SEQ ID NO: 51162 - RNA, 64 nt, hsa
ucuagcacaauuauggguuacuuccuuuuucuuaacaaaaaagaauguuugauuuccucugggu

SEQ ID NO: 51163 - RNA, 64 nt, hsa
uacuuagauuuucuuuuaaaaaaauuaaaauaaaacaaaaaaaaauuucuaggacuagacgaug

SEQ ID NO: 51164 - RNA, 64 nt, hsa
uagggccauaucuccaaaaaaagaaagaaaaaauacaaaaaacaaaaacaaaaaaaaaagaggg

SEQ ID NO: 51165 - RNA, 64 nt, hsa
ccaaaaaaagaaagaaaaaauacaaaaaacaaaaacaaaaaaaaaagaggguaauguacaaguu

SEQ ID NO: 51166 - RNA, 64 nt, hsa
auuaguagcuguccuggcccacuuaaacaagguuacaaaaaaucagagucggaagcagccaaau

SEQ ID NO: 51167 - RNA, 64 nt, hsa
cacacagaauuguguugacugggggaggugaaucacaaaaaaguuacgaggaguuuaagaguua

SEQ ID NO: 51168 - RNA, 64 nt, hsa
uccagcuugggugacagagugagacuccaucucaacaaaaaaaaaaucuaacugaagaacuaag

SEQ ID NO: 51169 - RNA, 64 nt, hsa
ggauguauaaaguguuacugcaugaguaauguagacaaaaaaaaaagccagcuguccuuggagc

SEQ ID NO: 51170 - RNA, 64 nt, hsa
aaguguuugaaaguacauuuuaaguguucucaccacaaaaaaugcuagugugugaggugauaca

SEQ ID NO: 51171 - RNA, 64 nt, hsa
uuugcuugggcaccaacagaauuaaaaacgaaaaacaaaaaaaaacucgaaugacuuaggcaga

SEQ ID NO: 51172 - RNA, 64 nt, hsa
uaaggguuuauuuuauguaaaaaaaaaaaaaaaaacaaaaaaaaacccugagaccaugaguggg

SEQ ID NO: 51173 - RNA, 64 nt, hsa
gccaacauggugaaaccccaucucuacuaaaaauacaaaaaauuagguguaguggcaggcaccu

SEQ ID NO: 51174 - RNA, 64 nt, hsa
ugcuauguuaaaaacaaacaacaaaaaacaaacaacaaaaaaaaaauuaaaaaaaaaaacagaa

SEQ ID NO: 51175 - RNA, 64 nt, hsa
caccaaagaaguccugcuauguuaaaaacaaacaacaaaaaacaaacaacaaaaaaaaaauuaa

SEQ ID NO: 51176 - RNA, 64 nt, hsa
aaacaaaaaacaaccuuagcauuaagaaauaaaaacaaaaaacaagaagcaaguuguacugcua

SEQ ID NO: 51177 - RNA, 64 nt, hsa
aagaagccuuaauacucuguaaacaaacaaacaaacaaaaaacaaccuuagcauuaagaaauaa

SEQ ID NO: 51178 - RNA, 64 nt, hsa
caucugaauuguuuuaauaucuuuacucaaaaaaacaaaaaaacaaaaacccauggaagcaaca

SEQ ID NO: 51179 - RNA, 64 nt, hsa
ccuuggaaccuuuguacgcuuugcucaaaaaaaaacaaaaaaaaaaaacaaaaaaaaaaaacaa

SEQ ID NO: 51180 - RNA, 64 nt, hsa
guacgcuuugcucaaaaaaaaacaaaaaaaaaaaacaaaaaaaaaaaacaacgguggagccuuc

SEQ ID NO: 51181 - RNA, 64 nt, hsa
uucuggcaaauaacaauuagaaaagauagguuuaacaaaaaaauuuacuuguauauaaugcacc

SEQ ID NO: 51182 - RNA, 64 nt, hsa
uguauaauauuacuucaaagauauguaaucacaaacaaaaaaaacuauuuuuuauaaugucauu

SEQ ID NO: 51183 - RNA, 64 nt, hsa
gugacagggucugacauggucagucuacuaaaaaacaaaaaaaaaaaacaaaaaaaaaaaaaca

SEQ ID NO: 51184 - RNA, 64 nt, hsa
acauggucagucuacuaaaaaacaaaaaaaaaaaacaaaaaaaaaaaaacaaaagaaaaaaaua

SEQ ID NO: 51185 - RNA, 64 nt, hsa
ggcaauggagucagauucucuuucuuaaaaaaccacaaaaaaacuggauuuccaguucucuaau

SEQ ID NO: 51186 - RNA, 64 nt, hsa
guggacagagcaagacuccgucucaaagaaacaaacaaaaaauuaaaagggauagaauauaaug

SEQ ID NO: 51187 - RNA, 64 nt, hsa
ugggcgacagagcaggacucucucucaaaaaaacacaaaaaaacaaaaacaaaaaaccauacac

SEQ ID NO: 51188 - RNA, 64 nt, hsa
ggacucucucucaaaaaaacacaaaaaaacaaaaacaaaaaaccauacacacacacacacacac

SEQ ID NO: 51189 - RNA, 64 nt, hsa
uaaaaaccaccaaggaaaccuacuccaaaaaugaacaaaaaaaaaaaaagcgaaagacugcagu

SEQ ID NO: 51190 - RNA, 64 nt, hsa
guugugcuaaaaacaaaacaaaacaaacaaacaaacaaaaaaguaaaaaaagauuacuuucgag

SEQ ID NO: 51191 - RNA, 64 nt, hsa
gcuaacaaggugaaaccccgucucuacuaaaaauacaaaaaauuagccaggcgcgguggcgggg

SEQ ID NO: 51192 - RNA, 64 nt, hsa
ggccugggugaaagagcgagacuccgucucaaaaacaaaaaaaaaagaaaagaaauauauuuua

SEQ ID NO: 51193 - RNA, 64 nt, hsa
aauggaauauaauggaauauucuugagacugaucacaaaaaaaaaaaccuuuuuaauauuucuu

SEQ ID NO: 51194 - RNA, 64 nt, hsa
cugaguuuucccuucuguaucaaaacaaaauaauacaaaaaaugcuuuuagaguuuaagcaaug

SEQ ID NO: 51195 - RNA, 64 nt, hsa
ccucuuuaaauaauauguauagacaacaacaacgacaaaaaauagacuguuuuaaaguuucagg

SEQ ID NO: 51196 - RNA, 64 nt, hsa
ccucugaggggaaaaacaaaaaaaaacuuaaaauacaaaaaacaacauucuauuuauuuauuga

SEQ ID NO: 51197 - RNA, 64 nt, hsa
aauucuuuuuuucauccuuccucugaggggaaaaacaaaaaaaaacuuaaaauacaaaaaacaa

SEQ ID NO: 51198 - RNA, 64 nt, hsa
aaaaauagaaauuaaaaacaaaacaaaaaaaaaaacaaaaaaaaacaaaaguaaauuaaaaaca

SEQ ID NO: 51199 - RNA, 64 nt, hsa
ugaguuaaccagaaaaauagaaauuaaaaacaaaacaaaaaaaaaaacaaaaaaaaacaaaagu

SEQ ID NO: 51200 - RNA, 64 nt, hsa
aaaaaaaaaaaaaaacaagaugacgacgacaaccacaaaaaaaauugacaucagaugaaaugaa

SEQ ID NO: 51201 - RNA, 64 nt, hsa
aaaaacaagaccagaugugauuuguuaaaaaaaaacaaaaaaaaaaaaaaaaaaaacaagauga

SEQ ID NO: 51202 - RNA, 64 nt, hsa
cccacccccccaaaaaauaaaaaaaccacaaaaaacaaaaaaacaaaacuaaggcacuucacuu

SEQ ID NO: 51203 - RNA, 64 nt, hsa
agcuccucccacccccccaaaaaauaaaaaaaccacaaaaaacaaaaaaacaaaacuaaggcac

SEQ ID NO: 51204 - RNA, 64 nt, hsa
aaccugagauuucuaagcuugcagguuacaaaaaacaaaaaaaacagagaagcugccugcguaa

SEQ ID NO: 51205 - RNA, 64 nt, hsa
ggagcacaaccugagauuucuaagcuugcagguuacaaaaaacaaaaaaaacagagaagcugcc

SEQ ID NO: 51206 - RNA, 64 nt, hsa
gcuaacaaggugaaaccccgucucuacuaaaaauacaaaaaauuagccgggcgcgguggcgggc

SEQ ID NO: 51207 - RNA, 64 nt, hsa
cgucacccauugggcaagagauccagauuuguuaacaaaaaagauuuuacuucgugauuccacg

SEQ ID NO: 51208 - RNA, 64 nt, hsa
aaaguaaugaagccuuucccaaccaggaugguucacaaaaaagcugugagauccacaguuacaa

SEQ ID NO: 51209 - RNA, 64 nt, hsa
cugucuuugcagaauuaucuuauuaaaaaaaaauacaaaaaaaaagcaccaugaauuuguacug

SEQ ID NO: 51210 - RNA, 64 nt, hsa
aguuugaguugauaguuauuaaaaagaaaacaaaacaaaaaaaaaaggcaaggcacaacaaaaa

SEQ ID NO: 51211 - RNA, 64 nt, hsa
aagaaaacaaaacaaaaaaaaaaggcaaggcacaacaaaaaaauauccugggcaauaaaaaaaa

SEQ ID NO: 51212 - RNA, 63 nt, hsa
caucguuucaaucgcaucguaucucuacuugggcacaaaaaaaaaggaaaagaaaaaaaauca

SEQ ID NO: 51213 - RNA, 64 nt, hsa
aaagaacaaaacaaaacaaaacaaacacaaacaaacaaaaaaccuucaacugccuuaugcccuu

SEQ ID NO: 51214 - RNA, 64 nt, hsa
ccaccaccaacaccgccacaccaacaccaccacuacaaaaaaaaaagaauuaauaagucacaac

SEQ ID NO: 51215 - RNA, 64 nt, hsa
uacguuuuaaguuauuuaggaacacaaaggacagacaaaaaagccauaugcacaugccucauuu

SEQ ID NO: 51216 - RNA, 63 nt, hsa
uucaaggcuuucagguaugaauuaaaagcaaaaacaaaaaacaaaacaauucauuagccucag

SEQ ID NO: 51217 - RNA, 64 nt, hsa
aacaauaagcuagaaaagacaaaaaaaacaaaaaacaaaaaaacguguaauaaaguuaguggcu

SEQ ID NO: 51218 - RNA, 64 nt, hsa
uucuaccaacaauaagcuagaaaagacaaaaaaaacaaaaaacaaaaaaacguguaauaaaguu

SEQ ID NO: 51219 - RNA, 64 nt, hsa
agccuguuuuucuaccaacaauaagcuagaaaagacaaaaaaaacaaaaaacaaaaaaacgugu

SEQ ID NO: 51220 - RNA, 64 nt, hsa
agaauaguuaucccccccuuuuuuuuuuuuuuuaacaaaaaaacacuuuucuaaggacugaaga

SEQ ID NO: 51221 - RNA, 64 nt, hsa
ccuagauuacuuauugauuuaaaaacaaaaaaacacaaaaaaauaguaaaauauaaaaacaaau

SEQ ID NO: 51222 - RNA, 64 nt, hsa
uaaugcuaguccuagauuacuuauugauuuaaaaacaaaaaaacacaaaaaaauaguaaaauau

SEQ ID NO: 51223 - RNA, 64 nt, hsa
ucacuggaugaacuugaagaucuuuuacuuguuaacaaaaaaauacuauggacagcuuucugau

SEQ ID NO: 51224 - RNA, 64 nt, hsa
uugucaaauauaaaauaauguuauugcaauacauacaaaaaaguuaaagauuuuauguaucacu

SEQ ID NO: 51225 - RNA, 64 nt, hsa
guacuaguuuugcuuuaaaaugcuauguaaauauacaaaaaaacuagaaagaaauauauauaac

SEQ ID NO: 51226 - RNA, 64 nt, hsa
gcuaaugcguugaaacuccgucucuacuaaaaauacaaaaaauuagcugggcgugguggugggc

SEQ ID NO: 51227 - RNA, 64 nt, hsa
acccuguauucuggaugcuaaaaaacaaaaacaaacaaaaaaacaaaaacaaaaaaacaaaacc

SEQ ID NO: 51228 - RNA, 64 nt, hsa
augcuaaaaaacaaaaacaaacaaaaaaacaaaaacaaaaaaacaaaaccagaaucagguaaaa

SEQ ID NO: 51229 - RNA, 64 nt, hsa
caagaccuaacugcagccgcuuugggaaaaaaaaacaaaaaacaaaaaacagaaaacaaaaaaa

SEQ ID NO: 51230 - RNA, 64 nt, hsa
uaacugcagccgcuuugggaaaaaaaaacaaaaaacaaaaaacagaaaacaaaaaaaaaaaaac

SEQ ID NO: 51231 - RNA, 64 nt, hsa
accgucauggcgaaaccccgucuauacuaaaaauacaaaaaauagccaggcaugguggcgcacg

SEQ ID NO: 51232 - RNA, 64 nt, hsa
ucucugucuacucagaucauagugaaaacuggaaacaaaaaaaaaaaacagccucuucuuggaa

SEQ ID NO: 51233 - RNA, 64 nt, hsa
cuguauauuuaugaccagagcaaaaauguaaaaaacaaaaaaaacaacaaaaaaaguuuguuac

SEQ ID NO: 51234 - RNA, 64 nt, hsa
gaccagagcaaaaauguaaaaaacaaaaaaaacaacaaaaaaaguuuguuacuuugaauagucc

SEQ ID NO: 51235 - RNA, 64 nt, hsa
cuggggacagagcaagacucuugucucaaaaaaaacaaaaaaaacauauauacugcuguaucau

SEQ ID NO: 51236 - RNA, 64 nt, hsa
cuaugaaaaggcuuccaggaguuuccaugaaauaacaaaaaaaaauacaagcgccucaccuuag

SEQ ID NO: 51237 - RNA, 64 nt, hsa
gagacaauuaauuguacauaauguauacacacacacaaaaaaaaauaccuguagaaauauuauu

SEQ ID NO: 51238 - RNA, 64 nt, hsa
ucaaacuugcaaaaaaaaaaaaaaaaaaaaaaaaacaaaaaaacuagacaaggagagaggcacu

SEQ ID NO: 51239 - RNA, 64 nt, hsa
uugauaagacaaguuuagaauugguuuacuuaauacaaaaaaaaaaaaaagaauuucaaaaaaa

SEQ ID NO: 51240 - RNA, 64 nt, hsa
guauaaaucccuaauauuuaaaaaaaaaaacaaaacaaaaaaagguuacaaaguuuguuaacuu

SEQ ID NO: 51241 - RNA, 64 nt, hsa
ccuguaguuucauuaccuuuuugaauaaugucauacaaaaaauguauuuguuuuuuugugcugu

SEQ ID NO: 51242 - RNA, 64 nt, hsa
gccaacacggugaaaccccgccucuacuaaaaauacaaaaaauagccgggugugguggugggca

SEQ ID NO: 51243 - RNA, 64 nt, hsa
guagaaauaggaaaacaacaaaagaaaaacaauaacaaaaaaagaaagugugauggcugggugc

SEQ ID NO: 51244 - RNA, 64 nt, hsa
agguaaccgucuaugguguguuuuuucauuaaugacaaaaaaaaaaagguuucaacuggauuau

SEQ ID NO: 51245 - RNA, 64 nt, hsa
gccaacauggugaaaccccacgucuacuaaaaauacaaaaaauuagccgggcgugguggcacac

SEQ ID NO: 51246 - RNA, 64 nt, hsa
gucaacauggugaaacccccuaucuacuaaaaauacaaaaaauuagcugggcaugguggcaugc

SEQ ID NO: 51247 - RNA, 64 nt, hsa
aggagaacuuacucaaguugguaaagaacauacuacaaaaaacccuacagcuaacauuauccuu

SEQ ID NO: 51248 - RNA, 64 nt, hsa
acuccagccugagugacagagagagauucaaaaaacaaaaaaaaagcaaaaauauacuuugcua

SEQ ID NO: 51249 - RNA, 64 nt, hsa
uacaaccuugauaacaaaaccuaaaaaaaaaacaacaaaaaaacccauaaagcuauagaccaaa

SEQ ID NO: 51250 - RNA, 64 nt, hsa
caacugccaaguuauuaguuccuaaauacuauccacaaaaaaggggaacagggaugauuccuag

SEQ ID NO: 51251 - RNA, 64 nt, hsa
agaccagccugggcaacauggcacaauugucucuacaaaaaauacaaaaauuagccaggcaugg

SEQ ID NO: 51252 - RNA, 64 nt, hsa
acaaagaccgagucuucuuuuuuuuuaaacaaaaacaaaaaaagcaaccagggcuauuuguaca

SEQ ID NO: 51253 - RNA, 64 nt, hsa
uguguauuguuuuuauuuugcgaaacaaaacaaaacaaaaaaaaaagcuuggaacuccaucacg

SEQ ID NO: 51254 - RNA, 64 nt, hsa
gggcaacacggugaaaccccgucucuacuaaaauacaaaaaauuagccgggcgucgcagcaugc

SEQ ID NO: 51255 - RNA, 64 nt, hsa
ucacugaaagggcugucaaccccagaaggccgacacaaaaaaaaugguaugugaagaugcaccg

SEQ ID NO: 51256 - RNA, 64 nt, hsa
ucugccucaaaaaaaaauuaaaauaaauuuaaauacaaaaaaaaauagccagguguggggugca

SEQ ID NO: 51257 - RNA, 64 nt, hsa
ggccaacguggugaaacgcugucucuacuaaaauacaaaaaaauagggcugggcgcgguugcuc

SEQ ID NO: 51258 - RNA, 64 nt, hsa
ucauucuucagugccucaugacugaaaacaaaaaacaaaaaaacgaaagcaucuucacaaugaa

SEQ ID NO: 51259 - RNA, 64 nt, hsa
gcacaacucauucuucagugccucaugacugaaaacaaaaaacaaaaaaacgaaagcaucuuca

SEQ ID NO: 51260 - RNA, 64 nt, hsa
gccuaggcaacagagcaagacccugucucuuaaaacaaaaaaccucacacauaccuaaaauaag

SEQ ID NO: 51261 - RNA, 64 nt, hsa
agccaguaaaaauauuguuuugcuucaucuguacacaaaaaaauacccuuuuacaauaugaaug

SEQ ID NO: 51262 - RNA, 64 nt, hsa
cuucgaagcuuccagaugguuuguguuuugagguacaaaaaaaugcugcagaucuagaaaugca

SEQ ID NO: 51263 - RNA, 64 nt, hsa
cuuauucuuuaacaaagagaaucuaaaaaaaaaaacaaaaaacuguugucuaauauaucuacag

SEQ ID NO: 51264 - RNA, 64 nt, hsa
gccaaccuggugaaacccugucucuacuaaaaauacaaaaaaaauuagcugagcgugguggcgg

SEQ ID NO: 51265 - RNA, 64 nt, hsa
gacuccaucucaaaacaaaacaaaacaaaacaaaacaaaaaaacccggcuuugcugcuuuuaac

SEQ ID NO: 51266 - RNA, 64 nt, hsa
acagcucagacuuuguauuuaaaaguuaaaaaggacaaaaaaaaaaucuaaagcauuuaaaauc

SEQ ID NO: 51267 - RNA, 64 nt, hsa
uauaaaauugauguugucuuuaccagaaagguagacaaaaaagaagcagcagcagcucuuaaag

SEQ ID NO: 51268 - RNA, 64 nt, hsa
agauuugaaaauacaagauugauuagaugaaucuacaaaaaaguuguccuccucucaggucccu

SEQ ID NO: 51269 - RNA, 64 nt, hsa
aaaauguauucuccuuuccuauaccgcucucccaacaaaaaaacaacuaguuaguucuacuaau

SEQ ID NO: 51270 - RNA, 64 nt, hsa
gccaacaaggugaaacccugucucuacuaaaaauacaaaaaauuagccaggcaugguggugcgc

SEQ ID NO: 51271 - RNA, 64 nt, hsa
aaagaauuguuaaauguucuuaaauguucucacuacaaaaaaagaaaaaagauaacuacgugag

SEQ ID NO: 51272 - RNA, 64 nt, hsa
cccccaucagggaccagacuguuccaaaaaaaaaacaaaaaacaaaaacaaacaaaaaaacacu

SEQ ID NO: 51273 - RNA, 64 nt, hsa
acuguuccaaaaaaaaaacaaaaaacaaaaacaaacaaaaaaacacuuaaaagcccaaggagua

SEQ ID NO: 51274 - RNA, 64 nt, hsa
cucucuaugguaaagauauuauucaccauguaaaacaaaaaacaauauuuauuguauuuuagua

SEQ ID NO: 51275 - RNA, 64 nt, hsa
ggagaacagugauuuuuuuuuagaacagaaaacaacaaaaaauaaccccaaaaugaagauuauu

SEQ ID NO: 51276 - RNA, 64 nt, hsa
ugacuagaaagugaauaaaaauuaaggcaacugaacaaaaaaaugcucacacuccacaucccgu

SEQ ID NO: 51277 - RNA, 64 nt, hsa
aucuacuguuucaaaaaagugucuuuacaaaaaaacaaaaaagaaaagaaauuuauuuauuaaa

SEQ ID NO: 51278 - RNA, 64 nt, hsa
ugggcuaaaucuacuguuucaaaaaagugucuuuacaaaaaaacaaaaaagaaaagaaauuuau

SEQ ID NO: 51279 - RNA, 64 nt, hsa
acaagagacucaaaucuaaaacauuuacagaguuacaaaaaacaaacaaucaaaaaaaaagaca

SEQ ID NO: 51280 - RNA, 64 nt, hsa
auuagguuugcuaaauucuuucacagacuauaaaacaaaaaauuuugaggaacaccucucauca

SEQ ID NO: 51281 - RNA, 64 nt, hsa
uaaugacaaaaagcacaugcagaguaauacacaaacaaaaaaagugacaguuacuuuuuuguga

SEQ ID NO: 51282 - RNA, 64 nt, hsa
uaaauauguacagugcacgggcuaugagauagcaacaaaaaaugcauaguuaauggucauagac

SEQ ID NO: 51283 - RNA, 64 nt, hsa
acccuuuuuuuuuuccuuuaaguauucuugagauacaaaaaaaaaaaguaaauacaauuucaaa

SEQ ID NO: 51284 - RNA, 64 nt, hsa
acugaacuucaaaacaaaacaaaaaacaacaacaacaaaaaacaaguccaaacugauauauccu

SEQ ID NO: 51285 - RNA, 64 nt, hsa
cuguaaaaaaaagugcacugaacuucaaaacaaaacaaaaaacaacaacaacaaaaaacaaguc

SEQ ID NO: 51286 - RNA, 64 nt, hsa
uuccuucuuaaaaucaaaaacaaaacaaaaaaacacaaaaaacacauucuaaauacuagagaua

SEQ ID NO: 51287 - RNA, 64 nt, hsa
uggaaaagaauuccuucuuaaaaucaaaaacaaaacaaaaaaacacaaaaaacacauucuaaau

SEQ ID NO: 51288 - RNA, 64 nt, hsa
uauguucugagauauaauguuaacauuguucauaacaaaaaaugcuaucaaucuuauaaauaua

SEQ ID NO: 51289 - RNA, 64 nt, hsa
uuuggucuuuauuaaaaaucacaauauuccgaaaacaaaaaaaccuaggagauaaauguagagg

SEQ ID NO: 51290 - RNA, 64 nt, hsa
aaauuccaaaguaauaaaacuuuucuugagacaaacaaaaaaaaaguuugcuuacuauuugauu

SEQ ID NO: 51291 - RNA, 64 nt, hsa
auugcaaaaauuucuuuuucuagaaaaaauaaauacaaaaaaaaaaaagaagaaauuccaaagu

SEQ ID NO: 51292 - RNA, 64 nt, hsa
uucugcagaaaucagaacucuuaccaugguuugaacaaaaaaaggggaaauggggaggggaaaa

SEQ ID NO: 51293 - RNA, 64 nt, hsa
aaaagaaaaaaaacacaaaaaauaaaaaaccccuacaaaaaaacuuuaaaaaaaauggcagcaa

SEQ ID NO: 51294 - RNA, 64 nt, hsa
gaaacccaauucuaagcagaaaaagaaaaaaaacacaaaaaauaaaaaaccccuacaaaaaaac

SEQ ID NO: 51295 - RNA, 64 nt, hsa
guucuuccaagagacuuccauguccugguuauuaacaaaaaaggaaaaauguaauaauugauau

SEQ ID NO: 51296 - RNA, 64 nt, hsa
uggagacaguuuuaacaaaaccaauaaaccaacaacaaaaaaaguggauguauauugcuuuaag

SEQ ID NO: 51297 - RNA, 64 nt, hsa
aggacuacagaugagauuaaauuuuuugccauuuacaaaaaaaaaaaaaaaaaagaaaacagaa

SEQ ID NO: 51298 - RNA, 64 nt, hsa
uaaugcuaguccuagauuacuuauugauuuaaaaacaaaaaaaagauuacuuaauuuugauuua

SEQ ID NO: 51299 - RNA, 64 nt, hsa
aacaaaaaaaagauuacuuaauuuugauuuaaaaacaaaaaaucguaaaauacaaaaaccaguu

SEQ ID NO: 51300 - RNA, 64 nt, hsa
gaggaagcggaaagcguuuucuuugcucgaggggacaaaaaagucaaaacgaggcgagaggcga

SEQ ID NO: 51301 - RNA, 64 nt, hsa
auuuugcuuaaaccacucauucguuaaagugauuacaaaaaaguucaagaaugauguccacugc

SEQ ID NO: 51302 - RNA, 64 nt, hsa
gaguauaaaggaaaaacagcaaaacaaaaagcaaacaaaaaaaaacugcaaaagucuaaaauac

SEQ ID NO: 51303 - RNA, 64 nt, hsa
uacaagccaaaugauuuucauugguggaacugacacaaaaaaaguaacuuaaaaacaagaaacu

SEQ ID NO: 51304 - RNA, 64 nt, hsa
ccaucaauuuaaaaguaaaaaaaacaaaaaaaaaacaaaaaauuuaaaaaaaagguuugcuaau

SEQ ID NO: 51305 - RNA, 64 nt, hsa
gccacgguucaccaucaauuuaaaaguaaaaaaaacaaaaaaaaaacaaaaaauuuaaaaaaaa

SEQ ID NO: 51306 - RNA, 64 nt, hsa
acaauaaagaugaaagaaaaaaugaaaacuuuauacaaaaaaggacuucugcaaaagcuuggaa

SEQ ID NO: 51307 - RNA, 63 nt, hsa
aaaaaaaaaaaggaaagaaaagagaaaagcaaugacaaaaaaaaaaaaaaaaaaaaagccaag

SEQ ID NO: 51308 - RNA, 64 nt, hsa
gguaaaaugugaugaagauggauuucacaaauagacaaaaaagaagaaaacuaccuucugaucu

SEQ ID NO: 51309 - RNA, 64 nt, hsa
accagccugggcaacauggcaaaaccccaucucuacaaaaaauacaaaaaguaggccgggcacg

SEQ ID NO: 51310 - RNA, 64 nt, hsa
gccaacaugguggaacccaaucucuacuaaaaauacaaaaaaacuagccggauaugguggcggg

SEQ ID NO: 51311 - RNA, 64 nt, hsa
uagaaauauuuuucaguuguuuaugucguuuacuacaaaaaaaaagauucagaguggauggagu

SEQ ID NO: 51312 - RNA, 64 nt, hsa
uuuaaaauaaucuaagcaucauugaagcaguaacacaaaaaaaagguucaguauuuucuuuuua

SEQ ID NO: 51313 - RNA, 64 nt, hsa
uccaucucaaaaacaaaaacaaaacaaaacaacaacaaaaaaagaaguuaaauaacuuguuuaa

SEQ ID NO: 51314 - RNA, 64 nt, hsa
uggaaaucuucauucucaguaaacuaucgcaaggacaaaaaaccaaacaccacauguucucacu

SEQ ID NO: 51315 - RNA, 64 nt, hsa
uccuuaguuuaauucuauuguaucuguuuauuuaacaaaaaauucaucauaccaaaaaguguaa

SEQ ID NO: 51316 - RNA, 64 nt, hsa
aaaaaguguaagugaaaacccccuuuaaaacaaaacaaaaaaaugaaauaaaauuaggcaaauu

SEQ ID NO: 51317 - RNA, 64 nt, hsa
ucuguuuaauuauguaaaaaacaaaacuacaacaacaaaaaaagaaaaaaguuaaaaaagaaaa

SEQ ID NO: 51318 - RNA, 64 nt, hsa
uaaaaaagaaaaaaacaccaaaaaacaaaaacaaacaaaaaaaaaaacccacaacccuuaucug

SEQ ID NO: 51319 - RNA, 64 nt, hsa
ugagaauguuguuuuaaaagaaaauagcaaaacaacaaaaaagcaaaccuuaaaaugugaagaa

SEQ ID NO: 51320 - RNA, 64 nt, hsa
ggcaacauggugaagccccaucucuacaaaaaauacaaaaaaauuagccggguaugauggugug

SEQ ID NO: 51321 - RNA, 64 nt, hsa
accagccugggcaacauggugaagccccaucucuacaaaaaauacaaaaaaauuagccggguau

SEQ ID NO: 51322 - RNA, 64 nt, hsa
auguauuaaauuggaauuuuuuaauccuuuauauacaaaaaaaauacgaucacucagugugugu

SEQ ID NO: 51323 - RNA, 64 nt, hsa
caaagggaaaacaaaaagcuacaaaaguagccuuacaaaaaaaaaaaaauuguuuagugaauac

SEQ ID NO: 51324 - RNA, 64 nt, hsa
agucacuaaauuggaaacaaaagguugcaacgugacaaaaaaaauuguguaguauuuaccagca

SEQ ID NO: 51325 - RNA, 64 nt, hsa
guuaguguuuuuuuauuccccuaagacagaaagaacaaaaaauguuuuaaauuucucuuauaua

SEQ ID NO: 51326 - RNA, 64 nt, hsa
agcagccuggccaacauagugggacccugucucuacaaaaaaaaaauuugccaagagccugagu

SEQ ID NO: 51327 - RNA, 64 nt, hsa
agcaagaccccaucucaaaaaaaaaaacaaacaaacaaaaaaaaaaccauauauauacauauau

SEQ ID NO: 51328 - RNA, 64 nt, hsa
cugcuaaaaagacaaaaaacaaaaaacaaaaaaaacaaaaaaaaccucaugagugcauggauuu

SEQ ID NO: 51329 - RNA, 64 nt, hsa
ccccucuuccugcuaaaaagacaaaaaacaaaaaacaaaaaaaacaaaaaaaaccucaugagug

SEQ ID NO: 51330 - RNA, 64 nt, hsa
uauucucccccucuuccugcuaaaaagacaaaaaacaaaaaacaaaaaaaacaaaaaaaaccuc

SEQ ID NO: 51331 - RNA, 64 nt, hsa
uucauuauauucucccccucuuccugcuaaaaagacaaaaaacaaaaaacaaaaaaaacaaaaa

SEQ ID NO: 51332 - RNA, 64 nt, hsa
gaaccauuugccaaaaaaaaaagcuuuucuugcuacaaaaaauaagcaauuuucuugagccuua

SEQ ID NO: 51333 - RNA, 64 nt, hsa
ggcaacauggcaaaacgcagucuguacaaaaaauacaaaaaauuagccagguguagggguaggc

SEQ ID NO: 51334 - RNA, 64 nt, hsa
accagccugggcaacauggcaaaacgcagucuguacaaaaaauacaaaaaauuagccaggugua

SEQ ID NO: 51335 - RNA, 64 nt, hsa
accagccuggccaacauggugaaaccccgucucuacaaaaaauacaaaaauuagcugggcaugg

SEQ ID NO: 51336 - RNA, 64 nt, hsa
aggaaacagcucaucccagagaaggagaugcuuaacaaaaaaaaauugaaauuguuucccaugc

SEQ ID NO: 51337 - RNA, 64 nt, hsa
agaaacaaacaaacaaaaaacaagacaaacaacuacaaaaaaagacaguauagagucucauaaa

SEQ ID NO: 51338 - RNA, 64 nt, hsa
auaucuauauaaauuaaaacaaagaaacaaacaaacaaaaaacaagacaaacaacuacaaaaaa

SEQ ID NO: 51339 - RNA, 64 nt, hsa
uuuaaauaucaacuuaauuuuuucuaaguaagauacaaaaaauuuucaucuaaaguaauauuuc

SEQ ID NO: 51340 - RNA, 64 nt, hsa
accauacaaucuagugucaaaaacauaaauggccacaaaaaaguaguuugaguguuaugaauau

SEQ ID NO: 51341 - RNA, 64 nt, hsa
acuagccugggcaacauagcgagaccucgucucuacaaaaaaaaauuaaaaagggggcuuuggg

SEQ ID NO: 51342 - RNA, 64 nt, hsa
ggccaacauggugaaaccccgucucuacuaaaauacaaaaaauuagcugggcaugguggcgcac

SEQ ID NO: 51343 - RNA, 64 nt, hsa
agacaauccuggccaacggcgaaacucugucucuacaaaaaauauacaggcguguuagcaugug

SEQ ID NO: 51344 - RNA, 64 nt, hsa
gccagccugggcaacauggcaaaaccccauuucuacaaaaaauacaaaaauuagcugggcaugg

SEQ ID NO: 51345 - RNA, 64 nt, hsa
ucauguggggauguuugugcugcagacaaaaagaacaaaaaaaaauuuuuaaauaccacaagau

SEQ ID NO: 51346 - RNA, 64 nt, hsa
aaaauuuuuaaauaccacaagauggaaaaaaaaaacaaaaaaauuuaaaaagauggaauguagu

SEQ ID NO: 51347 - RNA, 64 nt, hsa
ugaaaggcauugugggucugucuuuaaaguguuuacaaaaaaaaauuauauaaaaaaaaagucu

SEQ ID NO: 51348 - RNA, 64 nt, hsa
ggcccucguggauuuuuuuuuucagaaaacuuaaacaaaaaaagacuuacuaagaaauauguac

SEQ ID NO: 51349 - RNA, 64 nt, hsa
ugcaagauagguuucuguauuuauauauuaaaauacaaaaaaaaacuuauaaaauguuuaaaaa

SEQ ID NO: 51350 - RNA, 64 nt, hsa
cuucagagguaccuggcaccuuacucaagcaaaaacaaaaaacagcuuuacuucaaaagcaugu

SEQ ID NO: 51351 - RNA, 64 nt, hsa
gcuaacacggugaaaccccgucuuuacuaaaaauacaaaaaaaauuagccgggcgugguggcgg

SEQ ID NO: 51352 - RNA, 64 nt, hsa
cuccucauccuaguucuuuaaaaaaaacaaaaaaacaaaaaaaacuuuuuuuaaucguuguaau

SEQ ID NO: 51353 - RNA, 63 nt, hsa
cggcucucuccucauccuaguucuuuaaaaaaaacaaaaaaacaaaaaaaacuuuuuuuaauc

SEQ ID NO: 51354 - RNA, 64 nt, hsa
aagaaguugguuuauuuccaaaauaaauccccugacaaaaaaccuggugauguuaagcaauuga

SEQ ID NO: 51355 - RNA, 64 nt, hsa
auugacugucuuagaguccagcagaagaccuuagacaaaaaaagcagaacccacuggaguagaa

SEQ ID NO: 51356 - RNA, 64 nt, hsa
uaagaaaauuuuaaaaggaagagauguuuggaugacaaaaaaaugccuuauugaaaaacuaaag

SEQ ID NO: 51357 - RNA, 64 nt, hsa
augaugauguuuauuuaaaaaaaaaacaacagcaacaaaaaauccuagccuccaguugccuuuu

SEQ ID NO: 51358 - RNA, 64 nt, hsa
gcuaacguggugaaaccccaucucuacuaaaaauacaaaaaaauuagcugggcgugguggcacg

SEQ ID NO: 51359 - RNA, 64 nt, hsa
cagaaccagacuccgucucaaaaaaaaaaaaaaaacaaaaaaggcugaaggcagcuguagcucc

SEQ ID NO: 51360 - RNA, 64 nt, hsa
uuuaacucugccucggccauucaaaagucuaauaacaaaaaauguaaaccuaauuuggcaguuu

SEQ ID NO: 51361 - RNA, 64 nt, hsa
uaauuguccaauucuacgugcucucuauaccaaaacaaaaaaaaaaagcuauccaccuuuccau

SEQ ID NO: 51362 - RNA, 64 nt, hsa
gcuaacauggugaaaccccaucucuacuaaaaauacaaaaaaaaauuagccgggggugguggcg

SEQ ID NO: 51363 - RNA, 64 nt, hsa
ggcucugagagaacuggcuaagauucaggaagaaacaaaaaauucagaauccuacaagguuuug

SEQ ID NO: 51364 - RNA, 64 nt, hsa
uccagccugggugacagaguaagacccugucucaacaaaaaaauaacagguucuguugcugcug

SEQ ID NO: 51365 - RNA, 64 nt, hsa
accagccugggcaauauagugagaccguaucacuacaaaaaaguuuuuuuaguucaccgagcau

SEQ ID NO: 51366 - RNA, 64 nt, hsa
gcuaacacggugaaaccccgucucuacuaaaaauacaaaaaaauuagucgggcgugguggcgga

SEQ ID NO: 51367 - RNA, 64 nt, hsa
gccaacauggugaaaccccaucuuuacuaaaaauacaaaaaacuagccaggcgugguggugggc

SEQ ID NO: 51368 - RNA, 64 nt, hsa
gggaaguaaaaaaacaaaacaaaaaacaaaaaaaacaaaaaaaaaacccuauuuaaaugaaagg

SEQ ID NO: 51369 - RNA, 64 nt, hsa
aaucgaauagggaaguaaaaaaacaaaacaaaaaacaaaaaaaacaaaaaaaaaacccuauuua

SEQ ID NO: 51370 - RNA, 64 nt, hsa
aaacucaaaucgaauagggaaguaaaaaaacaaaacaaaaaacaaaaaaaacaaaaaaaaaacc

SEQ ID NO: 51371 - RNA, 64 nt, hsa
uugguuuauuuagaaaaaggaagaaaaacaaaaaacaaaaaacuaaagggugagaauuugcuua

SEQ ID NO: 51372 - RNA, 64 nt, hsa
caagcauuugguuuauuuagaaaaaggaagaaaaacaaaaaacaaaaaacuaaagggugagaau

SEQ ID NO: 51373 - RNA, 64 nt, hsa
aaucugucuuuaaguagggauaaauuacucuaaaacaaaaaagaauccuagauaguuuucccuu

SEQ ID NO: 51374 - RNA, 64 nt, hsa
uauuccaguaaguuauuuugcucucacuguuuuaacaaaaaaaaaaaacaacaacauaaaaauc

SEQ ID NO: 51375 - RNA, 60 nt, hsa
cccugccagaaauauucugagaccaaauuuacaaaaaaacgaaaaaaauaaggauugacu

SEQ ID NO: 51376 - RNA, 64 nt, hsa
gauucagaaucaugaaaacaacauuuuuacaacaacaaaaaaacuauauuaaacaggguuuaaa

SEQ ID NO: 51377 - RNA, 64 nt, hsa
cagcugauagaaaaacaaaaaugaaaaaaaaaacacaaaaaacaaaaaacauggcacguugcua

SEQ ID NO: 51378 - RNA, 64 nt, hsa
uagaaaaacaaaaaugaaaaaaaaaacacaaaaaacaaaaaacauggcacguugcuaguuuaca

SEQ ID NO: 51379 - RNA, 64 nt, hsa
ggcuaacacgugaaaccccgucucuacuaaaaauacaaaaaauuagccgggcgugguggcgggc

SEQ ID NO: 51380 - RNA, 64 nt, hsa
gcgacagagcgagacuccgucucaaaaaaaaaaaacaaaaaaaaaccaugcauggugcaucagc

SEQ ID NO: 51381 - RNA, 64 nt, hsa
auggaggaagaucuacgaagcaaauggaaaacaaacaaaaaaagaggcagggguugcaauccua

SEQ ID NO: 51382 - RNA, 64 nt, hsa
aacuaaaaucagcagaacucaaggaaauagagacacaaaaaaaccuucaaaaaauuaauguauc

SEQ ID NO: 51383 - RNA, 64 nt, hsa
ucccccagcugcguuuuuuuauaguagauuuuuaacaaaaaacggggagaaauaaugcauuucu

SEQ ID NO: 51384 - RNA, 64 nt, hsa
uguguguguuuuaauuuucuuuauggaaaaauugacaaaaaaaaaauagagagagagguauuua

SEQ ID NO: 51385 - RNA, 64 nt, hsa
uuauggaagaaccgggacauuuuacagaaaaaaaacaaaaaacaacaaaaaauauacgugggaa

SEQ ID NO: 51386 - RNA, 64 nt, hsa
accgggacauuuuacagaaaaaaaacaaaaaacaacaaaaaauauacgugggaaaaaaaacgau

SEQ ID NO: 51387 - RNA, 64 nt, hsa
accagccuggguaacauggcaaaauccugucuuuacaaaaaauacaaaaauuagccuagcaugg

SEQ ID NO: 51388 - RNA, 64 nt, hsa
gcuaauauggugaaacccugucucuacuaaaaauacaaaaaaauuagcuaggcaugguggcggg

SEQ ID NO: 51389 - RNA, 64 nt, hsa
aaguuacaaccaacuucuaugaaaaguugaaaagacaaaaaaaaaaaaaaaaagcgagcgagag

SEQ ID NO: 51390 - RNA, 64 nt, hsa
gagaaaaaaaaucacccaccacccccccaaaaacacaaaaaaagaaaaucuaucuauauacaga

SEQ ID NO: 51391 - RNA, 64 nt, hsa
aaaaaaaaaaaaaaaaaaaaagacaaaacaaaagacaaaaaaaaaaaaaaaacccaacaagaac

SEQ ID NO: 51392 - RNA, 64 nt, hsa
caaaaaaacacaaacagaagaggaaaaaaaagcaacaaaaaaagaaaacacacagaagagauuu

SEQ ID NO: 51393 - RNA, 64 nt, hsa
gcaaggaacaaaaaagaaaaaaaucaaaaaagcgacaaaaaaacacaaacagaagaggaaaaaa

SEQ ID NO: 51394 - RNA, 64 nt, hsa
uuauuaaacgucuguggagcuucugcugcaaggaacaaaaaagaaaaaaaucaaaaaagcgaca

SEQ ID NO: 51395 - RNA, 64 nt, hsa
uucuugaacuugaaaaaaaaaaacacaaaaaaagacaaaaaaaaaaaaagaaaauauuuuggca

SEQ ID NO: 51396 - RNA, 64 nt, hsa
uuacuggggauucuugaacuugaaaaaaaaaaacacaaaaaaagacaaaaaaaaaaaaagaaaa

SEQ ID NO: 51397 - RNA, 64 nt, hsa
ccccuuuuucuuguuaaaaaacaaaaaacaaaaaacaaaaaaccacacacacauuuuguacggg

SEQ ID NO: 51398 - RNA, 64 nt, hsa
cuuuugcccccuuuuucuuguuaaaaaacaaaaaacaaaaaacaaaaaaccacacacacauuuu

SEQ ID NO: 51399 - RNA, 64 nt, hsa
uuccuggcuuuugcccccuuuuucuuguuaaaaaacaaaaaacaaaaaacaaaaaaccacacac

SEQ ID NO: 51400 - RNA, 64 nt, hsa
gcuaacacggugaaaccccgucucuacuaaaaauacaaaaaaauuagccgggugcgguggcggg

SEQ ID NO: 51401 - RNA, 64 nt, hsa
accagccugggcaacauggugagaccccaucucuacaaaaaauacaaaaauuagcugagugugg

SEQ ID NO: 51402 - RNA, 64 nt, hsa
gcuaacacggugaaaccccaucucuacuaaaaauacaaaaaauuagccaggcgugguugugggc

SEQ ID NO: 51403 - RNA, 64 nt, hsa
ccagccugggcagaauggugaaaccaccuucucuacaaaaaauacauaaauuagcugggcauug

SEQ ID NO: 51404 - RNA, 64 nt, hsa
uggagaaaccccgucucuacuaaaaaaaaaaauuacaaaaaauuagccgggcaugguagcaggu

SEQ ID NO: 51405 - RNA, 64 nt, hsa
gcaaguucuuguuuccaaacaacaacaaaacaaaacaaaaaaaaaaccggauagaauaaugacc

SEQ ID NO: 51406 - RNA, 64 nt, hsa
gcaacauagcgagaccucaucuccaaaaaagaaaacaaaaaacaaaaaaaggaaugauguucug

SEQ ID NO: 51407 - RNA, 64 nt, hsa
agcgagaccucaucuccaaaaaagaaaacaaaaaacaaaaaaaggaaugauguucuguagagau

SEQ ID NO: 51408 - RNA, 64 nt, hsa
acugauuuaaaacaaaccaaaaaaaaagaaaaaaacaaaaaaaaaaaucccuccuuucuagcug

SEQ ID NO: 51409 - RNA, 64 nt, hsa
ggcaacauggugaaacccaguuucuacaaaaaauacaaaaaauuagccggguuccaucaccugu

SEQ ID NO: 51410 - RNA, 64 nt, hsa
accagccugggcaacauggugaaacccaguuucuacaaaaaauacaaaaaauuagccggguucc

SEQ ID NO: 51411 - RNA, 64 nt, hsa
uauauguaauuaaaauguuucuaguagcugcauuacaaaaaagaagccugggcacuguggcuca

SEQ ID NO: 51412 - RNA, 64 nt, hsa
gcuaacauggugaaacccugucucuacuaaaaauacaaaaaauuagccgggugugguggugggc

SEQ ID NO: 51413 - RNA, 64 nt, hsa
ccugggugacagcacgagaugccgucuuaaaaaaacaaaaaagaggugugcugcuugucagcau

SEQ ID NO: 51414 - RNA, 64 nt, hsa
auuauuuuucucaaaaaacaaacaaacaaaaaacacaaaaaaaaccacucuucuccaaaugccc

SEQ ID NO: 51415 - RNA, 64 nt, hsa
ucaauuagaauuauuuuucucaaaaaacaaacaaacaaaaaacacaaaaaaaaccacucuucuc

SEQ ID NO: 51416 - RNA, 64 nt, hsa
uggcuaacagugaaacccugucuccacuaaaaauacaaaaaauuagccgggcgugguggcgggc

SEQ ID NO: 51417 - RNA, 64 nt, hsa
gcuaauacagugaaaccccaugucugcuaaaauuacaaaaaauuagcugggcgugguggugcac

SEQ ID NO: 51418 - RNA, 64 nt, hsa
uuaucuuauauuuagggaaagccggagagcaacaacaaaaaauguuuaagccgggcgcgguggc

SEQ ID NO: 51419 - RNA, 64 nt, hsa
accagccuggacaacauggugaaaccccaucucuacaaaaaauacaaaaauuagccaugcaugg

SEQ ID NO: 51420 - RNA, 64 nt, hsa
accagccugggccacaugacaaagccccaucucuacaaaaaaauuacaaaaaaaaaaaaaacag

SEQ ID NO: 51421 - RNA, 64 nt, hsa
ccacaugacaaagccccaucucuacaaaaaaauuacaaaaaaaaaaaaaacaggugugguggca

SEQ ID NO: 51422 - RNA, 64 nt, hsa
uuaaaggaaauguuaaaaaaaaaaaaacaaaaaaacaaaaaaacaacuguucuuugccuaauaa

SEQ ID NO: 51423 - RNA, 64 nt, hsa
caccuuccuuaaaggaaauguuaaaaaaaaaaaaacaaaaaaacaaaaaaacaacuguucuuug

SEQ ID NO: 51424 - RNA, 64 nt, hsa
aagaggaaaaacaaacaaacaaacaaaaaaaaacacaaaaaaagaaagaauacuuuuuuauacc

SEQ ID NO: 51425 - RNA, 64 nt, hsa
uauagcaagaugaagaggaaaaacaaacaaacaaacaaaaaaaaacacaaaaaaagaaagaaua

SEQ ID NO: 51426 - RNA, 64 nt, hsa
aacaaaaaaacaaaaaacaaaaaaacacacacacacaaaaaaagagaaaaaacauaacaaguaa

SEQ ID NO: 51427 - RNA, 64 nt, hsa
aaaacaaaaaacaaaaaaaacaaaaaaacaaaaaacaaaaaaacacacacacacaaaaaaagag

SEQ ID NO: 51428 - RNA, 64 nt, hsa
aaaagcaaaaacaaaaaacaaaaaaaacaaaaaaacaaaaaacaaaaaaacacacacacacaaa

SEQ ID NO: 51429 - RNA, 64 nt, hsa
gaccuuccaaaagcaaaaacaaaaaacaaaaaaaacaaaaaaacaaaaaacaaaaaaacacaca

SEQ ID NO: 51430 - RNA, 64 nt, hsa
ccgcugggagaccuuccaaaagcaaaaacaaaaaacaaaaaaaacaaaaaaacaaaaaacaaaa

SEQ ID NO: 51431 - RNA, 64 nt, hsa
agacccuccgcugggagaccuuccaaaagcaaaaacaaaaaacaaaaaaaacaaaaaaacaaaa

SEQ ID NO: 51432 - RNA, 64 nt, hsa
guuucacaaacaguuuuauuuaaaaaaacaaaaaacaaaaaaaaucaaaaaaucaaaaaaauaa

SEQ ID NO: 51433 - RNA, 64 nt, hsa
aauagcuguuucacaaacaguuuuauuuaaaaaaacaaaaaacaaaaaaaaucaaaaaaucaaa

SEQ ID NO: 51434 - RNA, 64 nt, hsa
uuuaaauaucugaguuuuaaaaaaagaaaaaaguacaaaaaaaucuuguuauggccuuaagaag

SEQ ID NO: 51435 - RNA, 64 nt, hsa
uguucaguucuuaaaauguaauuaugucacacacacaaaaaauccuuuucaauccugagaaaau

SEQ ID NO: 51436 - RNA, 64 nt, hsa
aaagcaguucaaguugacaacagcagaaacaguaacaaaaaaaucugcucagaaaaauguaugu

SEQ ID NO: 51437 - RNA, 64 nt, hsa
cugaaaaacaaaaacaaaaacagaaaacaaacaaacaaaaaacaaaaaauccccacaacuuugu

SEQ ID NO: 51438 - RNA, 64 nt, hsa
acaaaaacaaaaacagaaaacaaacaaacaaaaaacaaaaaauccccacaacuuugucaaauaa

SEQ ID NO: 51439 - RNA, 64 nt, hsa
aagucuuauaaaaauuuaaaaagacacauuucuuacaaaaaagaguugaaugagguaaaauggc

SEQ ID NO: 51440 - RNA, 64 nt, hsa
guaauuugccaggaauucuucauaacaguaucuuacaaaaaacguguugcucucuucacaguau

SEQ ID NO: 51441 - RNA, 64 nt, hsa
agccacugcacccggccgguggaaagcauuuuuaacaaaaaauuuuuaggccaggcacaguggu

SEQ ID NO: 51442 - RNA, 64 nt, hsa
gaaccuaccauguugccucccaucuucugaaaaaacaaaaaaauuauaggcaugagccacugca

SEQ ID NO: 51443 - RNA, 64 nt, hsa
uaaguaagaaagaaggcaaauugauucaaauguuacaaaaaaacccuucuugguggauuagaca

SEQ ID NO: 51444 - RNA, 64 nt, hsa
aacaauggcagguuuuacacgucuaugcaauuguacaaaaaaguuauaagaaaacuacauguaa

SEQ ID NO: 51445 - RNA, 64 nt, hsa
gccaacauggugaaaccccaucucuaucagaaauacaaaaaauuagcugggcgugguggugggc

SEQ ID NO: 51446 - RNA, 64 nt, hsa
uuagaaugggugguaugggggauuucaaacuuaaacaaaaaacuaucaacuacaaauuaguugc

SEQ ID NO: 51447 - RNA, 64 nt, hsa
uguucaguucuuaaaauguaauuaugucacacacacaaaaaaauccuuuucaauccugagaaaa

SEQ ID NO: 51448 - RNA, 64 nt, hsa; identical to SEQ ID NO: 51436

SEQ ID NO: 51449 - RNA, 64 nt, hsa; identical to SEQ ID NO: 49066

SEQ ID NO: 51450 - RNA, 64 nt, hsa; identical to SEQ ID NO: 49067

SEQ ID NO: 51451 - RNA, 64 nt, hsa; identical to SEQ ID NO: 49068

SEQ ID NO: 51452 - RNA, 64 nt, hsa; identical to SEQ ID NO: 49069

SEQ ID NO: 51453 - RNA, 64 nt, hsa; identical to SEQ ID NO: 49070

SEQ ID NO: 51454 - RNA, 64 nt, hsa; identical to SEQ ID NO: 49071

SEQ ID NO: 51455 - RNA, 64 nt, hsa; identical to SEQ ID NO: 49072

SEQ ID NO: 51456 - RNA, 64 nt, hsa; identical to SEQ ID NO: 49073

SEQ ID NO: 51457 - RNA, 64 nt, hsa; identical to SEQ ID NO: 49074

SEQ ID NO: 51458 - RNA, 64 nt, hsa; identical to SEQ ID NO: 49075

SEQ ID NO: 51459 - RNA, 64 nt, hsa; identical to SEQ ID NO: 49076

SEQ ID NO: 51460 - RNA, 64 nt, hsa; identical to SEQ ID NO: 49077

SEQ ID NO: 51461 - RNA, 64 nt, hsa; identical to SEQ ID NO: 49078

SEQ ID NO: 51462 - RNA, 64 nt, hsa; identical to SEQ ID NO: 49079

SEQ ID NO: 51463 - RNA, 64 nt, hsa; identical to SEQ ID NO: 49080

SEQ ID NO: 51464 - RNA, 64 nt, hsa; identical to SEQ ID NO: 49081

SEQ ID NO: 51465 - RNA, 64 nt, hsa; identical to SEQ ID NO: 49082

SEQ ID NO: 51466 - RNA, 64 nt, hsa; identical to SEQ ID NO: 49083

SEQ ID NO: 51467 - RNA, 64 nt, hsa; identical to SEQ ID NO: 49084

SEQ ID NO: 51468 - RNA, 64 nt, hsa; identical to SEQ ID NO: 49085

SEQ ID NO: 51469 - RNA, 64 nt, hsa; identical to SEQ ID NO: 49086

SEQ ID NO: 51470 - RNA, 64 nt, hsa; identical to SEQ ID NO: 49087

SEQ ID NO: 51471 - RNA, 64 nt, hsa; identical to SEQ ID NO: 49088

SEQ ID NO: 51472 - RNA, 64 nt, hsa; identical to SEQ ID NO: 49089

SEQ ID NO: 51473 - RNA, 64 nt, hsa; identical to SEQ ID NO: 49090

SEQ ID NO: 51474 - RNA, 64 nt, hsa; identical to SEQ ID NO: 49091

SEQ ID NO: 51475 - RNA, 64 nt, hsa; identical to SEQ ID NO: 49092

SEQ ID NO: 51476 - RNA, 64 nt, hsa; identical to SEQ ID NO: 49093

SEQ ID NO: 51477 - RNA, 64 nt, hsa; identical to SEQ ID NO: 49094

SEQ ID NO: 51478 - RNA, 64 nt, hsa; identical to SEQ ID NO: 49095

SEQ ID NO: 51479 - RNA, 64 nt, hsa; identical to SEQ ID NO: 49096

SEQ ID NO: 51480 - RNA, 64 nt, hsa; identical to SEQ ID NO: 49097

SEQ ID NO: 51481 - RNA, 64 nt, hsa; identical to SEQ ID NO: 49098

SEQ ID NO: 51482 - RNA, 64 nt, hsa; identical to SEQ ID NO: 49099

SEQ ID NO: 51483 - RNA, 64 nt, hsa; identical to SEQ ID NO: 49100

SEQ ID NO: 51484 - RNA, 64 nt, hsa; identical to SEQ ID NO: 49101

SEQ ID NO: 51485 - RNA, 64 nt, hsa; identical to SEQ ID NO: 49102

SEQ ID NO: 51486 - RNA, 64 nt, hsa; identical to SEQ ID NO: 49103

SEQ ID NO: 51487 - RNA, 64 nt, hsa; identical to SEQ ID NO: 49104

SEQ ID NO: 51488 - RNA, 64 nt, hsa; identical to SEQ ID NO: 49105

SEQ ID NO: 51489 - RNA, 64 nt, hsa; identical to SEQ ID NO: 49106

SEQ ID NO: 51490 - RNA, 64 nt, hsa; identical to SEQ ID NO: 49107

SEQ ID NO: 51491 - RNA, 64 nt, hsa; identical to SEQ ID NO: 49108

SEQ ID NO: 51492 - RNA, 64 nt, hsa; identical to SEQ ID NO: 49109

SEQ ID NO: 51493 - RNA, 64 nt, hsa; identical to SEQ ID NO: 49110

SEQ ID NO: 51494 - RNA, 64 nt, hsa; identical to SEQ ID NO: 49111

SEQ ID NO: 51495 - RNA, 64 nt, hsa; identical to SEQ ID NO: 49112

SEQ ID NO: 51496 - RNA, 64 nt, hsa; identical to SEQ ID NO: 49113

SEQ ID NO: 51497 - RNA, 64 nt, hsa; identical to SEQ ID NO: 49114

SEQ ID NO: 51498 - RNA, 64 nt, hsa; identical to SEQ ID NO: 49115

SEQ ID NO: 51499 - RNA, 64 nt, hsa; identical to SEQ ID NO: 49116

SEQ ID NO: 51500 - RNA, 64 nt, hsa; identical to SEQ ID NO: 49117

SEQ ID NO: 51501 - RNA, 64 nt, hsa; identical to SEQ ID NO: 49118

SEQ ID NO: 51502 - RNA, 64 nt, hsa; identical to SEQ ID NO: 49119

SEQ ID NO: 51503 - RNA, 64 nt, hsa; identical to SEQ ID NO: 49120

SEQ ID NO: 51504 - RNA, 64 nt, hsa; identical to SEQ ID NO: 49121

SEQ ID NO: 51505 - RNA, 64 nt, hsa; identical to SEQ ID NO: 49122

SEQ ID NO: 51506 - RNA, 64 nt, hsa; identical to SEQ ID NO: 49123

SEQ ID NO: 51507 - RNA, 64 nt, hsa; identical to SEQ ID NO: 49124

SEQ ID NO: 51508 - RNA, 64 nt, hsa; identical to SEQ ID NO: 49125

SEQ ID NO: 51509 - RNA, 64 nt, hsa; identical to SEQ ID NO: 49126

SEQ ID NO: 51510 - RNA, 64 nt, hsa; identical to SEQ ID NO: 49127

SEQ ID NO: 51511 - RNA, 64 nt, hsa; identical to SEQ ID NO: 49128

SEQ ID NO: 51512 - RNA, 64 nt, hsa; identical to SEQ ID NO: 49129

SEQ ID NO: 51513 - RNA, 64 nt, hsa; identical to SEQ ID NO: 49130

SEQ ID NO: 51514 - RNA, 64 nt, hsa; identical to SEQ ID NO: 49131

SEQ ID NO: 51515 - RNA, 64 nt, hsa; identical to SEQ ID NO: 49132

SEQ ID NO: 51516 - RNA, 64 nt, hsa; identical to SEQ ID NO: 49133

SEQ ID NO: 51517 - RNA, 64 nt, hsa; identical to SEQ ID NO: 49134

SEQ ID NO: 51518 - RNA, 64 nt, hsa; identical to SEQ ID NO: 49135

SEQ ID NO: 51519 - RNA, 64 nt, hsa; identical to SEQ ID NO: 49136

SEQ ID NO: 51520 - RNA, 64 nt, hsa; identical to SEQ ID NO: 49137

SEQ ID NO: 51521 - RNA, 64 nt, hsa; identical to SEQ ID NO: 49138

SEQ ID NO: 51522 - RNA, 64 nt, hsa
acaaagaauacugaagccacucaagacucgggcccugaaggauucaucuaauuucucaguuucu

SEQ ID NO: 51523 - RNA, 64 nt, hsa
uuugauuuauauuucagcuagaucuaaaaagcaucugaaggaauuuacaaugaaagauaccuau

SEQ ID NO: 51524 - RNA, 64 nt, hsa
ugaucucaaccugcugacuuuuccuaaugcuuaccugaaggaacccauccuggcuagaaagggu

SEQ ID NO: 51525 - RNA, 64 nt, hsa
ugguuucacucuccucucuccuucuuuccaaacacugaaggauuuauuucaaacucucuaaugc

SEQ ID NO: 51526 - RNA, 64 nt, hsa
gcugcccucaaugugggagugaccccagccagaucugaaggacauuugggagagggaugcccag

SEQ ID NO: 51527 - RNA, 64 nt, hsa
ucaguugcuugcucuugugccuccugggcaagggcugaaggaggccacuccaucucaccucggg

SEQ ID NO: 51528 - RNA, 64 nt, hsa
caaguaaucauuaacccccagaccagccucagaacugaaggagauuguugacccagugaccugg

SEQ ID NO: 51529 - RNA, 64 nt, hsa
uccaccccacccaccucugcccuguccuuggcagcugaaggacaccuugacuuccagcuuuuac

SEQ ID NO: 51530 - RNA, 64 nt, hsa
cccucccucccaugacugagcccaucagccauuccugaaggaagacagugguagccacaggaac

SEQ ID NO: 51531 - RNA, 64 nt, hsa
uauuugucaccagauuagagaggcgugucaaggccugaaggagcccaugugguuggauaaaauc

SEQ ID NO: 51532 - RNA, 64 nt, hsa
uuuguuagcaauaacugaccuucaguuuacccuucugaaggagcagggacucagcacagaauuc

SEQ ID NO: 51533 - RNA, 64 nt, hsa
cagggacucagcacagaauucacuuuagacggggcugaaggagugucccuccucuaugugaaaa

SEQ ID NO: 51534 - RNA, 64 nt, hsa
cacccuaggugugagaugggauucuggaagcuuccugaaggauuugagugggaccuugugggag

SEQ ID NO: 51535 - RNA, 64 nt, hsa
cuaagaugucacugggggucacuaaagcugaagccugaaggaaagccucucauugcuguagagc

SEQ ID NO: 51536 - RNA, 64 nt, hsa
aaggcugcugauguaguucccggguuaccuguaucugaaggacgguucuggggcauaggaaaca

SEQ ID NO: 51537 - RNA, 64 nt, hsa
ugggaaaagucaaaauaaaacaaccagaaaaccccugaaggaaguaagauguuugaagcuuaug

SEQ ID NO: 51538 - RNA, 64 nt, hsa
ugugagcuacuuaacugacgcccucuuccuccaacugaaggaucgcccaacguuuuuggauuau

SEQ ID NO: 51539 - RNA, 64 nt, hsa
ugcuguggcauugguuauaucagagcacuuuaaucugaaggaugauacuguaacuugauuuauc

SEQ ID NO: 51540 - RNA, 64 nt, hsa
accugaccucuuugaaggaucagaaaauacuucccugaaggacugacauuugagccuagaccug

SEQ ID NO: 51541 - RNA, 64 nt, hsa
gcagacaugcaccagugauguggugacaggugcucugaaggaggucaccaggaccugaccucuu

SEQ ID NO: 51542 - RNA, 64 nt, hsa
cgagccauugaggacccuauccuggccuacacagcugaaggagagaucaacaaugugcaguggg

SEQ ID NO: 51543 - RNA, 64 nt, hsa
gaauugcucaucugagauuaguagaguagcaggccugaaggaugaugguuuuguccucuuuggu

SEQ ID NO: 51544 - RNA, 64 nt, hsa
gcacagcugccuguauuguccucaucuguucugacugaaggauggaggugcugaauaaauuagg

SEQ ID NO: 51545 - RNA, 64 nt, hsa
cgagcuggaaaaguuuauggagaccuucaaggcccugaaggagggccgugagccugacuacuca

SEQ ID NO: 51546 - RNA, 64 nt, hsa
cgucacagagcuuucagacgcccagaagaagcagcugaaggagcagcaggagguaagacugcgg

SEQ ID NO: 51547 - RNA, 64 nt, hsa
gcuaagcagccggagagacagccagggcggcuuccugaaggaugugggaugguggacuccgggg

SEQ ID NO: 51548 - RNA, 64 nt, hsa
cgggaagggugggcccuggaggggcccaugugggcugaaggaugggggcuccuggcagugaccu

SEQ ID NO: 51549 - RNA, 64 nt, hsa
guccaagaggaggaggacgaaggccuagacucagcugaaggaucuucaaagcaggaugaagacc

SEQ ID NO: 51550 - RNA, 64 nt, hsa
gaagaccuagacuuaccugaaggccuagacucagcugaaggaucuucaaagcaggaugaagacc

SEQ ID NO: 51551 - RNA, 64 nt, hsa
ggaucuucaaagcaggaugaagaccuagacuuaccugaaggaucuucaaagcagaaugaagacc

SEQ ID NO: 51552 - RNA, 64 nt, hsa
ggaucuucaaagcagaaugaagaccuaggcuuaccugaaggaucuucaaagcaggaugaagacc

SEQ ID NO: 51553 - RNA, 64 nt, hsa
ggaucuucaaagcaggaugaagaccuagacuuaccugaaggaucuucacaggaggauaaagacg

SEQ ID NO: 51554 - RNA, 64 nt, hsa
ggaucuucacaggaggauaaagacguagaauuaccugaaggaucuucacaggaggaugaagacc

SEQ ID NO: 51555 - RNA, 64 nt, hsa
ggaucuuugauggaggaagaagacccagacucaucugaaggaucgucagaggagggugaggaag

SEQ ID NO: 51556 - RNA, 64 nt, hsa
ggaucuucacaagaggaugaagaccuagacucaucugaaggaucuuugauggaggaagaagacc

SEQ ID NO: 51557 - RNA, 64 nt, hsa
ggaucuucacaggaggaugaagaccuaggguuaucugaaggaucuucacaagaggaugaagacc

SEQ ID NO: 51558 - RNA, 64 nt, hsa
gaaucuucaaagcaggaugaagaccuacaauuaccugaaggaucuucacaggaggaugaagacc

SEQ ID NO: 51559 - RNA, 64 nt, hsa
ccuaacugcagacuuuugcccuuuuucucucucaucaccaaagucccauccauuuuuuuuuaau

SEQ ID NO: 51560 - RNA, 64 nt, hsa
aacuaaacuuuucuaaagguuaccaguuauccaaucaccaaauccauggcuuuuucucaaagcu

SEQ ID NO: 51561 - RNA, 64 nt, hsa
agauugguaaugccagaaaaaauuuuaagaggacucaccaaaaguacuagaucuauguaaguug

SEQ ID NO: 51562 - RNA, 64 nt, hsa
aauaagagaugccagaacuacuuccauaacuaacucaccaaaucaaaucaucaguccucauauu

SEQ ID NO: 51563 - RNA, 64 nt, hsa
agauaguuuuggagccaggcauugauguagagguucaccaaacauauuuagggauaauagauaa

SEQ ID NO: 51564 - RNA, 64 nt, hsa
gaaucaacugcagaucuaauuugguucuaaguugucaccaaagcuauagccuucauaagcaacc

SEQ ID NO: 51565 - RNA, 64 nt, hsa
aucagcagccaaaacacuacaagccucuuguuuuucaccaaaacccuacaucucaggcuuacua

SEQ ID NO: 51566 - RNA, 64 nt, hsa
auaaaccaaagauggccagcacacugcuaaccagucaccaaauguaagacccauaagaaaccca

SEQ ID NO: 51567 - RNA, 64 nt, hsa
aaucaaguaugucccugaguagcaagauuaggccucaccaaagaagaaauuaaccugcacuuuc

SEQ ID NO: 51568 - RNA, 64 nt, hsa
ggugaggacucauuacugcaguauauugaucucuucaccaaaugcuuuuucuuuuucugaauaa

SEQ ID NO: 51569 - RNA, 64 nt, hsa
aguuuaaugaguagagagaauucccauguacacuucaccaaacuuccucuaaggauaauguaua

SEQ ID NO: 51570 - RNA, 64 nt, hsa
aaaaugaaagaggccaucacagcuaauccuauggucaccaaaaggauuagaaagaaacauggac

SEQ ID NO: 51571 - RNA, 64 nt, hsa
agcuaggcaguagugaccuuaggauaugacuaacucaccaaacaaugccaaggagaaaggcgga

SEQ ID NO: 51572 - RNA, 64 nt, hsa
aucgauuacauguauagcaguaguuuuggugaauucaccaaaucagcuuccacuuagcauuagg

SEQ ID NO: 51573 - RNA, 64 nt, hsa
uagauuuccaaaauuuucuacagagaguuaauuaucaccaaaaugugaaugguacauacaaaac

SEQ ID NO: 51574 - RNA, 64 nt, hsa
caaucugcccuuuucuccuuuguuuuuguaguuuucaccaaagaugaucaacuagaaauguuaa

SEQ ID NO: 51575 - RNA, 64 nt, hsa
caggccaaaugaacuaaacauugccuugcuauauucaccaaaaggacuuaauucuuguuuuuuu

SEQ ID NO: 51576 - RNA, 64 nt, hsa
uuauaaaaaugaacuaaacauugccuugcuauauucaccaaaaggacuuacuucuuguuuuuuc

SEQ ID NO: 51577 - RNA, 64 nt, hsa
aggaaauggagaguagugagcaaaacaucagauuucaccaaagaaccaaagugacuccacaauu

SEQ ID NO: 51578 - RNA, 64 nt, hsa
auuccaauaauuagggaaaauugauaaauaucugucaccaaaccacaagaaauccaaaaucauu

SEQ ID NO: 51579 - RNA, 64 nt, hsa
uuuucucuuuaguccacuuuugauuguaauuuuuaugguauaggauuuugaaucuucuauuuua

SEQ ID NO: 51580 - RNA, 64 nt, hsa
gaaaaacacugguauuuuuaugucuguauucaauaugguauaaaauauaaaaacuauauuuuaa

SEQ ID NO: 51581 - RNA, 64 nt, hsa
aacauuuuggcagguguagcuuuuucuguuaaaaaugguauacaugaagucacauacuuuuuua

SEQ ID NO: 51582 - RNA, 64 nt, hsa
uaacucacagaauggccuuaguuuucaaugucugaugguauauuugugaguuguguuaucugua

SEQ ID NO: 51583 - RNA, 64 nt, hsa
ccuuuccaaaauuaggugcuugguaaucacguuaaugguauaauuuuuuuuuuuuaauaucugg

SEQ ID NO: 51584 - RNA, 64 nt, hsa
auucuacaguuugaaacucugaugcuauauauacaugguauaauguauucagacuuugauuacu

SEQ ID NO: 51585 - RNA, 64 nt, hsa
uaaccuuguuguuuaccuuucacugauuucuuauaugguauaaauuaaaguucaggcauuuaug

SEQ ID NO: 51586 - RNA, 64 nt, hsa
caaguuugcugucuuuagaaugguuugugaaaauaugguauaaagguguuuucauuuuccuguu

SEQ ID NO: 51587 - RNA, 64 nt, hsa
cagugccuauggguuguuaauacuauauugcuguaugguauaugcaugcugauuuaccacuuau

SEQ ID NO: 51588 - RNA, 64 nt, hsa
cagugccucuggguuguuaauacuguauugcuguaugguauauguaugcugauuuacuacuuau

SEQ ID NO: 51589 - RNA, 64 nt, hsa
aucauuaaaauauucaaucuuccuauucauuaacaugguauaucucuucacuuuaagucuuuug

SEQ ID NO: 51590 - RNA, 64 nt, hsa
cccuuugagcaggaaauggugaaagcauguggcuaugguauagcccacagggcugagauugcug

SEQ ID NO: 51591 - RNA, 64 nt, hsa
uagaugguauagccuaccaguacaccuaggcuauaugguauagucuguugcuccuaggcuacaa

SEQ ID NO: 51592 - RNA, 64 nt, hsa
guaaacaucauguuguuuacuuccacaaaccuagaugguauagccuaccaguacaccuaggcua

SEQ ID NO: 51593 - RNA, 64 nt, hsa
uucuggaucuguuuaaucaauaagcccuauaaucacuugcuaaacacugggcuucaucacccag

SEQ ID NO: 51594 - RNA, 64 nt, hsa
ugaacccaacagucagaugagagaaaugaacccuacuugcuaucucuaucuuagaaagcaaaaa

SEQ ID NO: 51595 - RNA, 64 nt, hsa
uuguuuugaauuaagaaaugaguuucaggaauugacaaaccauuuguuaaccagcuguccuggg

SEQ ID NO: 51596 - RNA, 64 nt, hsa
uucuagaucuauccaccuuguuuuuuuauugucuacaaaccauuaaauguaaauauuguuuuua

SEQ ID NO: 51597 - RNA, 64 nt, hsa
uuauaaaaaguuauaaauaucgaguagcucuaaaacaaaccaccugaccaagagggaagugagc

SEQ ID NO: 51598 - RNA, 64 nt, hsa
cugccacacagcaaaaaauuguuuacuuuguuggacaaaccaaaucaguucucaaaaaaugacc

SEQ ID NO: 51599 - RNA, 64 nt, hsa
guuguuuuuaaagguuuuguacucagcacaucauacaaaccacauuacuucugucacuucaggg

SEQ ID NO: 51600 - RNA, 64 nt, hsa
agcauucgggucaaauccauggacacccugggcuacaaaccaaggcugcuguucaucccacauc

SEQ ID NO: 51601 - RNA, 64 nt, hsa
aacuucauguauaaauaaaauacauauuuuuaaaacaaaccaauaaauggcuuacaugaccugg

SEQ ID NO: 51602 - RNA, 64 nt, hsa
uuuuucaccauggcaaaccuaaaugcagucagucacaaaccagccuggggccuuccuggcuuug

SEQ ID NO: 51603 - RNA, 64 nt, hsa
guggggcucccauucugguagagggagacagucuacaaaccagaaagcaucagggaugcuaagu

SEQ ID NO: 51604 - RNA, 64 nt, hsa
aguuuagcauuuccaucugcgaugaauguaggccacaaaccacaguaguauuagcagugccugg

SEQ ID NO: 51605 - RNA, 64 nt, hsa
guucuuguacccagagugauucuacaugggaaaaacaaaccagcuuuuuucagagagugaccga

SEQ ID NO: 51606 - RNA, 64 nt, hsa
gaaaaaauugcuucuuuuauugguuuccaaagaaacaaaccaaaccaaccagcucuuggaugug

SEQ ID NO: 51607 - RNA, 64 nt, hsa
ugacuguacauuuuagugauuugaaaaauaacugacaaaccauugaaacaguuuauuuuauguu

SEQ ID NO: 51608 - RNA, 64 nt, hsa
uaaauauauauaaauaaaggaaccuuuuauacugacaaaccagagaaaaauggaccuuuuucca

SEQ ID NO: 51609 - RNA, 64 nt, hsa
gugcauguccuuugcgccugugaccaccaccccaacaaaccauccagugacaaaccauccagug

SEQ ID NO: 51610 - RNA, 64 nt, hsa
gccugugaccaccaccccaacaaaccauccagugacaaaccauccaguggagguuugucgggca

SEQ ID NO: 51611 - RNA, 64 nt, hsa
cuuagaaauacacguaugguuaauguucaguccaacaaaccacacacaguaaauguuuauuaau

SEQ ID NO: 51612 - RNA, 64 nt, hsa
gcauugucauuugggcuuucuguugaaugaaucaacaaaccacaauacuuccugggaccuuuug

SEQ ID NO: 51613 - RNA, 64 nt, hsa
uuagaggggccuacaaaccagcaacaugaaauggacaaaccaaucugcuuaagauccugucaua

SEQ ID NO: 51614 - RNA, 64 nt, hsa
auagaaggaaaaacgaagggccuuagaggggccuacaaaccagcaacaugaaauggacaaacca

SEQ ID NO: 51615 - RNA, 64 nt, hsa
ucguuucaaacccacaaaauuucucacacaggacacaaaccauaugauuguaaggaauguagga

SEQ ID NO: 51616 - RNA, 64 nt, hsa
ucccuucauugccacaucagaguugaugcugggcacaaaccacaugaguaucaggaauauggag

SEQ ID NO: 51617 - RNA, 64 nt, hsa
uuagucuuuugauucaaauucaaaacuuaacagcacaaaccaggucagaguuacuuucgguuag

SEQ ID NO: 51618 - RNA, 64 nt, hsa
aaaggugcuaaaccucucugaccuguguacauucacaaaccacagcuagaauuccuccaccuag

SEQ ID NO: 51619 - RNA, 64 nt, hsa
agggcggaaaaccgcuuaaagggguuccugaaccacaaaccauagcauaagugaucugugccuu

SEQ ID NO: 51620 - RNA, 64 nt, hsa
ugcugcuucagugugguggccaucaugcugugugacaaaccaggcuguucacagcuuccucagc

SEQ ID NO: 51621 - RNA, 64 nt, hsa
aggaaggugagggugagcagagauguguguggacaucucugaccauccaucgcuguauucaaau

SEQ ID NO: 51622 - RNA, 64 nt, hsa
uggaacagcucaccuugucagacagccucagggcaucucugagacacaggggcagaaaaugaca

SEQ ID NO: 51623 - RNA, 64 nt, hsa
aaaucaagucaaucccccauccucacacccacucaucucugaggagcuaugaacugguuuuggu

SEQ ID NO: 51624 - RNA, 64 nt, hsa
ccaggcaagagccauguuuuugagaagguucuggaucucugacuccauccugacuguuuaguaa

SEQ ID NO: 51625 - RNA, 64 nt, hsa
agcugcuucugcccccuugauccaaaugaccaucaucucugauggagauggguuggguaccugg

SEQ ID NO: 51626 - RNA, 64 nt, hsa
gcugcccacuccugaugcccauuggucaccagauaucucugagggccaagcuaugcccaggaau

SEQ ID NO: 51627 - RNA, 64 nt, hsa
cccagcuccuaccucugaccccaacuucucuuugaucucugaauccccucugacuccaacuucu

SEQ ID NO: 51628 - RNA, 64 nt, hsa
cgaggcuucugaccuuugauccgcuaggccccccaucucugaacccuagagccccgcuuucccu

SEQ ID NO: 51629 - RNA, 64 nt, hsa
uuugggcuauuucuguaugauccaauaacuuauuuugucacagggcuuaauuugccauuuuugg

SEQ ID NO: 51630 - RNA, 64 nt, hsa
gucucaucuuuucuagguugucaacagguacuauuugucacauaacuaacuuucgaggcacugg

SEQ ID NO: 51631 - RNA, 64 nt, hsa
ucucagaccuccagugaguaccugcaaaaaugaguugucacagaaauuaugauccucuauuucc

SEQ ID NO: 51632 - RNA, 64 nt, hsa
cuggggugcauuucccccgcagugcauaccggacuugucacacggaccucgggcuaguuaaggu

SEQ ID NO: 51633 - RNA, 64 nt, hsa
auaugagcuacugcauguaauucuuaaacugggcuugucacauuguauuguauuuuugugaucu

SEQ ID NO: 51634 - RNA, 64 nt, hsa
ucuucuguuguccaaggcuguaaaauggacagccuugucacaccuccccggugcuguuuuacaa

SEQ ID NO: 51635 - RNA, 64 nt, hsa
aaaagacacugguguaucucagaaggggaugguguugucacaaacugugguuaauccaaucaau

SEQ ID NO: 51636 - RNA, 64 nt, hsa
ccaaccaguaggauauuucuacaagguguucauuuugucacaagcuguagauaacagcaagaga

SEQ ID NO: 51637 - RNA, 64 nt, hsa
uuaauagggacuaaugugggaagaacuggcuaauuugucacagugcuuaguuacaacuguuaau

SEQ ID NO: 51638 - RNA, 64 nt, hsa
aauaauggaggcaaugguaugacuccaagugcuauugucacagaugaaauuggcaguauugacc

SEQ ID NO: 51639 - RNA, 64 nt, hsa
acuuauuuaauguauuucaucucauguuuucuuauugucacaagaguacaguuaaugcugcgug

SEQ ID NO: 51640 - RNA, 64 nt, hsa
auaaagccccaaaauuaagaauucuuuugucauuuugucacauuugcucuauggggggaauuau

SEQ ID NO: 51641 - RNA, 62 nt, hsa
ucacgccaggccccguccugccgugacacccuucauccuacccuuggaaccccaaggccaag

SEQ ID NO: 51642 - RNA, 62 nt, hsa
gauaaagcaacagccugcccagaucccucuguucauccuaucccuuccaagguugguccaug

SEQ ID NO: 51643 - RNA, 62 nt, hsa
uguaggaaaaacaaucuugccaaauaaugaauucauccuaggauguguagacaauaaucugc

SEQ ID NO: 51644 - RNA, 62 nt, hsa
cauaugcaaaaguccugcaugccucaacuuucucauccuaaaacuggaaacuuauuucucau

SEQ ID NO: 51645 - RNA, 62 nt, hsa
ccuccacccagaaaacugcccuuuucuuucucucauccuacauagcugccuggcaaaucccu

SEQ ID NO: 51646 - RNA, 62 nt, hsa
ccucccccaauccauacacauacauaccuaggucauccuaucacccaaaagagggacaaaca

SEQ ID NO: 51647 - RNA, 64 nt, hsa
ucauccaaacugagcaguuucuguguauauauagaagguagaaaugaaaagugagaaaauauuu

SEQ ID NO: 51648 - RNA, 64 nt, hsa
acaaauaagcuuuuaaacuggugucuuuggaaggaagguagauacaaaaagauugugguaaaaa

SEQ ID NO: 51649 - RNA, 64 nt, hsa
aaagaugaagcuggagagagaggaaccaguugccaagguagagagcugcccgcuccugcccucu

SEQ ID NO: 51650 - RNA, 64 nt, hsa
aguacccaugucuuuuucaugucuaaccauugggaagguagaggcuggcagggaagacaaaucu

SEQ ID NO: 51651 - RNA, 64 nt, hsa
aaaaacaaaaacaaacaacaacaacaaaauuauaaagguagaaaauaaaccuaaauugugucgu

SEQ ID NO: 51652 - RNA, 64 nt, hsa
augaacucccagaagauuuuauuauuuaauuguaaagguagaggccagacgcaguggcucacgc

SEQ ID NO: 51653 - RNA, 64 nt, hsa
uguauuccuuuggcuuggcaucuuuuagcucaggaagguagaagagaucugugcccaugggucu

SEQ ID NO: 51654 - RNA, 64 nt, hsa
aaagagccuauucgauagcuagaagggaauaugaaagguagaagugacuucaaggucacgaggu

SEQ ID NO: 51655 - RNA, 64 nt, hsa
acucacugucuuuucuccacacuuguccuaagccaagguagauuuguacguagacagacuggug

SEQ ID NO: 51656 - RNA, 64 nt, hsa
auaggaaggaccacaacaugacccguaagucaagaagguagacauuucauauccagcuuccuug

SEQ ID NO: 51657 - RNA, 64 nt, hsa
auggauucacugaugugcauuuuucgagauacuuaagguagaaaugauaccaagucuguacugu

SEQ ID NO: 51658 - RNA, 64 nt, hsa
uuccuugcaagaugcauucucucaaagcucauaaaagguagaucucaguaggcauauauaucua

SEQ ID NO: 51659 - RNA, 64 nt, hsa
guagccagugguaauacaaagcagggagaacagaaagguagaguuacuaaggccuucagugaac

SEQ ID NO: 51660 - RNA, 64 nt, hsa
cucacuuauguuaaugcaaucuugaaaugacugaaagguagauugccagcacagugaguuuccc

SEQ ID NO: 51661 - RNA, 64 nt, hsa
aaccccaucugaagguuaccagcaucaaagaccaaagguagauaaauucacgaagaugaggaga

SEQ ID NO: 51662 - RNA, 64 nt, hsa
uacaggcaaccagccugacuuaaaacaguaucuuaagguagauggugauuagcacauguaguau

SEQ ID NO: 51663 - RNA, 64 nt, hsa
ccucacccacccucuguguuuccccuucuuugaaaagguagaagagaaaggaauauuuuaaacc

SEQ ID NO: 51664 - RNA, 64 nt, hsa
uuagcauuuugaaagacuuucacagugagaguagaagguagauuuggaaucaugcauuuuagca

SEQ ID NO: 51665 - RNA, 63 nt, hsa
aauugcuuugacuucuaaauguuucugcuucccagaaugcaccugacuuaugaaauggggaua

SEQ ID NO: 51666 - RNA, 63 nt, hsa
uguucccaucaguuuagcccagagauagacaguagaaugcaaauaccucccuccccuaaacug

SEQ ID NO: 51667 - RNA, 63 nt, hsa
augaaaacugguuuguagcaguuuugaaagaauagaaugcauucaaauguaaggcugcuucug

SEQ ID NO: 51668 - RNA, 63 nt, hsa
uaggagagagugagugaaagaagccaagggucaagaaugcagaagcaaaggaaggacuaaaaa

SEQ ID NO: 51669 - RNA, 63 nt, hsa
ggaaaaguuuaaagacaguucaauuuaaucaucagaaugcauucuuuuuuuuuucggagacgg

SEQ ID NO: 51670 - RNA, 63 nt, hsa
ggauuacaggcaugagccacugcgccuggccucagaaugcauucuuacacaucuauccuagac

SEQ ID NO: 51671 - RNA, 63 nt, hsa
uaacuacguuggcacugguacgaauucucagugagaaugcaaugaaacagucaacugcagugu

SEQ ID NO: 51672 - RNA, 63 nt, hsa
uuaccacauaggcacugguacgaauucucaauaagaaugcaguggaacaguuaaguagaacug

SEQ ID NO: 51673 - RNA, 63 nt, hsa
ccuaauauucuugcccaggauccuuggaacuuaagaaugcagccaagcaauuguuaauaucuc

SEQ ID NO: 51674 - RNA, 63 nt, hsa
ggcccucgggacaagcuuugggacaugaggaaaagaaugcagagagggugcaagcagaauaca

SEQ ID NO: 51675 - RNA, 63 nt, hsa
aggcuuugugauuguaagcacugucaugaucacagaaugcaagcuucugguaccaugauccuc

SEQ ID NO: 51676 - RNA, 63 nt, hsa
aaggauuuuuaacuuguacuuuugugaacgaagagaaugcauaaauaauguuggugaggauaa

SEQ ID NO: 51677 - RNA, 63 nt, hsa
ccagcugacaucuugaauccuuccauuccacacagaaugcaaccaagucacacgcuuuugaau

SEQ ID NO: 51678 - RNA, 63 nt, hsa
aacauccacaauaaccaagauauuuuuaucccaagaaugcaagauuucagaaaaugaaaaauc

SEQ ID NO: 51679 - RNA, 63 nt, hsa
uugacuugauuuuuuaagcuacccugaauuuccagaaugcagguucuaaagaaaucuagauga

SEQ ID NO: 51680 - RNA, 63 nt, hsa
aguuguagauuauugggaugaagcuaaauccccagaaugcagcagcagcugagcauguuaaaa

SEQ ID NO: 51681 - RNA, 63 nt, hsa
aauauaucugugauuuuaaaauuuugcuaccaaagaaugcauguucugugugcccugaaaaug

SEQ ID NO: 51682 - RNA, 63 nt, hsa
cuacucacacauuaacccccaaauucaaaaguaagaaugcaaaagucuagaggggguaacagu

SEQ ID NO: 51683 - RNA, 63 nt, hsa
guuucucagcacacugcagaagggcagcucagaagaaugcagggcccauucagcauggggauc

SEQ ID NO: 51684 - RNA, 63 nt, hsa
cucuacagccuggccucaacucuaaaagugugaagaaugcaaugggcagagaccuaccugcag

SEQ ID NO: 51685 - RNA, 63 nt, hsa
cuaugcauguuuaaagaucugguccccuuuaugagaaugcaagccgauccacauccugacuua

SEQ ID NO: 51686 - RNA, 63 nt, hsa
aacuaauaaguaguaacaauaaacuucauauuuagaaugcaaagucuauaaagaauaauuuua

SEQ ID NO: 51687 - RNA, 63 nt, hsa
gccaacugaaaccccagagguuuguauaucaguagaaugcaagaacauuguuaaaggugcuua

SEQ ID NO: 51688 - RNA, 63 nt, hsa
cuuuuuuuuuuuucuuccccuggcuacuugaguagaaugcauuauaccagaucuggucacuuu

SEQ ID NO: 51689 - RNA, 64 nt, hsa
cauccacauguguuguacuuucagcucuaggcaugcagacaaccccacacggccacaccaccac

SEQ ID NO: 51690 - RNA, 64 nt, hsa
gccucccauccccagacccaccagacaccacacagcagacaauacacacccacucgcacaagcu

SEQ ID NO: 51691 - RNA, 64 nt, hsa
agaaguccaaacuuuuuuuuuauuacuagcuucagcagacaaaaacuuccucugucaagguguu

SEQ ID NO: 51692 - RNA, 64 nt, hsa
gucuuagagcauguguguauucagucagauacuggcagacaauucagaacuuucaccacaugag

SEQ ID NO: 51693 - RNA, 64 nt, hsa
uguaaaggaggguuugguccugucugcuuccucaccuugagaguaaagugcugcccucugcccc

SEQ ID NO: 51694 - RNA, 64 nt, hsa
aaggcauuucccaaguuagucgcuaccuaaucagccuugagaagaauccuuuccucuucuuuga

SEQ ID NO: 51695 - RNA, 64 nt, hsa
uauauuaaauucugaaugcaauuuuuuuuuguucccuugagaccaaaauuuaaguuaacuguug

SEQ ID NO: 51696 - RNA, 64 nt, hsa
guauuuuuuaaggcaaauaaagaugauuagcucaccuugagauaacaaucagguaagaucauaa

SEQ ID NO: 51697 - RNA, 64 nt, hsa
ugaagauauuuuaccaugaagagauugcacuuauccuugagaacagucuaaauauaaaugaaga

SEQ ID NO: 51698 - RNA, 64 nt, hsa
ugaagauauuuuaccaugaagagauugcacuuauccuugagaacagucuaaugauacuuuuuuu

SEQ ID NO: 51699 - RNA, 64 nt, hsa
aggcaucuugguuguaagucccuuuauucacagaccuugagaccacuggggucucccacaaggu

SEQ ID NO: 51700 - RNA, 64 nt, hsa
ugccugccugggccgccucuguggccuacuggccccuugagaaggggcuggcuuaccccccaag

SEQ ID NO: 51701 - RNA, 64 nt, hsa
ucucugccuugagacugccuugagacagugcuugccuugagagagugagccaauuaacagcugc

SEQ ID NO: 51702 - RNA, 64 nt, hsa
uguuuuuugcugugucaucucugccuugagacugccuugagacagugcuugccuugagagagug

SEQ ID NO: 51703 - RNA, 64 nt, hsa
uucucccccucuguuuuuugcugugucaucucugccuugagacugccuugagacagugcuugcc

SEQ ID NO: 51704 - RNA, 64 nt, hsa
auuuuuuuaaaaugagucgugggguagugcuucaccuugagaugcuuugaaagagcccuaaaca

SEQ ID NO: 51705 - RNA, 64 nt, hsa
uaauuaaacauggaggaugaauuaccuuccuaucccuugagauaagacaucuuucaguuucaug

SEQ ID NO: 51706 - RNA, 64 nt, hsa; identical to SEQ ID NO: 51689

SEQ ID NO: 51707 - RNA, 64 nt, hsa; identical to SEQ ID NO: 51690

SEQ ID NO: 51708 - RNA, 64 nt, hsa; identical to SEQ ID NO: 51691

SEQ ID NO: 51709 - RNA, 64 nt, hsa; identical to SEQ ID NO: 51692

SEQ ID NO: 51710 - RNA, 64 nt, hsa; identical to SEQ ID NO: 51693

SEQ ID NO: 51711 - RNA, 64 nt, hsa; identical to SEQ ID NO: 51694

SEQ ID NO: 51712 - RNA, 64 nt, hsa; identical to SEQ ID NO: 51695

SEQ ID NO: 51713 - RNA, 64 nt, hsa; identical to SEQ ID NO: 51696

SEQ ID NO: 51714 - RNA, 64 nt, hsa; identical to SEQ ID NO: 51697

SEQ ID NO: 51715 - RNA, 64 nt, hsa; identical to SEQ ID NO: 51698

SEQ ID NO: 51716 - RNA, 64 nt, hsa; identical to SEQ ID NO: 51699

SEQ ID NO: 51717 - RNA, 64 nt, hsa; identical to SEQ ID NO: 51700

SEQ ID NO: 51718 - RNA, 64 nt, hsa; identical to SEQ ID NO: 51701

SEQ ID NO: 51719 - RNA, 64 nt, hsa; identical to SEQ ID NO: 51702

SEQ ID NO: 51720 - RNA, 64 nt, hsa; identical to SEQ ID NO: 51703

SEQ ID NO: 51721 - RNA, 64 nt, hsa; identical to SEQ ID NO: 51704

SEQ ID NO: 51722 - RNA, 64 nt, hsa; identical to SEQ ID NO: 51705

SEQ ID NO: 51723 - RNA, 64 nt, hsa
cccugacucucugugaccugccccgcccagcugcaccugccagccuggcuucuggagcccuugg

SEQ ID NO: 51724 - RNA, 64 nt, hsa
aaagccaaacucugccagccacauccaaccccccaccugccauuugcacccuccgccuucacuc

SEQ ID NO: 51725 - RNA, 64 nt, hsa
aggggaggccagcccugcccucaggaccugccugaccugccagugaugccaagagggggaucaa

SEQ ID NO: 51726 - RNA, 64 nt, hsa
ucaagcacuggccucugccccuccuccuuccagcaccugccagagcuucuccaggaggccaagc

SEQ ID NO: 51727 - RNA, 64 nt, hsa
gcuguucauaccacaucaguguuuccgucugcucaccugccacagagcccacacccaugcccac

SEQ ID NO: 51728 - RNA, 64 nt, hsa
cccucccagggcagccccaaccaggucuccucccaccugccacacagcgcuccggggccugagg

SEQ ID NO: 51729 - RNA, 64 nt, hsa
ccugccauagccuugaugccacugggcacaagccaccugccaaauacaggaguggccucuccca

SEQ ID NO: 51730 - RNA, 64 nt, hsa
ucucccacacacgacaaagucacagacauccugcaccugccacuaggcauccucauccuacuga

SEQ ID NO: 51731 - RNA, 64 nt, hsa
ugacccgcccagacuguccccagacucccccgagaccugccagccccggcauccuggaaguccc

SEQ ID NO: 51732 - RNA, 64 nt, hsa
gccccggcauccuggaagucccgacuccccccagaccugccagccccggcguccuggagcuggg

SEQ ID NO: 51733 - RNA, 64 nt, hsa
ugugggcccuggggagaggagagaaagggcucccaccugccagucccuggggggaggcaggagg

SEQ ID NO: 51734 - RNA, 64 nt, hsa
caccaagagugacccacucucuuccauccgagaaaccugccaugcucugggacgugugggcccu

SEQ ID NO: 51735 - RNA, 64 nt, hsa
gccguuuaucuucucugaaagaacuucaaaucuuaccugccaacauauucaccauaauuuuuuu

SEQ ID NO: 51736 - RNA, 64 nt, hsa
ugccucagccuccugaguagcugggacuacaggcaccugccaccacgcccagcuaauuuuugua

SEQ ID NO: 51737 - RNA, 64 nt, hsa
gucuuccaggaaaaaaucccguuuggccaccgugaccugccaaaaguucucuugccccaugccu

SEQ ID NO: 51738 - RNA, 64 nt, hsa
gugguuucuccacuccuccccgcucaugucccacaccugccauauugaaccguuucugcacuaa

SEQ ID NO: 51739 - RNA, 64 nt, hsa
aauuuaguugaggcuggauucgauugcucaguucaccugccacguucucuccaaggaguggggu

SEQ ID NO: 51740 - RNA, 64 nt, hsa
acucccuugucuuuuuccagacuguuaagccaagaccugccaggagugucucuaagagauccag

SEQ ID NO: 51741 - RNA, 64 nt, hsa
ccucuaccuuuccagccaaggcauggacccugacaccugccaacagccccucugcccucacaac

SEQ ID NO: 51742 - RNA, 64 nt, hsa
guccccucucucacucugccuucaguggagcuagaccugccaggagcacuuggccugcaggggc

SEQ ID NO: 51743 - RNA, 64 nt, hsa
cccucagcagaggcagcugguggcuuugcccuccaccugccaacccuugggcucggagccccgg

SEQ ID NO: 51744 - RNA, 64 nt, hsa
gaagacaggcacaguccucucuguucauagaaacaccugccagugucaaggauuccagucaggu

SEQ ID NO: 51745 - RNA, 64 nt, hsa
ggaguggcccucagugucaucuguccacagugauaccugccaagaugaccacugacccacaucu

SEQ ID NO: 51746 - RNA, 64 nt, hsa
cccagcaugugguuacaguucucugacuugcagaaccugccagguguauggcuacaaguuaucc

SEQ ID NO: 51747 - RNA, 64 nt, hsa
gccucugacccuagcccugcccuggcagcaugggaccugccaacagcugaggguggcagcaguc

SEQ ID NO: 51748 - RNA, 64 nt, hsa
cuugggcaaguccugcccaccauaggccucugcuaccugccagucagcggggaaguucaccaga

SEQ ID NO: 51749 - RNA, 61 nt, hsa
ccggugccuaggauugugccuguaugcaacaggcacucaauaaauauuuuugcuguagacu

SEQ ID NO: 51750 - RNA, 61 nt, hsa
accucgaguuagaacccggcccacguagggcggcacucacacgcgaaaguaucaccagggu

SEQ ID NO: 51751 - RNA, 61 nt, hsa
ccccugcuuucucaaacacuugcccaccucaggcacucagcgggcuccgccguggugagag

SEQ ID NO: 51752 - RNA, 61 nt, hsa
agccagguccgcaucuccccaccaccaccagggcacucacucgcagcuauagcccaggaca

SEQ ID NO: 51753 - RNA, 64 nt, hsa
agcaugcacacuuguugcuacccucauuuuguaaccaauuuauuugccuuaugaaugugauugc

SEQ ID NO: 51754 - RNA, 64 nt, hsa
accucuggcuaccuagaguucuuccugucuugacccaauuuaugagaaagcucccaguugggac

SEQ ID NO: 51755 - RNA, 64 nt, hsa
aagcaaaagauuaagaguucaaaaguaaaugcaaccaauuuaacauguaguguuauuaaaaaau

SEQ ID NO: 51756 - RNA, 64 nt, hsa
uguuuugcaaugggauauauuuuuacuuauaauaccaauuuaggcugggcgcaguggcucacgc

SEQ ID NO: 51757 - RNA, 64 nt, hsa
aaaccacuggucuagcuuuagauaggauauugagccaauuuaaauaaagcaauauacuggucua

SEQ ID NO: 51758 - RNA, 64 nt, hsa
caagaauaaagauuucuuuagauagguuguugagccaauuuaaguaaagcaauguuauugugac

SEQ ID NO: 51759 - RNA, 64 nt, hsa
cugggaauagacaugguacuuaccuuagaguuuuccaauuuaucucaauuuuauauggcuugug

SEQ ID NO: 51760 - RNA, 64 nt, hsa
gcaugggauuuuuuaaagagcugcucagguaauuccaauuuaauugcguguccuacuuggguuu

SEQ ID NO: 51761 - RNA, 64 nt, hsa
gaguuuugggccugugcacggucaaccccaauuaccaauuuaguugaggcuggauucgauugcu

SEQ ID NO: 51762 - RNA, 64 nt, hsa
cugcacuuuuuauagagcugcauugucggugauuccaauuuaaaaauccauauucaaaaauacc

SEQ ID NO: 51763 - RNA, 64 nt, hsa
aacucuugauuacuaagaggcaguuagagacaaaccaauuuaauuccaugucuucaauugucac

SEQ ID NO: 51764 - RNA, 64 nt, hsa
uccaucacuuugaggacuuguguaugggcuuguaccaauuuacugacacugucuuaaauccuaa

SEQ ID NO: 51765 - RNA, 64 nt, hsa
caggugugugguaaacggguaaugcaugggaaauaaugagaagcagcucacagaguuuaaacua

SEQ ID NO: 51766 - RNA, 64 nt, hsa
agcacuuuaauuuuuuugccuuacuuucaugugcaaugagaauuacuuaagaauugguaacgca

SEQ ID NO: 51767 - RNA, 64 nt, hsa
agacagccagauccagugauugacuuggcaugaaaaugagaaaaugcagacagaccucaacauu

SEQ ID NO: 51768 - RNA, 64 nt, hsa
ccucuucaucaacauaguaaaauaagucaaacaaaaugagaacaccaaauuuugggggaauaaa

SEQ ID NO: 51769 - RNA, 64 nt, hsa
ucucuaacacguuuuuuacuucaguagugagggcaaugagaagcuuuauuaagaaagauccuau

SEQ ID NO: 51770 - RNA, 64 nt, hsa
gcuagugauuuucucaucuuuccuuuucuaaccuaaugagaaugucccagauucaauuaccugg

SEQ ID NO: 51771 - RNA, 64 nt, hsa
agcuuauugaaauaacugucgcugaauaaggagcaaugagaaacaaaacuaauuuuuggagcag

SEQ ID NO: 51772 - RNA, 64 nt, hsa
aaugaauauauuucuuaauacaaaauaagugggaaaugagaaguuauaccaauaaaaagcauuu

SEQ ID NO: 51773 - RNA, 64 nt, hsa
aauacuugaaauagaccuauaaaauaguaauuaaaaugagaaauacauaagaugauaaauaaaa

SEQ ID NO: 51774 - RNA, 64 nt, hsa
aaaggcacgucuuacauggcgguggacaagagagaaugagaacuaagugaaaagggaaacccuu

SEQ ID NO: 51775 - RNA, 64 nt, hsa
aaaggucauuguauccauuuuuaaaacaaacuaaaaugagaacauuagguucaauuuucuuauu

SEQ ID NO: 51776 - RNA, 64 nt, hsa
auuagcuaauucuauuacuacuuagcguguuucuaaugagaaguuacugaaaucuauuacuguc

SEQ ID NO: 51777 - RNA, 64 nt, hsa
auuugaaauugcauuacaguucauaaaaauugaaaaugagaaauuaaaccugcaagugaaacau

SEQ ID NO: 51778 - RNA, 64 nt, hsa
accucaguaaaaauagugaagacaugcaucauggaaugagaaaaugagaaaggaaugaguuguc

SEQ ID NO: 51779 - RNA, 64 nt, hsa
aaaaauagugaagacaugcaucauggaaugagaaaaugagaaaggaaugaguugucuaacauca

SEQ ID NO: 51780 - RNA, 64 nt, hsa
ucaagagccaucugcuuuccaggugaacauuggaaaugagaaucuuugaaacuuagcaauaugu

SEQ ID NO: 51781 - RNA, 64 nt, hsa
gccauuuuccaagugguggcugacuguugcagggaaugagaauuucauaauacacugcuauuuc

SEQ ID NO: 51782 - RNA, 64 nt, hsa
uaaaaauuguugcuucuguuuuguuuuaagaggaaaugagaaggccagcagaaguagauuaaaa

SEQ ID NO: 51783 - RNA, 64 nt, hsa
uauugguuaauuagaaauacucagcacaauauuuaaugagaaaucacaucagucacaagaauca

SEQ ID NO: 51784 - RNA, 64 nt, hsa
cagaaaauuuacgaaaaucuuagauuuuguuuagaaugagaaaauauacaauuagaauuauuuu

SEQ ID NO: 51785 - RNA, 64 nt, hsa
ucaauuuggguaaagaaaggaauacuuuuguuagaaugagaauuaaagagaaaacaaaagaauc

SEQ ID NO: 51786 - RNA, 64 nt, hsa
caagcuucccauuucuguauaauuuaagcaugaaaaugagaacacugagauuugauaggcaugu

SEQ ID NO: 51787 - RNA, 64 nt, hsa
acuuuuggacuggguuuguaacacgguuaaaggcaaugagaaacaagcagaauuccaggagucc

SEQ ID NO: 51788 - RNA, 64 nt, hsa
uagaaaaagaauuugguuuugcucguuuaagagcaaugagaaaaugauggaauguugacugugu

SEQ ID NO: 51789 - RNA, 64 nt, hsa
gaguguuucuucugaagaaccaaagcugaaauuuaaugagaauuucuacaauuaauggaauucc

SEQ ID NO: 51790 - RNA, 64 nt, hsa
uagcaaguagcuuacaaggggacaauucuggacuaaugagaaagaccugaagugaaggcuagag

SEQ ID NO: 51791 - RNA, 64 nt, hsa
ggagauggugagcacaagguaagucauaaagaauaaugagaaaauaaaucuaugcuggugcagc

SEQ ID NO: 51792 - RNA, 64 nt, hsa
uagauagauagauagauagauagauagauagagaaaugagaagguuucucuuuugcaauagaac

SEQ ID NO: 51793 - RNA, 64 nt, hsa
uaaaacuauuucagauguauuauaugauugagcaaaugagaaaacauguugauguugaugggag

SEQ ID NO: 51794 - RNA, 64 nt, hsa
aauuaucaguuaggcaauguuuuuaaaacuuaguaaugagaaacugugaaaagagccaaguguu

SEQ ID NO: 51795 - RNA, 64 nt, hsa
caagaauuaguccaaauggaaccccuugaaggauaaugagaaaccacaaggccugccucugacu

SEQ ID NO: 51796 - RNA, 64 nt, hsa
aacaagcauggggauucuuuucuaagguaauauuaaugagaagggaaaaaaguaucuuuaacag

SEQ ID NO: 51797 - RNA, 64 nt, hsa
agguuaccaagauuaaaaagugagauaaauggucaaugagaaagaauggaagaugguaaacaau

SEQ ID NO: 51798 - RNA, 64 nt, hsa
gggcuuaucagaacuccuuucuaaggagcacuagaaugagaaaucauguuguucgaucguuuca

SEQ ID NO: 51799 - RNA, 64 nt, hsa
uagccaacuuaaaccugugcuuucauguuuaagaaaugagaaauugugccaaagauagcagaag

SEQ ID NO: 51800 - RNA, 64 nt, hsa
auauuuuacugccuuuccuuuuaauuuuuguuugaaugagaaaaguuuaauacaacaggugucc

SEQ ID NO: 51801 - RNA, 64 nt, hsa
ugaauacuccauccccuucccucccagugaauggaaugagaaaagccuucuuccuuugcuucag

SEQ ID NO: 51802 - RNA, 64 nt, hsa
caggccuucuaaaaagcagguuaaaaugcucuaaaaugagaaagccugugguuucacuuauuua

SEQ ID NO: 51803 - RNA, 64 nt, hsa
ggcuuuguaaaaugaagaguagaauuccaagaaaaaugagaaauaauuuuguaaaacuuaacaa

SEQ ID NO: 51804 - RNA, 64 nt, hsa
uccaggauuuagaagugucuuuccagagaagcauaaugagaaagucagacugagguaauaagac

SEQ ID NO: 51805 - RNA, 64 nt, hsa
augaagcuguaauucugaaauacacauccaagugaaugagaauuaaaaauuuucuaaauauuaa

SEQ ID NO: 51806 - RNA, 64 nt, hsa
uaaggggaugacugucucaaauauguaggacagaaaugagaagccccaagcuugcuuuuaacuc

SEQ ID NO: 51807 - RNA, 64 nt, hsa
auacaauuuauuuaguacauacauuuauuauuuuaaugagaaugccucaggaaaagacuaguau

SEQ ID NO: 51808 - RNA, 64 nt, hsa
aaaucugaauacaguguggacuucaguuaauauaaaugagaaaaugguuucauuggcuuuaaag

SEQ ID NO: 51809 - RNA, 64 nt, hsa
accacauguucucacucauagauaggaauugaacaaugagaacacauggagacaggaaggggaa

SEQ ID NO: 51810 - RNA, 64 nt, hsa
cgcuaggauuacaaguaugagacuuugccauuccaaugagaauuuuguccuuagcaaucucauc

SEQ ID NO: 51811 - RNA, 64 nt, hsa
caauggccacuggagauguguguagggccacaagaaugagaaagggggcaauggagugacaggu

SEQ ID NO: 51812 - RNA, 64 nt, hsa
aaaaaaguugcugaaguacuguacaggguuguacaaugagaacccaaugccaaggcaaaaagaa

SEQ ID NO: 51813 - RNA, 64 nt, hsa
gggaagaauuauauugaauggaauuauuuuugauaaugagaauuauuuggguagauucacugag

SEQ ID NO: 51814 - RNA, 64 nt, hsa
ggaacauucaaugucaccugaaagagaaaugggaaaugagaacauuccaaguacagugagcaca

SEQ ID NO: 51815 - RNA, 64 nt, hsa
ucaugagaauaaaacaaaaggugauucuauucagaaugagaaaaauccuaacccaauagaauca

SEQ ID NO: 51816 - RNA, 64 nt, hsa
aauacagccaaccagguaagugaaagauuucuacaaugagaauuacaaagcagugcacaaagaa

SEQ ID NO: 51817 - RNA, 64 nt, hsa
auccagaaucuauaaagaacucaaacaaaucaacaaugagaaaaacaaccccauuaaaaacugg

SEQ ID NO: 51818 - RNA, 64 nt, hsa
uuuuaguguuuacuuccugcagugaauuugaauaaaugagaaaaaaugcauugucucugguuug

SEQ ID NO: 51819 - RNA, 64 nt, hsa
guuggcugguuguuuucguuguuguuaacaaaggaaugagaauauguaauacuuaaauaaacau

SEQ ID NO: 51820 - RNA, 64 nt, hsa
guuuaauuucaaauagaauauggacuuaaauguuaaugagaaaauggcuuuaaucaauucuagc

SEQ ID NO: 51821 - RNA, 64 nt, hsa
acuauuggaagauaaacuugucaaacuugucaagaaugagaaaagccaaauuagaaaauccuau

SEQ ID NO: 51822 - RNA, 64 nt, hsa
gcaacuccauuuguugagggucuuuguguucuucaaugagaaaucaaauuugagacguugaaau

SEQ ID NO: 51823 - RNA, 64 nt, hsa
uaucugccuguuauaaagaugaacaaaaaaacuuaaugagaaagaucacagauacguaauaauu

SEQ ID NO: 51824 - RNA, 64 nt, hsa
uuuauacugugaagacuuuguuauaccuuauuugcuacaacauagaucauaucauugcuacuuu

SEQ ID NO: 51825 - RNA, 64 nt, hsa
caagaaauagugagguaguaguuagucgucuuuccuacaacauuuuagcuuuugcccaucuaaa

SEQ ID NO: 51826 - RNA, 64 nt, hsa
uuuaaaaucauacauucugaacauuuuagucaagcuacaacagguuuggaaaaccucugugggg

SEQ ID NO: 51827 - RNA, 64 nt, hsa
aguggaacgaagacuaaccucaccagccagucaucuacaacaaaucugccugguucuccgggau

SEQ ID NO: 51828 - RNA, 64 nt, hsa
ugugggugugagccuggccguccuccggggccaccgaccgcagccagccccuccccaggagcuc

SEQ ID NO: 51829 - RNA, 64 nt, hsa
agccucaugcaagucauccccgacaugaccuucacgaccgcaaugcaaggaggggaagaaaguc

SEQ ID NO: 51830 - RNA, 64 nt, hsa
uguucacaggggcuagccaccuguacuacggugccgaccgcaaugcgaggaaugugguggccac

SEQ ID NO: 51831 - RNA, 64 nt, hsa
ugagccuccgccauccagcaugacaaacuguggccgaccgcagcugugccguggcacgauggcg

SEQ ID NO: 51832 - RNA, 64 nt, hsa
cacuuccagccgggccccucauguauccacuggccgaccgcagagugucccuaccuccucucca

SEQ ID NO: 51833 - RNA, 64 nt, hsa
agggagggcuggugccuucggagccucccacugccgaccgcacagcucccucucugggggcuga

SEQ ID NO: 51834 - RNA, 64 nt, hsa
ucaaucuuugcggauacuuugcuuauucguuuaacgaccgcacagcuccgagguuuggccucua

SEQ ID NO: 51835 - RNA, 64 nt, hsa
uuuccaacacacacaacguaaaaauaaaagcagucgaccgcacuuaugguaaucaguuuuguau

SEQ ID NO: 51836 - RNA, 64 nt, hsa
gcagggggcgccaggcagccgugaucacaggugacgaccgcaccgcggccgugggacugaugcg

SEQ ID NO: 51837 - RNA, 64 nt, hsa
cgcccacuucccggcccggggccugcacaaucuccgaccgcaucacugucuuccggaguccccc

SEQ ID NO: 51838 - RNA, 64 nt, hsa
gcacuggggaacgucuugggauccgaccccgggccgaccgcaccguacccgcauccucucuccc

SEQ ID NO: 51839 - RNA, 64 nt, hsa
aaauaguuuuaacuagcuuaguuuucugguuuccaaaacuaaaauagauuaaauccuacaaauu

SEQ ID NO: 51840 - RNA, 64 nt, hsa
guugguaaauuuuuaggauauuguguugcacuagaaaacuaagugguucauauuucuaaugagg

SEQ ID NO: 51841 - RNA, 64 nt, hsa
gcguuggccaucucuacauuuugugaggugagagaaaacuaauguuuacuuucugcugugaacu

SEQ ID NO: 51842 - RNA, 64 nt, hsa
ugcucaggugagaucauagcuuaaauacauugaaaaaacuaaaguaccacaauagcuguauuuu

SEQ ID NO: 51843 - RNA, 64 nt, hsa
aaaaaccaauguuuugcaguuuuuuucauugccaaaaacuaaauggugcuuuauauuuagauug

SEQ ID NO: 51844 - RNA, 64 nt, hsa
aauugaacacaaucucauugaggagcauuuuuuaaaaacuaaaaaaaaaaaaacuuugccagcc

SEQ ID NO: 51845 - RNA, 64 nt, hsa
uucuguuauuucugauacuuuugaaaaacuaauaaaaacuaauaaaagaagcguaaaaagugag

SEQ ID NO: 51846 - RNA, 64 nt, hsa
ucucccaacauucuguuauuucugauacuuuugaaaaacuaauaaaaacuaauaaaagaagcgu

SEQ ID NO: 51847 - RNA, 64 nt, hsa
gguuccugcucauuccaguaaugucuuugaaagcaaaacuaauauuuauuuucuagauuauccc

SEQ ID NO: 51848 - RNA, 64 nt, hsa
uucaaccuaaacagccaauuucuaagcagacaggaaaacuaaauaauaaguuaauuaauauaac

SEQ ID NO: 51849 - RNA, 64 nt, hsa
uauacugaguaaugcacucuugcaaguguauacaaaaacuaaauagacuucugcccuccaacau

SEQ ID NO: 51850 - RNA, 64 nt, hsa
ugcaauuaaaaugugauuggcuuagguaaucccaaaaacuaacaaauaacaaaggugcauaauu

SEQ ID NO: 51851 - RNA, 64 nt, hsa
uuucaucacuuuuuauucauaacuucagauuuguaaaacuaauuuccaaaauauaagcuguuuu

SEQ ID NO: 51852 - RNA, 64 nt, hsa
caaaauuuuacaaaucauuuguggaaugaaugguaaaacuaaucugaugaaauggaaaauuauu

SEQ ID NO: 51853 - RNA, 64 nt, hsa
uugggaaaacauuugcugccauuacagagguauuaaaacuaaauuucacuacuagauugacuaa

SEQ ID NO: 51854 - RNA, 64 nt, hsa
gccaggacaugcaauaaaauuuaaaaaauaaauaaaaacuaauuaagaaauugugugugugucu

SEQ ID NO: 51855 - RNA, 64 nt, hsa
auugcaggcaugagccacugcacccaaccccuggaaaacuaaauuuuuaagugcuuauuuuuau

SEQ ID NO: 51856 - RNA, 64 nt, hsa
aauauaauugcgaauaucagaaaacucauacuggaaaacuaaauuuuuuuuuucucuugagacg

SEQ ID NO: 51857 - RNA, 64 nt, hsa
aaauaaguaagaacuauuuuuaaaauauucaaacaaaacuaaaacaaaaauccagugucacaug

SEQ ID NO: 51858 - RNA, 64 nt, hsa
uucuuaauauauuucauuaugauugaaaaacauaaaaacuaacauaggaaagugaaugaucagu

SEQ ID NO: 51859 - RNA, 64 nt, hsa
guguauaccugggggugggcagugcucuuuuucuaaaacuaauauggcuuauauaucugaauua

SEQ ID NO: 51860 - RNA, 64 nt, hsa
aauaguggaaaaauaaaaaaauaaguaaacagaaaaaacuaaaguuguauuuucccacaaauau

SEQ ID NO: 51861 - RNA, 64 nt, hsa
aucuaauaggaaaacaugauacuuucaaugugccaaaacuaaaccuuaguauacaacuaaaaau

SEQ ID NO: 51862 - RNA, 64 nt, hsa
cagguacuaugaauguaauucauaauuuaaaaggaaaacuaaaaacuauuuugauuugggaaaa

SEQ ID NO: 51863 - RNA, 64 nt, hsa
uuuauauucagcuacucuugucauuucucguugaaaaacuaaaaucugacuagguuaguuuacu

SEQ ID NO: 51864 - RNA, 64 nt, hsa
ucaugaagccacugcugggcuccagagagaagggaaaacuaagagguuuuaaaaccccuacccu

SEQ ID NO: 51865 - RNA, 64 nt, hsa
uuaaaaaacaacaaugacaacgacaacaaaaaacaaaacuaaaacgacuuauuauuuauuaauu

SEQ ID NO: 51866 - RNA, 64 nt, hsa
uggagugauugugguucuuggaaaagcagaaggaaaaacuaaaaaguguaucuuguauuuuccc

SEQ ID NO: 51867 - RNA, 64 nt, hsa
cauuaucugauccaguccucacauuuuuaaauauaaaacuaaagagagaaugcuucuuacagga

SEQ ID NO: 51868 - RNA, 64 nt, hsa
uuggaaaaacccaugaagguaacuaacggaaggaaaaacuaagagaaugaaaaguauuugccuc

SEQ ID NO: 51869 - RNA, 64 nt, hsa
aaaauuuuauguauuaauauaugcauucacuugaaaaacuaaaaaaaaacaauaauuuggaaaa

SEQ ID NO: 51870 - RNA, 64 nt, hsa
cuccuacauagaugcugccccacgaaggacccacaaaacuaaccuaguucaggguucucaggca

SEQ ID NO: 51871 - RNA, 64 nt, hsa
acuuucaaccuaugaaaauguaaauaccuuugaaaaaacuaaacuaucagucauuuacauccuc

SEQ ID NO: 51872 - RNA, 64 nt, hsa
agaacuuauuagaaacgauuccggauggcauuggaaaacuaaagaaacugucaaucuugaaggu

SEQ ID NO: 51873 - RNA, 64 nt, hsa
uguuauuuuaacagacccugccuaaaagcauuggaaaacuaaagaaguugagcaacuugaaugc

SEQ ID NO: 51874 - RNA, 64 nt, hsa
cuguaucagaaugaagaaacuaauauuuuacauaaaaacuaauacuuucaauuuuuuauauagu

SEQ ID NO: 51875 - RNA, 64 nt, hsa
uugaucacuuguguacgaaaaauaaaucuccuuaaaaacuaaauaaaaugcacuguauucuuac

SEQ ID NO: 51876 - RNA, 64 nt, hsa
gucugcugauaaaauauuuaaccccaagaaagugaaaacuaauauaaaauuagaaagaccuauc

SEQ ID NO: 51877 - RNA, 64 nt, hsa
aguaauugcaucauaauuacauuaccaguguuggaaaacuaaugaagaaaacacuguaauugcu

SEQ ID NO: 51878 - RNA, 64 nt, hsa
acacagucuuuaauuuucacucacuguggaaauaaaaacuaagguaacuucucagaaagauauc

SEQ ID NO: 51879 - RNA, 64 nt, hsa
agaaaaauuggagacuuauaaucaugguaaauauaaaacuaaauauguuuuaauauuucugaau

SEQ ID NO: 51880 - RNA, 64 nt, hsa
uaaauuaaguugacaugagguaaauguguugauaaaaacuaauuuuagaaguuugaagacuuua

SEQ ID NO: 51881 - RNA, 64 nt, hsa
uaugagggagcaucuguaaaucuuuagccuugugaaaacuaaccuucucugcugagcaauugug

SEQ ID NO: 51882 - RNA, 64 nt, hsa
aaaaacaaggaaauguaccucuuucuucagaauuaaaacuaaaaucuuaaauaaaacagaaaac

SEQ ID NO: 51883 - RNA, 64 nt, hsa
aaagaaaacagaaaccugguuauaaccugacgcuaaaacuaaaaacaaggaaauguaccucuuu

SEQ ID NO: 51884 - RNA, 64 nt, hsa
acuuguuauuucuuuguaaaaugucuuagauaauaaaacuaaaucauaaaguagauauugguuu

SEQ ID NO: 51885 - RNA, 64 nt, hsa
aaaaaaacacuuuucuaaggacugaagauuggcaaaaacuaaaauaaauuaaaacugcuuacac

SEQ ID NO: 51886 - RNA, 64 nt, hsa
uauuuaaaaggguuucaugaauggaaaccuaaguaaaacuaagcucauuagugacagacuuguu

SEQ ID NO: 51887 - RNA, 64 nt, hsa
cuuauugcauauuuucauaaucagucaaaauaauaaaacuaaaaacaaaaaguaaaaauuaguu

SEQ ID NO: 51888 - RNA, 64 nt, hsa
ugcaauguauaaaaaguuuauuuugcuauugugaaaaacuaaauguaaaggaaaucaccuacuu

SEQ ID NO: 51889 - RNA, 64 nt, hsa
uaauuuuguguguuuagaguucuguugucaaaagaaaacuaaugaauaaauuaguuugucauuc

SEQ ID NO: 51890 - RNA, 64 nt, hsa
guuugucuucacaaauaucaaaacaaaauggaggaaaacuaagcauuggccucauguucagucu

SEQ ID NO: 51891 - RNA, 63 nt, hsa
uucagucuucaggauaucacaccacgucuuuucaaaaacuaaagagaauucaaaaagggcuga

SEQ ID NO: 51892 - RNA, 64 nt, hsa
ccaaagugagcguuuaaaucuucucauuuuauugaaaacuaagagcagaaaauguaaaaugcuc

SEQ ID NO: 51893 - RNA, 64 nt, hsa
acaguuuucaauguagugacacaaaagggcaugaaaaacuaacugcuagcuuuccuuucauuuc

SEQ ID NO: 51894 - RNA, 64 nt, hsa
acucugcgugaagggccuuaaugucacccaccagaaaacuaacuccaaauaaacgcuuacccuu

SEQ ID NO: 51895 - RNA, 64 nt, hsa
gguuuuuucuuuaaaugauuuguauuacuuuauuaaaacuaaaucugaaauggaauagaaaaua

SEQ ID NO: 51896 - RNA, 64 nt, hsa
ucaaaauuuucaguguguaagcuaaacaaaaacuaaaacuaagaauucucaaaaaaacuuguuc

SEQ ID NO: 51897 - RNA, 64 nt, hsa
ugcuucucaaaauuuucaguguguaagcuaaacaaaaacuaaaacuaagaauucucaaaaaaac

SEQ ID NO: 51898 - RNA, 64 nt, hsa
aagauauauaucuugguuuaccaugauuccaaacaaaacuaacuuguuuaaaaauauuuggagu

SEQ ID NO: 51899 - RNA, 64 nt, hsa
gggguuuaguacuccaaaugaacucuuaaagaaaaaaacuaaucuuggcauccuaucacuaugu

SEQ ID NO: 51900 - RNA, 64 nt, hsa
uacuggagacggguuaccaaugucagguuauacuaaaacuaaaucagaaagucugaauguagca

SEQ ID NO: 51901 - RNA, 64 nt, hsa
aucuuguuuuugugugcaacauaagaaaauuaugaaaacuaauagccaaaaaaccuuugagauu

SEQ ID NO: 51902 - RNA, 64 nt, hsa
gcaucucgguggccugccuggcugauucuuccuuaaaacuaaaaucucuggaaaauggauuugc

SEQ ID NO: 51903 - RNA, 64 nt, hsa
uguuuucucuuucaguuaguugacucaaagggggaaaacuaaagaaugcaaaacuuuugcuauu

SEQ ID NO: 51904 - RNA, 64 nt, hsa
uaaauaaaagugaaccauauuuaucugguuauauaaaacuaaaaauggggguguuuauauaaaa

SEQ ID NO: 51905 - RNA, 64 nt, hsa
gguuauauaaaacuaaaaauggggguguuuauauaaaacuaaaaacuaagaaugauguaaccuu

SEQ ID NO: 51906 - RNA, 64 nt, hsa
uaaaacuaaaaauggggguguuuauauaaaacuaaaaacuaagaaugauguaaccuuuugucug

SEQ ID NO: 51907 - RNA, 64 nt, hsa
caacucuugaauuaaauccacuagagcgagcuuuaaaacuaaucugagcauaacccccaacgug

SEQ ID NO: 51908 - RNA, 64 nt, hsa
gagauguuuggaugacaaaaaaaugccuuauugaaaaacuaaagcaaauucuuuauaggaagaa

SEQ ID NO: 51909 - RNA, 64 nt, hsa
gggaugacccaggcaucuugauuugcaaaaucacaaaacuaaguugucaguuaucacuguagau

SEQ ID NO: 51910 - RNA, 64 nt, hsa
uuuauccauucaaaauauauauuuuuuuccauuuaaaacuaauuuauaaacuauguacuccugg

SEQ ID NO: 51911 - RNA, 64 nt, hsa
acaaaacaaaucauuuuaacaagaugacuacuagaaaacuaaaagccucaaaaaugcuaaaaga

SEQ ID NO: 51912 - RNA, 64 nt, hsa
acuaaaucagagugcugaguauagaaaauaaucuaaaacuaaaauugguaaaauauuuguauau

SEQ ID NO: 51913 - RNA, 64 nt, hsa
aaaaaaauugaauuaaaaauaacacagucuuuuuaaaacuaacauaggaaagccuuuccuauua

SEQ ID NO: 51914 - RNA, 64 nt, hsa
auauagaugcuaugguucagauuguuuuuaauagaaaacuaaaggggcaggggaagugaaagga

SEQ ID NO: 51915 - RNA, 64 nt, hsa
aggauugaaaugauuuguuucucuuccuaggaugaaaacuaaaucaauuaauuauucaauuagg

SEQ ID NO: 51916 - RNA, 64 nt, hsa
acauaauauguugagguugcuuggaaauguacauaaaacuaaaauuuucugaaucguguguuua

SEQ ID NO: 51917 - RNA, 64 nt, hsa
ugagcuauuuuuuucuguacccuguaaaauauugaaaacuaacauaauauguugagguugcuug

SEQ ID NO: 51918 - RNA, 64 nt, hsa
uccugaaacucucaagccucucaucucugcccagcccccucaguggcgcugcuaugcaaggcuu

SEQ ID NO: 51919 - RNA, 64 nt, hsa
uguccagcgucuggcugccuguggccuggagggacccccucaagaggagacaaagccuaaguuu

SEQ ID NO: 51920 - RNA, 64 nt, hsa
ggaagcgcugagggaacaaaugguuggcaugcagcccccucaggcgccccgagaccucaucuuc

SEQ ID NO: 51921 - RNA, 64 nt, hsa
uccuuucuauccuuuuauauuuuucccuuccccacccccucacucaaugguauaaaagcuagga

SEQ ID NO: 51922 - RNA, 64 nt, hsa
uaacggcacuugagauaugugcaguggguggucucccccucagucuuacuuugagcugcuguua

SEQ ID NO: 51923 - RNA, 64 nt, hsa
cccaaccucccaccccuucaauguggggacgagacccccucaucucagaguaaugggaagaacc

SEQ ID NO: 51924 - RNA, 64 nt, hsa
caucagcacagacuacgggaggggcuggcucccucccccucagacccucacuuccuguaccuag

SEQ ID NO: 51925 - RNA, 64 nt, hsa
ggccucugccccucuucccuggccaggggcuucucccccucagcucucccucacaccucccuuc

SEQ ID NO: 51926 - RNA, 64 nt, hsa
caaugugucagugccuggggggaggggaggagcacccccucagccccccugaaccugaccaaaa

SEQ ID NO: 51927 - RNA, 64 nt, hsa
gaggcucccaccccgccacaucccaacuucauuucccccucacuguagcccauuuccaccccac

SEQ ID NO: 51928 - RNA, 64 nt, hsa
agaccaaucccuuccuuugguccuuugguacgcacccccucagagcugagauggaagacauggc

SEQ ID NO: 51929 - RNA, 64 nt, hsa
ggaggucccagaagucuucuguucucuggccucacccccucagucgccauagagcugggccugg

SEQ ID NO: 51930 - RNA, 64 nt, hsa
uuaccccugugccugugucucuacacacuccacacccccucaaacucuguuuaucuguucucug

SEQ ID NO: 51931 - RNA, 64 nt, hsa
cagucauugcacagcaaagccaugugcagggcgucccccucaacccugcccugaacaugcccca

SEQ ID NO: 51932 - RNA, 64 nt, hsa
cugagucuccucacagcagagagacccaccggagcccccucaacuuugcagaugcccaccugga

SEQ ID NO: 51933 - RNA, 64 nt, hsa
ggcgccucaacaguagcccccgggcccccgucagcccccucaaguucuccccuuuugagggguu

SEQ ID NO: 51934 - RNA, 64 nt, hsa
ccgcccucgaccaccgccccucuccccauccguccccccucagggaccaagaaguccaagaggg

SEQ ID NO: 51935 - RNA, 64 nt, hsa
agaccagagcgcccucugaugagcccacugcccacccccucaagccaauccccuccuugggcac

SEQ ID NO: 51936 - RNA, 64 nt, hsa
gugcccugguggagaaagcacugaccugucaugccccccucaaaccuccucuucugacgugccu

SEQ ID NO: 51937 - RNA, 64 nt, hsa
gggugucucccucgggggcucuuccccuagaccucccccucacuuacauaaagcucccuugaag

SEQ ID NO: 51938 - RNA, 64 nt, hsa
ggaaaaugacuuuauugcuuaauuucugccuuuccccccucacacaugcacuuuugggccuuuu

SEQ ID NO: 51939 - RNA, 64 nt, hsa
ccgcgcagccugcccccuccuggacgugcccauccccccucagauccagacaugccccuccccc

SEQ ID NO: 51940 - RNA, 64 nt, hsa
cugcugcaccuuccccacccccuccugggaagugcccccucaccucagggcacccgcaaccugg

SEQ ID NO: 51941 - RNA, 64 nt, hsa
uauguuugcucacauucuuucagccuucugucaccccccucaacaccaaacuuucuuccuugug

SEQ ID NO: 51942 - RNA, 64 nt, hsa
gugggcagccugguaggggucgccagccuccaugcccccucaucuuccaguucuugcuuagugg

SEQ ID NO: 51943 - RNA, 64 nt, hsa
cuggccugaugauggugggugggugggaugaguacccccucaaacccugcccuccuuagaccug

SEQ ID NO: 51944 - RNA, 64 nt, hsa
ccgucccccaaacauguuguacauuucaccauggcccccucaucauagcaauaacauucccacu

SEQ ID NO: 51945 - RNA, 64 nt, hsa
gggcugcuuccugggggcucuccagaccccucucuaggaccaagucacccgucgugcugggagu

SEQ ID NO: 51946 - RNA, 64 nt, hsa
agugcccagguguggugguggcauccugaagcaguaggaccauuagugugcgugcacacccacg

SEQ ID NO: 51947 - RNA, 64 nt, hsa
ggcuucacagccccagaggauuccauauaaaagacauuguaauggaguggauugaacucacaga

SEQ ID NO: 51948 - RNA, 64 nt, hsa
caagguggagucuuaccugguuuuccuuuccaagcauuguaaauuguauaccaaagauauuagu

SEQ ID NO: 51949 - RNA, 64 nt, hsa
ccagcuacccaguauccaugcugccauaucccuucauuguaaaaaguaccuaaacauucgugaa

SEQ ID NO: 51950 - RNA, 64 nt, hsa
ugguugacuuagaccguaagcuuuuuaaguuucucauuguaauuuaccuucucaugcagauugc

SEQ ID NO: 51951 - RNA, 64 nt, hsa
uccugcuccucaggaacuaugggagccucagacucauuguaauucaagcuuuccgagucaagug

SEQ ID NO: 51952 - RNA, 64 nt, hsa
uuaucugugaguucuguuguguuugucaaaaagucauuguaaucuuucauagccauaccuggua

SEQ ID NO: 51953 - RNA, 64 nt, hsa
caguauuuuagggugcauccaguauaccauugagcauuguaaccucaggaaacaguuuauuuug

SEQ ID NO: 51954 - RNA, 64 nt, hsa
guaacaauuguauaucuuacaauauuuuuccuugcauuguaauuuuuaaguauuuaucauuuua

SEQ ID NO: 51955 - RNA, 64 nt, hsa
uuaaaagcacaaucacuaaacuuuauuuguaaaccauuguaacuauuaaccuuuuuugucuuau

SEQ ID NO: 51956 - RNA, 64 nt, hsa
ugcagaaccacaaacaauucgaaugggguagaaacauuguaaauauuuacucuuugcaaacccu

SEQ ID NO: 51957 - RNA, 64 nt, hsa
aagucacugauguuuguuccuguuaaauguauagcauuguaaugagagcccaucaaauccugag

SEQ ID NO: 51958 - RNA, 64 nt, hsa
auaaaauuacuaugaaguauauuaaaaaucacgacauuguaaaaucucacuuuagaucaucaaa

SEQ ID NO: 51959 - RNA, 64 nt, hsa
uguuuccagcaaaagugagcuuuucuaaucgucucauuguaacauggcuuauuuuguagaggua

SEQ ID NO: 51960 - RNA, 64 nt, hsa
auaacuuauuuuucuccauugcuguucuuaaaaacauuguaaguagcuguaauauaccaguacc

SEQ ID NO: 51961 - RNA, 64 nt, hsa
gucauguaauguauagugaauuuauccaaaacgccauuguaacguuuuuuacuagaguguuuuu

SEQ ID NO: 51962 - RNA, 64 nt, hsa
gggcuacuucugcuuuaccucagugguaucagcacauuguaaauuacguuaaaacacacaacuc

SEQ ID NO: 51963 - RNA, 64 nt, hsa
ugguaccagaagucccuuuccuguucugucucuucauuguaauggaaguuucaguugggcauga

SEQ ID NO: 51964 - RNA, 64 nt, hsa
caagccuauacugauggccuuagcuuuguucagucauuguaacugggauuguugucauugcuac

SEQ ID NO: 51965 - RNA, 64 nt, hsa
auacauccacaggguaucuauuaccagcauaaugcauuguaagauggcaagguggcauuuugaa

SEQ ID NO: 51966 - RNA, 64 nt, hsa
aacagagggucagucacaggauguucugacacaccauuguaacuuuuuguuagagaugauccca

SEQ ID NO: 51967 - RNA, 64 nt, hsa
augggggauaauaacagaacuuguuuccuagggccauuguaagucacuugaauaaaaaauaguu

SEQ ID NO: 51968 - RNA, 64 nt, hsa
uguaaguguauauauucuuaguuuuucuugaaaucauuguaauguuaacuuuguuguuucaaau

SEQ ID NO: 51969 - RNA, 64 nt, hsa
uguuguuuacucuaccaauguuaugucgaaacugcauuguaaaaagagaagaaaguggcagguu

SEQ ID NO: 51970 - RNA, 64 nt, hsa
gcuuuguuuuuaaaaauuauauuccaguuuuaaucauuguaaaaaaagcaccuggaguuucaaa

SEQ ID NO: 51971 - RNA, 64 nt, hsa
uugggccucuggccuuccuuacuuaaugucuucuuuucccuacucuaaugcauuucuaacucac

SEQ ID NO: 51972 - RNA, 64 nt, hsa
uaucacugaaauccuuaagguugaggaggcuuuauuucccuagcacuggugaagggcuucaacu

SEQ ID NO: 51973 - RNA, 64 nt, hsa
agaacauccuccaauuccacagucucugggagacuuucccuaagaggcgacuuccucuccagcc

SEQ ID NO: 51974 - RNA, 64 nt, hsa
auuuuaugaaaaacucuucuacuuucaucuauucuuucccuagaggcaaacauuucuuaaaaug

SEQ ID NO: 51975 - RNA, 64 nt, hsa
ggcuguguccugcagugggaccuugggcaacuccuuucccuaugagaagcuggcucuucugagu

SEQ ID NO: 51976 - RNA, 64 nt, hsa
gagaaccccuuuaaccucugcgggacagcaugucuuucccuauccaccuucgauucuuuucucu

SEQ ID NO: 51977 - RNA, 52 nt, hsa
uugaggaccucuuugagugagcuuucccuaauucuuucuccuuucucuaaug

SEQ ID NO: 51978 - RNA, 64 nt, hsa
aguuuauuuuggguucugauauguagcaugguauuuucccuaaggcagaacuuuaaaaauaaag

SEQ ID NO: 51979 - RNA, 64 nt, hsa
aaaucuccaagaagcaccucuauuuuauacaucauuucccuaauuuauuuuaauauggauuucu

SEQ ID NO: 51980 - RNA, 64 nt, hsa
aaagaaaaaaaaaacccuaaaaccaaaaacuccuuuucccuaggaagucaaaaaugcugugauu

SEQ ID NO: 51981 - RNA, 64 nt, hsa
cacucagucucucauuugguaaacagaaagcuguuuucccuacaaggugcuugguggugaagcc

SEQ ID NO: 51982 - RNA, 64 nt, hsa
uucacuuugugagcaaaguaaccccauaaguuuauuucccuauuucaugguauuguuuaaacuu

SEQ ID NO: 51983 - RNA, 64 nt, hsa
acuguagcaagcuucagaaauaaaucuuuugaucuuucccuaucuugauuagauccaaagucaa

SEQ ID NO: 51984 - RNA, 64 nt, hsa
gcaaaagaaucagugagguuaaaguaguggaaguuuucccuaugagccuacagucuguauuguu

SEQ ID NO: 51985 - RNA, 64 nt, hsa
acugcauggauucuucuaaaaaguaugucacuuauuucccuaccuuauuaagacuaaauaagug

SEQ ID NO: 51986 - RNA, 64 nt, hsa
uguacaucacaauaauauauaauucagucucuaguuucccuagagucauuuuugaaaccacuga

SEQ ID NO: 51987 - RNA, 64 nt, hsa
cuaaguucuugaccucaguaauuuuauuuuuguuuuucccuaaauguuucccuacuagucuuuu

SEQ ID NO: 51988 - RNA, 64 nt, hsa
ccucaguaauuuuauuuuuguuuuucccuaaauguuucccuacuagucuuuuuggaaaacaugu

SEQ ID NO: 51989 - RNA, 64 nt, hsa
aaguaacuuugagaggacaagauaggcaaaguuuuuucccuacaucucuuuuggccaaaagaau

SEQ ID NO: 51990 - RNA, 64 nt, hsa
ccucccuacucucccugccgaggcguccauagcauuucccuaauaaauaguuuuaucagggaca

SEQ ID NO: 51991 - RNA, 64 nt, hsa
accuuuuucuaguucuugaauaaauauagccugcuuucccuagaugcauuuguguaggaaguau

SEQ ID NO: 51992 - RNA, 64 nt, hsa
uucccuagaugcauuuguguaggaaguauauacauuucccuauuacucucaucagcugaagaau

SEQ ID NO: 51993 - RNA, 64 nt, hsa
acagcgucugucgaacaaacagaggucuggugguuuucccuacuauccucccacucgagaguuc

SEQ ID NO: 51994 - RNA, 64 nt, hsa
acaccugccagcaacuugggggaauaagcgaagguuucccuacaagagggaaagaaggcaaaaa

SEQ ID NO: 51995 - RNA, 64 nt, hsa
cccauguuucccuaaaccucuagccugauuguucuuucccuaauucauugcacaagcuccuuug

SEQ ID NO: 51996 - RNA, 64 nt, hsa
cauuugacuuuucccuguuguuugaaaucccauguuucccuaaaccucuagccugauuguucuu

SEQ ID NO: 51997 - RNA, 64 nt, hsa
agcaucugguugcuuuuaagccaaguacaucuaguuucccuauuaaaaaugugucugaauagcg

SEQ ID NO: 51998 - RNA, 64 nt, hsa
acaagccaaguuuucgcccugucuccugagaccauuucccuacgcuuugcugcugcugagaguu

SEQ ID NO: 51999 - RNA, 64 nt, hsa
uguguaacauuuaaaguagcauggaaccuacgucuuucccuacugcuugcuggcauauaucagu

SEQ ID NO: 52000 - RNA, 64 nt, hsa
uuauagacuugauuucaaauucuuaaguucagccuuucccuaucaaucacaaaucauguauugg

SEQ ID NO: 52001 - RNA, 64 nt, hsa
aaacuuggccuuacagggcucuaguuaugguuacuuucccuagucaaugcucugaaaauguguc

SEQ ID NO: 52002 - RNA, 64 nt, hsa
ugaaaacacuugccuuacaaggcucuaauuaugauuucccuagucagugcucugaagauguguc

SEQ ID NO: 52003 - RNA, 64 nt, hsa
auuuguaaaugagcagaacuguuuuguugguuuuuuucccuaaauauaaaaguccacacuucgu

SEQ ID NO: 52004 - RNA, 64 nt, hsa
uccacacaggauuccguuggugaaccuguaaaaacaaaacaaacaaaacaaaacaaaaaagaca

SEQ ID NO: 52005 - RNA, 64 nt, hsa
gauuccguuggugaaccuguaaaaacaaaacaaacaaaacaaaacaaaaaagacaaaaccuaaa

SEQ ID NO: 52006 - RNA, 64 nt, hsa
cguuggugaaccuguaaaaacaaaacaaacaaaacaaaacaaaaaagacaaaaccuaaaacuga

SEQ ID NO: 52007 - RNA, 64 nt, hsa
gccugauaaccccuugucaguugucagcucuucccaaaacaaagcucuggaguuucugcuggaa

SEQ ID NO: 52008 - RNA, 64 nt, hsa
ugggaguugcagugaaugucauuaaaauuucuuccaaaacaaaacuagaaauaauugcugaggg

SEQ ID NO: 52009 - RNA, 64 nt, hsa
ccagccugguuacagagcaagacucugucucaaacaaaacaaaacaaaacaaaaacacacuacu

SEQ ID NO: 52010 - RNA, 64 nt, hsa
cugguuacagagcaagacucugucucaaacaaaacaaaacaaaacaaaaacacacuacuguauu

SEQ ID NO: 52011 - RNA, 64 nt, hsa
uacagagcaagacucugucucaaacaaaacaaaacaaaacaaaaacacacuacuguauuuugga

SEQ ID NO: 52012 - RNA, 64 nt, hsa
acuccagccugggcgacugagcgagacucuaucucaaaacaaucaaaacaaaaaagaccugugg

SEQ ID NO: 52013 - RNA, 64 nt, hsa
ugggcgacugagcgagacucuaucucaaaacaaucaaaacaaaaaagaccuguggacucuagua

SEQ ID NO: 52014 - RNA, 64 nt, hsa
aaaccucauuuuaguuguagaagaaaauuucuuacaaaacaaauuccacaaagaacacccuaua

SEQ ID NO: 52015 - RNA, 64 nt, hsa
caaacccgcuuuuguuuccuucccagaaacaaugcaaaacaacagguggagauagucuggucuu

SEQ ID NO: 52016 - RNA, 64 nt, hsa
ccauagccagcaaaagaccuggcagguccugaaucaaaacaacagaguggcugaaagucacacc

SEQ ID NO: 52017 - RNA, 64 nt, hsa
gaagagaugaagagggggagguacggucagcuuucaaaacaauaugccccccgcccaucccaug

SEQ ID NO: 52018 - RNA, 64 nt, hsa
agagcgacacucggucucaaaaaacaaaacaaaacaaaacaaaauuagagauugggucuuuccc

SEQ ID NO: 52019 - RNA, 64 nt, hsa
gugacagagcgacacucggucucaaaaaacaaaacaaaacaaaacaaaauuagagauugggucu

SEQ ID NO: 52020 - RNA, 64 nt, hsa
ccugggugacagagcgacacucggucucaaaaaacaaaacaaaacaaaacaaaauuagagauug

SEQ ID NO: 52021 - RNA, 64 nt, hsa
uacaaaggggaaagaacauaaagguaaaacaaaacaaaacaacauuuugagaacaaagaugacc

SEQ ID NO: 52022 - RNA, 64 nt, hsa
aucuguacaaaggggaaagaacauaaagguaaaacaaaacaaaacaacauuuugagaacaaaga

SEQ ID NO: 52023 - RNA, 64 nt, hsa
acuggcagacuguguaaaauguaaugcaacuacccaaaacaagccugguaggaaagggcaaguc

SEQ ID NO: 52024 - RNA, 64 nt, hsa
ccacaucgugcagucgugucauaaaaaaacaaaacaaaacaaaaaaacacuaggaguccacuca

SEQ ID NO: 52025 - RNA, 64 nt, hsa
cagauccacaucgugcagucgugucauaaaaaaacaaaacaaaacaaaaaaacacuaggagucc

SEQ ID NO: 52026 - RNA, 64 nt, hsa
uauguugguuucaguggcuggaauuaaaacaaaacaaaacaaacuuccaaacaguguguuggug

SEQ ID NO: 52027 - RNA, 64 nt, hsa
acuucuauguugguuucaguggcuggaauuaaaacaaaacaaaacaaacuuccaaacagugugu

SEQ ID NO: 52028 - RNA, 64 nt, hsa
acccccaguguuguaacguaccuuuguacccagacaaaacaauuauguuacauuccucaaagug

SEQ ID NO: 52029 - RNA, 64 nt, hsa
uguaacaaagugaaaacaggugagacaaugugcccaaaacaaagggaagaagagaaccuucugu

SEQ ID NO: 52030 - RNA, 64 nt, hsa
aaccaguagcugaucuuaaggcuuuuuuaaaaaacaaaacaaaacaacaaaaaaaaaucuuuau

SEQ ID NO: 52031 - RNA, 64 nt, hsa
guagcugaucuuaaggcuuuuuuaaaaaacaaaacaaaacaacaaaaaaaaaucuuuauaagaa

SEQ ID NO: 52032 - RNA, 64 nt, hsa
acuccaguuuggacuacagagugagacuccaucucaaaacaaaacaaaacaacaacagcaaaaa

SEQ ID NO: 52033 - RNA, 64 nt, hsa
aguuuggacuacagagugagacuccaucucaaaacaaaacaaaacaacaacagcaaaaaacaac

SEQ ID NO: 52034 - RNA, 64 nt, hsa
ggacuacagagugagacuccaucucaaaacaaaacaaaacaacaacagcaaaaaacaacaaaac

SEQ ID NO: 52035 - RNA, 64 nt, hsa
caaaacaaaacaaaacaacaacagcaaaaaacaacaaaacaaaacacaaauacucucacagggc

SEQ ID NO: 52036 - RNA, 64 nt, hsa
uuuucuccuucccaaggcagcuggauugaaaaaacaaaacaaaacaaaaaaacccaggggcguc

SEQ ID NO: 52037 - RNA, 64 nt, hsa
uccuucccaaggcagcuggauugaaaaaacaaaacaaaacaaaaaaacccaggggcgucagucg

SEQ ID NO: 52038 - RNA, 64 nt, hsa
gaaacuaguuucauauauuaccuaguuauucuuucaaaacaaaacaaaaaaaaaacaaaaacug

SEQ ID NO: 52039 - RNA, 64 nt, hsa
uaguuucauauauuaccuaguuauucuuucaaaacaaaacaaaaaaaaaacaaaaacugacgca

SEQ ID NO: 52040 - RNA, 64 nt, hsa
acuuugaagauuguuuguaucuuuuuuuaaaaaacaaaacaaaacaaaaauccccaaaauauau

SEQ ID NO: 52041 - RNA, 64 nt, hsa
gaagauuguuuguaucuuuuuuuaaaaaacaaaacaaaacaaaaauccccaaaauauauagaaa

SEQ ID NO: 52042 - RNA, 64 nt, hsa
agaaguuggauggguggguacuauucugauuacacaaaacaaaugccacacaucacccuuacca

SEQ ID NO: 52043 - RNA, 64 nt, hsa
ucuuacaggcacaaaaugauggacccaaugcacacaaaacaacccuagaguguuguugagaauu

SEQ ID NO: 52044 - RNA, 64 nt, hsa
uugauauauaauuauuucauguuacauaauaacccaaaacaaauaauuacuugaauauguuugu

SEQ ID NO: 52045 - RNA, 64 nt, hsa
gccugggugacagagugagacccugucucaaaagcaaaacaaacagcaauaacaauauuauuau

SEQ ID NO: 52046 - RNA, 64 nt, hsa
gcaagauaaaaggucuugggaaaacaaaacaaaacaaaacaaaccucccuuccccagcagggcu

SEQ ID NO: 52047 - RNA, 64 nt, hsa
cuggugcaagauaaaaggucuugggaaaacaaaacaaaacaaaacaaaccucccuuccccagca

SEQ ID NO: 52048 - RNA, 64 nt, hsa
auucucuggugcaagauaaaaggucuugggaaaacaaaacaaaacaaaacaaaccucccuuccc

SEQ ID NO: 52049 - RNA, 64 nt, hsa
aaguaguaucuuucucucuuucuuaugaacaaaacaaaacaacaacaaaaaacaaacaaacaaa

SEQ ID NO: 52050 - RNA, 64 nt, hsa
cggauaaguaguaucuuucucucuuucuuaugaacaaaacaaaacaacaacaaaaaacaaacaa

SEQ ID NO: 52051 - RNA, 64 nt, hsa
uacacuuuacugguaaaauuuaaaacaaaaaaggcaaaacaaaacaaacucauuuuccccuuag

SEQ ID NO: 52052 - RNA, 64 nt, hsa
uuuacugguaaaauuuaaaacaaaaaaggcaaaacaaaacaaacucauuuuccccuuaguuccc

SEQ ID NO: 52053 - RNA, 64 nt, hsa
uggauauuauucuuguaguuuaccucuuuaaaaacaaaacaaaacaaaacaaaaaacuccccuu

SEQ ID NO: 52054 - RNA, 64 nt, hsa
auuauucuuguaguuuaccucuuuaaaaacaaaacaaaacaaaacaaaaaacuccccuuccuca

SEQ ID NO: 52055 - RNA, 64 nt, hsa
ucuuguaguuuaccucuuuaaaaacaaaacaaaacaaaacaaaaaacuccccuuccucacugcc

SEQ ID NO: 52056 - RNA, 64 nt, hsa
gucuguuggauaauggcuguaaaauguuuaaaaacaaaacaaaacaaaaaagaggcacuagucu

SEQ ID NO: 52057 - RNA, 64 nt, hsa
uuggauaauggcuguaaaauguuuaaaaacaaaacaaaacaaaaaagaggcacuagucuaucug

SEQ ID NO: 52058 - RNA, 64 nt, hsa
cagagucagacuccgucccaaaaaaacaaacaaacaaaacaaaacaaaaaaaaacagaaguuac

SEQ ID NO: 52059 - RNA, 64 nt, hsa
ucagacuccgucccaaaaaaacaaacaaacaaaacaaaacaaaaaaaaacagaaguuacaaaug

SEQ ID NO: 52060 - RNA, 64 nt, hsa
cagccuggaugacagagugagaccuugucucaaacaaaacaaaacaaaaaugaaauguucuagu

SEQ ID NO: 52061 - RNA, 64 nt, hsa
uggaugacagagugagaccuugucucaaacaaaacaaaacaaaaaugaaauguucuaguuuugg

SEQ ID NO: 52062 - RNA, 64 nt, hsa
ucuccuacuuuacacucucuguacaaaaacaaaacaaaacaacaacaauacaacaagaacaaca

SEQ ID NO: 52063 - RNA, 64 nt, hsa
gaauuucuccuacuuuacacucucuguacaaaaacaaaacaaaacaacaacaauacaacaagaa

SEQ ID NO: 52064 - RNA, 64 nt, hsa
ggaccagagagagcuuggaauguuaaaaacaaaacaaaacaaaaaaaaacaaggagaaguuguc

SEQ ID NO: 52065 - RNA, 64 nt, hsa
auaggggaccagagagagcuuggaauguuaaaaacaaaacaaaacaaaaaaaaacaaggagaag

SEQ ID NO: 52066 - RNA, 64 nt, hsa
caacaacacgaagaugauaccaaaacaaggaccacaaaacaacuagccaugaugggagacagga

SEQ ID NO: 52067 - RNA, 64 nt, hsa
aaaagcaacaacagcaacaacacgaagaugauaccaaaacaaggaccacaaaacaacuagccau

SEQ ID NO: 52068 - RNA, 64 nt, hsa
aauagaaacacauuuucuggcuagcagaaaaaaacaaaacaaaacuguuguuucucuuucuugc

SEQ ID NO: 52069 - RNA, 64 nt, hsa
auggcacaaggaaucacacguggugcagcuaaaacaaaacaaaacaugagcaaacacaaaaccc

SEQ ID NO: 52070 - RNA, 64 nt, hsa
ccugggcgacagagcgagacucugccucaaaaaacaaaacaaaacaaaacacucacccaucaac

SEQ ID NO: 52071 - RNA, 64 nt, hsa
gcgacagagcgagacucugccucaaaaaacaaaacaaaacaaaacacucacccaucaacgaaua

SEQ ID NO: 52072 - RNA, 64 nt, hsa
cacaaguccugugaggcaaaaaaacaaaacaaaacaaaacaaccaaacaaauacaaucuaacuu

SEQ ID NO: 52073 - RNA, 64 nt, hsa
uauuucacaaguccugugaggcaaaaaaacaaaacaaaacaaaacaaccaaacaaauacaaucu

SEQ ID NO: 52074 - RNA, 64 nt, hsa
aagacuauuucacaaguccugugaggcaaaaaaacaaaacaaaacaaaacaaccaaacaaauac

SEQ ID NO: 52075 - RNA, 64 nt, hsa
gcucgcucuuuuuaaucagaugcuguaugggaaucaaaacaauugaaugcccaacauuuugugu

SEQ ID NO: 52076 - RNA, 64 nt, hsa
cagccugggcaacagagcaagacccugucugucucaaaacaaaaaacaaaaccacuuauauugc

SEQ ID NO: 52077 - RNA, 64 nt, hsa
aaagaaaauguguaaggcuugcuaaaaaacaaaacaaaacaaaacacaguccugcauacucacc

SEQ ID NO: 52078 - RNA, 64 nt, hsa
auacaaaagaaaauguguaaggcuugcuaaaaaacaaaacaaaacaaaacacaguccugcauac

SEQ ID NO: 52079 - RNA, 64 nt, hsa
uuucaauuaggaaaaguaaaauccaaaauguuagcaaaacaaagugcaauauuaaauguuugcu

SEQ ID NO: 52080 - RNA, 64 nt, hsa
cuugaccugguuaaauacugucuuaaagcucauacaaaacaaauaggcuuuuccauaaguggcc

SEQ ID NO: 52081 - RNA, 64 nt, hsa
cuuaaaacuuguuuguggucagcacaacaaggaacaaaacaaagcuuugaaaaaacuuuaacau

SEQ ID NO: 52082 - RNA, 64 nt, hsa
gaagccucggguaacacugaaaaacaaaacaaaacaaaacaaaaacaggaaaaaaacaaaaaac

SEQ ID NO: 52083 - RNA, 64 nt, hsa
ucagagaagccucggguaacacugaaaaacaaaacaaaacaaaacaaaaacaggaaaaaaacaa

SEQ ID NO: 52084 - RNA, 64 nt, hsa
gcucuucagagaagccucggguaacacugaaaaacaaaacaaaacaaaacaaaaacaggaaaaa

SEQ ID NO: 52085 - RNA, 64 nt, hsa
uuuccccuccuauuuuaaucagcaaaauccauaccaaaacaacgacaacaacgcccucuuaagg

SEQ ID NO: 52086 - RNA, 64 nt, hsa
aucucauuuuguacuugguuguggugccacuaaacaaaacaaaugaugggagaguaaguaggcc

SEQ ID NO: 52087 - RNA, 64 nt, hsa
agaaggaaacuaaggacuuggcuccaaaacaaaacaaaacaaaaucuggagaugcugaauuuug

SEQ ID NO: 52088 - RNA, 64 nt, hsa
uacugagaaggaaacuaaggacuuggcuccaaaacaaaacaaaacaaaaucuggagaugcugaa

SEQ ID NO: 52089 - RNA, 64 nt, hsa
gguguuacugagaaggaaacuaaggacuuggcuccaaaacaaaacaaaacaaaaucuggagaug

SEQ ID NO: 52090 - RNA, 64 nt, hsa
acuccaaccugggugacagacucugucuccaaaacaaaacaaacaaacaaaaagauuuuauuaa

SEQ ID NO: 52091 - RNA, 64 nt, hsa
acugcacuccaaccugggugacagacucugucuccaaaacaaaacaaacaaacaaaaagauuuu

SEQ ID NO: 52092 - RNA, 64 nt, hsa
gcacagaauaucaccauugcaguucaaaacaaaacaaaacaaaaagucuuuuguuugugaacac

SEQ ID NO: 52093 - RNA, 64 nt, hsa
uugcugcacagaauaucaccauugcaguucaaaacaaaacaaaacaaaaagucuuuuguuugug

SEQ ID NO: 52094 - RNA, 64 nt, hsa
caaauuugcugcacagaauaucaccauugcaguucaaaacaaaacaaaacaaaaagucuuuugu

SEQ ID NO: 52095 - RNA, 64 nt, hsa
ggacugggacuccagaaccauuaauaaaacaaaacaaaacaaagcaaaauauugaugaucaggc

SEQ ID NO: 52096 - RNA, 64 nt, hsa
gguagggacugggacuccagaaccauuaauaaaacaaaacaaaacaaagcaaaauauugaugau

SEQ ID NO: 52097 - RNA, 64 nt, hsa
uaaguaugaaaggaguaauuaaaaacaagcaaaacaaaacaagacuuaguuuuuaaaugaccaa

SEQ ID NO: 52098 - RNA, 64 nt, hsa
aauauuaaguaugaaaggaguaauuaaaaacaagcaaaacaaaacaagacuuaguuuuuaaaug

SEQ ID NO: 52099 - RNA, 64 nt, hsa
aaaaaaaagcgaaagacugcaguugugcuaaaaacaaaacaaaacaaacaaacaaacaaaaaag

SEQ ID NO: 52100 - RNA, 64 nt, hsa
aaagcgaaagacugcaguugugcuaaaaacaaaacaaaacaaacaaacaaacaaaaaaguaaaa

SEQ ID NO: 52101 - RNA, 64 nt, hsa
cuuuuaagagauuuaagcuucaguuuucucaaaacaaaacaauuauccugucuuaucugaagau

SEQ ID NO: 52102 - RNA, 64 nt, hsa
caggucuuuuaagagauuuaagcuucaguuuucucaaaacaaaacaauuauccugucuuaucug

SEQ ID NO: 52103 - RNA, 64 nt, hsa
cuuuguauauaaaugaacaaaaaagcaagcaaagcaaaacaauaaacuagcagaagaacuagua

SEQ ID NO: 52104 - RNA, 64 nt, hsa
uuaccaaaucuucuccuaugcauuuuuaauaugacaaaacaaauuuuaaaagauuugaaauaau

SEQ ID NO: 52105 - RNA, 64 nt, hsa
ccauauaacuaagacauaugcauuuaugggaagacaaaacaagaaugaaacacuuauacugacu

SEQ ID NO: 52106 - RNA, 64 nt, hsa
gcaugugacuaguuacaaaagcaauaaauugaaacaaaacaaaacaaaacaaaacuuguuucuu

SEQ ID NO: 52107 - RNA, 64 nt, hsa
ugacuaguuacaaaagcaauaaauugaaacaaaacaaaacaaaacaaaacuuguuucuuaaaaa

SEQ ID NO: 52108 - RNA, 64 nt, hsa
aguuacaaaagcaauaaauugaaacaaaacaaaacaaaacaaaacuuguuucuuaaaaaugcgg

SEQ ID NO: 52109 - RNA, 64 nt, hsa
augaacucccccaaacauggcuguggagagacaacaaaacaaaacaaagcacaaaagucucugc

SEQ ID NO: 52110 - RNA, 64 nt, hsa
cucccccaaacauggcuguggagagacaacaaaacaaaacaaagcacaaaagucucugccaaca

SEQ ID NO: 52111 - RNA, 64 nt, hsa
ucacauucguuucccagugaaaagcaaaccagaacaaaacaaaaagccaccgcaauaauucggu

SEQ ID NO: 52112 - RNA, 64 nt, hsa
ugggauuggugcugauugaaagaacaaaacaaaacaaaacaaacacaaacaaacaaaaaaccuu

SEQ ID NO: 52113 - RNA, 64 nt, hsa
auuuaugggauuggugcugauugaaagaacaaaacaaaacaaaacaaacacaaacaaacaaaaa

SEQ ID NO: 52114 - RNA, 64 nt, hsa
agaucauuuaugggauuggugcugauugaaagaacaaaacaaaacaaaacaaacacaaacaaac

SEQ ID NO: 52115 - RNA, 64 nt, hsa
uucaauacaugguuuuuaacaaaacagaacaaaacaaaacaauacagaaucucucccugaguuu

SEQ ID NO: 52116 - RNA, 64 nt, hsa
uuaaauucaauacaugguuuuuaacaaaacagaacaaaacaaaacaauacagaaucucucccug

SEQ ID NO: 52117 - RNA, 64 nt, hsa
aauguuaaggauugucuuaaaguuccuuagccagcaaaacaaaacaaaacaaaacaaacaaaug

SEQ ID NO: 52118 - RNA, 64 nt, hsa
uaaggauugucuuaaaguuccuuagccagcaaaacaaaacaaaacaaaacaaacaaaugaaaaa

SEQ ID NO: 52119 - RNA, 64 nt, hsa
auugucuuaaaguuccuuagccagcaaaacaaaacaaaacaaaacaaacaaaugaaaaacguuu

SEQ ID NO: 52120 - RNA, 64 nt, hsa
cuuaaaguuccuuagccagcaaaacaaaacaaaacaaaacaaacaaaugaaaaacguuuaaaaa

SEQ ID NO: 52121 - RNA, 64 nt, hsa
gaaagauggaggauuaccuacaaaucagacauggcaaaacaauaauggcuguuugcuuccauaa

SEQ ID NO: 52122 - RNA, 64 nt, hsa
aauccuuguuuuugucgugucuauaaaggaagaacaaaacaaaauaaaaacagagcccuagaga

SEQ ID NO: 52123 - RNA, 64 nt, hsa
uuguacacacacaacagaacaaaaugaagcaaaacaaaacaaaaaaacccacaaaaauuuguaa

SEQ ID NO: 52124 - RNA, 64 nt, hsa
uguuguuguacacacacaacagaacaaaaugaagcaaaacaaaacaaaaaaacccacaaaaauu

SEQ ID NO: 52125 - RNA, 64 nt, hsa
cucuuggaauguguauuguuuuuauuuugcgaaacaaaacaaaacaaaaaaaaaagcuuggaac

SEQ ID NO: 52126 - RNA, 64 nt, hsa
ggaauguguauuguuuuuauuuugcgaaacaaaacaaaacaaaaaaaaaagcuuggaacuccau

SEQ ID NO: 52127 - RNA, 64 nt, hsa
aaauuggguucaugaugcagucuccucuuuaaaacaaaacaaaacaaaacaaaacuauacuuga

SEQ ID NO: 52128 - RNA, 64 nt, hsa
ggguucaugaugcagucuccucuuuaaaacaaaacaaaacaaaacaaaacuauacuugaacaaa

SEQ ID NO: 52129 - RNA, 64 nt, hsa
caugaugcagucuccucuuuaaaacaaaacaaaacaaaacaaaacuauacuugaacaaaagggu

SEQ ID NO: 52130 - RNA, 64 nt, hsa
guuucaggugcuagggacuuaaugaaaaacaggacaaaacaauuccuuuuuguggcccagguaa

SEQ ID NO: 52131 - RNA, 64 nt, hsa
ugacagagccaaacuccgucaaaaaaaaacaaaacaaaacaaaaaaaagacaugggagagaugg

SEQ ID NO: 52132 - RNA, 64 nt, hsa
uggagugacagagccaaacuccgucaaaaaaaaacaaaacaaaacaaaaaaaagacaugggaga

SEQ ID NO: 52133 - RNA, 64 nt, hsa
aauguguuuuuuacuugcuaaauugucauaacaucaaaacaagaaauuucuugauggaauguag

SEQ ID NO: 52134 - RNA, 64 nt, hsa
gaguugggaaauucucuugacugaauuaauccuucaaaacaaucagauaauucacacaagaggu

SEQ ID NO: 52135 - RNA, 64 nt, hsa
gggcaauagagguucugaaaggucugugucuugucaaaacaaguaaacgguggaacuacgacua

SEQ ID NO: 52136 - RNA, 64 nt, hsa
cacuccagccuggggacggagcaaaacuuugccucaaaacaaauuuuaaaaagaaagaaagaag

SEQ ID NO: 52137 - RNA, 64 nt, hsa
acuccagcuugggcaacagagugagacuccaucucaaaacaaaacaaaacaaaacaaaacaaaa

SEQ ID NO: 52138 - RNA, 64 nt, hsa
agcuugggcaacagagugagacuccaucucaaaacaaaacaaaacaaaacaaaacaaaaaaacc

SEQ ID NO: 52139 - RNA, 64 nt, hsa
gggcaacagagugagacuccaucucaaaacaaaacaaaacaaaacaaaacaaaaaaacccggcu

SEQ ID NO: 52140 - RNA, 64 nt, hsa
acagagugagacuccaucucaaaacaaaacaaaacaaaacaaaacaaaaaaacccggcuuugcu

SEQ ID NO: 52141 - RNA, 64 nt, hsa
gugagacuccaucucaaaacaaaacaaaacaaaacaaaacaaaaaaacccggcuuugcugcuuu

SEQ ID NO: 52142 - RNA, 64 nt, hsa
aaggaauaaaaagcuggccguacaaauuacauuucaaaacaaacccuaauaaauccacauuucc

SEQ ID NO: 52143 - RNA, 64 nt, hsa
uuaggagauaaauuuauuuuuaaauuuugaaacacaaaacaauuuugaaucuugcucucuuaaa

SEQ ID NO: 52144 - RNA, 64 nt, hsa
ggagaagauauucucgugaaagaaaaaaacaaaacaaaacaacagugcuuuuuucaaaccugau

SEQ ID NO: 52145 - RNA, 64 nt, hsa
ccaagggagaagauauucucgugaaagaaaaaaacaaaacaaaacaacagugcuuuuuucaaac

SEQ ID NO: 52146 - RNA, 64 nt, hsa
aaaugacaacuuuauuccacauaaacaaggguaacaaaacaagcugcuuaaauauaccagucau

SEQ ID NO: 52147 - RNA, 64 nt, hsa
ucaucaaacucauauauuccuccuggcuuccuuacaaaacaagccuuucaaacaaucauugucc

SEQ ID NO: 52148 - RNA, 64 nt, hsa
caucugguccacucaauuguauauuuuuauuuugcaaaacaacccaaaacuuacuuuauguugc

SEQ ID NO: 52149 - RNA, 64 nt, hsa
aguaccuuuugaauucccccagaagaguuguuuucaaaacaaacauuccagaaugaaugucgcu

SEQ ID NO: 52150 - RNA, 64 nt, hsa
gaccugcucagcaguuucuucucucauauauucccaaaacaaguacaucugcgaucaacucuag

SEQ ID NO: 52151 - RNA, 64 nt, hsa
cauguauuuuuguuacaaaucuucugaaaaaaaacaaaacaaugugaaacauuaaaauuaaaag

SEQ ID NO: 52152 - RNA, 64 nt, hsa
ugggaacacagcgagacccucucauuaaaaacaacaaaacaaaacaauuccagucuuggaguag

SEQ ID NO: 52153 - RNA, 64 nt, hsa
acacagcgagacccucucauuaaaaacaacaaaacaaaacaauuccagucuuggaguagucuaa

SEQ ID NO: 52154 - RNA, 63 nt, hsa
cucaaaacuuuacuagggccaauaaacuuucuuucaaaacaauacguaacuuuguuguuguuu

SEQ ID NO: 52155 - RNA, 64 nt, hsa
aagagacuaggacucagucugaacugaaaucugucaaaacaaagggggguggggcuuuaagagu

SEQ ID NO: 52156 - RNA, 64 nt, hsa
cuuacuguaaaaaaaagugcacugaacuucaaaacaaaacaaaaaacaacaacaacaaaaaaca

SEQ ID NO: 52157 - RNA, 64 nt, hsa
guaaucuuacuguaaaaaaaagugcacugaacuucaaaacaaaacaaaaaacaacaacaacaaa

SEQ ID NO: 52158 - RNA, 64 nt, hsa
uaaugcuuuguuuaaaaaaacgaaaaaaacaaaacaaaacaaaaaaacaugagcagugguguuc

SEQ ID NO: 52159 - RNA, 64 nt, hsa
aacacuaaugcuuuguuuaaaaaaacgaaaaaaacaaaacaaaacaaaaaaacaugagcagugg

SEQ ID NO: 52160 - RNA, 64 nt, hsa
ucuuaucuuaaaaaguaaacaaaacaaaacaaaacaaaacaaaaaacuagauauguaauuucua

SEQ ID NO: 52161 - RNA, 64 nt, hsa
aggacucuuaucuuaaaaaguaaacaaaacaaaacaaaacaaaacaaaaaacuagauauguaau

SEQ ID NO: 52162 - RNA, 64 nt, hsa
gcggcaggacucuuaucuuaaaaaguaaacaaaacaaaacaaaacaaaacaaaaaacuagauau

SEQ ID NO: 52163 - RNA, 64 nt, hsa
gaggugcggcaggacucuuaucuuaaaaaguaaacaaaacaaaacaaaacaaaacaaaaaacua

SEQ ID NO: 52164 - RNA, 64 nt, hsa
aagucauuaaaacaaaaugaaacauuugccaaaacaaaacaaaaaacuauguauuugcacagca

SEQ ID NO: 52165 - RNA, 64 nt, hsa
gaccgaagucauuaaaacaaaaugaaacauuugccaaaacaaaacaaaaaacuauguauuugca

SEQ ID NO: 52166 - RNA, 64 nt, hsa
gagacagagcaagacuccaucucaaaaacaaaaacaaaacaaaacaacaacaaaaaaagaaguu

SEQ ID NO: 52167 - RNA, 64 nt, hsa
agagcaagacuccaucucaaaaacaaaaacaaaacaaaacaacaacaaaaaaagaaguuaaaua

SEQ ID NO: 52168 - RNA, 64 nt, hsa
gauaaugacuggacaucagaagaggaaaaaaacucaaaacaaaagcgagagagacuauugccau

SEQ ID NO: 52169 - RNA, 64 nt, hsa
aauggaaugagaauguuguuuuaaaagaaaauagcaaaacaacaaaaaagcaaaccuuaaaaug

SEQ ID NO: 52170 - RNA, 64 nt, hsa
cagccuggcgacagagagagacuccaucucaaaacaaaacaaaaaaaauuagccuacuuaaagg

SEQ ID NO: 52171 - RNA, 64 nt, hsa
cacuccagccuggcgacagagagagacuccaucucaaaacaaaacaaaaaaaauuagccuacuu

SEQ ID NO: 52172 - RNA, 64 nt, hsa
uuucccuccaugcagccagcuauaguuggcuuuccaaaacaacagaaauccuucaccaauagag

SEQ ID NO: 52173 - RNA, 64 nt, hsa
uuauagcaaugcaagaauggccuaaaacacaaggcaaaacaacuuugauaugguacagucauuu

SEQ ID NO: 52174 - RNA, 64 nt, hsa
uuuauuuuuuauuaccagagcauaucuauuauagcaaaacaagaaaaguggacuuuguuguuau

SEQ ID NO: 52175 - RNA, 64 nt, hsa
gcugaaaccgcuuuuuaaaauucaaaacaagaaacaaaacaaaaaaaauuaaggggaaaauuau

SEQ ID NO: 52176 - RNA, 64 nt, hsa
agguucccaauagcugaaaccgcuuuuuaaaauucaaaacaagaaacaaaacaaaaaaaauuaa

SEQ ID NO: 52177 - RNA, 64 nt, hsa
uauuuguaauaaucgagaaugccugggcauuuuacaaaacaagaaaaaaaauacccuuuucuuu

SEQ ID NO: 52178 - RNA, 64 nt, hsa
cacaaguuacaaguugauaucguugaaugaaaagcaaaacaaaaacaauucaggaacaacggcu

SEQ ID NO: 52179 - RNA, 64 nt, hsa
uguguuuauauuuccuguaagugaauaaauaaaacaaaacaaaacaaaaaaaacuugugccuga

SEQ ID NO: 52180 - RNA, 64 nt, hsa
uuauauuuccuguaagugaauaaauaaaacaaaacaaaacaaaaaaaacuugugccugauaagc

SEQ ID NO: 52181 - RNA, 64 nt, hsa
cagccugggugacagagcgagacuaucucagaaacaaaacaaaacaaaacaacaaaaaaagaaa

SEQ ID NO: 52182 - RNA, 64 nt, hsa
ugggugacagagcgagacuaucucagaaacaaaacaaaacaaaacaacaaaaaaagaaaaggca

SEQ ID NO: 52183 - RNA, 64 nt, hsa
gacagagcgagacuaucucagaaacaaaacaaaacaaaacaacaaaaaaagaaaaggcagagua

SEQ ID NO: 52184 - RNA, 57 nt, hsa
aaggauuuggcaugcuguaaaacaaaacaaaacaaaauaaaacaaaaaaaaggaagg

SEQ ID NO: 52185 - RNA, 52 nt, hsa
aaggauuuggcaugcuguaaaacaaaacaaaacaaaauaaaacaaaaaaaag

SEQ ID NO: 52186 - RNA, 64 nt, hsa
gggcgacacagcgagacuccaucucaaaacaaaacaaaacaaaauuagcugagcaugguggugu

SEQ ID NO: 52187 - RNA, 64 nt, hsa
agccugggcgacacagcgagacuccaucucaaaacaaaacaaaacaaaauuagcugagcauggu

SEQ ID NO: 52188 - RNA, 64 nt, hsa
acuugagccugggcgacacagcgagacuccaucucaaaacaaaacaaaacaaaauuagcugagc

SEQ ID NO: 52189 - RNA, 64 nt, hsa
gcuauccugacuuaauauccaguugugggguuugcaaaacaaaacagcuguauguaaucauugc

SEQ ID NO: 52190 - RNA, 64 nt, hsa
uuaauccagucugggucaugaccuuuucuucauccaaaacaaggugaugggaagacaaaaacaa

SEQ ID NO: 52191 - RNA, 64 nt, hsa
ugcuugaagaguuuucuaauucguuucuagugagcaaaacaaagaaggugcuugagucacugaa

SEQ ID NO: 52192 - RNA, 64 nt, hsa
uuugcaugcuaugaggcuaaaugguacugauucucaaaacaaggagcucauagucuaaaaccau

SEQ ID NO: 52193 - RNA, 64 nt, hsa
caacaagaguaaaacuucaucucaaaaaacaaaacaaaacaaaaacaacaacaaaaaacaaaag

SEQ ID NO: 52194 - RNA, 64 nt, hsa
cuggucaacaagaguaaaacuucaucucaaaaaacaaaacaaaacaaaaacaacaacaaaaaac

SEQ ID NO: 52195 - RNA, 64 nt, hsa
cuccccauucugugcccuacuauuuucaacaaaacaaaacaaacaagcaaaaaacacaaaaacc

SEQ ID NO: 52196 - RNA, 64 nt, hsa
cuccucuccccauucugugcccuacuauuuucaacaaaacaaaacaaacaagcaaaaaacacaa

SEQ ID NO: 52197 - RNA, 64 nt, hsa
aaguuguuuucuagauuuguggcuuuaagaaaaacaaaacaaaacaaacacauuguuuuucuca

SEQ ID NO: 52198 - RNA, 64 nt, hsa
guuuucuagauuuguggcuuuaagaaaaacaaaacaaaacaaacacauuguuuuucucagaacc

SEQ ID NO: 52199 - RNA, 64 nt, hsa
gggagggggacauagcgagacucggucucaaaaacaaaacaaaacaaaacaaaacaaaacaaaa

SEQ ID NO: 52200 - RNA, 64 nt, hsa
ggggacauagcgagacucggucucaaaaacaaaacaaaacaaaacaaaacaaaacaaaaacaaa

SEQ ID NO: 52201 - RNA, 64 nt, hsa
cauagcgagacucggucucaaaaacaaaacaaaacaaaacaaaacaaaacaaaaacaaaacaaa

SEQ ID NO: 52202 - RNA, 64 nt, hsa
cgagacucggucucaaaaacaaaacaaaacaaaacaaaacaaaacaaaacaaaacaaaacaaaa

SEQ ID NO: 52203 - RNA, 64 nt, hsa
cucggucucaaaaacaaaacaaaacaaaacaaaacaaaacaaaacaaaacaaaacaaaacacug

SEQ ID NO: 52204 - RNA, 64 nt, hsa
ucucaaaaacaaaacaaaacaaaacaaaacaaaacaaaacaaaacaaaacaaaacacugccaaa

SEQ ID NO: 52205 - RNA, 64 nt, hsa
aaaacaaaacaaaacaaaacaaaacaaaacaaaacaaaacaaaacaaaacacugccaaacuguu

SEQ ID NO: 52206 - RNA, 64 nt, hsa
aaaacaaaacaaaacaaaacaaaacaaaacaaaacaaaacaaaacacugccaaacuguuuccaa

SEQ ID NO: 52207 - RNA, 64 nt, hsa
aacagagcgagacuccaacucagaaaaagcaaaacaaaacaaacaaacaagcaaaaaaccacaa

SEQ ID NO: 52208 - RNA, 64 nt, hsa
ugggcaacagagcgagacuccaacucagaaaaagcaaaacaaaacaaacaaacaagcaaaaaac

SEQ ID NO: 52209 - RNA, 64 nt, hsa
cacagcaaguucuuguuuccaaacaacaacaaaacaaaacaaaaaaaaaaccggauagaauaau

SEQ ID NO: 52210 - RNA, 64 nt, hsa
ggcgacacagcaaguucuuguuuccaaacaacaacaaaacaaaacaaaaaaaaaaccggauaga

SEQ ID NO: 52211 - RNA, 64 nt, hsa
ucuggucggcaagagugagacuccgucucaaaaacaaaacaaaacaaaaaaaccacauaacaua

SEQ ID NO: 52212 - RNA, 64 nt, hsa
ucggcaagagugagacuccgucucaaaaacaaaacaaaacaaaaaaaccacauaacauaaauuu

SEQ ID NO: 52213 - RNA, 64 nt, hsa
augaugugaaauuuuaaauucuaccauguuagagcaaaacaaugaauccuauccccuuucuuuc

SEQ ID NO: 52214 - RNA, 64 nt, hsa
ggaaaccauaucauucauauuuagaaguaaaacacaaaacaaaaaagagagagaaaagaaaaga

SEQ ID NO: 52215 - RNA, 64 nt, hsa
auauauauauaaauauaaauauauauaaaaacaacaaaacaaaacaaaaaaagaaaaaaaaaca

SEQ ID NO: 52216 - RNA, 64 nt, hsa
uauauaaauauaaauauauauaaaaacaacaaaacaaaacaaaaaaagaaaaaaaaacaaaaaa

SEQ ID NO: 52217 - RNA, 64 nt, hsa
ucaugacugagccaaucacuguuucucagaaaaacaaaacaaaacaaaacaaaugacaguaacc

SEQ ID NO: 52218 - RNA, 64 nt, hsa
acugagccaaucacuguuucucagaaaaacaaaacaaaacaaaacaaaugacaguaacccuucc

SEQ ID NO: 52219 - RNA, 64 nt, hsa
gccaaucacuguuucucagaaaaacaaaacaaaacaaaacaaaugacaguaacccuuccccgga

SEQ ID NO: 52220 - RNA, 64 nt, hsa
gccugggugacagagcaagacucugucuaaaaaacaaaacaaaacaaaacaaaacaaaaaaacc

SEQ ID NO: 52221 - RNA, 64 nt, hsa
ggugacagagcaagacucugucuaaaaaacaaaacaaaacaaaacaaaacaaaaaaaccucuua

SEQ ID NO: 52222 - RNA, 64 nt, hsa
cagagcaagacucugucuaaaaaacaaaacaaaacaaaacaaaacaaaaaaaccucuuaauauu

SEQ ID NO: 52223 - RNA, 64 nt, hsa
caagacucugucuaaaaaacaaaacaaaacaaaacaaaacaaaaaaaccucuuaauauucugga

SEQ ID NO: 52224 - RNA, 64 nt, hsa
acaguaugcaugaagacaugaaggcaagaaacagcaaaacaaauacugaagcaugaagauuccu

SEQ ID NO: 52225 - RNA, 64 nt, hsa
uauucuucuaauacauauuaaaagacauaacuaucaaaacaaaauaaauuugucuguuuucaac

SEQ ID NO: 52226 - RNA, 64 nt, hsa
auaagaauguaggccuuaacuauuucacaugagucaaaacaaagcagcuuuaaaaaaauaauug

SEQ ID NO: 52227 - RNA, 64 nt, hsa
caaaaacgaaacuccaucucaaaacaaaacaaaacaaaacaaacaaacaaacaaaacuugcauc

SEQ ID NO: 52228 - RNA, 64 nt, hsa
ggcgacaaaaacgaaacuccaucucaaaacaaaacaaaacaaaacaaacaaacaaacaaaacuu

SEQ ID NO: 52229 - RNA, 64 nt, hsa
gccugggcgacaaaaacgaaacuccaucucaaaacaaaacaaaacaaaacaaacaaacaaacaa

SEQ ID NO: 52230 - RNA, 64 nt, hsa
cuccagccugggcgacaaaaacgaaacuccaucucaaaacaaaacaaaacaaaacaaacaaaca

SEQ ID NO: 52231 - RNA, 64 nt, hsa
ccacaauuguucuucaaaaacaaacaaaacaaaacaaaacaaaauuaacugcuuaaauguuuug

SEQ ID NO: 52232 - RNA, 64 nt, hsa
aaagaccacaauuguucuucaaaaacaaacaaaacaaaacaaaacaaaauuaacugcuuaaaug

SEQ ID NO: 52233 - RNA, 64 nt, hsa
auguaaaagaccacaauuguucuucaaaaacaaacaaaacaaaacaaaacaaaauuaacugcuu

SEQ ID NO: 52234 - RNA, 64 nt, hsa
agccuggaggccagagugagacuccgucucaaaacaaaacaaaaguggguggcucacggguccg

SEQ ID NO: 52235 - RNA, 64 nt, hsa
acuccagccuggaggccagagugagacuccgucucaaaacaaaacaaaaguggguggcucacgg

SEQ ID NO: 52236 - RNA, 64 nt, hsa
ucaaaugaggacugugggacccagauuugaagacccaauaaaaauacucaacuuuuuaaaaaag

SEQ ID NO: 52237 - RNA, 64 nt, hsa
ggaggacaaauaauuggauugucugauaagucugccaauaaacuauccagaaauagcaagugua

SEQ ID NO: 52238 - RNA, 64 nt, hsa
cacuugggaguuauuuacuguguuccucuggcagccaauaaaaucaucauaagcccuuuguaau

SEQ ID NO: 52239 - RNA, 64 nt, hsa
aguucuguaugcuucuauuccaaaucauucauuaccaauaaaaacgaaauaccacccuuuccau

SEQ ID NO: 52240 - RNA, 64 nt, hsa
augcucucuguuggcucugcaguacaauauguaaccaauaaagcucccucguuuccguauacuc

SEQ ID NO: 52241 - RNA, 64 nt, hsa
uauuuagugggucagugccaagugcuaccacuucccaauaaaggaauggggacccagaggcugg

SEQ ID NO: 52242 - RNA, 64 nt, hsa
accaaaaguuuuccugagaauaagaaaguuucacccaauaaaauauuuuugaaaggcauguucc

SEQ ID NO: 52243 - RNA, 64 nt, hsa
aggaccagagaauucuuagauuggcccggaaaggccaauaaagaguuagaaugaaaacucauua

SEQ ID NO: 52244 - RNA, 64 nt, hsa
ugaugcaacagggacccuuguaaauugucauacgccaauaaaaugucacaaguaauaacugcug

SEQ ID NO: 52245 - RNA, 64 nt, hsa
auaguauuuuaaaaaaauuguuuuucaaaugucaccaauaaaaguuuuggcaggaagcuuguug

SEQ ID NO: 52246 - RNA, 64 nt, hsa
aauagcaaucaaucauaauuaguaaacagguguaccaauaaaaagaauuuacaugauagguuaa

SEQ ID NO: 52247 - RNA, 64 nt, hsa
ugauaaauaacaaguuauaguaccaucucccccgccaauaaaaaagagaagaaaaaagagaaac

SEQ ID NO: 52248 - RNA, 64 nt, hsa
cagugggccuggguaaagagucacauugguaggaccaauaaagaauaauaaaaagacaaagcac

SEQ ID NO: 52249 - RNA, 64 nt, hsa
gcaugacugauuaacagaauuuuauacaacuguaccaauaaaauuccaaauuggaauuguuuug

SEQ ID NO: 52250 - RNA, 64 nt, hsa
aaacauaaugugaucaugcucuaacuucaauauaccaauaaaauaaucagcuugcaauuucuga

SEQ ID NO: 52251 - RNA, 64 nt, hsa
aauuuugaacuaacaguaauaacuucuugaaaauccaauaaaauuggcaaaagauugugaaaau

SEQ ID NO: 52252 - RNA, 64 nt, hsa
gcauaagcaguaaauuuuuuuauuuuaauauagcccaauaaaccuagaguauacauguacaaaa

SEQ ID NO: 52253 - RNA, 64 nt, hsa
aacacuuagaacaguuccuggcauauaguaauacccaauaaauauuaacugcuacuuugaaaau

SEQ ID NO: 52254 - RNA, 64 nt, hsa
augacaugguuaaucuggaacuuacguucuuauaccaauaaaagguaccucaauacauguucuu

SEQ ID NO: 52255 - RNA, 64 nt, hsa
agcuggcacugaagaucuccagggacuucagagaccaauaaaagcccauagggaagagagagag

SEQ ID NO: 52256 - RNA, 64 nt, hsa
guaaaacuaaaaugaaaaaaguaggccuucugacauuguguacuuggugguucugucccucugc

SEQ ID NO: 52257 - RNA, 64 nt, hsa
ugcgucugauuauugcuuuuuuaauuuuaugaaaauuguguaaaauuacauuuuuuuuccaggg

SEQ ID NO: 52258 - RNA, 64 nt, hsa
uauuuguaaucaaauguguagugauuacacuugaauuguguacuuaguguguaugugauccucc

SEQ ID NO: 52259 - RNA, 64 nt, hsa
caccgggauuuaucagaacaggauuaguagcuguauuguguaaugcauuguucucaguuucccu

SEQ ID NO: 52260 - RNA, 64 nt, hsa
uucacauccuguaagugcuuaaucauaucuuuuaauuguguauuuaagaaaaguguuuucacaa

SEQ ID NO: 52261 - RNA, 64 nt, hsa
aaaaauuggaaggcguccuuuugguaacccgauuauuguguauuaccuuuaaauauuucacauc

SEQ ID NO: 52262 - RNA, 64 nt, hsa
uuauuggggcacacccaugcucacccuuuuaaauauuguguauggccgcuuugugcuacaguag

SEQ ID NO: 52263 - RNA, 64 nt, hsa
ugcucuugugcaauauuuuaugcucagugagcaaauuguguauuuauguuuaucaauuuguucu

SEQ ID NO: 52264 - RNA, 64 nt, hsa
uuaugaaaaguauuuugcuuaagguuguguguguauuguguauauaccucaaguucaaguuaau

SEQ ID NO: 52265 - RNA, 64 nt, hsa
uugacauuuuucucauaaugaauccucucaggacauuguguagccuaugguaaguacaaaggga

SEQ ID NO: 52266 - RNA, 64 nt, hsa
aacuacuaaaaaaaccaacugcuuuuuaaauccuauuguguaguuaaagugucaugccuugacc

SEQ ID NO: 52267 - RNA, 64 nt, hsa
ugucuuugacuagagcuugaaaccuuguuaucugauuguguaccacuccaaauucccugccuuc

SEQ ID NO: 52268 - RNA, 64 nt, hsa
guaaucauuucuuacaaggugaaaauuaagaaagauuguguaugagagccuauauaguuguuuu

SEQ ID NO: 52269 - RNA, 64 nt, hsa
uauaaaagaaaaagccaaagugaaaaaaaguuagauuguguauuuuucaguaacagcuuuccau

SEQ ID NO: 52270 - RNA, 64 nt, hsa
ccgcccccgccguugguuguugguggucagaauuauuguguaauaaauaauagacauuuuuucu

SEQ ID NO: 52271 - RNA, 64 nt, hsa
acauacaaaaagcugcacauauuuaauguauccuauuguguaauuaauuuuuaauuuuuuugug

SEQ ID NO: 52272 - RNA, 64 nt, hsa
cauugaaacucacuucuuuucagguguagcuacaauuguguaauguacaauauuagagaaagga

SEQ ID NO: 52273 - RNA, 64 nt, hsa
acaagauuuaauugaaaggacaucaauaaucauaauuguguauuuaacaggugguuuuuuauua

SEQ ID NO: 52274 - RNA, 64 nt, hsa
aucacauauuuagcaugagaaaaauugauuugugauuguguauaugagucauuguuaaugggag

SEQ ID NO: 52275 - RNA, 64 nt, hsa
uucaguaaaaagcuacuauauauuguuguuuguuauuguguagguaauauuuucaauuaugaaa

SEQ ID NO: 52276 - RNA, 64 nt, hsa
cucuagucgcucagcauccacuuugugucuccaaauuguguaggacucuguaaucuuuugauua

SEQ ID NO: 52277 - RNA, 64 nt, hsa
ucaacaaaucccauaaguauguguuaauauuuuaauuguguaaaacucauuuguuacuuuacag

SEQ ID NO: 52278 - RNA, 64 nt, hsa
uugcacacugaacagauacuguugcuuauugaauauuguguaaacccuucuuuggcuuuccuug

SEQ ID NO: 52279 - RNA, 64 nt, hsa
guaauauccuuuagaaaugcucuagaagaucuguauuguguagaaugaucauguauuuauaaau

SEQ ID NO: 52280 - RNA, 64 nt, hsa
guauauaguugagaauuuuacgacacuuuuaaaaauuguguaauuguuaaauguccaguuuugc

SEQ ID NO: 52281 - RNA, 64 nt, hsa
auauauaucuuauguuuauuuuuuuucucaacuaauuguguacugcacuguaaggugaaaauua

SEQ ID NO: 52282 - RNA, 64 nt, hsa
gucauuucauccucauggccacccuggagguggcauuguguaaccucaucuugcacauucggga

SEQ ID NO: 52283 - RNA, 64 nt, hsa
cacugaaaguggaagcagaaggcuaaugggucacauuguguaaaggucucuggugcucaaaguu

SEQ ID NO: 52284 - RNA, 64 nt, hsa
uguuuauuauagagcuaauauuuauugaauaguuauuguguaccaagcauugugcuaaauacuu

SEQ ID NO: 52285 - RNA, 64 nt, hsa
guacaaaauuacauuauugauaguuaagcucuuaauuguguagcuugcaaaagacagcacuuuu

SEQ ID NO: 52286 - RNA, 64 nt, hsa
uccaccuuuaaaaguugugccaagucauaaucauauuguguauaacuuggaaauggugcuguuu

SEQ ID NO: 52287 - RNA, 64 nt, hsa
uguguauaacuuggaaauggugcuguuuaaaaaaauuguguauuuauacaguaacaguaugaau

SEQ ID NO: 52288 - RNA, 64 nt, hsa
ggugaacuugggagcaaugagauguuugggaaguauuguguaguacuucugggaaagaucuccu

SEQ ID NO: 52289 - RNA, 64 nt, hsa
uaaugaaaggcccuuuugauauccuugauuuuucauuguguaucuguuugggcacggucuaugu

SEQ ID NO: 52290 - RNA, 64 nt, hsa
aaaaguacuaaauaaauuaauuugcucucaucguauuguguauauucaccuaaugcccauugug

SEQ ID NO: 52291 - RNA, 64 nt, hsa
cucucaucguauuguguauauucaccuaaugcccauuguguauugauauugcauucuugaauuu

SEQ ID NO: 52292 - RNA, 64 nt, hsa
gcuguuuuuuaagaaaaaauuuuugguaaacaguauuguguaaaauugcuuuuuguauaccaau

SEQ ID NO: 52293 - RNA, 64 nt, hsa
uauauaauauaaacaguauguguuuuuauauaucauuguguaaauuuaauauaacauaugcagu

SEQ ID NO: 52294 - RNA, 64 nt, hsa
agauagcagaugucuuuaaaugaaauacauguauauuguguauggacuuaauuaugcacaugcu

SEQ ID NO: 52295 - RNA, 64 nt, hsa
aaagacuguuacuuuauuauuguauucaaaauucauuguguauauuacuacaaagacaacccca

SEQ ID NO: 52296 - RNA, 64 nt, hsa
ucucucagcagauauuucuuugguacuaccauguauuguguaacuuuugggaaaguaagguggc

SEQ ID NO: 52297 - RNA, 64 nt, hsa
gugcauauaguauauuacuaauaguaugcuguuaauuguguaagaaagaaaggaaauuagaaaa

SEQ ID NO: 52298 - RNA, 64 nt, hsa
gcucaaaauagaaauuagguuaaaaugccauuuuauuguguaagcucuugggcauuauacaaca

SEQ ID NO: 52299 - RNA, 64 nt, hsa
gccaucucacaaaauaagaauuucaaauguaaauauuguguauuuguguguguaugugugugug

SEQ ID NO: 52300 - RNA, 64 nt, hsa
uauacagcacuuaaaagcagugaaccagauccauauuguguaacauggauaguuaaaacaaugu

SEQ ID NO: 52301 - RNA, 64 nt, hsa
uguugaaugaaaaaaaucaaaauacaaaugaaacauuguguaauaauauuuauguaaauuggaa

SEQ ID NO: 52302 - RNA, 64 nt, hsa
gugugguguuaaguuucguugagacaugguggaaauuguguagcucugugauucuuccaggggc

SEQ ID NO: 52303 - RNA, 64 nt, hsa
ggguugugagucugggauagugugguccagcugcauuguguaggauucugugguuugguggguc

SEQ ID NO: 52304 - RNA, 64 nt, hsa
auuuuucuuuccaagauaaaauuuugaaacuuaaauuguguauuguguaauuaauuugauagug

SEQ ID NO: 52305 - RNA, 64 nt, hsa
uuuccaagauaaaauuuugaaacuuaaauuguguauuguguaauuaauuugauaguguacccuc

SEQ ID NO: 52306 - RNA, 64 nt, hsa
cuugaucauccagagaacauugacagacaauuaugaauaauaaagauguuaacaauccaucugu

SEQ ID NO: 52307 - RNA, 64 nt, hsa
ucucuaaaauacauaaguaaauuuaaaaaaaaaagaauaauaauuugaacagugaauguugaug

SEQ ID NO: 52308 - RNA, 64 nt, hsa
gcccucccaugaagaauuucuaggucauaaacaugaauaauacucaguauauguauaauaucau

SEQ ID NO: 52309 - RNA, 64 nt, hsa
guuaccaaaaaauuuuuaaguauuuucuuaauuugaauaauaaaaccagaggaaaugcauacag

SEQ ID NO: 52310 - RNA, 64 nt, hsa
uauuuugcacccacugaaaggaaagugcuuuccagaauaauaugaaguaucuaaaagugucacc

SEQ ID NO: 52311 - RNA, 64 nt, hsa
auacacuuggggagauuugccacaucuuaaacuugaauaauaguaugaguaaugcuuaagggag

SEQ ID NO: 52312 - RNA, 64 nt, hsa
gaccauuucuuucagaaguaauucucagccuguggaauaauagcaggugaagacuucauagaag

SEQ ID NO: 52313 - RNA, 64 nt, hsa
gcaguauugucacuuuugcucucacuguuauguugaauaauaauuagcauauaauugucuacag

SEQ ID NO: 52314 - RNA, 64 nt, hsa
aacagugucccaucuacugaauagaaaacuuugagaauaauauauauauauauuuuaaauguuu

SEQ ID NO: 52315 - RNA, 64 nt, hsa
ucuauacccucuuccuucuuucugcaaggcagaggaauaauauuuuuaaagguuauuuuguuuu

SEQ ID NO: 52316 - RNA, 64 nt, hsa
ggaacucuccucuuaccacaucagcauguaaggugaauaauaacugguuuugccagacagcagg

SEQ ID NO: 52317 - RNA, 64 nt, hsa
uauaaggaucucugcaaacaggaucuaagcuuaggaauaauauuuaggugugauauaguguuag

SEQ ID NO: 52318 - RNA, 64 nt, hsa
guggugugugaaguuuggagauagauggauaagggaauaauaggccacagaaggugaacuuugu

SEQ ID NO: 52319 - RNA, 64 nt, hsa
auuuugcuaucuuuuuuaguguuaaagagauaaagaauaauaauuaaccaaccuuguuuaauag

SEQ ID NO: 52320 - RNA, 64 nt, hsa
ugccagaauaauaaaaugaacuguguuuaauuaugaauaauauguaagcuaggacuucuacuuu

SEQ ID NO: 52321 - RNA, 64 nt, hsa
aaggccuauaaucaugaaauaucacuaguugccagaauaauaaaaugaacuguguuuaauuaug

SEQ ID NO: 52322 - RNA, 64 nt, hsa
accaggucccucuuuucugucaaggacuuucugggaauaauacuggggguuuuguuuuuguuuu

SEQ ID NO: 52323 - RNA, 64 nt, hsa
gugacuuguuauccuacuauauuuucuaaggagugaauaauauuguccgaguaacuaacuuauu

SEQ ID NO: 52324 - RNA, 64 nt, hsa
aaguacaaugagccuuacuguauuuaguguggcagaauaauaacaucaguggcaggccacugau

SEQ ID NO: 52325 - RNA, 64 nt, hsa
acugagaguuugguaaaagaauauuuucuucucugaauaauaauuauuuucacagugaaaauuu

SEQ ID NO: 52326 - RNA, 64 nt, hsa
ugaugaugaaaauuauuuccugggaacucaguaggaauaauaccguauuaaggaauaauacugu

SEQ ID NO: 52327 - RNA, 64 nt, hsa
ccugggaacucaguaggaauaauaccguauuaaggaauaauacuguacauaaaacaucaugaaa

SEQ ID NO: 52328 - RNA, 64 nt, hsa
uugacuacuaaaaagcaaauuauauaaaucaguugaauaauaauguuguuaaagaggcuguuua

SEQ ID NO: 52329 - RNA, 64 nt, hsa
gauuucugcuauuuugcaucccaauauaggaguagaauaauaucuacuaucagcugauuacuag

SEQ ID NO: 52330 - RNA, 64 nt, hsa
aguucagcagugugugcacagcuuucuuuugguuggcagagauucaggaucauggaguacugcu

SEQ ID NO: 52331 - RNA, 64 nt, hsa
uacugcucucauaauugaagacguguuuguuauuggcagagaaccuuaaaaaaggccuuuaccu

SEQ ID NO: 52332 - RNA, 64 nt, hsa
uuuccaagcugguccaucacuggccucuguccuuggcagagaccuugcugcccaggcccagggg

SEQ ID NO: 52333 - RNA, 64 nt, hsa
agaugccagcacugacucaggaacagcaagucagggcagagaggaggagggaggcugucaggau

SEQ ID NO: 52334 - RNA, 64 nt, hsa
gggagggcuggcucaggcaucgucucccgcaaugggcagagagagcagagacagguggaccaac

SEQ ID NO: 52335 - RNA, 64 nt, hsa
cauucuacccccagcuucacucagcacuggagcuggcagagacgcaaaacccagucugcccuug

SEQ ID NO: 52336 - RNA, 64 nt, hsa
guggcgcggggcauccuaugaggcaggcacccugggcagagagaugcagugggugcggggggau

SEQ ID NO: 52337 - RNA, 63 nt, hsa
uggacgaggaccagcugugaggcgggcgcccugggcagagagacucuguggcgcggggcaucc

SEQ ID NO: 52338 - RNA, 64 nt, hsa
ggcccauucaugccaaccuugccaacacggagagggcagagaugcacuagaagaccuucauccu

SEQ ID NO: 52339 - RNA, 64 nt, hsa
ccaaaacggaaucuauguagacaaugggacguuaggcagagagcucagauggcccuuuuaaggg

SEQ ID NO: 52340 - RNA, 64 nt, hsa
auaucuguaugucaccaggauggcagagagccagggcagagagagacuggacuugggaucagca

SEQ ID NO: 52341 - RNA, 64 nt, hsa
gacaaugucccccauaucuguaugucaccaggauggcagagagccagggcagagagagacugga

SEQ ID NO: 52342 - RNA, 64 nt, hsa
aggguaagcuguuguucccugaggcugaggcugaggcagagaaucuuccagaugauaaacccca

SEQ ID NO: 52343 - RNA, 64 nt, hsa
ccuggcuccucuuacugagauacagggcagcacuggcagagagcagacuuaaggaaaccuguaa

SEQ ID NO: 52344 - RNA, 64 nt, hsa
cuccuugccaaaucuaaauaguuuauauagggauggcagagaguucccaucucaucugucagcc

SEQ ID NO: 52345 - RNA, 64 nt, hsa
ugcaugauacaaggagagguugucaucuggguagggcagagaggagggcuugcucaucugaaca

SEQ ID NO: 52346 - RNA, 64 nt, hsa
ugguaaaagaggguugcauuucuugcagccagaaggcagagaaagugaagaccaaguccagaac

SEQ ID NO: 52347 - RNA, 64 nt, hsa
ccuggacaccgccaugagcacagggcagggcuggggcagagaaaggaagggaacuggagcuggc

SEQ ID NO: 52348 - RNA, 64 nt, hsa
guggcccaggagccauggccucacacagacccgaggcagagaacagcucauugggucacuggug

SEQ ID NO: 52349 - RNA, 64 nt, hsa
aguggacuguggcagagaaaguccuccacucagaggcagagacugaguuaagucauagguggcc

SEQ ID NO: 52350 - RNA, 64 nt, hsa
ucucuuuugucaggaaacucagccaguggacuguggcagagaaaguccuccacucagaggcaga

SEQ ID NO: 52351 - RNA, 64 nt, hsa
aagugaggucccucccaaaguuguuuucgugugaggcagagaaagccacacucugaauacauuu

SEQ ID NO: 52352 - RNA, 64 nt, hsa
uuauuuugggacuucaguucucgugguccauaggggcagagaugucaaagugaagguugccuga

SEQ ID NO: 52353 - RNA, 64 nt, hsa
gggguccuguccugcaggaugcugcauaggaaugggcagagauguccuggaugggaacaugguc

SEQ ID NO: 52354 - RNA, 64 nt, hsa
cagaccagugaggggugauucagagguggggaugggcagagagggcuggccacucugccucagg

SEQ ID NO: 52355 - RNA, 64 nt, hsa
gaguaauuguaaccgaggucagagcucugggguuggcagagaugaguggccauaucugggggua

SEQ ID NO: 52356 - RNA, 64 nt, hsa
accuccucgggcuucauuuucucuauuuagagauggcagagagugagguaguggcgagaaagcu

SEQ ID NO: 52357 - RNA, 64 nt, hsa
ccaggccuucugacugucagcaccaccggcacagggcagagaugcggguggcccaaggaccacg

SEQ ID NO: 52358 - RNA, 64 nt, hsa
guggggggacagcaaggucccuuguuauaagaggggcagagaggacaacuccgcuuuggccaac

SEQ ID NO: 52359 - RNA, 64 nt, hsa
cucagaacccacagugagaggggagggcuccuggggcagagaaguuccuuagguuuucuuugga

SEQ ID NO: 52360 - RNA, 64 nt, hsa
auaucuuauauugggcgauuugggggcucggggaggcagagaaucucuugggagucuugggugg

SEQ ID NO: 52361 - RNA, 59 nt, hsa
gcugcugcuccuucaugugaaucccagggggcagagaggaggcucuggaggcacacagg

SEQ ID NO: 52362 - RNA, 64 nt, hsa
uaagagauauggagaugggagggggaggacaaggggcagagaguagggucuagcuggcuaucuc

SEQ ID NO: 52363 - RNA, 64 nt, hsa
gaggcagagagggagagaggcagagagggagagaggcagagagacagagagggagagagggaca

SEQ ID NO: 52364 - RNA, 64 nt, hsa
caggcagagaaggagagaggcagagagggagagaggcagagagggagagaggcagagagacaga

SEQ ID NO: 52365 - RNA, 64 nt, hsa
cagagaaggaaagagacaggcagagaaggagagaggcagagagggagagaggcagagagggaga

SEQ ID NO: 52366 - RNA, 64 nt, hsa
cagagagggaaagaggcagagaaggaaagagacaggcagagaaggagagaggcagagagggaga

SEQ ID NO: 52367 - RNA, 64 nt, hsa
gagacagaggggaagagaggcagagagggaaagaggcagagaaggaaagagacaggcagagaag

SEQ ID NO: 52368 - RNA, 64 nt, hsa
gagacagagggagagagagacagaggggaagagaggcagagagggaaagaggcagagaaggaaa

SEQ ID NO: 52369 - RNA, 64 nt, hsa
ggggagagagauaugaggagagagagacagaggaggcagagagggagagaaacagaggagacag

SEQ ID NO: 52370 - RNA, 64 nt, hsa
ucggcuaugucuucauuaugagagcaggagagacggcagagauauguugcuaggugaauauaua

SEQ ID NO: 52371 - RNA, 64 nt, hsa
acgcagacccggaggagcaucagcaaggggcccgggcagagaaucggcuaugucuucauuauga

SEQ ID NO: 52372 - RNA, 64 nt, hsa
gcgaguuugcugggagcugggagcaggcuugccuggcagagaaccuguucagauacaggccagu

SEQ ID NO: 52373 - RNA, 64 nt, hsa
gccuuuauuucccuggcaggcagccuugccagaaggcagagaggcaguucugaaucauucucuc

SEQ ID NO: 52374 - RNA, 64 nt, hsa
cuggggucgcuugugcgggcgggagggcaaugguggcagagacaugcugguggccccggcggag

SEQ ID NO: 52375 - RNA, 64 nt, hsa
guuucuuuugaaagcaaguguagacaccuucgagggcagagaucgggagauuuaagauguuaca

SEQ ID NO: 52376 - RNA, 64 nt, hsa
acacaggugugauccuccuugagcauugaggaggcacauggagaacuaaaucuuuuguaguagc

SEQ ID NO: 52377 - RNA, 64 nt, hsa
uuuuuucaacaauuucaacaaugacacaaaaauucacauggaaauggggaagauggucuguuuu

SEQ ID NO: 52378 - RNA, 64 nt, hsa
uucuaucuagauguguaaguguuuuuuuuaaaaucacauggaacgguuuuuuuuauacuaaaaa

SEQ ID NO: 52379 - RNA, 64 nt, hsa
gcaguacauguaagcagccauuaauaaacuguugcacauggauacuuauagacagacuuauugg

SEQ ID NO: 52380 - RNA, 64 nt, hsa
cuggacauuggacauugcuaaguugggucacugccacauggagucuugccaugccugugugccc

SEQ ID NO: 52381 - RNA, 64 nt, hsa
ugccacaucugggcauacagugucuggacacugccacauggagccacugucaugcaggucauau

SEQ ID NO: 52382 - RNA, 64 nt, hsa
gccuguuguuuuggcucaauuuggguuuguuggucacauggagcucuuccauuucguuuagcug

SEQ ID NO: 52383 - RNA, 64 nt, hsa
uaaagccucaaaucuuccuuacugucucucuugucacauggaaucuacauguguuugaacuauu

SEQ ID NO: 52384 - RNA, 64 nt, hsa
cuuuggcccuaauagcacuggacaacaccacgaccacauggaaacauauuuuuggaagcaaaac

SEQ ID NO: 52385 - RNA, 64 nt, hsa
aagacuuaaagaauuuucuaauacacuuguuucacacauggacguugaggccauagucuuuaaa

SEQ ID NO: 52386 - RNA, 64 nt, hsa
cguccuagaaagccuggucauuuuacuguccucacacauggaagacacuuguguuggcugugcc

SEQ ID NO: 52387 - RNA, 64 nt, hsa
aaguaacuccccuuaaaaugucuaguaaagcuugcacauggauugauuaaaagcaaauaccugu

SEQ ID NO: 52388 - RNA, 64 nt, hsa
uuuuacagacacugggcuaaaaaggguauucagacacauggacacacauuccuagaaugucauc

SEQ ID NO: 52389 - RNA, 64 nt, hsa
aaugugaugcaauaaaauuuaaaauaaauuucugcacauggaauauuuucagcuggcucuucug

SEQ ID NO: 52390 - RNA, 64 nt, hsa
gccuucauugcuggagacaguagaggcaugaacacacauggaugcacacacacacacgccaaug

SEQ ID NO: 52391 - RNA, 64 nt, hsa
gagauaugcacacacagaugcacacacagauauacacauggaugcacgcacaugccaaugcacg

SEQ ID NO: 52392 - RNA, 64 nt, hsa
cacacaccgaugugcgcacacacagauaugcacacacauggaugagcacacacacaccaaugcg

SEQ ID NO: 52393 - RNA, 64 nt, hsa
uucaguuuuuaacauaauuuuuguuuuauccacaacuuuucaaguauugaaaguagaauaaaaa

SEQ ID NO: 52394 - RNA, 64 nt, hsa
uaagauuacaggcgugagccacugagcccagccuacuuuucaguuuuuaacauaauuuuuguuu

SEQ ID NO: 52395 - RNA, 64 nt, hsa
uagaauauuauaguuuaaaaguauuuaguugauuacuuuucaguuuuguuuuguuuuuugagac

SEQ ID NO: 52396 - RNA, 64 nt, hsa
caguggggaaaacugaggcacagagagguuagggacuuuucaugaucacacagcuaauaagugg

SEQ ID NO: 52397 - RNA, 64 nt, hsa
acaggugugagcgaccacauccggucaaguucugacuuuucagggcagugggauggugacuucu

SEQ ID NO: 52398 - RNA, 64 nt, hsa
ccugauaauauugcuugauuuuuccuaucaaguuacuuuucaauccauucagaaucugccccag

SEQ ID NO: 52399 - RNA, 64 nt, hsa
guuaccuucaauuguauguuacauaugauuagucacuuuucauacacuauaaccucugauuuuu

SEQ ID NO: 52400 - RNA, 64 nt, hsa
uggguucucaguagugaauugagacuuggaggugacuuuucauguuuggaguaucaucucuguc

SEQ ID NO: 52401 - RNA, 64 nt, hsa
uuaaaaccuagaguagugcuuaugcugaaaugauacuuuucauuuuuugguugauuuuuuugcc

SEQ ID NO: 52402 - RNA, 64 nt, hsa
cggaagggcuguggccaccucguuucgcccaucuacuuuucaccuugccguaucugauucuuca

SEQ ID NO: 52403 - RNA, 64 nt, hsa
ucugugucuuacacagaaacuuaaaauauuucaaacuuuucauuauauguguuuuggugauuag

SEQ ID NO: 52404 - RNA, 64 nt, hsa
cuggguggggaacagcauuggacauuaauagggcacuuuucagacccauuuuuuaaagugcuag

SEQ ID NO: 52405 - RNA, 64 nt, hsa
aacaaccauuugaaaaauuuuugucaccagcaaaacuuuucacuaauuagugauaugaaaugug

SEQ ID NO: 52406 - RNA, 64 nt, hsa
cugguaauguuugugguuauaucauuuacacaaaacuuuucaggaacuucuguguuguuuaagc

SEQ ID NO: 52407 - RNA, 64 nt, hsa
cauaaagcaauaaucccucagaaggaaaguccuuacuuuucacauauuaauauuuaguaauuuu

SEQ ID NO: 52408 - RNA, 64 nt, hsa
uuaucagaggagguucagcauuuuuugcagcauaacuuuucaugagucuguauuacuaauggau

SEQ ID NO: 52409 - RNA, 64 nt, hsa
aaaaaugaacaaucguuugugguuucuugggaaaacuuuucauaccaggugauacuauucaaaa

SEQ ID NO: 52410 - RNA, 64 nt, hsa
aacuuuuuucuuuuuuuucagcugaagucuuaugacuuuucaugagucaaaauuguuuggauuu

SEQ ID NO: 52411 - RNA, 64 nt, hsa
guacagaagaauuuuuuuuuuaagauaugugagaacuuuucauagaugaacuuuuuaacaaaug

SEQ ID NO: 52412 - RNA, 64 nt, hsa
uacuugagagugggggagaauggcaugguaggcuacuuuucagggccuugacaaguacaucacc

SEQ ID NO: 52413 - RNA, 64 nt, hsa
uggucuuuugcauugcuaaugugacauguacccaacuuuucauuaauuuguauuuccauuuuua

SEQ ID NO: 52414 - RNA, 64 nt, hsa
uaccugaggcaauucuuauuagagcuuacucaggacuuuucaaacaucaggacacacauagcaa

SEQ ID NO: 52415 - RNA, 64 nt, hsa
aauguuguaguaaaauuuaauuuuuccuuuuguuacuuuucauuugccucuaauuuugcuugcu

SEQ ID NO: 52416 - RNA, 64 nt, hsa
cuaaaauauuuuauuucuagcauccugauucuggacuuuucauuauaauucugagcaggaaauu

SEQ ID NO: 52417 - RNA, 64 nt, hsa
auuuuacuauagggguuuugcuuuuucuagagauacuuuucauuuaacagcuuuuguuaagugu

SEQ ID NO: 52418 - RNA, 64 nt, hsa
caaauccagugauaucuaagcucacaagauacccacuuuucaggaugggacaguaucagaugaa

SEQ ID NO: 52419 - RNA, 64 nt, hsa
aauguagaaacaaacauuuuuaaauagcugcuguacuuuucacauuuugauuuauuagguacua

SEQ ID NO: 52420 - RNA, 64 nt, hsa
caucuuauccaauuuuauugguuauacaugauaaacuuuucaugaaagaaaugcaaaauuaaau

SEQ ID NO: 52421 - RNA, 64 nt, hsa
aaaaucauguaaccauuuaaaugucacuguuaacacuuuucacucuuucuguugauucaccuaa

SEQ ID NO: 52422 - RNA, 64 nt, hsa
uguuacccugcgucagaaaugccaaguuguguuuacuuuucauucagauuuugugaauaugaac

SEQ ID NO: 52423 - RNA, 64 nt, hsa
gcugggcgcgguugcucacgccuguaaucccagcacuuuucagaggccaaggcgggcaaaucac

SEQ ID NO: 52424 - RNA, 64 nt, hsa
cuaguugaucuggaugaguuauacaugauauuugacuuuucauaaguaguggaagguuucacua

SEQ ID NO: 52425 - RNA, 64 nt, hsa
cugguugaucuagaugaguuauaaaugguauuugacuuuucauaaguaguggaagguuucacua

SEQ ID NO: 52426 - RNA, 64 nt, hsa
cuaauuugcauuugaauguauaacaaauugcaucacuuuucacaaacuuaacaccugccuggag

SEQ ID NO: 52427 - RNA, 64 nt, hsa
uuaauucauuuguuuuccaccauuauauuuuuauacuuuucaguuagauauacuucugcauaaa

SEQ ID NO: 52428 - RNA, 64 nt, hsa
aacucugcucagcaauaaucuguucucagaacagacuuuucaaccugcugccggauuucuccau

SEQ ID NO: 52429 - RNA, 64 nt, hsa
gguauaccugaguuuggggguacccuuuuuugugacuuuucaaaacagugaauuacugucaccu

SEQ ID NO: 52430 - RNA, 64 nt, hsa
auccauauauaucuuuuuuaauaaccaaguaaauacuuuucauuucugagccaaggaauaugcu

SEQ ID NO: 52431 - RNA, 64 nt, hsa
aaguugaaugauuuauuguuacuuauauuaauaaacuuuucaagagaauuuugucuuuaaauau

SEQ ID NO: 52432 - RNA, 64 nt, hsa
cauuugaauaauuauauuuuuccaaccacugauuacuuuucaggaauuuaauuauuuccagaua

SEQ ID NO: 52433 - RNA, 64 nt, hsa
uacccuuagucuccucacauaaauuucuuacuauacuuuucauaauguugcaugcauauuucac

SEQ ID NO: 52434 - RNA, 64 nt, hsa
aggcugguauucccuuuuuauauauaucuauauuacuuuucaccucuuuuucacuuuacuuuag

SEQ ID NO: 52435 - RNA, 64 nt, hsa
ucaguaguacaggcuucuugccgauaugaagggaacuuuucagaaagagaccuacucuggguca

SEQ ID NO: 52436 - RNA, 64 nt, hsa
gccgugucuguguagaaagaaguagacaugggagacuuuucauuuuguucuguacuaagaaaaa

SEQ ID NO: 52437 - RNA, 64 nt, hsa
uuuccuuuuugguccuuuuaaguaaccacucaaaacuuuucauuucacugaaaaaauaugaaaa

SEQ ID NO: 52438 - RNA, 64 nt, hsa
ggugucaguguucucuuguacguuguugcuuucgacuuuucagagcccuccugcucacuugacc

SEQ ID NO: 52439 - RNA, 64 nt, hsa
auccaucuccugccugugugagguagcagugggcacuuuucauugagacaaacuccaggguguc

SEQ ID NO: 52440 - RNA, 64 nt, hsa
auagcagauccuguaguauuuccaguagacauggccuuuuaaucuaagggcuuaagacugauua

SEQ ID NO: 52441 - RNA, 64 nt, hsa
cucccauuuucugaauuuuuuuuuaaauuuccccccuuuuaaaauuguucgaaagcccacaguu

SEQ ID NO: 52442 - RNA, 64 nt, hsa
uuaccaaaauuauuuuaaccuuuuaacucccugcccuuuuaauacagggacagggugucuccug

SEQ ID NO: 52443 - RNA, 50 nt, hsa
aguuaccaaaauuauuuuaaccuuuuaacucccugcccuuuuaauacagg

SEQ ID NO: 52444 - RNA, 64 nt, hsa
uugucucauuagccugaaugugccauaagacugaccuuuuaaaauguuuugagggaucugugga

SEQ ID NO: 52445 - RNA, 64 nt, hsa
ccucuuaagaagauuaaaagagaaaaaaaaaggcccuuuuaaaaauaguauacacuuauuuuaa

SEQ ID NO: 52446 - RNA, 64 nt, hsa
aguauaaaccuuuuuagugugacuguuaaaacuuccuuuuaaaucaaaaugccaaauuuauuaa

SEQ ID NO: 52447 - RNA, 64 nt, hsa
uauauauacuuucagugccauugugaagaauuggccuuuuaauucuaaguaguauuacccuaug

SEQ ID NO: 52448 - RNA, 64 nt, hsa
guuuuaaaguaaguuauauuggaugugaaaaacaccuuuuaaaguccaagacuuuacuacuuaa

SEQ ID NO: 52449 - RNA, 64 nt, hsa
accguacacacacaucaaucacucaauuuccuguccuuuuaaauugcccacccuuuaauuuuga

SEQ ID NO: 52450 - RNA, 64 nt, hsa
gucaauauggaguugagcuuauuucuuuggaaacccuuuuaaguugccuugcuggcugugagaa

SEQ ID NO: 52451 - RNA, 64 nt, hsa
uucaagauuuccaaagagaugaaauuuucuuaauccuuuuaaguuuucauaguaaacaguaugg

SEQ ID NO: 52452 - RNA, 64 nt, hsa
uugguuguccuaccuggucuauuuuuaaaagucaccuuuuaaagugacauuauuagauacacuu

SEQ ID NO: 52453 - RNA, 64 nt, hsa
gugcacaagcugauuuuaagugauauucagauggccuuuuaaauuuaauuauuauguauuuaaa

SEQ ID NO: 52454 - RNA, 64 nt, hsa
caagugauaugaacugugauaaugcagaagguuuccuuuuaaaauaaaguucagucaaaaaagu

SEQ ID NO: 52455 - RNA, 64 nt, hsa
auuuauuugcugaaagagcucuucugaacuguguccuuuuaauuuuugcuuagaauagaaugga

SEQ ID NO: 52456 - RNA, 64 nt, hsa
cugagaagaguaucuguaaauaaaaggguuccaaccuuuuaaaaaagaaggaaaaaacuuuuug

SEQ ID NO: 52457 - RNA, 64 nt, hsa
aacaacaaaaaaccagugaaauucuacaagugucccuuuuaaaaauagugugugcuaacuaagg

SEQ ID NO: 52458 - RNA, 64 nt, hsa
agauuaagugcuuaguuuuauuccuaauucugccccuuuuaaccugauguguaccuuacucuuu

SEQ ID NO: 52459 - RNA, 64 nt, hsa
ggggggaagaaaaggaggaaccaauuaaauaggaccuuuuaaaaauuguuaauuuuguaaacuu

SEQ ID NO: 52460 - RNA, 64 nt, hsa
aggcgugagccaccgcacccggccuccauaucccccuuuuaaaauucuguaguguaugguaagu

SEQ ID NO: 52461 - RNA, 64 nt, hsa
uaaugucuacauguguuagggaggaagaaaauugccuuuuaauuguuaauaagaaaaccaaaug

SEQ ID NO: 52462 - RNA, 64 nt, hsa
uacucuucgcacacuaaacuuugguauuuugauuccuuuuaaccauuuaagacuacuuuucuua

SEQ ID NO: 52463 - RNA, 64 nt, hsa
aggcauugacguaucuuugaaauguucacagcagccuuuuaacaacaacugggugguccuugua

SEQ ID NO: 52464 - RNA, 64 nt, hsa
caugaacugauuuagcaacacagguaaaaaugcaccuuuuaaagcacuacguuuucacagacaa

SEQ ID NO: 52465 - RNA, 64 nt, hsa
aagcauaauuuuaggaaggcuuucgcaaaccuagccuuuuaagagagguuuuuaaccugaagca

SEQ ID NO: 52466 - RNA, 64 nt, hsa
acuaagugcuagaauuuauaguuacaggcgguguccuuuuaaauguggaaaggcuuuuaaaaua

SEQ ID NO: 52467 - RNA, 64 nt, hsa
uuccaauuuauaaucaagaaggggcucuggauccccuuuuaaauuacacacacucucacacaca

SEQ ID NO: 52468 - RNA, 64 nt, hsa
auucuuuuuuaguggagugaaaguucugaagcccccuuuuaacuuccucuugguuuuucauuau

SEQ ID NO: 52469 - RNA, 64 nt, hsa
guauccugaaaggcaacauaauucuuccuucccuccuuuuaaaauuuuguguuccuuuuugcag

SEQ ID NO: 52470 - RNA, 64 nt, hsa
augaaaauaucagcuuuucuuauuccuuuuuauuccuuuuaaaaugguaugccaacuuaaguau

SEQ ID NO: 52471 - RNA, 64 nt, hsa
auauguaaggaagauuccacaucaugaguacuugccuuuuaacuuucccccacauuacuguuga

SEQ ID NO: 52472 - RNA, 64 nt, hsa
gacccaccuacauuaccuucaggagacuguucuaccuuuuaauuugaaaacaaggaaauuaaau

SEQ ID NO: 52473 - RNA, 64 nt, hsa
cagcuuuuuaugagcuuucacauuccuuguuuguccuuuuaauuuguuucuugauauaugaaga

SEQ ID NO: 52474 - RNA, 64 nt, hsa
aucuauuguuuaacucacuaguuuauaggccugaccuuuuaaauuccugggauaaauuuuagaa

SEQ ID NO: 52475 - RNA, 64 nt, hsa
ugggcucuaaaaguugggcucaugguggcaauauccuuuuaauguguuuuaacauuuuuuaauc

SEQ ID NO: 52476 - RNA, 64 nt, hsa
ucccuuuaaaauauguaaugucaaaaaugacucaccuuuuaaaaauuaugcaugaaaacaggug

SEQ ID NO: 52477 - RNA, 64 nt, hsa
aauuauuguuauugguuccugaauaaaacauuaaccuuuuaagucagaaggaaccucgguacuu

SEQ ID NO: 52478 - RNA, 64 nt, hsa
gggcaccacgaaauacauaugcagugccuuuuuuccuuuuaacauagguggcuagccaaaguuu

SEQ ID NO: 52479 - RNA, 64 nt, hsa
cgggaaggaaauccuuuuaaagauuuaaacugauccuuuuaaggaucacaugcuacaacuagaa

SEQ ID NO: 52480 - RNA, 64 nt, hsa
auggaaugcuauuaagccuuaacgggaaggaaauccuuuuaaagauuuaaacugauccuuuuaa

SEQ ID NO: 52481 - RNA, 64 nt, hsa
uuuagaguuccauuucagauuucuucuuugccacccuuuuaaggacuuugaauuuuucuuuguc

SEQ ID NO: 52482 - RNA, 64 nt, hsa
cucuuuuaaaggaauguggaucauagugauuuuuccuuuuaauuuuauugcucagaaaugaggc

SEQ ID NO: 52483 - RNA, 64 nt, hsa
gagaaaguauuuuuugguaugaaugggugacgggccuuuuaaucuuucaggaauacauauaagc

SEQ ID NO: 52484 - RNA, 64 nt, hsa
uaaaaaauaaaaaaauaaaaacaaaauaaggaauccuuuuaaagcauguugagaaaguauuuuu

SEQ ID NO: 52485 - RNA, 64 nt, hsa
ugcaaacaugccuuuuguuuucuauauacccugaccuuuuaauaaaguuucaguguauuuauca

SEQ ID NO: 52486 - RNA, 64 nt, hsa
gcaauuuauaauagaacuuauagcuuuuaaaagaccuuuuaaagacauuaaauguaaacuuaaa

SEQ ID NO: 52487 - RNA, 64 nt, hsa
acuggagcucguaauuuuuuaacuguaagcuuguccuuuuaaagggauuuaauguaccuuuuug

SEQ ID NO: 52488 - RNA, 64 nt, hsa
ccgaggguugauuaaggcaguacaaauuguggagccuuuuaacugugcaauaauuucuguauuu

SEQ ID NO: 52489 - RNA, 64 nt, hsa
accuguuuuagugcugcauucgacauggaaaaguccuuuuaaccugugcuugcauccuccuuuc

SEQ ID NO: 52490 - RNA, 64 nt, hsa
uagcagauaaugaugacuaguucacacauaaaguccuuuuaaggagaaaaucuaaaaugaaaag

SEQ ID NO: 52491 - RNA, 64 nt, hsa
ucauccuuaucuuuguuccucuuuacauaauguuccuuuuaaaaaaaaucacugauuaugaugu

SEQ ID NO: 52492 - RNA, 64 nt, hsa
uuuuugggucuuuuuauauauguucugugucuaaccuuuuaaaaccuggaacacagauauaaca

SEQ ID NO: 52493 - RNA, 64 nt, hsa
guuaucugugucgucccacugagugcauucaccaccuuuuaaauuuuggucacuguauguauca

SEQ ID NO: 52494 - RNA, 64 nt, hsa
uuccucaagaaugucugaagaagguaguaauauuccuuuuaaauuuuuuccaaccauugcuuga

SEQ ID NO: 52495 - RNA, 64 nt, hsa
ucccaggaauucauuaauaaucauccuuggcuuuccuuuuaaaggcuauuuugaaauggucuuu

SEQ ID NO: 52496 - RNA, 64 nt, hsa
caaugaaauagauguaaggaaggagggauuuaaaccuuuuaaaaaacuuuugcugacuuauauu

SEQ ID NO: 52497 - RNA, 64 nt, hsa
ugcuaauuuugugaaauaaagagucuagcccucuccuuuuaaugaacuuaacucucgcuggcau

SEQ ID NO: 52498 - RNA, 64 nt, hsa
gccaguuuuuacuuguuugcccugagggaaaaauccuuuuaaaaaaaauuucugguuuuuauug

SEQ ID NO: 52499 - RNA, 64 nt, hsa
aguuguugaaagcugaaaagcauacaagauucuuccuuuuaacuuggauuucucguuccagaaa

SEQ ID NO: 52500 - RNA, 64 nt, hsa
cccgauuauuacccauaaggcacacucucuaaggccuuuuaaggggccuacaaaaauguuuuau

SEQ ID NO: 52501 - RNA, 64 nt, hsa
cauguaucuugauuguugauuuaaugaaggauuuccuuuuaaugcugcuuuugagcuucaaggu

SEQ ID NO: 52502 - RNA, 64 nt, hsa
acuacugaauuucugucuugccucuccuucagugccuuuuaaaagguuuucccuuuucugaucu

SEQ ID NO: 52503 - RNA, 64 nt, hsa
ucucugucucaucucuccuccuuucucauuagccccuuuuaauuuguuuuuccuuuugacuccu

SEQ ID NO: 52504 - RNA, 64 nt, hsa
aguuaaaccugagacagagagcaaguaagcugucccuuuuaacuguuuuucuuuggucuuuagu

SEQ ID NO: 52505 - RNA, 64 nt, hsa
gguggagguugcagugagccaagauugcaccauugcacuccagccuggcgacagagcaagacuc

SEQ ID NO: 52506 - RNA, 64 nt, hsa
ggcacagguuccagugagccaagguugugccacugcacuccagccugggcaaaaaagcaaaacu

SEQ ID NO: 52507 - RNA, 64 nt, hsa
ggcagagguugcaguaagccaagaucgugccauugcacuccagccugggugacagagcgagacu

SEQ ID NO: 52508 - RNA, 64 nt, hsa
ugggcaagagagugagacuccguuuugugccacugcacuccagccagggugacagagugagacu

SEQ ID NO: 52509 - RNA, 64 nt, hsa
gguggagguuucagugagccaagauagcgccauugcacuccagcgugggcgacagcaagagacu

SEQ ID NO: 52510 - RNA, 64 nt, hsa
ggcggagguugcagugaggcgagauugugccacugcacuccagcuugggcgacagagugagacu

SEQ ID NO: 52511 - RNA, 64 nt, hsa
ggcagaaguugcagugagccgagaucgcaccacugcacuccagccuaggagacaaaacgagacu

SEQ ID NO: 52512 - RNA, 64 nt, hsa
ggcagagcuugcagugagcugagauugcgccacugcacuccagccugggcaacagagcgagacu

SEQ ID NO: 52513 - RNA, 64 nt, hsa
ggcggagcuugcagggagccgagauagugucacugcacuccagccugggugacagagcgagacu

SEQ ID NO: 52514 - RNA, 64 nt, hsa
agguggagguugcgugagcuaagaucgcgccacugcacuccagccugggcgacaagagugaaac

SEQ ID NO: 52515 - RNA, 64 nt, hsa
ggcggaguuugcagugagccgagaucacgccauugcacuccagccugggcgacagagcgagacu

SEQ ID NO: 52516 - RNA, 64 nt, hsa
ggcggagguuacagugagccgagaucacaucacugcacuccagccugggcgacagagcgagacu

SEQ ID NO: 52517 - RNA, 64 nt, hsa
gguggagguuacagugagcagagaucacaccacugcacuccagccuggguggcagagcaacacu

SEQ ID NO: 52518 - RNA, 64 nt, hsa
gguggagguugcagugagcugagaucgugcuauugcacuccagccugggcgacagagcaagacg

SEQ ID NO: 52519 - RNA, 64 nt, hsa
ugcaugauaauuuaaaauggaagauuuaaacuuugcacuccaaaagcuuauuuggauuuuuuuc

SEQ ID NO: 52520 - RNA, 64 nt, hsa
aaagucugcagaagagcucuucaguuguuggugugcacuccaagucaggauggacaauguguuu

SEQ ID NO: 52521 - RNA, 64 nt, hsa
auuugaagcugcagugagcuguguucuugccacugcacuccaaucugggugacugagcaagacc

SEQ ID NO: 52522 - RNA, 64 nt, hsa
ggcagagguugcagugagccgagaucacgccacugcacuccagccuggcuacagggcgagacuc

SEQ ID NO: 52523 - RNA, 64 nt, hsa
ggcagaggucauggugagccgagaucacgccacugcacuccagccugggcaacagagcgagacu

SEQ ID NO: 52524 - RNA, 64 nt, hsa
ggcggagguugcagugagccgagaucaugccauugcacuccagccugggcgacagagugagacu

SEQ ID NO: 52525 - RNA, 64 nt, hsa
ggcggagguugcagugagccaagaucgcaccacugcacuccagccuggcaacagagcgagacuc

SEQ ID NO: 52526 - RNA, 64 nt, hsa
gauggagguugcagugagcagagaucgcaccacugcacuccagccugggcaagagugagacugu

SEQ ID NO: 52527 - RNA, 64 nt, hsa
ggcagagguugcagugagccaaggucauaccagugcacuccaggcgggugacagagcaagacug

SEQ ID NO: 52528 - RNA, 64 nt, hsa
ggcagaaguugcagugagcugagauugugccacugcacuccagccugggcgacagagcgagacu

SEQ ID NO: 52529 - RNA, 64 nt, hsa
gguggagguugcagugagcugaggucgcaccacugcacuccagccuggacaacagagcaagacu

SEQ ID NO: 52530 - RNA, 64 nt, hsa
ggucgaggcugcagugagcugugacugugccacugcacuccagcuugagcaacacagugauacu

SEQ ID NO: 52531 - RNA, 64 nt, hsa
gccgcugccuguucccacgugucaccagcacgcugcacuccagaugaaauccuccuaggacagg

SEQ ID NO: 52532 - RNA, 64 nt, hsa
ggcggagguugcagugugccaagaucauaccacugcacuccagcccuggugacagaggagaccc

SEQ ID NO: 52533 - RNA, 64 nt, hsa
agcagagguugcaguaagcugagaucccaccauugcacuccagccugggcaacagagugagacu

SEQ ID NO: 52534 - RNA, 64 nt, hsa
agguggaguugcagugagccgagaucaugcgacugcacuccagccugggugacagagccagacu

SEQ ID NO: 52535 - RNA, 64 nt, hsa
gggagagguugcagugagccaagaucguaccacugcacuccagccugggugacagagugagacu

SEQ ID NO: 52536 - RNA, 64 nt, hsa
gacggaaguugcagugagcugagaucacaccacugcacuccagccuggugacagagcaagacuc

SEQ ID NO: 52537 - RNA, 64 nt, hsa
ggcagagguuccagugagccaagaucgcaccacugcacuccagccugggcaacaaagagcgaaa

SEQ ID NO: 52538 - RNA, 64 nt, hsa
ggcggagguugcagugagcugagaucgcacuacugcacuccagccugggcgacagagcaagacc

SEQ ID NO: 52539 - RNA, 64 nt, hsa
ucccauacaaacucagaaugcuauauuuuuaacagcacuccagcauuuuucuucauguaucacc

SEQ ID NO: 52540 - RNA, 64 nt, hsa
uaccucacagguuuucauucuuuugaacucuggugcacuccaucuguaauccaugucuauaauc

SEQ ID NO: 52541 - RNA, 64 nt, hsa
gacggaggcggcagugagccaagauugugccacugcacuccagccugggcgacagagugaaacu

SEQ ID NO: 52542 - RNA, 64 nt, hsa
ggcggagguugcaaugagccgagaucgcgcuacugcacuccagccugggcaacagagagagacc

SEQ ID NO: 52543 - RNA, 64 nt, hsa
ugaccuguccccaguguuuccagguaaugacuuggcacuccagagaaaguuucaugcuguugcg

SEQ ID NO: 52544 - RNA, 64 nt, hsa
gguugagguugcagugagcacagaucacaccacugcacuccagccugggcaacagagugagacc

SEQ ID NO: 52545 - RNA, 64 nt, hsa
guucaagucugcagugagcuaugauugcaccacugcacuccagccugggugauagagcaagacc

SEQ ID NO: 52546 - RNA, 64 nt, hsa
agagaccccacuccccugcugagaucgcgccacugcacuccagccugggcgacagagcaagacu

SEQ ID NO: 52547 - RNA, 64 nt, hsa
ggcggagguugccgugagccaagaucgcaccacugcacuccagccugggcgacaaagugagacu

SEQ ID NO: 52548 - RNA, 64 nt, hsa
ggcggagguugcagugagcagagaucgugccacugcacuccagccuggguggacagagcaagac

SEQ ID NO: 52549 - RNA, 64 nt, hsa
gguggagauugcaguaagccgagaucgugccacugcacuccagccugggugauagagcaagacu

SEQ ID NO: 52550 - RNA, 64 nt, hsa
gacagagguuguagugagccaagaucgcaccacugcacuccagccugggucacagagugagacu

SEQ ID NO: 52551 - RNA, 64 nt, hsa
aguuugaggcugcaaugagccaugauuucccacugcacuccagccugagugacagagcgagacu

SEQ ID NO: 52552 - RNA, 64 nt, hsa
ggcggagguugcagugagccaagaucgcaccacugcacuccagccugggcaacagagugagacu

SEQ ID NO: 52553 - RNA, 64 nt, hsa
uggaggagugaagccaccaucgaggccacacucagcacuccaggaucccagcgaugucagacac

SEQ ID NO: 52554 - RNA, 64 nt, hsa
ggcggagguugcagugagcugagaucgcaccacugcacuccagcacuccagccugggugacaga

SEQ ID NO: 52555 - RNA, 64 nt, hsa
uugcagugagcugagaucgcaccacugcacuccagcacuccagccugggugacagagcaagacu

SEQ ID NO: 52556 - RNA, 64 nt, hsa
ggcagagauugcagugagccgagaucacgccauugcacuccagccugggugacacagugagacu

SEQ ID NO: 52557 - RNA, 64 nt, hsa
gguggagguugcagugagcugagaucacaucauugcacuccagccugggcaacgggcgagacuc

SEQ ID NO: 52558 - RNA, 64 nt, hsa
gauggaggcugcagcgagccaagaucgugccacugcacuccagccugggcaagaguuuuuuuaa

SEQ ID NO: 52559 - RNA, 64 nt, hsa
gguggagguugcagugagccaagaucgcgccacugcacuccagccuggaugacagagcaaaaaa

SEQ ID NO: 52560 - RNA, 64 nt, hsa
ggucgaggcugcagugagccacgaucacaccacugcacuccagccuaggugacagagugagauc

SEQ ID NO: 52561 - RNA, 64 nt, hsa
ggcggagguugcagugagccaagauggcgccauugcacuccagccugggugacaagagugaaac

SEQ ID NO: 52562 - RNA, 64 nt, hsa
ggcggagguugcagugagccaagauggcgccauugcacuccagccugggcgacaagagcaaaac

SEQ ID NO: 52563 - RNA, 64 nt, hsa
gagguugcagugagccaagaucacaggagccacugcacuccagccugggugacagagugagacu

SEQ ID NO: 52564 - RNA, 64 nt, hsa
gauggagguugcagugagcugagaucaugccacugcacuccagccugggcaacagagcaagacu

SEQ ID NO: 52565 - RNA, 64 nt, hsa
cugcagccuggccuccccgcacaggcuguggcuugcacuccagccgcucuagucucucaggaau

SEQ ID NO: 52566 - RNA, 64 nt, hsa
caagcugccacacugcccggagcagccuguuccugcacuccacccugcuggccccaggacuucu

SEQ ID NO: 52567 - RNA, 64 nt, hsa
ggcggagcuugcaguuagccgagaucaugccacugcacuccagccuacaugacaaugugacacu

SEQ ID NO: 52568 - RNA, 64 nt, hsa
ggcggagguugcagugagcugagcucauaccacugcacuccagccugaacagagugagauccug

SEQ ID NO: 52569 - RNA, 64 nt, hsa
ggcggcgguugcagugagccgagaucguaccauugcacuccagccugggcaacaagagcgaaac

SEQ ID NO: 52570 - RNA, 64 nt, hsa
ggcggagguugcaaugagccaagaucguaccacugcacuccagccugggcgacagagcaagaca

SEQ ID NO: 52571 - RNA, 64 nt, hsa
gguagagguugcagugagccaagaucgcgccacugcacuccagucugggcaacagagugagacc

SEQ ID NO: 52572 - RNA, 64 nt, hsa
aguggagguugcagugagccgagauugugcugcugcacuccagccugggugaaaaagacaggcu

SEQ ID NO: 52573 - RNA, 64 nt, hsa
aaucauagcucacugcagcuaugaucaugucucagcacuccagcuuuggcaacagaacgagauc

SEQ ID NO: 52574 - RNA, 64 nt, hsa
gucagaggcugcagagagccgagacugggccacugcacuccagccuggaugacagagugagacu

SEQ ID NO: 52575 - RNA, 64 nt, hsa
gguagaaguugcagugagccaagaucauacuacugcacuccagccugggcgacaagagugaaac

SEQ ID NO: 52576 - RNA, 64 nt, hsa
ggcagagauugcaguaagcugagaucgugccacugcacuccagccuggugacagagugagacuc

SEQ ID NO: 52577 - RNA, 64 nt, hsa
cuagaaaugcaguauugcuuugaccugccauguggcacuccacaaugucaauugcaguuuacac

SEQ ID NO: 52578 - RNA, 64 nt, hsa
ggcggagauugcagugagccaagguuccaccacugcacuccagccuggcgacagagcaaggcuc

SEQ ID NO: 52579 - RNA, 64 nt, hsa
gguggagguugcagugagcugggaucgcgccauugcacuccagccuggcugacagagcgagacu

SEQ ID NO: 52580 - RNA, 64 nt, hsa
ggucggggcugcagugagccaagaucacgccacugcacuccagcacccugggcgacagagugag

SEQ ID NO: 52581 - RNA, 64 nt, hsa
ggcggagcuugcagugagccaagaucgcgccacugcacuccagccugggcgacagagugagacu

SEQ ID NO: 52582 - RNA, 64 nt, hsa
gguggagacugcaguaagccaagaucaugccauugcacuccagccugggcaacacagggagacu

SEQ ID NO: 52583 - RNA, 64 nt, hsa
gguggagguugcagugagccgagauugugccacugcacuccagccugggcgauagagcuagacu

SEQ ID NO: 52584 - RNA, 64 nt, hsa
ggcagagguugcagucagccaagaucaugcuacugcacuccagccugggugacagagcgagacu

SEQ ID NO: 52585 - RNA, 64 nt, hsa
cuguccuagguuacaaagacaugggggccuuguggcacuccaaguaugagucggauacccugga

SEQ ID NO: 52586 - RNA, 64 nt, hsa
gccggaggcugcagugagccaagaucgcaccauugcacuccagcugggagacacagcaagacuc

SEQ ID NO: 52587 - RNA, 64 nt, hsa
ggcugaggcugcagugagccaagaucgcacuacugcacuccagccugggugacagaguaagacc

SEQ ID NO: 52588 - RNA, 64 nt, hsa
ggaagagcuugcagugagccgagaucgcgccacugcacuccagccugggugacagagccagacu

SEQ ID NO: 52589 - RNA, 64 nt, hsa
ggcggagguugcagugagccgagaucgcuccacugcacuccagcccaggugacagugugagacu

SEQ ID NO: 52590 - RNA, 64 nt, hsa
ggcggagcuugcagugagccgagaucgugccacugcacuccagccugggcgacagagugagacu

SEQ ID NO: 52591 - RNA, 64 nt, hsa
ggcaaagguugcagugaacugagauugcgccaccgcacuccagccugggcgacagagcgagacu

SEQ ID NO: 52592 - RNA, 64 nt, hsa
gguggagguugcggugagccaagaucgugccacugcacuccagccugggcuacaagauugaaaa

SEQ ID NO: 52593 - RNA, 64 nt, hsa
ggcggagcuugcagugagccgagaucgcgccaaugcacuccagccugggcgacagagaaaaaaa

SEQ ID NO: 52594 - RNA, 64 nt, hsa
gcccugagggagugaguucacauuugagacaacugcacuccaguguggacgugccuuugucuuc

SEQ ID NO: 52595 - RNA, 64 nt, hsa
uuccucaaaaggucuugcugcugucagguguuaugcacuccauccaucauaacuguaugaaaca

SEQ ID NO: 52596 - RNA, 64 nt, hsa
gguugugguugcagugagcuaugauuguaccacugcacuccagccugggcaacagagcaagacc

SEQ ID NO: 52597 - RNA, 64 nt, hsa
ggcggagguugcggucagcugagauggugccacugcacuccagccugggcgaaagagcgacucu

SEQ ID NO: 52598 - RNA, 64 nt, hsa
ggcagagguugaagugagcugagaucgcgccauugcacuccagccugggcaacaagaguggcac

SEQ ID NO: 52599 - RNA, 64 nt, hsa
gcgccauugcacuccagccugggcaacaagaguggcacuccaucucagaaaaaaaaaaaaaaga

SEQ ID NO: 52600 - RNA, 64 nt, hsa
acccaguaucuucugugccaugguucccacauucgcacuccauggccuccuguccuggacccca

SEQ ID NO: 52601 - RNA, 64 nt, hsa
ggcagagguugcagugagccaagaucacacuauugcacuccagccugggcgacagggcaagacu

SEQ ID NO: 52602 - RNA, 64 nt, hsa
gguugaagcugcagugagcugugaucgcaccacugcacuccagcuugguucauggagacccugu

SEQ ID NO: 52603 - RNA, 64 nt, hsa
ggcggagcuugcagugagccgagaucgcgccacugcacuccagccugggcgacagagugagacu

SEQ ID NO: 52604 - RNA, 64 nt, hsa
gauugaggcugcagugagcuguguucacaccacugcacuccagucugggcaacagugcaagacc

SEQ ID NO: 52605 - RNA, 64 nt, hsa
gguggagguuucagcgagcugagaucacaccacugcacuccagccuuggugacagagugagacu

SEQ ID NO: 52606 - RNA, 64 nt, hsa
cugggaggcagaaguuguggugagccgagauugugcacuccagccuggguaacagagcgagacu

SEQ ID NO: 52607 - RNA, 64 nt, hsa
gguggagguugcagugagccgacaucaugccacugcacuccagccugggcgacagagcaagaca

SEQ ID NO: 52608 - RNA, 64 nt, hsa
guuggaggcugaagagagcuaugacugcaucacugcacuccagccugggcaacacagcaagauc

SEQ ID NO: 52609 - RNA, 64 nt, hsa
ggcggaguuuguggugaguugagaucgcgccacugcacuccagccuggguaacagagcaagagu

SEQ ID NO: 52610 - RNA, 64 nt, hsa
ggcagaguuugcagugagcugagaucgugccacugcacuccagccugggugacagagugagacc

SEQ ID NO: 52611 - RNA, 64 nt, hsa
gguugaggcuauagugagccaugaucauaccacugcacuccagccugggugacagagcgagacc

SEQ ID NO: 52612 - RNA, 64 nt, hsa
ggcagaggcugcagugaaccaagaucaugccacugcacuccagccugggcaacacagcgagacu

SEQ ID NO: 52613 - RNA, 64 nt, hsa
ggcggagcuugcagugagccgagauugcgccacugcacuccagccugggcagcagagcaacacu

SEQ ID NO: 52614 - RNA, 64 nt, hsa
gguagaggcugcauugagccaugauugcaccacugcacuccagccugggcaacagagggagccc

SEQ ID NO: 52615 - RNA, 64 nt, hsa
ggcggagcuugcagugagccaagaucgcgccacugcacuccagccuggguggccgagcgagacu

SEQ ID NO: 52616 - RNA, 64 nt, hsa
uggugaggcugcagugagcuaugaucgugcuacugcacuccagccugggcgacacagcaaguuc

SEQ ID NO: 52617 - RNA, 64 nt, hsa
cugaacagagcuccacacaucugucagggugugagcacuccaaggccucgcguggagcauccuu

SEQ ID NO: 52618 - RNA, 64 nt, hsa
ggucgaggcugcagugagccaagaucaugcuacugcacuccagcuuagguggcaaagugagacc

SEQ ID NO: 52619 - RNA, 64 nt, hsa
auuugaggcugcagugagcuaugauuguaucacugcacuccagccuagaugacagaacgagacc

SEQ ID NO: 52620 - RNA, 64 nt, hsa
ggcagagguuucagugagcugaaauugugccacugcacuccagccugagugacagagugagacu

SEQ ID NO: 52621 - RNA, 64 nt, hsa
ggcggagcuugcagugagcugagaucacgccacugcacuccagccugggcaacagagugagacu

SEQ ID NO: 52622 - RNA, 64 nt, hsa
ggcagagguagcagugagcugaagucccgccacugcacuccagccugggcaacagagcgagacu

SEQ ID NO: 52623 - RNA, 64 nt, hsa
ggcggagguuacagugagcugagaucgugccacugcacuccagccugggugacagagugagacc

SEQ ID NO: 52624 - RNA, 64 nt, hsa
uguccauauuccacauuugcugacugugcucccugcacuccacucaaguugagaguucaaauag

SEQ ID NO: 52625 - RNA, 64 nt, hsa
gguggagguugcagugagcugagcucaugcgacugcacuccagccugggugacugagcaagacu

SEQ ID NO: 52626 - RNA, 64 nt, hsa
ggcagagcuugcagugagccaagaucgcgccacugcacuccagccugggugacagagcgagacu

SEQ ID NO: 52627 - RNA, 64 nt, hsa
ggcggagguugcagugagccaagaucgcgccacugcacuccagccuggcaauagggcgagacuc

SEQ ID NO: 52628 - RNA, 64 nt, hsa
cacggagguugcagugagcuaagaucaugccaucgcacuccagccugggggacaaaagugagac

SEQ ID NO: 52629 - RNA, 64 nt, hsa
ggcggagguuguagugagcugagaucgugccacugcacuccagccugggcaacagagccagacu

SEQ ID NO: 52630 - RNA, 64 nt, hsa
caacacagugaagaccccagccaccucuaccugugcacuccaaccccuucacacccaccccucu

SEQ ID NO: 52631 - RNA, 64 nt, hsa
guuugagguuguagggagcuaugaucuugccauugcacuccagcugagagugugacccugucuc

SEQ ID NO: 52632 - RNA, 64 nt, hsa
gacauagguugcaguguaaugggaucacgccacugcacuccagcuugggugacaaaguaagacc

SEQ ID NO: 52633 - RNA, 64 nt, hsa
agcggagguugcagugagccgagaucgugccuuugcacuccagcguggaagacagugagacucc

SEQ ID NO: 52634 - RNA, 64 nt, hsa
ggcggaggcugcagugggccgggaucguacuacugcacuccagcauggaagacagcgagacucc

SEQ ID NO: 52635 - RNA, 64 nt, hsa
aaaugcuguugcuucagguucuuaaaaucacucagcacuccaacuucuaaucaaauuuuuggag

SEQ ID NO: 52636 - RNA, 64 nt, hsa
ggcagagcuugcagugagccgagaucucgccacugcacuccagccugggcaacagagcaagacu

SEQ ID NO: 52637 - RNA, 64 nt, hsa
guuggagguugcagugagccaagaucuugccauugcacuccagccugggcaacaagagugaaau

SEQ ID NO: 52638 - RNA, 64 nt, hsa
gguggagguugcaaugagccgagaucacaccacugcacuccagccugggcaacagugaaacucc

SEQ ID NO: 52639 - RNA, 64 nt, hsa
gguggagguugcagugagccaagacuacgccacugcacuccagccuggaggccagagugagacu

SEQ ID NO: 52640 - RNA, 64 nt, hsa
ugggagguggagguugcaguaagcugagaucgcugcacuccagccugggcgacaagagcgagac

SEQ ID NO: 52641 - RNA, 64 nt, hsa; identical to SEQ ID NO: 24182

SEQ ID NO: 52642 - RNA, 64 nt, hsa; identical to SEQ ID NO: 24183

SEQ ID NO: 52643 - RNA, 64 nt, hsa; identical to SEQ ID NO: 24184

SEQ ID NO: 52644 - RNA, 64 nt, hsa; identical to SEQ ID NO: 24185

SEQ ID NO: 52645 - RNA, 64 nt, hsa; identical to SEQ ID NO: 24186

SEQ ID NO: 52646 - RNA, 64 nt, hsa; identical to SEQ ID NO: 24187

SEQ ID NO: 52647 - RNA, 64 nt, hsa; identical to SEQ ID NO: 24188

SEQ ID NO: 52648 - RNA, 64 nt, hsa; identical to SEQ ID NO: 24189

SEQ ID NO: 52649 - RNA, 64 nt, hsa; identical to SEQ ID NO: 24190

SEQ ID NO: 52650 - RNA, 64 nt, hsa; identical to SEQ ID NO: 24191

SEQ ID NO: 52651 - RNA, 64 nt, hsa; identical to SEQ ID NO: 24192

SEQ ID NO: 52652 - RNA, 64 nt, hsa; identical to SEQ ID NO: 24193

SEQ ID NO: 52653 - RNA, 64 nt, hsa; identical to SEQ ID NO: 24194

SEQ ID NO: 52654 - RNA, 64 nt, hsa; identical to SEQ ID NO: 24195

SEQ ID NO: 52655 - RNA, 64 nt, hsa; identical to SEQ ID NO: 24196

SEQ ID NO: 52656 - RNA, 64 nt, hsa; identical to SEQ ID NO: 24197

SEQ ID NO: 52657 - RNA, 64 nt, hsa; identical to SEQ ID NO: 24198

SEQ ID NO: 52658 - RNA, 64 nt, hsa; identical to SEQ ID NO: 24199

SEQ ID NO: 52659 - RNA, 64 nt, hsa; identical to SEQ ID NO: 24200

SEQ ID NO: 52660 - RNA, 64 nt, hsa; identical to SEQ ID NO: 24201

SEQ ID NO: 52661 - RNA, 64 nt, hsa; identical to SEQ ID NO: 24202

SEQ ID NO: 52662 - RNA, 64 nt, hsa; identical to SEQ ID NO: 24203

SEQ ID NO: 52663 - RNA, 64 nt, hsa; identical to SEQ ID NO: 24204

SEQ ID NO: 52664 - RNA, 64 nt, hsa; identical to SEQ ID NO: 24205

SEQ ID NO: 52665 - RNA, 64 nt, hsa; identical to SEQ ID NO: 24206

SEQ ID NO: 52666 - RNA, 64 nt, hsa; identical to SEQ ID NO: 24207

SEQ ID NO: 52667 - RNA, 64 nt, hsa; identical to SEQ ID NO: 24208

SEQ ID NO: 52668 - RNA, 64 nt, hsa; identical to SEQ ID NO: 24209

SEQ ID NO: 52669 - RNA, 64 nt, hsa; identical to SEQ ID NO: 24210

SEQ ID NO: 52670 - RNA, 64 nt, hsa; identical to SEQ ID NO: 24211

SEQ ID NO: 52671 - RNA, 64 nt, hsa; identical to SEQ ID NO: 24212

SEQ ID NO: 52672 - RNA, 64 nt, hsa; identical to SEQ ID NO: 24213

SEQ ID NO: 52673 - RNA, 64 nt, hsa; identical to SEQ ID NO: 24214

SEQ ID NO: 52674 - RNA, 64 nt, hsa; identical to SEQ ID NO: 24215

SEQ ID NO: 52675 - RNA, 64 nt, hsa; identical to SEQ ID NO: 24216

SEQ ID NO: 52676 - RNA, 64 nt, hsa; identical to SEQ ID NO: 24217

SEQ ID NO: 52677 - RNA, 64 nt, hsa; identical to SEQ ID NO: 24218

SEQ ID NO: 52678 - RNA, 64 nt, hsa; identical to SEQ ID NO: 24219

SEQ ID NO: 52679 - RNA, 64 nt, hsa; identical to SEQ ID NO: 24220

SEQ ID NO: 52680 - RNA, 64 nt, hsa; identical to SEQ ID NO: 24221

SEQ ID NO: 52681 - RNA, 64 nt, hsa; identical to SEQ ID NO: 24222

SEQ ID NO: 52682 - RNA, 64 nt, hsa; identical to SEQ ID NO: 24223

SEQ ID NO: 52683 - RNA, 64 nt, hsa; identical to SEQ ID NO: 24224

SEQ ID NO: 52684 - RNA, 64 nt, hsa; identical to SEQ ID NO: 24225

SEQ ID NO: 52685 - RNA, 64 nt, hsa; identical to SEQ ID NO: 24226

SEQ ID NO: 52686 - RNA, 64 nt, hsa; identical to SEQ ID NO: 24227

SEQ ID NO: 52687 - RNA, 64 nt, hsa; identical to SEQ ID NO: 24228

SEQ ID NO: 52688 - RNA, 64 nt, hsa; identical to SEQ ID NO: 24229

SEQ ID NO: 52689 - RNA, 64 nt, hsa; identical to SEQ ID NO: 24230

SEQ ID NO: 52690 - RNA, 64 nt, hsa; identical to SEQ ID NO: 24231

SEQ ID NO: 52691 - RNA, 64 nt, hsa; identical to SEQ ID NO: 24232

SEQ ID NO: 52692 - RNA, 64 nt, hsa; identical to SEQ ID NO: 24233

SEQ ID NO: 52693 - RNA, 64 nt, hsa; identical to SEQ ID NO: 24234

SEQ ID NO: 52694 - RNA, 64 nt, hsa; identical to SEQ ID NO: 24235

SEQ ID NO: 52695 - RNA, 64 nt, hsa; identical to SEQ ID NO: 24236

SEQ ID NO: 52696 - RNA, 64 nt, hsa; identical to SEQ ID NO: 24237

SEQ ID NO: 52697 - RNA, 64 nt, hsa; identical to SEQ ID NO: 24238

SEQ ID NO: 52698 - RNA, 64 nt, hsa; identical to SEQ ID NO: 24239

SEQ ID NO: 52699 - RNA, 64 nt, hsa; identical to SEQ ID NO: 24240

SEQ ID NO: 52700 - RNA, 64 nt, hsa; identical to SEQ ID NO: 24241

SEQ ID NO: 52701 - RNA, 64 nt, hsa; identical to SEQ ID NO: 24242

SEQ ID NO: 52702 - RNA, 64 nt, hsa; identical to SEQ ID NO: 24243

SEQ ID NO: 52703 - RNA, 64 nt, hsa; identical to SEQ ID NO: 24244

SEQ ID NO: 52704 - RNA, 64 nt, hsa; identical to SEQ ID NO: 24245

SEQ ID NO: 52705 - RNA, 64 nt, hsa; identical to SEQ ID NO: 24246

SEQ ID NO: 52706 - RNA, 64 nt, hsa; identical to SEQ ID NO: 24247

SEQ ID NO: 52707 - RNA, 64 nt, hsa; identical to SEQ ID NO: 24248

SEQ ID NO: 52708 - RNA, 64 nt, hsa; identical to SEQ ID NO: 24249

SEQ ID NO: 52709 - RNA, 64 nt, hsa; identical to SEQ ID NO: 24250

SEQ ID NO: 52710 - RNA, 64 nt, hsa; identical to SEQ ID NO: 24247

SEQ ID NO: 52711 - RNA, 64 nt, hsa; identical to SEQ ID NO: 24252

SEQ ID NO: 52712 - RNA, 64 nt, hsa; identical to SEQ ID NO: 24253

SEQ ID NO: 52713 - RNA, 64 nt, hsa; identical to SEQ ID NO: 24254

SEQ ID NO: 52714 - RNA, 64 nt, hsa; identical to SEQ ID NO: 24255

SEQ ID NO: 52715 - RNA, 64 nt, hsa; identical to SEQ ID NO: 24256

SEQ ID NO: 52716 - RNA, 64 nt, hsa; identical to SEQ ID NO: 24257

SEQ ID NO: 52717 - RNA, 64 nt, hsa; identical to SEQ ID NO: 24258

SEQ ID NO: 52718 - RNA, 64 nt, hsa; identical to SEQ ID NO: 24259

SEQ ID NO: 52719 - RNA, 64 nt, hsa; identical to SEQ ID NO: 24260

SEQ ID NO: 52720 - RNA, 64 nt, hsa; identical to SEQ ID NO: 24261

SEQ ID NO: 52721 - RNA, 64 nt, hsa; identical to SEQ ID NO: 24262

SEQ ID NO: 52722 - RNA, 64 nt, hsa; identical to SEQ ID NO: 24263

SEQ ID NO: 52723 - RNA, 64 nt, hsa; identical to SEQ ID NO: 24264

SEQ ID NO: 52724 - RNA, 64 nt, hsa; identical to SEQ ID NO: 24265

SEQ ID NO: 52725 - RNA, 64 nt, hsa; identical to SEQ ID NO: 24266

SEQ ID NO: 52726 - RNA, 64 nt, hsa; identical to SEQ ID NO: 24267

SEQ ID NO: 52727 - RNA, 64 nt, hsa; identical to SEQ ID NO: 24268

SEQ ID NO: 52728 - RNA, 64 nt, hsa; identical to SEQ ID NO: 24269

SEQ ID NO: 52729 - RNA, 64 nt, hsa; identical to SEQ ID NO: 24270

SEQ ID NO: 52730 - RNA, 64 nt, hsa; identical to SEQ ID NO: 24271

SEQ ID NO: 52731 - RNA, 64 nt, hsa; identical to SEQ ID NO: 24272

SEQ ID NO: 52732 - RNA, 64 nt, hsa; identical to SEQ ID NO: 24273

SEQ ID NO: 52733 - RNA, 64 nt, hsa; identical to SEQ ID NO: 24274

SEQ ID NO: 52734 - RNA, 64 nt, hsa; identical to SEQ ID NO: 24275

SEQ ID NO: 52735 - RNA, 64 nt, hsa; identical to SEQ ID NO: 24276

SEQ ID NO: 52736 - RNA, 64 nt, hsa; identical to SEQ ID NO: 24277

SEQ ID NO: 52737 - RNA, 64 nt, hsa; identical to SEQ ID NO: 24278

SEQ ID NO: 52738 - RNA, 64 nt, hsa; identical to SEQ ID NO: 24279

SEQ ID NO: 52739 - RNA, 64 nt, hsa; identical to SEQ ID NO: 24280

SEQ ID NO: 52740 - RNA, 64 nt, hsa; identical to SEQ ID NO: 24281

SEQ ID NO: 52741 - RNA, 64 nt, hsa; identical to SEQ ID NO: 24282

SEQ ID NO: 52742 - RNA, 64 nt, hsa; identical to SEQ ID NO: 24283

SEQ ID NO: 52743 - RNA, 64 nt, hsa; identical to SEQ ID NO: 24284

SEQ ID NO: 52744 - RNA, 64 nt, hsa; identical to SEQ ID NO: 24285

SEQ ID NO: 52745 - RNA, 64 nt, hsa; identical to SEQ ID NO: 24286

SEQ ID NO: 52746 - RNA, 64 nt, hsa; identical to SEQ ID NO: 24287

SEQ ID NO: 52747 - RNA, 64 nt, hsa; identical to SEQ ID NO: 24288

SEQ ID NO: 52748 - RNA, 64 nt, hsa; identical to SEQ ID NO: 24289

SEQ ID NO: 52749 - RNA, 64 nt, hsa; identical to SEQ ID NO: 24290

SEQ ID NO: 52750 - RNA, 64 nt, hsa; identical to SEQ ID NO: 24291

SEQ ID NO: 52751 - RNA, 64 nt, hsa; identical to SEQ ID NO: 24292

SEQ ID NO: 52752 - RNA, 64 nt, hsa; identical to SEQ ID NO: 24293

SEQ ID NO: 52753 - RNA, 64 nt, hsa; identical to SEQ ID NO: 24294

SEQ ID NO: 52754 - RNA, 64 nt, hsa; identical to SEQ ID NO: 24295

SEQ ID NO: 52755 - RNA, 64 nt, hsa; identical to SEQ ID NO: 24296

SEQ ID NO: 52756 - RNA, 64 nt, hsa; identical to SEQ ID NO: 24297

SEQ ID NO: 52757 - RNA, 64 nt, hsa; identical to SEQ ID NO: 24298

SEQ ID NO: 52758 - RNA, 64 nt, hsa; identical to SEQ ID NO: 24299

SEQ ID NO: 52759 - RNA, 64 nt, hsa; identical to SEQ ID NO: 24300

SEQ ID NO: 52760 - RNA, 64 nt, hsa; identical to SEQ ID NO: 24301

SEQ ID NO: 52761 - RNA, 64 nt, hsa; identical to SEQ ID NO: 24302

SEQ ID NO: 52762 - RNA, 64 nt, hsa; identical to SEQ ID NO: 24303

SEQ ID NO: 52763 - RNA, 64 nt, hsa; identical to SEQ ID NO: 24304

SEQ ID NO: 52764 - RNA, 64 nt, hsa; identical to SEQ ID NO: 24305

SEQ ID NO: 52765 - RNA, 64 nt, hsa; identical to SEQ ID NO: 24306

SEQ ID NO: 52766 - RNA, 64 nt, hsa; identical to SEQ ID NO: 24307

SEQ ID NO: 52767 - RNA, 64 nt, hsa; identical to SEQ ID NO: 24308

SEQ ID NO: 52768 - RNA, 64 nt, hsa; identical to SEQ ID NO: 24309

SEQ ID NO: 52769 - RNA, 64 nt, hsa; identical to SEQ ID NO: 24310

SEQ ID NO: 52770 - RNA, 64 nt, hsa; identical to SEQ ID NO: 24311

SEQ ID NO: 52771 - RNA, 64 nt, hsa; identical to SEQ ID NO: 24312

SEQ ID NO: 52772 - RNA, 64 nt, hsa; identical to SEQ ID NO: 24313

SEQ ID NO: 52773 - RNA, 64 nt, hsa; identical to SEQ ID NO: 24314

SEQ ID NO: 52774 - RNA, 64 nt, hsa; identical to SEQ ID NO: 24315

SEQ ID NO: 52775 - RNA, 64 nt, hsa; identical to SEQ ID NO: 24316

SEQ ID NO: 52776 - RNA, 64 nt, hsa; identical to SEQ ID NO: 24317

SEQ ID NO: 52777 - RNA, 64 nt, hsa; identical to SEQ ID NO: 24318

SEQ ID NO: 52778 - RNA, 64 nt, hsa; identical to SEQ ID NO: 24319

SEQ ID NO: 52779 - RNA, 64 nt, hsa; identical to SEQ ID NO: 24320

SEQ ID NO: 52780 - RNA, 64 nt, hsa; identical to SEQ ID NO: 24321

SEQ ID NO: 52781 - RNA, 64 nt, hsa; identical to SEQ ID NO: 24322

SEQ ID NO: 52782 - RNA, 64 nt, hsa; identical to SEQ ID NO: 24323

SEQ ID NO: 52783 - RNA, 64 nt, hsa; identical to SEQ ID NO: 24324

SEQ ID NO: 52784 - RNA, 64 nt, hsa; identical to SEQ ID NO: 24325

SEQ ID NO: 52785 - RNA, 64 nt, hsa; identical to SEQ ID NO: 24326

SEQ ID NO: 52786 - RNA, 64 nt, hsa; identical to SEQ ID NO: 24327

SEQ ID NO: 52787 - RNA, 64 nt, hsa
aaguaccuaggggagaaagagccauguaaauaucuguaauaaacuuguagcauauguaaaguuu

SEQ ID NO: 52788 - RNA, 64 nt, hsa
uugguuguaaacuauauuucaaaguaaacccuaguguaauaaguuuuauaacuaaaaagguuua

SEQ ID NO: 52789 - RNA, 64 nt, hsa
aguguguuauggaguacacccauuuugacacacuuguaauaagagaaucuuucauuugccugcc

SEQ ID NO: 52790 - RNA, 64 nt, hsa
ggaaauuguauucccuauaauauacaaauuuuccuguaauaaagucaacuuagaaacuccaagg

SEQ ID NO: 52791 - RNA, 64 nt, hsa
uuauaagaugaagcguagugaauuguacagcuguuguaauaaugaccuauuucuauauaaaaua

SEQ ID NO: 52792 - RNA, 64 nt, hsa
aaguuuucuuguguuuuucugugagugaaaauuuuguaauaaauuaacaaauuuguacaauuuc

SEQ ID NO: 52793 - RNA, 64 nt, hsa
uuuucaguuaucuucuaccuccuguauuuucuacuguaauaauguaauuuaaggccuuccacaa

SEQ ID NO: 52794 - RNA, 64 nt, hsa
gcccggagcccugcucaucaaugaaaaacccauauguaauaaucgaauucauuuaacaugaauc

SEQ ID NO: 52795 - RNA, 64 nt, hsa
uuuuauaacccauguuacaaggaaguuaaacaauuguaauaaugaaaugagcuuucucuauagc

SEQ ID NO: 52796 - RNA, 64 nt, hsa
uauguagcauauauacauggcuauaugcuguauauguaauaagguuuauuucugugaguuuugu

SEQ ID NO: 52797 - RNA, 64 nt, hsa
cuauauuuuuaaacuggugaaacugacccaaauauguaauaaauaccauaguagcucagaccca

SEQ ID NO: 52798 - RNA, 64 nt, hsa
uucgggguugucauuaaguaaguugugaaauuucuguaauaacaaaggcaguccgcauucuucc

SEQ ID NO: 52799 - RNA, 64 nt, hsa
uuauuuuccuuggccuucaagcuuccaaaaaacuuguaauaaucauguuagcuauagcuuguau

SEQ ID NO: 52800 - RNA, 64 nt, hsa
uuaauuuuuagaaauucaugggaaauuggauuuuuguaauaaucuuuugauguuuuaaacauug

SEQ ID NO: 52801 - RNA, 64 nt, hsa
auuaaaucacaguucagaugaaacugaauaucauuguaauaaucucauaauauauauuuguaac

SEQ ID NO: 52802 - RNA, 64 nt, hsa
guauucaguguuuugccaauuaauauuauaugcuuguaauaaaagcaaaagaaaagcuuaagug

SEQ ID NO: 52803 - RNA, 64 nt, hsa
gauauauguuuacaguguagaaugauuaaaucaauguaauaaauuuauugccucauaccauuuu

SEQ ID NO: 52804 - RNA, 64 nt, hsa
acaguccucuggauccucuaaaugugaauuuugauguaauaacugcuaauaaaauuauauugaa

SEQ ID NO: 52805 - RNA, 64 nt, hsa
uguucuggcaccaaaaguaaugacaaauguuaaguguaauaauagaaaaguagagcaaagagcc

SEQ ID NO: 52806 - RNA, 64 nt, hsa
aaauugucuuuacuguauuuuuguucucugguaauguaauaagcaugauggugccuucuauuaa

SEQ ID NO: 52807 - RNA, 64 nt, hsa
uguggucacaugaugugcauagagauagcuacaguguaauaauuuacacuauuuugugcuccaa

SEQ ID NO: 52808 - RNA, 64 nt, hsa
agcuucuaugcauuaagaguaaaauuccucuuacuguaauaaaaacaauugaagaagacuguug

SEQ ID NO: 52809 - RNA, 64 nt, hsa
uuacauugccuaaaguagaauguguaaguaaugcuguaauaauacauaucauaguauauuauaa

SEQ ID NO: 52810 - RNA, 64 nt, hsa
uguuuaauaggaaauauauaauaauagcauuuuauguaauaaaauaugggcaacgauuaucuug

SEQ ID NO: 52811 - RNA, 64 nt, hsa
gagauguaauaaauguaauggaugugaaaaaaacuguaauaauuuagcccucauuagguauuua

SEQ ID NO: 52812 - RNA, 64 nt, hsa
caaagcucaucgaagaauacauccuugagagagauguaauaaauguaauggaugugaaaaaaac

SEQ ID NO: 52813 - RNA, 64 nt, hsa
uucuacaugaggacucauauauuuaagccuuuuguguaauaagaaaguauaaagucacuuccag

SEQ ID NO: 52814 - RNA, 64 nt, hsa
gugauuuccuacagaaauacugcucugaauauuuuguaauaaaggucuuugcacaugugaccac

SEQ ID NO: 52815 - RNA, 64 nt, hsa
ucagggaauuuguauuggagaaaaacccugcaaauguaauaaauauggaaaaacauuuuuucaa

SEQ ID NO: 52816 - RNA, 64 nt, hsa
aaaauuaauuaucauuuuguugauugugcuuuuauguaauaaaaugcaguacuuuaaaacauuu

SEQ ID NO: 52817 - RNA, 64 nt, hsa
uucuaaugugguauuuuaaauaaaguaucauaaauguaauaaguaaauauuuauuuaggaauac

SEQ ID NO: 52818 - RNA, 64 nt, hsa
acauucaggacaaaugauuagcccuaaaugaaacuguaauaauuucaguggaaacucaaucugu

SEQ ID NO: 52819 - RNA, 64 nt, hsa
uaccauucuaaauaucaccuacuuaugaauaacauguaauaauuuuuaacauuaaugauuccau

SEQ ID NO: 52820 - RNA, 64 nt, hsa
guauccuuuaaggcaccugugcuagccuagauuuuguaauaacacugauuuaugagaauggaca

SEQ ID NO: 52821 - RNA, 64 nt, hsa
guccuaaagccuuugccauuccuaauacucguuuuguaauaauugcuguauuucuguguaauaa

SEQ ID NO: 52822 - RNA, 64 nt, hsa
uaauacucguuuuguaauaauugcuguauuucuguguaauaaaauauaaaaauaaaauauucag

SEQ ID NO: 52823 - RNA, 64 nt, hsa
ucaauuuuuauuuucuaugauuucuagaaacaaauguaauaaauauuuuuaaaaucuccuuucu

SEQ ID NO: 52824 - RNA, 64 nt, hsa
cuuaguucagacucauauauggauuucaaaucuuuguaauaaaaauuauuuguauuuuuaaguu

SEQ ID NO: 52825 - RNA, 64 nt, hsa
aaugaccaaagugaagagcagauuauucauacgguguaauaagcaucuggaauggacccauccg

SEQ ID NO: 52826 - RNA, 64 nt, hsa
agaauaaaaggaacagaaauucuuaagaugccaauguaauaaauguacuuccuggaagugucuu

SEQ ID NO: 52827 - RNA, 64 nt, hsa
gcuuuaagauuucuauccaucuuucagaguugaauguaauaauguuugguauuuaauucuugau

SEQ ID NO: 52828 - RNA, 64 nt, hsa
guguggacauccugggacuuguuuacauuuuaucuguaauaagauaacugacucacaacaccug

SEQ ID NO: 52829 - RNA, 64 nt, hsa
aauuauuuagaugugaauguuaggucaguucuacuguaauaacuaaucguaaaaguuguaaauu

SEQ ID NO: 52830 - RNA, 64 nt, hsa
augaacuaaaauuucuaacauuaacauuucggcauguaauaaaacaagggccuaucuccuuuaa

SEQ ID NO: 52831 - RNA, 64 nt, hsa
aauguuaaucacgaauguaguaauauuucaugauuguaauaauguuacaugaucaugggugugg

SEQ ID NO: 52832 - RNA, 64 nt, hsa
ccuucagugaaauuaaggguagugugaugucccauguaauaaaacaggcuuagaacaucaauuc

SEQ ID NO: 52833 - RNA, 64 nt, hsa
acauaaaccuguaaugaaugaggcugggcuuuucuguaauaagcuuccuuuuauaauacugguc

SEQ ID NO: 52834 - RNA, 64 nt, hsa
cucuuacugauugaaagauuuuuuauguuuuccuuguaauaaaggaccuaaaccgaagguaccu

SEQ ID NO: 52835 - RNA, 64 nt, hsa
auaaaauaauuuucuaauguguauaucugaaauuuguaauaaaaucaacuucauauuuuaaaaa

SEQ ID NO: 52836 - RNA, 64 nt, hsa
ccuuauagcaucuuagucuuagaaauugguggguuguaauaaucaagggcuucauuccuuuuau

SEQ ID NO: 52837 - RNA, 64 nt, hsa
aacauuuacuauuuuugaagacuagugagauuucuguaauaauuuuaauucuuuaaaaagugaa

SEQ ID NO: 52838 - RNA, 64 nt, hsa
uuucagucaaacaguaaagacuuuauuuauggauuguaauaacaaccacaagaaaagccauaca

SEQ ID NO: 52839 - RNA, 64 nt, hsa
agaccgcagagaccauaccuguugucaaagaggguguaauaaacuguaauaauaaucaugacca

SEQ ID NO: 52840 - RNA, 64 nt, hsa
gaccauaccuguugucaaagaggguguaauaaacuguaauaauaaucaugaccacaaaccauaa

SEQ ID NO: 52841 - RNA, 64 nt, hsa
aaaauauuuaugaacuauauuucucauugcacucuguaauaaaaagcaguuaguuguuacuuac

SEQ ID NO: 52842 - RNA, 64 nt, hsa
cuauugauggauauuuguauuuuuuauacuuuuguguaauaauaaaaauacugcuguaaauauu

SEQ ID NO: 52843 - RNA, 64 nt, hsa
ugugagaagucacacaggggagaaacccuaugaauguaauaaaugugggaaagccuuuucucag

SEQ ID NO: 52844 - RNA, 64 nt, hsa
gaaugaaaaaaaucaaaauacaaaugaaacauuguguaauaauauuuauguaaauuggaaugaa

SEQ ID NO: 52845 - RNA, 64 nt, hsa
aaauuaguacguuauuuuacuauuuguacuuuuauguaauaaaaugcaguacauuuuuaaauuu

SEQ ID NO: 52846 - RNA, 64 nt, hsa
ucagggaauucagauuggagaaaaacccugcaaauguaauaaauuugaaaaaaaaguuuuccaa

SEQ ID NO: 52847 - RNA, 64 nt, hsa
uacacauugugacguuuaguauacaguugccuuuuguaauaacuuuuuuuuuguaaauacauau

SEQ ID NO: 52848 - RNA, 64 nt, hsa
auuaucgcaauuauccauaacauuuauauagcgguguaauaacugcagcaguucugaaaugaug

SEQ ID NO: 52849 - RNA, 64 nt, hsa
cauuuauucacaagcaaccccaaaaguccaaaaauguaauaauuuugacaaggcccaaaguuga

SEQ ID NO: 52850 - RNA, 64 nt, hsa
agaauguacucauacagauuuuuguuagucaucauguaauaagccauuuauaucagaaaccuuu

SEQ ID NO: 52851 - RNA, 64 nt, hsa
uaaauagauauucuauauuaaacacuaauuuaaauguaauaaaggccaaaggccucuguaugaa

SEQ ID NO: 52852 - RNA, 64 nt, hsa
uggucuucacaguaauauuccuugucucucaaagcuauuauauauugcuuugucuuggccaauu

SEQ ID NO: 52853 - RNA, 64 nt, hsa
cagucccugcugacauuuuuuuccuaaccuuuugcuauuauaaauaaugauucauuuuauaacc

SEQ ID NO: 52854 - RNA, 64 nt, hsa
auuucccaacaggugaacugaaaaguuauuuuaacuauuauacauaaucaagauccugccucua

SEQ ID NO: 52855 - RNA, 64 nt, hsa
agcuacuuggggugguaguagaggauuagguugucuauuauaaaaccaaaacucauucguuuaa

SEQ ID NO: 52856 - RNA, 64 nt, hsa
gauaguaauaugaaugugacaugcaccaauuguccuauuauaauuuucagauaaguguaacuaa

SEQ ID NO: 52857 - RNA, 64 nt, hsa
aauagugagcauuucaugaagugcuuuuauaccacuauuauauaucagagaaagauugagaaug

SEQ ID NO: 52858 - RNA, 64 nt, hsa
auuuugaaaggcuauuuugaaauugauuuaauagcuauuauaguuuaugaauaucaaaauuugu

SEQ ID NO: 52859 - RNA, 64 nt, hsa
caauaccacacccucauggaaggagaaaagcauacuauuauaucugggaccucucuuuuagacc

SEQ ID NO: 52860 - RNA, 60 nt, hsa
aacagaaaaagaaaagaugaauaucaauaccuauuauaucuguguggaguagguuuucuc

SEQ ID NO: 52861 - RNA, 64 nt, hsa
acagguuuaaaacaacuuuuuuggggauuuagggcuauuauaggaauaguuuguugucagaagc

SEQ ID NO: 52862 - RNA, 64 nt, hsa
acacuaaugguagaaugcuuuuuuaugugcuagacuauuauauuuaguaguaugucauuguaac

SEQ ID NO: 52863 - RNA, 64 nt, hsa
uuuuuauguacaauauugauagugagagguaugucuauuauaauaaagauuauggcacaguaaa

SEQ ID NO: 52864 - RNA, 64 nt, hsa
uaugaaauuuuagauagcagcgaguccuucguuugaucaauaaacaguguuacagauaacuuca

SEQ ID NO: 52865 - RNA, 64 nt, hsa
gaguacauauauaggcaauaaauauauaugcucagaucaauauacuuguuuagaaaaacuucaa

SEQ ID NO: 52866 - RNA, 64 nt, hsa
ggaggccagccugguaccaaaaggaguacccagggccugguacccaggcccacuccagaauggc

SEQ ID NO: 52867 - RNA, 64 nt, hsa
gugccgagccaacgccucaggaaucaggaggccagccugguaccaaaaggaguacccagggccu

SEQ ID NO: 52868 - RNA, 64 nt, hsa
guuaggucugcugaccuuuaccuaagcagccccugccugguaagaaggugcccauuguucagag

SEQ ID NO: 52869 - RNA, 64 nt, hsa
cucucaacucaugguuuguuuccucuuagagcuggccugguacucagaaauguaccuguguuua

SEQ ID NO: 52870 - RNA, 64 nt, hsa
accaacgccgcauaggacugcccacaugggaccgcccacauaggaccgcccacauaggaccgcc

SEQ ID NO: 52871 - RNA, 64 nt, hsa
ggacugcccacaugggaccgcccacauaggaccgcccacauaggaccgcccacaugggaccgcc

SEQ ID NO: 52872 - RNA, 64 nt, hsa
ggaccgcccacaugggaccgcccacaugggaccgcccacauagaaccguccuccaguggugaag

SEQ ID NO: 52873 - RNA, 64 nt, hsa
agagacucagcaaaaacaggcucgccuucccucucccacauaugaguggaacuuacaugugucc

SEQ ID NO: 52874 - RNA, 64 nt, hsa
uggugacucucacaugggcaucgaagaaguacaacccacauagcccucuggagaccgccuagau

SEQ ID NO: 52875 - RNA, 64 nt, hsa
caagcuggggagggauguggaggggaaaaagaugacagagaaguggacuccaaaccucauuuua

SEQ ID NO: 52876 - RNA, 64 nt, hsa
cagucuauaauuaacugacagaccuaacugaagcacagagaauacaucagacuuaugcauccaa

SEQ ID NO: 52877 - RNA, 64 nt, hsa
agguuuuucaucugaaaagcaguucaugucugaaacagagaaccaaaccgcaaacgugaaauuc

SEQ ID NO: 52878 - RNA, 64 nt, hsa
gaggagaaguauuccuguugcugucuucagucucacagagaagcuccugcuacuuccccagcuc

SEQ ID NO: 52879 - RNA, 64 nt, hsa
uagccuuuuuuccccagacuuguuggcguaggcuacagagaagccuucaagcucugagggaaag

SEQ ID NO: 52880 - RNA, 64 nt, hsa
gaaaaacaggcacuuggcagccuugugaugucauacagagaagucacagggcaguaccugaggg

SEQ ID NO: 52881 - RNA, 64 nt, hsa
gguccaaugagcuuucugaacagcugguguagcuacagagaaaccagcuuccuucagagagcag

SEQ ID NO: 52882 - RNA, 64 nt, hsa
gcuuauuuauuguauucugggguauggcguaaguacagagaagccaucaccucagauggcagcu

SEQ ID NO: 52883 - RNA, 64 nt, hsa
uggccauggagaaagcugacuuggcuggugugguacagagaagccagcuuguuuacaugcuuau

SEQ ID NO: 52884 - RNA, 64 nt, hsa
agguaagagaugcuaacuauuuuucaagcaagcuacagagaaaugauaaauguuuuuuguuuua

SEQ ID NO: 52885 - RNA, 64 nt, hsa
gaagaggaaauguuuacuuccaaauuaggaugugacagagaagggauagggaaauccucucugc

SEQ ID NO: 52886 - RNA, 64 nt, hsa
ccucgggaacucugccccucugacaaugagggccacagagaaggugguguuuccaugguagaug

SEQ ID NO: 52887 - RNA, 64 nt, hsa
aaggguccaggagaacugagacgcaggauggaagacagagaagaccccccggagcuccucgcuc

SEQ ID NO: 52888 - RNA, 64 nt, hsa
ugcauccgcuugcccugccuccaucccgcagggcacagagaagccucuucugccccugccagau

SEQ ID NO: 52889 - RNA, 64 nt, hsa
uuguuuauaacagaugguauaagagagguaauaaacagagaaaaaucuaugcuuguaaagaaua

SEQ ID NO: 52890 - RNA, 64 nt, hsa
ccaaccaaauuacuuaagaaauggaaaaguagucacagagaaauuuaguaauuugcaaaagcca

SEQ ID NO: 52891 - RNA, 64 nt, hsa
auuugagugaauaggagaaaacaauauauaacacacagagaauuaagaaaaugacauuucuggg

SEQ ID NO: 52892 - RNA, 64 nt, hsa
cggaggcuguugcuuuuaucccuaaacugcauccacagagaagccccaagaaggagguuggggc

SEQ ID NO: 52893 - RNA, 64 nt, hsa
cagucauauuuagaacaaagucaaguauaaauuuacagagaaaaaauucuaagacaguuggaug

SEQ ID NO: 52894 - RNA, 64 nt, hsa
ucaauguaauucccuucccagcuacccaaaugcuacagagaaauguuuucuacuuggccacuau

SEQ ID NO: 52895 - RNA, 64 nt, hsa
ccuuuuuuauuuuucuucuguacagucuaaagcuacagagaaaaaaaaaugcacucuucccuug

SEQ ID NO: 52896 - RNA, 64 nt, hsa
uugacauggaaugccuuugaccauuggugcucugacagagaagucauggagucauugccauuuc

SEQ ID NO: 52897 - RNA, 64 nt, hsa
uaaaguccuuuucucuuacagguauuaaaugaggacagagaaccucagguguucuuaugcuagu

SEQ ID NO: 52898 - RNA, 64 nt, hsa
uuuuuucucaaaaagaaacuguaggaaauacaugacagagaaaguuacacucagggagcagcag

SEQ ID NO: 52899 - RNA, 64 nt, hsa
uucaucuaucgcaaaguaaaaauguaaaauccuuacagagaauuguuucacaaaacuuauauuu

SEQ ID NO: 52900 - RNA, 64 nt, hsa
augcugcugcuacugcuaacagccaauuuuauagacagagaaaguauuuuguguucaaauaaac

SEQ ID NO: 52901 - RNA, 64 nt, hsa
agucaaaauaccccauucccucagcagacagaguacagagaagggccucagaggacaccugcag

SEQ ID NO: 52902 - RNA, 64 nt, hsa
aacagaaggccgaauccaaguuucaugugguaggacagagaacggcaaucuacaaaacuacacc

SEQ ID NO: 52903 - RNA, 64 nt, hsa
uagugaaggcugaauccaaguuucauguaguaggacagagaacagaaggccgaauccaaguuuc

SEQ ID NO: 52904 - RNA, 64 nt, hsa
ccacagagaacaagaguuuguucuguucugggggacagagaaggcgcuucccaacuucauacug

SEQ ID NO: 52905 - RNA, 64 nt, hsa
cuagguccaagccccccacaccuuuuccccaaccacagagaacaagaguuuguucuguucuggg

SEQ ID NO: 52906 - RNA, 64 nt, hsa
cauguugacaccaaccucacguuacgaacaauucacagagaauuugccuuuguggcaacugaag

SEQ ID NO: 52907 - RNA, 64 nt, hsa
gugcugcucccaggagaccacugcugacagauacacagagaagagaucagagaggaaaaacugg

SEQ ID NO: 52908 - RNA, 64 nt, hsa
guuuauagauaacugcuggucuuaauugcagaguacagagaacugaaccagcuccugauauugu

SEQ ID NO: 52909 - RNA, 64 nt, hsa
gacuucuacuauauacauuucucugucccugagaacagagaaacguaacccuguaggggacugg

SEQ ID NO: 52910 - RNA, 64 nt, hsa
ccaaaaaccauguuuuaugucaaagcucuguagcacagagaauguggugucacagauacaucgc

SEQ ID NO: 52911 - RNA, 64 nt, hsa
ccuccaucucugccuccauggcuaccuuuaggagacagagaagauccuguguguuucucuguac

SEQ ID NO: 52912 - RNA, 64 nt, hsa
aagauaggagauagcucuguagaaacacacaggaacagagaaaugguugaugucagacccagac

SEQ ID NO: 52913 - RNA, 64 nt, hsa
aagaugagagagaacucuguggauacucauggguacagagaaaugguugauucuggacccagau

SEQ ID NO: 52914 - RNA, 64 nt, hsa
aagauggaagagaguucuuuggaaacccguagauacagagaaguggucgauuccagacccagac

SEQ ID NO: 52915 - RNA, 64 nt, hsa
cuacaugaucuagagccaguuacuuuguguuucagccauguauuugcagcugagagaaaauaau

SEQ ID NO: 52916 - RNA, 64 nt, hsa
augucauguguacaaaaguuucauccuuuucauugccauguaggguucccuuauauuaauauuc

SEQ ID NO: 52917 - RNA, 64 nt, hsa
aacuaccaauuccagguuaacuuuguuggagaauuucccccacccccauccagugggucaccca

SEQ ID NO: 52918 - RNA, 64 nt, hsa
auuuauucagccuucucuacaggaaucucuuauguucccccacaugcaggugguuuuucaguag

SEQ ID NO: 52919 - RNA, 64 nt, hsa
gcagcagcaucucaugcauaacccuguggcuugcuucccccagggcagcacaggcuaagucagg

SEQ ID NO: 52920 - RNA, 64 nt, hsa
acagcaggugaaugggugcccuacggggcccuccuucccccaccaggaacagauggaaccugcc

SEQ ID NO: 52921 - RNA, 64 nt, hsa
gucucuuauucuuaucucuuaagaauuuugguucuucccccagugauugcugguugaauucuua

SEQ ID NO: 52922 - RNA, 64 nt, hsa
uugcugguugaauucuuauauggacagguuucccuucccccaguaucgcacaugguucuaguua

SEQ ID NO: 52923 - RNA, 64 nt, hsa
uguguccucccuuuguucaguggacgguuaaaccuucccccacucaaccaaucuuuuucuuuuu

SEQ ID NO: 52924 - RNA, 64 nt, hsa
ccauccuugaauccuuuaucccuuuccucuuucauucccccaacuucugucgcaugcagugccu

SEQ ID NO: 52925 - RNA, 64 nt, hsa
gcccugcccuagacccugccagaaaagggggcucuucccccagagaaguggcuuggagggaacu

SEQ ID NO: 52926 - RNA, 64 nt, hsa
cugucuccugggaaugcuggaccagggggauuacuucccccacccacacccccauuuggacauc

SEQ ID NO: 52927 - RNA, 64 nt, hsa
ugucuggcauuuuguagucuuaacuucuccccauuucccccaucuuuugguugccuuaaaagaa

SEQ ID NO: 52928 - RNA, 64 nt, hsa
uucauaugcuucaaacuaacacauuuuuaaagcuuucccccacuuuucucucuauuuguauugu

SEQ ID NO: 52929 - RNA, 64 nt, hsa
gccaccauguaggccaccacuccaggccguggacuucccccaacuuggggacagccuuauuccc

SEQ ID NO: 52930 - RNA, 64 nt, hsa
ugggggucugggggguacccucugggguuauagauucccccacugccccagcucugacuggacc

SEQ ID NO: 52931 - RNA, 64 nt, hsa
caugaccucuuggccucuccuuugauucucaaucuucccccaaagcaugguuuggugccagccc

SEQ ID NO: 52932 - RNA, 64 nt, hsa
uucauuguuugacguuuccacugcaugccuugacuucccccaccuccuccucaaacaagagacu

SEQ ID NO: 52933 - RNA, 64 nt, hsa
acaugggagcuuggagcuaauacgacacucugccuucccccagaaggugcaggcuuuccugagu

SEQ ID NO: 52934 - RNA, 64 nt, hsa
gucaaagaagccccuagcugcucucguggccuccuucccccacucccuaucccuucaccuguga

SEQ ID NO: 52935 - RNA, 64 nt, hsa
caagccucucuggcccacauaucuaucucuugccuucccccaugaacuucagccuguccacaca

SEQ ID NO: 52936 - RNA, 64 nt, hsa
cccagauacaaguaccaaacaguagucucugaaguucccccauuuccuucaguaccagucuaua

SEQ ID NO: 52937 - RNA, 64 nt, hsa
ggauugcuucuugugaaaccacaggcccuugggguucccccagacagagccgcaaaucaacccc

SEQ ID NO: 52938 - RNA, 64 nt, hsa
gcaccauggaggcaggcucccccugccuuugaaauucccccacuugggagcuuguauauacuuc

SEQ ID NO: 52939 - RNA, 64 nt, hsa
augggcuucacuaaccuucccuaggcauugaaacuucccccaaaucugauggaccuagaagucu

SEQ ID NO: 52940 - RNA, 64 nt, hsa
uaaauagaaguccuuauguauguguuacaagaauuucccccacaacauccuuuaugacugaagu

SEQ ID NO: 52941 - RNA, 64 nt, hsa
ggaguuccuaacaggaugaaaguucccccaucaguucccccaguaccuccaagcaaguagcuuu

SEQ ID NO: 52942 - RNA, 64 nt, hsa
ggaauggaaagcggaguuccuaacaggaugaaaguucccccaucaguucccccaguaccuccaa

SEQ ID NO: 52943 - RNA, 64 nt, hsa
ccgcccaccuccugcggauacucuuggagaguuguucccccagggggcucugccccaccuggag

SEQ ID NO: 52944 - RNA, 64 nt, hsa
accacacacccuuugggaaagcucuugucucuucuucccccacuaccucuuauuuauuuggugu

SEQ ID NO: 52945 - RNA, 64 nt, hsa
gcuuugggggagaauccacccucccaucaucugcuucccccaaggccucccacaggugacagaa

SEQ ID NO: 52946 - RNA, 64 nt, hsa
gucugaagauuaguucaggggauggaccaagaauuucccccagagcuuuaaagaagugggacuc

SEQ ID NO: 52947 - RNA, 64 nt, hsa
ugauagggucuaccacaucuguaaugucuguccuuucccccacuuuuacugggaauugauaguc

SEQ ID NO: 52948 - RNA, 64 nt, hsa
aaauguuucuaggggagagcauuggaaaauccccuucccccaucuagaucgaaggaagaugagg

SEQ ID NO: 52949 - RNA, 64 nt, hsa
gggugggccaaaggcuacagggugcuucuuccucuucccccacccccacugucccucaugugcc

SEQ ID NO: 52950 - RNA, 64 nt, hsa
ccgugcaucgugucucuucucugcuuuuucucucuucccccacuucucuuucucugaccccucc

SEQ ID NO: 52951 - RNA, 64 nt, hsa
ccugcuccauuaccaaccgaaggcucggucuuaauucccccaccugucuaaggggaacagaaaa

SEQ ID NO: 52952 - RNA, 64 nt, hsa
aaggggaacagaaaaccccugccaaaacuacccuuucccccauggggugcugugaaacucaagg

SEQ ID NO: 52953 - RNA, 64 nt, hsa
ccugcagcaaacacuccacccuccaccuuccauuuucccccacuacugcagcaccuccaggccu

SEQ ID NO: 52954 - RNA, 64 nt, hsa
ccagagccccuccuccagccccugucccacccccuucccccagcccauccauuaggccagcaac

SEQ ID NO: 52955 - RNA, 64 nt, hsa
uccauggccacccucucccaaagagggggcucgcuucccccauuuucaacuugauccacugagg

SEQ ID NO: 52956 - RNA, 64 nt, hsa
ccccggcacccuuuaacaccaccagauggguguuuucccccauccaccacuggcaggguugccc

SEQ ID NO: 52957 - RNA, 64 nt, hsa
cagggcuggggaguugugcaggcuggggugacccuucccccaucauugggccccaacgggcaug

SEQ ID NO: 52958 - RNA, 64 nt, hsa
cagggcuuaccaccugccaccaagguuuccucucuucccccaggaccugggcagagcaggcaug

SEQ ID NO: 52959 - RNA, 64 nt, hsa
gcugcugugagggguccuugcguggcccccauccuucccccaaugcagaacuccaugggcaggg

SEQ ID NO: 52960 - RNA, 64 nt, hsa
gccuugggcagugggggugcuccugucuguccuuuucccccacacccuggacugugcuuggcug

SEQ ID NO: 52961 - RNA, 64 nt, hsa
uuucuuucuuucuuuuuuucuuuuuuaaaguaauuucccccacaguaaaauacacugacuccug

SEQ ID NO: 52962 - RNA, 64 nt, hsa
aauggagacauucugauggaauuugggcaccuguuucccccaccuacuccaauauuugcuggag

SEQ ID NO: 52963 - RNA, 64 nt, hsa
gaagggcuucugggaccaauuccagcuccugacauucccccaguccugccucucccccauccua

SEQ ID NO: 52964 - RNA, 64 nt, hsa
cuccucuuagcuggcucugcucauccagaggauauucccccaucccccccccaucaaguuuggu

SEQ ID NO: 52965 - RNA, 64 nt, hsa
uuguuuguagcuuuccuggaagucaaauaaauguuucccccacuccauugcccuuccacuuguc

SEQ ID NO: 52966 - RNA, 64 nt, hsa
uguuucugaauguuugugucugugguugcagucuuucccccaggaaaaaaaaaaaaagaaauuc

SEQ ID NO: 52967 - RNA, 64 nt, hsa
uuggggggaggucuggagcaccucgccaaugcccuucccccauccggcuggguccuuccaguua

SEQ ID NO: 52968 - RNA, 64 nt, hsa
uggagcugcccuacccccagauucucugagcacuuucccccauccccagggccacagauccccu

SEQ ID NO: 52969 - RNA, 64 nt, hsa
ccugauggccaagaacaccgugugggauuuuuuuuucccccaaggauuuucacacacggaagga

SEQ ID NO: 52970 - RNA, 64 nt, hsa
ccacguaugucuacguggauuuuugguuuucagcuucccccaccccacuggcucuucuuaauua

SEQ ID NO: 52971 - RNA, 64 nt, hsa
acaacauauccguauauauccccucuacucuuacuucccccaaauuuaaagaaguaugggaaau

SEQ ID NO: 52972 - RNA, 64 nt, hsa
ccaaauuuaaagaaguaugggaaaugagaggcauuucccccaccccauuucucuccucacacac

SEQ ID NO: 52973 - RNA, 64 nt, hsa
gccccuccucuucuuucuccuuccgaguucgcccuucccccaccuccuugucuuuccccgaccg

SEQ ID NO: 52974 - RNA, 64 nt, hsa
augagcucugacaaagcuauucccugguguuuuuuucccccacuggggagggggugagguggaa

SEQ ID NO: 52975 - RNA, 64 nt, hsa
ugggaccuccccagcccaggaaaaacuggaagccuucccccagcaaggcagaagcuuggaggag

SEQ ID NO: 52976 - RNA, 64 nt, hsa
gaaaggaggaccagucaggaugaggccccgccuuuucccccacccucccaugagacugcccugc

SEQ ID NO: 52977 - RNA, 64 nt, hsa
gcucccaccucccugaccuaccccugcugcaccauucccccagcugggcuggaagguuccauaa

SEQ ID NO: 52978 - RNA, 64 nt, hsa
ccaccagugggcccagcucuucucaccugccugcuucccccaguggcgugcuccuggcuguagu

SEQ ID NO: 52979 - RNA, 64 nt, hsa
uugacucucgugggaaucccacuguugagguugaucucuucaccucagaaggucucuucagagc

SEQ ID NO: 52980 - RNA, 64 nt, hsa
ccacuguugagguugaucucuucaccucagaaggucucuucagagcugcugugcccaguggugc

SEQ ID NO: 52981 - RNA, 64 nt, hsa
ggaaugugugugugugugugucucuuugagcaucucucuucauuccuggaaugagccauggaca

SEQ ID NO: 52982 - RNA, 64 nt, hsa
ugugugugugugugugugugugucuuugagcauuucucuucauuccuggaaugugugugugugu

SEQ ID NO: 52983 - RNA, 64 nt, hsa
uuuuuuuugcucuagccugucucauguucuugcuucucuucauauguaagucaguauuuuuguc

SEQ ID NO: 52984 - RNA, 64 nt, hsa
acugaauguacaaaucuuagugcuggugcugaaaucucuucagaauagucaucaugauuuaaaa

SEQ ID NO: 52985 - RNA, 64 nt, hsa
uccaguauguugcuucccuuaaguugccauucauucucuucaugacuuuuacuaacucacuucg

SEQ ID NO: 52986 - RNA, 64 nt, hsa
gccaaugggcaaagagcuacuuugaauacauaauucucuucaaagacuucagcagcaaaccaaa

SEQ ID NO: 52987 - RNA, 64 nt, hsa
cucccagccuggaccuaauucuugagaggggcucucucuucacggacugugucuggacuuugag

SEQ ID NO: 52988 - RNA, 64 nt, hsa
ggccaaggagaccccuucgugcuguggacacagcucucuucacucuuugcucauggcaugacac

SEQ ID NO: 52989 - RNA, 64 nt, hsa
uaugaauacagggcaugcauuuugcagcagugagucucuucagaaaacccuuuucuacaguuag

SEQ ID NO: 52990 - RNA, 64 nt, hsa
uuggaaacggccuccuagggaaaaguucauagggucucuucagguucuuagugucacuuaccua

SEQ ID NO: 52991 - RNA, 64 nt, hsa
uaauugaacauuugguagucuuucaagaauagugucucuucaagguuuuacuugauuuaauuug

SEQ ID NO: 52992 - RNA, 64 nt, hsa
aauuccuuauaauugucccugcuccccuucuugaucucuucagggggaauacuaggcaguuuug

SEQ ID NO: 52993 - RNA, 64 nt, hsa
ucuagcugcccacagaugccaccaaaaccugcuaucucuucaucaccagguacgauucucuuuc

SEQ ID NO: 52994 - RNA, 64 nt, hsa
gaugucauagauuccaggccugggagguguuaugucucuucagcugggaaaacuagcucuucag

SEQ ID NO: 52995 - RNA, 64 nt, hsa
uugcuauuugagcaugcacagcugcuuguccugcucucuucaggaggcccuggugucaggcagg

SEQ ID NO: 52996 - RNA, 64 nt, hsa
caccucagcugauauuauggcaagugauaucaccucucuucagccccuagugcuauucuguguu

SEQ ID NO: 52997 - RNA, 64 nt, hsa
cccaggaauaucccaaacuucggaaacaaguuauucucuucacucccaauaacuaaugcuaaga

SEQ ID NO: 52998 - RNA, 64 nt, hsa
augaauuuuuuccagauuugggguauaggucucaucucuucagguucucaugauaccaccuuua

SEQ ID NO: 52999 - RNA, 64 nt, hsa
uuucaacaugaguguauuuuuuaaaauugauuuuucucuucauuuuuuuuucaaucaacuuuac

SEQ ID NO: 53000 - RNA, 64 nt, hsa
ccugcgggacuuaacgugcucaugggcugugugaucucuucagggugggguggucucugauagg

SEQ ID NO: 53001 - RNA, 64 nt, hsa
ucugaaauuugugauggaaucagauuuuaacagcucucuucaaugacauagaaaguucauggaa

SEQ ID NO: 53002 - RNA, 64 nt, hsa
uguauauaaaugguuggcagcuuauuccaguugaucucuucacaucugccuuaaaagugcuaug

SEQ ID NO: 53003 - RNA, 64 nt, hsa
uuuugggugaggacucauuacugcaguauauugaucucuucaccaaaugcuuuuucuuuuucug

SEQ ID NO: 53004 - RNA, 64 nt, hsa
uuuacauuuggucuuaaugaucuugaauagauccucucuucauuuuacucagccagguuuugua

SEQ ID NO: 53005 - RNA, 59 nt, hsa
ucaagaaagaaaagaaauaauggaauuuuucucuucaaagguccuuagguguaaauuga

SEQ ID NO: 53006 - RNA, 64 nt, hsa
cuggguaugcuucauauuacuggaaugaauuuauucucuucagagagaaauauuagguuagugc

SEQ ID NO: 53007 - RNA, 64 nt, hsa
ugccucuguguucacacggccuuucccucugucuucucuucauuaccuuuuaaggacagugucu

SEQ ID NO: 53008 - RNA, 64 nt, hsa
cuauccucucucucucuaugacuaucacacacuuucucuucaaugaaaaaaucgaauugguggc

SEQ ID NO: 53009 - RNA, 64 nt, hsa
ccuaaugauuccgcgcggagaccuccugacaacgucucuucaagcauccucagaagccucgacu

SEQ ID NO: 53010 - RNA, 64 nt, hsa
uucuaaauguuugggaucauuccuaucaucuuagucucuucaggaucuuuaguauuuuccuggu

SEQ ID NO: 53011 - RNA, 64 nt, hsa
cgcagugaacugucaaggacuuuccagacugucuucucuucagacuuuuauaaucuccaguggc

SEQ ID NO: 53012 - RNA, 64 nt, hsa
uucuacuguauucccagcacgggugacuucuuuuucucuucauuagccagagaugacuaauuua

SEQ ID NO: 53013 - RNA, 64 nt, hsa
gaaaagcuacuacagggaagaguguucucugcugucucuucacuggaaaacagggaggggggau

SEQ ID NO: 53014 - RNA, 64 nt, hsa
cugauuugcauaaaugacucagugggcuuuuguaucucuucauuuaagaauuauuugaaugccu

SEQ ID NO: 53015 - RNA, 64 nt, hsa
uucaauguaauauuuucuguagcuccaaaggcuaucucuucauauugacugcagacagacugaa

SEQ ID NO: 53016 - RNA, 64 nt, hsa
ccguuugcaguuucucucuguguugugauucccuucucuucaacguuuucaguacguguuucuc

SEQ ID NO: 53017 - RNA, 64 nt, hsa
gauucccuucucuucaacguuuucaguacguguuucucuucaauaaacuucauucaguguucca

SEQ ID NO: 53018 - RNA, 64 nt, hsa
agcauugucaagcuccuaaaggguucauuuggccccuccucaaagacuaauguccccaugugaa

SEQ ID NO: 53019 - RNA, 64 nt, hsa
caucccacaccccacccucccuucccuucauaccccuccucaacguucuuuuacuuuauacuuu

SEQ ID NO: 53020 - RNA, 64 nt, hsa
gguuuggagcacaauggugaagcacacuccccucccuccucaccugggguccaauguucugucu

SEQ ID NO: 53021 - RNA, 64 nt, hsa
ccaucaccagcuucuugcucagggagacuuccgcccuccucacugaggcaacaugaagcccgag

SEQ ID NO: 53022 - RNA, 64 nt, hsa
aaccccuggcugaacagugcucugccucuaacucccuccucacacuccagaauuacccuuccuc

SEQ ID NO: 53023 - RNA, 64 nt, hsa
agggccucggaggcuccucccucugccucauccuccuccucauucagaccaaucuuaguuucua

SEQ ID NO: 53024 - RNA, 64 nt, hsa
gacggggcucucagggcugggaggaccccagugcccuccucagaagaagcacaugggcuccugc

SEQ ID NO: 53025 - RNA, 64 nt, hsa
uaccucacuugggggagcacagggccccgcugggccuccucaccaacggcagugccaaaaucag

SEQ ID NO: 53026 - RNA, 64 nt, hsa
gacaccuggggcucuugauccuggcacugcuggcccuccucacccuacuggguguuguucuggc

SEQ ID NO: 53027 - RNA, 64 nt, hsa
aagucccagcccaguccccgcgcgcgucccucuuccuccucauacuuucccuugacugagagcu

SEQ ID NO: 53028 - RNA, 64 nt, hsa
ugucuuaauuauuauuuguguuuuaauuuaaacaccuccucauguacauacccuggccgccccc

SEQ ID NO: 53029 - RNA, 64 nt, hsa
ugggcauuuuuauuuuaugaaauacuauuuaaagccuccucaucccguguucuccuuuuccucu

SEQ ID NO: 53030 - RNA, 64 nt, hsa
cuuggaccaguagaggacacggaggguucagaccccuccucagacccuccccacaucugaaacu

SEQ ID NO: 53031 - RNA, 64 nt, hsa
ucccguguuaaguccugguuccccaccugcugccccuccucaacacagagccccucccgccgcc

SEQ ID NO: 53032 - RNA, 64 nt, hsa
cuugcuugcugacuuagccuccucccaaagucccccuccucagccagccuccuugugagagugg

SEQ ID NO: 53033 - RNA, 64 nt, hsa
cgccaaggagggaagagucccagugaacucggccccuccucaaugggcuuucccccaacucagg

SEQ ID NO: 53034 - RNA, 64 nt, hsa
caguuuacccagcaugacuuuccuuaggaggcccccuccucacgcuagaguaaaagucccaguu

SEQ ID NO: 53035 - RNA, 64 nt, hsa
agagaacaucccgcuucugaagcugcugcagcucccuccucagggaucacacugccgucaccca

SEQ ID NO: 53036 - RNA, 64 nt, hsa
gaggcccccaagaugccgcagcuccagggcucuuccuccucaccagaaaucccugggcuuccac

SEQ ID NO: 53037 - RNA, 64 nt, hsa
accuuuauuccccagugggcaguuacugagcuuuccuccucagagccaugcuggcagcccuggg

SEQ ID NO: 53038 - RNA, 64 nt, hsa
uggaggguccuggggacggcagaggauaaagcccccuccucacaucccucuauugcggauccac

SEQ ID NO: 53039 - RNA, 64 nt, hsa
ucuguacccggguaaagugggggccucaacugugccuccucagguggauggaagguucugggug

SEQ ID NO: 53040 - RNA, 64 nt, hsa
gguugggcccagccagauaauacaugauaaucucccuccucaagguuuuuaauauuaaacacau

SEQ ID NO: 53041 - RNA, 64 nt, hsa
aguuccuacccaggcugccuggccggggccacugccuccucagcaugcaggaggcugcccugua

SEQ ID NO: 53042 - RNA, 64 nt, hsa
uuugugacagcagaccuggcuguguugccccucuccuccucacuauucucaccaggccauggga

SEQ ID NO: 53043 - RNA, 64 nt, hsa
augacagaucuccccacuacauuaaucccgugcuccuccucacugccauuauaguuuauugugu

SEQ ID NO: 53044 - RNA, 64 nt, hsa
ugccuguuuccgcuacuauauuaugcccaguguuccuccucaccccacguccuggggucaggcc

SEQ ID NO: 53045 - RNA, 64 nt, hsa
cgcucccaucucuacccagucucaggccugcuuaccuccucacagcccaugaagaccccuucuc

SEQ ID NO: 53046 - RNA, 64 nt, hsa
ugaggaggacgcuguggggugagguccagggcugccuccucauggagcugugugugagcaggcg

SEQ ID NO: 53047 - RNA, 64 nt, hsa
gcucuguagaacugcagaccugugcuguuugaugccuccucacugucccgucacuccugggaag

SEQ ID NO: 53048 - RNA, 64 nt, hsa
gggacccaccacacacccacacaugccagaggucccuccucacagaggagagggccugugucug

SEQ ID NO: 53049 - RNA, 64 nt, hsa
gacugcauugagcaggcccaccugcuucccagaaccuccucacuagggcugagcaccuucucug

SEQ ID NO: 53050 - RNA, 64 nt, hsa
gagagugugagcggggcuuuagccggaagucaguccuccucauucaccagaggacacacagggg

SEQ ID NO: 53051 - RNA, 64 nt, hsa
agagagugugggagggcuuuagccggaagucagaccuccucagucaccagaggacacacacagg

SEQ ID NO: 53052 - RNA, 64 nt, hsa
acucuccuuucaugucccugugccccccaguucuccuccucagccuuuuccuccucaguuuucu

SEQ ID NO: 53053 - RNA, 64 nt, hsa
cccugugccccccaguucuccuccucagccuuuuccuccucaguuuucucuuuaaaacugugaa

SEQ ID NO: 53054 - RNA, 64 nt, hsa
cucaucaccaucgcccuagggaccaagacugaauccuccucacaaacuggggggaaaccgaagg

SEQ ID NO: 53055 - RNA, 64 nt, hsa
gcaugaagaucuccguggcugccauucccuucuuccuccucaucaccaucgcccuagggaccaa

SEQ ID NO: 53056 - RNA, 64 nt, hsa
gaagcgugaaccccagggaacagcgggucccuucccuccucagacacaagccaccucagcuugu

SEQ ID NO: 53057 - RNA, 64 nt, hsa
ugacccagccuucagugugggcugcugaagcuauccuccucaggccucagggaugaccuccugc

SEQ ID NO: 53058 - RNA, 64 nt, hsa
ucuaccugcucuucaccaacauccugcugcucaaccuccucaucgccauguucaagugagcgcc

SEQ ID NO: 53059 - RNA, 64 nt, hsa
accacggccgccccgccgcgccgccccccuucauccuccucagccaccugcagcucuucaucaa

SEQ ID NO: 53060 - RNA, 63 nt, hsa
gaaguuuauacccguuucacaugcuuuucaagaaugucgcaauuacuaagaagcagauaaugg

SEQ ID NO: 53061 - RNA, 63 nt, hsa
agggccgagggcuggugaagcuguuaaggcuaaaugucgcaugcaugaggcgggcugcaggcc

SEQ ID NO: 53062 - RNA, 63 nt, hsa
gcaacauauuaagaguaugugaaggaagcagggaugucgcaggaauccgcuggcuaacaucug

SEQ ID NO: 53063 - RNA, 63 nt, hsa
gaaacugaagagcaacuuguuagaaaacugacaaugucgcaagauguacucaguuuuguuucu

SEQ ID NO: 53064 - RNA, 63 nt, hsa
ggccaaucagugucaucuccuggguaaauuuugaugucgcauuauaaagacaugcauaauuga

SEQ ID NO: 53065 - RNA, 63 nt, hsa
gugccuuauauugguuuugguuuggggcacuggaugucgcagcuacugcuaugguuucaggag

SEQ ID NO: 53066 - RNA, 63 nt, hsa
uauauuuuguguuauucgugaauagucuuuugcaugucgcacaauguuugauguccccaaagu

SEQ ID NO: 53067 - RNA, 63 nt, hsa
cagcaggugucuuuaacugucauuguguguggaaugucgcagacuccuccacguggcgggaau

SEQ ID NO: 53068 - RNA, 63 nt, hsa
uuagucuggccacaugcauagcccaucuucauaaugucgcagcagaagguucuuugugguuaa

SEQ ID NO: 53069 - RNA, 63 nt, hsa
ugaacaguaucagucgucugggcucaugcugggaugucgcagugcuccuguugcaacuccucc

SEQ ID NO: 53070 - RNA, 63 nt, hsa
ggccaggccugcgagaagacccagcuggaguucaugucgcaacagugcgccaggaccgacggc

SEQ ID NO: 53071 - RNA, 63 nt, hsa
ccguggaccuggcugaggagcugggccaucgcgaugucgcacgguaccugcgcgcggcugcgg

SEQ ID NO: 53072 - RNA, 63 nt, hsa
augaacuggcuucggacagaacaggacagauggaugucgcacacgccgagacucugccguacc

SEQ ID NO: 53073 - RNA, 63 nt, hsa
uagcagagguggguagagacacuuaauaguaucaugucgcaugcagaugucacaucggccucu

SEQ ID NO: 53074 - RNA, 63 nt, hsa
gcugaaggaaaagcaaccuagaucaccuuauggaugucgcaauaauacaaaccaacguaccuc

SEQ ID NO: 53075 - RNA, 63 nt, hsa
gcugugcuuggaggggcaggaaaagaacugagcaugucgcaggcagcgggcccagccugagca

SEQ ID NO: 53076 - RNA, 63 nt, hsa
aagaccuguugauccuuuuagauuaaaaauaaaaugucgcauguaaaggcugaagucgcguuu

SEQ ID NO: 53077 - RNA, 63 nt, hsa
cuuacuccugguucccuaccaguauuucuaaacaugucgcacuuucuccacaggcaugugguu

SEQ ID NO: 53078 - RNA, 63 nt, hsa
uaaggcccuggugucuuacagaaaccaucacguaugucgcagcagcauuucaccccugaaguc

SEQ ID NO: 53079 - RNA, 63 nt, hsa
ggccagccccagacauccuaucgccacaaugccaugucgcaauaggaagcaggggccggccau

SEQ ID NO: 53080 - RNA, 63 nt, hsa
ggaggguugaguuucucuaaggaccccucaaacaugucgcaaaaugaaccaaacuucuggcua

SEQ ID NO: 53081 - RNA, 63 nt, hsa
cagaacccccauuccccagccucugcugguagcaugucgcaguuuccauguguuucaggaucu

SEQ ID NO: 53082 - RNA, 63 nt, hsa
gacucacacuuacugcaaaggcuuggcucccgaaugucgcauuugguggacgagaaggugcuu

SEQ ID NO: 53083 - RNA, 63 nt, hsa
cacuccacggcaggucccuagccugcaacauuuaugucgcaugucaauccgaagagugaugcc

SEQ ID NO: 53084 - RNA, 63 nt, hsa
uacugcauggacuguauacucgauuucauguguaugucgcaguaaacaaaaccaaaccucuuu

SEQ ID NO: 53085 - RNA, 63 nt, hsa
aauaaaaauucaagugugguuucuacugaaugcaugucgcauucgcaccauuguaaagucaag

SEQ ID NO: 53086 - RNA, 63 nt, hsa
gugugagggccugaccgggcccagggcaagcagaugucgcaagcccuauuuauucagucuuca

SEQ ID NO: 53087 - RNA, 63 nt, hsa
gucuuggcuuaaggagacuuccuguggguugccaugucgcacguccguuagaucuugauuuua

SEQ ID NO: 53088 - RNA, 63 nt, hsa
gcugaaggaaaagcaaccuagaucaccuuauggaugucgcaauaauacaaaccaguguaccuc

SEQ ID NO: 53089 - RNA, 63 nt, hsa
auggggaggugcccaacgccaggcuaccgcugcaugucgcacuaaguguguucuccuguugca

SEQ ID NO: 53090 - RNA, 64 nt, hsa
aaggagcaaacgucuggcuaugugaagccuaauuuaccugcaggaacuggcagggauagucacu

SEQ ID NO: 53091 - RNA, 64 nt, hsa
cucccaugucaucaccccaccaccgucacuucuguaccugcaucaagaaaaccugcuuguucac

SEQ ID NO: 53092 - RNA, 64 nt, hsa
acagauagcuugcuguauucuguauagcuuacucuaccugcagacagaaaaugaaagaaaaaaa

SEQ ID NO: 53093 - RNA, 64 nt, hsa
cuuaauugaaguguaauauagguuguagaauuguuaccugcaguucuaugguuuuguuucacuu

SEQ ID NO: 53094 - RNA, 64 nt, hsa
cagugcccgucagccaacugugggccuucaccucuaccugcacuuccccucucacaccagcugc

SEQ ID NO: 53095 - RNA, 64 nt, hsa
cgcaugcacgugcacacauguacacacacacaccuaccugcacagcacgcuguugaguguuggu

SEQ ID NO: 53096 - RNA, 64 nt, hsa
gucaauucucuaaaaauguguccguauauuucuguaccugcaguguaguaaagguuuagacgaa

SEQ ID NO: 53097 - RNA, 64 nt, hsa
gacacgcuacuguugguuaaauuuaaacauguuuuaccugcagaaauucucucacaaauaaccu

SEQ ID NO: 53098 - RNA, 64 nt, hsa
guugcugcgacacgcugacccugacuuuuaucaauaccugcaagaggcaggcgcugaugaccuc

SEQ ID NO: 53099 - RNA, 64 nt, hsa
cguccugcgccgggcuagggcucucuuugcugauuaccugcagucagaggugugggacucagag

SEQ ID NO: 53100 - RNA, 64 nt, hsa
ucaaauuacuagauuuuuuaaagagagaaauaauuaccugcacaaagcagagaacuucauaaaa

SEQ ID NO: 53101 - RNA, 64 nt, hsa
aaaccugcucauuaacaugcauguguauaauuuguaccugcagaucugauguugcauaauacaa

SEQ ID NO: 53102 - RNA, 64 nt, hsa
uuuuaaacauagauuauauuccucaagaugaagggcuuaacauauccacagcuuccucaguuug

SEQ ID NO: 53103 - RNA, 64 nt, hsa
uguaauuccaaaacuuaagaaccauauuuacauugcuuaacacagaauuuuacaucuaagcaag

SEQ ID NO: 53104 - RNA, 64 nt, hsa
cacuuuuuagagcggcgucuuaguuuauuuaaacgcuuaacaucuuccaccgcaacagcuugcc

SEQ ID NO: 53105 - RNA, 64 nt, hsa
uguaauauagaaaacugucccuuuccaggugggagcuuaacaccuguauaaaaccuaagguuuu

SEQ ID NO: 53106 - RNA, 64 nt, hsa
ccuggagcaauugagaggacuguuuaaacacagagcuuaacaauggcagaauuguauaucucgu

SEQ ID NO: 53107 - RNA, 64 nt, hsa
cagagcuuaacaauggcagaauuguauaucucgugcuuaacagauuuugguugaacuuuacccu

SEQ ID NO: 53108 - RNA, 64 nt, hsa
uauugaugccauuuaaagggauggaugcaaccuagcuuaacaguauaaugcugcaaauuuuccu

SEQ ID NO: 53109 - RNA, 64 nt, hsa
agaagugcaacauguaugugcaaaagcuaaaauggcuuaacaucaugcuacacuuuacacuaaa

SEQ ID NO: 53110 - RNA, 64 nt, hsa; identical to SEQ ID NO: 50680

SEQ ID NO: 53111 - RNA, 64 nt, hsa; identical to SEQ ID NO: 50681

SEQ ID NO: 53112 - RNA, 64 nt, hsa; identical to SEQ ID NO: 50682

SEQ ID NO: 53113 - RNA, 64 nt, hsa; identical to SEQ ID NO: 50683

SEQ ID NO: 53114 - RNA, 64 nt, hsa; identical to SEQ ID NO: 50684

SEQ ID NO: 53115 - RNA, 64 nt, hsa; identical to SEQ ID NO: 50685

SEQ ID NO: 53116 - RNA, 64 nt, hsa; identical to SEQ ID NO: 50686

SEQ ID NO: 53117 - RNA, 64 nt, hsa; identical to SEQ ID NO: 50687

SEQ ID NO: 53118 - RNA, 64 nt, hsa; identical to SEQ ID NO: 50688

SEQ ID NO: 53119 - RNA, 64 nt, hsa; identical to SEQ ID NO: 50689

SEQ ID NO: 53120 - RNA, 64 nt, hsa; identical to SEQ ID NO: 50690

SEQ ID NO: 53121 - RNA, 64 nt, hsa; identical to SEQ ID NO: 50691

SEQ ID NO: 53122 - RNA, 64 nt, hsa; identical to SEQ ID NO: 50692

SEQ ID NO: 53123 - RNA, 64 nt, hsa; identical to SEQ ID NO: 50693

SEQ ID NO: 53124 - RNA, 62 nt, hsa; identical to SEQ ID NO: 50694

SEQ ID NO: 53125 - RNA, 62 nt, hsa; identical to SEQ ID NO: 50695

SEQ ID NO: 53126 - RNA, 62 nt, hsa; identical to SEQ ID NO: 50696

SEQ ID NO: 53127 - RNA, 62 nt, hsa; identical to SEQ ID NO: 50697

SEQ ID NO: 53128 - RNA, 62 nt, hsa; identical to SEQ ID NO: 50698

SEQ ID NO: 53129 - RNA, 62 nt, hsa; identical to SEQ ID NO: 50699

SEQ ID NO: 53130 - RNA, 62 nt, hsa; identical to SEQ ID NO: 50700

SEQ ID NO: 53131 - RNA, 62 nt, hsa; identical to SEQ ID NO: 50701

SEQ ID NO: 53132 - RNA, 62 nt, hsa; identical to SEQ ID NO: 50702

SEQ ID NO: 53133 - RNA, 62 nt, hsa; identical to SEQ ID NO: 50703

SEQ ID NO: 53134 - RNA, 64 nt, hsa; identical to SEQ ID NO: 50680

SEQ ID NO: 53135 - RNA, 64 nt, hsa; identical to SEQ ID NO: 50681

SEQ ID NO: 53136 - RNA, 64 nt, hsa; identical to SEQ ID NO: 50682

SEQ ID NO: 53137 - RNA, 64 nt, hsa; identical to SEQ ID NO: 50683

SEQ ID NO: 53138 - RNA, 64 nt, hsa; identical to SEQ ID NO: 50684

SEQ ID NO: 53139 - RNA, 64 nt, hsa; identical to SEQ ID NO: 50685

SEQ ID NO: 53140 - RNA, 64 nt, hsa; identical to SEQ ID NO: 50686

SEQ ID NO: 53141 - RNA, 64 nt, hsa; identical to SEQ ID NO: 50687

SEQ ID NO: 53142 - RNA, 64 nt, hsa; identical to SEQ ID NO: 50688

SEQ ID NO: 53143 - RNA, 64 nt, hsa; identical to SEQ ID NO: 50689

SEQ ID NO: 53144 - RNA, 64 nt, hsa; identical to SEQ ID NO: 50690

SEQ ID NO: 53145 - RNA, 64 nt, hsa; identical to SEQ ID NO: 50691

SEQ ID NO: 53146 - RNA, 64 nt, hsa; identical to SEQ ID NO: 50692

SEQ ID NO: 53147 - RNA, 64 nt, hsa; identical to SEQ ID NO: 50693

SEQ ID NO: 53148 - RNA, 62 nt, hsa; identical to SEQ ID NO: 50694

SEQ ID NO: 53149 - RNA, 62 nt, hsa; identical to SEQ ID NO: 50695

SEQ ID NO: 53150 - RNA, 62 nt, hsa; identical to SEQ ID NO: 50696

SEQ ID NO: 53151 - RNA, 62 nt, hsa; identical to SEQ ID NO: 50697

SEQ ID NO: 53152 - RNA, 62 nt, hsa; identical to SEQ ID NO: 50698

SEQ ID NO: 53153 - RNA, 62 nt, hsa; identical to SEQ ID NO: 50699

SEQ ID NO: 53154 - RNA, 62 nt, hsa; identical to SEQ ID NO: 50700

SEQ ID NO: 53155 - RNA, 62 nt, hsa; identical to SEQ ID NO: 50701

SEQ ID NO: 53156 - RNA, 62 nt, hsa; identical to SEQ ID NO: 50702

SEQ ID NO: 53157 - RNA, 62 nt, hsa; identical to SEQ ID NO: 50703

SEQ ID NO: 53158 - RNA, 64 nt, hsa; identical to SEQ ID NO: 50680

SEQ ID NO: 53159 - RNA, 64 nt, hsa; identical to SEQ ID NO: 50681

SEQ ID NO: 53160 - RNA, 64 nt, hsa; identical to SEQ ID NO: 50682

SEQ ID NO: 53161 - RNA, 64 nt, hsa; identical to SEQ ID NO: 50683

SEQ ID NO: 53162 - RNA, 64 nt, hsa; identical to SEQ ID NO: 50684

SEQ ID NO: 53163 - RNA, 64 nt, hsa; identical to SEQ ID NO: 50685

SEQ ID NO: 53164 - RNA, 64 nt, hsa; identical to SEQ ID NO: 50686

SEQ ID NO: 53165 - RNA, 64 nt, hsa; identical to SEQ ID NO: 50687

SEQ ID NO: 53166 - RNA, 64 nt, hsa; identical to SEQ ID NO: 50688

SEQ ID NO: 53167 - RNA, 64 nt, hsa; identical to SEQ ID NO: 50689

SEQ ID NO: 53168 - RNA, 64 nt, hsa; identical to SEQ ID NO: 50690

SEQ ID NO: 53169 - RNA, 64 nt, hsa; identical to SEQ ID NO: 50691

SEQ ID NO: 53170 - RNA, 64 nt, hsa; identical to SEQ ID NO: 50692

SEQ ID NO: 53171 - RNA, 64 nt, hsa; identical to SEQ ID NO: 50693

SEQ ID NO: 53172 - RNA, 62 nt, hsa; identical to SEQ ID NO: 50694

SEQ ID NO: 53173 - RNA, 62 nt, hsa; identical to SEQ ID NO: 50695

SEQ ID NO: 53174 - RNA, 62 nt, hsa; identical to SEQ ID NO: 50696

SEQ ID NO: 53175 - RNA, 62 nt, hsa; identical to SEQ ID NO: 50697

SEQ ID NO: 53176 - RNA, 62 nt, hsa; identical to SEQ ID NO: 50698

SEQ ID NO: 53177 - RNA, 62 nt, hsa; identical to SEQ ID NO: 50699

SEQ ID NO: 53178 - RNA, 62 nt, hsa; identical to SEQ ID NO: 50700

SEQ ID NO: 53179 - RNA, 62 nt, hsa; identical to SEQ ID NO: 50701

SEQ ID NO: 53180 - RNA, 62 nt, hsa; identical to SEQ ID NO: 50702

SEQ ID NO: 53181 - RNA, 62 nt, hsa; identical to SEQ ID NO: 50703

SEQ ID NO: 53182 - RNA, 64 nt, hsa
aaaaggaaguaguuauuuuagcagaaaauuuaauaugaaucaaagcuuauauguaaacuucaag

SEQ ID NO: 53183 - RNA, 64 nt, hsa
ucuuaauuuuucuuucaugacaacacauuccaaaaugaaucaugcuuauguacuaagagggaaa

SEQ ID NO: 53184 - RNA, 64 nt, hsa
aaaaaaacacccaauaucuucucuuguagacuauaugaaucaauuauuacaucuguuuuacuau

SEQ ID NO: 53185 - RNA, 64 nt, hsa
aauucuucuugaguuaaaaaagacacuuuuuauuaugaaucagauuccaaaucauuaacuauuu

SEQ ID NO: 53186 - RNA, 64 nt, hsa
uccaugucucucguaaaacagauggcccaaaguaaugaaucauguggcuguaccuucuccacau

SEQ ID NO: 53187 - RNA, 64 nt, hsa
aaaaucuggcuuucaguguagaacagaaaguuagaugaaucagugcccaagacauauuuucugu

SEQ ID NO: 53188 - RNA, 64 nt, hsa
accgaaaaaacaugaaauuuuucauuaaaaugccaugaaucaagccagggccguuggcuuaugc

SEQ ID NO: 53189 - RNA, 64 nt, hsa
gagacccagccucaaaaaaaaaaaaaaaaaagugaugaaucaaaauuagaaauuaagaguuuua

SEQ ID NO: 53190 - RNA, 64 nt, hsa
augugucucaggcucaaguuuuuauaguuauuaaauguuucaaaauagacaaguuuuguuuccu

SEQ ID NO: 53191 - RNA, 64 nt, hsa
uugaguuauuccacaaacacauuauaaaguucagauguuucaucaaugcaguucucacgaaagu

SEQ ID NO: 53192 - RNA, 64 nt, hsa
caagugacauuucaaaagaaguucuauaacaauuauguuucaugcuuaaaguaaaaauucccag

SEQ ID NO: 53193 - RNA, 64 nt, hsa
auuaaucaugcaguguacaauucaaaaucaugcaauguuucacuuuagaauuggauuugaagaa

SEQ ID NO: 53194 - RNA, 64 nt, hsa
uugaaucuaccauucauagccagauguguaucagauguuucacugacaguuuuuaacaauaaau

SEQ ID NO: 53195 - RNA, 64 nt, hsa
uuauaauaccuuuuccuuguguguaauuauacuuauguuucaauaacagcugaaggguuuuauu

SEQ ID NO: 53196 - RNA, 64 nt, hsa
uagagacagcccagucucuucugguuuaaucauuauguuucaaauugaaacagucucuuuugag

SEQ ID NO: 53197 - RNA, 64 nt, hsa
uccucaugccuucaggaaagacuuaacaaaaacaauguuucaucuggggaacugagcuaggcgg

SEQ ID NO: 53198 - RNA, 64 nt, hsa
uagagauaaggauugcacauuggaaaaguaaaccauguuucauuccuuuuucccuauuuauauu

SEQ ID NO: 53199 - RNA, 64 nt, hsa
cagaaaugcccuccaugugucccucuaauguugcauguuucaguggguuggaaguuuuguauau

SEQ ID NO: 53200 - RNA, 64 nt, hsa
cuguuggaauugucaucuguacaauuaguccauaauguuucauguuuguccuaagugugcuguu

SEQ ID NO: 53201 - RNA, 64 nt, hsa
ugcuaugcagugugaucuuuauuuauaguaaauuauguuucauguaaaugauauauuuuuggug

SEQ ID NO: 53202 - RNA, 64 nt, hsa
ccuuuucuuguaucuggauucaaauuuauuuccaauguuucaagcgggaaacaugacucuuuau

SEQ ID NO: 53203 - RNA, 64 nt, hsa
uuuuuuaucagagucaugaugaaucaguccuagaauguuucauuugcacaaguagggcugccuc

SEQ ID NO: 53204 - RNA, 64 nt, hsa
cuuuuguccugcaucaucuugaacauuaauccacauguuucagagcucaccaggcaguaccaau

SEQ ID NO: 53205 - RNA, 64 nt, hsa
cuccugccguuuucuuccugccaagccugaaucaauguuucaucuccaacccucugccaguuug

SEQ ID NO: 53206 - RNA, 64 nt, hsa
cccauugggcccucgucugccucuccaggauuguauguuucaagccuuguccuguguuccuuug

SEQ ID NO: 53207 - RNA, 64 nt, hsa
uauggaauauuacuucuaucagaagaugaucaagauguuucaguccagugcacaucagcauugc

SEQ ID NO: 53208 - RNA, 64 nt, hsa
ugagcaggaagucuagaaaugauaacuagacuguauguuucaugugugugauuuuucagaauuc

SEQ ID NO: 53209 - RNA, 64 nt, hsa
gauaaacauauauccucuuuuuauugcuuugucuauguuucauaugaaacauuucagaaauuau

SEQ ID NO: 53210 - RNA, 64 nt, hsa
ggcgcccucucaauuuagucuucucucauuggccauguuucagauuuugaccuagaaaugcgag

SEQ ID NO: 53211 - RNA, 64 nt, hsa
aagcaauguagaguuacgcuuuuauaaguauuucauguuucagaaaugaugcauacagcaauuu

SEQ ID NO: 53212 - RNA, 64 nt, hsa
cacugguagauauagaagccuuuauuaagaauugauguuucauucaauuucagaucacugguac

SEQ ID NO: 53213 - RNA, 64 nt, hsa
ugucauuccacuugugaaagaaaacacaaugugcauguuucaaugauacugugcggaaacacac

SEQ ID NO: 53214 - RNA, 64 nt, hsa
guucaguucauagcguagacugcuaaauacuguaauguuucaaaacauccaacuguuuguuaua

SEQ ID NO: 53215 - RNA, 64 nt, hsa
uaaucugugagaacaaugguugaaauuucaaaguauguuucauuauucuuucuaaauuugauaa

SEQ ID NO: 53216 - RNA, 64 nt, hsa
ugacaauuuaucuuccauaugcucuuuaaguaaaauguuucaaagacaguuuuaaagggagcca

SEQ ID NO: 53217 - RNA, 64 nt, hsa
gcuggauuuggacaaaaagcaaaucuagacaugcauguuucaggguucaguaguauacuucaug

SEQ ID NO: 53218 - RNA, 64 nt, hsa
gacaugcauguuucaggguucaguaguauacuucauguuucauacagauaauucacauucaaaa

SEQ ID NO: 53219 - RNA, 64 nt, hsa
agugaaagugccaacaaauuauugauagcugauaauguuucauuaucugcaacugcuugauaag

SEQ ID NO: 53220 - RNA, 64 nt, hsa
aauguguauauguaaauaauauguguuuuaccagauguuucauagaaagaauuuuuucuugauc

SEQ ID NO: 53221 - RNA, 64 nt, hsa
gauuuauuaaauucuaguuaugugcccuauaaugauguuucagucagugacagaccucauauau

SEQ ID NO: 53222 - RNA, 64 nt, hsa
ucugcagcagggggugacugacacaccaaacaagauguuucacuggguacucugccauagaaau

SEQ ID NO: 53223 - RNA, 64 nt, hsa
uuugacugccuaagggacagcacgaaugacucacauguuucagacaggccuccacggcuaugga

SEQ ID NO: 53224 - RNA, 64 nt, hsa
ccuugguggauuaaccaaggccuuggauuccagaauguuucaugguaagcacuguggagaaccu

SEQ ID NO: 53225 - RNA, 64 nt, hsa
gucgucccuuuguuauuuuaugugggagagggaaauguuucagaaacgaaagaucucauccccu

SEQ ID NO: 53226 - RNA, 64 nt, hsa
acacauuguccacuucagaugcuuguuuaaaaaaauguuucaccaugugucuuuacccaauaca

SEQ ID NO: 53227 - RNA, 64 nt, hsa
uguaauauauauauauauauauaaaaugaaauauauguuucauuuuagagaaauaacuauuacu

SEQ ID NO: 53228 - RNA, 64 nt, hsa
aauauaucuugcucuauagaggauuuuuuuuuguauguuucaagcuucagccuuuaaccuauac

SEQ ID NO: 53229 - RNA, 64 nt, hsa
aacauuaacuucuaaagaaguuuuuucuaagaaaauguuucaaggcaauauuuuuuuugaggcu

SEQ ID NO: 53230 - RNA, 64 nt, hsa
cacuaaacuuuuguguccauauuuuacugagaccauguuucauuaaaagcauaguuucauagua

SEQ ID NO: 53231 - RNA, 64 nt, hsa
cuuugaugguucucaugccaucaguuguguggaaauguaugauccaacuagaaaugaauggaag

SEQ ID NO: 53232 - RNA, 64 nt, hsa
aaauggccacucagaugaccugaguuguggagagauguaugauucaaacauagaugacuggauu

SEQ ID NO: 53233 - RNA, 64 nt, hsa
auaaauuaugcaggguacuccuaacccuguagaaauguaugaccucucacaaaguugagauuug

SEQ ID NO: 53234 - RNA, 64 nt, hsa
agacagaaauggcuauuaaaaauguuuuaaccucauguaugaacugaauuuaaaaaaccacuaa

SEQ ID NO: 53235 - RNA, 64 nt, hsa
caugccuagaguagugcucucguugaugaagcacauguaugaggagaccagcagcaaaacauaa

SEQ ID NO: 53236 - RNA, 64 nt, hsa
uggaagaacugcccugcuuuuuuacccuguugccauguaugauuauuccuugugagauuacuua

SEQ ID NO: 53237 - RNA, 64 nt, hsa
uugugauucuguguggccuuuuuggggcuggaaaauguaugaauucuucaacugucuuacaaga

SEQ ID NO: 53238 - RNA, 64 nt, hsa
uugcucuuaagagcaaaucacaacaggauucuuaauguaugauuucuuuguucauauauuauga

SEQ ID NO: 53239 - RNA, 64 nt, hsa
aauuguguggcagugauuggucuguuuguggagaauguaugaaagcuauuaauauucuagaaua

SEQ ID NO: 53240 - RNA, 64 nt, hsa
uauaucguucucaauucuauagacuuucaagccuauguaugaauaugaagggguuuuuuuuuuu

SEQ ID NO: 53241 - RNA, 64 nt, hsa
aaaacaaaaauaccucucuuugcuagagaguuauauguaugacuuaaauuauuagcuaugguuu

SEQ ID NO: 53242 - RNA, 64 nt, hsa
uuaaaauacugcaggaugcuuagugcucaguguuauguaugaacuuguggacuuuacaaugcag

SEQ ID NO: 53243 - RNA, 64 nt, hsa
uaccucaaagcguugucauguggauugagaugauauguaugaaucacauaaaagagugccuggc

SEQ ID NO: 53244 - RNA, 64 nt, hsa
ccuuaagggucuaacuuguaaugaagacagaaauauguaugaggaugaucacugaaauauuuau

SEQ ID NO: 53245 - RNA, 64 nt, hsa
guagaagaauaucacuuauuuuuagacuuguaaaauguaugaacuggugagcggacaucuguua

SEQ ID NO: 53246 - RNA, 64 nt, hsa
acgcuguaacccggcaucgagugcugaccuuguaauguaugaguucacggaagaagcacaaccg

SEQ ID NO: 53247 - RNA, 64 nt, hsa
uuuacauacagccacucauacaauucagacagcaauguaugauugauccaguuucuucacaucc

SEQ ID NO: 53248 - RNA, 64 nt, hsa
gcauaauucccuugaaauccauccaaguuguugcauguaugaauaguuucuuccuuuuuuucuu

SEQ ID NO: 53249 - RNA, 64 nt, hsa
gcacccagcuuugucuguggguuaguauugguguauguaugaguaucuguauguauauauacac

SEQ ID NO: 53250 - RNA, 64 nt, hsa
uuguuugcaaacccgaaaauaaaagacguucauuauguaugaaaaguaacugauuuguauucug

SEQ ID NO: 53251 - RNA, 64 nt, hsa
auuuccugcauauauauguaugaagggcauguauauguaugaaugagcaaacauauuugaaagu

SEQ ID NO: 53252 - RNA, 64 nt, hsa
uguguaugaaugaacauacauuuccugcauauauauguaugaagggcauguauauguaugaaug

SEQ ID NO: 53253 - RNA, 64 nt, hsa
ggaggaguucccugggcuucuggcaccuguuucuaggccuaaccauuaguacuuacugugcagg

SEQ ID NO: 53254 - RNA, 64 nt, hsa
cuaaaacuccuuuuaaccaagcuuagcuucucaaaggccuaaccaagccuuggcaccgccagau

SEQ ID NO: 53255 - RNA, 64 nt, hsa
uaucugucauggaacugaacauucaucgauggucuccauguauucauuuauucacuuguucauu

SEQ ID NO: 53256 - RNA, 64 nt, hsa
acccuuuccccuuuuuccuaccccacagcucuguuccauguaaguugccaacaguuucacugaa

SEQ ID NO: 53257 - RNA, 64 nt, hsa
uguucauucauccauccaccuguucauuuguucauccauguauucuaacauuucuauguagugu

SEQ ID NO: 53258 - RNA, 64 nt, hsa
uaaacuaauuauuucucuggauaucuuucuguguuccauguaaauuuauuuaccaacaucuauu

SEQ ID NO: 53259 - RNA, 64 nt, hsa
uugucuguuguauaguuuacuuuuccauauugauuccauguauuuaugagaagauauugucucc

SEQ ID NO: 53260 - RNA, 64 nt, hsa
gaaaaaagaugaaaaacuugaacuacaaauuaccuccauguauauuauuggccauaguuaacua

SEQ ID NO: 53261 - RNA, 64 nt, hsa
uccauguuuauccauguacuuucccuguguacccuccauguaccuuguguacuuucuucccuua

SEQ ID NO: 53262 - RNA, 64 nt, hsa
ucaugucuuuccuauuugcacacguccauguuuauccauguacuuucccuguguacccuccaug

SEQ ID NO: 53263 - RNA, 64 nt, hsa
uuacccuguacagcuguaucucuauaaauauaauuccauguauuaauagucacagaaagacugu

SEQ ID NO: 53264 - RNA, 64 nt, hsa
gcacguccugguacuguauccucugacuuuauuuuccauguauuacaaaaggaaaaaaaaauug

SEQ ID NO: 53265 - RNA, 64 nt, hsa
guacuaaggaauuacuagugauuguuuuauuuuauccauguacucuuuuaguauuuaauaauua

SEQ ID NO: 53266 - RNA, 64 nt, hsa
aauuuaggcacuuuaaggagaacuaauaacuuuuuccauguaucaagauuaugagguuaaaaau

SEQ ID NO: 53267 - RNA, 64 nt, hsa
auuacuuacugguaauuaccugcugguauauaauuccauguagccuuuaauaugcuggguuauc

SEQ ID NO: 53268 - RNA, 64 nt, hsa
cuuuuaaaagacuuaaggucgggaugccuuuuuuuccauguaaggaaaugaaaagaccaaaauc

SEQ ID NO: 53269 - RNA, 64 nt, hsa; identical to SEQ ID NO: 53253

SEQ ID NO: 53270 - RNA, 64 nt, hsa; identical to SEQ ID NO: 53254

SEQ ID NO: 53271 - RNA, 64 nt, hsa
acaaauggagcuuucuguauauaaauguggagauuagaguuaaucuccccaaucacauaauuug

SEQ ID NO: 53272 - RNA, 64 nt, hsa
cacuucauuaaaauucuucuaaaacuuguauguuuagaguuaagcaagacuuuuuuucuuccuc

SEQ ID NO: 53273 - RNA, 64 nt, hsa
aacacugaccgacccuccuggggucugucaggaaaaaguagaagaaaagccacccccugcaccc

SEQ ID NO: 53274 - RNA, 64 nt, hsa
cugugucaugccauccuuugggcccucugcuggaaaaguagaaucaagucucaaauaaugccuu

SEQ ID NO: 53275 - RNA, 64 nt, hsa
uuuuguuaaccuauggaaaaagccuuggaagagaaaaguagaauucaguauguauggaggcaca

SEQ ID NO: 53276 - RNA, 64 nt, hsa
ugccaaaucuuuaccacugauuuaccauugccauaaaguagacugguauaugguuaauguguaa

SEQ ID NO: 53277 - RNA, 64 nt, hsa
auuuaaagugcaggcugcaauuaaaacauggagaaaaguagaaauaaugccauaagucuagauu

SEQ ID NO: 53278 - RNA, 64 nt, hsa
auuuaucuacuuuuuaggugcucugaguugaggcaaaguagagcggcaacauuaagugcuaugc

SEQ ID NO: 53279 - RNA, 64 nt, hsa
ucaauguuaagugucugcuuuaugggcauauauaaaaguagacacauuucauuuguuaauuuag

SEQ ID NO: 53280 - RNA, 64 nt, hsa
auaguagacuguauguugaaaauuguacugaaauaaaguagaaaauuguuacguaccauauuug

SEQ ID NO: 53281 - RNA, 64 nt, hsa
uauuuauaguuaauaaucuaugaugaagguaauuaaaguagauuauggccuuuuuaaguauugc

SEQ ID NO: 53282 - RNA, 64 nt, hsa
uaaauaaggugugaaaucaucaaaaagaaaaaucaaaguagaaacuacuaauuuuuuaagagga

SEQ ID NO: 53283 - RNA, 64 nt, hsa
aaaaaauucaguuuauagcauuccugcaccucccaaaguagauaaccuggaggucauucaguua

SEQ ID NO: 53284 - RNA, 64 nt, hsa
gcuuagauccagggcccuucuacuggagauaggaaaaguagaauucaggaauuaaaagaauuac

SEQ ID NO: 53285 - RNA, 64 nt, hsa
cuucuacacuagugccaugggaaccaggucugaaaaaguagagagaagugaaaguagagucugg

SEQ ID NO: 53286 - RNA, 64 nt, hsa
augggaaccaggucugaaaaaguagagagaagugaaaguagagucugggaaguagcugccuaua

SEQ ID NO: 53287 - RNA, 64 nt, hsa
gauagugcuuuugaacaagccuauuuccauuuugaaaguagauuucaggcuaggugcgguggcu

SEQ ID NO: 53288 - RNA, 64 nt, hsa
ugugacagaaugagaccaucuccaaaaaaaaaaaaaaguagauuucagauaauuuacuguucag

SEQ ID NO: 53289 - RNA, 64 nt, hsa
gaaaaaugaauucaaaaguagaugugucagcagcaaaguagaauuuucucacugcguugggcau

SEQ ID NO: 53290 - RNA, 64 nt, hsa
cacaguccaaagcaguagaagaaaaaugaauucaaaaguagaugugucagcagcaaaguagaau

SEQ ID NO: 53291 - RNA, 64 nt, hsa
cuccuucgagcuugacucugagagggaaagugacggaaaccaagucagaugagaugacugccau

SEQ ID NO: 53292 - RNA, 64 nt, hsa
agcauacagggggaagggccugagaggaauguaaggaaaccagcccagaucagucccaaggcca

SEQ ID NO: 53293 - RNA, 64 nt, hsa
aaaaaacucacacaacauauuuguauugacugaaggaaaccaucauaaugcaugcuagaauucu

SEQ ID NO: 53294 - RNA, 64 nt, hsa
gcauuuauugaaaaccuucuaaaaaguagacuaaggaaaccauaaucagaauuacuaugucuuu

SEQ ID NO: 53295 - RNA, 64 nt, hsa
augauauagacuaacuuccccauuuuucacaagaggaaaccauccuuaugacuuaccuuaaagu

SEQ ID NO: 53296 - RNA, 64 nt, hsa
ugacuuaccuuaaaguuuuuuguucuguuuugaaggaaaccaugugcuucaugaaaccuacagu

SEQ ID NO: 53297 - RNA, 64 nt, hsa
uggaaccaacauucaaauucugccucaucuggagggaaaccaaaauugggagggggaagaggac

SEQ ID NO: 53298 - RNA, 64 nt, hsa
gggggacggggguggggggugguaguggugggagggaaaccaugucuugcuaaaccuguuucug

SEQ ID NO: 53299 - RNA, 64 nt, hsa
acuguugaaacccacagcacucguugggguaugaggaaaccagggcuuggcacaggaaguuccc

SEQ ID NO: 53300 - RNA, 64 nt, hsa
aguagggggcuagauguggcuccuagugcaaaccggaaaccauggcaccuuccagagccguggu

SEQ ID NO: 53301 - RNA, 64 nt, hsa
aggcuaggacuuacuuaauagcacugugcagggaggaaaccauguauagcuuguacauauuuua

SEQ ID NO: 53302 - RNA, 64 nt, hsa
agagagaaagucaaauaaagucaaagaccaguuuggaaaccaaaguuggaaaagaagaauugua

SEQ ID NO: 53303 - RNA, 64 nt, hsa
ucuaaacagacugacuuucuuacaaaaugcauuuggaaaccagaccuuugcuacccaccaaugu

SEQ ID NO: 53304 - RNA, 64 nt, hsa
cccuccucugcuucccccugaacccaccccccacggaaaccagcccugcgggcuaagcaggugc

SEQ ID NO: 53305 - RNA, 64 nt, hsa
aagguuaccacaugacuaggguacagccagauuuggaaaccauagcuugaaggcagugagggag

SEQ ID NO: 53306 - RNA, 64 nt, hsa
uauccugccuuugaggagcucacuguuuaguuggggaaaccauuuguaaaacagccauuaacca

SEQ ID NO: 53307 - RNA, 60 nt, hsa
ucccaauugagacagcuagaaacaguugacugacuaaauggaaacuagucuauuugacaa

SEQ ID NO: 53308 - RNA, 60 nt, hsa
agcaguuugccuuuauaaaaacuugcugccugacuaaagauuaacagguuauaguuuaaa

SEQ ID NO: 53309 - RNA, 60 nt, hsa
aauaacagucuuuauuauauuaucuaauuuugacuaaagaaauacuuuugaaguaugaca

SEQ ID NO: 53310 - RNA, 60 nt, hsa
uugcucuuccuucaacuccaauaaauuuaaugacuaaaugccaaguuaacaaaucaacuu

SEQ ID NO: 53311 - RNA, 60 nt, hsa
cugguccagacuguacugugugaaccccacugacuaaauuagugagaaccauaggcguug

SEQ ID NO: 53312 - RNA, 60 nt, hsa
ugaacuuguuaucuucauucaauuuccucuugacuaaaacaucucuggugccaacguaau

SEQ ID NO: 53313 - RNA, 60 nt, hsa
ccagguuguuucucagccaucaaaugauaaugacuaaaauuucugaggcuucaggaguaa

SEQ ID NO: 53314 - RNA, 60 nt, hsa
uaccaacuugacuauguuucacccgcuucaugacuaaaucacagguggcagaauuuuuca

SEQ ID NO: 53315 - RNA, 60 nt, hsa
caggguuuuuguguuguuuucaaauaaguuugacuaaaauaaguuuggcugacaguuuuu

SEQ ID NO: 53316 - RNA, 60 nt, hsa
auuccauauguaaugccauugggagaguauugacuaaaauaucauucgucagggaaauau

SEQ ID NO: 53317 - RNA, 64 nt, hsa
ugacauccacuacuuauugccgcuaugaguuagagucuaucaguguucuuguuauaacccccua

SEQ ID NO: 53318 - RNA, 64 nt, hsa
aaucucacuaaugauacacagauagauaaagcaagucuaucaacauuaaaaauacuaaaaaaua

SEQ ID NO: 53319 - RNA, 64 nt, hsa
agccuugcccagugccacacaguaucuccuggcguucuaggagucuagguauuauggaaaguac

SEQ ID NO: 53320 - RNA, 64 nt, hsa
aggcuaagcugggccugacccagcauccucugccuucuaggaagugcccagcaagagggaaagc

SEQ ID NO: 53321 - RNA, 64 nt, hsa
cuggcauuugccuuaaggaccuauagcaagcuguuucuaggaucagaaacucaagagaggcauu

SEQ ID NO: 53322 - RNA, 64 nt, hsa
agaagucucuacaauagaaaaaaaagugcagugcuucuaggauauaaaauucacauuacuuuug

SEQ ID NO: 53323 - RNA, 64 nt, hsa
acuuugucaagcaccucaguuacacauucgccuuuucuaggauugcauuucccaagugcuauug

SEQ ID NO: 53324 - RNA, 64 nt, hsa
uguuacccuucaguaaguucuccccauuuuaguuuucuaggacugaaaggauucuuuucuacau

SEQ ID NO: 53325 - RNA, 64 nt, hsa
ucccaggguucugugauuuccccaugcucugcauuucuaggauauuucuaggacaccuggauug

SEQ ID NO: 53326 - RNA, 64 nt, hsa
ugugauuuccccaugcucugcauuucuaggauauuucuaggacaccuggauuggcuccaucaca

SEQ ID NO: 53327 - RNA, 64 nt, hsa
gaccucgugauccacccaccuuggccucccaaaguucuaggauuacaggugugagccaccacgu

SEQ ID NO: 53328 - RNA, 64 nt, hsa
uaaccagucauggugcuagauuguuuacuugguuuucuaggacugccucaacuagaauaacacu

SEQ ID NO: 53329 - RNA, 64 nt, hsa
acugcagaugccauaggccucaaaucagcuguaauucuaggagacacguguugaucuaguuauc

SEQ ID NO: 53330 - RNA, 64 nt, hsa
acccuuuugcuagugugcuuaacuuauuuauuucuucuaggaaacaauagauaaacagcaugaa

SEQ ID NO: 53331 - RNA, 64 nt, hsa
acagugcauuuacaagguuaaagauuccucgaaguucuaggaaauucuugaaaauauaaguggu

SEQ ID NO: 53332 - RNA, 64 nt, hsa
uuuucuucucuuucauacauauaugcgugccuaguucuaggaggaaacggguuaaaaauuguuu

SEQ ID NO: 53333 - RNA, 64 nt, hsa
uuauucauguuuucauuuaaaguuuuauccaauauucuaggaauuuucagcaauacugauauuc

SEQ ID NO: 53334 - RNA, 64 nt, hsa
caguuguucauguuauuuaaaguuuuauccaguauucuaggaauuuucagcaauacuaauauuc

SEQ ID NO: 53335 - RNA, 64 nt, hsa
ggugcugacuaaacugguugcccggacacucaacagccuccaccucccuuucuacccucacagc

SEQ ID NO: 53336 - RNA, 64 nt, hsa
gcggggagggcuccuuucuaccuccagugcccugagccuccaguccgucucccccugcaugccc

SEQ ID NO: 53337 - RNA, 64 nt, hsa
uggucacaggacucugccuccucuucaacugaccagccuccaugcugccuccagaauggucuuu

SEQ ID NO: 53338 - RNA, 64 nt, hsa
uaaucuggacuccucuguccaggcacugcugcccagccuccaagcuccaucuccacuccagauu

SEQ ID NO: 53339 - RNA, 64 nt, hsa
agugcagcccccuccugaccccaccuagaauggaagccuccaccugcagccccaggccucccuc

SEQ ID NO: 53340 - RNA, 64 nt, hsa
agugagaugucagacaaauucauucccuucucucagccuccacucccugucugaaaccagaaga

SEQ ID NO: 53341 - RNA, 64 nt, hsa
aaucuuagguaggugcuuaacucuugugguggccagccuccaagaugagccccaguguucuugc

SEQ ID NO: 53342 - RNA, 64 nt, hsa
cauguaagggagccaucuuggaagcagauccuccagccuccagucaagucuucagauaauugca

SEQ ID NO: 53343 - RNA, 51 nt, hsa
accuggagcuguuugagugacagccuccaucagggucauccuacagccucc

SEQ ID NO: 53344 - RNA, 64 nt, hsa
guuugagugacagccuccaucagggucauccuacagccuccaagcgggcuuuccccuggacaaa

SEQ ID NO: 53345 - RNA, 64 nt, hsa
gcuggagggcagugguacagucuuggcuaauugcagccuccaacuccuggacucaagugauccu

SEQ ID NO: 53346 - RNA, 64 nt, hsa
uccaacuccuggacucaagugauccucccaccucagccuccagaguaaguaggaccacaggcau

SEQ ID NO: 53347 - RNA, 64 nt, hsa
ccuggagugcaauggcacaaucauggcuuacugcagccuccagcucccaggcucaagcguuucu

SEQ ID NO: 53348 - RNA, 64 nt, hsa
uccagcuugcagacagccuaugggaggacuucucagccuccauaagugugugggccaguucgcc

SEQ ID NO: 53349 - RNA, 64 nt, hsa
gggaggccucauggccaacaauggacaccuccagagccuccaggggaccacacaguagacuauc

SEQ ID NO: 53350 - RNA, 64 nt, hsa
caucuggguucaccuccccacucugaugaucuccagccuccacugcuucugccccccgcugcug

SEQ ID NO: 53351 - RNA, 64 nt, hsa
cugacugcaaggcccaccugccccucccccacagagccuccagagcuagcugaggccaacgcag

SEQ ID NO: 53352 - RNA, 64 nt, hsa
uccugguauugauacaagacccagcuggugacaaagccuccaauccuggggguccacgagccug

SEQ ID NO: 53353 - RNA, 64 nt, hsa
gcuuaauuuuucccuccacucagugcuaaggcugagccuccagaugcuguuaccucagauuuaa

SEQ ID NO: 53354 - RNA, 64 nt, hsa
uuaaucacugguugaaacuccguauaaucuguagagccuccauggcucuaaaauuuggaauuaa

SEQ ID NO: 53355 - RNA, 64 nt, hsa
gcucuagaguuacuucuuuuuaccaagcauuuucagccuccauuuugaaggcugucuacacuua

SEQ ID NO: 53356 - RNA, 64 nt, hsa
uaucccaaaaauuucagugacuccagaagaaaugagccuccaccaccaagaaaugaacuuagag

SEQ ID NO: 53357 - RNA, 64 nt, hsa
uagguggcuuuggugacacacucacuucuuucucagccuccaggacacuauggccuguuuuaag

SEQ ID NO: 53358 - RNA, 64 nt, hsa
ggccuccaacgccccuguggccaacugcaaaaaaagccuccaaggguuucgacugguccagcuc

SEQ ID NO: 53359 - RNA, 64 nt, hsa
ugguaauacgugaggaauuuaaagacucauccccagccuccaccuccugugugauacuuggggg

SEQ ID NO: 53360 - RNA, 64 nt, hsa
gcuagaaugcagcggugcaaucaugagucaaugcagccuccagccucgaccucccgaggcucag

SEQ ID NO: 53361 - RNA, 64 nt, hsa
cuccuucuuaacucugcaggaaaucagagcuggcagccuccagugggaggacagagccgguuuc

SEQ ID NO: 53362 - RNA, 64 nt, hsa
gcagcacugggguuugggggcuucccugggccucagccuccaggcacccccaggauucccagag

SEQ ID NO: 53363 - RNA, 64 nt, hsa
gugcaccugccaggccaagggucagggugcccagagccuccaaagagagcugaggggauguggg

SEQ ID NO: 53364 - RNA, 64 nt, hsa
cccgugucccuugcugaguauucugucacagacaagccuccauuaaagccacagcagugcuacc

SEQ ID NO: 53365 - RNA, 64 nt, hsa
ggugcugcacgcuccagcgcccacucuagacaucagccuccagguugacuaagggucaggucau

SEQ ID NO: 53366 - RNA, 64 nt, hsa
gucacagcucagguucccacaccucacuuuucacagccuccaagggcagcagugcacauggagg

SEQ ID NO: 53367 - RNA, 64 nt, hsa
aaggaggcagagcuggggccugaaggcucugagcagccuccagccagggggcuccuccagggcu

SEQ ID NO: 53368 - RNA, 64 nt, hsa
cugagccucagugaggcugggcagauggucucggagccuccauggggcguagcaggaaccgggc

SEQ ID NO: 53369 - RNA, 64 nt, hsa
gacuccacccucccacuccuuggauuucuccuggagccuccagggcaggaccuuggagggagga

SEQ ID NO: 53370 - RNA, 64 nt, hsa
uaaaaauagaccaacgcuaaagccugugcuccagagccuccaggcaauuggaucagaagucgca

SEQ ID NO: 53371 - RNA, 64 nt, hsa
gacauggagagagggagggauuccaaaaagucucagccuccaucaaggcguggcagcucaugcc

SEQ ID NO: 53372 - RNA, 64 nt, hsa
ggagcugggagaggcaggaaggauccuccccuagagccuccagggggaacuggaggaugcguaa

SEQ ID NO: 53373 - RNA, 64 nt, hsa
acugaugagcaaaggaggagucaacuaaugaagaaaugaauaauaaauuuugacacugaaaaac

SEQ ID NO: 53374 - RNA, 64 nt, hsa
uaacaauauaauggcaauagguagagauacaacaaaugaauauaacacuauaacacuucauauu

SEQ ID NO: 53375 - RNA, 64 nt, hsa
gauaaauugcugcgugacauauacuaaauaaaaaaaugaauauguugaucauuagggguguggg

SEQ ID NO: 53376 - RNA, 64 nt, hsa
gagagaaaauguuuugaaaagaacaaaacaucaaaaugaauagaaagaaaaauuggaaggcguc

SEQ ID NO: 53377 - RNA, 64 nt, hsa
uauugacauuaacgaguguuuuaaaaagguuuuuaaugaauagucuuaaaucuaaauuugugug

SEQ ID NO: 53378 - RNA, 64 nt, hsa
gguuuuuaaaugugcuuauggaaaggacccaauaaaugaauauuccuaacuuaguaaaguagaa

SEQ ID NO: 53379 - RNA, 64 nt, hsa
ccagaagggcacaaaaugaaugaauaaauaaauaaaugaauaaagacaaaagccaagguguaug

SEQ ID NO: 53380 - RNA, 64 nt, hsa
uaguccugguucauucccagaagggcacaaaaugaaugaauaaauaaauaaaugaauaaagaca

SEQ ID NO: 53381 - RNA, 64 nt, hsa
uuauuguucauaauuaaugaauaaaauugauaugaaugaauauaguguucuuugaauuaguaaa

SEQ ID NO: 53382 - RNA, 64 nt, hsa
aagcauggaauauuauauuuuauuguucauaauuaaugaauaaaauugauaugaaugaauauag

SEQ ID NO: 53383 - RNA, 64 nt, hsa
gauuauaccuggaugauucaggagaguguauaugaaugaauaaagcauccaaguauauaugaau

SEQ ID NO: 53384 - RNA, 64 nt, hsa
guauaugaaugaauaaagcauccaaguauauaugaaugaauaaaguauguaaguaucaccagaa

SEQ ID NO: 53385 - RNA, 64 nt, hsa
agaguaucauccaaauaauggggccuaugacuugaaugaauagaaaugaauaagcugguguuug

SEQ ID NO: 53386 - RNA, 64 nt, hsa
ccaaauaauggggccuaugacuugaaugaauagaaaugaauaagcugguguuuguuuuuucaaa

SEQ ID NO: 53387 - RNA, 64 nt, hsa
auauuucuuuuuaaagaaucuuuuuaagauuaaaaaugaauaccuuaaaucucccaaaagagau

SEQ ID NO: 53388 - RNA, 64 nt, hsa
cguuaaauuguaguuugcuguauuaaaauagaucaaugaauauaauucagucuuuuaggggcac

SEQ ID NO: 53389 - RNA, 64 nt, hsa
augaaaaaucauaaucugacuaauuuugggacugaaugaauaaguacaagagguuggauuuucu

SEQ ID NO: 53390 - RNA, 64 nt, hsa
agcauaaucauuccuuggaguuauacuaacuaauaaugaauauuaaaugauuuuucuucaguca

SEQ ID NO: 53391 - RNA, 64 nt, hsa
auuuucaccuggaacaugagaggucagaugacauaaugaauauguucuaacuucugaaacuuuu

SEQ ID NO: 53392 - RNA, 64 nt, hsa
augugggagaggagggucugaagcugagcugcuaaaugaauaucccugcucugcuggucaauaa

SEQ ID NO: 53393 - RNA, 64 nt, hsa
uggaacuuaauaaaaguuggaaauuuuuaaaaagaaugaauaagaccugguauuugauagcaca

SEQ ID NO: 53394 - RNA, 64 nt, hsa
uuggccauauguuuauaauuuuuuuagauuggguaaugaauacauggaguuucauuauacuuuu

SEQ ID NO: 53395 - RNA, 64 nt, hsa
uagugauuauagagaaugauuauaugauguuuguaaugaauaaaauaguaguuucauuauuugg

SEQ ID NO: 53396 - RNA, 64 nt, hsa
ucuauauguaaaugauggguuuguugguauuuaaaaugaauacaacuugaauguaauuaaagug

SEQ ID NO: 53397 - RNA, 64 nt, hsa
aucagugaauggaauggaccaaugaggugguaucaaugaauauaguuccauagaacauuuucca

SEQ ID NO: 53398 - RNA, 64 nt, hsa
gcuuccaaauaauaauguauguuagacagcaagaaaugaauacuuuaaaaagugauguauguug

SEQ ID NO: 53399 - RNA, 64 nt, hsa
aaaaauaaaaaaguagggcuguuauuagagugccaaugaauaaauaacuuaagcacaaaauaca

SEQ ID NO: 53400 - RNA, 64 nt, hsa
uugauuaauaaacuuaguuuaaucugaauauguaaaugaauacauuuuaaagacaaaacuugaa

SEQ ID NO: 53401 - RNA, 64 nt, hsa
uggcuggcacauuguuggcacucaacaaugguugaaugaauaaaacaauaaaugaaugaauaac

SEQ ID NO: 53402 - RNA, 64 nt, hsa
cucaacaaugguugaaugaauaaaacaauaaaugaaugaauaacuaagauauagaaacucucau

SEQ ID NO: 53403 - RNA, 64 nt, hsa
auuucuuaacccaagugacgaaaacauuguccccaaugaauauacucauuagaauuaccauuug

SEQ ID NO: 53404 - RNA, 64 nt, hsa
uggaagucuaagaacccauggaaaaaugccaucaaaugaauaaugccuuuguaaccacaacuuu

SEQ ID NO: 53405 - RNA, 64 nt, hsa
aaaaaaccguuauaaagaaaugugccuuuuggggaaugaauacuuuuguucaugucuagcccac

SEQ ID NO: 53406 - RNA, 64 nt, hsa
uccugguuuuuaauguaugcauaguuucauauuuaaugaauaugcuuucauuaaauagggaggu

SEQ ID NO: 53407 - RNA, 64 nt, hsa
auuaacugguauucaaaaaugaauaacagccaaaaaugaauaacagccauuugauuuauguuuc

SEQ ID NO: 53408 - RNA, 64 nt, hsa
acuuugaaagcaguaauauuaacugguauucaaaaaugaauaacagccaaaaaugaauaacagc

SEQ ID NO: 53409 - RNA, 64 nt, hsa
ccugaccccagcagcaaagagguggcaggucgcuaaugaauauaugcuuuauaauguccuucuu

SEQ ID NO: 53410 - RNA, 64 nt, hsa
uuuagguaccacuugauauaaaaaggauauccauaaugaauauuuuauacugcauccuuuacau

SEQ ID NO: 53411 - RNA, 64 nt, hsa
auuugaguuuaaaggaauugaaauuacuucaggaaaugaauauaaaauagguucacaguuaaau

SEQ ID NO: 53412 - RNA, 64 nt, hsa
uucaggaaaugaauauaaaauagguucacaguuaaaugaauaagcuuuuguuuauuugugggug

SEQ ID NO: 53413 - RNA, 64 nt, hsa
cuguacugagguaagauaugugugaccuucuuggaaugaauauugucuuuagaauacccuuuga

SEQ ID NO: 53414 - RNA, 64 nt, hsa
gaauugaguauguggucacaugaaaacacggaugaaugaauaaaacacucuuugguggugacug

SEQ ID NO: 53415 - RNA, 64 nt, hsa
guuacuuuuugccuugucuggcauguuuguuuuaaaugaauacauuaaugggguuuuuauccuu

SEQ ID NO: 53416 - RNA, 64 nt, hsa
uggugcaugcaaguaacuaggguuuauucuauauaaugaauauuuauagaucuguaacauuugu

SEQ ID NO: 53417 - RNA, 64 nt, hsa
uugccaguucaccggacagugauuaaaacuauguaaugaauauaaucgguuucagugcaacugg

SEQ ID NO: 53418 - RNA, 64 nt, hsa
uggccaugaggcgcugcuauuauaagcagcuggaaaugaauauuaauggcagagauuaaaagua

SEQ ID NO: 53419 - RNA, 64 nt, hsa
acagaaaaugaaaaagaaaaugaguuacacugagaaugaauaugggaacacgucauugauagca

SEQ ID NO: 53420 - RNA, 64 nt, hsa
ggauuucuucugggaaauacagauggaaauacagaaugaauauguuuuuuugaggucggaaacu

SEQ ID NO: 53421 - RNA, 64 nt, hsa
guucaaugaauauuguaaauguucaaguauuguuaaugaauagaauaaauacaauauugcauuc

SEQ ID NO: 53422 - RNA, 64 nt, hsa
aaaauguaaguugaccuucucuuagauuauguucaaugaauauuguaaauguucaaguauuguu

SEQ ID NO: 53423 - RNA, 64 nt, hsa
aaugaauacuuuuuuuuuuaagaaaaaaaagagaaaugaauaaagaaucuacucuuggcuggcu

SEQ ID NO: 53424 - RNA, 64 nt, hsa
aaugucauauuuaaaauauuuauuuuuuauaccaaaugaauacuuuuuuuuuuaagaaaaaaaa

SEQ ID NO: 53425 - RNA, 64 nt, hsa
gguaaaggaauccuuucagcugccaguuuugaauaaugaauaucauauuguaucaucaaugcug

SEQ ID NO: 53426 - RNA, 64 nt, hsa
uuaacugaguuggucuuuagguuuaagauggauaaaugaauaucacuacuuguucugaaaacau

SEQ ID NO: 53427 - RNA, 64 nt, hsa
auauaccuaauacccaguuuaagacaccaaauauaacaaguauaauuacauccuccaauguacc

SEQ ID NO: 53428 - RNA, 64 nt, hsa
ggugagguuuaaaggauaugaaacucuacauuuaaacaaguauuuuauauuuggguacagagga

SEQ ID NO: 53429 - RNA, 64 nt, hsa
uauuguuaugucauaagcucuauuauguuauucuaacaaguagcaauuucacaaaauuuguaug

SEQ ID NO: 53430 - RNA, 64 nt, hsa
ucucaacaaaaugugcuagccacuggggacgcaaaacaaguaagaucccuguugcaagaaauuc

SEQ ID NO: 53431 - RNA, 64 nt, hsa
uuccuuuaucaaucucuuuugauacaacauuuaaaacaaguagcuucaagaaaccacugguguu

SEQ ID NO: 53432 - RNA, 64 nt, hsa
uugaacauuguaaguuccuaaaaacauuuuauuaaacaaguagacauuuuguuauuaaaaaaau

SEQ ID NO: 53433 - RNA, 64 nt, hsa
uuuuauugcucaaaaguucugaauucauacagaaaacaaguacuaugugaugaaaacauuucau

SEQ ID NO: 53434 - RNA, 64 nt, hsa
auuuguccucacauuccucuucuacuuuguaugcaacaaguagaauggggcauguugugucaug

SEQ ID NO: 53435 - RNA, 62 nt, hsa
ugaggcaggcagccgaccugaggccugggggcaccguggaccccuaugcccgggucagcguc

SEQ ID NO: 53436 - RNA, 62 nt, hsa
agccccugggugagcuccgucugccacugggcaccguggaucugcagcauguucuggagcac

SEQ ID NO: 53437 - RNA, 64 nt, hsa
uuaccuauuuuagugguugaaaugagagcuagugaugacagaaggauguggaaugucuucuuga

SEQ ID NO: 53438 - RNA, 64 nt, hsa
ugcucgaaaagaguguccaagaggaguaaaggucaugacagaauuuacucccaggacaaucuaa

SEQ ID NO: 53439 - RNA, 64 nt, hsa
aaaaaaaaaaaaaaaaaaaaguuaauguccaaaaaugacagauuuacaaguguaagcuauauga

SEQ ID NO: 53440 - RNA, 64 nt, hsa
aagaaagcgaaugaauuugacaccuguugguuggaugacagaccacacagagggagagugacca

SEQ ID NO: 53441 - RNA, 64 nt, hsa
cagugagcagagcgugccgcuacacuccagccugaugacagaccgagacacugucucaaaaaaa

SEQ ID NO: 53442 - RNA, 64 nt, hsa
ugagcugagauugcaccacugcauuccagccuggaugacagagcaaaacccugucucaaaaaaa

SEQ ID NO: 53443 - RNA, 64 nt, hsa
uaaucaucuggaaaccgauuucaguggcgauggcaugacagagcuagagcucgggcccagcccc

SEQ ID NO: 53444 - RNA, 64 nt, hsa
uagcugcuugccugauguguguaucaucggugggaugacagaacaaacauauuuaugaucauga

SEQ ID NO: 53445 - RNA, 64 nt, hsa
gcaguuucuuguacacauuuggauacuuugaaagaugacagauuguuaaauccauucaauggua

SEQ ID NO: 53446 - RNA, 64 nt, hsa
gaguuguguagacacagucuuaauguuucugguuaugacagauaaguuugcucaaaaaaugugg

SEQ ID NO: 53447 - RNA, 64 nt, hsa
ucgcaucgucaaaagauuuuugcuuggaauaagcaugacagaaagauuuaaccuaaguguuaga

SEQ ID NO: 53448 - RNA, 64 nt, hsa
uucuuuuuucucaaaaagaaacuguaggaaauacaugacagagaaaguuacacucagggagcag

SEQ ID NO: 53449 - RNA, 64 nt, hsa
auuucacccucauuaccuucugcuuccaaggaauaugacagaucaccaggaugcugcucgucgu

SEQ ID NO: 53450 - RNA, 64 nt, hsa
agccuuugaccuucccgcuauggaagugcacuggaugacagaaacugaauacauugcucccuuu

SEQ ID NO: 53451 - RNA, 64 nt, hsa
acuguuugaaaucuggucuguuugcauuucuguuaugacagagagaugauguuugcauuucugu

SEQ ID NO: 53452 - RNA, 64 nt, hsa
guuaugacagagagaugauguuugcauuucuguuaugacagagagaugaugaaaguaggcaggg

SEQ ID NO: 53453 - RNA, 64 nt, hsa
cgggacuuuuuuucuuuuuucuuuuuuuuuugcuaugacagaguaaugcuaacguaaggacaac

SEQ ID NO: 53454 - RNA, 64 nt, hsa
uucuggucuccaaguaucguuaagcacaggugcuaugacagaaaaaguucugggguggaaguuu

SEQ ID NO: 53455 - RNA, 64 nt, hsa
uaugauauacauguuaaauuucccuuuuauuuuggucaugcaucaaaauaaauuuacuaaguac

SEQ ID NO: 53456 - RNA, 64 nt, hsa
gaguacauaugcaaucacucguuuaugcugucuagucaugcacuuaaagcaauuuucaaaugua

SEQ ID NO: 53457 - RNA, 64 nt, hsa
aauaaggcucuucuguuuucaacaucugugcugggucaugcauuagcauuaauuacuacaauga

SEQ ID NO: 53458 - RNA, 64 nt, hsa
ugacccugaaaugaaccuuaagccuuagaacaaagucaugcagaugccccauuugauaauaauc

SEQ ID NO: 53459 - RNA, 64 nt, hsa
gauguuauauugguggcaucagucaacaguguaugucaugcaguacagacauagcaagccuugu

SEQ ID NO: 53460 - RNA, 64 nt, hsa
accgauauuuuuuuaucauggaaccagaacaucugucaugcaguguugucccuuccuaccuucu

SEQ ID NO: 53461 - RNA, 64 nt, hsa
uauggaauggaacugcagcaaaugcaaacuugaagucaugcaaaaguaugaaauggauuucuuc

SEQ ID NO: 53462 - RNA, 64 nt, hsa
acagaaagauccauaaagaugcagaguccgcccagucaugcacagacuccaguggaaguuuugc

SEQ ID NO: 53463 - RNA, 64 nt, hsa
gucuguguuguguuaugugagaauuuucuccuaagucaugcagguaaugacaauauacuguaaa

SEQ ID NO: 53464 - RNA, 64 nt, hsa
cagcucaucucugucccacuuggcaucagcuggcgucaugcaaagucaugcaaaggcugggacc

SEQ ID NO: 53465 - RNA, 64 nt, hsa
cugucccacuuggcaucagcuggcgucaugcaaagucaugcaaaggcugggaccacgugagauc

SEQ ID NO: 53466 - RNA, 64 nt, hsa
aaaggagugguuucuggcugaauacuaucuuaggcucaaggagaaacaaaauaaaaauuagcuu

SEQ ID NO: 53467 - RNA, 64 nt, hsa
augggaagggggcaggggugaggagcugagccugcucaaggagugggaaguggggcuauaggca

SEQ ID NO: 53468 - RNA, 64 nt, hsa
caaaccaccccauugaacagaugaggaacugaggcucaaggagguuaaguaacauuuccagggu

SEQ ID NO: 53469 - RNA, 64 nt, hsa
cccaacuuaccugcagacacuccuuuugcuaccacucaaggaaggaagucaccaguggccuuag

SEQ ID NO: 53470 - RNA, 64 nt, hsa
cgagguagguagcuaugauaggcaccuaaugcuucucaaggacuuauuuuuuccuucuugaaga

SEQ ID NO: 53471 - RNA, 64 nt, hsa
gaagggcugauuucaaaaucugggggcgagcaaccucaaggaacacaauuucccucccuaucaa

SEQ ID NO: 53472 - RNA, 64 nt, hsa
cgcggguuuccggcugccuguacugggcgugcaccucaaggaccuggugucccugcaugaggca

SEQ ID NO: 53473 - RNA, 64 nt, hsa
cacagggggccugugucacagugccaucuccagacucaaggacucccaugcccaccugagcccu

SEQ ID NO: 53474 - RNA, 64 nt, hsa
accugccaaagauggagaagagugccagggaccccucaaggagggagacgcuccauaucccagg

SEQ ID NO: 53475 - RNA, 64 nt, hsa
gauacaggagagaaucaagcguaaagucuuuguucucaaggaauuugcauucuagaaaguagaa

SEQ ID NO: 53476 - RNA, 64 nt, hsa
agguagguaguucaaucuaguuguuagccaaggacucaaggacugaauuguuuuaacauaaggc

SEQ ID NO: 53477 - RNA, 64 nt, hsa
ggaaaauaauacuuaucuuacaagguugcaagagcucaaggagaccauguauguaaaguuccug

SEQ ID NO: 53478 - RNA, 64 nt, hsa
aacaacucugagcacaugcugggugaagucacagcucaaggaaagauaaagcugggcggaagga

SEQ ID NO: 53479 - RNA, 64 nt, hsa
agguuucugccaauagacagccccugacaguggccucaaggagcugcagguggggggcucagcc

SEQ ID NO: 53480 - RNA, 64 nt, hsa
uuucauaagacuauuuuaaauagaaauuauuucaacaauuaaaguaauguugaccaucccccuc

SEQ ID NO: 53481 - RNA, 64 nt, hsa
agaucaguauuguaacguaugugaauagaugauaacaauuaauauuacuaaaagucccacauga

SEQ ID NO: 53482 - RNA, 64 nt, hsa
aaccagcaaguuguucauuuaaaacugaccaaagacaauuaauuccuggucuaguuuccugggc

SEQ ID NO: 53483 - RNA, 64 nt, hsa
guuaaaaugugaaauuguaauuuuuaaaaaggcuacaauuaaauuuuagccaaugccacucacc

SEQ ID NO: 53484 - RNA, 64 nt, hsa
gucgucacuacccuuuuuggauucagggcuccucacaauuaaaaugaguguaaugaaacaaggu

SEQ ID NO: 53485 - RNA, 64 nt, hsa
uaauuugccuuuugauuccuucccauuguugucaacaauuaagucuauucuucuuuuagaaauu

SEQ ID NO: 53486 - RNA, 64 nt, hsa
gcaucucaaaauguauagccagacuugagaggugacaauuaaagaucuaaaaaagagaggagau

SEQ ID NO: 53487 - RNA, 64 nt, hsa
ggaaaaccuaaagaguaaaaccuuagcacuuagcacaauuaaauagaaauagguuuucuugaug

SEQ ID NO: 53488 - RNA, 64 nt, hsa
aaucucugcauuguuucaugcagaaaauaaagauacaauuaaggcugacauuaguaucugauau

SEQ ID NO: 53489 - RNA, 64 nt, hsa
acagccauuuaguccuaauauacauaccaaugagacaauuaaaaauugguuggaagauggagcu

SEQ ID NO: 53490 - RNA, 64 nt, hsa
cacagauuagcuguguaauuuuugugugucaauuacaauuaaaagcacauuguuggaccaugac

SEQ ID NO: 53491 - RNA, 64 nt, hsa
uuaugcagugaaucucaguuugaacaaacuagcaacaauuaagugacccccgucaacccacugc

SEQ ID NO: 53492 - RNA, 64 nt, hsa
ggguacaggggaauuaugugugugaaugucaucuacaauuaaaaaaaauuagcacaucccuuua

SEQ ID NO: 53493 - RNA, 64 nt, hsa
gggaucccaaauucaugggacuuauauaagaaggacaauuaaugcugauuuggguacaggggaa

SEQ ID NO: 53494 - RNA, 64 nt, hsa
guauuagaaaagguuuuagcugaaaugaggagucacaauuaaggauggaggugauauuuuccuc

SEQ ID NO: 53495 - RNA, 64 nt, hsa
uauuugauauuaaaguaugagauagaguugagagacaauuaauuauccccucuuacacacaaac

SEQ ID NO: 53496 - RNA, 64 nt, hsa
ugacguaucaguacuucuaagaagggaucuaagcacaauuaagugaauugagucccuggucuag

SEQ ID NO: 53497 - RNA, 64 nt, hsa
uucugcuguuuguuguccugcuugguugaguaccacaauuaaagauuaugcuccccuuuucuug

SEQ ID NO: 53498 - RNA, 64 nt, hsa
uuggaaauagaugauuagauuuuugugucauuuuacaauuaaaucuaaaaugcuuaauccaaua

SEQ ID NO: 53499 - RNA, 64 nt, hsa
uuugauaaucuguucucuuaaaaaaguuaaugacacaauuaagauacugacaucaaauuguugc

SEQ ID NO: 53500 - RNA, 64 nt, hsa
cagcccagccccuugugaguccuggccucugcugggcccugaaggagcugagagggagcucaac

SEQ ID NO: 53501 - RNA, 64 nt, hsa
aaaugucugugcagugucagggcugcaccccauaggcccugaggcacacagcccagccccuugu

SEQ ID NO: 53502 - RNA, 64 nt, hsa
cuaaagcaaacaguccuccugaggcccugaggguggcccugacccccucagggcucauuccugg

SEQ ID NO: 53503 - RNA, 64 nt, hsa
gcauguuaucugcuaaagcaaacaguccuccugaggcccugaggguggcccugacccccucagg

SEQ ID NO: 53504 - RNA, 64 nt, hsa
ugugcagccuguccugggcugguggcucccggagggcccugagcugagggcauugcuuacacgg

SEQ ID NO: 53505 - RNA, 64 nt, hsa
cugagggcauugcuuacacggaugccuuccccugggcccugacauuggagccugggcauccuca

SEQ ID NO: 53506 - RNA, 64 nt, hsa
ugggagguucauuuuccuuuaaacugauccagcuggcccugaaccaauuguuuuugacugagua

SEQ ID NO: 53507 - RNA, 64 nt, hsa
uuuccuguuuggccccuguucaccccagugcacuggcccugacuccaggcgugaguauggggaa

SEQ ID NO: 53508 - RNA, 64 nt, hsa
gaagaagcuggaucacucuuggucccauucccuaggcccugagcaagucaggcuccuggcucug

SEQ ID NO: 53509 - RNA, 64 nt, hsa
cguggggacaacaggggcacaugacaucugccugggcccugaccaauaaacccucagacccagg

SEQ ID NO: 53510 - RNA, 64 nt, hsa
aagagccaagcgcaucgggagcacaccagaaaccggcccugagcacgagaagagccuccgcccg

SEQ ID NO: 53511 - RNA, 64 nt, hsa
ccucacaccgcacggcaggcacagaggcucgccaggcccugauccggucuguggggacgaggga

SEQ ID NO: 53512 - RNA, 64 nt, hsa
gccagugguggagguggguguuugggaaaggcagggcccugaaauggccugucccuagggcucu

SEQ ID NO: 53513 - RNA, 64 nt, hsa
ggcaggccucccaagcugauggacaugagaguagggcccugacaggccuuccuccucucaaacc

SEQ ID NO: 53514 - RNA, 64 nt, hsa
gccgggcucggggccccaccgggguggagauggaggcccugaccucugcugcaguggccgcccu

SEQ ID NO: 53515 - RNA, 64 nt, hsa
ugaccagccagcugaucccucugugccaccacguggcccugagccacauccaggugcagcugga

SEQ ID NO: 53516 - RNA, 64 nt, hsa
guggccucugcagaggggaccucagccugucacuggcccugaagacuggccccacuucuggucu

SEQ ID NO: 53517 - RNA, 64 nt, hsa
gugaccagaacagggcagaguagguccccuccauggcccugaauccuccucugcuccagggcug

SEQ ID NO: 53518 - RNA, 64 nt, hsa
gccugagaagaaguggcugccacacccaggggaaggcccugaggcggaggcugugcuccgccau

SEQ ID NO: 53519 - RNA, 64 nt, hsa
agugcucaccagcccugcagcccaccagacgucaggcccugacuccucuggcuuucccaggaga

SEQ ID NO: 53520 - RNA, 64 nt, hsa
ggcagcuggccuuccuggguuggaacgaggcaguggcccugagccccuucuccagggccaggua

SEQ ID NO: 53521 - RNA, 54 nt, hsa
agugggagaccuucgagugagccgggcccugagggugggggaugcaccgaggcc

SEQ ID NO: 53522 - RNA, 64 nt, hsa
ccccuccaccugccccagugcccagaccaaccaaggcccugacagcccugccuucugcccucug

SEQ ID NO: 53523 - RNA, 64 nt, hsa
uguucccuaccuggguggccugcuccccugccugggcccugacuucagcucccuguagugaagu

SEQ ID NO: 53524 - RNA, 64 nt, hsa
aagaggagaaccggcagcugcuggcugaaguucaggcccugagccgggagaacagggagcuccu

SEQ ID NO: 53525 - RNA, 64 nt, hsa
ccugcaggaacacgaaacagaugccaaccgagagggcccugagguacaggaaccggagaaacgu

SEQ ID NO: 53526 - RNA, 64 nt, hsa
gaccccaaggggaguccuuggacaaggaggccugggcccugagauccuccacggucagcgccgg

SEQ ID NO: 53527 - RNA, 64 nt, hsa
ggcagcgggcuucuccaccuaccccagccaccaaggcccugacgcacugccuccugcaccuuca

SEQ ID NO: 53528 - RNA, 64 nt, hsa
cuggggucaggacaugucggggucaugcguuucuggcccugacauaagcugucuggccucucug

SEQ ID NO: 53529 - RNA, 64 nt, hsa
aggcauuguuccagcacggaggugaugugucacgggcccugacugagcuacagcgccaacgccu

SEQ ID NO: 53530 - RNA, 64 nt, hsa
ccuagagcccuuccgccagcgccucugggacaguggcccugagcccaccccuuccugggauggg

SEQ ID NO: 53531 - RNA, 64 nt, hsa
uguguggcugggcccugccccacaaccggaugcaggcccugacuuccugugagugcaccaucug

SEQ ID NO: 53532 - RNA, 64 nt, hsa
ccugcaacccagggcagggggcugagaccuuccaggcccugaggaaucccgggcgccggcaagg

SEQ ID NO: 53533 - RNA, 64 nt, hsa
cccgcccgcgccccuccccaccggcgggcgccccggcccugaacccgcgccccacauuucuguc

SEQ ID NO: 53534 - RNA, 64 nt, hsa
uacacuucugacuggugaucagggcccggcccacggcccugagcggcugcagccugcuuuggga

SEQ ID NO: 53535 - RNA, 64 nt, hsa
augggcucugcucugagaguagggcgggcuugaaggcccugauggguggaccaccagccugggc

SEQ ID NO: 53536 - RNA, 64 nt, hsa
ggacccaaagccucuuuuugccucccggaaucaaggcccugagggcagcaggaugguggccugg

SEQ ID NO: 53537 - RNA, 64 nt, hsa
cuggcgcucuugaccccugauuccagugaggacuggcccugaggaguccuugcagaccugcugc

SEQ ID NO: 53538 - RNA, 64 nt, hsa
agccgcuaaaaugggcaagggagagcggguggagggcccugagguggcagcaggggucagggaa

SEQ ID NO: 53539 - RNA, 64 nt, hsa
cagagguggaggcccggggagaggcaccugagguggcccugaagaugccccgccuuaguuuucc

SEQ ID NO: 53540 - RNA, 64 nt, hsa
ucucaccugacuugaggugaauuuuggagugaagggcccugaggucagcucccaggucggucgu

SEQ ID NO: 53541 - RNA, 64 nt, hsa
cugcucuccuuuggguguaugcagguguguggggggcccugaguggcaaguugcuuagcuaaca

SEQ ID NO: 53542 - RNA, 64 nt, hsa
cuggcuuuauuuaccguggugguucagagucccaggcccugaccucuaaagacuuuucauaaca

SEQ ID NO: 53543 - RNA, 64 nt, hsa
cugcacacccaccucuccgggggacuugacaaggggcccugaggccaagggaggucacuccucc

SEQ ID NO: 53544 - RNA, 64 nt, hsa
gcccuuccuccugaagccucugcccugccucccuuucugggagggcggggugggggugacugaa

SEQ ID NO: 53545 - RNA, 64 nt, hsa
aauucaaugacagggaugccaacaccuucuuggcuucugggaccuguguucuugcugagcaccc

SEQ ID NO: 53546 - RNA, 64 nt, hsa
caaguacucuauucucugcacuaacuuacuguccuucugggaacuaugauggggcuucaaggga

SEQ ID NO: 53547 - RNA, 64 nt, hsa
uaguuuagucaggacucagaaaauuugagcuuaguucugggauuaugaaaacauggggacaaaa

SEQ ID NO: 53548 - RNA, 64 nt, hsa
ugaccaggcauccuccacaauagcagacaguguuuucugggauaaguaaguuugauuucauuaa

SEQ ID NO: 53549 - RNA, 64 nt, hsa
guugcugaugaacucuuaaucaaauagcauaaguuucugggaccucaguuuuaucauuuucaaa

SEQ ID NO: 53550 - RNA, 64 nt, hsa
gcuguacauccaauucaaguuuuauuugcugcuauucugggagaauaaacuuguauauggagaa

SEQ ID NO: 53551 - RNA, 64 nt, hsa
uacccaccuuaguuguaaauuggauaguuuauauuucugggacuuuuuaaaugaaaauguggaa

SEQ ID NO: 53552 - RNA, 64 nt, hsa
ucuuuugcuucucggggaacuguaagcccucgcguucugggaaucgcucucugcugcucuuucc

SEQ ID NO: 53553 - RNA, 64 nt, hsa
uuuggggauguccugugccucccagauuccucgauucugggaggagaggcugccgcauucugcu

SEQ ID NO: 53554 - RNA, 64 nt, hsa
acuuuucucuccacuuuugucuauguugaaaauuuucugggagcuaaaugaugagaacacaugg

SEQ ID NO: 53555 - RNA, 64 nt, hsa
aaucauaucaucuuuagaaauuguuuaaaauuaguucugggaaguugaaaguggggaaugaaga

SEQ ID NO: 53556 - RNA, 64 nt, hsa
caaaaugcaaaccuauuucccuugccucauaggcuucugggaugucaucaccuccaguuuguug

SEQ ID NO: 53557 - RNA, 64 nt, hsa
auaauguaagaagcuuugguggcagguuacagaguucugggauuucuucucacaggcccaaucc

SEQ ID NO: 53558 - RNA, 64 nt, hsa
cacauauuugaacagugaugaguuuggggcugguuucugggaagggaacguuuauuuaguaaag

SEQ ID NO: 53559 - RNA, 64 nt, hsa
gucugcucccacugcagcucccggugcucucguguucugggaaggccugggugugugcacaagg

SEQ ID NO: 53560 - RNA, 64 nt, hsa
ucgggccauaggggugagcagcugccuggaagaguucugggaaguauaacccuccauuuuuucu

SEQ ID NO: 53561 - RNA, 64 nt, hsa
cuugaggugguucggauuacaguuuccaaaugcauucugggauugccuauuccagagaggguac

SEQ ID NO: 53562 - RNA, 64 nt, hsa
gggcuccggggcggcagcagagcuggcacaccgauucugggaagccccgcgaaugauggcuuuu

SEQ ID NO: 53563 - RNA, 64 nt, hsa
cuaaaagugaucugcccaccucggccucccaaaguucugggauuacgggcgugagccacuucac

SEQ ID NO: 53564 - RNA, 64 nt, hsa
acuauugcuaaguuuucuuuucuggcuuguguuuuucugggacaguuuagaauugggaggccua

SEQ ID NO: 53565 - RNA, 64 nt, hsa
aaagaauugaagcaaauuguauuuacuuagccgcuucugggagccacuucagccuuuccccucc

SEQ ID NO: 53566 - RNA, 64 nt, hsa
aacuaaagcuuccuguuuauacacacuccuguuauucugggauaagauaaaugaccacaguacc

SEQ ID NO: 53567 - RNA, 64 nt, hsa
aaacaauuuugaugaauuuaagcagaaaaugaauuucugggaacuuuuuugggggcgggggggu

SEQ ID NO: 53568 - RNA, 64 nt, hsa
uguagaagucauggacuuuucugggaaaugacuuuucugggaaaugacaguuucuuugacauau

SEQ ID NO: 53569 - RNA, 64 nt, hsa
caguugguagaauccauguagaagucauggacuuuucugggaaaugacuuuucugggaaaugac

SEQ ID NO: 53570 - RNA, 64 nt, hsa
cucuccacuugcccaaacugccaaaagcuggugauucugggacaggccuucacuuuggagccac

SEQ ID NO: 53571 - RNA, 64 nt, hsa
cccuucccuccccguuguccuguccccacagccauucugggagcuggggaaccuggucucaagg

SEQ ID NO: 53572 - RNA, 64 nt, hsa
cucccuccuccuguccucccccgcacccccucccuucugggaaacaagaagaguaaacaggaaa

SEQ ID NO: 53573 - RNA, 64 nt, hsa
gcucagcgcuuaaaaaaacaaauuggacagcuacuucugggaaaaacaacaucauuccaaaaag

SEQ ID NO: 53574 - RNA, 64 nt, hsa
acugccccagggcuuugggggcggcacuugggguuucugggaaugacaucaucucuguucccca

SEQ ID NO: 53575 - RNA, 64 nt, hsa
cuuuagcaggcugggcccuaggcaggaagcuggcuucugggagaggagugagaacgugcagggc

SEQ ID NO: 53576 - RNA, 64 nt, hsa
uucugggaauccacagcucuggcuuuggagcagcuucugggaccauaaguuuacugaaucuuca

SEQ ID NO: 53577 - RNA, 64 nt, hsa
cagucuuccgacaaacuaacaggaacaaaaugaauucugggaauccacagcucuggcuuuggag

SEQ ID NO: 53578 - RNA, 64 nt, hsa
gaugcagaucugcguggcuggugcgugcgcgcgcuucugggaaacagucccgcgugcaaaggaa

SEQ ID NO: 53579 - RNA, 64 nt, hsa
accccagucaagcuccuaguaugcccuguaauuuuucugggaaguccuagccccucacuuccag

SEQ ID NO: 53580 - RNA, 64 nt, hsa
aaguuuaauacauccaauaugucaaguuaaaccauucugggauuugcaaaguuuaauacaucca

SEQ ID NO: 53581 - RNA, 64 nt, hsa; identical to SEQ ID NO: 53580

SEQ ID NO: 53582 - RNA, 64 nt, hsa
aaguuuaauacauccaauaugucaaguuaaaccauucugggauuugggaacuucuuuaaaggaa

SEQ ID NO: 53583 - RNA, 64 nt, hsa
gccaaggaggccuuggaaacgauucccccagucauucugggaacauguuguaagcacugacugg

SEQ ID NO: 53584 - RNA, 64 nt, hsa
cucccuucuacagccucagaaaccagacucguucuucugggaacccugcccacucccaggacca

SEQ ID NO: 53585 - RNA, 64 nt, hsa
aggacaguugaacucagaugggguucaugugggauucugggagcuuucugggaauucaguugga

SEQ ID NO: 53586 - RNA, 64 nt, hsa
acucagaugggguucaugugggauucugggagcuuucugggaauucaguuggagucaagucagg

SEQ ID NO: 53587 - RNA, 64 nt, hsa; identical to SEQ ID NO: 23154

SEQ ID NO: 53588 - RNA, 64 nt, hsa; identical to SEQ ID NO: 23155

SEQ ID NO: 53589 - RNA, 64 nt, hsa; identical to SEQ ID NO: 23156

SEQ ID NO: 53590 - RNA, 64 nt, hsa; identical to SEQ ID NO: 23157

SEQ ID NO: 53591 - RNA, 64 nt, hsa
agagagcuguugauuuguuucuguuuuuuuaaaggaaaacuauuuguaagauguugcacuaaaa

SEQ ID NO: 53592 - RNA, 64 nt, hsa
cguuaauuauugaggaaaaaaaaagaugggguaagaaaacuacccaugcaugauguagagagcu

SEQ ID NO: 53593 - RNA, 64 nt, hsa
ccugccuuucaaauuuguuucauaauuguuagaugaaaacuauuuuuuuggagauguuacugaa

SEQ ID NO: 53594 - RNA, 64 nt, hsa
cuguacuuacuuuacaggaagaaauuuuaaaacugaaaacuaccugggaucauaguguuucugu

SEQ ID NO: 53595 - RNA, 64 nt, hsa
cuuuuaacugagcugcugccuauagugucuuuuggaaaacuacuuaaagggugauuuucuguua

SEQ ID NO: 53596 - RNA, 64 nt, hsa
uuaguugcaacuucuuuggggugaucuauaguuugaaaacuaaaaccucaaagacagauguuac

SEQ ID NO: 53597 - RNA, 64 nt, hsa
gauugcaggcaugagccacugcacccaaccccuggaaaacuaaauuuuuaagugcuuauuuuua

SEQ ID NO: 53598 - RNA, 64 nt, hsa
aaauauaauugcgaauaucagaaaacucauacuggaaaacuaaauuuuuuuuuucucuugagac

SEQ ID NO: 53599 - RNA, 64 nt, hsa
cagaacuuauuagaaacgauuccggauggcauuggaaaacuaaagaaacugucaaucuugaagg

SEQ ID NO: 53600 - RNA, 64 nt, hsa
uuguuauuuuaacagacccugccuaaaagcauuggaaaacuaaagaaguugagcaacuugaaug

SEQ ID NO: 53601 - RNA, 64 nt, hsa
agcaacacaguaaacagacagccuguagaauggggaaaacuauuugcaaacucugcaucugaug

SEQ ID NO: 53602 - RNA, 64 nt, hsa
ucaaugaaaaaaaaugugguacauagauacgauggaaaacuaugcagccaugaaacacaagaaa

SEQ ID NO: 53603 - RNA, 64 nt, hsa
ggucugcugauaaaauauuuaaccccaagaaagugaaaacuaauauaaaauuagaaagaccuau

SEQ ID NO: 53604 - RNA, 64 nt, hsa
uaguaauugcaucauaauuacauuaccaguguuggaaaacuaaugaagaaaacacuguaauugc

SEQ ID NO: 53605 - RNA, 64 nt, hsa
aauaccaaagccaggcaaaaacauuacaagaaaggaaaacuacagaucaauauuuccagugaac

SEQ ID NO: 53606 - RNA, 64 nt, hsa
cuagauuacacaaguaaucuaagcuuccacuuuggaaaacuagaaaaagaagagcaaauuaaau

SEQ ID NO: 53607 - RNA, 64 nt, hsa
aucuuacucaggaaaacuaacuauuuguucauuagaaaacuaugaagaauaaagaaacuuagga

SEQ ID NO: 53608 - RNA, 64 nt, hsa
gaagaaugguuaacuuuuuuauaaucuuacucaggaaaacuaacuauuuguucauuagaaaacu

SEQ ID NO: 53609 - RNA, 64 nt, hsa
cuuaaaagguuuguggaaauacauuaggauaucagaaaacuaaauauauggaguugcuuuauga

SEQ ID NO: 53610 - RNA, 64 nt, hsa
aaaaagaaauuauauauaucuugccucccugauggaaaacuauauaaaauuguagacuuaaaag

SEQ ID NO: 53611 - RNA, 64 nt, hsa
accaaagugagcguuuaaaucuucucauuuuauugaaaacuaagagcagaaaauguaaaaugcu

SEQ ID NO: 53612 - RNA, 64 nt, hsa
uagaaaaccacgcccacaugcuaauauggguguugaaaacuagguuacuuauaaugcaaggaau

SEQ ID NO: 53613 - RNA, 64 nt, hsa
uuuccuuuuauuuuuuaguaaucaagaaaggcuggaaaacuacugaaaaacugaucaagcugga

SEQ ID NO: 53614 - RNA, 64 nt, hsa
uuuuccugugguugaccuauacgaccaggauguagaaaacuagaaagaacugcccuuccucaga

SEQ ID NO: 53615 - RNA, 64 nt, hsa
cuuacuuuguuccagccaaagcuugcuaauaauagaaaacuacccauauuccaaaaguagauuu

SEQ ID NO: 53616 - RNA, 64 nt, hsa
cuguuuucucuuucaguuaguugacucaaagggggaaaacuaaagaaugcaaaacuuuugcuau

SEQ ID NO: 53617 - RNA, 64 nt, hsa
caacagacuucucaauaaucaaugaaguagcugagaaaacuaagucagaaagugcauuaaacug

SEQ ID NO: 53618 - RNA, 64 nt, hsa
caauguaaauauuacacaucaagcgaugaaacuggaaaacuacaagccacgaaugaaugaauua

SEQ ID NO: 53619 - RNA, 64 nt, hsa
uuguuucaaccuuuauuccuguaaauauuucugugaaaacuaggagaacagagaugagauuuga

SEQ ID NO: 53620 - RNA, 64 nt, hsa
aauauagaugcuaugguucagauuguuuuuaauagaaaacuaaaggggcaggggaagugaaagg

SEQ ID NO: 53621 - RNA, 64 nt, hsa
uaggauugaaaugauuuguuucucuuccuaggaugaaaacuaaaucaauuaauuauucaauuag

SEQ ID NO: 53622 - RNA, 64 nt, hsa
gcuuuuuuuuuucuuuuguuuugguuugguuuuggaaaacuaauuaauuagacuuguguggggg

SEQ ID NO: 53623 - RNA, 64 nt, hsa
gaguguuccugagacagaauuaauggucauuugggaaaacuaucgccauggcuucccaucugug

SEQ ID NO: 53624 - RNA, 64 nt, hsa
cccagacuaagguugaacaaccugcaugcccagagaaaacuauggcgacaaaggggaaaaggcc

SEQ ID NO: 53625 - RNA, 64 nt, hsa
uugucuaaaauaaaaggcauuauuggaaauauuugaaaacuagaaaaugauggauaaaagggcu

SEQ ID NO: 53626 - RNA, 64 nt, hsa
augcaggacuacccccuuaccauuuuaagaagguacuuuauacauuuauuuaauccuacuaaug

SEQ ID NO: 53627 - RNA, 64 nt, hsa
aguaugaaugauuagagaaaauuugagucaguguacuuuauagugugaauccugugagcuaaua

SEQ ID NO: 53628 - RNA, 64 nt, hsa
agcuggcugggcaguggaauuuugagcgaccuuuacuuuauacuuuucugugcuugacagauuu

SEQ ID NO: 53629 - RNA, 64 nt, hsa
ugugcuugacagauuuucagccaugaccauguucacuuuauaaucaaaacaaaaauaaaggucc

SEQ ID NO: 53630 - RNA, 64 nt, hsa
caauguauauaagacagguagugccugauuuacuacuuuauauaaaauaguaccuccuucaguu

SEQ ID NO: 53631 - RNA, 64 nt, hsa
auuacacuacaguuuacuuuucagaauacuaaagacuuuauaacugcaugaacuuggauuuuuu

SEQ ID NO: 53632 - RNA, 64 nt, hsa
accuggagguugcauggacuguacgaccggcaugacuuuauauuguauacagauuuugcacgcc

SEQ ID NO: 53633 - RNA, 64 nt, hsa
cuugggggcacuggcugggagucagcaagcgagcacuuuauaucccuuugagggaaacccugau

SEQ ID NO: 53634 - RNA, 64 nt, hsa
ucacuuuauauaaaugucuugauuacaguauagaacuuuauagaguccauaauacaaaguauca

SEQ ID NO: 53635 - RNA, 64 nt, hsa
ucuagcuuaugaggccaaauaaucccaaagugucacuuuauauaaaugucuugauuacaguaua

SEQ ID NO: 53636 - RNA, 64 nt, hsa
caaugcaauuugcaugugcacaugugcgcacauaacuuuauauguuaguucuuuuuuccaaacu

SEQ ID NO: 53637 - RNA, 64 nt, hsa
aaagugaauuaaagugaaucauggaagcagcauuacuuuauaugaauauuauuauuuaaguuaa

SEQ ID NO: 53638 - RNA, 64 nt, hsa
aagcaaaggggcugaaaaacugaauaaggaaacaacuuuauaagagaaacaguggucuucaauc

SEQ ID NO: 53639 - RNA, 64 nt, hsa
uauauucaccaauuucaggaaaaccaaccauagaacuuuauaauaggacaguuauaaccugacu

SEQ ID NO: 53640 - RNA, 64 nt, hsa
gaaauggugagauguauguuuggcucugcuuuuaacuuuauaaauccagugaccucucucucug

SEQ ID NO: 53641 - RNA, 64 nt, hsa
agacagguccugauuucuagaacccgugacuguuacuuuauacagcaaaggaaacuuugcagau

SEQ ID NO: 53642 - RNA, 64 nt, hsa
ugauuauugcacauuauaaaauuguuuuucuaauacuuuauagggcccaacuucagaaaauacu

SEQ ID NO: 53643 - RNA, 64 nt, hsa
gcaagaugugcagagggcauaaaagcaaaucaacacuuuauaguuauucuucugaacuaagaca

SEQ ID NO: 53644 - RNA, 64 nt, hsa
agauuacaguugcgagccacugugcguggccagaacuuuauaauaagagacuugaagcugggug

SEQ ID NO: 53645 - RNA, 64 nt, hsa
uuuaaaaucacauucaauuuucagaugaaggggaacuuuauaguuuuuuuuuuuuuuuuuuuuu

SEQ ID NO: 53646 - RNA, 64 nt, hsa
ucauagcugugguuauguuauuuuuuauuuaaaaacuuuauauuaaagucauuuguaauguuau

SEQ ID NO: 53647 - RNA, 64 nt, hsa
gauuucaauucuuggauaaucaggcucuguuugcacuuuauauuuuagcagauacagucucuua

SEQ ID NO: 53648 - RNA, 64 nt, hsa
ucucaauuuuuaaaccuuugcuguuaaaugcaauacuuuauaaagaaugaacaaaauuacugga

SEQ ID NO: 53649 - RNA, 64 nt, hsa
gaaacuggcagucguauguuaguuucacuugucuacuuuauaugucugaucaauuuggauacca

SEQ ID NO: 53650 - RNA, 64 nt, hsa
gaaaaacaaaagguuugaggaaaucaggcauaugacuuuauacuuaacaucagaucuuuucuau

SEQ ID NO: 53651 - RNA, 64 nt, hsa
gaucuuuaugcuguuauuacaggagaagugacauacuuuauauauguuuauauuagcaaggucu

SEQ ID NO: 53652 - RNA, 64 nt, hsa
uuuauauuagcaaggucuguuuuuaauaccauauacuuuauauuucuauacauuuauauuucua

SEQ ID NO: 53653 - RNA, 64 nt, hsa
acuacauguucuacccagcauuuuaacggcaagaacuuuauauuuauucucaagcagggcaugu

SEQ ID NO: 53654 - RNA, 64 nt, hsa
cuguaaaaacuguuaaauauuuaguaucacucuuacuuuauauucuacaaaggagagagaugua

SEQ ID NO: 53655 - RNA, 64 nt, hsa
aggaguaacaaaaugucauuucugaaagaggcuuacuuuauaccaacuagugucagcauuuggg

SEQ ID NO: 53656 - RNA, 64 nt, hsa
gcagcaguuugcaauacuaaaauauuuuuuauagacuuuauauuuuuccuuuugauaaagggau

SEQ ID NO: 53657 - RNA, 64 nt, hsa
uaacuauauauaauuuucccaccacuaauaccacacuuuauauucaguucugugucuuacuuau

SEQ ID NO: 53658 - RNA, 64 nt, hsa
acacaauagucagaaaacauuuuagaaauugaugacuuuauaaugcaaccaggaguauugaaaa

SEQ ID NO: 53659 - RNA, 64 nt, hsa
cuuggagagugucaaauacauacuuugaggauugacuuuauauaaggugcccuguagaacucug

SEQ ID NO: 53660 - RNA, 64 nt, hsa
uccaaaaucagccuucugucuguaacaaaaauguacuuuauagagauggaggaaaaggucuaau

SEQ ID NO: 53661 - RNA, 64 nt, hsa
uauaauguguauaaucagagugccucuuauacauacuuuauagaauaaaggaacauuuugacag

SEQ ID NO: 53662 - RNA, 64 nt, hsa
aauuucacucuacaaugcauauucuaaugaagcuacuuuauauaaauuggagagcuuauaaaau

SEQ ID NO: 53663 - RNA, 64 nt, hsa
auaacaucuugaauuuaaccauauaugccagauuacuuuauaugcaucaacaagaucaccagug

SEQ ID NO: 53664 - RNA, 64 nt, hsa
gcuacaucccuacuaauauaauuuuaaaaugagaacuuuauauauauuacuuaaaauuaaaugg

SEQ ID NO: 53665 - RNA, 64 nt, hsa
uaugggacauuuuaucuucuggcccaaagucagaacuuuauaaaaaucuugaguuuguucacua

SEQ ID NO: 53666 - RNA, 64 nt, hsa
guuuuauauuuuauauugcuaaauagagaaccacacuuuauauaaaguaguuuuugcauuuguu

SEQ ID NO: 53667 - RNA, 64 nt, hsa
agauacaaaaaauuuucaucuaaaguaauauuucacuuuauauuguaaagaagguagguauauu

SEQ ID NO: 53668 - RNA, 64 nt, hsa
ucaaauaacuaaauuucagaaaauuaagaagcugacuuuauauuuggugguuugaaguaucuug

SEQ ID NO: 53669 - RNA, 64 nt, hsa
uguuguaguuuauuuugugauuuuuuggaaucguacuuuauauuuccaaauuuaaauuuaaaug

SEQ ID NO: 53670 - RNA, 64 nt, hsa
accgaacacuaguaccauugacucucguugaauaacuuuauauuuccauaauccugaauugugu

SEQ ID NO: 53671 - RNA, 64 nt, hsa
uaaagagguauuuucuaauuaugcacagauaucuacuuuauacaaauacuuuauauggcuauuu

SEQ ID NO: 53672 - RNA, 64 nt, hsa
ucuaauuaugcacagauaucuacuuuauacaaauacuuuauauggcuauuuuugagaaaacccu

SEQ ID NO: 53673 - RNA, 64 nt, hsa
aaccagcaugccgauuucauaccuuaugcuacacagacauuaagaagagcagagcuggcacccu

SEQ ID NO: 53674 - RNA, 64 nt, hsa
uuauuauauugaaggcuuuaauaaaggccacaggagacauuacuauagcauagauugucaaaug

SEQ ID NO: 53675 - RNA, 64 nt, hsa
auccugauaaauauuaacaucacagaggaagaccagacauuaugggccuggaaguacuauagga

SEQ ID NO: 53676 - RNA, 64 nt, hsa
ggauugaagaagauugucuacucaaauggcauuuagacauuagaaugucugggaaaauauuucu

SEQ ID NO: 53677 - RNA, 64 nt, hsa
gcauacuaauauccaccugauuuauugacgaaguagacauuaggcaaagccaaacaauacucuu

SEQ ID NO: 53678 - RNA, 64 nt, hsa
agacguccauagccuuagguauaucauuuauaccagacauuaugaaguuauuaaagucuccuau

SEQ ID NO: 53679 - RNA, 64 nt, hsa
uuuuugggcaauacaaguuaaguucuuaauggggagacauuaucauggcaugacuuaagggaac

SEQ ID NO: 53680 - RNA, 64 nt, hsa
uaauagaacuuauagcuuuuaaaagaccuuuuaaagacauuaaauguaaacuuaaaaauguuua

SEQ ID NO: 53681 - RNA, 64 nt, hsa
cuauugugcauucagugaaguguuauuaugccacagacauuaaccuauuccaccuuacucaagg

SEQ ID NO: 53682 - RNA, 64 nt, hsa
aggugagcauuauuuauaaacuuugcuaugaaaaagacauuaaaauaugagauguaugaugaaa

SEQ ID NO: 53683 - RNA, 64 nt, hsa
guagauucuucuugaaaucccacauccagaaacuagacauuagaauguugaggcaguuucccag

SEQ ID NO: 53684 - RNA, 64 nt, hsa
cccuggcaggagacuaaucagauaggccggucucagacauuaauccuaccaucugauauuuuug

SEQ ID NO: 53685 - RNA, 64 nt, hsa
gcuacagggagaugcucucuuugagaggcuccugggcauugauuccauuucaaucucauucugg

SEQ ID NO: 53686 - RNA, 64 nt, hsa
cugaauaauggguuuuagcggguccuagucugcuggcauugagcuggggcugggucaccaaacc

SEQ ID NO: 53687 - RNA, 64 nt, hsa
acacaugccccccagauugcugcaaagaucccaaggcauugauugcacuugauuaagcuuuugu

SEQ ID NO: 53688 - RNA, 64 nt, hsa
acagcugacugaaugcagaacgguuuuuggaucuggcauugaaaugccucuugaccuuccccuc

SEQ ID NO: 53689 - RNA, 64 nt, hsa
uauaauuuuucucagccaauccauucacaagcuuggcauugacaugugcugcuaguuuauaaac

SEQ ID NO: 53690 - RNA, 64 nt, hsa
cuuggcauugacaugugcugcuaguuuauaaacuggcauugacgaaaaucauuugaaucucuuc

SEQ ID NO: 53691 - RNA, 64 nt, hsa
ucccugcaaggguccuuucuuugucaccagccaaggcauugauaaccaaguagccauuuuccuc

SEQ ID NO: 53692 - RNA, 64 nt, hsa
gacuuucaugauuauccucagggacaggauuggaggcauugagcguguuuauuaacaaauuguu

SEQ ID NO: 53693 - RNA, 64 nt, hsa
ccucagcacccagcuugugccauugggcauugauggcauugaacuagagcgagugccugccucg

SEQ ID NO: 53694 - RNA, 64 nt, hsa
uugucaugcccucagcacccagcuugugccauugggcauugauggcauugaacuagagcgagug

SEQ ID NO: 53695 - RNA, 64 nt, hsa
cagccccaucucccggcauugagccccaucuucuggcauugaguccugcuuccuacaggaguag

SEQ ID NO: 53696 - RNA, 64 nt, hsa
cuccuucucuagcugucaaacagccccaucucccggcauugagccccaucuucuggcauugagu

SEQ ID NO: 53697 - RNA, 64 nt, hsa
cagcgcaaguauuccauuugcauuugguaauuuuucaugccaccuauuuaugaauauauaaauc

SEQ ID NO: 53698 - RNA, 64 nt, hsa
cccuccccuggcucuuagcaaccugcccuuuuauucaugccauuuggggucacagaugccuagc

SEQ ID NO: 53699 - RNA, 64 nt, hsa
gcccuuugggcggccucugggcuugggcaccagcucaugccagccccagagggucaggguugga

SEQ ID NO: 53700 - RNA, 64 nt, hsa
cagaggcuaacagauccaaugggaguccauggugucaugccaagacaguaucagacacagcccc

SEQ ID NO: 53701 - RNA, 64 nt, hsa
ggcgcaaucucacugcaagcuccacuuccuggguucaugccauuuuccugccucagccucccga

SEQ ID NO: 53702 - RNA, 64 nt, hsa
cauguuuagauguuggagcagauuagagcagcauucaugccacucggagcaaccagacuuacag

SEQ ID NO: 53703 - RNA, 64 nt, hsa
uuaacagaucauuuauaaagcaggaguccauuuuaacacuuaccgacuuuuuuugguuuggaaa

SEQ ID NO: 53704 - RNA, 64 nt, hsa
gaaucacauaauugucuuuggaacuuggucucccaacacuuauugugauugcaaaguguuuacc

SEQ ID NO: 53705 - RNA, 64 nt, hsa
ugacauuuugugauauuugaauguuauuaaguuaaacacuuagaguugaguauauucaggggag

SEQ ID NO: 53706 - RNA, 64 nt, hsa
ccugaauauauauacagauagauagaugaguaucaacacuuacaagcucuacacagucugugag

SEQ ID NO: 53707 - RNA, 64 nt, hsa
gacaugaaaacugugcaagcaaaaaccgaagaaaaacacuuaaguacaacuguagugacaguga

SEQ ID NO: 53708 - RNA, 64 nt, hsa
ccaggauggcauagagaaagcuggcaauuagguuaacacuuacauauuauagugccccuuuaag

SEQ ID NO: 53709 - RNA, 64 nt, hsa
cugcuucugagauaagaaccauuuguguaacaccaacacuuaacuucagaaagacaugcauuau

SEQ ID NO: 53710 - RNA, 64 nt, hsa
ccaguugacuuuuaaauguaagaauggaauuccaaacacuuaacacauucagcuauaugacaga

SEQ ID NO: 53711 - RNA, 64 nt, hsa
ucuauaauacccaugaaaugauaauuuguaaaauaacacuuagugauaucuggaaauaauaauu

SEQ ID NO: 53712 - RNA, 64 nt, hsa
uuuaugaauauuaaaauuaucauuaauaauauaaaacacuuauuugagauuaaauuaaauuuuu

SEQ ID NO: 53713 - RNA, 64 nt, hsa
aucguagaucucaaaggaucuugcuuuaacuuucaacacuuagaaaaucuacaaacauucagac

SEQ ID NO: 53714 - RNA, 64 nt, hsa
ugcugguagaucuacugacuguagccaucaccagaacacuuaguuucuucccagacaugaauuu

SEQ ID NO: 53715 - RNA, 64 nt, hsa
aauaaauaccacuuuuaaaaaugacacauauuuaaacacuuagaaaauaaaguuaacacuuacu

SEQ ID NO: 53716 - RNA, 64 nt, hsa
augacacauauuuaaacacuuagaaaauaaaguuaacacuuacugaagugcuaguacuaaacug

SEQ ID NO: 53717 - RNA, 64 nt, hsa
uuccacguuuuguagcccacugcaucuggauauauaccaguauuuucuuuuuuuuuuuuuuuga

SEQ ID NO: 53718 - RNA, 64 nt, hsa
gggauuacaggcgucagccaccgcgccuggccuauaccaguauuuucuaguuuaaaggaggacu

SEQ ID NO: 53719 - RNA, 64 nt, hsa
gauaauaugcucaguuuggaccuuuuuuucaguuaaaugcuaaauauaugaaaauuacuauacc

SEQ ID NO: 53720 - RNA, 64 nt, hsa
aggaaccuucuuaaucucuucugugggauuuucaaaaugcuaaagacucacacugcagcaauca

SEQ ID NO: 53721 - RNA, 64 nt, hsa
ugagaaaagugggacaaaauauacuuuugaaauaaaaugcuauauggcaccuaauuauuuuuuc

SEQ ID NO: 53722 - RNA, 64 nt, hsa
auuacagcuguaaauuauaugagacuugccagucaaaugcuauuugguuuaaaaaaauuauugc

SEQ ID NO: 53723 - RNA, 64 nt, hsa
uguuaacaugaaagucaaccacuggcuuugugaaaaaugcuaugucacuauucagaauaugcug

SEQ ID NO: 53724 - RNA, 64 nt, hsa
agauauguacuucaugguuaaauucuaaaucugaaaaugcuagugggagauaucaagaaauuuu

SEQ ID NO: 53725 - RNA, 64 nt, hsa
cuuaccacucccagaaacauaagugaccaauuuaaaaugcuagggaacaggcuuacaacauagg

SEQ ID NO: 53726 - RNA, 64 nt, hsa
cagauugagaauguuuuacacaugcucuucauauaaaugcuacagaaaaaccuuuguuuuggug

SEQ ID NO: 53727 - RNA, 64 nt, hsa
aaaaaaaaaaggccuaaugcauuauuuugucauaaaaugcuauuuuaaaauucauggaacuuuc

SEQ ID NO: 53728 - RNA, 64 nt, hsa
aagaaucacugcacuuagcuguuggaauguuguuaaaugcuauggaaauacauuuagaaccugc

SEQ ID NO: 53729 - RNA, 64 nt, hsa
aagcauucaaaucaaagcuaaaagccuaaaugugaaaugcuaaugacaagccugagaagguaaa

SEQ ID NO: 53730 - RNA, 64 nt, hsa
uagauauuggaucaauauauuuaggugguauugaaaaugcuauuggaggagucacacuaauacu

SEQ ID NO: 53731 - RNA, 64 nt, hsa
uuugaacaggaaguaggaacaugcauacacgaagaaaugcuaacggaaggauuuguuauguuua

SEQ ID NO: 53732 - RNA, 64 nt, hsa
gaaaauauaaaaucacaguagauuuuauuuuuuaaaaugcuaacugaaaguaauagagacuguc

SEQ ID NO: 53733 - RNA, 64 nt, hsa
cuuuuaaaguucuuuauaggguuagggugugggaaaaugcuauauuaauaaaucuguaguguuu

SEQ ID NO: 53734 - RNA, 64 nt, hsa
uuuuuggcaguguucauauuauuaaacuagucaaaaaugcuaaaauaauuugggagaaaauauu

SEQ ID NO: 53735 - RNA, 64 nt, hsa
uaaugaacagaaauagcgcuaauuuucugcuuauaaaugcuaucauuaugaaaaggcuaaugca

SEQ ID NO: 53736 - RNA, 64 nt, hsa
auuacagaaaucuucuauugaaugggaaagguuuaaaugcuaaccaaagcaauuuauuuuuaau

SEQ ID NO: 53737 - RNA, 64 nt, hsa
gauguaucaauaaauuguuauaguagcuuauggaaaaugcuauuaaagauaaauuuucauacau

SEQ ID NO: 53738 - RNA, 64 nt, hsa
ucauacaaaauaaucaaaauagguuuucuacaccaaaugcuacccaggcagugcucuauaauuu

SEQ ID NO: 53739 - RNA, 64 nt, hsa
auucaauuugauagaaaucuugccacaaaacuucaaaugcuacaaaauauacacacacacucac

SEQ ID NO: 53740 - RNA, 64 nt, hsa
uggaaaggaauggaaaauauaguaacacaugaaaaaaugcuacuccaaucugaaugauuacuuc

SEQ ID NO: 53741 - RNA, 64 nt, hsa
uuuauuaauuuauuuuccaauaggauuuaaauagaaaugcuauucucaagucaucuuucuugcu

SEQ ID NO: 53742 - RNA, 64 nt, hsa
gaaaggguggggaugauaagaaaugcuaauauaaaaaugcuaagugaaaaaaagacuuggccag

SEQ ID NO: 53743 - RNA, 64 nt, hsa
uacaaacugucaaagaaaggguggggaugauaagaaaugcuaauauaaaaaugcuaagugaaaa

SEQ ID NO: 53744 - RNA, 64 nt, hsa
acaacacauuuuuaguuuuaaccaguuguagucaaaaugcuacaauaaaacaaaaaagagaaag

SEQ ID NO: 53745 - RNA, 64 nt, hsa
cauucuuaacaguaugugcccauuugcaaaacaaaaaugcuaauaaucaguaauaguccuauaa

SEQ ID NO: 53746 - RNA, 64 nt, hsa
uauuugcacuuaaaaucaaaguaguucaacaugcaaaugcuagggucuagcccuggguaagggc

SEQ ID NO: 53747 - RNA, 64 nt, hsa
uuuuaguggaaagauuggggugugaguccugauuaaaugcuaguaaaagcugccucauacauac

SEQ ID NO: 53748 - RNA, 64 nt, hsa
ucucuugccuucaacaagcacacugacagagaaaaaaugcuacugucuguugguuccaauauuc

SEQ ID NO: 53749 - RNA, 64 nt, hsa
gaaacaguaucuucaaaaaaaucagcagcaauugaaaugcuacaaaagacuuuguuuaaagauu

SEQ ID NO: 53750 - RNA, 64 nt, hsa
ggguaccuaucccagccacguuucagagggagagaaaugcuacaguugauccucaucugucugg

SEQ ID NO: 53751 - RNA, 64 nt, hsa
acauacauacaaacauaggcuaucuuggcacacuaaaugcuaagcacugucuuaagagguagag

SEQ ID NO: 53752 - RNA, 64 nt, hsa
guaauuaaccaacgaaaaagcuuuccggacuuuuaaaugcuaacuguuuuuccccuuccugucu

SEQ ID NO: 53753 - RNA, 64 nt, hsa
aaaugcuaacuguuuuuccccuuccugucuaggaaaaugcuauaaagcucaaauuaguuaggaa

SEQ ID NO: 53754 - RNA, 64 nt, hsa
augauaggauuuccuaaaguauuuguggacaguuaaaugcuaauuauauacaucuguaguuauu

SEQ ID NO: 53755 - RNA, 64 nt, hsa
augauaggauuuccaaaaguauuuguggacaguuaaaugcuaauuaauauacaucuguaguuau

SEQ ID NO: 53756 - RNA, 64 nt, hsa
uauugaugcacggaugcuuuugaacaguagagcgaaaugcuagacauggagaaucugcucuguu

SEQ ID NO: 53757 - RNA, 64 nt, hsa
uaaaaaaaaaaaaaaaaaaaaaaaaaaaaaaaaaaaaugcuauaaaauggugaaagcuuccuuc

SEQ ID NO: 53758 - RNA, 64 nt, hsa
uucauucuaucucagaguuaccggcaagcauauaaaaugcuacuuggauaauaucuacaugaau

SEQ ID NO: 53759 - RNA, 64 nt, hsa
gugguuuauuuuauuuugguaggcucugaaaucaaaaugcuacgccauuauaagccaguggagu

SEQ ID NO: 53760 - RNA, 64 nt, hsa
uacugcaaauagaccgcagacauaaauaucuaccaaaugcuaucuuaaauuuugguccaaacug

SEQ ID NO: 53761 - RNA, 64 nt, hsa
ugcuuuuagaagucuuuuucuuuguaagcauuguaaaugcuaauaaauccuguuaauuuuuuuu

SEQ ID NO: 53762 - RNA, 64 nt, hsa
auccagugaggguucaaacuuccaauugccucauaaaugcuacuuguuuuauuauuuuuaauua

SEQ ID NO: 53763 - RNA, 64 nt, hsa
ucuuuguagaguuacuaagcauuagcaaaggaggaaaugcuauguaauagaaauauuauucaau

SEQ ID NO: 53764 - RNA, 64 nt, hsa
cccucagacauucuccucauggcacauuuucuucaaaugcuaacauuuacugaguguacauuga

SEQ ID NO: 53765 - RNA, 64 nt, hsa
aacaucugaagguuuaguauauuagaaacacccaaaccaguaauaugcuaaccugaugcacugc

SEQ ID NO: 53766 - RNA, 64 nt, hsa
guuuugccaacuuuaaaugcuuaaacauaagcgaaaccaguagcaaguaugugggucagcuuaa

SEQ ID NO: 53767 - RNA, 64 nt, hsa
ggacugacuuuaauaauuugcauuauauugucccaaccaguaguuuauuuuuugccacggagau

SEQ ID NO: 53768 - RNA, 64 nt, hsa
auuuuagccagguauuucuuucuugugugugaugaaccaguauggauuugcuuuucuaagccuc

SEQ ID NO: 53769 - RNA, 64 nt, hsa
gaauuaguggagcuuuuguaucuucugcagacacuguggguagcccaucaaaauguaagcugug

SEQ ID NO: 53770 - RNA, 64 nt, hsa
guguggugugugugcuugguuuaggggaaguauguguggguacaugugaggacugggggcaccu

SEQ ID NO: 53771 - RNA, 64 nt, hsa
auuguccccugacuauccccagcccugaaaaaaagagcaggaggggacaccccuccauaugccc

SEQ ID NO: 53772 - RNA, 64 nt, hsa
ucuccgugaccuuucucuagccagggagaagggagagcaggaguauuggggcugggcccugggg

SEQ ID NO: 53773 - RNA, 64 nt, hsa
ucuucagucccaguagacucugcucccuagcccugagcaggaggcugggagcagcucuguuucc

SEQ ID NO: 53774 - RNA, 64 nt, hsa
ugaugagcuaagauccagccccagaauccuggaggagcaggagguagcaggagaggaccagguc

SEQ ID NO: 53775 - RNA, 64 nt, hsa
gggcccugccugagggugggcuuuucccuggguggagcaggacucccaccuaaacggggcagua

SEQ ID NO: 53776 - RNA, 64 nt, hsa
uuaaggcguggcuucugcaggaaucccggcuccagagcaggaaauucagcccaccagccaccuc

SEQ ID NO: 53777 - RNA, 64 nt, hsa
caccugccgcgugcaccugcaugacacacgcaaggagcaggagacggcauugcgcgucuacagc

SEQ ID NO: 53778 - RNA, 64 nt, hsa
ggccaagaagauggaguuccugaagcagaagaucgagcaggagcuccguaggcagccgggcggg

SEQ ID NO: 53779 - RNA, 64 nt, hsa
ggcagugagugucacacaccuguuaauccaucuugagcaggacaguacuauacaaauagaaugc

SEQ ID NO: 53780 - RNA, 64 nt, hsa
aagauugugccacugcacuccagccugggugacagagcaggacccugucucuauuuuauaaauu

SEQ ID NO: 53781 - RNA, 64 nt, hsa
aaagggaaacuggugggauauggaacauggcucugagcaggacuguugagcucacauaguguuc

SEQ ID NO: 53782 - RNA, 64 nt, hsa
uugagcucacauaguguucugacuccaaaucugggagcaggagaauguguaaacaagaauaaag

SEQ ID NO: 53783 - RNA, 64 nt, hsa
gccaggcauuacuacuaucaugaagaaaaaugaagagcaggaugcauguuagucuuuaauucac

SEQ ID NO: 53784 - RNA, 64 nt, hsa
uaaaagaauuaaaaaaggacaguggugcuugacagagcaggacugaaguuuucauuccucuacc

SEQ ID NO: 53785 - RNA, 64 nt, hsa
ggugccuccucuggggaagggaaccagcccuccagagcaggagacuggcaagagcucuuugucu

SEQ ID NO: 53786 - RNA, 64 nt, hsa
gccagggcccgaccuggggcugagugcagaggcugagcaggacguuaggcccgggccccuggca

SEQ ID NO: 53787 - RNA, 64 nt, hsa
ugacuagaaucuggauccugacgccugcagcugagagcaggagcaggaaaaggaggcucagcac

SEQ ID NO: 53788 - RNA, 64 nt, hsa
gaaucuggauccugacgccugcagcugagagcaggagcaggaaaaggaggcucagcacugucuc

SEQ ID NO: 53789 - RNA, 64 nt, hsa
ucuuuuucauuuucauggagguuucauuuuaauggagcaggagagaaaagagagaucuacuuug

SEQ ID NO: 53790 - RNA, 64 nt, hsa
uaagucucgccaucgucaaagagaaacuuugaaggagcaggagacugaaaucgauauuaauucc

SEQ ID NO: 53791 - RNA, 64 nt, hsa
agucaagucauacuuggccucucccugagaaucugagcaggagccuuauaaccuguggucauua

SEQ ID NO: 53792 - RNA, 64 nt, hsa
aucauacucuuguuucuuagaaauaagcaagacagagcaggaaauggaauaugcgggucacacu

SEQ ID NO: 53793 - RNA, 64 nt, hsa
uuacauuaagggcccugggggagaauaaagcucagagcaggagggaguaaggaaacauuuccuu

SEQ ID NO: 53794 - RNA, 64 nt, hsa
augaaguucuuucucugugcagcuuucccccuuggagcaggagugaagauguuucauuaucuug

SEQ ID NO: 53795 - RNA, 64 nt, hsa
gccagguggggcuagguguggcugggggccaggagagcaggaacagaacagagaaaugcccuug

SEQ ID NO: 53796 - RNA, 64 nt, hsa
gagcugaguaggccagguaggcgauuggaagagugagcaggacacagaggggaggggaauguuu

SEQ ID NO: 53797 - RNA, 64 nt, hsa
uaaauaugaccucaguguccuauaaauaauguaagagcaggauuugaaacuuggagagcuguuu

SEQ ID NO: 53798 - RNA, 64 nt, hsa
ccagcugccuuugaucaagauucgggugcaaguggagcaggagccauauaccuggagggaaugu

SEQ ID NO: 53799 - RNA, 64 nt, hsa
gcaagaaaaugagggcuugagucgccugaaccaagagcaggaagagguugcuggagcaagagga

SEQ ID NO: 53800 - RNA, 64 nt, hsa
ggaagaaaaugagggcuugagucgccugaacgaagagcaggaagagguugcugagauuguugga

SEQ ID NO: 53801 - RNA, 64 nt, hsa
ggaagaaaaugagggcuugagucaccugaaccaagagcaggaagagguugcucagguuguugga

SEQ ID NO: 53802 - RNA, 64 nt, hsa
cacacccuggacgggaagggacagcugcauuccagagcaggaggcagggcucuggggccagaau

SEQ ID NO: 53803 - RNA, 64 nt, hsa
cugguggccugccccagcucucuucuggcuuucugagcaggaagcgagcagaggcuccacaggc

SEQ ID NO: 53804 - RNA, 64 nt, hsa
uuuugcaacaaaaagcugacccagaggccauacagagcaggaauaucccauugcccccuccucc

SEQ ID NO: 53805 - RNA, 64 nt, hsa
gcuucuguugucuaacguauggcaggcagacugggagcaggaaaacagagggccccaaagccca

SEQ ID NO: 53806 - RNA, 64 nt, hsa
auucauucagaaaguugccacuucugaaugaguagagcaggaaaaguaaacuuuacugaaacau

SEQ ID NO: 53807 - RNA, 64 nt, hsa
gcagcugcucugcucaccagccugaccccacccagagcaggagcuggcgggugucuuccugcgg

SEQ ID NO: 53808 - RNA, 64 nt, hsa
caauaaggagcaggaccucagcuucauuguccuugagcaggacaauucugaaguguauucuaca

SEQ ID NO: 53809 - RNA, 64 nt, hsa
auguccccaggagcagcaacccugagucaauaaggagcaggaccucagcuucauuguccuugag

SEQ ID NO: 53810 - RNA, 64 nt, hsa
aauugacucaagcuauuuaacucgcacggccuuggagcaggaggugggucuggcaugcugcuau

SEQ ID NO: 53811 - RNA, 64 nt, hsa
gggacccacuguugcccuggaccucagcgggaaggagcaggagagagcugcugucagugagaau

SEQ ID NO: 53812 - RNA, 64 nt, hsa
cucugugucguguuugcuguggccgcagggagaggagcaggacacgcaccuuuccaggggccuc

SEQ ID NO: 53813 - RNA, 64 nt, hsa
gaccuuuguuucacuugccucugcucgacuccgagagcaggaaacccggccguggccuggcagc

SEQ ID NO: 53814 - RNA, 64 nt, hsa
uaccaaccccuggauuuuccuuguggggguacaagagcaggaguggggcaagaguuugaaaaua

SEQ ID NO: 53815 - RNA, 64 nt, hsa
ucagggaccucaccugucggaccuauagcuugcugagcaggaaccuugcacuucacacuucuug

SEQ ID NO: 53816 - RNA, 64 nt, hsa
cuccuuucuuuugggugcugccuauaaaucuuggaggaaucauuucuccuccucaaaaacugau

SEQ ID NO: 53817 - RNA, 64 nt, hsa
ucuugaccuaccccagauauuuguguggaagaggaggaaucaccauuuacaagguggacaaaug

SEQ ID NO: 53818 - RNA, 64 nt, hsa
ucauagaaaaaguagguacacguaaaucuguucaaggaaucauuguuuggcauugaaaauagga

SEQ ID NO: 53819 - RNA, 64 nt, hsa
gagauacagcucagagugccacgcccccagaaagaggaaucaggcaaguacugucccaaggcag

SEQ ID NO: 53820 - RNA, 64 nt, hsa
aaaagacuuagaauagucagcuauccugagcaaaaggaaucaaacuggaggaaucauauuaccu

SEQ ID NO: 53821 - RNA, 64 nt, hsa
agucagcuauccugagcaaaaggaaucaaacuggaggaaucauauuaccugacuuccaauuauu

SEQ ID NO: 53822 - RNA, 64 nt, hsa
aagcucucccuuacagaggcaacacagaauuauaaggaaucagaaaucccccuucuaccaggcu

SEQ ID NO: 53823 - RNA, 64 nt, hsa
augggugugugugugacugcaggggucguguccaaggaaucaagagucaccccagcugcugggc

SEQ ID NO: 53824 - RNA, 64 nt, hsa
augccauuuugcuauagacucauucauguuuuuuaggaaucagaaucauuucaggagaaaacca

SEQ ID NO: 53825 - RNA, 64 nt, hsa
ucacuuguauuauuauuugaauggaugcugcuggaggaaucaguuggaauugaagacacguucu

SEQ ID NO: 53826 - RNA, 64 nt, hsa
gcauauacuuuaauguuuuaacucuuuuggacaaaggaaucaauuacuugaaguugcuuuuuug

SEQ ID NO: 53827 - RNA, 64 nt, hsa
accauucagaauaucaucuuuuagacacagcccgaggaaucaacaauaguaacucuuucuuucc

SEQ ID NO: 53828 - RNA, 64 nt, hsa
gggauagaugugcuagucuucuagcauaggagcaaggaaucagaggugggguuaaaggcauuuu

SEQ ID NO: 53829 - RNA, 64 nt, hsa
uacgugugggcacuugugcuugagccuguauuaaaggaaucaggccaggcacaguggcucacgc

SEQ ID NO: 53830 - RNA, 64 nt, hsa
cuucaguuaccacuguacugcucaaaaacaugagaggaaucacacugcacagaaacacuaugaa

SEQ ID NO: 53831 - RNA, 64 nt, hsa
cuucauuuaccgccauucugcucgagcacaugaaaggaaucacacuguacagaaacgcuaugaa

SEQ ID NO: 53832 - RNA, 64 nt, hsa
aaguaacaaccugaauugagucauugcuuucugaaggaaucauuguccuuucuccaguuuuugu

SEQ ID NO: 53833 - RNA, 64 nt, hsa
cucagcuauguagcugauauagugaugggcaaacaggaaucacuugcuuuuauguccacuuuuu

SEQ ID NO: 53834 - RNA, 64 nt, hsa
gcagcaaauuugacuugaauucacuuaggaucgcaggaaucaggggaaagugauuuuaaaggug

SEQ ID NO: 53835 - RNA, 64 nt, hsa
uuguuauuagcuuuguggcuuugugaaauucuaaaggaaucaaauaauucaucaugauuuaaau

SEQ ID NO: 53836 - RNA, 64 nt, hsa
agaaugauggaauucugccugaagggucuugauaccuacucagugagguacuuugcuuggauug

SEQ ID NO: 53837 - RNA, 64 nt, hsa
ccuuggcuucugagcauccgcuaagaagauaagaccuacucaagcuggaaaugccgaugcaauu

SEQ ID NO: 53838 - RNA, 64 nt, hsa
uugugacugcccaggacucucagguugggcuggcccuacucaggauuacacugaaaguaauggc

SEQ ID NO: 53839 - RNA, 64 nt, hsa
cccacauguuuuggccauggauaaagugaagaggccuacucaccauuaucccugcagcgugaca

SEQ ID NO: 53840 - RNA, 64 nt, hsa
auaaagauuccaccuccaguccucucuccuccccccuacucaggcccuugaggcuauuaggaga

SEQ ID NO: 53841 - RNA, 64 nt, hsa
ggggauggaugggcuggucagcuggucuccuuuuccuacucauacuauaccuuccuguaccugg

SEQ ID NO: 53842 - RNA, 62 nt, hsa
cuacuccuuccuguagagcagaaauuguauuuugcacgaacaugcaguuauugaagauuagg

SEQ ID NO: 53843 - RNA, 62 nt, hsa
aggguguaaguauuccaccagcccgcugagugugcacgaaauguucgcagugcaacaaaaag

SEQ ID NO: 53844 - RNA, 62 nt, hsa
auauuagagucagagacuaaugguggcuuaaaugcacgaaugucuuuuuuuuuaaaacuguc

SEQ ID NO: 53845 - RNA, 62 nt, hsa
uccuuugguugccauauggaauggccauggaaugcacgaagucacaaugcaccauccaugag

SEQ ID NO: 53846 - RNA, 62 nt, hsa
aaacccguaggcacggacacacccagucucaaugcacgaaguuggagaaccugacagggcug

SEQ ID NO: 53847 - RNA, 62 nt, hsa
cgugcugcagcgacaggcggcagcacagcaccugcacgaacacccgccgaaacugcugcgag

SEQ ID NO: 53848 - RNA, 62 nt, hsa
ugggcugguacaggccucagccuugcccucaaugcacgaaagguggcccaggagagaggauc

SEQ ID NO: 53849 - RNA, 62 nt, hsa
gucacuuuuuaugcuauuucuguauauaaaggugcacgaagguaaaaaguauuuuuucaagu

SEQ ID NO: 53850 - RNA, 62 nt, hsa
ugaaagacaugagugcccucccaaagucugagugcacgaaaauuucucucuugccuugagga

SEQ ID NO: 53851 - RNA, 62 nt, hsa
aaacugaaucaagaaaugaaugcuccaugaaaugcacgaagucuguuuuaaugacaagguga

SEQ ID NO: 53852 - RNA, 62 nt, hsa
ugcuggugccaaccucugguggccguaccugaugcacgaacaccccgccuaccuguacucgu

SEQ ID NO: 53853 - RNA, 62 nt, hsa
uuaggguggcuguccaucccuggauagcuauuugcacgaaucauggacauaaauccaaguug

SEQ ID NO: 53854 - RNA, 62 nt, hsa
uuuguauucucuguccagggcuucagauauuuugcacgaauuuuaaaacauggcaauaaaug

SEQ ID NO: 53855 - RNA, 62 nt, hsa
augugaguugcacagcuaugaaggcuguacacugcacgaauggaagaggcaccugucccaga

SEQ ID NO: 53856 - RNA, 62 nt, hsa
ccaacacaugccuucccuccccagccacaccgugcacgaagggggcacaggagaggagaggg

SEQ ID NO: 53857 - RNA, 62 nt, hsa
uccagaaccuggaaccuagaggccuuucucucugcacgaaaaacagguaguuugcagucuga

SEQ ID NO: 53858 - RNA, 62 nt, hsa
guacuguaauuuugaauggaacugaaaaauuaugcacgaauaaaguacuuuucucaugccau

SEQ ID NO: 53859 - RNA, 62 nt, hsa
cagcugccaauaauaucuaauauuuuucaucaugcacgaauuaauaaucaucauacucuaga

SEQ ID NO: 53860 - RNA, 62 nt, hsa
cuggaauccacuaugguuuaccuugaguggccugcacgaacaugacagcccugaucuguauu

SEQ ID NO: 53861 - RNA, 62 nt, hsa
aguugaaguacaaauuaauaggccuuaugauaugcacgaauuuuacuauagauaauauaugu

SEQ ID NO: 53862 - RNA, 62 nt, hsa
guuggcgcucggggcgagaugcugcccuucuuugcacgaagccuggccucuugcuuggcgug

SEQ ID NO: 53863 - RNA, 62 nt, hsa
guagugcagcuguggguggaggcuggggugucugcacgaagucaggccagcguccuccucca

SEQ ID NO: 53864 - RNA, 62 nt, hsa
aagggauguuuuguaagaacuaccaacaguuuugcacgaacaaugucuuuuaaauuaaaaua

SEQ ID NO: 53865 - RNA, 62 nt, hsa
guguguguauguuucuuagccccuuggauuccugcacgaaguggcugaugggaaccauuuca

SEQ ID NO: 53866 - RNA, 62 nt, hsa
ggcuggguuaacguuuucucagggaaccacaaugcacgaaagaggaacugggguugcuaacc

SEQ ID NO: 53867 - RNA, 62 nt, hsa
cagccuucagcacaggcaacuguuacugagucugcacgaacuuagauaaugaggugcagggu

SEQ ID NO: 53868 - RNA, 62 nt, hsa
ucccauauuguuuggagacuuccagauggcucugcacgaaggagaaccacgcauuuaugaag

SEQ ID NO: 53869 - RNA, 62 nt, hsa
ggcucccuguuggcuacgcagggaugggcaguugcacgaaggcaugaauguauuguaaauaa

SEQ ID NO: 53870 - RNA, 62 nt, hsa
gacuuuccaaauauggaacuaacuggagaaggugcacgaaggagacaccacuuggggaccuc

SEQ ID NO: 53871 - RNA, 62 nt, hsa
ggucaaagugaggggaaaaaagcacgaccuacugcacgaagggaagauccaagcuucgaaag

SEQ ID NO: 53872 - RNA, 62 nt, hsa
ugagaaaggagacgaugaacguguagcugacaugcacgaaguuuaauuuacucauguccacg

SEQ ID NO: 53873 - RNA, 62 nt, hsa
ccuucaggcucuguugcucccuccucugcagcugcacgaaggcgccaucuggugucugcaug

SEQ ID NO: 53874 - RNA, 62 nt, hsa
cccuggccuccagagguggcgugggcuggcuuugcacgaagguugugcugggagaccggacc

SEQ ID NO: 53875 - RNA, 62 nt, hsa
cauucuaaugaaagaaaaugugaccaaagaaaugcacgaaaugugaaguucuuugucacugu

SEQ ID NO: 53876 - RNA, 62 nt, hsa
uucccgguuauguguagggaacagcagagugaugcacgaacuuugaacauucguuaugggga

SEQ ID NO: 53877 - RNA, 62 nt, hsa
gugggucccugacaaagaagagcuacgcucugugcacgaagucaagaaccaaacagcucagg

SEQ ID NO: 53878 - RNA, 62 nt, hsa
uguggcacaaaaagggaacauguuuuacucuuugcacgaaacuuucauuguuaauguauauu

SEQ ID NO: 53879 - RNA, 62 nt, hsa
gaaaugccucuucuuuauguacaaagauuauuugcacgaacuggacugugugcaacgcuuuu

SEQ ID NO: 53880 - RNA, 62 nt, hsa
agccaacagaugugucagccaggauugaccuuugcacgaacaccaagugucugcaaguaaac

SEQ ID NO: 53881 - RNA, 62 nt, hsa
caggccccgcgggccgggcuccaggaagggccugcacgaacccuacagcgagagugacgaug

SEQ ID NO: 53882 - RNA, 62 nt, hsa
gaggucccgcagaagcuacagcugccaggucaugcacgaagggagcaccguggagaagacgg

SEQ ID NO: 53883 - RNA, 64 nt, hsa
ggcuacuccuuccuguagagcagaaauuguauuuugcacgaacaugcaguuauugaagauuagg

SEQ ID NO: 53884 - RNA, 64 nt, hsa
agaggguguaaguauuccaccagcccgcugagugugcacgaaauguucgcagugcaacaaaaag

SEQ ID NO: 53885 - RNA, 64 nt, hsa
uuauauuagagucagagacuaaugguggcuuaaaugcacgaaugucuuuuuuuuuaaaacuguc

SEQ ID NO: 53886 - RNA, 64 nt, hsa
cuuccuuugguugccauauggaauggccauggaaugcacgaagucacaaugcaccauccaugag

SEQ ID NO: 53887 - RNA, 64 nt, hsa
agaaacccguaggcacggacacacccagucucaaugcacgaaguuggagaaccugacagggcug

SEQ ID NO: 53888 - RNA, 64 nt, hsa
ggcgugcugcagcgacaggcggcagcacagcaccugcacgaacacccgccgaaacugcugcgag

SEQ ID NO: 53889 - RNA, 64 nt, hsa
ucugggcugguacaggccucagccuugcccucaaugcacgaaagguggcccaggagagaggauc

SEQ ID NO: 53890 - RNA, 64 nt, hsa
uugucacuuuuuaugcuauuucuguauauaaaggugcacgaagguaaaaaguauuuuuucaagu

SEQ ID NO: 53891 - RNA, 64 nt, hsa
ggugaaagacaugagugcccucccaaagucugagugcacgaaaauuucucucuugccuugagga

SEQ ID NO: 53892 - RNA, 64 nt, hsa
gaaaacugaaucaagaaaugaaugcuccaugaaaugcacgaagucuguuuuaaugacaagguga

SEQ ID NO: 53893 - RNA, 64 nt, hsa
ggugcuggugccaaccucugguggccguaccugaugcacgaacaccccgccuaccuguacucgu

SEQ ID NO: 53894 - RNA, 64 nt, hsa
gauuaggguggcuguccaucccuggauagcuauuugcacgaaucauggacauaaauccaaguug

SEQ ID NO: 53895 - RNA, 64 nt, hsa
acuuuguauucucuguccagggcuucagauauuuugcacgaauuuuaaaacauggcaauaaaug

SEQ ID NO: 53896 - RNA, 64 nt, hsa
ugaugugaguugcacagcuaugaaggcuguacacugcacgaauggaagaggcaccugucccaga

SEQ ID NO: 53897 - RNA, 64 nt, hsa
ccccaacacaugccuucccuccccagccacaccgugcacgaagggggcacaggagaggagaggg

SEQ ID NO: 53898 - RNA, 64 nt, hsa
aguccagaaccuggaaccuagaggccuuucucucugcacgaaaaacagguaguuugcagucuga

SEQ ID NO: 53899 - RNA, 64 nt, hsa
uuguacuguaauuuugaauggaacugaaaaauuaugcacgaauaaaguacuuuucucaugccau

SEQ ID NO: 53900 - RNA, 64 nt, hsa
aucagcugccaauaauaucuaauauuuuucaucaugcacgaauuaauaaucaucauacucuaga

SEQ ID NO: 53901 - RNA, 64 nt, hsa
cucuggaauccacuaugguuuaccuugaguggccugcacgaacaugacagcccugaucuguauu

SEQ ID NO: 53902 - RNA, 64 nt, hsa
auaguugaaguacaaauuaauaggccuuaugauaugcacgaauuuuacuauagauaauauaugu

SEQ ID NO: 53903 - RNA, 64 nt, hsa
guguuggcgcucggggcgagaugcugcccuucuuugcacgaagccuggccucuugcuuggcgug

SEQ ID NO: 53904 - RNA, 64 nt, hsa
cgguagugcagcuguggguggaggcuggggugucugcacgaagucaggccagcguccuccucca

SEQ ID NO: 53905 - RNA, 64 nt, hsa
ggaagggauguuuuguaagaacuaccaacaguuuugcacgaacaaugucuuuuaaauuaaaaua

SEQ ID NO: 53906 - RNA, 64 nt, hsa
guguguguguauguuucuuagccccuuggauuccugcacgaaguggcugaugggaaccauuuca

SEQ ID NO: 53907 - RNA, 64 nt, hsa
ggggcuggguuaacguuuucucagggaaccacaaugcacgaaagaggaacugggguugcuaacc

SEQ ID NO: 53908 - RNA, 64 nt, hsa
cacagccuucagcacaggcaacuguuacugagucugcacgaacuuagauaaugaggugcagggu

SEQ ID NO: 53909 - RNA, 64 nt, hsa
gaucccauauuguuuggagacuuccagauggcucugcacgaaggagaaccacgcauuuaugaag

SEQ ID NO: 53910 - RNA, 64 nt, hsa
auggcucccuguuggcuacgcagggaugggcaguugcacgaaggcaugaauguauuguaaauaa

SEQ ID NO: 53911 - RNA, 64 nt, hsa
gagacuuuccaaauauggaacuaacuggagaaggugcacgaaggagacaccacuuggggaccuc

SEQ ID NO: 53912 - RNA, 64 nt, hsa
uuggucaaagugaggggaaaaaagcacgaccuacugcacgaagggaagauccaagcuucgaaag

SEQ ID NO: 53913 - RNA, 64 nt, hsa
gcugagaaaggagacgaugaacguguagcugacaugcacgaaguuuaauuuacucauguccacg

SEQ ID NO: 53914 - RNA, 64 nt, hsa
ucccuucaggcucuguugcucccuccucugcagcugcacgaaggcgccaucuggugucugcaug

SEQ ID NO: 53915 - RNA, 64 nt, hsa
cucccuggccuccagagguggcgugggcuggcuuugcacgaagguugugcugggagaccggacc

SEQ ID NO: 53916 - RNA, 64 nt, hsa
uucauucuaaugaaagaaaaugugaccaaagaaaugcacgaaaugugaaguucuuugucacugu

SEQ ID NO: 53917 - RNA, 64 nt, hsa
guuucccgguuauguguagggaacagcagagugaugcacgaacuuugaacauucguuaugggga

SEQ ID NO: 53918 - RNA, 64 nt, hsa
cugugggucccugacaaagaagagcuacgcucugugcacgaagucaagaaccaaacagcucagg

SEQ ID NO: 53919 - RNA, 64 nt, hsa
uuuguggcacaaaaagggaacauguuuuacucuuugcacgaaacuuucauuguuaauguauauu

SEQ ID NO: 53920 - RNA, 64 nt, hsa
cugaaaugccucuucuuuauguacaaagauuauuugcacgaacuggacugugugcaacgcuuuu

SEQ ID NO: 53921 - RNA, 64 nt, hsa
ggagccaacagaugugucagccaggauugaccuuugcacgaacaccaagugucugcaaguaaac

SEQ ID NO: 53922 - RNA, 64 nt, hsa
gccaggccccgcgggccgggcuccaggaagggccugcacgaacccuacagcgagagugacgaug

SEQ ID NO: 53923 - RNA, 64 nt, hsa
uggaggucccgcagaagcuacagcugccaggucaugcacgaagggagcaccguggagaagacgg

SEQ ID NO: 53924 - RNA, 65 nt, hsa
aggcuacuccuuccuguagagcagaaauuguauuuugcacgaacaugcaguuauugaagauuagg

SEQ ID NO: 53925 - RNA, 65 nt, hsa
aagaggguguaaguauuccaccagcccgcugagugugcacgaaauguucgcagugcaacaaaaag

SEQ ID NO: 53926 - RNA, 65 nt, hsa
cuuauauuagagucagagacuaaugguggcuuaaaugcacgaaugucuuuuuuuuuaaaacuguc

SEQ ID NO: 53927 - RNA, 65 nt, hsa
ccuuccuuugguugccauauggaauggccauggaaugcacgaagucacaaugcaccauccaugag

SEQ ID NO: 53928 - RNA, 65 nt, hsa
cagaaacccguaggcacggacacacccagucucaaugcacgaaguuggagaaccugacagggcug

SEQ ID NO: 53929 - RNA, 65 nt, hsa
uggcgugcugcagcgacaggcggcagcacagcaccugcacgaacacccgccgaaacugcugcgag

SEQ ID NO: 53930 - RNA, 65 nt, hsa
aucugggcugguacaggccucagccuugcccucaaugcacgaaagguggcccaggagagaggauc

SEQ ID NO: 53931 - RNA, 65 nt, hsa
auugucacuuuuuaugcuauuucuguauauaaaggugcacgaagguaaaaaguauuuuuucaagu

SEQ ID NO: 53932 - RNA, 65 nt, hsa
aggugaaagacaugagugcccucccaaagucugagugcacgaaaauuucucucuugccuugagga

SEQ ID NO: 53933 - RNA, 65 nt, hsa
ugaaaacugaaucaagaaaugaaugcuccaugaaaugcacgaagucuguuuuaaugacaagguga

SEQ ID NO: 53934 - RNA, 65 nt, hsa
aggugcuggugccaaccucugguggccguaccugaugcacgaacaccccgccuaccuguacucgu

SEQ ID NO: 53935 - RNA, 65 nt, hsa
agauuaggguggcuguccaucccuggauagcuauuugcacgaaucauggacauaaauccaaguug

SEQ ID NO: 53936 - RNA, 65 nt, hsa
cacuuuguauucucuguccagggcuucagauauuuugcacgaauuuuaaaacauggcaauaaaug

SEQ ID NO: 53937 - RNA, 65 nt, hsa
gugaugugaguugcacagcuaugaaggcuguacacugcacgaauggaagaggcaccugucccaga

SEQ ID NO: 53938 - RNA, 65 nt, hsa
accccaacacaugccuucccuccccagccacaccgugcacgaagggggcacaggagaggagaggg

SEQ ID NO: 53939 - RNA, 65 nt, hsa
aaguccagaaccuggaaccuagaggccuuucucucugcacgaaaaacagguaguuugcagucuga

SEQ ID NO: 53940 - RNA, 65 nt, hsa
uuuguacuguaauuuugaauggaacugaaaaauuaugcacgaauaaaguacuuuucucaugccau

SEQ ID NO: 53941 - RNA, 65 nt, hsa
aaucagcugccaauaauaucuaauauuuuucaucaugcacgaauuaauaaucaucauacucuaga

SEQ ID NO: 53942 - RNA, 65 nt, hsa
acucuggaauccacuaugguuuaccuugaguggccugcacgaacaugacagcccugaucuguauu

SEQ ID NO: 53943 - RNA, 65 nt, hsa
uauaguugaaguacaaauuaauaggccuuaugauaugcacgaauuuuacuauagauaauauaugu

SEQ ID NO: 53944 - RNA, 65 nt, hsa
gguguuggcgcucggggcgagaugcugcccuucuuugcacgaagccuggccucuugcuuggcgug

SEQ ID NO: 53945 - RNA, 65 nt, hsa
ccgguagugcagcuguggguggaggcuggggugucugcacgaagucaggccagcguccuccucca

SEQ ID NO: 53946 - RNA, 65 nt, hsa
uggaagggauguuuuguaagaacuaccaacaguuuugcacgaacaaugucuuuuaaauuaaaaua

SEQ ID NO: 53947 - RNA, 65 nt, hsa
uguguguguguauguuucuuagccccuuggauuccugcacgaaguggcugaugggaaccauuuca

SEQ ID NO: 53948 - RNA, 65 nt, hsa
gggggcuggguuaacguuuucucagggaaccacaaugcacgaaagaggaacugggguugcuaacc

SEQ ID NO: 53949 - RNA, 65 nt, hsa
ucacagccuucagcacaggcaacuguuacugagucugcacgaacuuagauaaugaggugcagggu

SEQ ID NO: 53950 - RNA, 65 nt, hsa
ggaucccauauuguuuggagacuuccagauggcucugcacgaaggagaaccacgcauuuaugaag

SEQ ID NO: 53951 - RNA, 65 nt, hsa
gauggcucccuguuggcuacgcagggaugggcaguugcacgaaggcaugaauguauuguaaauaa

SEQ ID NO: 53952 - RNA, 65 nt, hsa
ggagacuuuccaaauauggaacuaacuggagaaggugcacgaaggagacaccacuuggggaccuc

SEQ ID NO: 53953 - RNA, 65 nt, hsa
guuggucaaagugaggggaaaaaagcacgaccuacugcacgaagggaagauccaagcuucgaaag

SEQ ID NO: 53954 - RNA, 65 nt, hsa
agcugagaaaggagacgaugaacguguagcugacaugcacgaaguuuaauuuacucauguccacg

SEQ ID NO: 53955 - RNA, 65 nt, hsa
uucccuucaggcucuguugcucccuccucugcagcugcacgaaggcgccaucuggugucugcaug

SEQ ID NO: 53956 - RNA, 65 nt, hsa
ccucccuggccuccagagguggcgugggcuggcuuugcacgaagguugugcugggagaccggacc

SEQ ID NO: 53957 - RNA, 65 nt, hsa
auucauucuaaugaaagaaaaugugaccaaagaaaugcacgaaaugugaaguucuuugucacugu

SEQ ID NO: 53958 - RNA, 65 nt, hsa
uguuucccgguuauguguagggaacagcagagugaugcacgaacuuugaacauucguuaugggga

SEQ ID NO: 53959 - RNA, 65 nt, hsa
ccugugggucccugacaaagaagagcuacgcucugugcacgaagucaagaaccaaacagcucagg

SEQ ID NO: 53960 - RNA, 65 nt, hsa
uuuuguggcacaaaaagggaacauguuuuacucuuugcacgaaacuuucauuguuaauguauauu

SEQ ID NO: 53961 - RNA, 65 nt, hsa
ucugaaaugccucuucuuuauguacaaagauuauuugcacgaacuggacugugugcaacgcuuuu

SEQ ID NO: 53962 - RNA, 65 nt, hsa
uggagccaacagaugugucagccaggauugaccuuugcacgaacaccaagugucugcaaguaaac

SEQ ID NO: 53963 - RNA, 65 nt, hsa
ggccaggccccgcgggccgggcuccaggaagggccugcacgaacccuacagcgagagugacgaug

SEQ ID NO: 53964 - RNA, 65 nt, hsa
guggaggucccgcagaagcuacagcugccaggucaugcacgaagggagcaccguggagaagacgg

SEQ ID NO: 53965 - RNA, 64 nt, hsa
gccugucuccaaucagcaaguggucgugccuggcucuagagagcguggggagcuggucucaagg

SEQ ID NO: 53966 - RNA, 64 nt, hsa
aaaauugugcucuagaagaauaaaacugaaaaacucuagagaauuuuuuuuccccauugauguu

SEQ ID NO: 53967 - RNA, 64 nt, hsa
uuuuuugggggggguggucucuuccugucuggcuucuagagaugugccugugggagggggagga

SEQ ID NO: 53968 - RNA, 64 nt, hsa
gccaaguacauaaaaaaaaaaaaagcagauuaucucuagagaguuugagccuuugcuggucaca

SEQ ID NO: 53969 - RNA, 64 nt, hsa
aaacccacauuccaaagugguaggcucauuuguuucuagagauuucaucaugucgcuuuuccuu

SEQ ID NO: 53970 - RNA, 64 nt, hsa
cucucuuuugaggcucucucauaaccccucuauuucuagagacaacaaaaaugcugccaguccu

SEQ ID NO: 53971 - RNA, 64 nt, hsa
auguugccgcucuccaaucucccagagcucgcucucuagagaaucaccuucuuucgcuuuuuuu

SEQ ID NO: 53972 - RNA, 64 nt, hsa
cccucucuccuuccuccccaucucucgcacgcagucuagagauggacugagccuugcuucucac

SEQ ID NO: 53973 - RNA, 64 nt, hsa
uauauaucuaucuuauauaguuuacuauuuuacuucuagagauaguacauaaaggugguaugug

SEQ ID NO: 53974 - RNA, 64 nt, hsa
ucaggugucuggucuugggggcacugugcucacuucuagagagaagaaaaaggcuggguuugga

SEQ ID NO: 53975 - RNA, 64 nt, hsa
gccacuuauaucuuagacuauacuuuuugggaagucuagagauguauauaaugugcuaaauuca

SEQ ID NO: 53976 - RNA, 64 nt, hsa
cuuuuaaaaggcagauuaaaagcacaagcguguuucuagagaacaguugagagagaaucucaag

SEQ ID NO: 53977 - RNA, 64 nt, hsa
ccuccuacuuuccucccuagguggacagugcuccucuagagagcugcgacuuuaauuaaaaaca

SEQ ID NO: 53978 - RNA, 64 nt, hsa
gucuguacagaaaugaagcugguugcaauaccaaucuagagaguccaagcuggugaacuauuaa

SEQ ID NO: 53979 - RNA, 64 nt, hsa
uauaauaugugccuuaaguuuuagucuuuagaacucuagagagccuuaacuucuuaaaccauuu

SEQ ID NO: 53980 - RNA, 64 nt, hsa
uaggaaugaauaccucaaaucuguugucugagauucuagagauuaaaccacugugccauuuuua

SEQ ID NO: 53981 - RNA, 64 nt, hsa
aaauggaguguuggaaaauguucuuucugcagggucuagagacugcugggacacuuuucuugga

SEQ ID NO: 53982 - RNA, 64 nt, hsa
uuuugugaaaucuuuuaagagccaguaacauacuucuagagaacaggaaaagagacuaggauaa

SEQ ID NO: 53983 - RNA, 64 nt, hsa
aagcaucuaaagcaaaaaaaaaaccaaaaaaaaaucuagagauguggcuguggcuuuuugggag

SEQ ID NO: 53984 - RNA, 64 nt, hsa
cuuacugaagugccugaaacccaaagcuagagcuucuagagacgccguucuuccugucucagcu

SEQ ID NO: 53985 - RNA, 64 nt, hsa
ggaggcggcucuggugcccauccucccagcaugcucuagagaggcggcucuggugccccuccuc

SEQ ID NO: 53986 - RNA, 64 nt, hsa
uuggagauguacugguguccgucucccagcaugcucuagagaggcggcucuggugcccauccuc

SEQ ID NO: 53987 - RNA, 64 nt, hsa
uugccacauuaagguugaacagcauggcucagagucuagagaaagugaucaccaagcugucuca

SEQ ID NO: 53988 - RNA, 64 nt, hsa
caagccucuauuauacaaaccaugcagacucgccucuagagauucugauucgguugaucugggg

SEQ ID NO: 53989 - RNA, 64 nt, hsa
acuuagcuuccugauacuagguagugaugguggaucuagagacauucacuugaagagcaaggau

SEQ ID NO: 53990 - RNA, 64 nt, hsa
uuccagugguauuugaugguauaacauaacucauucuagagaaaaacuuuaugaagguaucgaa

SEQ ID NO: 53991 - RNA, 64 nt, hsa
gcugcagggaggagaggugagaaaggaagcgucuucuagagacauuggcccaggagcucuguuc

SEQ ID NO: 53992 - RNA, 64 nt, hsa
uagacugaagagaccacagcaauuggcuccuccaucuagagauuuucuuggcaguauuccaugg

SEQ ID NO: 53993 - RNA, 64 nt, hsa
caccuggguccgugccagcacaaucugccaaaguucuagagacccuguucccuuccccaucacc

SEQ ID NO: 53994 - RNA, 64 nt, hsa
uuaugcaaguuuugaaagauagguauuuauuuuuucuagagacaggaguuuugcucuguugccc

SEQ ID NO: 53995 - RNA, 64 nt, hsa
uguuguaaaguauuguuugcagcucuuuccaauaucuagagacauuuuuauuuaugaauauuua

SEQ ID NO: 53996 - RNA, 64 nt, hsa
gucuggcagaagccacgcuuguuccccauguaccucuagagaagcagaaaccaaagucccccug

SEQ ID NO: 53997 - RNA, 64 nt, hsa
acuguuuguacaucguuuuuuuccauuaaacuuuucuagagaagacaaaagcuuacacugguga

SEQ ID NO: 53998 - RNA, 64 nt, hsa
uagaaccaacggaaauaugggcacuauuuugaauucuagagaugguuuuuguuaaaucuacuaa

SEQ ID NO: 53999 - RNA, 64 nt, hsa
uggccuuuuuccucagguaguuugaaaaacacacucuagagaugcacuguccaauccgguagcc

SEQ ID NO: 54000 - RNA, 64 nt, hsa
ucaaguagcacauugguaauagguaucagagcagucuagagacaauugcaugucaaaaaaugua

SEQ ID NO: 54001 - RNA, 64 nt, hsa
uccaguguuguugagugaaaaucugacagaucauucuagagacuguaagaguuaggaaaauauc

SEQ ID NO: 54002 - RNA, 64 nt, hsa
auucuguauuuggccuuauucgggcauuaggaaaucuagagaucuaaaggguugaaugacaaua

SEQ ID NO: 54003 - RNA, 64 nt, hsa
caaguaugaaaaaugaaaaggcccaggguuaccuucuagagacaaauaaaugcagucuugaaag

SEQ ID NO: 54004 - RNA, 64 nt, hsa
aacugcaaaaacaaauauagacaaauauuuugauucuagagaacgucucagaugugcuuauaaa

SEQ ID NO: 54005 - RNA, 64 nt, hsa
ugugugguaacuguauuguucuagaaauaugcuuucuagagauaugaugauuuugaaacugauu

SEQ ID NO: 54006 - RNA, 64 nt, hsa
auguuaagugccuuguccgcaccuugcuuuuaucucuagagacaugaaguuauuauuaauuuuu

SEQ ID NO: 54007 - RNA, 64 nt, hsa
guauuaaggcaacaagacaguacaacaaauaaucucuagagagguccacuuuguugcugaagua

SEQ ID NO: 54008 - RNA, 64 nt, hsa
gucuuauaaugauuagguuuuguucugaguuauuucuagagaaagaaaguauuuuaguaugugu

SEQ ID NO: 54009 - RNA, 64 nt, hsa
uguaaugcuggaagaucuuaaggacuacauacauucuagagaugacaguguuguucaaagacag

SEQ ID NO: 54010 - RNA, 64 nt, hsa
ggaucauggagaaaaaaugagacccuaaaaaguuucuagagagagaaaacaaaagaucagaaau

SEQ ID NO: 54011 - RNA, 64 nt, hsa
aaauccaugcugagcuguaccaggaacuugcauaucuagagacagagacugagucacuggccca

SEQ ID NO: 54012 - RNA, 64 nt, hsa
guuucagucuugggcucuugacuccucacuguugucuagagauggagccagcaggcugguagcc

SEQ ID NO: 54013 - RNA, 64 nt, hsa
ucaucggcaggcgcaugaguaucugugggaguccucuagagagaugagaagccaggaggccugc

SEQ ID NO: 54014 - RNA, 64 nt, hsa
agaucuauguacuguaauagugugauuacuaugcucuagagaaaagucuaccccugcuaaggag

SEQ ID NO: 54015 - RNA, 64 nt, hsa
augauauagcuuugccauguggcagaucuacaugucuagagaacacugugcucuauuaccauua

SEQ ID NO: 54016 - RNA, 64 nt, hsa
cucuauuaccauuauggauaaagaugagaugguuucuagagaugguuucuacuggcugccagaa

SEQ ID NO: 54017 - RNA, 64 nt, hsa
aaacuuuaggguaaaaauugccauuggacaguugucuagagauauauauacuugugguuuucaa

SEQ ID NO: 54018 - RNA, 64 nt, hsa
gcugagauuuugguuaauagaguaagcuuacauaucuagagaaacaacauaguggaaaaccgaa

SEQ ID NO: 54019 - RNA, 64 nt, hsa
uguggcagguggcugcccuauuggauagcacaggucuagagaaaugauaccuuuuuuuuuuuuu

SEQ ID NO: 54020 - RNA, 64 nt, hsa
ccucauccaaggagcuggggcagacuucauugauucuagagagaccuguuucagugccuacuca

SEQ ID NO: 54021 - RNA, 64 nt, hsa
uccucaaagacugucuuaauuacucauggcagguucuagagacuuaaggggaaaagcugcuuuc

SEQ ID NO: 54022 - RNA, 64 nt, hsa
gggaugggaggccucucucuccccacccccugacucuagagaacuggguuuucucccaguacuc

SEQ ID NO: 54023 - RNA, 64 nt, hsa
aucauccugguggaacuugaacauuuagaguuuaucuagagagcuugguuaaucuuuccauauu

SEQ ID NO: 54024 - RNA, 64 nt, hsa
auaaauauaauacuauaacucgagaaaaggcauuucuagagaacagauucauuugcuuaauuuu

SEQ ID NO: 54025 - RNA, 64 nt, hsa
uguacuguagcuuguuguuugggggaccaaauuuucuagagagaacuagagcacuuuuguugug

SEQ ID NO: 54026 - RNA, 64 nt, hsa
uaaaaaucaauugcagaaguucauuugucauuuuucuagagauaaauuauaguacucaaacugg

SEQ ID NO: 54027 - RNA, 64 nt, hsa
gaaaugagaaaaauacagaguuuuagaaaugagaucuagagaacacgucuucuaaaaggggcau

SEQ ID NO: 54028 - RNA, 64 nt, hsa
aucugaacaucuuucccagugcuaucaguauacaucuagagaggaaaugcaaugugacaguguu

SEQ ID NO: 54029 - RNA, 64 nt, hsa
uucaccaguuguacugcaauauagacaagaugucucuagagacucaaacuacuguuuuauuaaa

SEQ ID NO: 54030 - RNA, 64 nt, hsa
ggcauguaccuucauuugcuuagcuauuugaguaucuagagaaaaauuaaaaugcaaugaguua

SEQ ID NO: 54031 - RNA, 64 nt, hsa
gcaaaaugccucucccauccucucucaggaagcuucuagagacuuuaugcccuccagagcucca

SEQ ID NO: 54032 - RNA, 64 nt, hsa
ugauugguauucucaacagcaaaggggugaaaaaucuagagacagaggaggccuggcaggggug

SEQ ID NO: 54033 - RNA, 64 nt, hsa
gugacuuagacauguuugcaugaauaaauauauuucuagagaacaguuuacaaagccucaucuu

SEQ ID NO: 54034 - RNA, 64 nt, hsa
acuuuuuacucucccuccugaccaguccagcuggucuagagaaagccuuguuuuuucccagagc

SEQ ID NO: 54035 - RNA, 64 nt, hsa
cgcagguacaugcuaguuucaauuaccacaguauucuagagacggguugcaaugacaagggggg

SEQ ID NO: 54036 - RNA, 64 nt, hsa
gccauggagaccacugucagaaaugggauauuagucuagagagaaggugaucuauucccacaug

SEQ ID NO: 54037 - RNA, 64 nt, hsa
acaaaauagggauuuuuacuucauuuucugaaagucuagagaauuacaacuuuggugauaaaca

SEQ ID NO: 54038 - RNA, 64 nt, hsa
auguaucuaguggucugauuuuaauuugggcaucucuagagaacgcuuucagggaaaaauacuu

SEQ ID NO: 54039 - RNA, 64 nt, hsa
gaucucaaagaaagcauuuucauuucacugcacaucuagagaaaaacaaaaauagaaaauuuuc

SEQ ID NO: 54040 - RNA, 64 nt, hsa
ucagugauuuguaauuugggacuuggauuauuuaucuagagauguuuguauauuuugucaguaa

SEQ ID NO: 54041 - RNA, 64 nt, hsa
ccagauaauguccuugcuuuacaaaccaaccauuucuagagagucuccuuacucauuaauucaa

SEQ ID NO: 54042 - RNA, 64 nt, hsa
gcauuccuaggggagaaaauaaaauuuguaauguucuagagaucauuuggaaaaaaagauccaa

SEQ ID NO: 54043 - RNA, 64 nt, hsa
ggcuaccaggucucuaggggccugagagaggcccucuagagaauccagggaaacugugagccca

SEQ ID NO: 54044 - RNA, 64 nt, hsa
caucaccacacccugcuaauuuuuuaaauuuuuuucuagagagagggucucacuguguugccca

SEQ ID NO: 54045 - RNA, 64 nt, hsa
uauaaacacaccccauaaugcaaguaauagguaaucuagagauguggacuuuauugcuauaugg

SEQ ID NO: 54046 - RNA, 64 nt, hsa
gcucuccauuuugacguuaaaaaacaacaacagaucuagagauaccucaaggauaucauuuuug

SEQ ID NO: 54047 - RNA, 64 nt, hsa
auagugcuuacauuguauuagguguuauaagcaaucuagagaugauuuagcaaguauacaggag

SEQ ID NO: 54048 - RNA, 64 nt, hsa
gaguagaugaauuauugaaugugagauaauccguucuagagaauaacuaugaaagcuugcauca

SEQ ID NO: 54049 - RNA, 64 nt, hsa
cagguuguccuccgauuuuuagaugaguuuccugucuagagauguccuagucugcucacuggcu

SEQ ID NO: 54050 - RNA, 64 nt, hsa
uuaauaaagaacauucucaaaacguaaauagguaucuagagaagugaguacucaacauuuggua

SEQ ID NO: 54051 - RNA, 64 nt, hsa
aaguaaguauauuuuagagcugaaucaguaagauucuagagaaagcaaaacauaguaguucaca

SEQ ID NO: 54052 - RNA, 64 nt, hsa
cugaaaguauagauccaacaaauagagacuggguucuagagaguucuggucuauagaaacccaa

SEQ ID NO: 54053 - RNA, 64 nt, hsa
uugugaugacgugagaucaauaagaagaaccuagucuagagacaaugaugcuaguuugcauaug

SEQ ID NO: 54054 - RNA, 64 nt, hsa
aauaugucugaagaaaaaaauugcaagccacacuucuagagauuuuguucaagaucauuucagg

SEQ ID NO: 54055 - RNA, 64 nt, hsa
uauugcagaagcuaaaaagcuaaaguaccagucaucuagagagaaggaaauuaauguuucuuaa

SEQ ID NO: 54056 - RNA, 64 nt, hsa
ugucugcacccccagcaagaaggcgaguuaguuuucuagagacuugaaggagucucccccuucc

SEQ ID NO: 54057 - RNA, 64 nt, hsa
aagcccaagauccgcaggaagaagccagauacauucuagagaauugugagacuuugcccuaagc

SEQ ID NO: 54058 - RNA, 64 nt, hsa
caaaugaguuacugaauaaggugcuucugcuucuucuagagauggugcuaaagaaaggacuagc

SEQ ID NO: 54059 - RNA, 64 nt, hsa
ugaauaacaaaacuagcaauauuuuaauuaucuaucuagagauuuuuuagauugaauucuuguc

SEQ ID NO: 54060 - RNA, 64 nt, hsa
uuguguuugauuuuacuauagggguuuugcuuuuucuagagauacuuuucauuuaacagcuuuu

SEQ ID NO: 54061 - RNA, 64 nt, hsa
aaguaauagagaaaauuuacuuagcauuuuagauucuagagacauggaaaugaaaauuauuuua

SEQ ID NO: 54062 - RNA, 64 nt, hsa
aaauaaaauaaaaugacguacagagauucuauauucuagagagucaaauggucuugcucaauuc

SEQ ID NO: 54063 - RNA, 64 nt, hsa
aaaguacucuuuguaagguacaguuaccgauuaaucuagagauaaaauauuuucuuaaaaauau

SEQ ID NO: 54064 - RNA, 64 nt, hsa
uccuucaaaggacaguguuguuuugaccgggagaucuagagagugcucagaauuagggccuggc

SEQ ID NO: 54065 - RNA, 64 nt, hsa
ucugaaaaaaacacccuuaucauccaguguaccaucuagagaucaccacagaauccauuuuuuu

SEQ ID NO: 54066 - RNA, 64 nt, hsa
guaugaacccuuaauuugaagaacuaacuugauuucuagagaaauauccacacuaucucagugg

SEQ ID NO: 54067 - RNA, 64 nt, hsa
gaauuggagagcaggcacaucaacugaucucauuucuagagagccccugacaauccugaggcuu

SEQ ID NO: 54068 - RNA, 64 nt, hsa
cauuuacagccauuucuaaaauggcagcuucaguucuagagaagaaagaacaacaucagcagua

SEQ ID NO: 54069 - RNA, 64 nt, hsa
cagcagggaugcccuggagguggcugagccccugucuagagagggaggcaagcccuguugacac

SEQ ID NO: 54070 - RNA, 64 nt, hsa
cucauuucucucaagagauuggacaagcuaaaauucuagagaguucaaaaguguuugaaaguac

SEQ ID NO: 54071 - RNA, 64 nt, hsa
cgauuaugauugucucuguccuugccacaguuuuucuagagacaauggagagagaaagagagag

SEQ ID NO: 54072 - RNA, 64 nt, hsa
uuuuaacuugcugguuaaaacauuuuagaaauauucuagagaugggcaggagagucaaagggcu

SEQ ID NO: 54073 - RNA, 64 nt, hsa
auguuuuuagaagcaagagcaaaauuaugaaaccucuagagauuugggucauguuacuccauuu

SEQ ID NO: 54074 - RNA, 64 nt, hsa
aaugucacuugcuacagacaauagugcaugagagucuagagaaguagugaccagaacagggcag

SEQ ID NO: 54075 - RNA, 64 nt, hsa
ggauauuaggguaaguggcuaauuauaaaucuacucuagagacauauaaucauacagauuauuc

SEQ ID NO: 54076 - RNA, 64 nt, hsa
uuuugaaaacugaagcuaagagagauaauaaauaucuagagauaacuauuaacaguauucuuuc

SEQ ID NO: 54077 - RNA, 64 nt, hsa
ggggaauggucaccagugagccauauuuauuauuucuagagaaaucacgaacugcuuucuguaa

SEQ ID NO: 54078 - RNA, 64 nt, hsa
cucuuacaugauuucuaggccccaugacccagugucuagagacauuaauucuaaccaguuguuu

SEQ ID NO: 54079 - RNA, 64 nt, hsa
uuucacacuggagugaaugaaguuguacuucauuucuagagaaaaguuauacccagguccccaa

SEQ ID NO: 54080 - RNA, 64 nt, hsa
guguguguguaguuuauccucucucucaucuuuaucuagagauugacugauaccucauucuguu

SEQ ID NO: 54081 - RNA, 64 nt, hsa
gucaaaucaacuaauugauuccuugugaccuaauucuagagaaugggaagaaggccuguuauuu

SEQ ID NO: 54082 - RNA, 64 nt, hsa
aaguuugauauuaaaggaguuaagaguagcaaguucuagagaagaggcuggugcuguggccagg

SEQ ID NO: 54083 - RNA, 64 nt, hsa
ccauguauauuaucacuauauuuaauaaucacagucuagagauguucaugguaaaaguacugcc

SEQ ID NO: 54084 - RNA, 64 nt, hsa
aguucuguaauucuaaguguuguucuagauuuccucuagagaagguuauuagaaucuccauugc

SEQ ID NO: 54085 - RNA, 64 nt, hsa
uaaccaauuugaugaauacccaguucucuucuuuucuagagaaagauaguugcaaccucaccuc

SEQ ID NO: 54086 - RNA, 64 nt, hsa
ugucauuguuuccagagaaggagaaaauggacagucuagagacucuggagcuggauaacuaaaa

SEQ ID NO: 54087 - RNA, 53 nt, hsa
ccguucccuccuccauauaaucuucuagagaucuuaaccaguuucuaucccuu

SEQ ID NO: 54088 - RNA, 64 nt, hsa
ggauuuuugugaugaaaggggauuuuuugaaaaaucuagagaaguagcauauggaaaacuauaa

SEQ ID NO: 54089 - RNA, 64 nt, hsa
uuuccaaauuauugcuucaaccaucagucauaacucuagagaaaaacuucaucuucaucucgga

SEQ ID NO: 54090 - RNA, 64 nt, hsa
guuacuuaaguuuguaagacagugcccugagaccucuagagaaaagauguuuguuuacauaaga

SEQ ID NO: 54091 - RNA, 64 nt, hsa
uggaaagaaaauuaaaaugugucaauaaauauuuucuagagaguaaugauuugucucugccuac

SEQ ID NO: 54092 - RNA, 64 nt, hsa
gagaaagguauuucaagaucuaguccaaucuuuuucuagagaaaaagauaaucugaagcucaca

SEQ ID NO: 54093 - RNA, 64 nt, hsa
cuagcaaguuuccaggugaugcuguuguugcuggucuagagacuauuuugagaaccacugucca

SEQ ID NO: 54094 - RNA, 64 nt, hsa
uucuucucagcuaacaggcauauaaggaaaaccaucuagagaguuuucuuuagaagugacuccc

SEQ ID NO: 54095 - RNA, 64 nt, hsa
agggagaauggagcaggaggaaaagcagaguuggucuagagaggaggagggcggggcuggagga

SEQ ID NO: 54096 - RNA, 64 nt, hsa
cggcacagccugacucacaccccgcggcaggacuucuagagaagcccaggaucugucccgugcc

SEQ ID NO: 54097 - RNA, 64 nt, hsa
gcaccaccauaccuggcugauuuuuaaaauuuuuucuagagaugaggucucacuauguugccca

SEQ ID NO: 54098 - RNA, 64 nt, hsa
uaucagcuuucuuguaauaaccuuuuauuacuguucuagagacuacacuaccgacagugugggc

SEQ ID NO: 54099 - RNA, 64 nt, hsa
ugugugcacccacccacccaccacacuggacuuuucuagagauggacagcuugguuaccuccac

SEQ ID NO: 54100 - RNA, 64 nt, hsa
uauuacaggugauucguuggaaaaauucauugucucuagagauugucagcuugguccacaucac

SEQ ID NO: 54101 - RNA, 64 nt, hsa
gcgacuguguuaagagagagcagugacucucucuucuagagaagagguuuucaauaacagggcu

SEQ ID NO: 54102 - RNA, 64 nt, hsa
ggauuguguuagaggaaucggcucuguauuugccucuagagaaacacaguguucucuuuguauu

SEQ ID NO: 54103 - RNA, 64 nt, hsa
uuuucuuuuuugaaauucccugaaaugauguuauucuagagaacuucuaugucagguuccuuug

SEQ ID NO: 54104 - RNA, 64 nt, hsa
auuauagcuucuaccaagagaaacacucaauuuuucuagagauuugccucuaucuuccuuuccu

SEQ ID NO: 54105 - RNA, 64 nt, hsa
aauauaauuuuuuccuguacuggauggcuaggauucuagagaauugauuauaaaauauuuucaa

SEQ ID NO: 54106 - RNA, 64 nt, hsa
ucuauuuaacuccucagagacaugcacaaacuauucuagagaggcuugugccuacgaagauuac

SEQ ID NO: 54107 - RNA, 64 nt, hsa
gcugcucucccaaggguuuuauuuuauuucugaaucuagagaacaguauugggcaggaggaaaa

SEQ ID NO: 54108 - RNA, 64 nt, hsa
aauugcauaggagugugggaugugguuucugccuucuagagagagaucagaauuaaacuaguac

SEQ ID NO: 54109 - RNA, 64 nt, hsa
gugucccgucauuucuagaaacagaauggucucuucuagagagcuuggauaaggaccuugcugg

SEQ ID NO: 54110 - RNA, 64 nt, hsa
gcggggggagggcugggacuguuucguuucugcuucuagagauugaggugaaagcuucguccga

SEQ ID NO: 54111 - RNA, 64 nt, hsa
guauccuugaggaauauagugggucaguuaaauaucuagagacauacaaacaucugcuaauuca

SEQ ID NO: 54112 - RNA, 64 nt, hsa
ggagaaccguagagcgcaggaacggguggguaauucuagagacaaaagccaauuaaaguccauu

SEQ ID NO: 54113 - RNA, 64 nt, hsa
uauaauaaccuugcucaccaagcuguuccacuucucuagagaacaugcccucagcuaagccccc

SEQ ID NO: 54114 - RNA, 64 nt, hsa
ugcuauagaagcaaagaggacuaaagggcaaaauucuagagagugguaaaucucagaaagcaca

SEQ ID NO: 54115 - RNA, 64 nt, hsa
caggccacuuugccucuaaauuaccucugauaauucuagagauuuuaccauauuucuaaacuuu

SEQ ID NO: 54116 - RNA, 64 nt, hsa
gaaugagagcaguggacacaucucagcaggucggucuagagaguugcgaaucuaaaccugggac

SEQ ID NO: 54117 - RNA, 64 nt, hsa
guaacugguuucuaagaguuuagccacaguagcuucuagagauaggaaauuagauuuagugggu

SEQ ID NO: 54118 - RNA, 64 nt, hsa
caugaaaauucagaauuuuauacuuucccuacccucuagagaaauaagaucuuuuuugucaguu

SEQ ID NO: 54119 - RNA, 64 nt, hsa
cuauugauugcuucuucuauagccuuguagaguuucuagagagauguauuuaugagggugauaa

SEQ ID NO: 54120 - RNA, 64 nt, hsa
uccuuuuuuauugauugggccugaauacaggcuuucuagagaucuuuuucauuaauacuuuuaa

SEQ ID NO: 54121 - RNA, 64 nt, hsa
cuugggaaaugcuucagaacaccagucuguuccuucuagagaauuuguuuuuguguucuaugua

SEQ ID NO: 54122 - RNA, 64 nt, hsa
cuugcaaacagaauucauaacacuuggcacuuguucuagagaaguguagaggaugauguuuaca

SEQ ID NO: 54123 - RNA, 64 nt, hsa
uggguugggguaguggguggggaggugaauguuuucuagagauucaaacugcuccagcaauuuc

SEQ ID NO: 54124 - RNA, 64 nt, hsa
auacuaagaaagcaauuccaaauagauguauacaucuagagagagugguauuagagauucagug

SEQ ID NO: 54125 - RNA, 64 nt, hsa
acagcagaaauacuuuuaaauuuuuccuucaugcucuagagaaaauaauuuuauuuuuaaauaa

SEQ ID NO: 54126 - RNA, 64 nt, hsa
gagaccccagcaacuggcccaggaugcaggcugcucuagagaccaaaggaacaccaggcccagc

SEQ ID NO: 54127 - RNA, 64 nt, hsa
guaucuucucacauucuguauacuguauccauuuucuagagaacccaguagcuuuuauacaguc

SEQ ID NO: 54128 - RNA, 64 nt, hsa
ccagaauuuucuaccuaaggaccagaauuuuuuaucuagagaccagcauguucuccccaaagac

SEQ ID NO: 54129 - RNA, 64 nt, hsa
ccagaauuuucuaccuaaggaccagaauuuuuugucuagagaccagcauguucuccccaaagac

SEQ ID NO: 54130 - RNA, 64 nt, hsa
ccaggauuuucuaccuaaagaccaggacuuuuuaucuagagaccagcauguucuccccaaagac

SEQ ID NO: 54131 - RNA, 64 nt, hsa
ccaaggacguuaaaggcauuuuauuccagcgucuucuagagagcuuaguguauacagaugaggg

SEQ ID NO: 54132 - RNA, 64 nt, hsa
gggcuucaugaggccccuuuugaggcucucaaguucuagagagcugccugugggacagcccagg

SEQ ID NO: 54133 - RNA, 64 nt, hsa
aucucugucucaaggagagcaggguaggugaaagucuagagaaagaggcuaccugcccaggguc

SEQ ID NO: 54134 - RNA, 64 nt, hsa
agugcaauagugcaacaucucugaauccuuuuaaucuagagaaggcauuucauauuugggggcu

SEQ ID NO: 54135 - RNA, 64 nt, hsa
cuccggaugggcuguugugauaccacuuaaaaucucuagagaacuacugaacaccuaaagauuu

SEQ ID NO: 54136 - RNA, 64 nt, hsa
auaaaagauuuguacuguuuagaugggagaaaccucuagagagaguaaaaaugaauuacacugu

SEQ ID NO: 54137 - RNA, 64 nt, hsa
caugucauuuaucaacguccuuagaaagaauucuucuagagaaaaagggaucuaggaaugcuga

SEQ ID NO: 54138 - RNA, 64 nt, hsa
cggagcccccucucagccuuaccugggccccuccucuagagaagagcucaacucucucccaacc

SEQ ID NO: 54139 - RNA, 64 nt, hsa
acguaccuuaauccaaucuuuauaaaagaggcagucuagagaacuaggacugcucagccuuauc

SEQ ID NO: 54140 - RNA, 64 nt, hsa
auaauucuuacuaacacagauuaggguauaggcaucuagagaugcacuguccacuguaaauacu

SEQ ID NO: 54141 - RNA, 64 nt, hsa
gaaaauggggagguuagcucagagcagaguagucucuagagaaaggaagaauccucaacggcac

SEQ ID NO: 54142 - RNA, 64 nt, hsa
uauaguuauuguuuguuuuuaagaaaagcucaguucuagagacauacuauuacuuuaggacugu

SEQ ID NO: 54143 - RNA, 64 nt, hsa
ugccuucccuuuguuccuuauuuucuguuuuuucucuagagagguacaguuguaagucagaguu

SEQ ID NO: 54144 - RNA, 64 nt, hsa
ggucccuggugccaaaaauguuggggaccacugcucuagagagaggucaugauaucauaccaac

SEQ ID NO: 54145 - RNA, 64 nt, hsa
ucuucuucaagccauuauuuuaacucaagaaaacucuagagaagaaaagugaagaagucauguu

SEQ ID NO: 54146 - RNA, 64 nt, hsa
cuuuuuugguuucuuggcuuuccgaaggccaugaucuagagauagaaaaaucccuacuaagucc

SEQ ID NO: 54147 - RNA, 64 nt, hsa
ucuuaagucagcugguucauaacauaggccaaauucuagagauguuuauagagcauuugaagug

SEQ ID NO: 54148 - RNA, 64 nt, hsa
cuuauaaagcacaaagcauacauuuccugacuggucuagagaacugauguuucaauuuaccccu

SEQ ID NO: 54149 - RNA, 52 nt, hsa
aagagaacauagaugaguaaagucuagagaggacauugcaccuuugcugcug

SEQ ID NO: 54150 - RNA, 64 nt, hsa
ggaaugcugguuuugaagagcaaaggacagguagucuagagagggucgucuggccugcuugcug

SEQ ID NO: 54151 - RNA, 64 nt, hsa
ccauuuucugcucugcuccccccugaggcugucuucuagagacugggguuucuucauagguuug

SEQ ID NO: 54152 - RNA, 64 nt, hsa
uauguuuuauuagcauuuucaagaagacggauuaucuagagaauaaucauauauaugcauacgu

SEQ ID NO: 54153 - RNA, 64 nt, hsa
uuguauaucuuuucuauuuauugacuucucauguucuagagaguaggacuuuuauuccguguac

SEQ ID NO: 54154 - RNA, 64 nt, hsa
cuuuccuucagcuaucuguggggaccuuguuuauucuagagagaauucuuacucaaauuuuucg

SEQ ID NO: 54155 - RNA, 64 nt, hsa
auuucuauuuuuuuuuucuuauaaguucguugugucuagagauuguuaauauuguaauuuaaug

SEQ ID NO: 54156 - RNA, 64 nt, hsa
cugaacuaugcguacugcauagcaucaagucuucucuagagaccucuguaguccugggaggccu

SEQ ID NO: 54157 - RNA, 64 nt, hsa
ucucgggggaggaagcccagaaaauuggguauguucuagagauuuaccaccauugcuuauugcu

SEQ ID NO: 54158 - RNA, 64 nt, hsa
auauuugcuuauuuaagguacauuucuuuggguuucuagagacgccccuaagucaccugcuuca

SEQ ID NO: 54159 - RNA, 64 nt, hsa
auaaguaaccauugaacauuaauuugauaauaggucuagagacucuaaaaacuaaccaaacuug

SEQ ID NO: 54160 - RNA, 64 nt, hsa
gucacuuacuuaauuccuguccuucaguguuccaucuagagaauuaagagauaugauguauaaa

SEQ ID NO: 54161 - RNA, 64 nt, hsa
guaccuucaaguucuugauuuuuaaaauuccaacucuagagaaaaccaauauaugguggugcug

SEQ ID NO: 54162 - RNA, 64 nt, hsa
gcuugucagcacuuccaguuuagaacgcaauguuucuagagacauauuggcuguuuguuuugau

SEQ ID NO: 54163 - RNA, 64 nt, hsa
ggaccaagauguacauaagacaaagcuacugccuucuagagacaaccggcagugaccucacuga

SEQ ID NO: 54164 - RNA, 64 nt, hsa
uuaaugauagcaguagucauagacuuaagacuauucuagagaucuucaucuccauaagacuuuu

SEQ ID NO: 54165 - RNA, 64 nt, hsa
cuuucuccccagagagcuugaccaaguuacauauucuagagaucguccugagugccaagcacgu

SEQ ID NO: 54166 - RNA, 64 nt, hsa
uuggauuaaaauauuucauccagauuuguuuacaucuagagagaaccccuuguagguuauaagg

SEQ ID NO: 54167 - RNA, 64 nt, hsa
aacaaauagguuggcauagucuuaagucuuugagucuagagagauuugaguuuuguuuugccug

SEQ ID NO: 54168 - RNA, 64 nt, hsa
cacacuucaaccccagcuugcuggucggcuuuccucuagagagagccgguuuuggggccauuuc

SEQ ID NO: 54169 - RNA, 64 nt, hsa
uggcugugagaagaaaccugcuuuugaucauuuuucuagagaucugggugugaauccuuuuuug

SEQ ID NO: 54170 - RNA, 64 nt, hsa
guguagggucacugggagagcagaggucacagccucuagagaagggagaggggcgugugcaugg

SEQ ID NO: 54171 - RNA, 64 nt, hsa
gcugcagggacccguuuggacccacagccucuguucuagagaugcuuguauaggcuguuaauug

SEQ ID NO: 54172 - RNA, 64 nt, hsa
uguagcauuuacauuuauuagguauuauaaguaaucuagagauuauuuaauuaaaauauacagg

SEQ ID NO: 54173 - RNA, 64 nt, hsa
uaccccucaguuuuccuuaaaacgcgcacacaacucuagagaguguuaagaauaauguuacuug

SEQ ID NO: 54174 - RNA, 64 nt, hsa
caaaaguugcugaaagaugcugugccuaugggguucuagagaguguugagugugguacauuaac

SEQ ID NO: 54175 - RNA, 64 nt, hsa
ugccucccuggaauguuccagagacggaacauucucuagagacaacagucugugcugcagauug

SEQ ID NO: 54176 - RNA, 64 nt, hsa
acacauauauuuuugaggcugggugacgagaaaaucuagagacaugagggacauaaaugggccu

SEQ ID NO: 54177 - RNA, 64 nt, hsa
gagguguccgcugacggguggccucucaccccccucuagagaaaccugacauuuacaauggauu

SEQ ID NO: 54178 - RNA, 64 nt, hsa
cagcaccuuagggccaggggcuuaccuuucaaccucuagagagaccagcugccuuugagaccag

SEQ ID NO: 54179 - RNA, 64 nt, hsa
cagccgaugugguaggugauaaagaggcaucuuuucuagagacacauuggaccagaugaggauc

SEQ ID NO: 54180 - RNA, 64 nt, hsa
agaggaggaccccugccuuccucugaggacaggcucuagagagagggagaaacaaguggaccuc

SEQ ID NO: 54181 - RNA, 64 nt, hsa
uucuuuauauauauuuuuuguugcaaagugucucucuagagaaacucuauauauuauucgaauu

SEQ ID NO: 54182 - RNA, 64 nt, hsa
aaauuguacuuccaggcuuggauguaauuuuugcucuagagagaagcaaguggugggaaggagg

SEQ ID NO: 54183 - RNA, 64 nt, hsa
agagaggcauagcaaaguggggguugcuaccauuucuagagagagaggacacagucccggccug

SEQ ID NO: 54184 - RNA, 64 nt, hsa
ggccuuauuuugcaauuaugggaguaaacaauagucuagagaagcauuugguaagcuuuaucau

SEQ ID NO: 54185 - RNA, 64 nt, hsa
agcacccacauccccuuucuugacaaaugauuuuucuagagaacuauguucuucccugacuuua

SEQ ID NO: 54186 - RNA, 64 nt, hsa
ggucagagcuaaauggcuccuuaaggaugaacucucuagagaagcaccuuccuccuacaggagg

SEQ ID NO: 54187 - RNA, 64 nt, hsa
cccaccacugggcagaggcuggacagcacggacuucuagagagagccgcguugccaguuccucu

SEQ ID NO: 54188 - RNA, 64 nt, hsa
auguuuuaguuugcuucaccuaaaauaaugcugaucuagagauagagaaauaggggugguuauu

SEQ ID NO: 54189 - RNA, 64 nt, hsa
aaacagggaugucacuuugaggggcagaugaaagucuagagaacuguuccuuaauagcauugua

SEQ ID NO: 54190 - RNA, 64 nt, hsa
uuucaaauugguuuuucuacuaguagauuguguuucuagagaaagauacaaggcauaggugauu

SEQ ID NO: 54191 - RNA, 64 nt, hsa
cuaacuccccuucaucuguaacugugcuaaucuaucuagagaccucaaacacugcuaaaggccu

SEQ ID NO: 54192 - RNA, 64 nt, hsa
gacgauuuggcugucuaggcgucauuuggcaaugucuagagacauuuuugguaguuagaauggg

SEQ ID NO: 54193 - RNA, 64 nt, hsa
uucugucagugccuuuuuuaauacaugaaagaauucuagagagaagccauauacauguaaguaa

SEQ ID NO: 54194 - RNA, 64 nt, hsa
ggaccuacauuaucuggacuguaugcuggucauuucuagagacagcaaucaauauuugagugua

SEQ ID NO: 54195 - RNA, 64 nt, hsa
gauucacuacaagguccaaguacuugggaagcuuucuagagauuacuuguacuuucuaaucugc

SEQ ID NO: 54196 - RNA, 64 nt, hsa
uauaucauuggcuuucuuuaguucuugauacauuucuagagaauuucuaagcgaacugccagaa

SEQ ID NO: 54197 - RNA, 64 nt, hsa
gucagccucacccacaccgugugccuuacuccugucuagagaccccaccucugugaacuuauuu

SEQ ID NO: 54198 - RNA, 64 nt, hsa
gagcccagagauccuacuagacugggucagcaauucuagagaaccuuccggaauagucugggaa

SEQ ID NO: 54199 - RNA, 64 nt, hsa
ugaagaccugagcaggguuuugccaacagcuuguucuagagaagguuucccuuuuucugggaca

SEQ ID NO: 54200 - RNA, 64 nt, hsa
uguguuucuggagugauucuagagggagacuuguucuagagaggaccagguuugaugccuguga

SEQ ID NO: 54201 - RNA, 64 nt, hsa
uuuccagagacccagcuacaguucccuggcuguuucuagagacccagcuuuauucaccugacug

SEQ ID NO: 54202 - RNA, 64 nt, hsa
uauuuuuaauauagagaggaagauugaauauuuaucuagagaauacaaagacccacauguaaau

SEQ ID NO: 54203 - RNA, 64 nt, hsa
uuuuugcuuuaacaacuauaaauauucuuagcugucuagagaaaagauguauguuauuuugaaa

SEQ ID NO: 54204 - RNA, 64 nt, hsa
cagaguuuucucaaccuuugcuaugguuauucugucuagagacccugagccaacuuucaaauug

SEQ ID NO: 54205 - RNA, 64 nt, hsa
guuacacuuucuuaaaauuugauuugucauauuuucuagagaaacuugaauuuaauuguguuau

SEQ ID NO: 54206 - RNA, 64 nt, hsa
aggaaggcagacacccacaagaagaugacugaguucuagagaccccacaagcacuauggacgaa

SEQ ID NO: 54207 - RNA, 64 nt, hsa
cucucuggucuuccuccccacuucuucccugccuucuagagaaagagccuggagacaaugguga

SEQ ID NO: 54208 - RNA, 64 nt, hsa
cuuggagacacagaggguuucaccuuggaugaccucuagagaaauugcccaagaagcccaccuu

SEQ ID NO: 54209 - RNA, 64 nt, hsa
agcgagagcauguccaucuguuggacagcacuauucuagagaacuaaacuggcuuaacgaguca

SEQ ID NO: 54210 - RNA, 64 nt, hsa
ugaauuggaugaugacuauauugaggauaaaauuucuagagaagaaacaauacaugcuugcuau

SEQ ID NO: 54211 - RNA, 64 nt, hsa
ugguuggagacuguuaacacugagcucauugacuucuagagauuuuauuuuuacugguugaucu

SEQ ID NO: 54212 - RNA, 64 nt, hsa
uguuuccagagcaaaguaacagagaccagguuuuucuagagagcuaagugggauguguagcuca

SEQ ID NO: 54213 - RNA, 64 nt, hsa
gaguaaagcagcuuauguugucaggucguucuuaucuagagaagagcuauagcagaucucggac

SEQ ID NO: 54214 - RNA, 64 nt, hsa
aaaaaaauacagagucauccccuacccccaccccucuagagacccuccagcuaaaaacagagcc

SEQ ID NO: 54215 - RNA, 64 nt, hsa
gggccaugaacuuuguccgguggaaggccuucuuucuagagagggaauucucuuggcuggcuuc

SEQ ID NO: 54216 - RNA, 64 nt, hsa
ggccgucuccauuuuaugguugaggaaacugaggucuagagaggucaagauuacuugcccagaa

SEQ ID NO: 54217 - RNA, 64 nt, hsa
uuugccugaaguaacagcaucuucuacuucuccaucuagagauuuuugugugugugccaucaag

SEQ ID NO: 54218 - RNA, 64 nt, hsa
uuuguaguuaaaggguccaguucugacuggagccucuagagagcugggcuuguauguucuuuug

SEQ ID NO: 54219 - RNA, 64 nt, hsa
uccugccugaucauuucauugguggcugaaggauucuagagaaccuuuuguucuugcaaggaaa

SEQ ID NO: 54220 - RNA, 64 nt, hsa
ccucugggugcacccccugccuaccacccucccuucuagagagcacaucgccugaccggggaga

SEQ ID NO: 54221 - RNA, 64 nt, hsa
aaauuuucaaugagcuuuuucuaacuucucaaguucuagagaaagaauuaaccaacugaugacu

SEQ ID NO: 54222 - RNA, 64 nt, hsa
uggauugugagugaaugggcccuuugagcugcccucuagagagcaaauccaguuuccuggagcu

SEQ ID NO: 54223 - RNA, 64 nt, hsa
gggcuugcucuaaaucguuuagaggauaacaggaucuagagaugcucucugcuugacaacaaaa

SEQ ID NO: 54224 - RNA, 64 nt, hsa
ggcugaagccucagauuccuucuaaacacagcuaucuagagagccacauccuguugacugaaag

SEQ ID NO: 54225 - RNA, 64 nt, hsa
cucuauccucuguuucuuuaauuugcuaguuaugucuagagacuugaugagauugaaacauggc

SEQ ID NO: 54226 - RNA, 64 nt, hsa
uccauuacaccacagcauuguguggaauuugaggucuagagagaaccaauaaaagugguaauug

SEQ ID NO: 54227 - RNA, 64 nt, hsa
aaaauugcggcaggaugcaugucugucuguucuaucuagagaucacccauauaccuauauaugu

SEQ ID NO: 54228 - RNA, 64 nt, hsa
uuuugauuauaguuaauccuucuaucuugaaucuucuagagaguugcugaccaacugacguaug

SEQ ID NO: 54229 - RNA, 64 nt, hsa
caaaacagugacacucacuuguguguauauaaacucuagagacaucuuaggcccucccuucauc

SEQ ID NO: 54230 - RNA, 64 nt, hsa
accuuuguucugccuuggucuuaagagaguuguuucuagagaaacaaguuuuaugguucuguuu

SEQ ID NO: 54231 - RNA, 64 nt, hsa
cgcccgcuccgagagccacacagauuugacuuucucuagagagcugacuaaugaugaacggaag

SEQ ID NO: 54232 - RNA, 64 nt, hsa
ggaugacaggccuccgcuggaaaugcaaagugauucuagagagugaaguaauugcagaagcagu

SEQ ID NO: 54233 - RNA, 64 nt, hsa
aaaggaaucaaauaauucaucaugauuuaaauuuucuagagauuuugauuuuuuuauaauguuu

SEQ ID NO: 54234 - RNA, 64 nt, hsa
gcaaaaauaagucaggagcagcgaaaaugggacuucuagagagcucucuugccccacgccgcug

SEQ ID NO: 54235 - RNA, 64 nt, hsa
ccacccugaacaacgagccuuuucacccuucuacucuagagaaguggacuggaggagcugggcc

SEQ ID NO: 54236 - RNA, 64 nt, hsa
ggugugaccucucugugccuuacugaggcaccuuucuagagauuaaaaggggcuugauggcugu

SEQ ID NO: 54237 - RNA, 64 nt, hsa
aagcuggacagucacccaggcccaaccuuccccaaugcacgaguccucucucucuccuuguccc

SEQ ID NO: 54238 - RNA, 64 nt, hsa
cuuauauuagagucagagacuaaugguggcuuaaaugcacgaaugucuuuuuuuuuaaaacugu

SEQ ID NO: 54239 - RNA, 64 nt, hsa
ccuuccuuugguugccauauggaauggccauggaaugcacgaagucacaaugcaccauccauga

SEQ ID NO: 54240 - RNA, 64 nt, hsa
cagaaacccguaggcacggacacacccagucucaaugcacgaaguuggagaaccugacagggcu

SEQ ID NO: 54241 - RNA, 64 nt, hsa
ugaaugugaagucaagucugagcacaaaaagauaaugcacgaugagauugccuaccauuuuaua

SEQ ID NO: 54242 - RNA, 64 nt, hsa
aucugggcugguacaggccucagccuugcccucaaugcacgaaagguggcccaggagagaggau

SEQ ID NO: 54243 - RNA, 64 nt, hsa
acugggcaccuucccggagcggacacugacucccaugcacgauuuuuuggaaucuuccuccuga

SEQ ID NO: 54244 - RNA, 64 nt, hsa
uugaaguugaggaaauaucauugauauuucuaucaugcacgauuauuuuagauuucuaccaccg

SEQ ID NO: 54245 - RNA, 64 nt, hsa
ugaaaacugaaucaagaaaugaaugcuccaugaaaugcacgaagucuguuuuaaugacaaggug

SEQ ID NO: 54246 - RNA, 64 nt, hsa
ccggaagcuggaccucacggagaugaaacggaagaugcacgaggauaugaucuccauacagaac

SEQ ID NO: 54247 - RNA, 64 nt, hsa
aggugcuggugccaaccucugguggccguaccugaugcacgaacaccccgccuaccuguacucg

SEQ ID NO: 54248 - RNA, 64 nt, hsa
uuuguacuguaauuuugaauggaacugaaaaauuaugcacgaauaaaguacuuuucucaugcca

SEQ ID NO: 54249 - RNA, 64 nt, hsa
aaucagcugccaauaauaucuaauauuuuucaucaugcacgaauuaauaaucaucauacucuag

SEQ ID NO: 54250 - RNA, 64 nt, hsa
ucugcagccuuucccaugcucugcccccugucucaugcacgaguggugcggggugcugggagcg

SEQ ID NO: 54251 - RNA, 64 nt, hsa
uauaguugaaguacaaauuaauaggccuuaugauaugcacgaauuuuacuauagauaauauaug

SEQ ID NO: 54252 - RNA, 64 nt, hsa
auuccaaggcaaaucuaaauggguguaguuguauaugcacgauguaauuuaaugcuaaagagua

SEQ ID NO: 54253 - RNA, 64 nt, hsa
agcacuagugcuuuuaugugcaauggugucguccaugcacgacagcagcaaacauucuggggcu

SEQ ID NO: 54254 - RNA, 64 nt, hsa
aaccuugacucuaaaauucugugcugugcgaaacaugcacgauuuuuauuaugcuuacugcgua

SEQ ID NO: 54255 - RNA, 64 nt, hsa
gggggcuggguuaacguuuucucagggaaccacaaugcacgaaagaggaacugggguugcuaac

SEQ ID NO: 54256 - RNA, 64 nt, hsa
uacaagccacuggagaccccuuuuuucugauacaaugcacgauucucugcgcgcaaggacccuc

SEQ ID NO: 54257 - RNA, 64 nt, hsa
caauuuugggucaugaaaguuugcaauauaguaaaugcacgauugacuguugcuuugugccuca

SEQ ID NO: 54258 - RNA, 64 nt, hsa
ugauagugcaauaaucagugaucuauagacccucaugcacgauucaaguuucacucuuguggcu

SEQ ID NO: 54259 - RNA, 64 nt, hsa
acccuuaaggucuuuaagggaggaaguguaauagaugcacgacaggcauaaacaagaacaacaa

SEQ ID NO: 54260 - RNA, 64 nt, hsa
ucagcaugggcccaggaaugccaaggagacaucuaugcacgaccuugggaaaugaguugauguc

SEQ ID NO: 54261 - RNA, 64 nt, hsa
guugaaguggguaagcagcaggguaccuuguauaaugcacgacaguugcaguaugggaagaaug

SEQ ID NO: 54262 - RNA, 64 nt, hsa
auuucucuauuuuugaauacuacaucagauuuagaugcacgacuaccuguugacuuguuuuaua

SEQ ID NO: 54263 - RNA, 64 nt, hsa
uggagcgagaauaaaaaguugucucuagauacagaugcacgauuuggccauggauccgacuacu

SEQ ID NO: 54264 - RNA, 64 nt, hsa
agcugagaaaggagacgaugaacguguagcugacaugcacgaaguuuaauuuacucauguccac

SEQ ID NO: 54265 - RNA, 64 nt, hsa
cagaguuucgcuuugucgcccaggcuggagugcaaugcacgaucucaguucacugcaaccucug

SEQ ID NO: 54266 - RNA, 64 nt, hsa
agcccuuuuccccaagagucccaucucuucugccaugcacgacaugaaaauccacuucucuucc

SEQ ID NO: 54267 - RNA, 64 nt, hsa
uuuuuuuuuuuugucaagagccaagacacagguaaugcacgacauugauugcugcauuuuaccu

SEQ ID NO: 54268 - RNA, 64 nt, hsa
auucauucuaaugaaagaaaaugugaccaaagaaaugcacgaaaugugaaguucuuugucacug

SEQ ID NO: 54269 - RNA, 64 nt, hsa
agaaacagagguggcugcugugcuagugccugagaugcacgaugcuggggucaaagacuugugu

SEQ ID NO: 54270 - RNA, 64 nt, hsa
uuuuuuccuauuuuugacgauuggagcccuuaagaugcacgauggaauuguguuuugcguuuuu

SEQ ID NO: 54271 - RNA, 64 nt, hsa
uguuucccgguuauguguagggaacagcagagugaugcacgaacuuugaacauucguuaugggg

SEQ ID NO: 54272 - RNA, 64 nt, hsa
acaguauguaaaugcuauuaaugucgucacucacaugcacgacaguccuuguucccccaggaag

SEQ ID NO: 54273 - RNA, 64 nt, hsa
ggagccggccgcccucggucugguguaagcacacaugcacgauuaaagaggagacgccgggacc

SEQ ID NO: 54274 - RNA, 64 nt, hsa
gaacccgucgcuaaacugcacgauccugcaaugaaugcacgauggagugugggggucuggaggg

SEQ ID NO: 54275 - RNA, 64 nt, hsa
guggaggucccgcagaagcuacagcugccaggucaugcacgaagggagcaccguggagaagacg

SEQ ID NO: 54276 - RNA, 64 nt, hsa; identical to SEQ ID NO: 52236

SEQ ID NO: 54277 - RNA, 64 nt, hsa; identical to SEQ ID NO: 52237

SEQ ID NO: 54278 - RNA, 64 nt, hsa; identical to SEQ ID NO: 52238

SEQ ID NO: 54279 - RNA, 64 nt, hsa; identical to SEQ ID NO: 52239

SEQ ID NO: 54280 - RNA, 64 nt, hsa; identical to SEQ ID NO: 52240

SEQ ID NO: 54281 - RNA, 64 nt, hsa; identical to SEQ ID NO: 52241

SEQ ID NO: 54282 - RNA, 64 nt, hsa; identical to SEQ ID NO: 52242

SEQ ID NO: 54283 - RNA, 64 nt, hsa; identical to SEQ ID NO: 52243

SEQ ID NO: 54284 - RNA, 64 nt, hsa; identical to SEQ ID NO: 52244

SEQ ID NO: 54285 - RNA, 64 nt, hsa; identical to SEQ ID NO: 52245

SEQ ID NO: 54286 - RNA, 64 nt, hsa; identical to SEQ ID NO: 52246

SEQ ID NO: 54287 - RNA, 64 nt, hsa; identical to SEQ ID NO: 52247

SEQ ID NO: 54288 - RNA, 64 nt, hsa; identical to SEQ ID NO: 52248

SEQ ID NO: 54289 - RNA, 64 nt, hsa; identical to SEQ ID NO: 52249

SEQ ID NO: 54290 - RNA, 64 nt, hsa; identical to SEQ ID NO: 52250

SEQ ID NO: 54291 - RNA, 64 nt, hsa; identical to SEQ ID NO: 52251

SEQ ID NO: 54292 - RNA, 64 nt, hsa; identical to SEQ ID NO: 52252

SEQ ID NO: 54293 - RNA, 64 nt, hsa; identical to SEQ ID NO: 52253

SEQ ID NO: 54294 - RNA, 64 nt, hsa; identical to SEQ ID NO: 52254

SEQ ID NO: 54295 - RNA, 64 nt, hsa; identical to SEQ ID NO: 52255

SEQ ID NO: 54296 - RNA, 64 nt, hsa
uaccuggugauaaguuccaaauauguuaagggcuuuaauacaaaaagcaaaaauugucaguguu

SEQ ID NO: 54297 - RNA, 64 nt, hsa
uccugguaggcuuacaaguguuuacuauaugcuauuaauacauuauacuuuauaacuaauagau

SEQ ID NO: 54298 - RNA, 64 nt, hsa
uauaauuuaugucauuuuauagcagcaguaucuauuaauacaugccuuuuccucccauccaccu

SEQ ID NO: 54299 - RNA, 64 nt, hsa
gucagauaccaugaaugccagucaucaguaaaucuuaauacacuuuugcuuuauucucacaugc

SEQ ID NO: 54300 - RNA, 64 nt, hsa
uuaccucaugauuucuuuuggucaaucaggaucuuuaauacaauauagaaauuguguaauaguu

SEQ ID NO: 54301 - RNA, 64 nt, hsa
caauauagaaauuguguaauaguuauuauaaauguuaauacacaacuuucagguaauuuuaacu

SEQ ID NO: 54302 - RNA, 64 nt, hsa
ugcguuuaaucauugucucuucauuuuaagacuuuuaauacaaaugucauuuuuaaagaaacaa

SEQ ID NO: 54303 - RNA, 64 nt, hsa
auuguuuguguuucuguguuucauauucagugauuuaauacaguaucauggcugagguggaugg

SEQ ID NO: 54304 - RNA, 64 nt, hsa
uuuucuuuauauaauauugucauaugucauaguuuuaauacaauucacaugauuucuauguuuc

SEQ ID NO: 54305 - RNA, 64 nt, hsa
uagagacauuggugucauuauaugaagcuugcauuuaauacauuuauacauaauacauuuguac

SEQ ID NO: 54306 - RNA, 64 nt, hsa
guuauuucaucuuuuauucaaggaaguuuuaacuuuaauacagcucaguaaauggcuucuucua

SEQ ID NO: 54307 - RNA, 64 nt, hsa
caauuagaucuaaacaguuauuucuguuuccuauuuaauacagcugaagucaaaauauguaaga

SEQ ID NO: 54308 - RNA, 64 nt, hsa
aaugcuuagauuaaaaaaaaaaaauuacguaggauuaauacagaaauuuaaucaugucugauua

SEQ ID NO: 54309 - RNA, 64 nt, hsa
aggagguugguaagagugacuaaccagccuaacuuuaauacacauguauaaagauguucacaga

SEQ ID NO: 54310 - RNA, 64 nt, hsa
gccauuucucagagaaugaucaggccuuaggaaauuaauacaguaguaguaaucauuuucuagg

SEQ ID NO: 54311 - RNA, 64 nt, hsa
auacauuaagucaucucuagauuauuuauaacacuuaauacaauguaaaugcuauguaguuguu

SEQ ID NO: 54312 - RNA, 64 nt, hsa
uuacaacuaagcuggccccagccuugucuugauauuaauacaugaaauuuuuauaauugucuca

SEQ ID NO: 54313 - RNA, 64 nt, hsa
gaugaagaagucuuaauacugaaauacugaauuuuuaauacauuauuauuugguauucuguaua

SEQ ID NO: 54314 - RNA, 64 nt, hsa
uucucuuuguaugucuguuaccuuguuaauagacuuaauacaugcaacagaagugacuucugga

SEQ ID NO: 54315 - RNA, 64 nt, hsa
cagaaaccauucuagguguuucaacagagggaguuuaauacaggaaauugacuuacauagauga

SEQ ID NO: 54316 - RNA, 64 nt, hsa
acauaccaugugccacacaccuugacaaaaucuuuuaauacaguuuauuauguacuauucaauc

SEQ ID NO: 54317 - RNA, 64 nt, hsa
ccccccaugccaccggcuccacuuuccccuuuuauuaauacauucacccagauaaucauuaaaa

SEQ ID NO: 54318 - RNA, 64 nt, hsa
ucuauuuuccuuaaucaaaccagcucugggaaauuuaauacauuuauauuaauugagauuauua

SEQ ID NO: 54319 - RNA, 64 nt, hsa
acuuacauagcucaaauauugaauguuuaaaauauuaauacagauggggccucuuuauguuuag

SEQ ID NO: 54320 - RNA, 64 nt, hsa
aagggggaauauuuuaaaaauaaaccagaucaaauuaauacaaucagaagguuucgaaauguaa

SEQ ID NO: 54321 - RNA, 64 nt, hsa
ucuguugcaccacucuaguuuuaguauuucuauuuuaauacauuuguuuaccacuuguuuaugu

SEQ ID NO: 54322 - RNA, 64 nt, hsa
uaaaaacguuuaaaaguuuuaaagagaaauugcauuaauacagauugaaguauuuuauucuuuu

SEQ ID NO: 54323 - RNA, 64 nt, hsa
uuaaagcaauaacuuucauaguuucuuucaaaguuuaauacauccaauaugucaaguuaaacca

SEQ ID NO: 54324 - RNA, 64 nt, hsa
augucaaguuaaaccauucugggauuugcaaaguuuaauacauccaauaugucaaguuaaacca

SEQ ID NO: 54325 - RNA, 64 nt, hsa; identical to SEQ ID NO: 54324

SEQ ID NO: 54326 - RNA, 64 nt, hsa
accggcaccugccagacagagcugguucuaagauuuaauacagugcuuuuuuuccucuuugaaa

SEQ ID NO: 54327 - RNA, 64 nt, hsa
uggaaaagccaccaauucuagaucuugauuugaauuaauacacacaauaucugagacacuuaca

SEQ ID NO: 54328 - RNA, 64 nt, hsa
gagugugcaugaaccaaaggaaauaacauugaagaaggaaaacaauauguagaaaguauuuuag

SEQ ID NO: 54329 - RNA, 64 nt, hsa
uacaucugaauaauuauggaaguugggacauguuaaggaaaacaaauauguucaucaccaacaa

SEQ ID NO: 54330 - RNA, 64 nt, hsa
aauaaacuuuuccagaagcacgagguaguuugcaaaggaaaagucugcacuguuugcucuaaag

SEQ ID NO: 54331 - RNA, 64 nt, hsa
uguuuugcuguauuucaaaauuuuccuucuguuaaaggaaaauauugugaauaaccacuggugu

SEQ ID NO: 54332 - RNA, 64 nt, hsa
aauugcacuuucugguaaaaaguuaaaaauuuuuaaggaaaaaauaauuucaaugguuaaaguu

SEQ ID NO: 54333 - RNA, 64 nt, hsa
guguuuacauuuaaagaucauuugcaccuuuuucaaggaaaaaaaguauugaguaaacaauugu

SEQ ID NO: 54334 - RNA, 64 nt, hsa
gaaaguggcuuucuacuuucaaaaaugaaacaaaaaggaaaaauggcaaaguacuguuuuagcu

SEQ ID NO: 54335 - RNA, 64 nt, hsa
cuguagaaaauguuaaaaauaccaacucacuuggaaggaaaaauaaaaaucacaaagguauauu

SEQ ID NO: 54336 - RNA, 64 nt, hsa
uuguaucgggaauuucucagagcugaguaaaaugaaggaaaagcauguuauguguuuuuaagga

SEQ ID NO: 54337 - RNA, 64 nt, hsa
aguaaaaugaaggaaaagcauguuauguguuuuuaaggaaaaugugcacacauauacauguagg

SEQ ID NO: 54338 - RNA, 64 nt, hsa
aaaaaaaaaaaaaaaggaaaaaggaaaaaaaaaaaaggaaaaccagaagcccugcugucugucu

SEQ ID NO: 54339 - RNA, 64 nt, hsa
uaugcuuucuucuuaaaaaaaaaaaaaaaggaaaaaggaaaaaaaaaaaaggaaaaccagaagc

SEQ ID NO: 54340 - RNA, 64 nt, hsa
caaccucuaugcuuucuucuuaaaaaaaaaaaaaaaggaaaaaggaaaaaaaaaaaaggaaaac

SEQ ID NO: 54341 - RNA, 64 nt, hsa
uguagagagcuguugauuuguuucuguuuuuuuaaaggaaaacuauuuguaagauguugcacua

SEQ ID NO: 54342 - RNA, 64 nt, hsa
acacaaauauguaaagcaauuguaggaaauuugaaaggaaaaaaagaaaccgaagccaguauuu

SEQ ID NO: 54343 - RNA, 64 nt, hsa
uuuuucugaaaguggcugauguaagaacaggcagaaggaaaacccuuuuugucaauaacucugu

SEQ ID NO: 54344 - RNA, 64 nt, hsa
caggcagaacagucauaagccaggaaaugaaacaaaggaaaacaggugccugaauuuccugggg

SEQ ID NO: 54345 - RNA, 64 nt, hsa
ucuuggauuuuuugaaauaaucuucagaggaaggaaggaaaauccuauuuugggguaucagugu

SEQ ID NO: 54346 - RNA, 64 nt, hsa
cuuaguuuaaagggggaaagaaaagggaagaagaaaggaaaagagaaauccaacuccuuuuuca

SEQ ID NO: 54347 - RNA, 64 nt, hsa
caccuuuguauuuucaagaacucuucuauuuauuaaggaaaaugucacauugugauguauuaag

SEQ ID NO: 54348 - RNA, 64 nt, hsa
cagagucugucugcagcuauguggugagcuauguaaggaaaaaaaucugggcuguuagagugaa

SEQ ID NO: 54349 - RNA, 64 nt, hsa
uagagugaaaaaguguguuuuaugucaauugugaaaggaaaauguuaggaguaugguuuuuaaa

SEQ ID NO: 54350 - RNA, 64 nt, hsa
ucaugccacggauaaaugaggcaaauccgaagaaaaggaaaaucgaauaaaaaauagucccaca

SEQ ID NO: 54351 - RNA, 64 nt, hsa
auucauccauacagaauuuggaugacuauguauaaaggaaaacuuaaaucuuaauuauuaucag

SEQ ID NO: 54352 - RNA, 64 nt, hsa
gguuuuaaacgacuuuuguuugcggggcuuuuaaaaggaaaaccgaauuagguccacuucaaug

SEQ ID NO: 54353 - RNA, 64 nt, hsa
cgaauuagguccacuucaauguccaccugugagaaaggaaaaauuuuuuuguuguuuaacuugu

SEQ ID NO: 54354 - RNA, 64 nt, hsa
gaaagucaaaaaaacgaaagagaaggagaagaaaaaggaaaagggcaaauugaaagucaaggag

SEQ ID NO: 54355 - RNA, 64 nt, hsa
agaaaaagcgcaaagaggagaaugaagauccagaaaggaaaauaaagaagaagggcuucggcgc

SEQ ID NO: 54356 - RNA, 64 nt, hsa
uucuuaaaaguguaaagaagccucauaagaucauaaggaaaauguauauaugcuuuucacagcu

SEQ ID NO: 54357 - RNA, 64 nt, hsa
guuaacaaugccaugaaagcauuuucuuucuccuaaggaaaagugaauuucuuaucagaauauc

SEQ ID NO: 54358 - RNA, 64 nt, hsa
uuguauccaaauguagugcaggugaaaagcccagaaggaaaauuucagaagaccaguacuggag

SEQ ID NO: 54359 - RNA, 64 nt, hsa
gagcccauauaugcgguccaugaaacagauuucaaaggaaaagcuuaaagcaaggcggaacaga
